United States Patent 12,376,589 (CHRYSEOBACTERIUM INSECT INHIBITORY MICROBIAL COMPOSITIONS AND METHODS OF MAKING AND USING) - sequence listing, part 3

SEQ ID NO: 77 - DNA, 4653412 bp, Chryseobacterium sp. (residues 1-1,551,138 of 4,653,412)
tctaattcacgattcacttgcgaagcaaaattcacttattgactgtgaaattgtgaatggtcaatcgtcaatacactgcgcttgtcaattcttttatgctataaagaattcacgattcacttgcgaaacaaaattcacttattgagacttctcccctatttctccggcatcactttataagtcgggtcttcctgaatattaatttctactacagcttctgcatttttcagtattttccggcagtcttcactgagatgacgcagatgcaaggttttattctgttgtttgtaacgtctggataacttgtccagtgcatctatagcactcatatctacaatgcggctttctttaaaatccacaaccacttgttcaggatcactcaaaggatcaaatttatctgtaaatgccgttactgacccaaagaacagtggtccgtatatttcgtaaaattttactccattttcatcaatatactttcttgcgcggattcttttggcattatcccaggcaaaaaccaatgcggaaatgattactccaaccaaaacagccaaagccaggttatgtaaaattaccgtaatcaatgctacagtaactccaacgaagatatcagacttcggcattttattcacaatcctgatagatacccattggaatgtactgatggcaaccatcatcatcactccgaccaaagcagccataggaattttctctatcacaggagctccaaccagaatgattatcaaaataagcacagatgccacaattcctgataatcttgctctggaacctgcattcagatttaccaaagtctgtgctaccattgcacagcctcccattccgccaaagaaaccattggtaatattcgccaatccctgtgccactgattctttgttggcgcttccctttgtattggtaatttcatccaccatggatagtgtcagaagagattctataagacctactcctgccataatcaaggcataaggaaaaataatctgtaaagtttccagggaaaaaggaatcttgggaatatgaaaacccggaagattcccactgatatgggcaatatctgcaactgtttttgttggaatattaaatccaagaacaacagcaaatacaatgataatagctacgagagaagcaggaacaacttttgtaattttgggaaagaaataaacgatggcaatcgtcagggcagtcaaacaacccattatatatagaggcatcccttgcaaccagcttacagctccgctgctgtctgttattttaaactgttcaacctgtgccataaaaataataatagctaatccattcagaaacccgtacataacaggctgtgggataagtctcacaaattttcccagcttaaagatccctaccatcatttgaaatatcccggctaatgcaactgtagcaaagagatattctactccatgcgattttatcaaagcaatcaacaccacgatggttgctccggctccaccggaaaccataccgggacgccctcctaaaactgcagtcacaagtcccatcataaaagctgcatacaaacctgtaagaggagacaggccggcaagaatagcaaatgaaagagattcaggaatcatcgtcattgctacagtaaaacctgccagcagttcatttttataattgattttttttgaaaaatcgaataagcttagtgtattcttcattgatatgcaaaggtatgtactgtgcggatggtatacaattttttctttttatgattttatgataaggaagttattgttttaaataattcacacatcagcccttataatatgttaattttaattaaaataaatagataaagtgtaatttttgtatttatgactgtttttacattttatttttgtctacatttgaaagcaaataagcaattatttggtactaattaaagattcaatgtgtataaagctgcttatcaatctatctgcagctttcactcaaagaattgtgtaaaaaccttaataggttatatattatttcacacaaatggcaggaaaaagaagtttgaaaagaagaagaaaaccattgaaaagaatatatcaatacattaaggtaattcctacctacctgttttattgatagttaaaagtcattttctaagatagatagttttattgaatatttttaactattcttcaaacataatttttatttcttataaatttcaaattttcagtaacaatttcctactatataaataatataaatcacctattctcgtttttttatatataagtttaaataaaagaataatattcaagtaaaaatgttatataaagaaatccatattgggaaatttattaaggaaagggttgatgaaattgaaatagcaattgagagaatctgcaagtttttaaacaaagatgaagaaacggttgaaatgatgtatgaaagcagatcaatggatacggatcttcttttaagatggagtaagttgctggaatatgattttttcaggctctacagctcccatttgattttatatgcaccaccctctgccgttaataaaagcaatcaaaagtccgagaaaacaccttatttcaggaaaaatatttatactcaggaaatcaaagacttcattatgaaaaggattctttccggtgaaatgacccaaagcgaggtcattaaagagtattctattcctaaaagtacactgcacagatggcttcagaagagtgataatgtaaacggataaacatataagacatgcgcccaaattacaaaagaatttatcaggatatgctgaagatggaatatcctgaaaagctgaaagatccaaaaatcaaggaacttcttgaaaagcttaacacgagtgaggatgtccttaagtttaatgaaaaactgttcaagcagtccagagaaaatcaaaaactcaaaacctatgacagacagactatgctaaaactgcttcagtaccagaaaaagcatgggcattccacaagctatatgtcgagaaaatataaaataagcagaacaacgctttcaaaatggaaagtcatgtttgaagaagagcttgaagacacaatgaaaaatgccggtaaataattcaccggcaattttttaaaggtaatagtaaggaaaaaacgggctgtacgtatgccggagtcgaaccggataaccttgccggaatgaccggcttcgctattcctcccaattgtggtacgaagaactttttcctgacgacacttcaaacgggtcatataaagaagctggaagtggaaagaagaaaaatggcaagtctgagattcctccgacttaatagaaaattatgatacaaagatctttcaacgttccacttccggcttctaatatgatgaaagcaaggcaataagcaaaaaatgcagtcgtgctctaaccagctgagctactcttcctatatagactgtgtttttttgttgtggaagagacgggattcgaacccgtgaccccgtcgtaatgagcgaagtaacatttttctacggcacttgtttgtttttaaaataaaaaagaggctagattcgaaaagacttgtacaagatcattttcatgaccttctggagtcgaaccaaattaaaccgaagtaggccttttctacggcactctttatgcaaatcaaggtaatatttttcagaatcttccgtgcatttgctctacccgctgagctacctctccttttcgagggaaaaggcaggattcgaacctgcgacccaatgtttactcaatctcgaagtatgattctaagacgacacttgatttttatttttattcatagttattagtttttctttttacgaaattatgtcatattttcatagttgtcattgatggaaattctgaccttttattatcttttcattgatgtgatttaaataaaagaggctagattcaaaaagactttgacaagaacactttcgtgatctgttatggagtcgaaccaatattataccgaagtaagccttttctacggcactcttttatagtatcagggcaaaacggcggaatcttttctttttctcctgctctatcttttgagctacattccgtttacaacaggaatggcaggaattgaacctacatctgaagacttaactcgaagtatgactccaaaacggcacctgatttaatttttccatcggttttttctatatttcttccagtttctctggaactttgtatactttgcattcactacttcataaccgtgtggaaaacagaatgagcatcccatttcatttccacacatcaatctttaaatctgtgttccggaaattttctttggaaagtcaatgagtccatattcattgaatccaaatttttgtcttaatggtgtattttttttcataagtattgagtattaacctcaatacaatgcttcttttaaattggatttataatttttcatagttattagtttttctttttacaaaattatatcgctactgcgcaatctttttacgtagttatttttttattaaaccaagtaacaatgtataagagtttttgattctagtcaaattaaaagtttgatgatggaactcttatgaacgacattggtttactaccgggcaatctcttgaaagactctttcagtttggaatcgaagcaggtctttctaacggcaccgatattattaacattgcaaaattatatgataagtacgcaatctttttacgtaatttgattttattgagaaaataatgatgaaattatttcaaaaagtttaataattcctaatacaggaagtaaaataataaatccaatcaataaaaagattccaatcttgcttagaaaacctgtatgatgttcctgaaacttttctttttctctcgttttagctttaaaaacagggatttgcttggtcgctttgaagctatcttgctcaagctctatgattactttctttgcatgctcatcaagcaaatctttatctcctctgaaaacaatatcttttaaaattgcatttcctgaattgcttaaagactctctgtaaatctctactgctgcttccatttcattattctctggtttagacaacatccagaatttacctgcttcgtcaagaaatcctgcttcaaaataaatctgccctaacttttttctcaaggaaagatcattaggaaactgattgatcatatttcttaatctgtcgcatgcctttttctttctgcctgccttaagatcttgttcaattctgtacaataaattccccatcgttttttacgcagttttattttttatttaatatttgttcgttttgccttgaagcaaaagaaccaaaagttcaagacctggaaactccgactaaaaataacctacactcactaaaaattctaaaacttgcgcgaatgttatattagttcttcgtttcactttctgtgtcgcgcttcaaacaatagaattttcttaacgttcgtatagcttattttcctaacgcctccgtttcctatgtcgcatttctgtcccgctttatttaaaagcagtgccttttacagcactactttatgaatcatttctacagctgactttttatcttccaatgcgttcagcacatcgaaaattttatctgaccagcctgcaataagatgtacatcattttttctgatatcaatcggctgtctgccataacctgccaggtcaaaaatatacagttttgcatgaggagttatagccttgtatttgtcccacagatcatcaaaagagtttctgcttccagtactatcccacatttgggtatcggtgaataacattactttgttcactttttcacctcttttaatcagatcctcaatcactttgtagccattggtagcatatcctacttcaccttcacgtttgtagaaagcgtctacatttcttaaaataccgtttttaggcattggaactctcagccaacggtcaccgaaaatacctgtcacaacatttttacactgtgactgaagaatcatcgacattagcaagccaatatcatacagcagtattttgcttttatgagaaaccggtttctgcatagagcctgagacatctgcagcaattaccactgaagtatcaaaaccaaaacctttaatgtttttagcactcaccacaacagcttcttccagtgcctccaatacggatgacagataaggagaatctatagttttcaattctctgtaagccgccagaaatctgaacggaagctgttttgaattggagactgctctttcatcagaaagatatttacagactttattcattgcatcagcagacactccggcatccagaatatttctcaggtttcgcatggttgccatataacctaatttattactgaaaatcagttcttcccatttgtttttgaaagcaagctttctttctgcatcatcagcaaattttgtctgtcccagaacagaaagttccacttcccaggtataaggagtttctaatgtattatttgcaattttgttgaagaccatttgctggttttcgtcttttgctttcgggtgaaccagaaaaagcgcgtctttcagggttacctctgctttcctgttgtattttgcaaactggtattcatcaaacttgttgaatgatttcaccagacctttctgaatctgcttggatagtttgtttagttttttagtttctgtccttttattggcaagttgataataagccagcaattctgtgatttcatcagctctctgaatgactccatctactgttttgctcaccagatctgttccggaagtctgttttgccaattcggtagttagaaccaaaggaatggaacgcagatacatatctttccttgcgtacaccgccagttttgccacaaattcaggattattttttttgatcagagaccggattctctccaatctgtcatttcccttttcatagttggcatccgacagtcctgttgtaacaacagcactatacaattcttctgcaggtgtcatagcatatgcttttgcaccctcgtagttcagtactactttattttctttttttaaaaaattaaatttcatggttactgttttaatttgttaaacatggagaaggatcgatagttcctccctgatttctgatgcaaagtaaaaacagtattacgcaatctttttgcgtagcaaatttttctttgttttttattttttaacttaagcagttccaaataaatctctccgtatctacagatcttagttttgggtaaagccggatgaatcatgctgtttataagtcggtctaatagattttttcttaccgctgatgtgactgatttatacagatgtttgagaaatacaactcattcatcattcatcattcatcattcatcattcattattcattattcatcattggtcatttacaatcataaaatccttctatcattgaatttcattaaagaaatcgtttacatcattttttttatgcacggttgtctagctttgtcttattaaaattaaagctatgattaaaggactatatgaaacccatgttcaggtgagtgatctggaaaatgcaatacagttttatactgaagtattaggactaaagttggctcacagagacgaaacaagacctattgctttcctatgggttggagaaggaaaagaattcatgttgggattatgggagcagaaggaaaaccttcaaaccagacattttgctttctccagcagtaaggaggatattttaaattactcagtggagtttttagaaaataaaaacttaaaaccatataatttcctgaaaaacggcagtgttaagcctatggtatttgcatggatgcccgcactggctatctactttaatgactcggacggaaaccagcttgaatttatttctatccttgaaggagaaagtaaacctgaattaggagtgcttagctatgatgaatggatgaagcagacaaacaaattatagcagaattccttcagattagataaaaagagacgcaagaaccggtcaaagtttaacaaaacctggtttttgcgtctttgtattttcagtaacaagatatgtatcaaaaatcttattattttttcagaaggagattacagatttttttcaaactggagttttctttccaactgttaattttctctgttatcttgtgatgaacttgcgaatggttgagtgcaagaacttcatgatagatttccagaatttttttcagattggtgactggtctatccatttgaatcaatatattgaaaatcagctcttccaatgcaatattatgatttttactgacattcagcatatgatgctgaataacatctgttaatcttttaacgggtgcccactccaatctttcgtgcagcccgatcacccttcctaaacgggcattatccattatttggccagacacatgttccagccacatatgggccgccgtttcacggatggttttatcactgtcaaggaaaatagttcccaggaacagatacccgatttcatccagcggttttttggtctgataaagtgcattggctgtattcagtaccagacttctttcataaacttcagcaattcctgaatagaaaaggcagtgtttcattacttttaccagagcgtttgccggagtattcggaaaacacagcatcagggcaggtatttcattaagttctttctgttctgccacaaagtattccataaacaagggatctttccttttttcaagatggtattttggaatggtaatgttaagttccgcgggataataagaatttttcctgctgtcaatagttctccacttgtattctcctgaaaggaattctacaggaatattgtcatatccaaaactgctgaatttttcaaatacagtttccggtgaacgtgtaatccccgctgtcatccaccatgaaggatgtttacattcaccttcaggttcagcatttttgccaaagaagaaaagtaataagtctttatattcccctttcagtcttttctccacttctatgatagcttctgaagtattgtctaaagcacaacgctgcaatgccagctgaatatcaagatgattcggttcaataccggcattctgatacgcctccaacctttccaccagtgtaaaaggtgagatccagcatggcgtatgggtaatgggaaacaacagaggaatattgtttccggttttaattttttgaaagacatagatcgcaatctctttaaatgcgcttctggcaggacaatctgctcctacattttctattggccccagttttttctgatagtttaaataagactctctttcagcttcttcttcttgtgtcttccggtagattttttccagatttttaagctgaacaggatattgctcaagcagctctaaaccataattgataatggcattgcacaataagacattcagaaagggaacctcccacttagaaattgtcttacaggctttcagaaatacaggttctaccaatttcaccgaaccggcatcaacatcgccagcgaaacgtataaatcctgccagagcaacatcacaatgatggctgtatgggtcatccatagccaaaggcagataaagcatcagatcttcaaaattctcaaggactttgactgcattttcgggtgttgtcaaatataatttttccgaagctatcacctccagctgcggttgtttctgttcaatatattttgacaaaagaggacgtatatttgtcagtatattatcggaataatgagaaagtgcctcaatcatattttcggaaacaggaatgtatttcaggataatcttagctgcctttgactgtatgccattgtctttacttacaaatgccgtacataaagccattcccagcagttccgggtttatttttcttctctggaatattttttcagtaagccctaagcttgaaacgactactgttttcacttctgtgctcaggagattcggaaggtaatgcgaaaattcctcacttttgaaatcagcaattcctgcaatttttttaagatgtgataagatagtattcaccgctttcgactgggaagatgtcaggccagcaagcaattcttcctgcagatcagacaattcttcttccgttggctttaaggaagtaaatgcatccataaaccagcctgtcacatttttattaaaatttctgttggaggccagaagacattctctcagaaatctttttctatcaatttttttgtctgcaatgagcttctgaacaataggaaaccattctttacgaaaaggtaaggatttggaaggatatttacacagataccagaaatgggtattcagggtttcaggataatgatcaagatcggccggataattgctcaggtggtgtcccagcaattgaggtttcggttgtacatagcctttttctgtccatcctaaaatatctttgtaattaaatgcggtaaagtcagcttctacagattcgttgataaagtctgaaaaccattcgggacagccccactccaaaatctgttcggtctgttctgcattccggaaaagactccagtaatttttaccgaaattttttttatccatgcagacaaatgaagcaatatcaataatagagtgctgattgacagatcctgcggtgtggtaagagtttttagtcattacgatcttgctgatctcccggtccattttctttatagacggcaccagtgtttttctttcctcaatgctaagctgcttcagaaaagggataatctcatgtattttttcctcattaaggatctcataaagtctttctttcatgtgctttcaatttgatatatagttgttttcaggttatttgttatccattaaagtttcaaagctatgccacaagttcccgtcttaagtttcgattcatttatgcatcaaaagacgtatactttttacagggtatgatgtcatatctgaaatgttttgttgcaaacggagcccgaaaaaaggtacccaatatatgaacctgatcaaatcacgatgataaacatcctgataagatcatcttttgattccgttctttattgatatatttttttaaaagagcagtatcttcttttttattttttgaaagtttttttaaaaacagcacaatctcatttattttgcagtttaaaaattttgtcctgaaatctccttcaataagcatagattcattcttatcagctaaattaaaaaatattggctgacagacagtaaattatcccttaaaagtgacttttttaacaaaatattaagttaataaaacggctgttataatatatttgattacataaaaataattctctgtttaaagatataatgataaaaaattggttaaaagccctgtactttgatatttacacaacatttggtgtcttaattttaaaaattatacagtcacaacataaaatcatttacctacacggatacgttaattttttctaaaatattaaaacatgcattgtaattcattaaatttaatatatttgcaaaataaaatacttgacaaatcaaatacttttcaatgataagcaatgaattattatttttaatcaaccttaataaactgcaatctgtaattgccagaaggtttgattctctgggtgctcatggtttgggactcaatgactttgttatactttatcttctcagttcttctcctcagggtaagatgcggaggatagatcttgccgaaaaaaccggacttacggcatctggagtgacccgtttattgaatcctcttgaaaaaatcggcttagtggcaagggaagccaacgaaagagatgcccgcgtcagctatgttgtaattacaactaatggtaaaaagatatttgaagaagctacaataagcgccgaatatattacaaaagaaatccttccttcccgaaagagtaaatctttaaaaacagtaaatgaatttttatttgatcttggaggaaatatacaataatcatcaatgaaaaatgcagcaaaaaaacagctaagggaaaaagcaaaacactataaaacaacgatgggggttcttgcggttaccaatactacaaatgggaaacagtatatccagggatccttacatcttgaagctttggtgaataaaatgaaattccttttaaatggcggaatgttcacaaatcctcagctacaaagggaatggacagaattgggaagtgaagcctttatctttgaatttgtcatgattgttcctgatcagaacaatgaatatatcaactatcgtaaggagatacagaaagcggaagaagcttatatttccgggtccgatgcacaattatactagcaatatgtcagaaaaatacttgtcaccaacttttgaagccggaaagcatctgttcatgaaaaatatacaaggggcagtcattaatctgaatctgattaaactgaagaaagaagcagattattcagcacatccggacctgaagcctgatgaaaagatcagtggatgggatgcttattttacttatatcagggaaaccgagccatttttaaaggaaagtggcggcgaaattttgtttattgggaaaggagatatgtttctgataggtcctgaaaatgagtattgggatctttgcatgctgatcagacagaaaagtgtaaatgattttttcagttttgaacagaatgaagcgtatatgaaaattatgggacacagaatggccgctattgaagattcgagacttttaccgctggaagaaataccgttgaatggaaaaagaaattaaaatggagatagtcagaattggtgaagcagacctttgttatgagatctttggtgagaaaaatacagaaaatataatcctgatttccggattaggaagtcagatgattcgttgggatattgctttctgtaatattctggttgaaaaaggattcagggtgattcgttttgataacagggattcgggatgttctgtatataacgcaaagcgggaaattcctgcaaataaaagtattgaagaggtttttgatgttctcagtaaagaaggtattccttattcattaatggatatggccaatgatgtgatcgggctgcttgattatttaaagattgaaaaagctcatattgcaggccgttccatgggtggaattattgcacagcttttaggttcaaattatcccgaaagagttttgtcattaaccattatcatgtcaacatctttaaacccttctcttcctaagacggaccctgaaattatggcgatgatgacccagcctgctgctgatccaaatgttgacagggaaggatatttaaaagcaaaaatacattttgcagaaaaaatatcgggacaaggatatctgtttgatccggatcaggaaaaagaattgcttgaagaagagcttatccgttcaagaacaaaaaacggcatcatccggcaactattggcgatgggttcttttcaatataattctgacctattgaaaaagataactgctccaaccatgattattcacggaacagatgatctgatctttcaccctgattgcggaaaagatattgcggattctatttcagattctgaatggattctgataaatggtatgggacattctattcctgtggaactttatgattctatcagtaataaaatatatggtttaacaaaataaaagactgcctcattatttgagacagtctcatttgcaaatctattctattcagagttaataattcttcaggcaccaatgcagaatttttgcaatattctttgcatcatctactcctctgtggtgtgtaccttccaatgtaaagcccaattctcccaaagccctttgcattcctacactttttctgatagtagggtgaatttcaccgaataatgtcttcacattgatgtggtcatcactcatcggataatcggtggaaaatctccttgcctgattctgaagcatattcagatcataatttccataactggcccatgtaagcgcttccgaatcatactctgctctcaggatatcgaaggcatcatccagcataattccttcatgatccagcatactttgggtaatggtggtcagctcggtgcagaacgggcttacttttgaatgctgtggttttattaaaattccttcacttttggagatctttccggtttttgcattcatgatacacacaccgatttcgatgatctcactttcctgacctcttggcggacggttttcccaacacgttgcttcaaggtctactattactatattttctgttgttttcacttgtttataatttaattgttaaaagatggaagatgagagtcttacaccgtgttatctgcttccggatttagtttaatttccaatcacctcggagcaaatggagccacccattttttctttttcatcaattctttgacttccccgtaggaaaccggataaaaattgtgacagtctaccccaacgtcaaaactcagagctttctcatcatccggtaatgttccgtgtgaatggccgtatagttgccataccccgcggtgtgagccattccaggtgcgcatggcgtagtggaaaagaataattttctgctttccattactgttatccggttcatcaattttcagttcatggtaatctctgatagaagcaaatcgtttgggatacgttaaagcggctccttcatgattacctttaatcaaatggatattgccatgtaattgatccaaaatttcttttgtaaaatccggttttcctaaactcatatctcctaaatggtacaccgtatcaccgggttcaactttctcgttccacctttttatgagttcttcattcatatggtccagtgattcaaaaggtctctctgaaaattttataatattctcatgaccaaaatgatggtctgctgtaaaaaatatattgggtttcatttttttaattgtttgtttaactacaaaaattttcaacgttttgcggtcattctgaatagagactgaaagtctgtgaaagcagttcattgtggtataaagaatctctttcactttaaacatatttttccctcatcagaaatcgtagattcgacgtaatcaatgacacattcaatgtttaacttcgtagtttagtctataaatattttaattaattcttacgaaatgctttataaaaggcagtttcaatttcttcctgatcgctttccgtatatcttcttgagaaatggatcggaacggcttctttcacctgacagtcattcatgattttccccgacgcagaagcaaaactgtgatggttaaccttagcaaattcctgatctgtatttttataaaagctttctatatataccagatctgcctctccaaatacagcttgtatttttttgtaattgttatcatctgccgcatgatccataatgacaccaagcttatatccctcatttcgggttaacagatgaaacagatctactgctttacagatgactccttcaatttcgatttctttttcaccatcattattttcaaaggcattcttcagcgcactgatccattttccttttctgaatccggaagcattttcattaaaggtcactgaatctttttctttaaacagataggcaatagaatctgttttgtgatcaagaatagcaaagtcaacattcacatattcgtcctcaaagaggaaatgctgagtttttacaaattccagtttccattgtggcggacgaagggtgtagacattaatttcttcttttgaaacaatctcacggatttcatatacgattgcgttttcatcaatcagattccatgtgtaagattttaatcttgcttccacctgtaaatgaatattttttggtcctgcaatcactactttttccccacttccgatctgatgcctgaatatcccgtcaaaatttgaaaagtgatcaatatgggtatggctgatgaatactgcggataaggactgcacttccttcacagtcagcaagctggcttccccacaatcacacaaataatgttttcctgaattcggaactttaattaatatactgatgtcttcctttaaaagactttttatttctgcctgtaacatggttttttcttttttaaaccaccccgtcaaattctttgaattccccccctccaaaggatgggaattgtcacactttcatagtattatttctctttatgaaatgaggtgttttcgttcttctgactttgatggttacgtttatacataaaaaagtttcggtaaaatgaattaccgaaactacactttaagagtcatcaactcttcttttataaaatcaatcacaaaagaattcaactttttgttgatccttttctgttcctctttttcaatgctggtgaaagccaccggaaagtctttctcgaagtcctccaaaatatcctgagcaaaaaggccaatcactttccctataattttggactcgaattcgccaatcttactcacaacattattcagcctgttgactgtaacatatttttggatttcttcccatatttcctgcgccttttcactgaaatgaacctgtttacgaacagttttcgcctgttttttaaccattttggatttttcgatccatttctcattcttgtttttcagaatgactcttgcgccgtttccaaaatatctggttttcaaagttttcacaatggtaccttcacacatattgtcttctaaatcaggtagtccaagccaggctggaatgtatgaattaaaagcattgggaaatttcaaagcttcttccagagttccctgaaacagggttttagcatagaaaaatcctgtctcatcaaaaatctgattgacaacttctgtatccatataggtaattccattcaacttgatatcgaaagcgtaaaattcgttgtaaggggcatactcaatgcctttctgcactttcactgcatcttttacaggctctacctctttatgtttgtagccaccaccgaacaattcaccgtagattaccacagtttctacatccgggcgcatggtcctcactttttgaaatactgccattacattttttctgtagcgttccaacatctgatgggcattgaaaaatttctcacctttttcgatgaaagcagttctcttcgcgattttaatttcctttccgtcggtaaagaaagagaaattagcgccgtgaactttttcctgtactatgaaaacctcatccccaaacccctgcattctgatctgttcgatcacgcgggcctggtaagcattttctatagaattatatgttttgaaaatcattttgttttagtttttaatcgtttctgattcgtttttcttcatctgggtaacgtgtctttgggcatggagtgagagaaaataaatatattcatacacattaattttcccaagtccattcactgtcattgtagttttatacaaaagtccttctccatttttcattacttccagatattgtaaacactgcagatattgctggttgattaaatttcttattttacccaagcataattctcctttcggttccatatgttccggtcttatccattcaaaagcgccatattctcctactttatcaaatttttctttattgaaaatgtagttttcaatttcaatttgcagatcaagatccagagaattcttcattgctttttttgagcctttctcaataaggataagcagataaaaattcgtaagataaatatgctctaaaatctgctgaatcgtccaacctccgtttgaaggctgatgattcaacgtttctttatccttttcaaaccatccgtctacctcatcaaatgttagtttcagatgtatttttatatctttgataaatctaaaaatgtccattacaattctttaaagttttgcagcaggtttaaaatattttcttttcctaccggattcatagagtgacaataaaattctggcaaatcaaggtaattgtccatacaatattctatcagccatttggcacagtcataacctgttttttcaacaaattcctgagaatcctgtttcagataatgttcatcagccaggtcatggtcaaaagagatcatttccggaagtcctttttccaatatcctgttaacaaactgctcgtaattccgcacaatatgccagtcgtttctgaggaaaataacctgtttcgtataatgataagcctcgatcggatatcttatatcatccagaaataataatctttttgttttttccatgatttatttttaaacttcaacccttcctacatcattcttccagctttattacaccatcatatcagcacagttggaacttgcaaaagcgtaaggctttgccttgaacacatatcccattcccagaatatatcccatggcatcttttaatgctacattggatttgaaatccgggtcggtattaatgtctgcgtgtacctccatttccacaccataagcatccagcacagagcagatcgcgtatgcaatttcaacggatttgttgacttcattcagcattcgctccttgatactaatactctgtatttctctttctttcctgataaaggtaaacgctccttttccctcacgaataaacactactgccgtagcataactgatggcatctccgtatacatgagagtctgatcccacacatactttcagacggtgtccgttggcctgttcgcgaatgatggcttcttctaccagctgtgtgatagagtgttggaaaatttttccattcatattctgccatgtttgttgttgcgtttccattttttctacatttttaattcataaatgattgttgataattgataaatgattactagcagtcctattttttaactctagtttctactttctatttttgcactccgaaccggacccgaaccgataccatcagttttggagactgagatgccgccattaaactatcagagtaagtgtattgttgattcattaggactcgaacctaaacttcaagaatcaaaatcttgtgtgctgccaattacactatgaatcaattttaatgataattaaatgatgattgataattgatgaattgctcagcaatcatttatcattgatctctcttatcattcatatttggcggaacagacaggaattgaacctgtacctttagtttttcagactaacgtgcagaccttctacaccactcttccatcttataattgataaatgatggttgataattgttgaattactcaataatcatttatcattgatctcttatcatttatatttttgtacggaaagagggattcgaacccccaaaagcttgatcctaaatcaagaatgtctgccattccaccattcccgcaggtttttttataagtaatgagtaattggtaatgagtaatattttttattttcattattactcattgctcattacttatttctcatattctgtacctctccccagattcgaactgggactttacggggtttaaagccgttttctctgcctattggaatagagaggcgtattttatcagtaatgaatactggataatcagtaatatgaaaatctatatttattactcattattcattgcttattactcatataatgctaggtttgagaaagctctgtctattaataaactatgcctgttagtgtttgtaaagatcttctgcgcctgacagatctttctcatttcctaatgatgttgtgtttaaaaaagtaaaaggctgtctgtttttattgactaaagatcttctgctcctgacagtccttttttcttttcttcattttttgtgtgaatggtaactggccaatttttttaaaaatctgaactttcatggtattatattcattcaatattgaccagctattcacatccagtactctataagggaatcgaacccttgttttctgctcgaaaggcaggcgtcctcaccgttagacgaatagagcattaaaaccactaaccgggaatcgaacccggacaacaagagtacagttcctgcatgctgccattacattatcagtggttggtggaagtagtaggattcgaacctactcagcaatgaagcaacagatttacagtctgccccgactctccaacttcggcgtacttccggatttttatgagcaattaatcctgaataacaagtaattcctcaatttttccttttaaaaagaaaaggtctgtctttatattgaatgtttgactaaagatcttctgcgctcgacagcctttttcttttattaataaaggatattctttgttatagatgataaaagatcattgataaaagattctttacatctcctataattttatattgagatggttatgggattcaaacccactcagtttacacaacggttttgcagaccgccccgactcttccacttcggcgaaccatcagattaaaaaaataaagtctgtctaaaattgtttgatataagaacttctgcgctcaacaaactttatttttacctaaaatttataaatgatattttttaatttttaactaatccggagagaagaaaagcctgtctgtatttttcgtgtttggcgtaaagatcttctgctctcgacaaacttttactttttctcctgaaacaattaacaattagttacctgcgattccggaaagactcgaactttcaacttccggtttaacagaccggtgctctgccattgagctacaaaatcattgtaattccggaaggacttgaaccttcaaccttcggcgtatcagaccgacactctaaccacttgagctacgaaatcattagtattccataagggaatcgaacccttgtcgttcggtagaaagccgaatgcactcaccattatgctaatggaacaattggtctggaaagcaagattcgaacttgcgacctcccgcgtccaagacgggtaaacaaccaccgttatctttccagctttggggttcacttctgtttcttttccgggagacagccgaatgggaaatttccatgaacctttgtgattccgagaggattcgaacctctaaccctgggtttagaaaacccatgctctatccagttgagctacggaaccattttttgtaatcccagaaagatttgaactttcaacccccggtttaaaagaccggtgctctaaccatttgagctatgagattgttttaaagtggtgaatagtcaataatcaattcgtttcgcttgtcaatcactattcatttttttgtaatctcagaaggactcgaaccctcaaccttcggtgtcgtaaaccgacgctctatccaattgagccatgagattaactattttgggtatctccggggatcgaaccctgttctccggttccacagaccggcgctttaccaaataagctaaagaaaccataaaaaaaagcgcctcttttcgggaggcgcttcatctatttaaacgtaagagatcattagctgacccacgtatataagcaccttttatccacaattccactttcaagaatacatgcaacacctgtcggctcctgtccgaatagtcttgaatattgattgaatatgttatgtaattgtttcattttattttttgtttgtttctaaattatttttaactgaaccctgaaaacctgttgctttcaattttcggttgcaaagtaaatatgaatttttgaaatccgcaaataaattttcaaattaagttattgataatcagttaattatatctaattttcagaatagagagtttctgtccgcaatattttgcagatctcttaattacctaaatgactgtctctcaccgggttgcttatcactctattttatcgtattaaagtttcattgttgattaaaaaattttcatgtttatggttattttttttcattctaaataatttctgacctaaaaaacaaaaaacgcctcgaaaaatcgaggcgtttctgtcgtattttgattaattttttacaagtttacagtaaataatttccaaagtcagcacatttcgcctcattccatatcacctcatcatacccgaataaccctttgctagaaggactttcgcatagttctgcattgatatgtgctctttgtattgtcataattttctggcgcaaagataaatcttttttgatattattttataattttcacaattaacgggaggtttttctatatacaaaggcgcaaaataatatcaaaaaatggtgctttaaggcgcaaggattttatctgcgataaaatttaatcgtatatataattacaatatctcttaacgcaaagcttttattttcgcagatgattattttaagggtgctaaggtgaatcaattaaaaattgatttgatgaagcagcaggatttttaaatatttaaattcttcaatctttgaatatttaattcctgaacattttatttcttccggttttgaatcttgaaatatctttcaggattacctgatcatcgggattaaaatgtttcagttcgtttacaatttcagagcgggtcgctaccttttcggatataatttcataagctatattccttgtaaccatatgaagcttcggatcttttttgaattcatatttcatggcatccagatacgtaatctttttgtgagccggcaccttttcatacaggtcctgtatttcagattccagtcttttaatatcaacaatattggcaaaatagttattcagacagttgaatgcatctttgtcctcttcccatcctttcagcagtactttctgtgcctcctcaggtttttccattttgttgcggtataccaaagaagctttcaccatttgattatttcctgtatagtcatctgctacgatctgataataataatgggcatttttaagatcgttgatttctttataaagatctcctactttttctttctgctccatttctttgtaaagatcaattgcctttttgtactgtcttgccttttcataacaatgtgcagcatcggatttattatgcagttttttaagatatactacggctgcttcgttgtaaaatcctccgttttccaatgtttttgcccctctgtaattatcctgcagaagattcatatacacctttgctgcttttttataatcattttcagcgatgtatttctcggcaagttcttcgtatttgcttcggattctgtcaaaaagtgagttttcgagataaaagctgcctccacttccttttcttcctgctgcatttctcttattttgttctttatcttttaaagaggtaatgacaataagaatgataaaggctacaattaagaaaatacctaatgttcccaccacactccagaaactttcatggaacagttgtgcaacaatcccgataaccttaaacatcgccagcagtacgaatgctgccatgaatttgtcaataaatttctgtttattcatcgtcatcagattttaaaatagtcttatcttccctgaagaggcggtaaaggatcagcatcactccgattaccagcacccaaacaaaccaattgtacccaaacatttctatcaatggataaaacaagtataccagcattgctacaagaattgtaatgagaataaatttcacccagactggtacattatctccaccaacattgagggatttatttttaaacaggaatgaatagagtcctactccggcaatcatcaggattatcatatacaaaatatctgaaacgggagctttttcctccatcggagttccctctgcacctataccttttactttcgatttgtcaattgaggcggaggaaggatccacaatatccagggttccatagagttttccaagagaatctgccatcaaagccttcttctttttcagaagatattttacaacatcaccatttaccggtttacctttggtatattgcttcagtgaatctgagattttatgtttcagcttttccgttttctgttcaagatgttttgtaatttttttagtataaatggtttttagagaatccctgctctgcttttctttgttaacaagcttttcaatatcttttcctatctcacctacatctctgccacctgcttttttatagttttctttgtctttttttgttttggattctataataccggcattgataagttccttggataatccttttcgctcctgatgatacattgaatcaatcttaagatcaatttccgaagttccagactgaaaagcaatcatatcagaaggcgcttttactgcattgttcacaattgttcctgaagaagggccggcttcttgctgttcattgctctttttatctgaaggcaaagcaatcctcagcacaatggccgcaataatgactgcccaaaagactctgcggaaatttcttgttcccgcactttccttttttccattggatcctccaaacaatccttccaaccaggtaaatttcccgaagccatctcctctggaagttcccataatgtcaagaggtattcctaattctactgcccgttcaggatatttttcaatatactgtaaatacttttctatttcttttttatttccggccattacttttttaaggtcaaaaggcaggttgttcatccactcttcttcggtttgtttgggctgtaaagtttccatgactttttcgtcatccatttcaaccgtgtagctttttattttttggggaatagaaaccccgttcaaaggttttctgacacttttattaatcgttccgggttgttgaattattgaagtccagtcgatttcttccgaaagttttaccaatccgaattcagggtgcataatcaggaaacgtgaatcaagctgtgcccagtcttccggattgattttaggataaaaagtagtgttttcagggatgaaaagtctgtcatcaacacattgaaaataagcgttccttcctatttcctgtggagcatagtcattgaaaataagaaaacagccatacagcacattgggactgttagccggaatagcgaatgattttaccagatttaaatctatacccaatatttccatttcctgcagccacaccacaggtgaagagcctctgatcagaagtccttttttaggatagttatttttcgggaaaggttttattctaagctccataatccagaatctgttctataaacggtttcaaaaacctgtcacacatatcatccattgttcttaccttcagcagcgaatgctccggaagataatattctgatcctccaaattccgtataggtagccagcgacaggaaaccgccaagtgtagagggaataaaaaattcctcaatgctcttgttactgcttcggaaggtcagcatcccgcgggaatctgtaatcatttcacttccatcgggaaatgtaaatttatttttgttttgctcggcaaaaacttgaaaatcatatttatttttggaaaatcccagcgtattttcagaagcactgtacaattcattaccggaaataaccagatttctgtactggttgattccgatcttattgaaattattgatcatccgcagtccgcttccttttagtttggcaacttcggcttctgcttttactgtatttttttccagttctttctcttttgaagtgatagtttccacagaaatattcccatcgatattgattttgtaatgagttgcatgatccgggtgatgcagataaaagcttcgtccaaaataaatcagtttataaaacataggaatgttcatccccgtgaggttctgttcggaatattctccggtattgagattaagctttgatatcaacctcttatcatactgatactggcacagaataaagtgctgctgtctgttttttgccagagcaaactgtcctctgggttttatggaaatcttatcaaataatacttcacaaccatgatgtgttttgtaataatcgtaagaatgcctgtcgtaatagttatcggaaagataagtcttcagtaattgttttttcgagctcagaatgaaaaattctccttcatacagaaactcagcgatcttattaacgggagccgggaatagaatcggatagttttgcggaaggtctgttttctttccgttggaagtattaacactttgtttttgttgcggcggattggcccacagctcctgcaatggaagttttattttctgaatatgctttcttgctcctttgtggtgtttgtaaaaattaatctcaccatctgaggttgtggtcaccagaaacttcagtctgtctctgttctgatggatcacccgctgcattttttcatcctccatattatcctgatgggtaatgaaaaacacttcaatatccttttctgaatgattctcgttaaaaaacttctccagcgcagctgaaacttccagagcggagcttacctgattaaggctttccactacatcttccactttattaagtgaaacaggaacagccgcctgtcctaaggtaaaaactttacattcagaatgggctttcggatgcttgatcacggctatggcagaggcaaaagccaatacttttggggttccccagtttctgagggaagtatctatcaggataattctttcaaaaatattttcttccggtggaatttccctttgaatataaagcgcttcattattcgctacacggttcatgaagacatcatcttcgttagcaaattcggaaagaagcatcctgtgaaaatctcctttattggtcatatcagaaattcctccgacaggctgctctccgggagaaagatgacgcatcgggattttcagtccgctccagattcttttaatcaggcttcctacctgaaatgttttgggttcttcaattaattctttgataaagtctttatctgtatctgctgttgtttcttcttccagcacttcatcatccagttccggctcatcaatcagacctttcatggcatcaatgatagactgtactgtaggaaatttttcattcagattcaaagcgctcagatctttattaagaactgatgggcttgcctcttgtttttctgcactaatggcaagctcctgcggtcttttataatagattcttaaattaacatcggctaaaagagtagccactctgttatgaccatcactgaataaagtctgcagcaatacaattctgttttgtttttgtttataaactttgggaagagcatgtattttttcaagaaattcaatttgtttttccacattgaactcaaaatcttcaccgctgtagaactctgctgtacgtcttaaaggtcctgcgaaatctgcgtaaccgtcctgcattgcatacagaaccataagcaatgccccgaacggaggccagccctgcggctgaagctctttcaggatctccatgacataaggtctgtaagcaatagctcctactccggggatggagaggagattattctcatgataaccggaatctccgggaacatcttcatcagttttccattcccaaaagtaattttcataggactggaaataagcctttaattccattctcttgatttttctgtaagacggaatgagcttaaggatagggtacggaaatcagtatcttttatcgaaagataatttccgttttcatcccacagcagccatccttccggctcattgttatatttttgctgtaacagtgtacttaggtttttaaactcaaaatccagtcctgccggcagtaaatgcctgtctttggtccaataggtttttccgggaaagctcaacaatggagttcctataaacagtgctttatcctccaacatcgtccattttattttttcaagcttaaattttggtaatgcaacgatattttctttgatatcagctatattgctcagcaaagcgattaccggctgctcttcattactttcttttaatcttaccggaacttgttcctgaattccaaaatagttttggttggaaggaggcaaagtaagcggtaatgctttatttataggagcccagagtaatgctgttcttatttttttggtgggaaccaaagcttctttcctgaataaaagtccatcccggagttcatacaggataaaatccggtaattgttgtatttccggagcttcggcctgttcatcagtaaagcctttgagccagattgttttttcatctacggcaatctgaatatttttccagtctctgattgagcccagaaaatcttcatccgcacggggaagttccgcccagaattcttttaaacgctttgaagaatcttctgccataagctttcaatttcctgctgtatataatgcttttgttccgggtttctgatccagtcgcaacgggtctgcagatacctcagtttatcttttattacattctgctcttcaaaactcaatgctcctccattccatttttcaacaagaatttttacgtctttcatgacttcttcaggattgggagttttgttctgcatggcctgtggatgggaatccggatgatcatctttttcaatcgtcctgttgatgattccttccagaatttcaatctgttcttccgtatcccagatgtgtttcaatacccacaggtcggaaagcacggcttcttttcttccgcagatcagagcacttgctgcaatgaggttctgaagttttacggctctacggtccgaaatagcaattcctgtatttctaagcgtcatgatcgtattcaggtacacttcataaatcggtgtaagatctattgttctgcacaggttttgtaactgcctaatttcgtcagcatgaatttccggaatttccgtttcttcttcattttccagttttcttcctgccagaaggacttgttgtaaaagttcgggattcacataatcgacattaattcttaccagaaaacggtcaaataatgcattcagcgcttcatcttccggaagaacattacttgctcctacaaacatcagtgcaggtaagtgtttggtttcctttccccgtttaaagattttttcgttaagtgccatcagaagggaattcagaatagcagagttcgcattgaaaatctcatccaggaaaaccatggaagcttcaggcatcattccttccgtattggtcaaaagttctccttctttcagctttctgatatcaaaaggaccgaagatctcgttcggttctgtaaagcgggtcaataaatattcaaagtttttcccgtctttcactgttttcgccagcgttctgacaatagctgattttgcggtccccggaggtccgtacagaaaggcattttctcttgccaaaaggcagattcccagcagatctacgacatcatttttacctacaaaagtatcttttacgtagtttaggactgtattgagttgattgatattctgattcattgatttaaaaaattaaaatttccaccacttcttcttctgtggcttctcttctgctttattttctgcctgttcatttcttttgctgaatgaaaaagcaagtctctgataaggcactctgatatcgaagtatagctgtgtaccatcatcaagcgtaagtgcatccattattttatctccgtcctttaccagattttgtgatacatcctgtttattgaagtgatgcctgatgagatccctttcatcagaaattcttgtaataatatagggtgaatctttggttccgtctcctgttttttcaagacattcaaaaatcatctgtgatattgtcatttcaatgctcctgcctttttcatcacccaattccttataagcaaaatatttatagatatgagctctcggactaagcagaatattgacattgacgtattgcacaacttcttcaaattttccttcattgagccaatcctgtaagttttcaaggtcttcggaataagggtcatattcaggatcactgattaccagttcacggcatttcaggaatgtttcctttgtcggatctgttaaaaattcaaatactttctcatacgttttcattgttatcttcggttatagtttttagttcccgccagaatgcgtctttgtgcattccgaattcggctgttagcagtttattgataaacggaatttctgccagtttatactctcttttttcaacaattctttccagatatagttttctgtaagtattgtctgccagttcttctgtccagttcacgttcgtcagatcaaggtcataccctattccggagtagtgaaactgcatcagaatattttccagcatagcaatcaaaggatcttcaggatcaaccgtatttaaagcaataatcacctgtggtaaaaacctcagcgataaatctgccgataagatagaagaaatatctcttgttcctttgaatccgggaataagcttttcaatatttttttctgtattttccctgatgagataaagctgagtactgtgatagagaactttagcagcccaaacagcagcttctttgttgcaggttagccggtcagataaaaactcaaggcgttctttttcgaattctgtttcaaaataatctcctgcttccgcctcttcctgaggggagatttgctgtaagcttgaaaaaagagtaatgcattcttccttacgaagcaaaaagatcgtgtctaaaaacggtgacttggtttccatgatctaacaaaaataaaattatttcgttgagaataaaatttttgttgggaagattcttgttaaatatgggttctttatggcggttacaaggttggaaaaaagcaaaggcgcgaagagaataagtcttgtagttatttttaaggcgcaagaaaatctttgattttcagcaaggctatcccttaatgagttgcttcatttagaaatagtatttatgttattgaattttacaagagataaaatctttgcgtccttattacagtataattataaaaattttgcgtctttgcgtttttaaaatcatcaatagattgcttcgtcgctaaagctcctcgcaatgacttactgtgatacaatttcaatgatattattttccggatccagaatgacactttcataataaccgtctcctgttgtacgtggttctccggcaactgtatagccatcttttcttaacacttccgtaagttcatctactttttctttactgtttaccgaaaatgcaagatggatgattccatactgctgggattcgtatgagttttcactttctttgatatccggtctggtcatgatttcaagacggcagccattatcaaaacttagaaaataggattgaaagtttttaacagggttatggtatttttcattagaaaccgctccaaaatatttctgataaaatgctctggattgttcaagatctttcacccaaatggcaatatgttcaattttcatttgttaaatatttactacacacaaaagtaaacaggccgtcttcacgatacctgctccttattattattttattgttctgtatttaccggattatattttgaataatgtaaaagactttttatatcatctcatttatagcacttattcctaacatcttatgtattctgatcatgacaggcaacttcattgtttacattgatgcaatacctgaaacaatctaaaagttattatctttgccccattcaaaataacattatgagtattcacatcagtgcaaaaaaaggagaaattgccaaagtagtattgcagccgggggatccgcttcgcgcacagtatattgctgaaaattatttagaaaatgcaaaactggttagcaaaaccagaggaattttttattatacgggtctttataaaggaaaagaaatcactgtaggagcaagtggaatgggtttcccaagtatcgggatctattcttttgagctgtttacagaatatgaagtagataccatcatcagaatcgggacttgcggtgcttacaatacggatcttaaactttttgatattttaaatattgataaagctgcaagcgaaagtacttatgctaaatacgcatggggaattgaagacgaaatcctttctcaccagggaaatatcttcaataccattaatgaaacggctaaagaactatccttaaacgcaaaagcaatcaatatccacagcagtgacattttctacagaaaagatcctgctactccggagattgctacaaaatataactgtcctgcagtagaaatggaagctttcggtttatttgccaatgcccagcatttaggaaaaaatgcagcaactattcttacggtgacggatattatcccaacgcacgaaaaaatctctgctgatgagagagaaaaagctttgaatccaatgatggagctggctttggaatcggcaattaagagtttgtaaaaggtgtaagagcaaaacagcaaaacagcgaaaaaacgaatttgcaatttgttatattttagtctttttgcggtttggcaattttgctaaaaaaagagctttacttcatcagtagagctcttttttatagtctgaaaaaaattccggcagtttttgtagtttcgtctgccacttcggaaatgctgatcttttttaagtgagcaattgtctgtgccacataaggtaagaatgaaggttcatttcgtctgttctgcgttctgggcatatttttaggaagcataaaaggagcgtctgtttcaatcatcatcctgtccagaggtacatattttataacatcttcgagatatttaaatcttttctcgtcactgatggctcctgtaaatcctaaataaaatcctttatccagataggtttttgcttcgttcaatgttccggtaaaacagtgtacaaccgcttccggtagttgggaaagatattcatctgtaatctcattaaatcttttaaatgcagatctttcatggagaaaaagaggtttatccacttctatagcgagttcaagctgtgcctgatagcatttttcctgtacaggtctcggcgagaaatccctatcgaaatccagtccgcactctcctactgaaactacataatcgtgtctcaataatttcctgagttcagcaatactttctccgttaaatgatttggcatcatgaggatgaattccggctgttgaaaatagaatttccggatattcttctgcaattccggcagattctttacttcctttcacactggttccggtaagaatcatatgctcaaccccgtgatccaaagcacggttgataatttcttcgtgttcatgatagaactgtttattggtcagattaatgccaatgtcaatataagtgttcattttgttttttacttttttataatttccttaattattgtttttaacttcggcaatgctgatgtactgctttcccgaattgaataaagtgttttgcttcctttcaggatataatcaaaataggtatcactttcagggttaacaaggacaatccacctggctctgatttttactgtttctacaatattgacaggcaacgcagtagatcctgaagttccgataacaaataaaatatcggtatgatcagcaatatcataagcagtatcaaaatagtaatatttttcattataagactcgtcaaaccataaagtatgaggtcttagccagcttccgcatttcttacatttcaaaccgtcaatatcttcaggtgtaaggtcttctgtatactctttctgctttacattttccgggaagtcaataggctcactgcattcttttgagcagcgcactttctgtttatttccgtggatttcataaaccttttgggttcctgctctttggtggagaccgtccacattttgggtaattaacttaaatctgtcgcccaaaagattttcaatttccgccagcgcaagatgtccctcgttgggttgtgcttcagtgataagttttttccagaaaagattatactgccagacttcttctgtttcctgtctgaaatattgtaaggttccaaattcttctggacggtgatattttgttcctttaatccagattccatcaatggaacggtacgttggaagtccgctttcagcagagatacctgctccggtgagaaaagttatatatccttttttctctttaatgatggtatgtaaaattgattctaattctttcataatttttaatttaaaaaatagaaacaggtcgggtttgaaccaacaactttcctttgagtggaaggtttttccagttaaactactgtttcctgttttatgtttcagctctgaggagattaaagtactctgaagaggtcaaaggtctgatttctccggctggagccattttttctttcaattcgcagatcagcaaatctccctgtctttttaaacattttatatgaggtatcaggttactatgtattctgaaggtagaggcaatagctgttaaagcatcatctttatactcctgttctatccatagccaatgttctttttttgtagacggacaccagcatttcacagcataagaatattctgctctgcttccccagatgaagactcccaatttacgattttcaacttcgtgaacttcataacgattgacctttcggatcaattttggatttccgtttttgtcgtattctacataatcaacttcaatttctttttcattgatcttttgggcttccagtttttccatcagattcccaactccataatagctgaaacagaaaagtttaaagttgcggtcttcttcattaaagaattcttcaaacttcatcagttccactttatcccacaggctttcaattttatttaaaatctgtgtaaaaaacggagtatcaaaattttcccactgtctttcatattcacgcgtcacaaaattctgaaaactgctgtgccgtaattttaaaatggcaatcagctttctcaaaggatggcctttttcctgtaaaataaaatggaaaggtaaccttgagacaatgaactgatcttttgtaagatagatattgttattaattttaaaataaatattctttgcgatctgctcaaaaccatcataggtaccatacaaataattgctgacacaacccaaagccggaaactgaagctcctgctgttttgaatcaccccattctcccaaatattccaatgatttaaaatctacacgaacatccgcatgatatgggatctgaatttgtccgttaattttctgaagacgtccgaaatctacattttcatggataatcagatctcctatctcagcaatattaggagcaacggttttgaacgcattgaaacttcctttcacgtattgaagtgcatgcagatagcagatttcagaaccataatattgatagttcccgttaatatctgtcaataccggaaatgcgactccgcttccaccgttgataactacgtttccacatttctcaagcgcctgaaagttcgcataagagccatttagcagatcgatatttccgctggtttcctgaaggtttgggaatacaactcttgtattgtccagtctcagattaccaatcagctttttcagctccggaaaatgatgggtaaacctgtgtccggatgcctcattacatcttattctaagcgtaccatgaacaaattccagattcggaaatgaaatatttttacccacaacattgatcttaccccgcatttcccgatgaggaatcacaatattatctccaatgatattgatatcaaaaataccatccttcagaagcgcatcggcctgaaactggtactgaacaggaataacaactcttgtcttcagcagctgaccattcctggcatataccttagtattttttacagaaacatacccaccggttatttccagatttttaaaggtagcatctataatacatttgaaatgaccgcttacttttttaagctgatccagctgggtacggcaatgcattttaaaatatccttccaccgtttcgagaagtggaatttcacagttcggtgcatcaatagaaagatttcctttaatgtgtttcagttccggaaaccggcagccttcgccacgcaaaagcaggcttcctgatatttcggtgcaatggaaggtcatatttttagcatatacctctatccaagcatattcatcaaaaacaatattcgcccaatcttcttcggagaatattttgtatcgtcgtatggtgtcagtcgtaggcattttctatcatttgggttatcgggttgtattcctgctgaatatattttacaaagcaatcactttctatacggagcatttcatgttcattatgagttataaaagcatcttttgcaatcaggaatgtttctgtagttccatttttcgcatagatatgatagtcttctgctttcagcatgtgctgattgcttgttttctcaagacagtattctttataaccttttgtatattctgtcagatttctaattctgttcagatagtttctgttggattttctttctcttcctgttgagaagtattccggtatattctcatttttggttaccagtgtatcctcaagaaattcctgtttaatttccaacggaattacttctgtttttctaaccagttctgttttaggaattcttggtcttgtacttctttcaaccggtttcctttccttccactgcatcggcaccggaacttttacttcatcaatgatgttcaaaaaaatcaataaatctttaagcatggtattattttttaaaatgaaagccagacagaccgggatcgaaccggcaacccatcctccgtggacatgtttttccagattacactactgttctggctttctggttagggagataagcgtgattcgaacacgcaactattctgggcaggaattatttttccatttaaactattatctccattatttaagttgggagtacagcaggactcgaacctgcaacctcgtccgtgacagggacgcattcttcactgttgaactatgtactcctgtgaaacgggcgggaatcgaacccgcagcctctggcgtggaaggccaacgctcttccgttgagctaccgtttcaagagttgggagataaacaggaatcgaacctgcaactcattttagcaaaatgtatttttccattattactattatctccgtatggattttaccaggtatgaactttataatttttcaataaaactccactgaagtaatttccttttattccttccatcacaggatgcagaattctggctgcaccatccacagagtccaacggtggaatgtagcccatttcaaactgtctctttctgagactttctttcgcgcccgtggaaatccatcccacatctacggcactcatatagatctgatcattttcaaattcttttgcagacgttaaggtcatcatattcaaagccgcttttgtcatattggtatgcgggtgaaaaatggttttattttcatagctgaaaattccttctgatgaggttacattgatgatgaatttttctttaaacactgagtttttcatcaatggtttcagttctttgatcagaaaataaggcgcaatatgattgatgagattcacctctaccaattcgtacatggaaacttcttccagcgtggaattccagcttgttttttctctgttatcaacaggctgtccgaaacgggtaagtgctacttgtgtttcttcatgataagcatattccagtttcgcaatttcacttgaaatttcagtctgattcgggatcagagtatgaatatttttaaattctaccagtttttctttttcacgctttattatcggaaggtaatattcatcgggatattttatggtctgtgcagcattattgatcaggatatccagcgtatcaaaattgaatgtataaaaattgataaaatcctgaatagcctttagatttctcagatccaaaccgtaaatccacaatctgtctttccattcgttatagtctgcttcctgctgcatcaattccatcgccagtgccggaaaacgggttgtcaaaaccagattggccccgcctcttaataccttcaatgcggtggcaaaacctactttcactcttcctcctgtcagaattacatttcttccggtaagatctgccgtttcaaaacgcttttcgtagttctcttcagcacagacaggacataatctggaatagaaagaatgtgcatactgataactttggttacagcagtagcagtttttgggaatctgaagctttgtaagtttcacttcttccttttcatcatcataaaaagcagaaacgcctgccaatgctttctgcattaatactgaattggaatttactgccaggtcatgggatttcatttctgaataattctcgtgacggctttgtttttttgcacctttatgaattttggtaatcagccctgaaaatgttttattatcgggattcagaaaagggttttccttcaaagcattcaaaactttgaggcaggtttcccattcttcatttgaaaatttttgatctgattgattcatagcttctgttttatatctgcaaaactagaagctcagtgcgcaatgtttttacgtagtaaaaaagaagataaaaaaggcgaaaaagtggaaatgtaaaatcttccattaaaggcaacgacaaggaaaagcagctattgtttaaaagaacctgcaaaatctgcgagagttttattttcccacgaatttcacagatggcacagcggtttgtgtttattcattgataaatttttccagaaagccgatcagctttgttcctccgtggctccaccggattccatggccctgcttttccctgacttcaaaaacaagttcatgtttatagtggaagaaaacattccaccaggttttattttctaaaatttcatggattttctccattactttttcctgcttctgttgattgtttcctttgatttctccccagaacttatcatccattcttccgatatgtttttcccaggctctctgggcaatggtgatttcgttattgaagggctcctgacaagctttgataaggatggctttcaaaggtggaatagcgttttcatcacgaatgctcgctgaggttaatctctgtcctaaaacattcagccaatgttcaaacggaattgcttccagaagttttgtcttcacctcatctgaattgttactttcgagaatggtaatcagtttttcaaaactttcttcgcggttgattattacttcttcgttaaaataaggtgcatccagttccagattattcttcttaaacttaaatatattttcttccagatgttccagatgttctctttctaaaatggctttgtaattacttttccatgcttcagaaaaaagggaaatataaggttcaaacagattcatatttacatcattttgatcagattaacagagagttttttttctttgatcagatatccgatcaggttaaaccatgctttacaatgatccagaatccacgcatcggaggaaataatgatttctgcactttctgccagtattttatccggattatattgcagatctgcttcccaattgaggtggtgctgttctgcaaaatcaagaacaatctgtttgatccgtccgctgtttgaaacaggtttgtcaaagatccataccagtttttcaatttgatttttcctgtaaaaagaagcaaccaattccacggctctcacagtttgattcactcttttataggttccgtgaactccggaaagatcacggaaacacccatccagtccttcaaaaatataggcttcggagagcagactttccagcaaaatcagaacattgaaaccgtcaagatatacggtctctccttttaacgatgaagaatttacatgcttcaactgcctgttttgaagctgtacagcagaggcggatgcaccccgtagagcctgtatctgccgggttttaagtctgtatctgtttcctacgagttcagaagctgctttttccggatagtctctggtcagcagataatgcatgtcttcaacagcgagtttcagcttgctgatctgtttctctgaaccaaacagagtgtcatcacctgtattttttccacggtttctgttattcatgctcaaaaatagagtttttacggtaagaaatattttttatctgagaatattaaaccatcccgtcaaaaattctttgaattttcgcccctccaaggagggaatcgagtgcttcaatattaaagcctttcaattatatgattttcttcttaattcatgatctgttatatttactacaacaaaagagatattttgtacaatgtattgatatttattagggataagtttgcaaagacttaaaaattcccttatgaatacactgaaaaaattatgttacctgtctgcagctgtattgctaacaacatctttcgtttcatgttcaaacgatgataatgaaataagtatcgaacagcagactccctcacaggttctttcttctactccatgggaaactaccggagcaaaagataagaatggaaacaatgtagcccttactgatgccagcgtagccggatacgtaggctttgcttatttcaaggcagacgggaagtttgctatttacaatctgactgacgtgctgcgatcaatgggaacctggtctgtggatgcacagggaaaaacaaggactattgcagcattaaatccggatggaacgactattttcacccgcgatgttgaaattcttgttttgaacagaaatgaattcacttacagaatccatcctaacccgagtgatccttctctgtattatgacatcatccatacaagaacctctcatgccgaacctactaacggacagcttacacttgcttccactccatgggaaactacgggagctaaggataagagcggaaataatattgctttaagtgacgccagcgttgcaggttatgtagggtattcctatttcaaggccaacggaactttcagaattttcggactaaatgatgtattaagatctgaaggaacatggtctatttctccggacgggaaaaagagaacgcttaccacacctacttttacccgtgttgtggatatcctggtcctgaacgaagccacattcacttacagaattactcctgatgcatccaacccagctgtattttacgacatcatccatacgaaggtaaaccataaggagcctttgtagtgattatttttttataataaggaagaacctgctcagtgatgggcaggtttttatattaatttacaaaaccacaagcctttatttaaaatactttagtttacttgtaagtttaaatggataaaaataatctacatgaaaattcagacaacttctgtttattcatttatctatattcttcccaccattttttccagtttgctgattctaactgattcagattcactttttctccaatcattgggagtgttatcggaatattattttcttccgcatgctgtgctgccagctccaaaggttcataccatgcatgctgtgccagcttgaatttggaattgtgtacaggaatgaaatttgtggctttcagttcctttatttctgttatcaactgatcaggcaaagtatgtatgtagggccacttttcattgtactgcccgttttccatgatggccagatcaaacggaccatatttgtctccgatttctgtaaaatgattaccataaccgctgtcaccgcctaaaaacagattttttgacggagtttttaaaacgaaagatgtccagagggagatattacgattcagtaatcttcctgaaaaatgtcttgcaggagtaagagtgattctgaaaccttcagcaatgtctatgctttcccaccagtttttctcaatgattttgtcaaaactccagccccagtattcaaaatgttgtccggttcccagcccacaaatgactttacccactttatcttttaattcctgaacggttttataatccagatgatcccagtggtcatgggagataagcaggaaatctatctccggcatatgttcaggcttataataatcggctccctgaaaagcttttactgagcctggcatcggagaagcattaccactgaaaacaggatctatcagaaatttctttccatccacctgaatgaaatacgagctatgcccgaaccaaaccaaaacattttcttcaggctggaggtttttcagatcagtgattacaaacggaagtgccgctttgggtgaggtattttctactttacacaaagtatggaaaagcactttggtcatgctttcaccttctaacagagcaggtgttggcaatatattctgaaatcttccattaagataattgggaagtgtattgaaatattcttttcttttttcatcggggaactgcccgagctgcttttttaaatttttcattcgcttgatttttacattctgagtcgttcttcttccagatcaagcctggttaaataatgtcttatatattcttcgtcaatattaggattgcgtctgttttcttcccgaagccagattctttgctgctcaagggtttcgaaataaatttctttggcttcttcggacagcttatggatagagtcttctttatcttcctgctcccagcggtccatcaatttgctaaaatattcattttctgttcttctctctttataattttcattgagatacctgaaggctacccgtcgcatttctcttctcaaaaattgttcagattcttccccggacatatatcctcctccggaatcggataaattaagctttttaatcagtgccggtaatgtcaatccctgaataatcaaagtagcaagaattacaataaatgtaatgaagagaataaggtcacggtgcggaaaaggttgtccgttttccatgacaacaggaatagataatgcagcagccagtgaaactaccccacgcattcctgtccagcccatcaataccggagctttcattcccggatttctgtctgctacattgatgaaattcctcataatcaaggttacgaagacagcaccaaaagaagagataaagcggaccagaatcaatacagcagtaattaataatccataccctattgcatcggataaacttataccctctttacgcaagcctaccaaaatttccggcagatcaagacctatcagtaagaatacaattccgttgatcagaaatacaaagctttcccatacgttggaccctcttaatctggattgtgaagttctgaaaatctgatgtcttctcacggaaaggaataaaccaccgcttactacggctaatactcccgaggaatgcatttcttctgctgcaatatacatcacatatggcgcaaccaggctaaggattgcatccatattgacatctgtaggaaatattttttctatttcaaggaatataaaagccaatacaactccaattcccaaccctccaaacaccatccatccaaaactcaatgccgcatcctgccataagaactgtcctgtagctacggccaccattgcaaatctgaaaataatcagtgaagaagcatcattaaataagctttccccttccagaacggttgaaaggtttttaggaactttcacaaacttcaaaatagctccagcacttaccgcatccggtggtgatacaattcctcccagcacaaagcctaatgccagcgaaaaaccgggaatgtataagttcgctgcaaaagctaccgatattgctgtaaggaaaactacaatgaaggcaaaactggtaataatccgcctcattttccagatctccttccaggatacggcaaatgctgcttcatataaaagcggaggcaggaaaataataaagatcagttcaggatcaattttcaacaccggtaatccggggataaaactgatcaggagtcctgcaataaccaatatgataggataggccactttcaaccgattggccagcataatggacccgataataacaaggaccagtcccaaataataaataaaattttccaccattgtcttttcaattaactttaaatcaaatttctatttttgaccacaaaatttaatagaaaataaatataagcataagattctgagatgtgaaaataaattacaagcagtgaaaattttaatcaatgattttagagtaaatacattcatatttagaaaaccattcagccagtcccaacataattaatcccagtattgagcctgacagaattaatacagctaatgtcttcgcaaaagttagccaatatgtctttcctgcaaatgtgaaatctgtgggattaatattgtatgcagaataaacggaaggattgatacgcagatccggcctgaagtaaacaactccctgaatatatcttctctgtaaagctttgagatttccgatatagcaactgtaacctgcatctgctccatcaaaatctacgtttattacggaaccgttatagtttactttcaatacttcaattttatttctcgggctgagatttatatcatattcatctgaaaggcaagatttttccagaccatgataaaggattctatcaattgttccatctcttctttcataatgaacgcctgtatcatccacaacaatctttctaacttctctttttctaaccctcttctgataaagaataaaatgatataaaccaaaccctaaaactggatagtaaaccaaggctgctataacaaatattgtaattgttttgcacagtattaaaggtaataccatcaaaattaaagacaccatcaataatacaagcactcccaacgttctggtaagccatgtcatgaaccaccatggtttggaaactaatggtaaaaaatcttttcgcacattctcctgcatttgttgaagatacggaaaaaattaaaaatgctaaagagccatagtagtataccatgactcttttacccaattgaaaataagatataattaaactgaaactatgaaatcgtatatgttttttctgtcgttgtattgtatatatcggaaatgacattatctacaaatctccattctgcaacagaactgcctgaagtaaatttcacatgcagatatcctcttttataaagattggcatattccagatcatcaatcaacagggaaaatgcctgtgccagttctattgcttttgcagggtctgaagtgattcccagatatccttctaaacctggagaagaaacggagctgcacgccagttctgtcccgataaattttccctgggcatcggtaagctttcctagccatgcattgtgtgtatcacctgccagtactatgacattctttcctgcaagaacagaataaagctgctctctttccataaaatagccatcccatgcatccagattgtatggtaaagtagtggtgattcttgcaatttcctgcggcgttaatgtaggatcctgctgtttgtatcttgttttaaggactattagttgggtgatggtattctgaagtgcctgcatcgtagccggttgagcgcttccatgttgtttgatctctgcaagaatctggttcagtaacataagaagttctgcaggaaccatcattttcgtcattaaaatctgctgaccaagaactttccattttgccgtatcaccattgatctgcgaatttagccatgacatttgctcgctcccgatcagccttctgcttgtacttagaaaatctgttttaaactgtatctgattaaagttcccggctgcatccagataatccgagtattccatctgtttatctctcgcaatcactcttgtatccatcatgtaaagagaaactatatttccgaagttgaaacttctgtaaattctcatatctttccccgtcttaagaggaatatattcactgtatgcctggaacgctgccatttttcttgcctgaaaatctccttcgttcggctgatggttttcggctccggatttataggtatcattggcaaattcatggtcatcccaaacacagatgaacggttttttctgatgaagaagctgaaggtttttatcgcctctatattgtctgtaccgctctctgtaatcagtgaggttaagaatttcttttgcgggtagatgagctctgcccaactgattggtgtaaggatttgttccatattctcccggagcatattcataaatataatctccaaggtgcaccactacatcagcttcagattttgcaatggctccatatacattaaaaagtcctgcaggaaaattagaacaagaaactacttccattttcacttcacttacagcatctgattttgaaggtaaagtaagcgtttctcctgttacgctgacttctttagttttactgttatagaatctgtagtaatactttgtgttggaggaaatattctgtacatccactgctaccgtaaaatcattcactgctgtagcattcacctgtcctcttctcacaacttctgaaaagctactgtttttactgatttcccatgtaatctctgcatcagttccttttgaataccgggtccagataataattcctgtagcacttgggtcaaaactagctacaccggattcaaaacctccgtttttaagatcatcaggtgcatttccgttttcagtaaaatcatcgctgcagctttcaattaaaggagcaataaaaaatcctcctgccgctaatagtgaatttttaagaaatcttcttctgttgaattggttattgttttccatcattacttttttttgcaaagcaacggtatctagggaagaagactgttaactgtgttttaaatatattttaggattttttaaacacatgtttaatacaatgtgtgatttttaaatatctaataagaataatgtgcaatagttttataatgcctgaataaataatcatagatcaccatttcaaataatctttgattagaaatgaaaagcctattaatattcatatgaaatatgctttggaaaaaattttgcaatgacatttctaaagactgattttcaaactgatatataatattttcaaatatagtattgcttacttcaatgttattaacaataacatctctttcttccgaaaactcagcagaatgaagaaattcaagaaactttaatttgaattctctatattttttatctaattgtgaattgagttttttatctgcatggaattcttgtttaaaagcattattgaaatcttttatccactctagtttttcccggactgaaagattgagatgagtcaaaatttcatcaatataaaaaagtgaaacaagtattttttcctcatcatcataatgaaggcattgcagggtaaatttactgtttcggcaaaataaagtttcggcatcttctatggtgtattctccataccgttcaatttcccggttataggtatcaacctgaatcgtagaaatctcaccgctgtctatatattgttcaaatgtagcagcaattttatcaaaagtctgattataatattcagtattttgcaatttaaatcttagcctcaaatgtggtttcggatcattgtaacgaacgaaaaaccactttgaaatgtagttgtgttcctgaaaatattcaacaagcggctgtatagcatcttctaagattaaatcggcagtttttacccctgtatagattttcaggtacagccattcacttcctggaataaaagttcttttcattttcatcaattatcttttctatacattggaaaaataaactcccgtttaaagtcatcattttcattatgtaaaaattcttcaatgataataaagttttcattttttactgaatcaatcagcatttttatcagatcgtaattttctaagtttacggtaagtttattatcagatttaacccattgtatccattgcggaatttgcttcagttttctccagttttccaattctgaaaaaagttgatctttatcgtctatcaataataaaaatttctttatttccttcttcgtgatcttccaagaagcttttgataaaataatgtttttatattccactcttggtaaaaagttatatatatattttaaatctccccaattaaaatatagtcctgaccgaatattttgtgaatgtaagtcacaaagaaaatgataaacaggtaacgaatttgcagaataattatgtgcgttggtaagataaggcttaacttccttgttcaatctcttggaacgaaggactatcctattattttttaaagagataaatagatcatctattaatatttggttttccttgggcaaaacagattgggctaagtaaggaatttcatattgtctaagtgttggtcttctgattacattccctattcttgcatccggtaagtgaataatttctgctaaaatgtagtcagaatttaactcttcttctttgttagcaatttcttttgttagattttgtattcccgatttttcagaacaaaatcttcctaataaacttccagcactacatccgtcacttccgtttaaaaataatttttcagaattattttcagaaataatttcagccataaaggaaatagtatctggtaaatcatcccagttttcttcaaaatctaaaaaatattcgtcaggtaaattgattatatattgaccgtgtgttaaagcatcctgtaaattttcatttaaaatttgctgaataggatcaagttcaatttttagatttgatttttcatgaaacgaaggaagttctaaatcttcaagatagggatataatccttttgtaacagcatcctgacgataccctatgcccacctctgtgtctaaagcataattcaaagaaacttcctgtgtttcaaatctatcataaaaagcttttttgaatttctctaaatgagtttctttctgagaaaaattaattttattaagaaaactaattcctttttttaattcttttttccaaaaagaagaaaggtttagtgttttattttcgtacaaatcagtctgaaaaagataatttggtttaaattcaatcttaaaagatttaatcaggctttcaatttcaaaataattcaaaattgaattttcaatattttgatccaatccatttaatttctttttgattgagtttagtatatttatttctttttccgcttttattctttccagaactgaaattattttttccaaataatccgttccagatataacagattccagttcacttacaagcacttgattgcatatgagttcttctataaattctatagcttcttcttctgtaatctcatcatcaactatactttctgcaatttcttgtagggttttaccttcaaaggaaaaattcaatacatgatacaatacttcagaaagtggagctgaagagataatatattctcttttttctttggtgtattcatactctacaaatcggattttatttccaactgtataaatactattgttagggaaaaacaataattggtttctgatttcaggaacttgtagaaaatgctgaactaaaccaataagtaaatgcgtgtctaattttgtatctcttattttttcatgagctgaactgtaattatttagctcattgttgaaagtacccaaaccaacttttgaaaacagtccaaagggggtgcatcttgtacttgctctactgaagtattttaaaattgtggttttaagcttctgaaattcctttaaagaaaattctttttctaaattaacccatttaatcaaatcattatacacatcaggtgacgcaagatagattgcttcttgaaaaattgcggtattgcagattatttttaactcatcatcagaaatgtaataattatttgctttttcatggaaatttttatacgaaaataaaggagtacggactacatactcatcaaagaactgatacggaaaacgagccatttatttttttattttttcattttctttaggctggtattcaggatgatctaactgccataaagcaaaggcaaaaacatctgatagatttaagtatttttgttttaagagaagatcacgtccaccatgtccacccttatagtctactttaagtaaaatgggattcttagaaacattactatttgatagtaatttcgcagcaaatttaacaggcatccatggagctactcgcggatcgttgattccggttgtaataaaggttgcggggtattttgtgtttttttcaatatgatgataggcatccatttcatacagatctttaaattctgattcaatatttttagaaccgaattctttaacgctatttaatccgtttggcattgcctcaattctcaaactatttactattcctgctgttatgatagcaactttaaacagatcaggtctttcagtcatagctcttcctaccgtaattcctcccgcactttgtccccaaatagctattttataggcagatgtataatgttcattgatcatatattcagcacatgatattaaatccttccatgaattgggcttggtatttttaaaaccacctaaatgccatggttcgcccttttctgctcctcctcttacatgggcaatagcaacaattccaccttttaatgcccaaagcatgaatgtcatatctaaaaatggactattattaattccataagcaccataagcatctatcaaaagaggattatttttatttttcacaagatcttttttatatattaaagaaagcggaatatcaagtccgtcatgtgatttaacagttatttcttttactataatatctttgaattcaggatattctacaattgtagctaaattttcaggagtaaactttttggtcattgaatcaaatttaaagcgttcattatcatttttccatcctgtacaatttatccaaaaatcattggactgattatcttgagtagttacagtaatatcacctgacgggaatggtaatgtcaggttttcaattttattattttgataaagatatagtttagcttctacaccattttttgaactgctaaacacaaaaccatctttagtttgataaagtccgttaattacctcgttgggaatactgggaattattaggctaggattcttaaaatccggagatttcaatgatgtacaataaatggcattcacaccatttttctctgatataaaaattatactgtcattttttacaataaatccattaattttttcctctttagaaaagagcagtttccattgattttgtttattgataagactaaccggctggaaataagtatcattaaaatttgtagcacccgctatatagccaaatagatattggctttcttttgtaggaagcttcactataggatagtcttcaggatttatttttaaattaagattgtttttttgtgataaaattacattcaattctttcggattttgtcctattttatagacaacagcttgcatatctttcataaaccggtctgaatgaggatctgttacaggaaattgaagataaataaaactgttattatccggaagccatgaaatccctcccccatttgttggccagcaatttgtaacgaggtctggaagtattttatgagacttcagatcatatataaccatttcagaaatttcttttccactttctgttagagcaatagcaaccttagagccatcataattaggcttaatataattaattataaattttttgccagaatctaggttataattttcgggattgaaaatttgcttttctataccgctaaatccttttctgtaatataattttgctgtattttcatcagcacttttctttaaataaaaacaaaaatcattttccgtgatattaattctatctacggaaaatgattggcgtttatcaaattcaattcttttattaatataatattctctgttaggaattttattaagaacagaatctgaataattggtttgagattgcatccagttaatgactgaaggatcttttaaattttcaaaatttctaaactcatccacaaccttaactccaaaatagttttcaataactggcttcgatggggctaaatttgttttttgggcttttaccgtaccaaaaacaaaatgaatgaaaaatatgaaaattaatcgatgtatcattatacggacttatcttgttttaccagtacctgtcggctcatcatcttcattaaaaaaattcaaatcgttactaccacctctgattgagttaagattgttgattttggttaattgtatttttcttaaagataacttttttaagggttgctttttctgcttcatcttgtttttattatattatttaaacgtctgacaaataacgaaattaatataaacatattcaagaattacattccaaaatttataaatatcgtacaaaaaatattttaactagctggttatatgtgagatagaaattatatttttttatcttttaaagcttttataaaataagaaggcagagtatctgtaatctttttaaaagctttagtgaaagattctacattattatatcctgcttcatctgcaatagctgaaattgtaagcttttgtaaatttttattttcctttaattcatcaataatataattaattcttaattcattgagatattgaggaaaattttgccctttcagttcgtttactagtttggataaataggatctgtttgtattgagttcttttgataataaatccaaattgatcgttttatctaaaaaacgtttggttctttcgaattcttctaattgtattctaagttgtttaattttattatcaggtagatttgatagcttagatttttcagtttcttgttttgatgaaaggtaaattaatttattatctgtcacatcaacatcttcagggataacctcttttatatcttggcttctaactaataagttggctttagattgatataattttattttttttctatttttaatttgtaaaaatatcaaactgattataagcaaaatacccacacccaacaacccaaatagggtataattcttagaatgtaaatctgcaattaagttttctttttcattcaagagaagtggcgtatcatattttttattgatttctgcagacaaaaagctgtaatttttatttaatatgctatctacagacaataggtgctcaatataaaataattgtttttctttatcccctgtttttttataataatcaattaaaagtgggtaagtatttcttagttcataggaaacatttttacttgctattataattgaatctaccttctcgaatcgatctatgaaatttttgttattagtattatataaaatttgtcctatataatattcactcaaagccacattttgaatattatcaggatctttagtgaagattttggaagctttctccaaaattggcaaagcaagtttgtaatttcgttgtttgaaagtattaatcccataaactaatgataaagaagcatataagtcctgatctttactttttaaattttgctcaaatccacgtttgacatagtaatttgacgaatctaaattattacttacgtgataggcataagataaattatataaacatttctcataattaatatgatttgtaaaattatttttttctaaataatctttatatcctaataagagttttaaagcctctggataattctgcagttcaagctttagtaaacctatacaagaattaatattttggtaaacctcactaccttttttagcgtagctcttcgcaattaaataattatctaatgattttaaataatccgcagtgtaataataataaactcctttatatctatatgcttttgacagatattcaaggttttgtattttcctggatacaattatcatactgtccaaaaataaaagagcttgtttatctctacttattttatataataactcatatccatcagctatttttttatcatttttattttttttcccctttgacagaattgtattagcatagatttcagccttggttttattagtataaatatttttttcaaaatttttctctaattgctcaaaatcttgattttttagagagtcagcaatttgaaaaccttttatgctttgagaaatgcataaactagaataaaaaaaaattaaaacaaataatattttatacatgggtatttttcaaatgcaaaagtacacattttgaatcttttttattgccaggataaaacaaaatacaaacaactgataatcaatattattaatacctgaatttacaaattccttaaagaatttttaccaaaatttataaatcccgttatccttttcttgcgatatcaaaaaagcacatgcatctttgctccgggtaaaaacacaataaccatgacctttttatttttatatctgcgcaattataaaaataaaataacgctgatcagcaaaaacccatgccagggtttgtatggcaaaattaattatcataaaaacaaaattatcatgaacaaaaaaatcagaaactcagttttcgcaggcggaatgacattcgtattcgcattaaattttttagtccctaatgtagttaaagcaaaaggtatcgcctatggagatcaaatacagtcttctaatacttcacgtgaggcaattgctcctgattcaaatgtatctgctgttgccggtaccgttcttcttgctgtaatggtagtatcagccatagtagatggtcttcatgcaacagatgatgtttcagcaaacatccagaatctggactaataatgattttatggctcattatattaatgggccatttttatctaaacagctatgaagaaagtaattaaaatatttatcgttgcctgtgtatcaatttattggcttttaacatttttatataattcgcccaataattttataaaaattgagcatcaaaaagaactgaaaatattttctactttttttgctcaaaaatggagtttttttgctccaccaccgcaatttaattacaaactttattttacttatctggatgagaataaaaatgaaattgctgcttttgaagtctactcttcaattatagaatcaaaacgaaatacaagaccatttaatggtagagcagaaatggtagattacacaatttatggatctatcgagggcgttgttaatacaatagtgaaagaaagaacagaaataaataccaaacaacccgaattaaatactgacaatgcaaatcttctggcagtgcaaaggctcaatgaagttcctgaacgggttcaaggttttctattgttaaaagactatgcaaaaattgttggaaaagataaaatgtccgcagagaagttaaagtcagtaaaatatgtaacaataaacataaattctgaagaaattaaaaagtttgccaatagagaaagcaaaaaaccaaatgtagaatctaaaataattgctttcaatccttatcctttttaaaatgaaaaaactattccactcaaatcattatatatatctttcggtattcaggatattgatatcaatacatgtatttaaaaaatatttacaactattttttaataaggatttaataactgatgctacatttttgaaagcagcacctgttaaccagacatttcagatatttggaattcagcagtccactatttttcaaaatattaatattattcttagtattataatgttgctaagtattttatttgcctttggaattttcaggtatttcacacctttattgttatacatttgtgtagaaattgttcaaagagcatatccttttatattaaacggaggtgataatctattaaaatttcttttactgtatatgatttttacggattgttacagatatttcacactgaataacagtagcggacaaaaaaaagacagtatcagctattttataaatcaaatatcagttttatctataaaaattcatttatctttgatttatttcgtttctgctatattcaaactcaatgctaaagtatggttcagtggtgttgccacttattatactttacagctagaaagatttaagggaacagaaatgaataatatattagcaaaaaatggaatttttgtaacactctccacctatattactttaatctgggagttagcatttccttttcttgcgtggcataaaaccggcaaatacattgtgttcgctcttggaataatgatccatatgggaatctatatttttatgatgatccatgattttgagatcctgtttatgatgtgttatggttttttcatcagtgatgaggaatgggaaaaagcaggagtatattttcaaaaaattgtatcattattcaaaagaaaaatatttagtaaggaatatgcttaagagatatctggaactgagattaaaattattgcttaaagcttctaaccaaaatatggatattggtgttatggtaagtataatgcttttatttctgcttttttttaaaacaaataataatagctattatgcattaatttcatcaactgttttatttatcattcactttacccgaaaggatattgactttctaaagaatattttaggaaaacaattctacataggtattgtatcagaatatttgataatttggatatttataaatttatttttcatcttcaaagaaaataattttatttttctgggaaatatttttatatgcttcatcttgcctttactaaagcttaaaaaatattttgccaatccctcgtttattaataaaattcctaatgcattattagagtggaaggcttatatgagaaagaatattataatcttcttttcctttgtattactttccgttttcttaggatatcatcctgcaactttagtaatattaggactatgttggttacatattctcctgcatgtgtattcactccaggaaaataaagaaattctcattctgcagttttcaagattaagattagaaaaaaaagtcatatactcttttttgatttgctggatcatctcaattcccgctataatcaactttgcctttttaaatcctttgcaaaaagattatatagtttattttagtctttatctttttctttcgaattatgttattattattaataagtacgccggctataatgaaaaaataaaggtaacccatgttaatgatgcagactttttcaaatttacacttataattgggttattaattcctgcaataatttatataataaacaatagaaaatcagccttaactaaaatcgcaaggtatgtttagtatacaaaatatcacattcaattataactctaaaaaaattttagatgaccttagtttaaagataaacgaaggaagcatatttggtgttctaggaagaaatggtgcaggaaaaacaactttatttgaatctatttttcaaaatacaaaatacactgggcaaatattattaaaaaaccaaccaataaataaaagagatatttcttatttggaatctgaaaattacttttatccttatctgtcagttaacgatattttaaatctgttaaaaaatgagaacgaggataaaaaggtaacaaaactgacaaatttctttaatattccaacagatgctattgttgaaaaactctcattaggaacaaaaaagaagcttgcaatcctttgtaatatcttaattgatagatccgtatatctatttgacgaaccatttaacggacttgattttgaaagtgttgaaaagttttattttattattgatgaattaaaaaaaagaaataagatcgttttgataagctctcatatcatggagactcttacaaattgcagtgatcatatcggtcatttacaaaatggaaagtttactaaaatttacctttcagaagaataccatttaatacggacacatcttacagaagatatccagaaagattgggtctcttataccaacatttagcatttaaaaaaactaatttctatggacaataaccttctttcattggagtatatttttattacttcaatagtaatcgctttatcctttacaggatgcatatatggcattgcatattatctttcttatgataattttagtatgactgctgttgctttctttcctattcttttattgtttattgcttttatgatagctgcaataagtttgtttttatcattaaagaaatacaggaatgcaaaaaaagtaaatcatatcggcaatttttattatgcaatttgtacgtttattcttagcagcattatgatttttttgattgatgttttcgtgtatgctttaattgacaaaactctgtcttttaaatatgctgaaacattgcaaattatatccaaacaatatgcggtgacgtcaaaaaatattaattacatgaaaaaaattccatttattcttcaaagtggagttatggtgtttacaggactacttgcaggaacatttttttcgctattcattttatctcaatataaaaacataaaaaaacagccagatttacaagccatttaaaaattcacaaatgaaagttattatttatgattctgaatgtaaattttgtacaagattttccaaatggagccaatcaaatgttaaaacgctggaaattatttctgtaagaagcaaagaagcaagaaaacttcttcgtgataaaggaataaagtttatagatcttcaaactatatattttgtgaatgataatgaagtttgggtacggtcaaaggcaatatttaaaatatttacgaactttacttctccctggaaatttatttcttttttctcttttttgcctgcttctattacagatttcgggtataaaatttttgcaaaatacagatactacttttaaaaactaacctatgaaatacttagtaatactatcattattttttttaattaatatcaaaaccaaagcacaggaaataaatcgctttttctatgaagtacaatataaacctaaaaaagattcttcaagaattgaaactgcgatgatggttttagatattaaaaaagataaatcaatctttaaagattatcaattaattgtttcagattcaatctccaacgaagtctttaaaaaaatgcaaaaaacaggcatttacgaaaatcagacaacccctccaaatgttagatttacctattctgtaacaaaaaaataccctgatatggatgttcaatatactgaggatattatgaacgggttgactcctcttacatttggctatcaggaaaaattaaattttgattggaaaattcagaaagaaaagcaaaaaatcggggaatataatacccaaaaagcaatattaaattttgctggaagaaaatggattgcctggttttgtcaagatcttccttttaatgatggcccctataaatttaatggcttacccggattaattgtaaagatagaagatgatcaacaaaattattcatttaccttaaaaggaaataaaaaagctaaagataacagtgaagattctcttattaaaaagttcaccaatggtaatgtgaaaatagtagaaaaagtaaaatttacaaaaactttcgaaaactacaaacaggatcctttagctgcaatgagaagtgaattaactcctcaattattaagtatgacaatgccaggaactgatatgaaggtaaaagattttattgaaaaacaagggaaagagataaaagaatcttacaagcttaacaataatcctattgaaaaagaataataatgttattaataaattatgtgtaaggtaatattattttatacaattatatcaacttaaaactaatcgtatattccaatagtatgatcctaaaataaaaagccccttgaacaggggcttttcgagtttttagtgtggtcccacctgggctcgaaccagggaccacctgattatgagtcaggtgctctaaccaactgagctataggacctcaaaacttggttaaattttgtgtttgcaaaaatagtaaaatttctttcactacaaaattttttatcgcttttcttggcaaagttctaccagcacgccgttggtagactttggatgtaagaagacaactaatttattatcagcaccttctttcggttcttcagagataaactgaaacccttcttttttcagtcttttcacttcatccaggatattttctaccccaaatgccagatgatggattccttcaccctttttatcaataaatttagagatcggactttcaggattactggcttccagaagctcgattttactttctcctgtttcatagaaagatgtcacaacgccttccctttccactgtttcttttttataggattccttccctaataattttgcaaaaagttcatcagaaccccctaaagactttacggcaataccaatatgttctagcttcataaatagtaatcaatataattaaatcgtaaatttgatactacagtcgaatttcaaagtatcaattcaaacaaaagtactaaatttgcagaaattatggaaagtaacagacaaagaaaagtagcacagatcattcaggaagacttcgcagagcttttccgcaaacaggctgcagaaagcaaacagagcatattggtatctgtttcagatgtaaaagtaactgctgacttaggaattgcaaagatttatttaagcattttcccacaggaattccgtaccgctgtaatgaaggagattgaagaaaacaagcctcaatacagaaactttattggccagaagatggcaaagcaggtgcgtattattccacagcttaacttttacctggataccgctcttgatgatgttgaaagactggaaagagaattaagaggcgaaggcgacaatcctgttttatagatcttgaagaatattgcattttacatagcatccagataccttttggctaaaaaaggaagtactgccgttacgtttattacgtggctggccgtgggtgccatgacggttgctgtggctgcaatgttcgtcattatttctgtcttttcaggacttgaagacctgaacaaggatcttatttccaatctgcatgcagatcttactttaaaaagcacttcgggaaaaacgatcaaaaacctggatcatgttactcagattctgagtaagaataaagagatcagcagtttctcccgtgttattgaagaaaaagtatacatcagcttcaatggaaaaggtgatattgcctatttaagaggtgttgattctgcttatgtcaacgtaaatcctattaataaagaagtattctacggaacttatccgagtttcaaatactctaatgaggtattgatggaaaacagtctggataacagactttcaattcctgtagattcctccaatcattatgcaaccatctttatgcccaagccgggtacggggatcatcagtaaggaagaagacatttataataaaagagatattctggtaacaggagttttccctggaaaagatcagctggacaattacattatctctcccatcgaacttgcagaagagctacttagccttcccaaaaaatcagcttatcagattgttattaaactgaaaaatccggaaaatgcagatgccgtaaaacaaagcttgctttctgcaatcggaaaaaatattgagatcaaaaccaaggaagaagaaaatgccgctttctggaaaatgatcaacactgaaaaactttttatttacctgatctttgcactggttatctttattaccacctttaatcttgccggagcaattattatccttcaacttgataaaaaagagcaggcaaaatcattgatatcactgggcttccctttaagtcatttaagaatgacctatttctataccggactccttattgttgtttccggagtaattacaggattgattcttggaacagcactttgctacttccagctttatacagaattcttcagagctaatgaggtattgccgttcccggtaaaaattgtaggcaaaaattatcttatcgtagcactcacagcttccctgttcggaattgcaatttcatggttcttttcaaaaatcagcaaagaatatattactaaaaactaatatattaacttcatatattacatacaattaatatacttcagtttcattttttcgtacctttacgccccaattttaaaaaatgaaacaaattttatctttttttcttgtaagcgtgactttcataagcgctttggcacaggctccggcaggatattataatcaatcgccaggattaacaggtgctgctcttaaaacagctcttaaaaacattatcagcaatggacatgtagaccatggctatggcggtttatggacaggctatgcaacaactgaccgtgattatttttacgaaaatgacggaaccattctggatatttattctgaaaatcccaatggacctgatcaatacagctatacattaggaactaaccagtgtggaacatactctacagaagggcaatgctataacagagaacatgttattccacaaagtttattcaacagtgcttctcctatggtcgctgacatacactttatccgtcctaccgatggaaaagtaaacggaatgagatcaaattatccgtacggagttgttggtaacatttctttcttatctaaaaacggatcaaaattaggaacatcggtatctccgggatattcgggaacagtatttgagccgattgatgcatttaaaggtgatattgccagaatgatcctttattttgtgacaagatatgaagacaaccttcccaatttctctactggagacatgcttgccaacacagcataccctggactgcagccctgggcacttaatcagtatttagcatggaatgctatggatcctgtatctccagaagaaatcgcaagaaataatgcatcttatacgtatcagggaaacagaaaccctttcattgatcaccccgaatatgttactcagatctggggaactccggttattgatacacaggctcctacagccgcaacaaacgttgtagccaacaatcctacttcaaactctatcaccgtaagctggacggctgctacggataacataggaatagcatcttatcttgtttatgcaaacggagccctaaaagctaccgtatcaggcacaactacctctactgtaatttcaggattatctccgcttacccaatatacattctatgtaattgctaaagatgcagcaggaaattcatctccacaaagtacaaccgctacagagacaactcttgacgggcctgcaggaggcggaagctgcggaacggaagatttcagcaccatgctggatggctcatcttcgccgtcttcatatgccacaagaacatggacaaacaataatatcacttggacagccacttcggcaagaaccgacgaaaccattaacggtaaagctgtttgtactaaaggatctttaacaagttctgttatttcaggcggtattcagtctctgacattgaccacacagagaaaatacaacggtaacaatggtaaccttaacgtattgataaatgatgttacagtaggaaccattccgtacagtagcaccgtaacaacgactactattaatgtaaatgtaagcggtaatgtgacaattaagatcgtaaatccaaacagtagcgacagagttgctatggatgatcttagctggacatgtttcggtagtacgttagctactgctgaaaaccaaaaaggtaaatcagaattcacagtttaccctaacccggtaagaaataatgaattatccgtaaaaggagaaaatctcagcaaaatttcaaaagctgacatctatgatctttcaggaaaattaattgaaacaattgctaatcctttcagacattcaaacaagattaaccttaaaggtatggtaaaaggaacttacatcctgaaaacagacagtttctctactaaatttattgtagattaattattaaaaaatatttaaaaccaaaggccggatttatccggtcttttttttatttttgatatatggattccaacaaaaaattaggattaataggacgaaatatttcttattccttttctaaaaaattcttcgaaaataagttccagaagctcatgctgaagaacttttcctacgatatttttgatctgaacgaaatcaatgaagtagaacaactttttgcttctcctgagctgttaggatttaatgttaccattccttataaagaaaaaataattgattttcttgatgaattaagtgatgaagccgaaaaaataggcgctgttaactgtgttcttattcatgatggtaaaaagacaggttacaatacggatgctttcggttttgaaaagacacttcttttacacaaaaaaccttcacaggataaagctctgatcttaggaaacggaggagccgcaaaagcagtcaagtatgcgctggataaacacaatattccttcaataactatttccagaagtacagaaatcaattttgaaaaccttgatagggaaacagtttcagaacataaaattattgttcaatgtacgcctgtaggcacttttccaaatgttaaagaatgtctgaactttccttttgacggactttcctcagatcatctggttattgatctgatttacaatcccaactacacccaattcatcctcaatgcctctgaaaaaggagcaaaaacagtaaatgggtattatatgcttgaacagcaagcagaaaaagcctgggaaatttggaattttcaaaaaaaataacataaattagtgctttaattggccttacagctatatttaaaggatattaacgccactcacataaaagatttgctatgactacagaaaacaatctttctgaaaacgaagaaaagaaaaatcctaacgaagtatctcaggacacatcagaaaacgcggtttctcatgatgcaaacccgcatgaagatgatgcagaacacctggaagaacatgaagaggaagagatctctcttgccgatgctttaaaggaaatggaaaaaatcatcaacactcctaatgcaggtgaaaacttcaaaagattcaaccaactgaaggaaaaagcaagtcattacatccatgatgaagtggaggacaaaaaacatgaatacatagaagccggaaacgctgctgaaaatttcagctacgaacacccttctcaggctaagtattccgcattagtcaatattttcaaggaaaaacatgacgacttccagaaaggacaggaagaagaacagaagaaaaaccttgaacaccgccagaatattattgaaagacttaaaaatctttataccagctctgagccggggatcaatcttttcaaatccatccgcgagataaaagaagactggtcaaaggccggacaggttgcaaaatctgaatttaaaattcttaataacaactatttccaccacctgaatcagttttatcagatgctggatctgaacaaagaatttctggagcaggaatacagccataacctggaaaaaagagagcatatcattgcccgtgccaaagaactggaaaacgaaccggtaatccagaaagcactgaatgaacttcaataccttcataaactctggaaagaagaagctgaacccgttgcagaagaattccgtgaaaaaacatgggaagaattcaaagaaatctccaacaaaattcacgaaaggaaatctgagctttctgcttctattgaaaaagaacagaacgaaaaccttgaaaagaagaatcagatcattgctgaaatcaaaaagctttccgagccttcagaaacacctaaccacaattactggcaaaatgccatcaaaagagtggaagacctgcgatctgactttttgaaaacaggaagtgttccaagaaaactttccaaccagaattggaatgacttcaaaacaacactaagagcttttaatacaacgaaaaacaattattataaatcgttgaaaggatctcagcaagccaatcttgaagaaaaactgaaattgattcagaccgcacaggacaatatgaacaatgaggaatgggatatctcggtacctctattcaaaaagcttcaggaagactggaaaaaaatcggtcacgtaccaaaaagcatgaccaataagatctgggacgagttccgtgatgcatgtaacgcattcttcaacaattacagagagaaaagcaatacttcaatcgacaactggaaggagaactataaaaacaaaaaagctcttcttgatgaactgaaggaagtttccaatgacgaaggaagcatcgaaagaattgagcagatcaaaacttcatggaataatatcggaaaagttccaagagataaaatttcaatcaactctgaattcaataaaacattaagagagaaattgaaaataaacaagatcaatgaacttgagctgaaagaagaaggcttatctgaaaatcagcttaccgacaaagcaagaaagatcaaaaatcagatctctgatcttgaagcagaaatcgtgaagctggaaaacaacctttctttcttcaacaagccgtcaagagaaaatcctcttttaaaggatacttacaataccattgatgagaaaaaagctcatctggaaacgttaaaacaaaatctccacaacattatcagcggagaataatacataacaaaatacataaaggcggagcaaagtaatttgtcttcgctttttctttttacaatatgaacaacgacgaactttatatcaaaagatgcatcgaactggcccaaaaagcacttggcaaaacataccccaatcctcttgtaggaagtgtgattgtctataacggagaaattattggtgaaggataccatcataaggcaggggaaaaccatgctgaaattaatgccatcaattcagttaaaaataaggatcttatcccggaatcaacaatttatgtatccctggagccatgtgcacattacggaaaaactccgccttgtgctttaaagattaaagaacttggatttaaaaaggtggtgattggagcgatggattcccatgataaagtaaacggcaaaggaaaaaaaatcattcaggaggcaggcattgaagccgtttcaggaattctggaaaaagaatgtatcgaactcaacaaaagatttttcacctatcacgaaaagaaaagaccttatatcattttaaaatgggcagaatccggtgatggatttcttgataaggattttaagtcaacagctgtttccaattcgctggtaaatcaatttgttcatcaactcagggccgatgagcatgctattttagtaggaacacaaaccgctttgaatgataatcctagccttaccgtaagaaatgcagaaggagtgaaccctgtaagaattttaatcgactttgacttaaaagttccggctcatttcaacatttacaataatgacgcaaaaactctggttttaaactctgtaaaagaaggtattgaaaatcatatacagttcattaagatcaacaaagatgattttctactggaattaatgaaagcactatacaaagaacagatacagtccgtcatcattgaaggcggccgctttacactccaacagtttattgatgccagcctctgggatgaagctatagtaattaaaaatgaaaaccttaaactggaaaacggaacaaaggcacctgaatttaattatacagccaatagacttgaaaatttcagagataacatcgtatcattttacagacaaaaataaaattaagcagtctattctgacggcttaatctatgatcatgatgtaaaatagtaaagcatttaatacttttgcatccataaagccggaatacacgatgacgtttgaatataaaaccatagaaaaacccatagaaaacactcttttaaaagaaaaaggaagcaagtttatcggatttgcttacccggtaaataatgaaaaagagttaaaggcagctttggaaaagatcagggaggaacatccgaaagcgacccaccattgctatgctttcagaatgggattgaatggtgaaaactatcgggctaatgatgacggcgaaccttccggaagtgccgggttacctatttacaaccaattattggccaatgaaattacgaatgtgcttgtaattgttgttcgttattatggaggaaccaaactgggagtttccggccttgtaaaaacttataaagaatctgcgaagattacattagaggcagccagtattatcaccagagaattagaaacagaagtagagattcaatttaacttcaatcagcagaatacaatttttacattgctttctaaatttgatgctaaagttttgaacttcgatgcgaatgaagactgtattctcaccgcgtcattgaaactggcacaaaaagaaagcatctcagaaaaactttccgagatgcagtatgtttcatttgaatttaacgattaatctcttcttcctccaaggagcaaagatgcccagtacagaagctgtgccagtgaccctaaagcagctactacataggttctcgccgcccatttcaaactgtcctgtaccccaacaaattcttctgcagttactgttcctgtatctttaagccatttcatcgctctgttactcgcatcatattccaccggaagtgttacaaaagcaaaaagcgttgtcacagcaaacatggcaactccgatggcaagaacggtcgtatttccattgggattctcaattgttcttgatgctgccattactgcgatgcccgcaatcagaacaaactgcatcagattggaacttatattaacaataggaaccagttttgaacgtaaattcaacatagaatatcctaccgcgtgttgtactgcatgaccgcattcgtgagcagctactgccgctgccgctgcgtttctctgcatataaactgcctcagaaaggttaactgttttatctgccggattatagtggtccgtcaactgcccgggtactgatattacctgaacatcatttatcccgttatctctcaacatcttttccgctacttctttccccgaaaggccatttcgaaggtgtacattggaataatattcaaatttcgatttcaatctggaagaaacccaccagctcaccaacattgaaataccaataatgatataataacccaccattttatataaattttgtgtttaaattttacccataatcaaataaaaactgtgccaaagtatacaatattattatttatatttgtcctttaattcttctcaaaaaacatgtctacaatttcaattattgaagtaaaaactgcgggtcagctgaagcaattcgtaagatttccaatggatctgtataaaaacaatccatactatgttccgtcctttattaatgacgaaatcaacatttggaatgctgatgaaaatcctgcccttcaatattcggaggccagacaatatctcgcttacaggaatgataaaattgtagggagaattgcagttcttattaaccacaaagaagagaaagagttaggaattaaaaaagtacgctttgggtggatcgactttattgatgatgctgaagtttcaaaagcattaattcagaaagcggttgattatgccagagaaaaaaatattgacaaaattgaaggtcctatggggtttaccaatcttgataaagccggaatgctgataaaaggtttcgatcagctggctacaatgatcggaatttacaaccacgaatactatccgaaacatctggaaaacctgggattgaccaaggaaaaagaatgggtagaatttgaaatcatcttccctgaaaccctgcctgaaaaaatccataaatttaatcagcttatttccgaaaaatacaagctgaaagttttaaaattcaaaacaaaggaagaaatcattcagtatgtgcatcctatgtttgatcttttggatgaaacttacaaacacctttccacctacactcctatttctgacgaacagcgtaaaacctataaagagaaatatttcaaactcattgacaaagattttattgtatgcattgccgatgagcataacaatctgatctctttcgcgattacgatgccttcctattccaaagcccttcaaaaatccggtggaaaactgcttcctttcggttggtggcattttttaaaagcaggaaagaagaatgacagagccaacttctatctgatcggaattcatccggattatcagagaagaggtgtgacttctatcatcttcaaagaaatctgggatatattcagaaaaaaaggagtcaaatatctggaaaccaaccctgaactggaagaaaacaaaagtattcagctgttatggcaagattataatccggtaaatcataagagaagaagaacctattctatggaaatcaataactgatgctgtattttgtaccaggtaataatttaaaatctaaaaatttatgaaaccacagcttatcatatttgctattttaattgtaggatttatcagttacaatttcttttttcagtcaccggatgataaaacaaatacagtaataaatattctttttgccagtattctttttgggtatatttcatttatggcttacactctcttgaaaaaaatgaaaaaataaaagcagtgcttttaacaagttattttgattggtagtaatcattcaaaataccctcaatatacctgacagaatgtattttttcatattcgctacaaaaaacgggaaaaaacccggcaaaaaacgatgacaaaaagctaatttttattgattctaaattactgatttaactcattttcatcctacttttaagctgataaatttcatgctttcttgtttattcgctaaatttgcaaattgagataataatgcaaaaatgaatttacctgaaagttatattccaatccttatccaggctggtgtagcagtaggatttgtagcggtttctttgcttggtgcacatttcttaggtccacagcagaaaaaaggaaactctgtaaaaaaccaaagctgggaatgtggggttcctgtagaaggaaacgccagaacaccgttttctatcaagtacttcctgactgcggtattgttcgtactattcgatattgaaatcgtattcttttatccttacgctgtaaatttcagagaattcggtatggaaggattccttgccgtacttacgttcgtagccatctttttcatggcgtttttctatgtatggaaacgcggtgcattagattgggataaataaattttaattaaaagattcaatgtatttaagtaaattgaagattttcaagatcttattttttaatcttaaatattttaatctttaaatatttactaaaatgtcagataaaaaaccagtaataagaacagatgcacctgctcctgaaggctatgaaggagaagggtttttcgcaacgaaactgagcagtgtaatcgggatggcaagaaagttctcactttggccgttaccatttgcaacctcttgttgtggtatcgagtttatggctaccctgaacccgacttatgatgcttcaagatttggaatggaaagaaactctttctctccaagacaagcagatatgctgatggtttgcggaactatatcaaagaaattgggaccagtcctgaaagaagtgtacactcagatggctgagccaaaatgggtggtagcagttggagcctgtgcttccagcggtggtatttttgatacgtattctgtacttcagggaattgataaaattattccggtagatgtttacgttccgggatgtcctccaagacctgaacagatcattgaaggtgtaatgcaggtacaggctctggcagaaagcgaaagcatcagaagaagagacatgcctgagtatcagaaattattagattcttacaacataagcaactaacggaaatgacaaacgaatttgtattagaagctatcaccagagaatttccggaatctgtcatttcaagctctgagccttatggaatgctgacgattgaagtaaaaaaagaagatattaagaaaatcattcactatcttaaagattcatctctggaaatcaatttccttacagatatctgcggaattcattatcctgagttcccggaaaaggaaataggtgttgtctaccatttacataatatgatgaccaatttcagattacgtctgaaaatcttcatgtccagagaaaatattgaagtagattcccttacggatctatatgcgggagcaaactggatggaaagagaaacttatgatttctatgggattaaatttaaaggacatccggatctcagacctattctgaatatggaagatcttggataccacccaatgttgaaagaatatcgccttgaagacggtacaagaaccgacaagaacgatagtatgttcggaagataaaaaagcgaatggccaatggcagctagccaatagccaaaagcaaatagctaaaagcaatcattatgaaagataactcattatctaatatactaaaccagtacgatagtaaggaacagattgacgggcaattatataccctgaacttaggacctacccaccctgctactcacgggattttccagaatatcttaacgatggacggagaaagaatccttcacgctgaacaaacagtgggatatatccacagagcatttgagaaaatttctgaaagaagaaactattctcagatcactacccttacagaccgtatgaattactgttctgcacctatcaataacttaggctggcatatgacagtagaaaaactgatcggcgtagaagttccaaaacgtgtagattatatgcgtgttatcctgatggagcttgccagaatcggtgaccacctgatctgtaacggggtaaccggaatggactcaggagccattacaggtcttacctatatgttcatcgaaagagagcgtatttacgatatgtatgagcagatctgcggagccagaatgacaaccaatatgggaagaatcggaggatttgaaagagatttcactcctaagttccatgagctgatcaaggatttcttaaagacattccctccaagattcaaagaattctgtaccttattggaaagaaacagaatttttatggacagaactatcggtacgggagcgatctccgccgaaagagcattaagctacggtttcacaggtccaaacttacgtgcagcaggtgtagattatgatgtaagagttgcacagccttattcttcataccaagacttcgactttattattcctgtaggaacttcaggagatacttacgaccgtttcatggttcgtcaacaggaagtctgggaatccatcaaaattatcaaacaagcatacgaaaaccttccggaaggaccattccatgcggatgttcctgatttctatcttcctgaaaaggcagatgtctatcagaaaatggaagcattgatctaccatttcaaaatcgtaatgggagaaactgatgtaccgaaaggagaagtttatcatgctgtagaaggtggaaacggagaattaggtttctatcttgtgagtgacggaggaagaagcccttacagacttcacttcagaagaccatgcttcatctactatcaggcataccctgaaatgattacaggttctgtaatttcagatgccattgtaacgatgtgtagtatgaatattattgcgggagaattagacgcataacattgtaaaaagtaccattgtaaaatgtattcatgattttacaatgatcaaataaataagtcattagtacattgtacactgtacaataatacattaaaaaaaatgagcgaaacaatagcttttaaaccggaaagtttagcacaggtacacaaaattatcgcaagatatcctgaaggaagacagaagtctgctcttcttcctgtacttcacctggcacagaaagagttcggaggatggttagatgttcctgtaatggattatgtggccggactgttaagtatcaaaccgatcgaagtatatgaagtggctactttctatacgatgttcaatatgaagccggtaggtaaatatgttctggaagtttgcagaacaggaccttgcatggtttgcggaagcgaaaaaatcctggatcatatcagaaccaagctgaacattaaagacggagagactactgaagacgggatgttcacattgaaacctgctgaatgtcttggagcatgtggatacgcaccgatgatgcaactggggaaattctttcatgaaaatttaacgatagaaaaagtagatgaaatccttgatctttgcagacagggacaagttgctttagactaaataaattttaacacattaaaaatagccataagctaaaagccacaagccaatagctgaacgctaaaagcataataaacaatgagtaaaaaacttttacttaaagacgcacatatagaaggtatccgttactttgaaacctaccgtaagcagggaggttacacagcagctgaaaaggccttgaaaatgactcctgacgaaattcttgaagaagtaaaagcttcaggattaagaggtcgtggtggagctggattcccgacaggaatgaaatggagctttctggcaaaacctgaaggtgttccaaggcaccttgttgtgaatgcggatgaatctgagcccggaacattcaaggacagatacctgatggaattccttcctcatttattgatcgagggaatgctgatttcttcttactgtttaggttccaatacttcttatatctacatccgtggagaatattcatggattccggatatccttgaagaagctattgaagaagccaaagcagcgggatttttaggtaaaaatattttaggaaccggtttcgatcttgaaatctacgtacagagaggtggtggagcatacatttgcggtgaagaaactgcattgcttgaatcccttgaaggaaagagaggtaacccaagattaaaaccaccattcccggctgtaaaaggtctttgggagagaccaacggtggtaaacaacgttgagtctattgcggcagtggttccgatcattgatattacaggtgctgaatacgctaaaatcggggttggaagatccacaggtaccaagctgatttctgcttgtggaaatatcaacaaacctggtgtatacgaaatcgatatgacgatcactgtagaagaatttatctattctgatgaatattgcggtggtattaaagatggtaaaagattaaaggcttgtatccctggaggaagttctgttccgattgttcctgcaaatctattgctgagaaccgtgaacggagagccaagatatatgaactatgagtcattggcagacggtggtttcgctaccggaaccatgatgggttcaggaggtttcatcgttttggatgaagaccagtgtattgtagaacataccatgactttggcaagattctacaatcacgaaagttgcggacaatgtactccttgccgtgaaggaacgggatggatgtacaagattttaaagaaaatcgagaaaggagaaggaaaaatggaagatatcgatctgctttgggatatccagagaaagatcgaaggaaatacgatttgtccgttgggtgatgcagcagcctggccggttgcagcagcgatccgtcacttcagagatgaatttgagtggcacgtgaaaaacccagagttgtctcagacacaaaattatggattggcacattatgcagatcctatcccggctgtagaaaagaacgcatagttgaaatgaaaaaattgttggttgtcggcttaatgatgtcgagttttgttttcggacaaaataaagagaaggattctttaatagatagaagttctgataaaggagcattggtttccagaaagaaaccggaacctttaagcaaaaaaggtcagatgttcgttttcttcggatggaacagagcagctttcagtaactctgatatccgtttcacaggaaatggctacgactttcagctgaataatgtatctgcacaagacagacctaccaagtttggtattgtttatatcaatccgggatggtttacagtggttcagtacaacttcagagcgggatattttattaaagataacttagccctggttttaggaatagaccacatgaaatatgtgatggatcaaaaccagaccgtaaatttcaaaggccatatttcagaccctgaatatgcagcaatggtgcaaaacggacaggtgaacctggcagatgagaagttccttacttttgaacatactgacggacttaattatgaaaatttaggtcttgaaagatatcagaatctgatcaataagaaaaatgttgatctggtttggtcttatggagccggtatcggattcatgttcccgaaaagtaatgtaaagcttttcggaaatgaaagaagcgaccgttttcacgtggcaggtatgggtacagacgtaagagccagtcttaaccttgttctttgggaccatgtaatggtaagattagaaggaaaagcgggttacatcaatatgtgggatatcaagactacattgaataataagccggacaaagcccaacaggatttcgttttcggacaggtccttgcaggaatcggatatacatttaatactaagaaatataaataacaaagcctattgcttaatgcataaagcttaaagcatacaatatgagcgaagaagttaaaaaattcaaaataactatagacggacagactactgaagtgttgccaggaacttctatccttgaagctgcaagacaaatcggtggtaaatctgtacctcctgctatgtgctactacagcaaattagagaccagtggagggagatgcagaacttgtctggtagaagtttctaaaggatctgaagcagatccgcgtcctatgccaaaactggtagcaagctgcagaactaatgtaatggacggaatggaagtaaaaaaccttacttctgagaaagctcaggaaggaagaaaggcggttactgaattccttttggtaaaccacccgctagactgccctatctgtgaccaggccggagaatgtcatcttcaggatttaggttatgagcatggtgtagaaaatacaagaacagaattcgaaagaaatacttacgaagccgatgaccttggtccacacatcaaattgaacatgaaccgttgtattctttgtgcgagatgtgtattggctgccaatcaattgacaggtgaaagagaacacggtatccttttcagaggagatcacgctgagatttcaacatacctaaataaagctttggataatgactttatcggaaatgttattgatgtttgcccggttggagcattaacggacagaacggcccgttttgccagcagagtatggtttacaaaacctatgaacgcttcctgcaaatgtgataaatgttccggtaaagctgtagtttggatgaaaggtgacgaaattgtaagagttaccgcaagaaaagatcagtggggcgaagtggaagaattcatctgtgatacatgtcgttttgagagaaagtcattatcagactggaatatcgaaggtcctagacatatcgacagacactctgtaatttcattgaaccactacgaaaagccaaaagacgagctaagagttttagacaatccgatggcgaaagaaatcagtgaaaaagacgaaaaatagaatagttggaagttaggaagctggaagctgggagcttaataaataccctaaatttcagttttaattttagctgttttaataatatataaaaaatttggtaatgtgatgaagagttgatgccacgatgtgataaacttccagcttccagctcccatcttcaaacatttaaataaaaaatggatttacttacatttaaacttatacttgtactagcacttttcctgctatcactgacgattgccgcctactctacctgggcagaaagaaaagtagcctctatcatgcaggatagaattggtccgaacagagcgggacctttcggattgctgcagccgcttgctgacggtggaaagtttttcttcaaagaagactttacacctgccaatgcagaaaaattccttttcgtattaggaccagctttggtaatgtttatttcattgattacaggagctgttattccatggggtaaaagtttaaatattgcaggtacttcttttgatcttcaggtggcaaacatcgatgttggagtacttttcatcatcggaatggcttccattggagtttatggaatcatgatcggaggttgggcttcgaacaacaaatattcattattaggtgctatccgtgcttcttcccagatgatttcttatgaattggcaatgggattagcgcttctttctatcattatgatgtcaggaagtttagacttaaaagaaatcaccgaaagtcagactaccggcaaattatggggtgtaattccttgggtttccggattgaactggaatattttctaccagccggttgctttccttgttttctttgtagccgccttggcagaaaccaacagacacccgttcgatttacctgagtgtgaatctgaattggtaacagggtactctacagaatactcttctatgaagttaggattatatatgttcggggaatatgtgaacatgtttatctcaaacgctttcatggtagttcttttcttcggaggatacaactatcctggtattgagtgggtaactcagaactggggagaaaacacagcagggattttaagtattgtagcattccttacgaaaacagtaattggaattctgatcttcatgtggatcagatggacacttccaagattcagatatgaccagttaatgcacttaggatggaaaacattaatcccaatggcattggtaaacctgttaattacaggtgctgtaattttagcgttccagtaaatttgagatttgatgtttgaaatttgagattcaacgaattgactttaaattagtaattttaagagtaataatttcaaatatcaaatacatggcaacgataaataattttgaagatttagaaatatggcagcagtcaagaagtctttgccaattgattcaaagagaatgtttattgaatccaaaatttctaaaccatgtaaaaaccagattgacaggtcatctgcatcaattatggataatatagccgaagggtttgaaagagaaggtaataaagaatttataaactttcttaccatgtctaaaggttctgcaggagaagttcgttctcaattaatcagagcttttgaccgaaattatttagatgaagaagtttttatttttttaaaaagccaaacaatatctttatctaaacagctgtcaggatttataaattatttgaagatgacagaccacaacggaaataaatttaaaagaaataataattaataattaaaggtttgagagataaaaattttgctaataaatttcaaatctcaaacttcaaatttcaaattatataatgaaattaactaacagatcaaaagttgtttccaataaagaaatgacccttgctgaaaaaatctacctgcctgcgatctttacagggatggggattacatttaagcatgctgtaagaaccgtgataaagggtgctcccgcagtatattcgtatccggaagtacagaagccaagaaccaccatctggagaggccagcacgttctgaaaagagacgaggaaggcagagaaagatgtacagcttgcggactttgtgcggtagcttgtcctgcagaagccattacgatgactgctgctgaaagaactaaagaggaaaaacatctttacagagaagagaaatacgcttcagtatatgaaatcaatatgctgagatgtattttctgtggtatgtgtgaagaagcttgtcctaaatctgccatctaccttactgacagattggtagacgtagaaaccaacagaggttctttcatttacggaaaagataaattagttgaaaaaataaatgaaaggattgatatcacgacaagacaatccgagaaacaaaaaaatgcggtaaaataatggatcagtttttatttttcttggtggcgtttttagcagtggcaagtgcggtttactttgtatttgcaaaaaatcctttatatgctattttgtcattaattgttacaatgttttcaattgccggaatgtacattcttctcaatgcacaattccttgcaattatccagattatagtatacgcaggtgccatcatggtacttttcctttacatcttaatgatgcttaatcttaataaagcagacgaaagtaagaagaacaatactttaaaatttgttggagtttttactgcagggcttttattaattggagttttaggggtattcagagggattcaggacaatcacattgttgttgaaaatgtagacagaggggttggtcttacgaagaacctgggtagacttttgtttaatgaatatgttttaccgtttgagcttgcttccatcctaattctggcaggtattgtaggcgcggtattaatcggtaaaaaagatttataaaattatgggagaagtaaatacatttatacaaagcatccctttggactacttcatcattctttcatcagtattgttctgtctgggagtaatgggagtattgcttagaaaaaatgctattgtgattctgggctgtgtagagcttatgctgaattctgtaaaccttttattggcagccttttcagcatacaaaggcaacggcgacggacaacttttagttttcttcattatggtggtagctgctgctgaagtagcggtaggtctggcaattattgctatgctgtatagaaacacccgttctgtagatgtgagtatatttaataaattaagaggataagaatggagaatctagtatatgcaatagtacttttaccacttttagggtttcttattaacgggctgttcggaaaaaatcttccaaaaatattggttggatctctggctactgcggtagttttcggatctttctgtatcgcggtaagccttttcatgaatttcaattctgaaagccagcctgtcattgtaaaagcttttgaatggtttagagtaaacggagttcagatcaattttggattccagattgatcagctttctttaatgatggttatgatcatcacgggtatcggttcactgatccacttatactctatcggatatatgagtcatgataaagggttctacaagttctttacttacctgaatcttttcatcttctccatgttacttttggtaatgggaagcaactaccttattctgttcatcggatgggaaggtgtaggtctttgttcttacctgttgatcggattctggtataccaacgaagaatatggtaaagcagcaagaaaagctttcatcatgaacagaattggtgaccttgcgttattgatcggtatcttcatgatcgcttctcagaccaatgctgtagattatctttctgtagcagaaaacgcttcaaaatttgaattagacggaacagtgatcatctttatcacagcgagtttattcatcggtgctaccggtaaatcagctcaggttccattatatacatggttaccggatgcgatggccggacctactcctgtatcagcgttaattcacgctgcaacgatggtaaccgcaggtatttatttagtagtaagatctaacttcttatttactttggcgcctaccgtacagggagtaattttattcatcggattcttaacggctgctttggcaggattctatgcacttcgtcagaacgatatcaaaaaagtattggcatactctactgtttcacagcttggatttatgttcattgctttaggtcttggagcatatacaacagcaatgttccacgtaatgacgcatgcattcttcaaggctttattattcttaggcgcaggttctgtaatccacgctatgagtaacgagcaggatatgcgtttcatgggaggtcttaaaaaatatattcctcttacgcacgctacattcctgatcggaacattagccatttcaggtttccctttattatcagggatgatctctaaagacgaaattttagtagcagctttcgctaaaaaccctgtttactgggtaatcctatttgttttagcggcaatcactgcaacatatatgttcagactgtactatcttacattccacggagaattcagaggtactgaagaacaaaaacaccacttacacgaaagtccttcaaatatgacattaccattgatcgtattggctgttctttctgtaatcggaggttttattaacctgcctcacttcatcggtcatggtcactatgccaaactgatggaatggttaaagccagttcttacagaacaaagctatagccagatggaagctactctttcaggagtgcctttcaacactgaaatgatcttattggcagctacagtaattatgttcttctctgtttggtttatcgtaagaaatacctacgtgaaaaagaaaaaaatggctgtggcagaagaaagctataccggatgggagaaactttctgctaagaaattatatgtagacgaactttacaacgcattgattgtaaaaactgttgaaggattaggacgcggaggaaaaatgtttgataagggtatcttagaccgttttgtaaactttgtaggtgatggagctgaagacagcggaaaagctatgaagcgtgtacagaacggaaatgtagagacatatatccttatcatgtctttagcggtgggaattatattaattgttaactttttattacaataataatgtcttgtttgttattaacattattactattacctctagtaggttcgggattagtttttgcctggaagaatagttccagcaaatatttggcgcttggaattgcattggtacagatgctccttaccttctatatgctttcggatttcaattttggaccgacagtagacagtaagcttcagtacgaaatcacttatccttggtctcaatttattaaaagtacgcttcatttcggtgttgacggaatgagtatgctgcttttattactgaccaatattctggctccaatcatcattttatcatctttcaacgaaaatgtaagctacagaaatacattctacggattgattctgctgatgcagttcgggcttgtaggagtgttcacttctttagacggattgttattctacattttctgggaagtaactttgattccaatttggttcattgccggactgtggggacaagaaaataaaaggttcgaattcactacgaaattcttcgtatatacatttgttggatcattatttatgttagccggactgatctatgtgtacaatcactctgcatcattcgctttaacagatctatataatgcacaactgaacgaaacgcagcagactgtggtattctggttcatcttctttgcatttgcagtgaaattaccggtgttccctttccatacatggcagcctgatacctatacctactctcctactcagggatcgatgttattatcagggattatgcttaagatggcagtatatggtgtaatgcgttacttacttccaatcactccgattccgattgccggaatttccggacagattgtaatcatccttgctattgtgggtattgttcacggagctttgattgccatcatccagacggatatgaagagaatcattgcttattcatctttctcccacgtaggattgatggtagcgggtatctttgcttctgcagtagttactttaagaggaacattcaatgttgaaggtgctgaaggagctttggtacagacttttgctcacggtattaacgtagtgggattattctactgttgtgatattttatacaagagatttaaatcaagagacatcagacaaatgggtggtttagcgaaagtagcacctaaatttgcagtgttgttcctgattatcatattaggttctatgggagttccattaaccaatggattcatcggggaatttattttgttgaaatcggtttatgattttaacggaacagcggcagtaattgctggtcttacagtaattctttgtgcagtatatttattgagattctacggaaaagcaatgtttggtgaaggagatgcagcagttctaagtacagcaaaagatttatcaggtgtagaattttctgtattggcaagtttagcggtttttgtgattttacttggtattttcccacaaccggtaattgaaatggtgagtagttcggtgaagtttatctaccaatcaatggtaagttaatttgatattttaagaaatgagtgttttaattattgttttcctaacggcagttattgcgttattttcaggagtttttgaacaaggaaaattcgcaagatacattgggattttgggattaatcatcgcattgtacgtaagttttatgccggaatgttcgttcttcgatcattacaagcatatgtatgagtacagtggcaatactgcattattcactaaaatatcaatcgtaacgactttattattattcttccttggaggttttgctttcagcaatcacagaagccaccagtcagaattatatgcattaatgctgtttgcattatgcggagggattatccttttcggatatcagaacctggtgacgatgttcttaggagttgaaatcctttctattccattatatgtaatggctggagctaataaaacggatctcagatcaaacgaagcttctatcaaatatttccttatgggggcttttgcaacaggttttttactgttcggtattgcattcatctatggaagtgcgggaagttttgatctttacaagattcatgattttggaatagccaattcaggaaatgtaatgttcatcttaggagtattattgattctttgcgcattggcatttaaagtagcattagcccctttccatatgtggagtcctgatgtatatgcaggttcaccatcattaatcacagctttcatggcgagtgtggtaaagatctccggattctttgccctgttcagattgatgacacttggttttaccggagttacacacgaatggatcaatgttttaggagtattcctaatcattactttacttttagcaaacgttatgggtcttgctcagacaaatgcaaaaagaatgttagcttactcttctgtatctcacgcaggatatatcggattggtattcttcggaatgacaagcctttctacttataacctggcattctatttatttgcttattctttatctacagtaggcgttttcatgtgtctgatctgggtagagaaattaaagagagaaacttctttcggagcattcaaaggattggcgaaaactgaacctttattagcaacagcagcaacaatctctatgctttcaatggcaggagttcctttaacagctgggtttatggggaaatttgctttattctcccaggctatgaatggtgcagctttccttgtattggtagcagtattaggttctgccctgtctatcgcttactatttaagactgatcatcgcaatgttcttctttaaagaatcaacattcaaatcatcagaaaaagtaacgcttacttacaacatcattgcagtagtggttattgctttgattataaccctgggaattttcccggatctttttgcaagaatgttcggaatgtaatatctgaattcacaatatcaaaaagcacaactttcagttgtgctttttttattttagattaaacaataatatttattgtcccaaaaagctataaaatgcattaatcaataatttagttatatgtctttttaaaaaacaacaaaaaattacaaaatatgttgtgaaatttcaggaagcaccgttaaattatgcacaataaaataacatagctatcctagtaatattccgcttttttcataactttacttttaaatttcagctcttggctaatctctataaaaaagactccccttttcaggtttatatatcattcaaaaaatatttggatgttctggagcatatccgatataatgacagattggaatacagggtgaactatgcagagtctttgattgagagtacaagaaactttaaagagttcagggaaggttttcaggacacagcgctccttgaaaaatatgaagacctcatcaggcttcttcttgccgatctgttcccaacaggacttaccaaaaatgagataaaagcggccagcattcctctttccaatattaccttcaattataccgaaaggtttaaagacattctgaaagacgcagggaaagacttcgaaatagagctgagaaatatttcagataatgaattttatgtgttctgctgctgcctgattcttcagagctatttcaaaaaggatattaaaagtacaatcccgttttattatgatattcccaacaaacagggaatcatgaaacattacaagattactgttaattcagattttactgaaattatccctacagaagacgctaagattccatctgatgatattctggacatgcttctggaaaatctggacgattttaaactgtggaaaaaatactttccttctcaatcctggatattaaaaggatttacgattatttcactggtagactgcacttctgaagtggctctttctgatctgaaatcaagcatgatcgaaattgatcccgaagatttgaatcctaatgaaaatcttaccgaaatctttaaatcctattttgatgttccggaactaagctttggattgatgaccttcaacaagaaagaacagaagctggataaacttccgatttatgagagtcttctcactaatcatattctcgatttctggatcaatgcctttgatgaagaaatccgtaagagcacttttaataaccttaatcataattcgaaacctgttgttgtttccaatgtcaacaatcttgatgaaagtgttaaaaaactgccttctttcagtattttaaaggataataatgtcaacagtttcatggtaatacctatcatgaaagacggtgagcttctggccatcatggaatttacgtctcctattgccggcagctttaatggcttaaagcttaaaaaacttgaatttttcaccgatatggttcttttctccctgaacagattttattttgagaaaaattatcagatagaagccattatacagcgtgaatataccaccatccatgacagtgtggtttggaagttcagaaatgaagctgaaaaatattttacggcatcactgggaaagaagatatatactttaaagcagatttcatttaaaaaccttacgccattgtttggggtttcggatatccgctcttcgtcagaaaaacgttttaatctgatgctgcaggaccttaaccagcagattgaatcactgaacgaaattttaacgcttaccaattcagattcagaaaagtttctgctggcactggatgtttttgaaaatgaactcaacaatgaaataaaagctgatacggaacaacgttttcagagattgctgagggaagaaattcatccttttttacaggggaagctggaaattaaaacctccagagccataaagtcaaagatcaaagattatttttcccaaatcttttcatcaactgagctgttttacagctatagaaaaaaactggatgactctattacgctggttaaccgtaagctggcagatatgctggacgaaagccaggtaaaagctcaggaaattttcccgcattattatgaaaggttcaaatcagacggtgtagagcataatctgtacattggccctaccattgcacctgatcttcactatacttctaaagttgttcataagctgagatactggcagctgaaaaccatctgtaaaatggaacttgatttccagtctttcaaaaaggatcttcctatacagctggatattgcctctctcatttttgtatacaatgaaaaaatagatatccgcttcagaatggatgaaaagcgctttgatgtagacggagcgtacaattcttattatgagattattaagaagcgtctggataaagcccatattaaagattcttcggaacgtattacagcgcccggaaaaattaccattgtctatttcggaatggaaaaccagaaggaatatctcgactacatttcaaaacttcagaaaaaaggggttttacaacatgaagtagagtttttgagggttgaagatcttcagggaattacaggattgctggcactgagggtttcttttactcttccacaggaataaaaaatccggaacaaaaattccggatgtatttatattgattttcaagaaaattgatcttgaatgctgttaaagacttagaaatgccactccaaaggataaaacagaaataataattcctgccataaaaattttataggtaatagataaaagtttatactttctgttaagaacttttccaagataatataaatctttcaccatagaatcgtagatgtaatccctgtctttgatcaggtctttcatggcgttgtgataatcatcgaataacatctgctgaaagtttccgaagaaaagaagattcacttttctgttgacaatatcctgagaagtaaatgtagtttttgtcacattcggttttgtggacagaatcgcaaagataatggtcagtacacttgacagcagtaaaataaagctcggaagaatcagatgcgaatttttaggagcatccagcttcggaaccaatacggaaagacatactgaaataataatggcatttacagataaaagaatattggctttactatctgcaatatcgctcaatcttgtatggttattaagtgttaccctgaataaggtatctacacttctgtctgatttttctttgtcttttttaccttctgagttatcctttttactttcctttttttcctcctctttttccagtttcttttctatctttttgatgtttttctttttcaaaggctcccagttttctttggcataatcagtataaaaagtatgtttgtttttcagcatatcaagatttcccgcattccattcttcattggaaaaacatcttacattggtcagctcccattccttcctcaaagcatcagaaatatcagtataatcatgtcctgcaaaatgactgaaatctgcatcttttacaattttttccagtaagttctgaggttcatagtgtattttcgtagccagaatcagcttttcaacatcagcaatataactttcaggataattttcctgctgcaaaaaagccttcattacttccacacttcgctcctcatgattcagagcacactctatataccctgtatcatgaaaccatagcgcaacgagaaccttctcctgatcttcttcagaaacaggggtgttcttcataatttcttctgccttatttaccgtataggcagtatggataaaattatgataaaaatataccgaagataacttatctttgaataagatttcaacataatttttagctttgtctagaatgttcattcctgaaattttgttaatgtaaatttatgaatttatcctttaaaactcatcttaaaaatacttctattgttctgagaacagtaatgtccgcaggagtcctgtattcctgttctacatataacgtacaaaagggcaaaaacttatttgaagtaaaagattccgaaataaaatcagaaaacgattttaaactttttctgattggagatgcaggaaatgcagatgaacctcaggcacaaaaaactctgaatttactgaaaatcaaactggattcagcagatagcaattccatgctgatctttctgggagacaatatctatcctaacggaatgcccaaagaaacagacaaagattatgcattagcaaaacagaagctggaaaaccagttagccattacaaaaaactttaagggaaaaacactagtcattcctggaaatcacgactggtataacgggctggagggtttaaatgctcaggaagggctggtaaaaaaatatctcgatgataaaaaagcttttctaccgaaaaacggctgtcctattgatgacatcaacgtttctaaagacattaagctaattgccatcgatacagaatgggtgattgccaactgggataattatcctggaatcaacaaaaactgtaatatcaaaacccgcgaagatttttttacagagtttaaggatcttattattaaaaatcaaggtaaaaaaataattgttgccttacaccatcctatcatcagcagcggaactcatgcaggttttacctctgctaaatctcacctgtttcctttaaatagtaaagtccctgttcctgttgttgcaagtgtgatcaatattttaaggagctcatcaggagcaagcccggaagatattaacaatcaacattacgcagatctcgccaaccggctgaaaagtattgtacaggataaggaaaatattattttcgtatcaggtcatgatcataacctccaatatcatgaagatggaaacctgaggcagatcatcagtggtgctggctctaaaacagatccatccactattgtagaaaaaacagacttctcctacggaggcagtggttttgctgttttaaatttcagaaaagacgaaagcacagatgttgagtatttttcaacccgggatgccggacttcaaaaactgacacatatttccgtgatttcaaaaccggatgtatttgtcaataactttccaaattcatttccggcaactttctcttctactatttatcctgtacagcttacagaaaaaagaaaattttacagatggctctggggagaccattacagaaaatattatggaatcccgattgaagctccaaccgctaatctttcagaactgaacggaggatatattcctttcagagaaggaggaggaaaccaatccaacagtttacgtctgaaatctgcagacgggcaggagtttgtaatgcgtggtgtaaaaaaaagtgcgatccgtttccttaacaacatggctttccagaaaagcacattaggagaagagcttgccgatacatttcctgaaaaattcctgctggatttttacacaaccaatcatccgtttaccccttttacgattggaaacatgtcggaaaagctgggtatttaccacagtaatccaaaactgtattacattcctaagcagcaagctttgggaaggtataatgaaaactacggggatgagatgtacatgattgaagaacgtttttcttccgatccgaaaacactggcttatctggacaatgcaaaagatattgtctctacagatgatgtattaaaaaacctcagcaaaagcaataaatattctgtagatagagaatcttatatcagagcaaggttatttgatatgcttatcggtgactgggacagacattcagaccaatggaaatgggcagaatatgaagaaggcgataaagtaatctataagcctattccgaaagaccgggatcaggccttcagtaaatatgacggtgctgcatttaaacttatcatgaatgttcccgccatccgccatatgaaaacctttacagaagatatcagcagtgtgaaatggcttgccatggaaccttacccaatggatcttgttttcttgaaaggagcggatcagggtgaatgggaggctcaggcaaaatacatacaggagcatcttaccgatgcggatattgatgatgctttccataatcttccgaaagaagtacaggacgataccattgcggaaattcagagaaagctgaaaataagaaaaacaaagcttcagacctatgcagctcagtattatgatgtactgcagaaaaaagtacctctggcaggaactgtaaatcctgataagtttgtcattacgaaaaacggacattctgtacttgtgcagcaatataagctgggtaagaataaagataagaatgagctggtttttgaaaagacttatcatgattcgaaaacaaaagaattgtggatctatggactggaggatgatgacatctatgaagtaacgggaacaggaaatccaaagatgaatatcaggctgatcggcggatataatcatgacacctatactgtgggtgatggaagaaaagtgaagatttatgattttaaatctcagaaaaacacctataacgccggtaatgcaaccaagaatattacggatgattatgacattaacagctataattataaacatcctaagtataattctgtagcaggatatccaaatctggattacaacccagatgacggtgttattgtaggcgttctggctaattatacagtaaacaattttatccgcgatccttttactcaaagacatagcttaaaagctaatttttatactgccacagcaggattcagccttacgtataaaggcgtatttaaaaaagccatctcaggttgggatatcaatctggatgcattttatacgactccaagattttctcagaacttcttcggactttccaatgaaagtgattatgataaagaaaataccgaaagggaatacaacagagccagaatttccaaattcaacttttctccttccatctcacagaaaagctggatgaatctcagccatcagttccaattaacttttgaagataataaagtgcagagaaaagctgaccgcttcatcaatcagtctccggatgtaagacctggtgtttttaatagccagcagtttgtgggagccaattatacatttggttataaaaatgctgataacgcagccttccctactcttgggctggaatttatgcttaatgcagactggaaggcaaccctttctgattttaataaaaactttgtgactctaaaaggaagacttgccgttgatcacagaattgataaaaaaggaaaatttgtatttgccaacgccagcaatgttatgtggatcaataataataactttgagttctatcaggctgctgctatcggaggcaacaacggaatgagagctttcagaaatgaaagattctcaggaaggtcctattttacaaataattctgagatccgatgggactttggaagaataagaaataatattgctccggcaaacatggggattcttatcggatatgatgtcggacgggtttggaatgataatgaaaattccaggaaatggcatcagtcagccggtgccggggtatggctgagtattgtagaaatgatgtctgcaaggttaaattatttctatggttcagatggcggaaggctatctgcagggataggaatgaagttttaaacacattcgtctgtaaagaaattattccaaacttacttttggattaaaatttaaattaatataaagtactgtttaataagattttaaagtataatttaaaataaatattaaaaaaatccaatttaaataaaatttaatatttcaaattttcaactcacattttttaatgataaaataaatatggcttttaaataaaagccatattttcagctatataggtcaaaaacacacatagtttaatatgattatcaattatttaaaaatttgacattttaaaaacattttatatttgctgcaacaaaaaaatcagcaaatgatgaaaaagaagctattgtatatggtattatttatcatattcgcaaacttaaatgcacagatagggattaaaacatcaacacctcaaaatacactgcatgtcaacggttcccttcaggttgttaaagatcttaatgtaggaggagatgacagaacaaaaggaaattccggaaacaaaggtgaggtcttaatgtcaaacggagcaggtaatgcaccagtttggaagaccattgaatctgaaaactttctgaaggtagtatttgttggaaacaagactgatatcagtccggcaagtggcagctatacgggaacacattctactccggtaagtactcacgaaagttattcacagacgtatatttttaatgtaagtaataaaattgatacagcttatttaacatataactcaaccactggacttttcacagtagtaaagcccgggttctataatattgtgccttatgcaacctatgatcttaatttaaatccatccggacagacggcaggtacagccaattcttatatacaaaaggtttctccggcacttacaacacttgcaggcatatctaccggtcatggcgaacgtacgacaggattgaatcataatctttcatccattaacttttttaatgcaggcgagaccttcagaatacgctgccgttatacccaggatttccggttatcaagtggtaatattcatatttcttaccttactccctagtctataaaacgtcaatcactttaatactttcatatatttaaaagccccgcagattttctctgcggggttttatttattttttataaagaaaaagtatacacatttcctccttcatctttccctttctcatctgcaatcattaatgttttatcatctaggaaaacaacagcttctttctgggaattatgattcaacggaattttctgaatcttggctgaattaaaatcatcagctgtaaatcctgtaagaacatgaacatttttatgggtcagcaatacaattttatctttagtactgttgatagtggcagatgtaatggctgcatcattataaccgccctgaagtttcaatgttcctaccagcttcgcttcaaaatcaccagctttattaggtacctggaatacaaggaaagttccgtcgaagcctttgcttctgtttttagtaaaaaggtagaaatttccattcatctcaacaaaagcttcacagtcataaagcagatatgattttttcggaggaaattccgtctgtccctgataatggaattttgttgtctgaacaactttggtaacagtttgtcgactgtcttttaaatctgtttttaagattgccagatcctgcctgttattatcattatttccaaagtctccaatataaatatttccttcaggatcggaaataatgtcttcccagtctgtattttccgcattttctaccggaatttttgccagcatatcgcctttatcactcagtccgtatattgcatttttatttcctctgtcttcaattacccagatcgttttcttatcttttgacaaagtaattccggaaacctccttcaactttttgggtaatgagaactgtatttttagttcatcttctttggcagaggaattctgagcttttgggttgcagctcattaaaagcaaagcaggtaacataagaaaacgtaacatatttattttttattttttattttttatttgaatgtaagaagcattaattgttccaatcgggaattatgaaagctttttcgctttttcccaaagaacatccatttcttcaagagacatatctgtcagtttcagattctgttcctctgcaagtccttccatcttttgaaacctagaaataaacttaagattggttctttctaaagccgaatccggattgattcctgaaatcctggagtaattaatcaaagagaaaaaaacatcaccaagttcctgttcttttttatccagatctgtctcagcatgaaactcctgaatttcttcatctaccttcttccaggcatcttctgcatcatgaaactcaaaaccgattcctttcactttatcctggattctgtaagcctttaccagacttggcagacttttcggaacacctcctaaaatagacttattcccttctttcagttttaatttttcccagttctgctttacttcttcttcatcttttacttcagtatctccgtaaatatggggatggcggaagaccagtttttcattcaaagaattgataacatctgcaatatcaaaactttctttttcagaaccgattttagcataaaaaacaagatgaagcaggacatcgcccagttctttctttatctcctgtaaatcgttctgcaaaatagcatctgaaagttcataggtctcttcaagggtaagatgacgaagggattctaacgtctgcttttgatcccacggacatttttcacgcaagtcgtccataatatccagtaatcttccgaatgcttctagtttctcttgtttcgtattcataaataatgggaaattcaatcttatacaaatgtaagggttattcgggcatcattacaaacgttggaagtaaaagttacggagtgcagtatttaggatagattaggtggtaaacctaataggtttcgaaaacctgttaggtttggaatattagcatgcaattatcttttgtctgaaaaaacaaaaaaccttgtccggaaattccagacaaggttttgtatttttaattcaaaaatgaattatccttgttttctatgtgtactctttggagctgattttgcagctgaagtcgcttttacttttggagcagctggcttttcagtttttggagccgcttttttagcttctttttcaatgcttacttcttctgttgcaggctcaccttctaaagtttcaggttctgctttcacaaagctttcaggagtaatatatccagctttttgaaggatgttgtaccactgagctaatttcttgatgtcagaagaatatactctttctgtatcatagttaggaagagatgccaacatgaaatctttcagttctgcttcagaagatttgtgagaaattgtttccttataatcattgttcttagcaatattttcaaatacttcaaacaagggaacttctttctcgaatgtaaacatggcaatattgtccagtaaacttacctggcttgagtttccaatgcttacttttttctttgatgtaacatcttcaataatgaatccgtttcttaattgagaaactaatttgaaaagtcctggttttccagaaattgaaattattttttctaacagcataattttattttttgtaaattctgcaatcagcactagctttttgcttttattattctttttaatccttgtttaaattattttggaaatctcattttgtaaccgatgtttacgtcaccctgagagatttttgtcagcttacctttcaccagtttcttcttcagagcactcaggtggtcagtaaacagaatcccttcaatatggtcatattcatgctgaattacgcgggctctaatatcggaaaaagtttctgtatgtttcacaaaattttcgtcataatattcaataacgattgtgccttttcttttcacatcttctcttacatccggaatagaaagacagccctcattgaacttccattcttcacctgattcttcaagaatctgagcattgatgaaaacttttttaaactctgccagctcatccttaatatcttcataatcctcatcttctgcaagaggtgtcacatctattacaaacagacggatatccaaaccaatctgtggcgcagcaagacctatgccatttgcactgtacatggtttcgaacatattatctatcagttcctgtaatccgggataatctttgtctatatcttttcctacttttctcaaaacaggatccccaaaagctcttatcggtaaaatcatcttaatctttgttctaaaaaattctgcaatatgatagttgcgcttactttatctattaatcctttttcctgcctcttcttcttattctttccactttgggaaataaaaaatgaagccatttttgaggtaaatctttcatcaaaacggtgaactgcaatatccgaaaattcttttttaaatgcttcaatgaattttaaaatatcggtttccacttctgaaatatttccttttaaatctatgggaagcccaatgactaccgcatcaaccttgttttcactgaaatattttttcaaaaattccatcaaagaacggttctctacagtctccagtccgctggctataatctgcatatcatctgttgcagcgatgccacaacgagcctttccgtagtctattgcaaggatttgtcccataagtctgcaaatttagtaaaatttactgattttattcataacgcagtttttttatgtaaatcatgttttattccattattttttttataattttaatcttccaaaaaacaattatatgaagaaactcatcctcgtaagacatgcgaaaagcgactggccggaggaaacggaggactttgacagacctttggcagacaagggtctggaggatgctatgcacatgtccagatttctgaaaagcaataatatttccattgactattttgtgtccagccctgcggtacgtgcactgaatacctgtaagatttttaatcagacctatcagctggattgttctactgatgaaaaactatataacccttcggaaagaagctttgaatctgtaatttatgacctggatgacaatctgaattccgttgcactcttctctcacaataacggaatttccaattttgccaattccatttctgaggatattttccattttcccacctgcggagttgccggttttgaagtagactgccaatcgtggtcagaatttgacggagccaaaaagaaacttctgttcttttatgagcccgggaaaatataactttacttttctgtttttttatgctgtcctatccgttcttcttttctcctgccagaaacagaagaaaccttactttgaatctattgcactgagtgatataaagctttctgcgtccccaaaacccggaagctggcggtataatcatgatgaacattttcagacatttgaagattttaaaaaatcaaaaaagataaagcccacacctggaaaaaatacgatttatcttcaacccatcggaacatttgatgatctgcagaaaaaagaaatagccctcacaaaagaatatttaaaactatatttccaactggaaacaaagatacttcctgttttacctaacagcattttccctgaaaaggttaaaagaatttcaaaagaagggcaggaacaaattctggcaagttatgtactggacagtattctgatcaaaaaaaacctaaggatgctatagcattaatgggtattacggagaaagatctttttccaatgccggaatggaactatgtttttggactcgcctcttatgataacggtgtaggggtaacctcaatatacagatttgctggcggccaattatcagattctaattttgatgaaagctttttaagattaataaaaatcagttcgcacgagattggacatatgtttgggatcagccattgtcttaatgccaattgcgtgatgaacggaaccaattcattaacggaaacagattatcatcttgccagagcctgttctttatgtcagagaaaactgagttccagtatacattatgacaataagaaaagacttcttgaactgaaaaacttctttgaaaggcagcatcttaacacagagcttactttagcaaatcaggatttaaatcttgtgcaataaaccaacatttcttttaccgactactcattcccctcctccggagaagtagcaaaaatattttttttaacaggtgataagtttcggctcctatgtttgcaaaagaataaatttacatacaaagcaaaaggggtgagagaacagttttggctaaataactcaggaagtatattgtgctttagaaatgtcctccaagtgaatcgtgaatttttcagacagattttgaagaaagtagggtaaaaatcaaagaccttcaccctacgcaagctaactcaaggtcgcttttataaatataaatgtataaaaaatatttggaagttaacacagaatctaaagccatatcactgttaacaaaaaataggttcaaaccctttcctattgaactatatcagctttaattttttattagaatccgtgttatttgtgaacaaatttgcgccatttgtgtttagtcacaaaaaagaacggaccaaagcccgttctctataaaatatctctcgcgatttcgcctttttacctttagcactttcgcctatttattttctcttcaaatccaggtcatcaaaatcaaaactaaagtctgtcacatcagaaattgccttcaatcttgcagattctgcctttccgttttcatcataactgaaaataatataagcatcagcatcatagcttctgtcatcccacttaataatgaatgaattattggagtaaggaagcagctctccttttaatcttggagaattcttgcacgaaattctgtaggtatttccctgttgtgcaatttctacatcaccaaaccatacatcattgtatgttcctgtaaactgttctgctttgggctgcagtcctttttcttttttaaatgcttcagctttagcatacgcatctttcttttgtttattgaattcagcctccattttagacattctttctccataggttttcagccagtttctgtctgctacgccaagataagaatcttttaccgtattcgtaatggtattgaatgctgctccggactgctggtttgttaatactacaattcccagtttcatatccggaattaaagtaaactgggtaaccgttccgattaatcctcccgtatgctgtacttgcttgtgcccttttacatcgctcagaaaccatcctaaaccatatccgtaaaaacttgtatcataaggattttttgccgctactctgtccggaatctgtaaactccacaattgttgagcattcttatctgaaaccagtttttttccatctttagtggtgaaattatttagaaggcattcagcccatgtagtcatgtctttaatgttactcataattcctcctgcagcattggcggtttcgttccagtcatgaggaacagcaattgcttttccgtctacaggagcgtgcgcatcaattttattcgctacagcttttgctctgttgtagcttccaaaacttgaggtcattcctacaggtttcataattctttgctcaataaattcagcccagcttaatccggagatcctgtgaatcacttctccagccacaatgaacatgatgttattataatccagtttcgttctgaaaggattttcgggtttcagatatcttacattgtgaacaatatcgttaacagttaaatttcctccttccggaaagaacataagatctccctggccaagtcctaatcctgctctgtgcgtaatcagatctttgatcgttacattttgagaaacgtagggatcatacatttgaaactcaggaatatattttgaaactttatcgtcccagttcaactttccttcatctgccaggattgctaatgccgtacacgtaaaaccttttgagttggaagcaattcctaccaacgtattatcatccattggctgtttgctggtaagagaacgcacaccaaaccctttggaatagattactttaccgtcttttacaattcccaccgacattcccggtacatcaaaagttttcagggtattctggatcagttcgtccagctttttttcttctacctgcgcattgaccaatcctacagttaaaagaaaaatgaaaaaagaaagtttctgtttcattgtttattttaattttcccaaatttactaaataataagcgatgctaattttagccgcgttaaaactttacaataaatcagttgtattcatgaaaaagcctatttgtatctgtattttctccctttttgctgccaccacaattaaagctcaggacaaaacagccaatccattgctgttacaaacctggaatttgaataaaatggacacctatatttatacttatgaaaaacaggatggttttgaggccagaagagaaggaatcagatttcagaaaaacggaaagatcacaggaaatctgatcaaatctaccttaaaatatgatgctctggaagaacctgtgactaaaaatgaaaaggcagaccgctacatcggaagctggaaaaaagcttcagattctacagtgaccatagtatttccttccaataccaatatgacaggcacttttgttattacaaaacttacggagaatcagctgaaactaaaaaaggttttcagtgcggatatagaaaagaaaatggattctatccgaaaaacaaaaaatattacagagtaagagcctgactcagtttatgaagcttctttatatttgcaatcttaaaaatagtaaaatgacacgaaacagattattggccttcttcttactgatggtaagctgtaatttatatttttcgcaggacgtatccattaaagatgataaagttttactggatgggaaacagattctgaaagcagaaaagatcaatgcagcccagtattcctttttctctatgaaagatgatgaggaagttcttctttaccggtatatggataatgagacgccaaggtatgtaaatgatgattattttatcctgaattttctgactgaaaaaacaaaagtagaatcgacggatatgaccaaaatatccaattttatgaattcgaaaaaaggaatggaaaaactggtaaaatggttactgaaagaaagagtgatcaatcatgacggggaacttaatcctgagcgtgtagccatattcaaagataaatatcacgaaaatattactgaaagaacctttagataatgaccaaaatccttctcctctccgactctcactcctatattgatgacaggatcctggaatatgcttctcaggccgatgaaatctggcattgtggagatttcggaagtctggatgtgattgaacagcttgaaaaaataaaacctctgaagggagtttacggaaatattgacaatgctaaaattcaggcagagtttcccgaggttaaccgtttcttttgtgaaaaactggaagttctgatgattcatatcggaggatatcccgggaaatactcacctcttgcgaagaaagaaattgcagaacagcccccgaagttatttatttcaggacattctcatattctgaaagcaatgtacgatgagaaaaacaagcttcttcacctgaatcccggtgcctgtggaaaacagggctggcataaagtaagaacaatgatgcgctttgtagtagatggtgaagagatcagggatctggaagttattgaattggggccgagggtgtgataagggaaagcacgtgaaagttcgagtgttggagagtttgagagtaaaggagtttgttttttataccttttactttctacctttgtacaataattgactcagaggagacttgaaaaatatgaaaatcggcgataaggtttcggtagtagatgaagatttaaacggaatggtaacttccgtgaagggaaatattgtcgtttttaaagatgaatatggctttacccatcagtaccccaaagaaaagctggttccgaaagatgctgatctgtatgaaaatataagaattgtaaggaaagcagaacccaaaaaaattatttctaagaaacatcagaaaaatcatttggttctggacctgcattttcataatttggtaaagaatcccaatgactatgacagctttgaaagactgtttattcaaaaggaaaagctgattgaagtactggagttttgcaggaaaaataacctgaagaggctggaaattgttcatggtattggtgatggtactttacagcggatggttcgggatgtactggaaagccaggtcaatattgatttttataataaggaaatacttcaccatcaatcaggtgcggtaatggtagaatttcactaaatttgcaggaattgaaatatgaacgtacttaatttactttttaccaaagacggattaatctgccagattgttaaaaacaaaaacatcctggaggaaaagtcttatttcgttactgaagagacaccagccaatcttattgaacagaagctggacgaagttcttatcaagcagcgttacgaagaaatccatgtgatttcagcatttaatcactttaccctgatgccggaaggtttttccgagcatgatgcaggatttgatctgattgccttcaatgctccggctgacagagagaaggaggaactgatgctctccatcaacaaaaaattcaatattcagttttattatactttcccgaaaagttattataaaaaaataaaggaacttgccgtgcctgcccattttaatttctcaggtgaaaagtttttaagctcaatcaataataaaaccagtaaagaaattcacatcaacctgtatcataatcaatgtgaattttttgcgattgacaataagaaaattattctttataataatctggatgtcaattcagaagtagattttctttacttcattatgtttacattaagcaaaatcggtttcggaattaatgaaaccagcttttatgcttatggagaaactacggaaaatgaaacatttatttctgaacttcagaagtttgttaaaaacctgaaaattgtttttgacaacattcccaacaagaattttatacttaattaggttgcaggcagaaggtaatagaaattaaaacacattcatcttccacctataatctaccacctaacccctaacaaaaatatgttcagaataatatcaggcaaatggaaagccaaaaaaattgccgctcccaagaactttgaagtaagacctaccaccgattttgcgaaagaggctttattcagcattctggaaaacaaatacgatatgcagtcgatctccgtgcttgatctttttgccggaattggctctattaccctggaatttgcttccaggggatgtcagaatataacttcagtggaaatgaatccaaagcatacggcattcatcaactctactgcttccgagcttgatatggcacttcagatcaatgtacagagaggagatgtttttgactggcttaaaaaattcagaaataaaaagtcatttgaaattgttttctctgatgcgcctttcgaaatggaagagaaaaaatatcacgagcttatctctctggtcttaaacaataaatacctgaaagaaaatggagctctgattgtagagcaccaaagccgtatgaaattcgatcatcctaatttaatagatacccgaaaatacggaaacgtaagtttcagtttttttgaaccgaataaagaagataatcaggaactctaattcctgattattttttttgagataaccggagcttcttcaccccattttgtaatggcttccagaacaggcaataaagttcttccgaagtctgttaattcatattccaccactaaaggaggtttctctgtaaaaacttttcggtcaacaattccatcttcttccagttgctttagctgtagactgagggttctttctgtaatggtaggaattgattttcttaattcattatatcgcttagcgccatcaatcaaatggtgtaaaattactgctttccatttgcctcctataaatttcatagtaacactggtacagcacgggtaggatttattatctatggtatacatttttatactatcattttttaccgttattgcaaagttaggaaacttaaattaattttgtaactataaaaatgatagtataaaattatgaactttttagagcaaatgaaaaacaggtatactgtaaaaaagtataacccacagggaaaagttactgaacagcaggttgcagagcttaaacaaattctaaaccttagtccgtcttctatcaacagccagccatggaattttatatttgtaaatgatctggagctgaagcagcaattaggggacaaatcttattttaataaggaaaaagtattggaaagcaactacatcattgttttccaggtaatcaaagatgtagagaactttgagaaacaaatagaagaaaatcttccggaaggtgctgttaattattaccggacgatggtaaaacctaaaggtgaagaagctgtaaaatcctggctgcgtcatcaggtgtatttgtcattgggagtacttttatctgcctgtgctgccatgggaatagattccactccaatggaaggaattgaacctgatggatatgatgctgtgctgaataatgaaaattatgaaaccttattcgcagtagcgatcggggaaagagatgaaacagatgccaatcagcctaaattcaatccaaaaaagagactgaatgctgagaaagtaattgtggaagcgtaattaaaacacgagtttcacaaattatttcacccatgacactaagaaaaaaatctgcttcgatgtgaggcagactttttatttataatactttcaattctaaatcaattgttttcccgaagaactttttagagatcttttcgaaattcttggtaagatctgaaagatagaaatgataattcggtttgggattgttctcatttaaaagattgtacttatccaggataatcttcagatgattggcaacaatattcggagagtctattacccgtaccctgtttccgtaatattgctttatttcatctattaaaagaggataatgggtacagcccagaatcaacgtttcaatatttttaagcttactgttgcttaaataattgtaaataatagcatgggtaatcggatggtttttaaaaccttcttcaatggcaggtaccagcaatggtgttgccagttcatccactttgatccatttgttatgcttgcggatactctttttatacagtccggaatttacagtcgctttagttgcaataactccaacattattgtggatttcgtaagatactttttcagctacaggattgataacgtctattacaggtactcttcctgcaacagactgcattacttcattcaaagcattagcggttgccgtattacaggcaattacaattgctttgcagttctgttccagcagaaaattggtgatctttgtagaatattcaatgatggcttccctggatttttctccgtaaggaaggtgctttgtatctccaaagtaaatcagatcttcattaggaagaagtcttttgatttctttggcaacggtaaggcctcctactccactgtcgaaaattccgataggctggcttggtgaaagatgtgaataatcttgttttttcgttttcaaatgagctgaaattttatacaaaaatagtgaattttatggcatactgtatacatacagacattatacaataaacaaatctgaagcaatcccatctgccataaaccaatgcttctccggaattttcaaatgatcattttcaatgattaaaataccttcttccatttttggtttgatttccgtttgaaaatgctccagaagtctatccgaaaatttggttttcagactttcaatatctactccccaaatggtacgcaagccaatcatgatcatttcattaaactgatcttccatcgaaagaatttcttcttccttagccagtaatttatcattaagcttcttaatatactgctgattattggcaacattccagcttctgacatcaaatccgttgtaggaatgtgccgaagggccaattcccaaatattcctgatacttccagtatgaggaattgtgacgagaatagaaaccgggtttggcaaaattggaaacttcataatgttcaaaaccatgatcttttaaaaagtctgataaataatagaattctttattttgttcttcctctttaggactttttacctttccttttgcaatccagttttccaaagcagttttaggctctaccgttaaggcatacgacgaaatatgaggaacttctaaagcgatagttttgttaaggttttctttccagatctcaagattggaagtgggcgaaccatagatcagatcaatactaaggttttcaaagccgaaatcctgggcacgcttgatagagctttctgcctctgaggcattatgagctctgttcattaattttaaatcctcctcaaaaaaactttgtgtaccaatggaaagtctgttcacgggtgttcccgcaagctgctttaaaaagtttttatccaaatcatcaggattggcttccagtgtaatttctatatctttttcaaagctgaaataacgtaatgtttcatctattaaagaactgatttcatccacagaaagaatagaaggagttccgccaccgaaataaagggatttcagatttttgttttgcaattcatcttttctcagcaatatttcagttttcatggcacgaagcatttcatccttaaaattcagggatgttgaaaaatgaaagttacaataactgcatttttgcttacagaacggaatgtgaatgtatatcataaaaaaagctctgaaatttttcagagctcaaatttatttaaattaaattgattagtatctaaatcctctcacattaataaagttgtcgaagttatatcccagaccaatcatgaagctgtttcctccataactttggatatcagataatccaaggttataggtagctccgatcatgaatttattgaatcttacttttacaattggagaaatactcaggtcctgattgtcaaatctgttctgaaccgttctgtagcttaccccgaaagagaatgcgttgatatcattggagaatgtcgccatcaggttccagtcgatcattcttgttgagtttgtattaaggttgatcaaagctgacggtgcaattgtaatattatcagcaatgttccagttgtatcctaagtttaggaagaatttaattggagaaggttcgtagttgtttacgatagaagcatcattacttaatgcaatatcatttacggaaacacctccgaataaacctctgtaggtagcagccaaaccgaagttcgcatataccatgaagatattactttcctcccctcttaataacgggtcacctccttcttcagtattgatttttgaataatcaaaattcatgttatagaagttaacacttgtaccgaaagagaactggtcttttctatctccttcgctacttagcggaataaaatatgaagcaccagccgtaataccacccgcagagatcggtccgttactgtctctgaatacggaaataccagcacctactctatcaaagatattcgcattgatcccgattgactgtacattcggagaattactgaattttgaaaattgttgttgataattggcgttgagctgtacgtaatctgtttttccgtattgagctgggttgaacaggaactcaccatccaaaagatattgctgatagtatggtagtgattcttgtgctttgtatgcatttgacaaaagagctaaacatacgatagcatatagttttctcataacaaatcttgatttcaattcaacaaatataaaaaaattctcaatatatttttagttttctaaataatttctccatttttttacagcatccgccatatctttgggcattgggctctcaaaatataattccttctttgttgttgggtgtataaatcccagggtatgtgcatgaagggcatgtcttggcaaaatttcaaaaacatttttaataaattgcttgtatttcggaagatttacccctcttaaaggagtatgtccttcatatctttcatcattaaacaaagtatgccctatatgtctgaagtgcgctctgatctggtgtgttcttcccgtctccagcttacactctacccaggtcatatacttgaatctttccagcactttataatgcgttacggcgtgttttccctggctgccgtcttcataaacagacatttgcattctgtttttaggatgccttcctatatggcctcttatggttccttcatcttcctgaaggtttccccatacaaaagcccagtataacctcttcgtggtccggttaaagaattgttttgccaaaaagctcagagcatattcattcttggcaatgaccagcagtcctgatgtatctttatcaatcctatgaacaagccctaccctgtcaagatcggatttctcaccattcttttcaaaatgatacgccagcgcattcaccaatgttccgtcccagtttccgaaccccggatgcaccaccattcctgcttccttatccacaacaacaagatcatcatcttcataaataatattcacaggaatatcctgcgggataatgacattctctctcggaggatgcgcaagcagtacagagatctgatcgcccggcttcacacggtaattctgctttactgcaactccgtttacgatcacgtttccggctctgcaggtttgtgaaattttatttcttgaagaattctgtctgtatattaaaaggaacttatcgattcttaaaggttcctgtttactgtcaacagtgatattaagatgttcatacaatcccttattttcctcatcaatatcgatgttttcaatactgttggaatctaataattcttcatctaaaaaatcgtcgttatcttctgacattgttttatatttttttacacaaaaggcctcaacatttgcagttgaagcctgtatttttgatattaatctgatcttattctacgacaaccttcttggcttttggcttttgcgcaggctgttgtgttgttgtggatacagccggcttggctgtattatttgccgtagcatgagtaccattccctgcagaagttttaggcttttctgctgttgaagcagctggtttaacagctgtagtctgagttttaggagtctctgttttcggtacttcaggctttggagtttctcttcttggggcaggagcaggcactgcgggagcttcataacttggctcgctatgaacttcttcatatcgtaccggaggaagtgaagtatctactttcatacggtagatagaattcagctgttccaccttagctcttaattcagcaggagttttcttacttgcccaaaggtcaatctgcatgccctggtcacgaacatctccggcagcaggatcctgataataaatgatatcagattcatcattactgccatcttcatgttctaccaatcctacttcaaacatactcttggtaatgacagctcttgcttcttttaccgtaagtccgacaacgttaggaatagaaatatttctcattggtccggaacctaccaccacatcaattactgagaatcttggtaaacgggtacccggatttacagcatttcctttatataatattcttaaaagagcatctttctgaatactaggctcataaattgtatcaccgattttaagacctacctgatccagtctctggaaagccagcccggaatatttattgataacattcggaacagcaataggagcccatgttctgggatttactttaagcgttacagttcttccgtcttttacacgggagcctggcgcaggataaacctgcaaaacctgaaatggtctgtatttaggatcataattagcactgtctacctcatattccaaccctgtatcgtctaatattttaacagcatcatgtactgatttgtttacaacattgggaacaggaatttcctgaccatgattagtatggtactccagccagcgaaatgtgagccataccaacccaacgaaaacaccgatggctactactaaattcagtaaaactttccaattgaaaagtgatttaagcatacttaaaaatactttaattataaccgcaaatatagctaataattttagaatggactttttatttaacacaattcatttttgattttaaaatttgctgatttcccgtattgcattatataaaatgattaaatttgccttaattgatactatatggttatgaataaaaaaagtgttgccgtagtaatgggaggctattctgatgaatatgtcgtttctttaaaaagcggacaattgatttatgattctctggacagaaatctctatgacgtatataaagtagtagttcttaaagatgaatggtattttttaggagaaaatgataaaaaatatgccatcaacagaggtgatttttctgtgactctggataatggagagaccttacaatttgatgtctgcttcaatatcatccacggaacaccgggagaaaacggaattcttcaggcatactgggacgccataggtcaaaaatatacaggctgcggtttttaccagagcgcgcttacattcaataaaaaagatacactggctgtactttcaaaatatgggattccttctgcgaaaagcatttatttaagaaaaggtgaagacattaatgttgatgagatcgtatcagaacttaagcttcctttatttgtaaaacctaatcaatccggatcttctctgggaatttcaaaagtgaaagaaaaatctgaactgattgccgctactgaaattgccttcaaagaagatgatgaaattctgatcgaaagtttcttaaacggaatggaagtatctgtaggagttattgattttaaaggagaaaccattgttttaggaatcacagaaattgttcctaccaatgagttcttcgattacgaggcaaaatacgaaggagcttctgaagaaattacaccggcaagaattgatgaagaaaccacaaaaagagtggaggaaattgcaaaaagagcttacaattcattgggaatgagtggtttttcaagaagcgaatatattctgatggacggtattccttacatgctggaaatgaacaccaaccctgggttctctccggcaagtattctccctcagcaggcaagacattatggaatttccatcatggatctttgtggaaatgaagtagaaaaagcgcttaataaataataaagagttagaaattagaggttagaagttagagattgaatacacttttaacaaataattcactactcaaaatcataactcgtacaacatgaaaattgctgttttcccagggtcttttgacccgattacactaggacattacgatattatagaaagagcagctccgctatttgataaattaattatcgctatcggacagaactctcagaaaaaatatatgttccctcttgaaaaaagaatggaatttatacagaattcagtcgctgaatttcccaatgtggaggtagattattttgaaggacttactgtggattactgttttgaaaaaaacgcacaatacatcatcagaggtcttagaaatccggccgatttcgagtttgaaaaagcaattgcccataccaacagaactttagcccacaaaaaactggaaacggtattcttactgacttcttcaggaaaatctttcatcagcagcagtattgtaagagagatcattaatcacggaggtgaatacgaactattggttcctgagtccgtgagagtggagcgataaaaaaatataattgatgagcgataaatgataattgatataatggccaagaatttgcttaagcagaaatcattcatcaattatcatttatcaacaatcatttataattatatatgcacgaacagttcaattttgcaatagaagtcctggggaccattgccttttccatgtctggaagttttgcagcgatgcagaaacggctggatccgttcggggtacttattatcgcatttgtaacctctgtgggaggaggaactgtaagagacctgcttcttgatattcctgtattctggatgcatgatctgcttacatgtgggctgattctggtaaccagcattttttcaatggttttcaaatcccttgaaaaaaatttcaaggtaaccttgtttattttcgacagctttggtcttggcttattcaccattataggagttcagaagggtttaaatgcaggcattcatcctatgatctgtattgcattgggaaccataaccgggtgtttcggagggataatccgggatatactgcttaacagaattccattgattttcagaaaggaaatttacgctacagcatgtattgtaggaggagcagcatttcttctgatgaccaggtatgcaccgttttcctatacttttgtgcaggtcttcactattttactgattgttgccatacgaacatttgctgtcaaataccattggcagatcccaaagttctatggtcatgatcaaagttcggaaatgtagaatcaatcttcacagatataaaaaaagcacctctaagggtgctttatatttttaagtgacttagaagaactttcctctgtttctcatatgaggattatgcatatgtttctgcatcgtcggcattttcaactgctctttcatcattttgatctgatcagtcatcattcctgcactgtctaatctctttgcttcttccaacagcttctgcccttcctgttttcttcctttggaaatagcggctgcagcaagatttaaagtagccattgctctgtcatgcttcatattcaaaccgtattccaatgcctttttcatgaaaggctctacttttgcagggtgatcctgagcctgggtcaatcctgacaaatagtgaaaatatccgtattgagtcttatgaagctgtgttttatagtctgtaatttttgataaccattctccggctttctccatattctgctttcttaattgccagaatgccaaaaggatatattcatttttaaagaatagcaggattggaaatgcagccaaaaggaatacaacaataccccacccaagatttctcgtgaagaacatcatataaagtcccagtaaaataaggactgctgctactgcaatttttatgtatttattcattattaaattttagaagtgcaaagataataaatttaaggcttaaagttcaaaaagtcaatggtgaatggtcaattcgctgtgcctgttaatttttatacctgtgagaaattcacgattcactttgcaaagcaaaaattgactattgacccctatgcttcttttttaattctttcaaacgtctggaaacagaaatcataaccgttcttttcatctttttcatgacagatttcgttggtcattttccagattttaggatctattttcgggaaaaatgtatccgcttcaagatctgctttcactaaggtaacttcaagtctgtctaccacatccatagtctgctcatagatatttccacctccgatcacgaaaacttcttcatcaattttttttgcaaatttcaatgcttccttgatgcttcctacaattagaattccttcttcaaaccaatctttttttcttgacacaacaatgttggtacggtttggaagagcttttccgatactttcatatgtttttcttcccataataaccggatgccctgaagtaatttccttaaaatgtttcaaatctttgggaagatgccaaagcaactggttttcaaaaccaatctcatttttctctcccatcgccaccactattgttgtcattcaaataattttttacaaaattagcacataatttgtatatttggttagcacaaaaaatttaaaaaaataaactatgaaaaataaaggatgtctgggtgcaggaaccattggtatcgccctccttattattgttgctgttctattcttctggggaaaaagcggctataacaattttgttaacaaagaacagactgtgaacgcaaaatggtctaatgtagaaacagtatatcagaagagagccaaccttatccctaacctggaaagaaccgtaaaatcgtattcaaaatttgagcaggaaactttaacacaggttgtggaagcacgttccaaagctacttctatcaatattgatccaacgaatatgactgaagcagatctggcaaaattccaggctgcacagggagaattatccggagcattgagcagattgatggctgtggtagagtcttatcctaacttaaaagcggaccagcagtatatcaatttccaaagagagtacactgctatcgaaaacagcatcagaactgaaactgtttattacaatgatgctgcacaggattacaacacgtctatcaagactttcccgaataatattctggcgaatttcaccaactttaaagaaaaaccttatttcaaagctgatgcaggagctcagaaagcccctgaagtattcaaataataatgggtaatttcctaacaaatcaacagatcgcttcccttgtggaagcgattcagtctgcggaagatcattctacgggagagatcagggtgcatattgattccaatacggaaaaccgcgatgccaaaacagcttttgaggttttcaaaaaactcggtatggacaaaaccactgacagaaatgcggttcttttccatgtcaattttgaacagaaatatcttactatcattggcgatataggaatccatgaaaaggtaaagcagagttactgggatcatcttcacgattacattaccgctgaatttgccaaaggaaattattacaaagcactgaaaagtgctatcctggaaacaggacttgaactcaaaaaacattttcctgtaaaaggagaaaatccaaaccaactcccaaatgaaattacgttctcttaaaatagtattttcatttttattactatgcttttacacatttgtatcagcacagtatactattcccgaaaaacctgcagtgctgtatcctgtttttgatgaagccggactgctttcacagcaggaaaaggatgcgctcaataataaactgatcaagtttgcagattctacctcaacggaaattgaagtggtgatcatccgctctaccaaaggggaagatgtcaactttctggcaaccatgtttggtgagaaatggaaaatcgggaagaaagatgtggataacggagtggttttcctgattgcaacagaagacagaacaatgtctatccagcagggacgtgccgtggaacaatatcttacagcttcagtagctggacagatcctggattatatcgtcactccaaatttcaagaaaggactttggtatgagggaatcaatggaggaacctcagccattatggaggcagttcagggaaaattcaaaccggtagcgacaacggctccttccggtaacggaagtgcttttaaagttctgatcatcgcttttgttattttcatcattattgccattctttttggaaacagaggcggcggacgcggcggaaacaatgacgacgacgatgatgtaatcatcaccagaagaggacgcagaaattatcctggcggtttcttcccattccctggaagcttcggaggaggtggctttggaggcggaagttccggcggtggcggcggattcggaggcttcggcggtggcggaagctttggaggcggtggtgcatccggaggctggtaaacaaatacattttaaaaatcatataaatcagatcattaacgatctgatttttttatttaaaacactaaaataacactgattctttagcttttcttaatgttaaattgatctttagatattaaaaaattaataaaaccgcacaaaaaccgtctttaattcaatattttttcactatatttactaaaaacaggattatgaagaagacgctggtagtatttgcacacccttatctggagcactccaattcgaatgtagagctcatcaatttctacgttcgccaccagcattataccttaagagatctttatgaagaatatcctgactttcatatcgctgccttcagagaaaggaaacgtcttaaaaattacgataggtttattttccagtttcccctgatatggttcggaatgccgcctctcctcaggttatggattgatgaagtattcgacagagactggcttaaagagggcgaatacaatccactggaaggaaaagaagtttatattctggtcactaccggaggaaaagaaagatctttcagtaaaaccggcacataccagtataccatagatgaactgatcagcggactgatagtttctttaaaagttttcaaagcagatattaagcatataaaaatcgtttacgaagccaacaaattatccaaaaaagaaattattttacataaaaaagaattcacagaactccttaatcaataacatatggaatccagcttagcgatgaacacattaatttttctgggtgtagccattatcatggttccattggccaggaaattagggctgagctctgtgattggttatatcctgggtggaattattataggtccatatgtactcaggcttacaggaaaaaatgtagatgatatcatgcacgccagtgaatttggtgttatcatgctgctgtttcttgtaggattagaactggaaccccggaaattctgggaaatgcggaagaaaataatgggacttggactttcccagatggtacttacgattgcattattattcgttgtattcatcactgcaggatggagaatagacaaagcggttgccattgctatgtgttttgcgctatcttccacggcaattgttctgcagaccttacaggaaaaaaataacctcaagaccactgccggagaagcctcattctccaccctcctttttcaggacatttcagtgattcctattctggcaatacttccaattatagccaattacaaggccaagcatcacgataatgaaatccagattctgattcagaaactgccggaatggcttcaggcaggaactgtaatcttcggtgttgccttgcttattttattaggaagatatgtttttgttccctttcttcgttatgtttcaaaatcgggtatgacagagctgctgacggcttcttctctattcctcgttatcggggtttcagagctgatggttgttattggtctttcacctgctctgggagctttccttgccggggtgatgctggccaacagtgaattccgtcatgagctggaagcacagattgatccgttcaagggacttttactggctgtattttttgtcagtgtaggttctactattaattttaatattattcagaaagatccattgtttatattcagtactgtttttgctgtactggttgtaaaatttatcgttttatacaccatcggaaaatttttcaggatagatactcctcaaagtcttttttatgcatttgcgctttcccaggtaggagaatttgcttttgtactgcttaattatgcctctgatctttatctgttaggtcccgagatgaatgcacagatgatggccgttactgcaattaccatgtgtatcactcctatcctgcttattatcaatgataaatttattactccgaaattcattaaagaaattccggaagaagagcacgattttaatatccttggaagtgaagttacccaaaagaaaattatcattgtaggttttggtcatttcggaagtaccgtgggacgtcttttaaaagctaataaaataccagcaacagttctggaccgtgattctgatcgtgtaaaactgctcagaagctacggctttaaagtctattatggtgatgctaccagaattcctattctaagagcagcaggaattgaagatgccgagattcttgttttatgcctggatgatccggatgataataagtttattgcggaactggtacgcgaacattatcccgatgtgaaaatttttgtaagggctaaaaacaggattgatgcttatgactatctcaacaacgggatcaatcatatctaccgtgaaaccttaggaacagcagttgatatggctgtggatgttcttcatgaaacaggaatgagaaaatatgcagcaagacggctgggacaaaggtttatggctattgataaagcctcaatccggaagctggcaaaaatgaaagaagaagatgacgacattactctctttaccacaaaagaaatcctccagcgtgaggaggaattattagcttacgataatcttaattttgataataaaaactgggaaggttcctcatccgctgatgaagaagatgaggaagaatcccaggattaatttattggatgtttacgcttccaccgctgctttcctccttgattacattcttaagttctccttttttagagatatccacacttcctccggatgaagcaccggctttcacactggaaacagcactgatgtgaacacttgccccgctggaagcatctgcttctacatcatcagcaataactccttttgctgaaacactgctgcctgaagaggcgctgatatctgctttttttgcttttcctgaaagatcaagagtagatcctgaggaagattcaatatcaaggttcacggcccatattttaccatcaaagctactgctgctgcttatattgatatccatatcgttagcctccagatctccggaaatacttcctgcacttgaagcttcgatatctgttttttcctgggtaaatttatcttttacaataattcgagctgctgaatctgccaaaagttttttaaaatcctttgcataaattttcgcagtcactttgctgatgttcatcactctgattcccggtttataatgaatgtgcagttttccgccatcattatctataagaatttcatcaatgatactttgaggtgccgaaatttctactttttccgtttcagattttataacctcagcttcaatagcctgtgaaacctgaatttcatcaaagtctcctgtaaattctttatgctgcatcgggccggtttctttgcttaccactttttctacccaattacctctgtcaccttccctgtctctgtttctgttctcatgtttatcattacatgaagtcaatgccactaaggctgaaaaaataaataaagtccctgttttcatgtttatttcttttgtcaattatttgtttgatttctttatatttaaataacaactaatttataaaaaatattacattaccattgaaaatactataacagcttatcaattccccttcaaaaagcttttttgcacattttctgaattatgcagtacaaaaaatattcataaaccggcttcaataaatacattttcgaatatatattctatgatataagtttttaatatctttatggtttaataacaattatatttatgaagaatatttcatcggtattattaatttctgccttggcgttcaatcaatcttgtactacaatgaaacagaccgatattcaacaggagcttcctgcccctgatccctctttatcttcaaatccttttatgaagaagagcaagcttcaatacgaagctccggagtttgacaaaattaaaaatgaacacttcaaacccgcttttgactttggtttaaagcaacatgaagctgaaatcatcaaaattgccaacaatccggcggcccctacttttgaaaataccatcgtagcattggaaaaaagcggtgaagtattgagaagagcacaaattgttttctctaatcttaccagtgccaatacgaaccctactttgcaggctttggatgaagaatatgctcctgttttcgcagcacattctgataaaatgtaccttaatgaaaatctttacaaaagaatacaatccattaaagaagacggccttgattctgaaagtaagagactggtgcagttttataagcaaaactttgaaattgcaggtgccaatctttctgcagctgataaagaaaaattaaagcagatcaatcaggaactggcctctctttctacccaatatgccaacaaattactggaagcaagaaagcagggaggtgtatttttctcagatgcaaaagaacttgacggactttccgctgatgaaattgcagcggctgcatctgatgccaaaacggcaggacagccgggaaaatatcttctggctttacaaaatactacgcagcaacctcttttacaaaatttaaaaaacagagcaaccagagaaaagctgttcaaagcttcatggacaagagctgaaaaaggagatgctaatgatacaagagcaactattgaacaacttgctaaactgagactgaaaaaagctcagattctgggaaagaaaaattttgccgagtggaagcttcaggaccagatggcaaaaactcccgaagcagcaactaaactgatgaaccagattgctactccggcagtggaaacagccagacgtgaagcaaaagacattcaggatcttatcgaccagcaaaaaggaggcttcaaagtagagccatgggattggaacttttatgctgaacaggtaagaaaagcaaagtttgatctggacgaaagtgaaataaaaccttattttgaaattacaaccgttcttgaaaaaggagttttcttcgcagccgaaaaattctatggattaactttcaaaaagagaacagatcttccggtttatcaccctgacgtagtaacgtatgaagtttttgaccatgacggaaaatctattgcgatctattatctggatttctatacaagagattctaaaaacggaggggcatggatgagtaattttgttgagcagtcttatttattaggaacaaaacctgtaatcgttaattgctacaattatcagaaaccggctccggggaaaccttcactgatcagttatgatgatgtttcaaccatcttccatgaattcggacattctattcacggaatgtttgcaagccagaaatatccttcgctttcaggaacaaatgtacctagagactttgtggaattcccgtctcagatcaacgagcattgggctttagatcctgtcgttctgaaaaactatgccgttcattatgaaacaaaacagcctattccacaggctttggtagaaaaaatcaaaaaggcagctacattcaatcaggggtatatgactactgaattggtttctgcggctgaacttgatatggattggcatactgtaagcaatgaaagtcagtttattcctgttcttgattttgaaaagcagtctttagccaatcatggattcaatttagcaacggttccgccaagatatcacacgccttatttcgcacacatctggggaggtggatattctgcaggatattatgcttacttatggtctgaaacactggacaatgatgcatgggaatggatcagcaaaaatggcggattgaccagagaaaatggtgaccgtttcagaaaatatattctttcagtaggaaattctgtagatctgaaccaggcattcagagactttacaggacacgatccggatatcaaacctttattgagaaacagagggtttattaaataatctatgatagtcaatacaggaataaaagttttatcctcattaattattctgacttgcttctcattaaaaaacaaaaaatttgaaagcaggtcagaatctttatttcaaaaacattctgatacagttacacaagaagaagcagacaaatactttcaggagcaacaaaaatattttgattctacttgtaaggccgaaacaataaaagctgaagcggatattaagaagaacaaacttgtttattttcattatttcggaatggtaaaaagctacagaagcaatgatgaaatgaatattcttttaaaaagacacaatatcgaagtagattctgcactttattattgtactgttccacaggcgcttcaaaattgctacgccaaagtaatgtcaaaggaaattaggagaaagtttggtccaaagtttattgattctttaagacaggtagcagatatacagtatgtagaaaagaattccgataagctctatgattttgaagaatgtgatactatttcaagatatccgggaagtaaatcctaccgaagtttttttaaagattataaaagaggattttggaagaatgtacaatatcccgatcaatttgaatatcggaaagacaaagatttttattcttccatttctgcagaatttacgcttcacaaagacgggacggtctcagatatagacattgaccttacttttcataataaaaagaattataagtacgcctcttactttatcaacgaaactaaaaattttataaaaaagacaaaatggattcctgccaaaacgatgggaataacagtaaatagcagggttcctcttacattattttttaaataacaatgaaaaaaattattacagcaacattattatcagtctttggagcaatatatgcacaaaaaggccacgcaaaaccacaagccaatcaaatagacaacaaacttgtcggcctatggaaaggaagcgaaaaagaccaacagatagcagggatggaaaaacgatgggtgatggaaagaaaagcagatggtacttttatgcttatttttaccacgattcaggattgcgaagtcgatcaatttattgagagaggccaatggtggattgagaagggagaatttcatgagctccactttaattcagggaaaacagacatatacacttacaaagtcctggacccttcccatgtaaaatttgattcaaaggagcaggcattggatatagcaactgatacctatagctttgttgatactaaaattgatgaagacaatcagtaagatataatgagaagcattctttaatcagagtgcttctttttttatatttcggcgaaagcctgttcctattgaaatcaaaatgcatcttttcaaatccgaaagtagatcatatgttaaacgttaatcaaaaaattagctgtattaaacggtcaggattcattatttttgcatttcaaattttaaatacaatataatggactgtccatgctgttcaggaaaatcctacgaagaatgctgtaaaccttatcacaccggagaaaaacatgcgcctaccgctgaagctctgatgcgttcaagattctccgcctttgctattccgaatggtgaatatctgatggaaactacccttccgggaaaaagaaagtatcacaataagaaagatcttcaggaatggggagaaattaaccaatggacaaaactggaaatcataagaacgcctgctcttaaccatgtagagtttaaggcttattatacagatcaggacggccatccgcagattcatcacgaattttcagtctttcagaaaatgcatgagcgttggtattatgtttcaggagagtttttagattagtacatataatgtcgtgcgatgctttgcgcatagaaccacccccgtcaaaaattctttgaattttcgccacccctccggtggaggggaatgccaagcaaccaataactattatatccttataaataaaaatgtccgacaaaatcggacatttttattttttagtgagcatcagttccgtcaattccgtgagcgtgaccgtgtgccaattcttcttctgtagccggacgggtattcaaaacttctacctggaagtctaaaactttccctgccattgggtggttaagatctgctaccacaacttcaggagtaatttctactacaaatgcctggaaattgtttccctgattgtcagataaaggcaaaatagctcctaccggcggaagtcctgattctttaaacatctccactggtaattgtgcaatagcatccggctgtctttcaccgtaagcttcttcaggctggatcacaaaagccgctttgtcgccagcttttaagcctaagatattttgttcaaattttggaatcatcattcccacaccatacaaaaatgtaagcggattttctgttgttgtctcttctacaagaatcttacttccatctggttcgatagtgtgaagtatatactttacagctacaacgtgattgttttcaattgtcatatttttctttttttcgtgattttgtctcacgattaatggtacaaatatactgtttttgaaatgattcaatgagcaaggaagatgggagatggaagaaggaaactatgaaaggcataaagaaaaatatttctctcttttttagcctttattttttcgggcctcatctctctttttctgtctcaggacaaaaagatataagctttccacctttgttctggcccagggtgttttccgtaaaaatttcagagaggagctgatacttggattatctgtaaaacattttatattaatctgttcaccaagcctttcgaaaccttcataatattctaccagttcctcaaggatagcatccagtctttttccatgtagaggatctttggactgctgttccatattttttctgcaaaattaatttattataagtttatatggaaatctacaatccttcttctctttttgtttcttatttttgaagaagctatttttcacccataaaaattatccgttatcaaacatgagcaaaaataacgaagccaacaggaaaaaaaataaaaagaaaattgatcagaagaaacgtaaaatacaaaatgctgaagcagaaagaaaagcaaggttaaaacaaatccgggaagatttcaaagcaagagaagctgataataagccataaaattgtttttaaccgaattaaggaaaaccttatttttttaaattaagtattctctatctttacatgtaatagctgcaaaataattctttacgaagcaagttgaaaattatgcagcaaatattctttttaattctcaaatttaaattatgaaaatcctccacactgccgactggcatttgggtaaacgtctagaccgtttttcaagactggaagaacaggttctggtgatgaatgaaattgttcagattgctgatgagcaaaacgttgatttagttttaattgccggtgatctttttgataattttaatccaggtgtagaggcagttgaacttttttataaaacactgaagcgtctatctctgaatggaaaacggccggtgattgcgatttccggcaatcatgattctccaagtttaattaatgctcctgaccctctggcgcgggaatgcggaattattttaatcggccatcccaagacggaaattactcctttcggaacagaatattttaacataaccaattcaaaagaaggttttatagaactgaaaattgacgggatagatttcccggtaagaatacttcatactccttttgccaatgaaatccgtttaaaggaatatttcggcgaaaataaagaagaggaaatcaacaaagtactttctcaaaaatggaaagatcttgcagatcagttttgtgatgataccggagtgaatcttctgaccgctcatttgtatatgaataaacggggtgcagaaattttagaagaaccggaaggagaaaaaccaattaaaataggaaatgcagatctcattttctctgacagcattcctgaacagattcaatatacagcattgggccatctgcatggttttcagaatatcggcacgaaggaaaagcctatgatctattcgtcttctcctctatgctacagtttcagtgaagccgggcagataaaatatgtttctattattgatgcggagccgggaaaagcagttagctatgaaaaaaaggctttaaaaaacggaagagcactggtcagaaaaactttcacatctgtagaagatacggttcagtggctgggtgaaaatcccaatacatttatagaactcacactggaaagcgaaacttttttaacggctgatgaaagaagattgatttatcagtctcataacggaattgttcaccttattccaaaagtaaaaaataaagaatttaccgaagaacaggctcatgaaatcaatttaaatcaaaatattgagctgctgttcaaagattattttaaatcaaaaaacggcggacaggaagccaatgaagaactgatgaatttgtttaacgaaattttaaatgcataagccatgatccctgttcaattaactatcgaaggtctttactcgtaccgggaacgccagactattgatttcagaaatcttaccgaagcggggctgtttgggattttcggggctgtgggttctgggaagtcttcagttcttgaagcaatttcgtttgccttatacggtgaaacagagcgtctgaatatgcgtgataaaagggcttataacatgatgaatctgaaatcaaacagttcttatatagaatttgattttgtgaattatgagaataaactcttccgtgccacccgtgattttaaacgaaactccaaaaaattcgaagaggtaaagcctaatgctgttactttttatgaaaatatagatggaaaatggattcctctggagcactcaaatgcagaagctatcataggtttaagctattccaattttaaaagaaccatcattattccgcaaggacagttcaaagaattccttgagctgggtgccgcagaaagaacgaatatgatgaaggaaatttttaaccttcagaaatttgatcttcagaacaatgtttctgcactcaatgtaaaaaacagatctgaactggatcaacttgaagggcaattaaaaggttttgaagatattaatgaagagaaaatcaaaattcagaaagaggaacttacagaggaacagaaaaaactctcggaagccaataaaaaactggaaaagatctcccaaatctatcaacagctgaaaaacctgaaaagtgattttgaaagtttgcagctgaataaggaaaaattcagtaagctctctgaagaaaagcctcaaatggatgctttggaggcaaaagcagaattatatgaccgtattttcagaatcttcaatccgctgattattgagaaaaataagctttccaaagaaattgcagataaacggaacgagaaagaacagcagattaaaatatggcaggaaactgaaaaggcttttactgttataaagaaacagctcgctgctcttgaaccacaatttaaggcattggagcaatcaaaaattcaggaaaatgatatgaacctcatcgttcagatcctgaaattttctgaagaaataaagactttaaatgaaagaacccggaaaggctctgaaaaggtaaaagaagtaaatcttaataaggagaaaattcaaaaaaccattgatgaactttccgcacagattaaaactttaaaagaacaaaaacttgattcagctttactttctgaagtaggcaactggtttattcaacataagaattttaaaaagatacagcaggaacagaccgaaaaaactgaacagcagcaaaaacagattgcggaaattgcagaagaactaaaaccttttggctatcatgaaaattacaaagacgatttcagaatcaggaaggaaactttagaagctaaaagaaaagagctttccctaaaactggatcatcttaaaatacaaaaagagctttcccgttttgccactgaacttcatgacggcgaaaactgcccgctctgtggctccaaagagcacccgcacattgtggaatttcatgatgtaaatactgaattacaggagatccaggagaaaattacatctgttgagcaggaagtgactgccgttcagaagcaggaatctgaaattgataaaattctggaccgcaaaaaaatctttgaagaacagcttacttcagagcaaaaaacggtactccggattcagaaagatatagagcatcatatcctgagttttacatggaagcaattttctcatgatcaggaagaggaatttgagaaaaaacgttcagactcattcactttagaaaaaaagattgaagaagcggagcgaaatatagcactggaaagagaaatgctggaaaaagaaaacaaaacgctggagaaatataagagtgcattggaggctttccgtttggaagaagtttcgaaacaggaacaaatcaatatcagccgttctgcgcttaaaatcctggactggaatctgtatgctcaaaaaacaatcacagaaattgaagatgcttatcaaaagttggttctgtccaacaaagaaaccgaagaaaattataataaagcattagagcaggaaaagattctttctccaaagctggcagaacaaaaaaccattgtcagccaatctgaaaaacagatcacagaacttgagagagagatttccgcaaatgaatcggttatagcccaagccttagcagatcaaaatttcaccgattttaaagaagttgaaaacattctgcatcaggaaattgatattcaggttgtgagaactcaaattcagaatttcaagattgaatttgaagctttaaagaaattcatcggagaactggaattaaagctgaaaggactttcatttgacagtaaccagttttcgttggctgaacaacagcttactcaagcacagaacgagcaaaaacagatcagcgattctgtggtgacaaaggctgcagaaatagagcgtctggaaaaagaattcgtaaaaaaagaagaactgttgaaagcactggcaaagcttcagaaacgttctgaaaatttaaaggtcatgatgaacctgtttaaaggagctggttttgtacaatatgtatcatcaatttatctgagacagctttgtgatcatgccaatgtacgtttccacagaatgaccagaaaccagctgagtctacagcttaatgaaaataacgatttcgaaatcattgattacctcaacgaagggaaaagcagaagcgtaaaaacgctttcgggaggacaagcttttcaggtatcgttgagtctggctctcgcactggcagaaagtgttcaggccaacgcgcaggcagataagaatttcttctttattgatgaaggtttcggaacgcaggattctgaatctgtgaatattgtctttgaaacgcttaccaacctgatgaaagaaaacaggattgtaggtattatttcgcatgttgaagaactgaaagagaaaattcctaccgctctcaatattatcaaggatgaagaaagaggaagtatcattgaaattatttagttcaatatattgtaaataacaaaagccacaaaagaaacaaatctttcgtggctttcacacctcacaaactttcctgttacagtccttttataacaggcttcacttcatttccaaacaattctatagatttcatcatcacatcatgagcaggatctcccacatccatatgcccgataaatcttgtgattccaaaaatctctttcatataagcaattttatctgttacctcagccggacttccgataaacagtgcaccgtctttacttcttccgccttcatactgtgcttttgtgtaaggagcccaacctctggaagcgcctattctgtccatctgcgatttataattatgaaaatatccatccaccactttctgatcatcactcacaaaggtatgggagtgaatggcgatctgcattttcgaaacatcatgtcctgctttctgatattcctgtttatagaattcgatcagattcctgaattggataggcattcctccaataatggctactactaagggcattcccaattgtgccgcacttaaaacagactgaggagttcctcctaccgctctccagatggaaagttttccgtcattttttgctcttggatataccgtttggttctgcatcggagcacgaagttttccagaccagcttacattttcttcagaattgattttcaacaataattctaatttttcgtcaaatagctgttcatagtcattcaatgaataaccataaagcggaaatgattctatgaaacttccacgtcccacaaatatctctgctcttccgtctgaaataagatcaagtgttgaaaaatcttcatatacttttaccggctctgaagaacttaaaacagttactccactggccagctttacatttttggtaatacttgctgcagctgccaacactatttccggtgaggaaacggcataatccggacggtggtgctctcccattgcgaaaacatcaattcctacctcatccattaattttacctgatccagtatttcacggatcttagttcctgcatctctatattttccggttgactggtcaaaagccaggtcaccgaacattcctattcctaattccatattgttgattttagtgatacaaagttaccactatggaaaatcaaaaacattgatgtttgttaagatcggaagatgattactttaaacactaattacactaatggatcactaataacgcgagagtgtcattgcgagcaaagcaaattgtgcttttgttggaaaacgcaaaggcgcgaaaggatctttatcttcattctgtttaaggcgcaagaaaatcgaagattttcagcaaaggtcagttcttatagtattagggactataaaattttatcgcagataaaatctgtgcgccttacgacataatccattagtaatcttgtgcctttgcgttttccaaaaaattagcaaaaacaaaaaatccagccgttccgctggattctattattatttcttcagatataaatcaaaataatctgtaatcttctgcatcaggtgaaccctgtctttcccgatcacattatgcggatgtcccggatacgtaaagtaatccagctgaactccgttatccacagcagacttgatgaatttgatagaatgctgccatactaccacatcgtcctgcgctccatgaatcatcagtaattttcctttcaggttctgaactttatccaaaagattggctgcagcatatccctgaggattttcctgcggggtatccatatatctttccccatacatgatctcgtacatgctccagtcgattaccggtcctcctgctactcctactttaaatacatccggcttgcgaagcataaaacttgtcgccataaatcctccgaaactccacccatggattcccattctgtctccatctacataaggaagagattttaagtactctacacctttcatctggtcattcatttctgtagttcccagatttctgaatacagcctgctcaaacttcaacccacggttggaagaacctcttccgtccattgtgaaaatgatgtatccgttctgagccatgtattcgtaccaaaggtttccggaagccgggaagctgttggtgatcagctgtaaatgtggtccgttgtacagataaacaatagtcggatattttttattgggatcaaaatttgtcggaagaatgattttcccatacaaaagagtaccgtcgtctgcctttacttctacatttttgatttccggtctctgataattctttaatggattttcagaagtaagaatattggtagtctttaaattggctgtattgatgatattggcaactctaggtgaattggcattgctgtaggcatcatacaggtagtttccgtcactgctcaaagttccggcatgcataccttccgcactgtccagtctctgcatcttaaaattcgtccagttgattctgtataaatgtctttccaaaggagtctctttcgtagaggtaaaataaatttcctttttcttttcattaaatcctaaaatatctgttaccagccaatctccttttgtaatttgtgctaccagtcctttttcaagactgtaatggaacagatgattatatcctgttctctggctctgccagataaaatctgtgttggagttcgggaagaaagtaagcggatgttgtggttctacatatttactgtctgtttcttcaaacagcgttttcaccaattctcctgtaacagcgtcatattgattcattttcatatgattctggcctctgttcagaacgcctacaaaaatgtattttgaatccgggctccaggtaactgcagtcaggtactgatctttttccccttcaatttttaagaaagtagtagattgtgtcttaatattgaaaacgcctaatgttacctgatgagaagtctggccagccatcgggtatttgatgttgtgattgacagcaggagttacagaccagtcaatgatcggataatctgcaaccatgctctgatccatcttatagaatgctacactctcagaattgggagcagggaaaattcctgtatcaattccgaattcatttctgtgaactgcctgaccgctgatgatattttcattggtttcgttagttacagcaatcgtttttccgttcttatttacaaataaattgttctttaccgtgaaagcaaaggtctggttatctccaaacatttttatgttggctgcatcctgatcaatgacagctgtactctttactttccagtcatttcctgatttttcaatccaggacattttaccaccagcagcaaaatagccattggaatttcctgtgaatctgatggcaggaacagctttcagtttatcattcgtaaactgtttattcaattgggtaagagataccagagtatcctgcttattggttttcagatctgtaatcagataaccacctttcacagcctgtatgtaagactttccatctgcagcccacgaaaactgggagatatttttcacagcaaggttggtcctcattccatttacagcctccgccatggtgaacttctgggtctgggcaaatgctgaactgcctaaaaccagcatcaataaagaaaatttatgtaatttcatcgtataaaattgaatcctccaaaaataagaaataaaaaccattcgttaagaaatgttaaattaaaacattcataaaatggaattcattcattgaaagaaattatttcttaacttaatagtagattttttaaaagagattaaataagtcaattgtgaatagtcaattcgctgcgcttgtcaaattttattgctggaaagatagtattcaccattcacttgcgaagcaaaattgacgattgatgtgctaaataagcaattgtgaatagtcaattcgctgcgcttgtcaaattttattgctggaaagatagtattcaccattcacttgcgaagcaaaattgacgattgatgttaaataagcaattgtgaatagtcaattcgccgcgcttgttaattttaatttattggaagatgatagtattcaccattcacttgcgaaacaaaattgacgattgacaaaaaaagttcatttcttatcctatatcaatgacttgtataggtaagctatcctaaatttgcatcattaataacaaacaaaaaatataaaatacaatggcaacaaaatggattttagaccctacgcatagtgaaattactttcaaagtaaaacacatgatgatctctaacgtaaaaggaagtttcagaactttcactgctgaaattgactctgaagacgaattctttgcaaatgcaaaaactacggctactattcagacggattctgtatttacaaacaatacggacagagacaaccatttaaagtcagctgagtttttcaacgctgaagtgcatcctacaatcacttttgaatcacaggcattaaacaatactgttgtaggtaatcttaccatcaacggaattacaaagccagtaacgcttgacgtagatttcggaggaattaatgtagacccatggggaaatacaaaagcaggtttctcttttgaagggaaaatcagcagaaaagacttcggattaaactggaatgcagctcttgaagcgggaggtgtaatggtaagtgacgatgtaaaagtagctggtgaattacagtttgtaaaacaagcataattaacaacatataatataaaaggttcagggatttgtctaaaagccttgaacctttattctttttataatcttcaatattatgaatctcaatgatcttcaaaacataagcgacggttttaaaaacactcagagaatgcctgttttatttcttggacatggttcgcctatgaatgccattgaagaaaaccaatttgtacagggattccggaaagcggcttcagaaattccaaaaccgaatgcaatcctttgtatttctgcccactggtatacagacggaactttcgtaacggcaatggatatgccgaaaaccatccacgatttttatggttttccaaaagcactttttgatgtacagtatcctgctccgggaagtcctgagctggcaaaggaaacagcggaacttcttctccctgttgatgtagaggaagatcacagttggggactggatcatggcgcatggtctgtgatcaagcatatgtatccggatgcggatattcctgtgatccagctgagtatcgattatacaaagtctccacagtatcattatgacctcgctaaaaggcttaataagcttcgtgaaaaaggcattctgatcatcggaagcggaaatattgttcataaccttcgtcttatcgactggaaaaacatcaatacagtaggagccggctgggattgggcagtggaggcacgggaaaaaaccaacatctggcttctggacggtaattttcagaatatcatcgattatcagaaacagggaactttcttacaatatgccgttcctactcctgatcattatcttccgttgctttatactttaggattaaaagatcagtctgaagagcttactttattcaatgatgaacttatcggtggctcactgagtatgacaagtgtaaggatcggataatatgaatattaaataaaaaaagaaatacctcagccgaggtatttcttttttttatgactgtttttttattgtacagcttttaaagcattgatgtttccgtagccgtagcttgaatttacactggaataataggtggaagcctgtctcattttagtgagtacctgctctctcgtccatgacggatttttagcccaaaccaatgccgcaattcctgctgttgctgccgttgccacagaagaaccgcccacataatctgcctgcccgttataataactaagcaccggaacggtatttcctgaaggcctttccatctggaaagtaaaatcgatctgacttcctgagtgacagacatcacatctctgattggaagtattttcttttacgcctgtaatggcttgagtttccggcatagatgcagggaaaattacacccacaaaattagtgaagctggtagaagttcctcccgcacagaaaatcagttttccttttgaatacgcatacttaactccatcttcaatttttccaacggaaaaaatatgccccatcgacatagaaatgatctttacattggtattattacccaattctgtgaaagccgtttttactgccgtctgctcgctggaagtttccagaacaacattttctgctgccctgtatgcaataagattggcgttataagctacccctacaggtaatcctgcattatttctgggagctgccattacagaagccattttggttccatgaccgcactgatctccagaaccgtctgaattatacaccccgtatttactgatcgttctccctgaagaagctccgttgttaaagctgctgcccagtaaagtctgttccggagaaactcctgtgtcaataagtccgatagtcactccggctcctgtgctgtagctccaggcttcaggaatactgtgtttggtgaaagcccatggaatttttgcgccaggcgttgttgaggtataatctgctgtactcaatgtggcagaagaaaaaccacatcccgatgaaccacttccggaagactttgcagcagtattatactgagcttcaaattcaaaataatgataatctgccggttctacatatcggattgttttcatttgccggagagccgtgatggtttcctcgttttcaatgacaacatccatctgattcagatattgatctgaaaggagaagaaaatttctttcctcttttccttcatactttctgatcacagaaagaacttctttctccatatcactgctgtttggagatttacttctgtcaaagtcatcctttgaagctccgaaaccgatggaaaccattttgtttccacggaaagcagcactccatatgaaatgatcggattcattcttccagttgaaagtaccatctgtttttatagcctggttgatcctttcattgatctgttttgcagtcaaaggatctttctgagccatttctgtttttacattttcattctgaagttcttccctggtacacgagtttagggcaaaaaatattgccagtaggaatacagtttttttcatatgttataattttggttggagccacaatataacactttaacgggaattaaaaacttaaaaagagtaaatttagcattacaggaatattaaattacagtactttttcatagcagacactctgctcaacgccaatgtattgcccataattgggtattctgctaaacccgcttttttcgtatactgaaattgcatttttaagatcccttgaggtttccaggactgcttttttaaaattcagttctgcagcccagttttcaagttcttttacaatggcagagccaagtcctttttttctgaattccggattggtaaacattcttttaatctctacggtatcttccgaaagcggtttaaaagcaccgcaggctgccggaatattatcaatgtaggctacaatacagtttttgatggtatcaattttattgaattgagcaaagaaatcatcattttcaccattatgttccgataaagtggcgtcaagggattttacaagagtttgaaaatctgtattggcagaatctgttctgagtatgtgcattttgtttgattaaaaaattaaaaattaaaataatttaaagatctgtgaaaacaaaaagcttccttctggaagcttttattttatggagctggtgggggtggattttgaaaatgataatgtttatttaatttatcattaacccttttatctaatacttctgcataactagttccaatttctcttgcatccttcattaagtttggcatattttcaatcattttctgtcctgccggagttttataaaatttaataagctcatcaacgtctgaatcagtaaaatactttttataaacaggaatgtataaagcaaaaattttctccggtgacatgtcttttttaaactcatcccaaaaactctcaggtaaatctttatacttattgttataatagtccataaactgttgaaaagctatagacaacatcttatctgatcttgttaaagtgatcagttctttcaattttgcttcattggactgagaaaaagcatttattcccaataagaagaaacacaaaataatacctttcttcatatttttattttacatcaacaacaaactttctctcattgatcaattctgcgatcgctaacatgtctttaccgataagcctgtcatcttcaagcttagcaactttggaacgaagaatcgcgaagttttcctcaattattttcgagcatttggcaggtcttctgaactcaagtccctgagcggcaaacatcagctcaacagacagaatattcacaagatttccaagaacctgattgaattttcttcccgagatacttcccatagaaacatgatcttcctgacctaaacttgtaggaatagagtctgccgatgccgggaaacataatgttttattttctgtaaccaacgctgcagaagtatattgagggatcataaatccggaatttaatcctgagctttccgttaataatcttgggagcccatattttccttctaataataagtaacttcttctgtcagaaatattccccaattctgctgcagctaatgtagcatagtctaaaggcagtgccatcagctgtccgtggaagtttcctcctgaaatagattcttcagcacttagaacaatcgggttatctgttacggagttcagttctgtttccgccatacttctgagatgttcaaaagcatttctgctggctccgtgaacctgtggtacacatctcatagaataaggatcctgaactctctcacaatcttcgtgagctttcaggttttctgatccttttaagaatttaagcattcttgctgctacttttttactgccttcaaatggtctgatctcatggagttcctttttgaaagggctggcagagcctctgtaagcttcaatactcatagcagcagtcatatctgcaaggtctaataaatattcaaatttttcaagtcctttgatcgcatgagcaagaataaactgagttccgttgatcaatcccaatccttctttaggccctaaaaccaatggttcaaggtcatgtttcttcagaacctccatagtatcagacacctgctctccttcccaaacctgtcctaagccaagtaaaggcaatacaagatgcgctaatggagcaaggtctccggaagctcctacagatccctgctcaggaactaccggaatgatatctttttcaagcatcaggatcattctttcaataacttccagagaaactcctgaaaatccttttgaaagggcatgaaccttagcaatcatcataattttggaaagttctttatctataggctttccaacacccaccgcatgagaaatgatcaggttatattgtaactgagcggtctcgtcagccgaaattttagtatcacacaatggcccgaaacctgtattgattccatatacacatcggtctgactctactattttctgtacgtttttctgagattttaaaatttgttctttggcagccttgttcagcttggctttattaggttttttacatatttccagaacatcatggaatgtaaagacatctaccccgtatatcatttctaaaaaatttccttaaaattacgcatttaacaataattggaaaagctaaatttcaatcttctatatttttataaagcaagcgaattaatttactatttttagccccgaaaattaaaaacaataatacatgagaatgaaaactctattccttgctttatgtgtagcaagcacagccgctttcgcccagaaagtaaaatattctaaagaagaaagaaaagaaatgaaccgttatctgtttaatgaaggtttcaatacggcaacagataaaaaagtttctaccattatattgaaagataatactgagcatcagggttacagtaaatcatgggaaaagcaaaaagggcagattctttctatcaccattgaggatgttgacaccagaaagcctatgaaatttgcagcagcagatattgctgaaatgtacttatacgcaactgagactgaaaaatcgatgaaagcggcaaagtttatttccaatatgagaaattacagtactaaaaaatacagcaaatctgtaactgatgacgcaattccgtatgaaaaccagattgtttctctaaaaaataaaaaggaacctaaggcctttttaatgcaggtaatcaaccctgaatttaatgaactaattacggtttatcacgatccgtttgcttcagagactgtatccacaggctttgccggcgctcctgcatttggaggtggtgttatcaaatcttattatgtaagaaaaggagataaagtaatgtggcttcacaaagatgattttgaagataactatgattttctgtttggagacaatgccgaatttatgaaaaagtatcctaaaaactctgtagaatggaattatcttagctttctgatctatcagtatactgaaatgagccacggataaaatagacattcatcatacaaaagcctgtagagccatctgcaggtttttctttttttaaatagggaaagtttccttaattttgttatatgaatccttctttagaactacagctcaaaaccttaccatccgaacccggcgtttatcgttattatgataaaaatgaacagctattgtatgtggggaaagctaaaaatctgaaaaagagggttctctcttatttcaacaaaaatctttccggatacaggatcaaaataatggtcagtaaaatccagcgtctggagacgaccattgtaaacagcgaatatgatgctcttctattggaaaacaatctgattaaggaacatcagccgttttataacgtcatgctgaaagatgacaagacttatccatggatctgtattaaaaatgaagattttccaagaattttcctgaccagaaatgtgattaaagacggatccgaatactatggtccatatgcaaaagtgcgtcctgcaaagattttattggataccattaagcatatttacaaactcagaacctgtaacctgaatctttctccggccaagatcgcagaaggcaaatataaagtgtgtctggaatatcatatcaaaaactgtgaaggcccgtgcgaagaccttgaaagcaaagaagattatgatgaaaagatagatgctatccgcggaattattaaaggagatttccgaaaagctaaggagtatctggtgaatcagatgatgaagctggcctccaatcttaaattcgaagaagctcagattattaaggaaaggctggatattcttgaggattatcaggctaaaaacaccgttgtaaacccgaatattgatgatgtagatgtatttggaatgaccagtgatgaaacagccgcttacgttaacttctttaaaatccgaaacggaaatatcatccagagtttcactacggaaatcaaaaagatccttgaagaaactgatgaggatattatggaagaagctttgatagaaatccgtcagaagttttcttccgattctaaagaagttcttttacctttccatttgtctgtggaaattcccaatgtaaaactgattgttcctaaagtaggagacaaaaaaagaattgtagaactttctgaaaagaatgctaaagaataccgtctggaaaaactgaaacaggttcagattgtagatccggaaaggcataccaacagaatcatggctgaaatgcagaagcttctgagaatgcctgtagagccaagacatattgaaggttttgataactcaaacatccagggaacaaaccctgtatcagcatgtgttgttttcaaagacggaaggccaagtaaagctgattaccggattttccatccgaaaacagtagaaggacctaatgactttgccacaatggaagaggtcatttatagacgttataaaagaatgcttgatgagggtgaaaaccttccgcagctgattctgatagacggtggaaaaggacagctgtcttctgcagtaaaaagcctgagattactgggactttacggaaaaattaccattgtaggcatcgccaaaagactggaagagattttcttcccggaagatcctataccattataccttgataaaaaatctgaaacactgaaaatccttcagcgtgtacgtgatgaggctcaccggtttggggtaaaacatcacagaacgagaagaaaaaactctaccatcaaatctgaactggaagaaattcccggtgtgggagaaaaaactattgaactgctcctgtctaaactgaagtctgtaaaacgcatcaaagaagccaatctggaaactcttgaagaaattctggggaaaagtaaagctaaagtgatttgggaattttttaatgccaactaattgtacagtgtcatagttaattttctaacagaagacacaatcattcttatgcgattttatatgatttctcattttatcaatatgagacaaaaaccaacacttctttaattacagagtaaatccatcaacaaaatacattaataaataaatattttatttaaaaatattattatatgtatttttttcataaattagtgttatcaactaataacaataatactatgaaattttttcctgttttataaattctatcacattctcacaaccttttataaataaccagaaattttattaagaagtaatgtttctactatcaaaattgaaaaacacatcagcatatatattattaaaggctctttttcaagagcctttatacttattgtttatggtatttttattattttgctgcaaaaacttctttagcatatttaccatctgtctgaggaatatcaatcacgatatttccgttttcaaaataacctatggtagtacttccatcagataactttacaaggaaaacagaattcttagacgttgctttgaaaactgcaaacggcactgagctgccagactttgccagaataaactgatttggatcaagttgtattttctgaagatccagcttgccatttgagtagttattcgcctccggagttgttgttgttgttgttgttgttgttgttgttgaaggcacaactgtttcaggaaatgtacgctgagcaatattatcagatgccggtagcagcgctacaggattagaaaccgggatttttatgaaagatttcttaagagcatctggataaccctcttcaaactctttaatatttgaactctctttagattcaaaaacaattttgtccttacaattcttaaactgtaaagttactttattaacaaaaagacttgagctgtcaagaatatctgcaataagtacattacaggaattttctttagcatcagaaggccactcttctttattcataggtaaaacaacgtattttttactgctcaaggacatttttaaaatattttccaagccaaagctatcttttttaaatgtttctaatttttctggaatagctacatatttataatctgaaaccttttgtgcaaaagccattgtagaacatacggctaacactaacattgataactttttcattttaattattttaatcatttctgaatgctcccatatccagttttaaggaaaagaaattggaataaaaattagatccgcctatccctgaatttgtaatcgcgtaatccagtgtaagccctctatatctgattccaagacctgcacttggctggaacgaaacttttcttttaagatcctctatatctgttatcgattgaaatctgttaatccccaatctcacaaaaatcattttctgatatcctaattcagctcctgcataagggctgatacttgcaaaatctgtagaaatcaatgaagcggttttagcaaaatctacattcagaccggcttccggaagtacatatacactgctgttgatttcaaatagtttactggctcccacatttagtttgggcatggtaagctccattttatcttttggcgccgggttaaattcttctccgttgacaaccgttgaaagttctttttgattcacactccagaagtttacagttgtggtgatgtccctcaccattcccccgaatttccatccgttatctgctttgtaaatggcacccacatcgaaaccgaaaccataaccattggcaaatttccctacatttctgtaaacaatttttgcgtttaccccgacatctaattttggatttccacccggcctgaaggcataggataaaatagccgcataatcggattgggagaattttgtaattttatcataatcaatattcccttcagaatcgatcatctgcgtggtattcaaaatattatctactccaagccttactactgaaacaccaaaaacaccttcttcaagaacctttgcataagccagataatcatattttgcaatggattcaaagtattccgcatgcattgctgccccttgccagtccctctccacagacatcaaacccgcagggttccacattggagcgtacacatcatcctgattggaaatgactgctcctcccattgcaagtcctcttgctccggctccgatatttaaaaattcattcgagtattttctgataatctgagattgtgagagcccaaaaagtagtgaaaatgcaaataaaaaatattttttcatcatataaatttgatgcttagtttaagtttttagtttttctggctttaattaatccatttgcaatgattgccagtatcataacacctgaagcaatataaaatatggggctcatatgttctgattccccaaagataaaaaaagctagtataattccgtagacaggttccaaattaactgttaaaattaaagtaaaaggtgatatatacttcattaatttcactgactccagcattggaaaagccgtaaatacactggctaacaagcatattaacgccaaatccctgtaatttatttcatttatctgaaaaatctgccccgaaagtaaataaaatatcattaaaataaaccaaccacagaatatttcataaaaaataatatttcctgaacttgtttttccaaacatttttccgttaaaaacagaaaaaacagtcccgaatatagcacagagaattccgtaaataatcccttctttaaagtgaaattctgttttaaagatcaataagatgcaagccacaatgactgctcccattactacctcagatatatcaatttttcttttgaaaataattggctccagaatcgaggcaaaaagtgtagataaagaaagacagctcaatgcaatagagacattggaaactttaatagaataaaagaaacaataccagtgcaacgccatcgcaaaacctatagcagccagctgaaaaaatatttttttggaaacctttatactttctttcttaaaaacacgaataaatatgaaaagaaaaacagaagcgaacaacattctgtaaaataccaggatctgagcattcgcatggattaactttcctaaaattgcagtgaacccccataaaaaaactattaaatgcagcctgaaaagtgccaatttatgcataccctatctccttttaattttaaccctgcaaatttacaaatcacaaacccaaatattgataaaaagataagtttaatgtaaaaaaagttaataaaaattaaattgacatctaattcataaaaaaaccctgaaaatttgttaaactttcagggccttcaaataataaactattaaaaaaataaactaggaacttagagtatttttgcagagaatatcacctctgttactctagtgtaaagttagaaaaaatataaattatttaaaaatattttttagttaaaaatttcacaatttactagaaaccaaactattaaacacttgttttacttcctatttatattcctcataaaaatagtatctttaagcgtaaaaaattgaaaattttatggacatcgaattcaataaacgtgaagatcagaacagactaaaattatctgaaataaatcgcttacttactgagatcaaaaaaggaggaggtgagaagaggcttcaaaagcttcgtgatgaaggaaaaatgacagcaagagaaagaatagattatcttctcgataaagattctgattccatagaagtaggagcatttgcaggatatgaaatgtacaaggagcacggaggatgccctagcggcggagttgtagtagttatcggctacgtttccggaaaacaatgtattattgttgctaatgatgcatctgtgaaggctggcgcttggtttcctatcacaggaaagaaaaacctgagagcccaggaaattgccatggaaaacaggcttccaatcatttacctggtcgactctgcaggtgtttatcttcctatgcaggatgagatcttcccggataaagaacattttggaagaatcttcagaaataatgctaaaatgagttcaatgggaatcatccagatctctgctgttatgggaagttgtgtggccggaggtgcttacctgcccatcatgagtgatgaagctatgattgtagataaaacaggttctattttccttgccggaagctatcttgtaaaagccgctatcggagaaagtatagataacgaaacattgggtggtgctaccactcactgctctatctcgggcgttactgattataaagcgaaagatgacaaggatgctttgaacagaatcaaaaatatcatgaaatctatcggaacaactgagaaagcgggtttcgacagaatagaaagcttcccgccaaaagaaaatcctgaaaatatctttgggatcatgccggtttccagagctgagcaatatgacacctacgaaatcatcaaatgtattgtggataactccgaatatgaagaatacaaacctgattatggcaaaagtattatctgcgcaacagcaagagttgacggctggtctgtaggaattgtagccaatcagagaaaactggtaaaaagcggtaaaggcgaaatgcagtttggtggagtaatctactctgattctgctgataaggctacaaggtttattgccaactgtaaccaaagaaagatccctttgatcttcttacaggatgttaccggatttatggtaggttccaagtcagaacatggcggaatcatcaaagacggagctaaaatggtaaatgcagtttccaattctgtagttcctaaatttactattatcactggtaattcttacggggcaggaaattatgcaatgtgtgggaaagcttatgacccgagattaattgttgcatggccttgggctgatctggctgtaatgggtggagcacaagctgcaaaagtattagcccagattcaggaatcaacattaaagaaacaagggaaagaaatttcagaagaagagcacaacgaaattctggacacgatctcaaagaaatatcagaaacaaaccgaggctacctatgcagcggcaagattatggacagatgctattatcaatccggcagatacaagaaaatggatttctatgggaattgaagcagcaaaccattctcctattacagaaaaattcaatctgggagtaattcaggtctgataaatctacataacaaaaaaaatacggctatctcagtctgagatagccgtattttttatacttaaaaacaagcaatataagttttatttttaaggagctgtttcccgctatccattcatagtcctcgcacctgcaccctcccacgctcaaaccctaccgcactccagctcctgctgcggggtaaccattcctatcggggctaggagtgaatgagtgatgaatgataagttataaatgatgtgacgagattcgggatacaggttctgtggttatcttttcctatgagtaattgattccaatggcgtctttctttttcatttttgctgcttctttctactgtgtcattcgacaggaatccaggttcctttatgagagttttaaacgatttaaaagggtaaaagtaatacttaagttatgtgctaatactttgcagagactcctacggagtgacaatagggtatgtgatgaatgtcaagtgataagtgatggttgataaatgataattgattgatgtatcgtttaccattcatcaattattacttattacttattactcattgcttattgcttattgcttatacgttcggtataaagcaaaaaaaatcctctatcatttgataaaggatttttaaaaataaaataaaaactggcggcggcctactctcccgcgttagcagtaccatcggcgctggtgggcttaacttctgtgttcccattcctttaaagttttttttcgtctgtctcttgtgaagtaataatgttcctgcttagctaaaagcccttctgcgcttactgatctactctcgttttcagtggggcaaagatagtaacttcctacaacgcaaaacaagtttatttaacttaaattttaccgtttcgtaatatttgctcttaaggcactggattgcagggagaaaaattttaaacatttgtttggggcttgggctggagagttggagtgtatgagagtttgagcgtttgagcgtttgagcgggggagggtttgagcgggggagaaagagagaatgatgatacggggtgtggggttacaggatgcggggttgaccattgatcaaaatagtgtatatattatataatagagaacagactatataagaaaacagggtttcttcgacaagttcaaaattatacctgtttcctattgaattgatgatacaccatattatatatcaaacacagcgttctcactccgcagaagtccgggcaaaacttttccgtagcatgacaaggctaataccaattgttaaaaaagattttagacattatcctgccaacttgcatcctttaagggctttggtcaagaggtttggattcctgcggaatgacacaaggggataaaggcttgtacacactaacccgaagctcgcaacacaataacccgaaccactatattctcctaccatgaaattcatcattcatcattcatcattcatcattcattattaaagactccttccctagccctgatagaaatggttaccccgcagcaggagctggagcgcaggagggtttgagcgtgggagagcgctggcgcgaggagtaaaaatggatagcaggattaagctccataataaagagggagtgtgagagagtgagaatataaaagtattgagaaactgaagtggctcgcttatattatctcgctttaatataaagatggagtagagtgcttagcagtctttcgaaagtgggatcagaaaaaacgttttatcaatagtttataggcatagtaacctaacaggcacccgatagtatctgcaacgatatctaatgtttccatagatctgcccagtcccatttcttcctgcagaatttcagtaaggaatgcataaataaggatgatctgaaagaagtaggagaattttattttaggaaatgtggcaatgaaagaaaaacccaaagccgcaaagatactgagatgcaaaactttgtcgataccattgaacatgaaccaatattcatggttttcttctccgggtttgagaagcatataagtaagaaatgcccaataaatgggcagtatcttactaaatatttttgaaatcttatccaatgatcgctttgtaatcatctgcagaaagtaactctgactgatctgctccatcagcaatttccaatttgatgatccatccgtttccataaggatctgtgtttaacagctcaggctgatcttctaagtctgaattaaattcaataaccttccctgaaacaggcaagaatagatctgaaacagtctttaccgcttctacacttccgaaaacgtctcctccattaaggtcatcatctacagtatctacatctacgtatacgatgtctccaagttctccctgagcgaagtctgtaataccgattgtagcaacgttaccttcgattctgatccattcgtgatctttggtgtactttaattctgatggtgtgttcatttttaaatttttattttgtacaaatgtattcaaaaatatagtagcttcaaatatcggatataaaaaaagtccttcaaaactgaaggacttttaggtttgtatcattttagaatccacctccggattcaccgaatgtaaatgtagctgaaataccggctctgattgtagacagcgggaatgctgtggaaatcttatactttgaggtcatctgttcgtagaataccctcaggttcagattctcagaaacattgtagtctgcggaaagtttaatgttcatcaatctttgtcctcctgtaacctgggcgtcattcaagaggatattcataatggaggttttactgtctcttaatgaaatatctcctctgatgttaagatcacttccttttcctcttgttcctcttcctctgatattagctgttcccaatctgaagtttctgacaatatatccaagtcttaccacatattctgtattggcatcttcagtaagcgtctggtttaccaatcccagcaccatcattctggttctgttatactgtatcccaaactgcatattatttctcatggtaacatctattccaataagcggcgagaaggattctacatatccaacctgtgcaaatgtatatgggttgatcttgtctcctgcatttttgattacattaccagcatcatctacagtctgataatatccgttcggattatcatgataatctacattgctttggatacccgtagcagtataggtcgcggtataagcatgtaaaatatcaaacttcgtgaactgtccgctgatgatcggaatattttttaatcctgaatacgtaattctccagtttggtaaagggaatcctgattttttaggattggtcatcggtgccacagactttccttccatagctgctctaaaggctggaatcaatacataggcgtttccgatgctataatgcggggcaaatccattgttatccaatactgctccaggcccccccaattgctgggaaagcgctcttgcattttctctgattgcctgataaatcgcctgtccatctttaaacgatgtgctgagaagcgttgtcgtattggaataggtcgtcaattcgttggcaaatgtaaagtccggatcaggaacgccattattggtatagttaaatcctgtatgtgagaagttactgttaaaagtatgcaatacattcaggtcaactcttaaatcgttcatcggcattacctgtaagtccgctctcaattccttggtagacattcttacgtatggatctgtcatatagttagaaccacttacccatccgttctccattaccgttcttctgatatctgcctgcgatcctaaaaggaacccaagtgtaggacctcccagtgtctgtccgtatccataccagtttggtgctgatattaatcccggaagcactgttccgtttgtttcattataacttatattcaactgcttgaaagaagtcaggaagaatgctgcactttgaagtggagtaagcctgtttttaaatttatactttttgtatctgtatctgttcttttcccattgttttgcatacacattattcagagagtccatctcctgtctgcgcttctgcagttttgcattgatgtttttaaaatagttaaactggccaaagaacttaggaagatctgctgaagccgttgcctgaataacattggtattctgacccactgatcctaaactagttgttttattattgttgttaggatccacaaatccaagcaatgaagtagatcttgctgcccagttgtaagtaaatccatatcctacttccgcatcaatgaaatccaggtaaggaagatactggaatggcagcttataatttaactgtgctctgtgattatacaataccggtcttcctgctctgaatacatttccgaagatcgacttattatccatagaattcacatccaggttatcattaagggttctggttgctgagttgatttccagttttaacgattttgtgaaattaaatcctaatccgtactgccatccaaagaagaagtttctgtttttgatggcatcaaagtcactgttcatatttccgttcaggattgcttccacgtttctgaattcaagctcgttataatttctgtcgatttcagttctaaaagatattcttgtaggtattggattaaagttgaattccttcacccatctcagatactttgtagattttgcggtatcgctgatcattttgttgaaaggtttgatcacccacggtttgaatgtgtagttgtaatcaatatatcctctcagatactgtctgtagttcctcttggtataaatgtccctgtaatagtcatcgttataaacagcagttacagaaacgttttctatatcatagaatttaggttttttatttggatttactctttccttatgcatatttacaactcctatacttctttgctgggtataagttctcgctacttttttcagctgatctttattaggggccttgctgaactccacatcggtgtccagaggattatatttcggatcttcgatagtctgtgagtaagaataatttaacggaatttttactccggttttttcaggaaggaatttgtctacattaatcgcagtattaatgctgaaggctgattgggtagactgggttctttctgcaggcttagaatcaatattaccgaaaccaacagatgtataggaggcattggcattcactgttgcaaggtctcccatattaaagtttaaactggcattccctgcatatcctccatcattctcaatttcagaaagacggatttcgttaacccaaagaactcttgttatagtggatgcccctcttggatcagagtttcttaccccaatcataatagtggtaatatttcctaaactaggtcgtcctttgatataaatatttttataaggttcctgatatgtaaggtcttttgttctttcagtgattttcaccccagacttatctcttctgattttcgcatctacaaaattctgaacatcaaagtcaacttcattttccattggccagatctccataggggctgttgctgtagtaggagtcatttttaaagatgattcatattcatagtagttgtcagtagcatcgcttccgaaacgtataaagaatttcgttttctcatcaattcctgtgatagtattagaaggatcgtgagcgtgcacaaacagctttagctttttgtatcttctcatatccaacgttgtatttttgaacacacctcttgcctcagtcttaagatctttcactttcatgtaaagtgaagcttcattctgtctttgagctcctgcatttccacttaacacttgtctatcaattcccggaggtaatacatacggaggctggttcagtgcattctcttcaatattcacacttcctacctcaaaattcgggtctgtaacaacccctataccttctcctgaacctggaatatttgtactggcaatgttactattatattttctccagtctgatcttacaagatccattgtcccgaatcttaaagtagacgtttgatcaaatcctgtcagcattaatctcgcaaatcttacgttatttaacacagatggatctgctgttccttcagctggatcataattcgccacaggaattctgaacaaataccatttaacgtctgaagtctgcccgttctgaaatgttgcttttactgtttttacatctacaatattattatttgccccaagtgataaacttggctggtcaagctttataacatattggttatagttttcagtctggtcaaggttataatctttgttgatatcttcagcatccggagtttgtgaagctacattcagagagtttgcttcggagtttccttccgggtttctgaaatatttatatcgttctaccactgaagcagcctgacttcctgtaaatttatcagaaagatagaatacgaagtcatccactgccgggtcagcaatattggttaccgggtttacaaaggtattcccgaacctcatggcttcctgatcagaagtaagaccgtcatatcctgcatcctgaattcttctgtcatctccttctgtagagaatgcatataaaattggtggctgttttggctgtactccccagtttgaatttgttgtagaagaaggtgttcccggagtaggaagtccgttttcatactgcatttttccatctttcagaacatcttcggaaacgtttcctaagtgaagtaaaagctttggatcagcacccagggttttaccatctgcataaggatccatcatccagaattcaacatattcaatatttgaactcacaaagttcggaacgctgatggatctcataatcccagcccatctgctttgtgtctgttctgttaaaggattaacgttatacggccctttttctttagggaaataagaaatatcgaaagtattcgtaaaggtttgttctcccgctacgaaatctctgttgttataaatctcagaatattgcacccttctggaagcgtgattggatacagactgtggtgtgatccctgcaggagctttccctccgacaccccagaatcttggatcaatgttataccatgtcagcaatcctcttccatatccactcgttatatcatcatccgccggtattgtattaaatggtggcaacttatttttttcgggttttgatgcaaggctccatgctgcaggctcttttaatgatattttagaagttgtctgttcaaaatcgtcaatataagactggttattggttcctttattcaatcccggtaataaataggcagcttccatcttgaagtttaagttggatggagcttcggtttttaccatcggaagtttattggtaagtcttgtaaggtaaggagcctgattgttatacatcaggttgatcccagccatagtattatttactgcttcctgcccgaagtttactttctgagtcaatggagattcagaataattgattactgttccacccaggataaagttttcactgaatcttctttctaagtttaatcctaagaatctttttctttgggtattaaatgtaagttgattttccagtgaaatattgatggcctgtccggactgctttacattttcattgatgatggtaaccgttcccagcatatagtctacggtatagtctacaccttcagtaagctgtaccccgtttgccgcgactttcaccgatccctgaggaacgtttactgctcctaaagaaataccttgcccctgaacacctttataacggccttccatggtatacctttgtgaaaggttactggaagaagcttctagtttttgcttggtataaagatcctggaaaacatattgaggatcaaaggttccacctaaagccttttgcatataggcaccaaagggctgtactttggtaaagatgactcttccggtctccggtctgatggtaatcccattgacaaagtcgaagataccgtctcctttacttccatctttattgttctggatatcaccgttcatattaaggcggtcccagttaaataattttagtaagttctgatcttttacaggcgtgtccggaaggtagtttaccttacctcctgttttgggatctctataatatacattaaggataaatccgtcctgagcaacctgtcctgcatctatagagtagatattcttcatcatcagatcccacatcggagactgagtgttgactttgttatttactctcaatactttagtaaccagtacagggctttcttcagaaaattcccctactttgtatactttattacttccgttaacggtataagagtatgaaacggctaaaagctgctggtcattaagtttttggtttaatgaaatatacccaagctgtggctgaaaggtaaattcattagcattcagttttcttgcttttgtagcaagaataaattcttctccgttactatagggagaaggatttcccggaaagacatgcccctgaaaaagagcattgtaatttttcccagcttctctggtaccggctacttttgatacttcatcatataatccattcaatgagttatctggcagagtaattcctcccggaccttcccccaggtctctgatcccgataatacttttctgatacgccagattactgtttccttgatcaagtacccaaacttccattctggtaatattgatggttgagttgatctgtggataattaaggagtgcgtcatcatacttgttcaggaaataatgtcctataaaaaagtgctggttttcttcatagtcaatagcattgactttaaagttattcataactccaccaccctgaactacaatgttacgggcttcaccctgttgctgggaaaggacaactgttccaaatgtttttcctaactgaaactctgtcttcaccccgaacaatgactgggaaccacggataagactggttgaaagcggcatgtttacgttaccgaattcaactcttttgattattttatcttctcctccttcgttaggtttatctacatttccaaggcctttgctttgaagatctttccagcttccttttgcctgccaaacaaggttcatcctgttttcgaaagcaaaaccactctgggtatcataattggcctttaactgtaagttttcccctactttacccaataaccccagttgaattctctgatctatatcaaaggtaaagctagtcctgttttgtggcaggatcatcgggttatctattttctggtaaagtcctgcaaaatcaagagatgcatatcctgaaggaataatttcaattttattaccaccaaaaatagtttcaaaaagcctgttgttgatctgtaatgaaggaataagccctttctttctggcatcagttctgtctctcctgaagagaaggttatatttatcagatttctccttataataagcctttgtctggctggcaagcatatattctttatattcttccggagacattgctgtaggaggacctgtaatggtatttccgattttgggatacacgtagtacatcccggtttttatatcgtaataggcttcgtacctcgtagggtcggccacttcatattgttttcttatgatcgccgtatctttttgtgcctgcgcgaaagcactgacagacatacacaggaacgacaggaacaaaaatatgttaagatgcttaatattcgccaccaaatgttaaatgttttttaagatttgttttaccaattcttctaccgagatgcttggattttgttttataattttatccgcaatcttctcactggttcgtttaggaatgcctaaaacttctaatgcagataacgattcttccttaattttattatctaccatcacagaaatattcgcattaggatcactgtatttctgcactttatctttaagatctacgataattctttccgcagtttttgccccgattcctttagctttctggatcaatgcactgtttcctgaaagtatggctgaagcaatctcatccaggctcaaagttgacaaaagtataagtgctgagacagcccccactccattaacacttattaacagattaaacatttctttttctgaacgtgtgttaaatccaaagagaagatgagcatcctcacgaatgatctgctgaataaataaaaaggtctgctgattcaaaaccaacgtctgtgaggtcatcaaactgattcccacatagtaaccaactccttgcacattgatgacagcataggtaggtgtaagttcctgaactgtgccttgtaaagaaaatatcattattaatttttaaaactcccaaatatagcaatttaaactaattaatgttttcatttgatctgagaatgatttttaacttaaatttcaaataagaattcaaggaattaacagaaaaacaaaagactccaaaatatggagtcttttttgtatctgaacacctcttatggtgttattttttaaataatatttgtatgtctttactattttttctctcttctctgagcatcaagaacggcaatggtagcaaggtttacaatttcatctacgcttgaacgcatctgaagtacatgtaccggttgtttcaatcccatcaggataggtccgattacctgtgctaccttcatacctctcaggattttataagaaaggttggcactttcaaggttcgggaagatgaatgtattggccggagttgttcctaattttgagaacggataatcactcaggtggtctgcattcattgcaaaatcaggctgaatttcaccatccacaaccattttaggatatttttcatgaaggattcctactgctttcgcaactttcttggaagtttcagagatggcagcaaaattttcaaatccaagcattgcgattcttggttcaatagcaaaagattttactgtaaattctgccattttagcaatatttaccagatcttcagctgtagggttctggttgatggaagtatctgcaaagaaaataggtttcttttcagacaggatcatcatcattgccgctactttgtctacgcctttatctttttcaataacttctaaaacaggacgtaaaacggaagtatagtttttagagaaacctacgataagtccgtcagtatctccatgcttcagcatcaaaggtccgaaataatctctctgacgaacatatctcttcgctttgtactcgttcattccttttctctgacgaagcttccaaagggtttctctgtatttttttctgttttctttctgatcatcatcacttggatcaatgatagggacatccagagtaattccgtaacgttccatctgttccttgatgtactttttatcccctaaaagacttgggtatgcaattccttcttcataaaggatctgagcagctttcaatacattgtattcttcagcgtttccaagggtgattcttttcggattggatttcgcacggctctgcatcattcttaccaatctttcatctctgcccattctgtctaaaagctggtgctcatattcatcaaaatccgtaatggtttttcttgcaacaccactttcaatagctgcttttgccacagcgcttgatacttttgtgatcagtctgttatcaaatggtttcggaataaagtattctcttccaaactgaaggttctgaacgttatatgctaagattacagcttccggcaccggttcttttgcaaggtcagcaatggcgtgtaccgcagccagtttcatggcttcattaattcctgttgcctgtacatccaatgcaccacggaaaatgtaagggaatcccagtacattgtttacctgattaggataatcacttcttcctgtagccatgatcacatctttacgggtttcaattgcaagatcgtaagcaatttccggatcaggattagctaaagcaaatacgataggattatcgttcatgcttaaaagcatttcaggagtcattacgtttccttttgataatccaacgaaaacatcagatccttttacagcatcttccaatgtttcgatatcagtctgagcgataaaatccagtttttcaggagtaaggttttctcttttatggttgattacccctttactgtcgcacatcaggacgttttcttttttcaatcctaatgaaatataaagcttagtacatgcaatagctgcagcacccgctccgtttaccaccattttcactttatcaatatccttgttggcaatctgcagagagttgatcaatgcagcagccgagataatggctgttccatgctggtcgtcatgcatcaaaggaatattcaattcctctttcagtctttgttctatataaaaagcttcgggagctttaatatcttcaaggttaattcctccgaaagtaggagcaattccttttacgatttcaataaatttatcgggatctttttcatcaatctcaatatcaaaaacgttgatatctgcaaagatcttgaacaaaagtcctttcccttccattaccggttttgaagcttcagcaccgatatctcccaatccaagtacggcagtaccgttagaaattactgctaccagatttccttttcctgtgtaatcataaactgtttccggcttatcatgaatttccatacaaggtactgctactccaggagaatatgccaatgacagatctctttgggaagagtgcggctttgatggtattacttcaatttttcctttgggttctgctttatgataatccagcgcggcctggctaaagttcttttcgtcacgattgttgttacttgacataaaattttgttttttgttaaagtatatatttaatgtggtaatctactaagctttcaattggtttctgaactacatgtcccacatttaaattaagttccgttgctacagaacgtagtgtattttcataataataagcgatggaaccgatgaaattaatctcagcttcatacgcttcttcataagggagaacctggtattcgaagaaatttttcatttcgtcaaaaaccatatccctgaagtaaggatgatcttttctttcgattacaaatttggtaaaattcgccagataagcattgggtcttggggtatgatacatatttttcaatgcatcttccaccgtaagttgataatctgcttcaaattctttatgaaggtctgcaggcagttttttcataaaatatctgcgcaccagctgttttccgatagcacttccgcttccctcatcccctatcaggaatccgagtgaaggtaattctatctttacatttttaccgtcaaaaaaacaggaatttgatcctgtgcccaaaatgcacacgatagcaggttttccgctgtaagccgcatatgcagcagccatcagatcttccttcacaataatctctgcttttccaaaaacttttttcagttcttcttctatggtttcgcagttttttttcaccccgcatcctgaaccataaaaaaatactttggtaattgaatttttaaccgatatcagattgctatttttctggatttccggagcaataagctccctgttgataaaattcggattgaaaccgattgtttctgttttcagaaaaacttttttaaagtcatcaagaattacccaatccgttttagtagaaccactatctacaatagcaaccatattttagattttaatttaaggatgctaaattatgaatttatcttcaattagcatttaaaacaacctggaagctgtctaaaatcattaatgcttgatctgtgtttttttttcattgaattgtaaaagccaatcttctatttcatcttcaagataggaagtctgtaattccatcgcattgataaaatcatcaggcaccggctcaccagtggagttttcaagattccacaattcgtttgacatattttcatattcggaatacactcttttgaagcgggaattttctttctcaagagcctcaatatttttctgttgaagctggaattttctgtatttgttttgacgtttcatacaaatattattaataattgggtcataaaatgtaggaggatatgctcttagctgcgcactacaagatagaaaaaaccatcaacacaaggcgttgaaaatgaatttattatcaggtcttaattacatcattctgaatattaaaattagacatattttttattaaaaaaaatattttaacaacttttttcagtgtttaacatatagttataaatttgcatattcatattgtggggccgtataattttgggtactataaaaccattatgggaaggcaggaatccgtaaaatgtttatctgctgagaagtatctcattttagtacgctatacaatatgtacaaacatgtttagttttataatcattaaatgaaagaaatactcttacgccagaagcaggttttgttcttcatcattgcaggaggactgagtgctgttgtagagataggcagctttaaaaatttcagcacttatcttccgcatttcattgtaaaagaaaccaacttttatggtgtgcattatcctctgagtaatattttctctaccagctgcgggattattaccaattattttctgagtatatggtttgtatttgaaagaggaaagcattcgaagagaaaagagtttgcttactttatgatagtatcctttttttcgacaatgctcagcttaggatttttccagattttctatagtttcatatttaaagataatatcaatttatttttttataccttgagcccggaaatgatcagtaaaattgctgcaatattgctggtgtccattctgaattattcaataaaaaagaaagtaatttttaacggttaggctgtgacaaaaattttaaactatctctggagattctggttgctgctgctggcattttttctgaccgttacactcggaatcccggtatatattttatcttttaataaaaaacattataaatacggttataagcttgtcaggctctggtgtttcggaatgttctacggaatgggtttccggtatgaccttattaagctctccacccaggaaaaagataaaaatataccgtacgtttttatctctaaccacacctctatcatggatattatgcttgtctgcattttgttccctgatcatccgatatgttttgtaggtaaaaaagaactggtaaagattccgattttcggaactatatataaaaggatctgtgtcatggtagacagggcaagtgcgcgaagccgtgcagatgtgtaccgcagatgtgctgagaagatggaagaaggtaacagtattgccatttttccggaaggcggcgtacccgatgatacttctgttatcctggatgattttaaggacggagcttttatgctgtcctcaaaacatcactcccctattgctgtttatacctttatcggactcaaggaaatgtttccttttgaaaattcaaaaggctatcccggaagagtaaaggtttatttcaatggaattattgaacctactgattcgcccaaagacctgaaggcagaggcttatgaggaaataaaaaaaaccttaatcaggtattccgttgaaagtaaatagttatatttgtttgtgaaatctataataaatatgtcaaattattctaagcaaaccaattgggcccaattcattccgttggttactgtattcttcttttggggatttgtagcagccagcaatgatattctaatcccggtttttcaaaaagccttcaatctatctcaaactgaaagtatgctggtccagatatgcttttatgtagcgtatactgtaggatccttaatttatatgattgtatccaagagtctgaaacaggacctgatcaacaaaatcggatacaaaaacggtcttattgtaggacttttgatttctgcactgggaacactgttgttctaccctgctgccaatatgcattcttttcctttaatgatctccggattatttattgtaggtttaggattctctcttcagcagattgttgccaatccactcgctattgaggtaggtcctacggaaacaggatcacaaaggttaacaatggcgggaggaattaataacttaggaactactatcggcccacttatcgtttcgtttgccatctttggttctgcaagtgctgccaatacggaagcgagtgtggaaagtgtaaaaataccttatctaatactgggagcagcttttgcgcttgtggctttaatgcttaaattttcatcacttcctgcaatcactccaaccaacactgagaatacggatgatgtaattccgggagaacacagaacttctgcattccagtatcctcaattggttatgggaatgatcgccatcttcgtgtatgtaggagtagaggtttctacagcaagtaaccttcctgcttatatggaaaaaagccttggatttgaaacgaaagaagtagctccttatatttcattgtattgggcgtcattaatgattggccgttggacaggtgctgtagaagcatttgatgtgaacgcaggtttcaaaaaaatcttaagattcctggcaccttatctggcgttcggcgtatttttattggtaaacgctattgccaaccatgatctttctcctttctatgtatatggatttatcattgttgctatgatcatctgtgatattttaagtaaaggaaacccggcaaggatgcttttaatcttctctttagcaggaattacagctctgcttataggaatgttcactacaggaatgatatctgtgtatgcatttaccagtgtaggtcttttctgttctactctgtggccatgcatctttgcactggcaatcaacggacttggaaagcataccaaccagggatccggattccttattatgatgattatgggaggcggaatcgtaagtatgttacaaggatatattgcagatatcacaaatattcacttcagctatatcgtgggggttatttgttttgcttatcttgcattctatgcgatccgtgtgagtggaatcttaaaagcccagggcattgatcttgataaaatatctaaaggcagtggtcattaatataacaaaaacaatatataagaagaaaagattttgggcaggtgtattacttgcccaatttcttttattttatggtttctctaaatccaaaatgatggtttctttttttgaaagtttttttgaacttcaaaaaggaatccaccaggtgttgttcagctggatttcgttttctgttggagatttgatttatattgtagtaagcatttttcttttatattgggttatagctttattcaggaagcagcggaggcatgatgcaatgatgaaaatcctcatcttcattaatgctttttatttcacttatcaggtgttttggggaatgctgtatttccagactcctgttattaaaaagctttcaagccaggaagaacccaatatagacaaggcaaaaaaattagcactcatctatcttgaaaagtgtaaggttaccagacaatctgttcatgaagataataaaggtgtctttatgatcacagacttgacctctatacaaaaggaaatcctgcatcaacaagcaaaattaccttcttatatttccaataaaaaagcgcctcagattttaaatattaaacccagcttgttcaaaaatgtaatgaacttcacgggaatactcggatactacaatccttttactgccgaagcccagtataactctgaactgcctcacacttttatccccttcaccactgctcatgaaagttctcaccaactgggatttgccagagaacaggaggctaattttgtgggatatttaataggaattcattccagcaatccggaactgagatacagtacggagtttttcactttaaaaagtcttttaagattcattgtggaggaagatcctgagtttgtaaagaatattcttcatcactattctccggctatgcaaagagaccgtgcttatgaaaagagctttatttatcgtcatcagggctggctggatgacttctttggatttactaataatctgtttctgaaaagtaatcagcaggaaggcgctattacgtattcttactttatagatcttctcctaaactatgaaaaatagataaaaaaagaatcgtatcaggcgatacgattctaaaaacacaaatgatgaaaaaaaatttattaccttgacttgttccctcattcaaggcgatgtaaaagtacgacatattttataaatacaaaaaaaattccgtccttttttaaaactttatgaaaactttatgattttttaagtttttttgagtttatatgtttttgtcacaaattaaatcaaacatctttatttacagccaaaacagcattaaaagcacatacaggctattaaatactcaaaaaattaaacaaatgtttaaataaaaaatattcgttttctatcaagtttttctcatttaaaaattggagttattgctgtattatgatatgatatctctaaaaattgcgattctaaaattctggaaattgtgaatataaaatgcatggagttttatatccattctgtttattgtcccaaactaagaatttatattttataaaattgagatctgttactcattatcaaaccttattttctaaaggatcttatccggaaattatttctgagaagagataaaaaagcatgattctaacaataaattatagaaaataaaatactgaggatcaaataaaatccaacaacaaccgtttatatctcactaataaaggagattttttttgtatatttaaaacatctgtgtattttagataaaaatattaatatgatttttgacaaactaattaaccaccttaaactagataaacaggaatttattttccagttcaactcacatcccaattacccatctgcattggcattcagtgatacgctgaactttatgggggtaaaaaatgacgcctatgaacttgacaaagaatattgggacgaacttccggaagaatttatcgctattgttgaaaattcattttcccttgtaaaaaagtcaggaaacaattattccgtatattctgagaaagcaaagacctttggaaaagaggagctttataataaatcaaccgactttgtacttctgtttgagaaaactgagaatgcagaaaacaaactgacattcaatttcaaaccggttctgtacattatttttgctgttgttcttgcttattcatttataagtcaaaccatttatgaggccgtattcaatcttctttcattagccggagtttatatttctctggaaattttcaaccaaaaatttggaaatacatctaccgttatcggaagtatatgcggaggcggaagtactgctgccagccagacagccaactcgtgtgataagattataaaacaggataaaacaagcattttaggcttaaaattcgcggacttttccctgatttatttcacaggacttacagtattgggtttattcttaccggctacagcttatattgtaaaagcatttacattcgtttctgtacttgcaatcggatattcattatatatccaggcatttgtagaaaaaacattttgtagagtatgcctgttgattatttcaatccttgcagggcaaattgtaataagcagtttactttttgagaatctttctttcagtgtgggagcacttttactgacgattatcctgtgggcacttgttttctctgctgttatttatttcaacactcttcttgagcaaaaagaaacgcttcaaaaatcgaatgcgaaaaatctcagattcaaaagaaattatgagcttttcaaagatcaaatgatgcaaaatccaaaaatagaattccaggataccgaaacctttgctgttggaaaaagagacgccaaacttcgcatatcaattgtttccaatccatattgtggtttctgtaaagatgctcataaactggtagaaggccttttggaaaaatatcctgataatctctcgttgcagatgagattcaattacagtcctgacagagctcctgaaaaatatactcagcttatttcagacttaactcatatttatcataacaaacctgaaaacgagtttttacatgcggtagaagaatggtttgaaaccaaagatgaaaataaaattaatgctctggcaggaggaaaagtaacatccgaaaatctgaacccattagtagaaatgtctaaggaaaacagtaatgcaggattaagctttacccctatctttattatcaacggatatcagtttccagacaagtatgatcgtgaagatattttattctttattgatgaattaatagaggatgatgagatttagtaattaaattttatgcatttaaaaatttcactatcttaggaaaaacaaaataaccatctgaaaagatgtaaaagagtagaaaaacggtgacaaatgggactatttccagtgtaccatttcattgaattataattgaattaaagcaaaaatgtcgccattcactggcggcattttataatgagtagtagttttgaaaaaaaagtttcctttttataagcagccagataccaaagactgcggccctacatgcctcagaattgtaagtaagtattatggtaaaagcatatccctgcagcagattcgtaacctttccgagacaacgcgtgaaggaagcagccttcttggactgagtgatgcggcagaaaaccttggattccggtcaatgggagtccagatcgatttcaatacccttacagaagaggttccttttccttgtatagcacactggaataaaaatcattttgttgttgtatacaaaattgataaaaacaataaagtatatatttcagatcccagttacgggctcatcacttacacacgggaagagttcatcagatcctggatcggagaaaatgcaaatgaaaatacagaagaaggaattgtccttattcttgaaacgactccggcattcttccagacagaattcgatgctgaagaaagtaaggctagttttacattcctttccaaatatcttcttaagtataaaacacttgttattcagcttgctatcgggcttttgggaggaagtttactttccctgatatttccgtttctgacccaaagtatagtagacgtcggaatccagaaccaggatattaattttatctatgtggttttacttgcacagatcatgctattcctgggaagaatgggaattgaaaccattcgaagctggattcttcttcacctttccgcaagaatcaatatttccatcatctccgatttctttatcaaacttatgaaacttccgatcagtttctttgatacaagaatgacgggggatattatgcagagaataaatgaccatcacagaattgaacagcttcttacaagttcttcactgaatacattattctctctggtcaatcttattattttcagtattgtattgctattttatgattacaggctttttcttgtttatctagtaggagctgtattgtatgttggctggatcagtttcttcctgaaaaaaagaaaagaactcgattataaaagattctcccaggtatctcaggagcagagtaaagtgatcgagctcatcaacggtatgcaggaaattaaaatgcataatgccgaaaaacaaaaacgatgggattgggagtttcttcaggtaaaactgtttaaaatccggataaaatctctttcactggagcaatggcaatctgtgggaggtaactttatcaaccagatgaaagatatcctggtaagtttcctttctgcaaaacttgtgttaagcggaaatcttaccttagggatgatgctttccgttcaatatatcattgggcagctgaacagcccgcttcttcagcttatcgattttatcaaacagactcaggatgctaaaatttcccttgaaagattgggcgaaatccatgataaagatgatgaagaagataagaatgaacaatacgttatggatatcccgaaaaaagatattgaaatcaaagatatgtcgttcagatacattggttctgatgttcctgtttttgaaaacttaaatcttacgataccttatcagcagacaactgctattgtaggagccagcggaagcggaaaaacaactttattgaaactgttgatgaagttctatgatcctgaccagggtgaaatcagaatcgggaataccaatatgaaaaatatttcccctagatactggagagatcattgcggagtggtaatgcaggaaggttatgtattcaatgatactattgccaacaatattgctgttggtgaagatcatattgataagcaaaaattaagacgcgccgtagaaattgccaatatcaaagaattcatagaaagtcttccattgagttataatacgaaaatcgggaatgaaggtgttggagtcagcggtggccagaagcaaaggttattcattgcaagggctgtttataaagctccggaatacattttatttgatgaagctacttctgcactggatgccaacaatgaaaaagtgattatggaaaatctcgagcagttcttcaaaggcaaaacggctgtagttattgcccacagactctccacagtaagacatgccgataagattattgtgcttgatcagggaagggtggtagaagaaggaagccacgctgagctggtagatttaagaggtgaatattacagactggtaagaaaccagcttgaattaggaaattaaataagataaagtcacttatagcggaatccgaaaagcttacagagtaggaaaaataaaaactaatattaattatgaaaaatcttaaaaaactttcgagaaaagatttgacatttgtcagcggaggtgttatcattccggacaacaactgctgtggatcgtggtgtcttggcagctgggtaccatgccgcataaagcattttgaatgcccgccggatgcagacacttcgccaccatcatggtatgacgggaactgcccaattatttaaattatattccccctgaaatattgggggaaattttacctcagaacaatgaaagaagacgttttagacaatattgaactccgctcagaaagcgtacaggatattcttacccagcctccgcattggatgatccgctggggaaataccgttatatttgttattctcctgcttatccttctgatgagctacattataaaatatccggaatttgtacctgctcccattattgtaacttctcagaatcctcctgagaaaatagaagcaaggaccagttctaaaattgaaaaaatattcataaaagaccaccaggaagttaaaaagaatgatgtactgatggtgatgcagtctgcagccaattataaggatattttagagctgaaaaaactggtagattccattacgccagatcagttatataatttcccaattgctcaggcttcaagatttaaattgggtgaactacagggtgaatataacagtttcgccaaagcatttcaggatgaagcactctttacaaggttacagccttatgcgcctgaaaacctcgctgccaaccagagtatttctgaatatagagtgagaattgctactttaaagcaacagaaaaaccttgaatccataaaatatgacctgactaagaaaaatttcaacagatctcaggaactattcaaccagggcgttatttcagcgatggaacttgaaaatgaaaagatcaaatatcttcaggctcagcaaaaccttgagaatattaaaatttccatatcacaaatggatgaagggatctccaacctgaataaaaccaaaagcggaactgccattaatacagaaaaagacagaattacatactcttcacagaccttacagcttcttgaacagctgagaaaatctttaaaacagtgggaactgaactatctggtgatctcatccacagacggtgttgccagttttcagcagtttttcggcgagaatcagttcgtaaaggtaggtgaacctatcctttctattcttcctaaaaataaagagcagttggtaggcagaatgtctgttcctacaacaaactcaggaaaaataactccaggtgaaaaagtactgatcaaactggacaattaccgattccaggaatatggtatcatcgaaggaaaagtgcagaatatctctcttattcctgatgaaaaagggaattattatgtagacgttattttgccaaaaggattaaaaacaagttataacaaaacacttacgtttgataaagaactccggggcagtgcagagatcgtgacacaagacctgcgactgattgaaagatttttctatcagatcagaaaactccttggatatcaggtttaataaaccaataggaaaaattaagagccgttccgcaaattgcagaacggctcttaatttatattttaattactacagatactgaaaattaccgtcgattatttaaacaagccattacacgcattattcgactcaatgaagtattaaatccagatattccaaaataagccatagaaaagcgaatatgagggaaatatctgtacatagttaatgcataaactatgacaaaaaataaacaacggatattccctggattttattctaagaagcctaaatattaaaaaaaggaaatcttttagaagaattaaaagataaagttatgatacttttaaaattaaaaaccgcaatcattaaatcaataattgcggtttattgtagcgaagacgggaattgaacccgtgacctcagggttatgaatcctgcgctctaaccaactgagctacctcgccgttttggtggtgcaaatatagaaaatatttctttacctccaaaattattttaacttaaaatattccaaaacatcaccaacatgatctggtttgctgattatcttattgttagcatctaaaataaaatacgtcggagttgcatgaatattgtacgtatctgtataactgctgttccatcctctcaattccgagtcattcacccatggaaacgcggcaatctttttggtataagaattcttatccacatctaaagacaatcctacaacctgaatattttttgatttcagatcattgtatttttcaagaagcttaggaagctcagtttcacaatgtgaacaggtggatgaccagaatacgataaccttcttatctgcctttatatcatgtaaagattttgcggtagtattcacagctgactgaaacttataattagggaaaacagctcctatttcagtgtttgcattcgattttaaggtagaagcaagcctgtcagtaatggtacatttaagatttttagcaagagagagatatttgctcttgtattcatccatctgatatgcatcaaagatatcaatcaattcggataatactgtctgccctcttggcgtctctacttttaaacggtctaaaagcttatcaacagaagctgtaacatttgtgtttcctcctgcattaagataagccaccaaaaccggtctcaataatgaggagctttcaagcatatctcctgatttgtccagaaagttgatgatctcttcctgatctacttttttgactgaatctggtgagttagaaataaatttactgtagttcgtattataataagcaataaacggatgttgtgctgcatcaatggtgcttgaagtcccggaaagcctgtcaatttcagttttcagggcttttccaaagtccgtattgtctttatagtattctttgatttgtgttaaagccggcaaaataagctcttttttttgtgaaccttcctgctgtttgctcatcagactatttgcctcatcaagataaataacatctttgactttattattctggacatccagtttaaagtttacattcttattctcagaaataaagcttaccgtattgttagaaccgggaaaataaactttcatcatccccatgtagttacccggatatttaaaagtccacgtaccattcttactttgttctttagtaacaataatatcttttgagccgttcaatgtatatagaattgcgtcctgatctttaaaatctgcaggagtctggattgtgaccgtaaattgagcctgcaaagcaaatgcagctaaaaccgcagatagcgtataaatttttttcatagagtaaaaataaaaaaactccctgagtaatcagagagtttaatattattttaataaaattttatgcttttacgcttttgtacttttttgtaaagtaggcaataaatacaattgctacgataccaagtacatatacatacatatcaattggtgaggctggtgatggtgatccggtaccatttcccccgtttcctcctcctcccggaattggtggagctgcatttactaaagatatagcaaagagaaaaaaagccaggactagtttattaatagttttcatgtggtttattttaagattttagtgttaacagtttctcccttatcagaaacgatttttacgatgtaagagtttttaactgagccatcaagctcaattacaaaatctctggatgtttcaaccgcttttttagagattaccagtttaccgctcatatcataaacttgaatgtccgcttttttccattttggatcaaatctaacaatgtaatttgtaacagatggatcgtaaacaacaagtgttctcgaaatactaggagctgccttatctacagccagagtaatattacttggctcaccataatacaagttagcttcctcatttgttacaggtacaatatcaccttgtttagcctgtagtaaatttccattttccgctttatagtagaaaccaattcctgaagataactggtgtgcaccggcaggaataagttctgcattttctctgatctcaaacttataagatttaacctgatcaagcttatagttaactaacttaacatttttaccttggaagttattctcattagcttcattaatatataaccaatagttggtatagttgttatcatacccaccattcaatgcttcttcgtaagtaccaataattcttgtacctgctgaactttgaactgttgtagctgcagaaacctggtgtcctgttgtaaatgatggagaaacgacataatatgttctggaaatctcattaccattagcatcaagaccgattactccaagctgcttcactgtattggatgtgttcttaccagccattctagctgcatttacaccgttaggagtacctgcagttcttgctgttgatttaaatcttcttagaggattaaaatctaaagtctgagctgtattgtctcttaactttattttaaatgactgcataggtttaatcaccattttatctaagttgacatcaccaactgccggagctactccgtcacctgtcggcacgtaagtaactacctgagcacctgtagcataagtagaacctccaggaagtgtaacaatagtaccagggttatattcaataccccagatgtttcttaccgcatttccatctgaccctgtaacgctttcagtgtatccgatattagataaatctatattagttagataagggttaccaaattgatagaagttctgaccaaatgttccagcccatgggcttaaagtaaattcaaatgaatcatcaaggtaagtattatacttttcgctgtaagaattcaaagcgttaccaccatttccaaatacgacattggaagggccaacgttagattttcctgcattctgcaatgaagcagttccagccaacggagcaaatggtctgccgttaatattgaaaactgttcctgtagcaggtgcacttggattccaatcattgttggtaactttcagcatataataccctgaaccatcagctgtagtagttgctaaatctgtaaaatgtgcagaaactgcattaccgttatcccattttagaatcggattgctatatctacctgtattgaaggttttaccaacctctgtagataatgaacctaaagctttaccatagaaaggcaaagcgacttgctggaaataattaccactaccattacttgtagttctgtattctttagttacaatacctgtaatattggactgggatagtccatcgatgtacagctggccatacgtggaagtagcaaaggaagcaggggtatttagtcttaagatgatattaccgccatctgtcttatcagaacctgcagcgtctattgtcttaaaagcatctgtaccagatcctacaatcattatatttccatgtacgtccaaaaggccattaccttttgtttgtacacctccaccgctataaactagggtgccttcgctcacatacatattagcattagtgtcaacatgacatagtatctgcgcctgaacagaataactaattgctaaaagacctatagcaaataaactttttctcattgtataaattatttgtgtgttaatacaatcttcacccgcaaaggtattattatttttcttaaaaaaaaaattttttatctattaatcaaaacattatcctccgttaagatgatctctttctcctctcctattgaaaacatatagtcttctagaactttttcggtcgtacctctcagacctcttgctcccaatcctttttcaatagtttcctctacgattttttcaattgctccgtctgtaataaccaaatttgtgccatccattttgaaaagttccacaaattgattcacgatagagtttttaggttccttcataattcttaccaaagtctcttttgtgagtttatcgaggtaagtgataatcggaaatcttcctaaaagttccggaattaatccgaaagtacgaagatcaatcgcattaatatttgttaatatatactcatcttcatcagtcttattgattttttcagagctgaagccaatggcctgcttgttcattcttctttcgatgatctctttgatgccgtcaaaagctcctcctgcaataaaaaggatgttctgtgtatttacctggatatatttctggtccgggtgttttcttcctccctgaggcggaacattgacgatacttccttccaatagcttcagcaatccctgctgcactccttctccggaaacatctctggtgatactcgggttatctgattttctggcgattttatcaatctcatcaatgaaaacaattcctttttcggctttttcaacgtcataatccgccaccatcagaagtctggaaaggatactttcaacatcttcccccacataacctgcttctgttaaaatagtagcatccacaatgcagaaaggtacattaagttctcttgcaatcgtttttgccaaaagggttttacctgttccggtctcccctatcatgatgatatttgacttttccagctctacttccctgttttcgtcctgagcatgaagtaatcttttatagtggttatatacagcaattgaaagctgtttctttgcctgatcctgaccaattacatactgatcaagaaattctttgatctcttttggttttttaagctcgtccatgctttctgcaggcgagtatcctgttttggatgcactgtcttttacaatagcatgtgcctgctctatacaattttcacaaataaaaccattctgcccggaaatcagcatctgtacttcacttctttttctgccgcagaaagaacattggtttgagttcatatgatataatatatgtatatgttaaagaaaatcgtaaaaaattacttttttacgattttccggttgttaagaattaataattgagttttgaatctctgtatattcttcgttcgttaattttaatctttcatttctgaaattcatatcttccatcttatttaaaggaatcagatggatgtgtgcatgcggaacttcaagtcctaccaccgctactcctactcttacacatggaattgcagttttgatcttcttggctacctcttgggcaaatccccaaaggtttttgtattcttcactttcaagatcaaaaatcaaatccacttctttcttcgggactactaaagtatgtcccttcaccaaaggcattgcgtctaagaatgcgataaagttttcattttctgcaatcttataagagggaatttcgccattgatgatttttgtgaatatagtgctcattttatcagaagtttggttagatattttagaagttagaaataaaagaaatatcagactataaagaaatgtctaatacttcaaaagacagtttgtttccgttcggtaaagtaatttcagctgtttcgccgatagcttttcctagcagaccctttgcaataggtgtgtttacagaaatctttcctgtcttcagatcgctttcattatccggtaccaatgtaaatacctgttcctgcttggtagcattatttttaagtttcactgttgttaagattgaaacttttgaagtatctaattggctttcgtctataattttagaagtagagatgacatctttcagcttggaaattctcatttcaagcataccctgagcctctttggccgcatcatattctgcattttcagacaaatctcctttgtctctagcttctgcgatctgctgagtaatttttggtctctccacagtttccaactgttccagctcagctttcattttctctaagccctccttagttacatagcttgccataattttcaaaatttagttttagtataaaaaaataatccgacatttgccggacaatgttttcgtgttgtaatcgtttaatttttacaaatatataaaaatttaaattgaaatgaaaaaaactttttcaatcttatctattttcagcttattgattttcagtaatttaaccataaactcatgtggaagcagagaagatacggtgaactgcttccctaatgttcctatcaatgtctcacttaacctgaaccttccggcgtactaccctttgaacaatatcaacggctggatctacgtcaacgaacaacagtccggaacgagaggattaattattgtacgaacagcaaacggatttaaagtatacgacagaaatgctccccatatatgccctgacagcaataccaccctggaggtgaaagacaatatttctattatatgtcctcaggataatacaagatggattttaagtacgggacagccggaatcgggagctaaaacatctcttcctcccaaaacttatccgtacagctatgatgcaccaagcaaaactttaaatgtttattattagaatataaaatgaagatcgttatacaaagagtctctgaagccagtgtaaaagtggaaggaaagattgtaggtgaaatcggtaaagggctgatgctgctggtaggtgtagatgagaatgatgaaaaaacagatgcagactggcttgtacagaaggttttaaatctaagaatcttcggggatgaagaaggtaagctcaatctttctgtgaaggatatttccggagaaatcctttgcatcagccagtttacattgattgccgattataagaaaggaaaccgcccttcttttataaaagcagcgaaacctgataaagcggttcctctttttgattattttaaagaagaaataagcaaatccggattgaaaacagaaagcggaatcttcggggcagatatgaaagtatccctgatcaacgacggacctgtaaccattgtaatggattctattaccaaaagctaggtttgaaagatgagtaacaaaaatatagtcattgcttatctggcagtgactttaatttttctgttcgggatcataataagcctgaaccactatagtcttgctggctattatacagacaagataattaactggctttggcttgcaatgactgtttttattattatccgcttctggaagaaaaaaggagttaaagtatattttggtgttttgatatcaggaattattctgagcatactgcccatgatgatcccttttttcaatattcttctgtatttttctaccctgggctgtgatcagcaaattaagctcaatgatatttacagaatggaaagaggccgtccgggagcgctatataatcctatgatcacgatttacaaaaaagaggggatttttgaaaagcaaacagcaagggttctttacagagatataacggaagacattttgccaccatcactgcagagaattacagatgagagagagctacccattcaggaggctaaactggtgaatgtgaacaacgacagcattggtattgaataccacattaagaataagaagaaagtgatttatcacaaaaataaattaaactggtttgatgatctgtaaagattcaattgataaacctcaacaatgccattcagtgattttggatggttttttattgtttaacctttaaaagctcctgcacaaagggcaaagaaaaaaatcaaaaataaactcacaaaaatgtgatttgtttttattttattactacttttgatgtaaatcaaatctgatttacaaccatttaacaaaatagtatgaaaacaaaaatcaaccttttcgcattgtttgcgttctgtgcttccctgtcttttgggcaggacagccagcacaggatggctaatgatcaaaattcaattatttatgtatgcttttcgaaaggtattaattcagaaaaaacagcattcagtcgaaatgctgatctggaaaagttttcaagagagtatcacatttcgttcaggtatgatcttgattttacggacagcaggcttgatgagatggccagaaacagtaaggccatcggaaattccacagaatctgtagaaaagctgaaaagaatttataaggctgatcttcctcttcagaacacagaaacaacagagaaaattattcgcactctggaaaggtttccagaaatagaatatgtgtctgtcatgagtgctgatcctgttgccccccctttggtcaatgcttttgtggctacaccggatctggaaagccttcagacttacctgaacgacaatccgggtattaatgcaaaatatgcatggtcaagaggaattaccggacagaatatccgtgtaagggatgtggaatatggtttttacaaaacgcatgaaatgctttccaatcaaaattctatacagcttgagcccggatattctcctaatgcaggattagcgaataataattaccgtgaccatgggactgcggtagtgagtattttaggctcaattaaagataatataggacttacaggagctgcctacagtacttctgaaataaaaggctatatggaatggaccactgtgggatacaacagagcttctgcggtgagcagatctattaacgcatcacaggctggcgatattattttatatgaaatgcagacgggtggcaaagatggccagtattgccctgctgagtatgaccaggtcatctgggatcttacaaaagcagctactgattcaggaatcattgttattgctgctgcaggtaatggtaaccagaatctcgatgatccgttttatgccacctatcttgcgagaggaaacagcggagctatcattgtaggcgcgggatctcccaataccacccattcaaaactgagcttcagtacttatggaaacagagtggatgttcagggttggggaagcagtgtactggcagcaggctacggatcttacgcgaaatatgacaatgataataacagaacctataattatttcagtgggacgagttctgctacgccggtggtgtcttctgcagctattctgatccagtctttttatcgccagacaacaggacaatatttaacacctacggcgatgaagaatcttttgatttctacgggaattccgcagggaggaactgtaacgggacagaagataggccctcttcctaatgtgaagaatgccatacttcaactggaaagtaaatttgccacccctgttaaaaccttatctgcattggaagttaaaatttatcctaacccatccagcagcagcattgctattcaaagtaatgaaaataaaaagctggatattgaaatcattaattttcagggacgtacagtaattaaaagttcagttttacctgatgaaaaaattgatatttcccaactgcctacaggtcagtatatcattaatatcaatgaaggtcagagaagagttgttgagaaattaaccaaaatatagttttaaaattttacatcattttacttcacattaaaccctcttccggaatactgaaagagggtttttaatatcaatttttataggtcttattgcgcaggaacgctgttgaagttaagcgctacttttatattcatatctgaagaggtttgattcttcaattcataaactgttcttactgtcaatccggaactttttacaatttcatcaagaaatcctgtatcattcaaatccagatttaagctggaagaattggtggagatattggaacgtgatgcaaccagtctttctcctgttccgttggatgaaacatagatcttcacgcttttaaatgcgctcagattgcctcccgaaggagaagctacagaaatttttgcatctgatattcttacatctttaatttttgcattattattacccccaaaccaggtctgcacattggtagctgttgcagtagaagaaatttctttatcagaaggtactcccgtagataccaagacattcgttgtgtatggaaatgtattctgaaccagcgactgtacggttccgcaacttacgagtacagctgaggcggccattgctgttagaactatatttttcataattgtaaattttttaaatttcagagtttagtttgcagaaattgtaccaaattgattggttttattctacagttactgtaaagcttcctttggtatttccggaagccatattacttttaccgataatcagccatacttctccttttccgggagtgtcataagtaatttcccttccgaaaggtccatcatagttcccgttcggtagtcttatctgattgaatctgatattgaagtctttttcttttgtagaaatttttgctttaatattcggacgatcataatgggtcagttttaaaacaaagtcctgatcatcttttgtaaattcttcccctatagtaaaaggcaactggctggcatcagccgttcttataatctggccctctttttcatctctcatgacacctttacgaagaacttctttggtagccggtgcattgttaataattgaatctctctttatcaatgcagcagaatcacttttcacagaagagtccggcatttctgtcacggctgtggagtctttctccggaacgctggtcacggcaggctcttttttacaggcaacaattatcaaagggattaacaataagctttttttcataataattaattttaaaaagtgatcaaccaatattctgttgagctcaattaaatgctaaaactgttccaattcatgaaacggtttattttccggctgcattactttttcattatctgtttctgcccatctgaatgtgaaatacatgaaattgagcatgatccccatcagggcagtaacgccccaagtcttggtatattccatcggatagatgaaccttactacaatatcagagaaaagaccaaaaggattattgagcacatcccagctgttccatctcagaaatcttcccagatagactccaaagctgctcataaaaaggaaaaatataattaaaccggtaatgaaatttctcccggcataatctgaaagacgctgttcaatatctttaaggctgataaagccacagatcagacccgtccaggcataagaaagaatcacaaccaggtcataccagatcggaatctcgtttcttgctctcagatgaaaaagatctgtaaggatataaggcgaattgggaaaaaacaaaatccagactataataataaatgccagcgagattttacttctgatattaaaagccggaaccaaagaacttaataacaaagggatccatgccagaaagaggttccagttgagaaataaaaatacttttgtttcactgatataatatctgaaaacagagaggctgaaacaaaatacagtcatcaatataaggagcatactgattttacatcttgaagattctgtgagctttttcataatcaattattggatagtttgataatagataattttggaaagaaacgttttggatgtttcattttttactttgttctgcagtgtctttttaagcttttgatcattttttgcatctgcatacttcaacagcgctttttcactgaaattgacagacgttaaataatagttcactgcaaaatcttttcttttcatattctgagcagtaataaaccctccccaattgaaatagctgcacactaaaatggttccgtaaacataccagatcatggtattgataaggaaaatatttctttttttcttttgaattttaataaaggttaaagccagaccaatcattgataaaacaaggaaagcaaaaacgcccagtcttttataggtaaatccgtaattcacgatatactcatagtttttaaggaccgcagacaaaacaagagcagcattgagaaaaatccagattttagctaatgtttttaacagaccagctttcggatcaaaattaaatcccgatttaaagtagaacatgattaccaggatggccatgacaatagacatgatcacagcgtttactctttcatgggtttcttctgacaactgaacaggagtttttaccgcttcataaaactgttcgtagttgtacgtaataataaagaataccaatagaatattcagcaaaataaaagaaatcaccccactcattctttctgcatcaatgtcaagaaaagaataggtagcctttgggatccgggcatctttgctaaactcattatccagaacatgattgtttttatagatcagcttttctacagcataattccagtaattgaaggcaataaagaatcctaaaacagacagacagaatacctgccacagattaatatccagctcataatctgtgaaaagagctgcaaaatgattgcttcctgcagaataaattccaaagaaaacggaaaccaggatcagcgggatcaaaatgaaagccagtgttttttgccataatccgggaatatttttctttggcagccactcatcaaaactgaaaaaacggcagaatgaagtgcagcaattaacgacaaaaaccggaattaaaaaaaggatttttaatcttttattcttcgacttatatcccagtaaaagcaatgagcttacgacagcaataaaagacgggaagtctccgaaccaggcaaacgcaatgccggacaggatgcttgtcacaaaaagggtgtacaaagttccggttctgcttttttgctgtgttctgaacagagtcagtacggcataggcaattccaagaattccaaggttcagccctacttcctgatcgtagaagacaatgacaaacaagagggctgtaagaaatatataatgatgtgttttcatgaggttaattattgaaagatttaaatttaaaggattgaaagacttgatctatagatatagagattagcaaaaattaaagaacaggatgaggtacagaaaagcaatagggatattaagcaataacagaagcacagagttcccgtttcttttctttccggagatatcactcagaaactccatcaattcatataaagtgattaacagattcactacagctgcaatcatcacataataaaatccgaatatcatgagaaactcggctcttgtaatccaaaacaaaagcagtaaagctgtacccagcaaaaaggagattaaaaatgtcttctcccccaatggactgaattttatttttcccattattttaattttaatgtagaactgctgtttctttctgttgaataaaatctttcacatgttcaaaattctgccagagcagcccttcaaaatcccaatcgtgaaaggctatcatgttctgtccttttttgtaggctttgatataaattttcacatattccggaaggataattgttcccaatacgattgcagccagaaggtgtgcattaagcttgccgttcccaaggagcaggtactgcatggcaatttcatcttcgaagttggttccgcagccggtaatcagatggtgaacatcgtggttttccattttggggatcattgaaaacccatgtttcctgtaaaattccccaagctttctccccaaagaatcttcctggaattccagcagctgtttttcattgaactgccattgtctttttttctttttaaaatattttctgtagagcttttgagttttatcatacacaaatagcagaaactgaacgcgtatttttttcataatgtatttattaacaataatcagcttaaatgttgtataattctctactagcttcccgcaaacggacttccaaaaatccctactgccagttcgagccagattaatgcaagggctagcaaaatgaaaatgcagatcagaattttctgactttgttttttgattttgttcctgacgagattgatcagaaatgctgttgtaaacagtaaaattcctgcgatcagaaaatctgaaggtgaccagtttacttctttagaaaccagatttcccaacaatggaatacttagcaaagccaagggaagagcataaattgtaactgttgtttgtttttgtgtcatcattttatttgattttaatattataaagtactttgtatttcaaagttaattttcaaaaaaatataggactatcgtcccaataatttttcaagagcattcaaatgctcagtaaaagcctgtctcccactctgcgtaacacgataagatgttttaggctttttccctacaaattcttttttcacttcaatgtatcctgctttttcgagtgcgttgctatggctggccagatttccgtctgtaatttcgagcaggcttttcatttcagaaaaatcaacccagtcgttgaccatcagaacggacataatgcccaatcttacacggctttcgaattctttattgagttgatttattttgatcattttatttattttatttattctgaaacaggcaaaatctgactatctctttaattctttataactttagtatgatatttcatagctaaaaaattaatattaatttccaaatgtacaccgctccaacactaataataaaagataaaaacattatcagtaaaggccaataacccataatatctttcttcctttctgaatagaattcagtcacatctactagattgagttttttacctatatgtaaaaaactcaactctttctctgtttgaaaggtttttacatcatttgtctttaaatcaacgaaaaaatattcattatctaatgtctttccaaaaatatggttaccagattcttctattttagcaacagatgagatcaatgtcactccattcccattatttataattgcttgttcgggcaaatcaataaataatagttgatgatcatttttaataggaacgtaccaggaatcaccaattccaacatccacttttttattattagacaccatggataaaccaataactccaacaatataaaaggtataaaaagctacaaaaggagctattaatgctaatattattttccgtcttctattttcttttttgctgataaaataagtgaaagtacaacttatcacagcgaagataaaactgagagcagcaataatgaaaagatggattaatatgacaaaaccaactcccattatttgtacttcttatgcataatcaatccatagataatatgcaaaaccccaaaaccaattgcccaaaacactaacccccaacctaaaatgaataaagaaataagtcctaaaacaatctcaaaatatcccagatactttacgtccgttaatgtataccgttctgccgctaccagagccaatccgtaaaaaatgagtgtaaccggagcaataaaaacgaaaaggtgatgatagagaagcgcaagacaaaaaactcctccagcaaccaaagggactgcaaaggtaatcaaaagtcgctttgttgtggcatcccagatcttcaaacctttctttttgcttttatgggctgtaaaaatataaccactaagaatagctacaaccaaaattacaattccaatcagaacaagttctttaaccaaagcaggtcccagaatatttctatctccatcaaaataactgatcccttccctcaggaaaacaaaatacacataaacagctccgataattgccgttaaccccgcaacaactccggataatccgcttaaagaaataaatctggaagaacgctccatcatggaacggatatgggataagtcttcgtgatagttttttgcatccataaaaagaactttgaattacaaagttataatttatttttaatctgcaaagtttttattttaaaattttggagttgtatttatcgatatattcatctattatcaaaatgcagaacagtcgtataataatattatacgcaacaaaaaaatccgtagaaaataaaatatttctacggattatatattgtattaaaatcctaaaagctaaaaaaaagaactatttcgctctcaatctttctttaattgattcaatatttttctttgcagaatcttcaagaataagactggcactcatgtgaattcttgcaggcattaattcattgaaatgatctgttccttcccatgaaacttttttaattaatgccagggcatcagtgcttcttgaagccaaagtttgtaaaaatttctccagtttttcatccatttcctgaatggtatctgaaactgaatggtagatattatgctgctcagcccactctgcagacctgaaatcagcatcaatagccattgcagaaaattgtgattttccgatttttctttctacgtaaggaccgataacaaagggaccaattccaagattgatttctgtaagtgccaacgctgaatcttttgtggcaaaacaatagtctgctccacaggcaattccaacaccaccaccggtagttttaccctgaactcttacaaccacaatctttccgcagtttctcatcgcattcaaaactttagcaaagccgccgaagaattgtgtggaagcttcaagttcttcaattgctaaaagctcatcaaaacttgctcctgcacagaatgctttctcaccttcactttttaccaaaatagctttcacctcatctttcgctccttcttcaaggatagttgctgccagtttttctaaaattgctcccggcaaagaattacttttaggagttccgaaactgatttcggcaatattatttttaatttctgatgctacaaattcgctcatttttatttttattggattcttacaaaaatacgaaatacagctcgttcagagaaacttaaatcctatattttctttttaactctgcccaatacgagacattattacgtagaaatacggagtttttaatttggtattttctactctagtacctgcctgctattaatcgttcctttgaaataagaaataataacccatggcggcatctgaaaagccattaaaagagtaagaaattaaaaactaaaaacatattatcatggacgagtacattggaattgtaaaattatttgcaggaaatttcgcaccgagaggctggatgttttgcgacggaagcttattaagtatttcaagaaattctgccttattttctattttaggaaccacttatggcggagatggcatcactacttttgcccttcccaacttaaaaggacgtatggctttgggtgcggggaatgtaaactccggtgaaaattatcctttgggaatagtatccggtacaacacaaaatactcttttatcatcaaaccttccaagtataggagccggattccagcttaaagtagccaataagaatgccaattcgtctactcctacagctacctcaacaattgccatttcaggaacgcaggtgggaagagatttcaatgcagtaccgagtttcgtgaatgatgccaaccctgatacaacgattaatccgttaagtatttcttttacaggacaaggtttaccattaaataatatgccaccatatcttggcttaaattatattatttgtgttgaaggaatttatccgccgagggattaatatccttttaaccaacctaacatttaaaacaaacatcatgaaaagcactacttttttagccatctgtagtctgctcatttcaattttctcattcgggcagaccagtacagaattatttgaaacagaatcgaacgggagtacaagcttcaccgacaatggagtcattttcaatatcatttcacatgtaagtgtttttgatatccaggcgaatttcccgggaacaggctggagcggaacatcaaatgataaccggtatattgataattccaatgattctcagtttccgccgtcattcagtattaaaactacttctaacctgtttaaggtaaaccgattctggatgtatctttctgcattaaatctggacctcaatgtagcaggaaccctgaccgttaccggaaaactgagcggagtaacaaaatttacacaaacgaaaactaccggatttgcaacaggcttaggatccactaatggatataccctgatagatcttaccaacctaaacggccagaattattcaaatatcgtgattgatgaattgcagatcactgcaaacggagcctttcgctatgtaggttttgatgcctttacctgggtaaaagacagcaatcttgtattaggtacctcagaagctaaaagcactcaaaaaaacctgactgtttatcctaacccaaccaatggtcctctttctatcaccactgaaaaggctaatgaagctaaagtatacagccttgacggtaaattgctgaaaacggtacaaacccagaaagggaaaaatgaaatcaatatttcagagcttccgaaagggatttatattatcaaaacagcaacagaatccactaaagtcattaaaaactaatatcaggaaattgcatataagttccatatcccttaaagattctaattcataaatgacaaatcccttcatcgaaagggatttggtcattttttcaaggccaaaatgtatttgtttatgtaaagctgtttatcttttgatttgtactgctggatatatcttggatgctccagaacggtcatagtatcgaagagtttggcttctttatttagttttgaaagaaaatctgcattctttttacccaggacaaaaacttctgaagtgtccagattaagactgatatgcttcttcagcgattcaatcataaagtcttttacaaaattgaagagctccttgtcatcataataattagcattgagccatccgttttttgtttttctcacaatcgccaacggaaaaggagagttgatataaatgtctttataaaaaagatctgcgccgccatattcttcaatcatatcatacatgaatacggaagatacttcatgggtgtacgctgacttcattttgattccgcaaacactttcaagtcttttggtatcggtaaacggaactcccgttactcctgctccatgacggcttggattaattccaatcataaatttcctgcggactgagtcatcataatatgtatgataaaattcctgcatgaccgtcaatgtttccggattatccagatatggattcaggacttcaaaaccctccggtaaatttccagtatagctaagattcttattgaactcaatgacatggtctgcaaaagttgtattcatgaattattgctttaaaaatataaaattatccggctgttcagaatcctcatcattgtcttcttcctcttcttcggatagcataagttcaatatcaataaagtgaatataaagtcctgatatttttccctgagcatcgtaagcaaagtaaacagggtacaggccatctcctaaaccgcttgcaaagaagggaatatgatattcggtattaggaaccttccagttgatccagtcaccaagatctctctgatttttagggttttctttgtagctttcagcaaagagttctgcaaaataatcatcgtaaatattattaacatgcaattctgaaagaaacttctcaacaaaaggcaccacctcaggatccgtgatacagcctaatcctgcatctactgcaaaaccgaaatactctccttcactgacaccttcaagattttcgattccaatcaatgcttcctggtaaagtacaggtttttcttttgtaaattctactttcactgcagcataccggtctccccatccttctaattttgctacggcaaccgttacggaaaagtctcctttgggaacttccacaaaataaggtttctcatctgcattcagatataccagcggatccctcacgattacttttcctgaaggcagggaaacttttccaatttccatgacttccatactctgtcccataatcacttctgaagtaaaataagtatcaatatctacgggagatgtgagaatttcttttactccttcccatttttgcatccagctttcgttcattattgaattgattttaagtctgaaaataatgaataaatttaacggcatcaaactcaaaagaatttttaacaaaagattataagaaagctgcaaactcatggaattgcagcttgttgtattgtttgaaattataaaatctaagaatcagcacatatataacatgctctggcaatatccggccatcttcccggaaggcagcaggtgcctggaggacaaggattaagggtacaagaccagtttggtccggatcctttaagtgatctcaactcatgtcttgaaagttttttaaaatttttcataataatcagttttgatgttttctcctactctatatgcttttcggattgcgcttattaaagttaataattttcatccgaaaacctacataataaactgattaaaagcagttttctacatttccaataataaatcttctcatatttagtcatcgtagaaaaaaatctatcagtctatcgatgtatatcttaacactattttttgtaaatattttaaaaattttcacttttgacaaaaatttaaacactttggttgcgcacatctattattatcgaagattctaaaaacacattaatgatgagaaattaaactattgttatgaaagtgattttttcaaatttgatctgtagccattatttggctgaaaattgagaaattctaatttttgcaaatccctcaaaagcaaaaacttaagaaccagcagttttctgatcattatgacattaattgtcaatttccctaagacattgtttactttttaaattcccaaaactcatttttagaatgtcattgctctttaaaaataatgacttactacattgtatttatagcctaaaattctaattaaaatatgattaaaaaacacaaattattaatacttcctttttgtttctttacctatgtacttaatgcacaaataggtataggaacaaataaccctttaggaagtttacatgtggatggtgctaaagacaatcccgcttcaggtgtaccgacatcagcacagctttctaatgatgttattataaataaaacaacaggttttattggagcaggagttcttaatcctctggttcagttggatatgagatcagcaggaagtgaaaattcacttggtttagggacgaccagcatgtcggcagtggcagcaggtgcgggtgctacacggtatgatgtaaacaatatacctgtaggagctaaaattcaggtatctgatggtgcagtatggaacaaggtttatcttgcccctcaaaaagcagttgttgtggtccgtaaaatagtaagccagtcgataccaacagccactcccacaactatcactaactggagtgaagttcgtgatatgagcaatagctttgatcccagcactggtgaatttacagctccccgaaacggaacctatacctttttgttaacattcaatttcacaggtgcagttattaatgatggttccagagttgagtcccagttttataatcccgctacaggtattgttcttgccagcgtatataaaacttttggccaatctatgactggtacagctgatgatgcaaatgctacacgttcaacacaggccggaggatcaagtactgttacccttactttaactgcaggtactaaggtaagtgcaagattgtatcagaaccttacctcaggtgctattcctctgagagttaccagtaattcttcagatcctgccaatccggatgatggatttaacaatctaactataatagaacattaagatatagatcatgaaaaagaaaatcaatataacttataaactattttcttctcttttatttcttttcgccattaaaacaactgctcaggttggttttttcacccctaatcctgcgcaacccttgcatatagatgccggaaaagataacggttcttcccctgatgcgacaaaaatatccaatgatgttgtcattacatcagaaggtcagataggggttggagttttaaatccggttaccagggttgatctcagatcttcaagtgatcaaagaattattggtttgggcagcaatacacagagcccttcttcagctggcggaggagcaatacgttacaacaccggcggatatctggaatattctgatggtgagcaatggatagctttgccccttactcctcctaccaaagcacttgtaaatgcaagtaacagttctgcacaaagtattcccagtggaacaaccaccaccattacaggctggacagaaacagtggacctaggtgcaggaggtggagattttgatccggttaccgggctttttaaagctccgcgtgatggtttttaccttgtttctttcaatattactctggctaacggaaatatccctaaaaatacctttatagaaaccgcaatagaaagcagccaaagcaccaataatattcctgtatttaaaacagtaaactcttatcctgcttttcaggccggtgcagtaagtaattttataagcggtaattgtaatgctattttcaatcttaaaaaagatgatactataaaattcaccgtgaagcataatataggcagtgcgagaagcatcctcaatgacagcaaattgaataatttaagtatcagtgaattgtaataatatataatgatgaaatcaaagaataaaataaaaagattgattagtatttttattgctttatcattcaacataaactatatcaatgctcaaataggaataggattatccaacccaaccaaccctgtggaggttaagacagatgcaggtaacattatcattgataattccggaaaaataggcgcattagttactaatccaaaagtagcactggatctgcgcagcaatgtaaatggttctgtagctatcggaaatactactaaaacagcagcccaggcgggtgcaggtgcattacgctatgtagcaagccctgcaattggtgtgaaaggctatcttgagttttccgacggttcaaactgggtgagcttttttcctaaagggaaaccgcgtatcattgtaatggcaagcaaaacaactcaggatacttatgtatttgaaagtgctacgccttcagaaataggaactaaatccggcattgttcaaagaagatcttcttatttaactaactggactgagaaattagactcggattcaggggttcctacctcaaatttcaatccggctacaggtgaatttgtggctccgcgtgatggtgtctattttgcaacttttaccttcgcattacaatccagccaggtaaatacaggatctaacaatcaaactgaagcaatctgggaagtgagaaatccgggtggcacaatcacacagaggataaagacaaataatggatattcttctgatacaggtgcaagtcccaatgctgtacccgtagggtctgcctgtaccgtaagtgtatatttaaataaaggggacaaattaagaccttttacctggattaccgtagcatttgatggcacaatcagccagtttgatacttcaggaaatggagcctataattcacttacaatagttgaacagtaatcgattcatatttgatatttgatatttaattacataaaaaaacagcagtttacttaaactgctgttttttattttatacttagttttaattaaatcaatccgaactgctgaaagtggtgagtaaaatgctttctgtgcatcagttcccacatttctttattcagctttccaaatacataattcatgtgttctgcctgtggattctccttgtaatagatcacaaatttcttcagattatccatgaatgactgctttgctgcttccaggtttttgtggacaggctcaggaagtgaaccatcctgcggaaggaacggagctgtgaattcttttggcatcgctctgtgattataaagcgagtcctgccatttttcaatattttcttcgggggtgaaacatttttctgcttcaggttctccaaagcttaccaatactgctttttccaaatgttcaatcatctgctgaggagacatttttccccaaagtgcaggagtgttttctgttaacccgctcagtattttctgaacattctttacattcagatcaatgaaaggagattgcttagcaaccaatgtcaggattgttgccacgcaaaccacctcatctctttggttcactacttctaccagccattttacaacaccggaaggaatatttctacccttgactcctctgtttattttttctttagccgttaaataaaccgtaatggtatctccggcgtataccggtttgaagaagctgcagtcttccaatccgtaattagcaataacaggtccttttttgcctgaaacaaataatcctgcagcagctgaaagaatgaaatatccgtgagctacggttttatcgaagatggtacctgttaaacttgtggcatccgtatgggcatagaaatgatcccaggaaacattggagaagtttacgatatctgcctctgtaacagttctaccggccgtttctaaagagtctcctacttccacttcttcaaaatatttctggaaaggatgtttgtctgagaattttttctctgctccctgctgatagatcttggtaattgctttcagtacatccggtgatccctggatagctgttttctgcaggaagaaatgaaggccgctcaacccacccatttcctcaccaccgcctgctctaccaggacctccgtgcatcaatgtcggaagtggagaaccgtggccggtgctttccttggcgttatctctgttcaatacaaagattcttccatgctgggaagccattttccatgaagtttcagcgatgaagttctcatcgtgagaaacaatagatcctaccaaacttccttttcctctttttgccagtgcagccgcctcttcagcatctttgtaaggcattaatgtagatacaggcccgaaagcttctacatcgtgagagatattcttttcgaaaggcttatcattcaggaaaagtttcggactcataaatgctccgttttcatagttcgcatctaccagttcgtgttttccgtcatagaccagttccgtttctgattttaataagtttacttttctcagaacttcttcatactgctgtcttcccaccaaagatcccattctggtctctctgcttaatgggtttccgatttttgtctgatccaaagctttagataacgcattctgaacatcaccaattaagtgttcaggaacgataattcttctgattgcagtacatttctgaccagcttttgtggtcatttcgttacgaacttctttgatgaaaagatcaaattcaggagttcccggttttgcttccaatcctaagatagaacagttcaatgaatctgcttccatattgaaacgaacggcatttcctgcgatagaaggaagcgattttaactttcttcctgtatgggcagaacctgtaaacaatacagaatctccatcctgtacataatctaaaatatttcctggctctccgcacactaactgaacagcaccttcaggcaatactccactttcaatcatatcctggaacaccgcattggtaagataagatccaaaaggagatggctttacaatggaagggacacctgccagtaaggaagtggaaagcttttccagcattccccacaccggaaagttatatgcgttaatttgtatggaaacgccttcacttggtgttaaaatatgggttcccaaatgagtaccatttgcagagattttctgtgtatctccatctacccagaacggagtattgggaagcattctttttgccaatccggaataggtgaagaaagttccgaaacctccttcaatatctacccatgaatctacgtgcgtagctcctgttttgtaggagagttcgtaatattttttctttctttccaacaggtaaagggccacttttttcaacatttccccacggtcgtagaaagtcattgaagaaaggtttttgtatcctactgttcttccatagtcaagagcctgttcaaaattaagtccttcagtatcagaaacagctacctgctctcctgtaacggcattgtacaaaggaactccgtttccggtaccttctacccattgtccgtaaatataattttttaacttttccatatagttttttactttttgcttagattattgtttttaataaaattactgatgaacagataaggaataaaaagtaccagccagcaatctaaaataaagacaacttcaacaaataatgtgtagaaatagtctttgctttttagatgagcaatgacctcatccaactcagcatgttccaaagtatctgaaattcctattgactcttttgcaaagtgaaatcccaaagcatttataaagattataacaatcaatattacaagccagtactttttcagaagacttaccattggaaactgatttacttctgttcctgataaggaaacattttcaccaatccttcatataaacttctgtgaagaatggttgcatggttgtctgtttccatcattttatattctaatgtccagtttttctttcctgcttttttcaaaacatcataaaagttttctgcatcttttatcatcacaggatgttctccttttcctacggaaacataaacaaactttttggtatccggagattttgaaagtaattgaggagcctgttttaaaaggctttcgtcatcccaccacaaacttggactaataataaaatagttattgaacatttctggttttttcaaaaggatttctgtcgccaaaagcccacccaaagactgaccgaaaaggtatttatctgtagttttgaactggctttcaacatatggttttaactccttttccatgaattcaataaacttatcagaatgtcccgttgtagggtaatctttctgcagatcttttaaatccgtatggaaagtaaagtccctttttctgtctacattagcaacccccaccacaatggtttccggcatggaatacatctgattaaagaactgtactaatcctgtcacatgaataaaatcttcattgatacttccatccaaaagataaatcaccgggtatgattttgttttgtcatatccctgcggaagataaatattcagcgttctgtcttcatttaacgttttggacttaatggtccttacttctcctattgtaagcggttttgttgtaactgtctgtgctgacactacactattcaccgccaacattatgctgcatgcaagtgcaatttttttaatcatattatttttgttaaacctaacaggttttagaaacctgttaggttttcttgtatacttattttatatcatcccagatactgtaatccacaactttagttgggatctgctgtacatattccgtaaatggctcacaaggcagaatagcttcttttccttctctcgccagctcttgatatagtttagttccttctgttttccagcgaatcatttcatcagaaacatcacggataattttcgcagggcttcccaccactaattttcttggttcacatctgaaattagcaggtacaaaagccaatgctccaacgatactttcatcaccgatataagctttgtccattaccacagaattcattccgatcagacagttttttccaatatgccctgaatgaatgatagcaccatgtccgatatgtgcagattcttccaatatggtttctatatttgggaaaacgtggagggtacagttttcctgtacattggctccatctttaatgataattttcccccagtccccacggattaccgcattgggaccaatatatacttcttcacctatttctacattcccgataataactgcctgcggatgaatgtatgcagtaggttttataatgggacgaatcccgtggtatgagtagatgttcattttttttaatttgaaaatctgagaatgagctaatttgaaaattaataatgtctttcatcattttcaaattctcaaattagctcacttttaaattaattatactttttcaatgaccatcgcatatccctgtccgacaccgatacaaagggtacacaatgcatactttttatcctgcttctgaagttccattgctgcagaacctacgattctggccccggaaactccaagtgggtggccgatggcaatagcacctccgttcgggtttattcttgcatcatcatcttttaaccctaagcttcgggttacagccaatgcctgcgctgcgaatgcttcgtttaattcgatgatatccatatcctcaagggatagatttaatcttttcaacaatttttgagtagcttccaccggtccgattcccataattcttggttcgacacctgctacagaagatcccagaatttttgctttaggttttaaaccatattttttaaccgcttcttcgctcgctaaaatcaaagcagcagctccgtcattcattcctgaagcgtttccggcagttactgttccttcttttcggaaagccggacgaagttttgccaacccttccatcgatgaagaaggtttaataaattcatctttttcgaaaatgattggatcgccttttctctgaggaatttcgacttttacaatttcttctgctagtcttccgctttcctgagcttttgttgctttctgctgagaccaaagagcaaatttatcctgatcctccctgttgatctggtgaatatctgctaaattttcagcggtttctcccatcccgtcaaccccgtacatttctttcattttagggttgataaaacgccatccgaaagttgtatcaaacatctggctgtctcttccgaaagcagcgctgggctttgacattacataaggagaacgcgtcatatgctccactcctcctgcaatataaatttctccttcccctgcagcaatggaacgaaatgcattggctaccgcagacattcctgaagcgcatagtctgttgacagtttcgccaccaattttataaggaagaccagccagtaaaagtcccattcttgcaacgtttctgttatcttctcccgcctgattagcacaaccgaaaataacgtcttcaatttcctccacaggaacttcaggatttcttgctactacttctttgattacaatagcagccagatcatcggctcttacttctgataatcctccctgtaattttgagatgggagttctgacatagtctatgatgtatacgttgttcataattattttaatataacaatctgataatgtaacagtataacaataccggatttatttgtttttatttcttaattctaaagcctgttttaaagtataaggttcatatttaaagtccggtccgaacattcttttggcattttcttcaagagtagaatcgaaacctgcttcttttcttcttttattaacatttttaagatcttgtaccggccatacaaaattgacaaacacttgtttaccatctttatcttttgtcatttcaccttttccctgtgttccatagatctgttctttatcttgctgcatcaggtacctgtcctccatcatagcaacccaggtgaaaggaatttccttcttttttccagcttctttaatgagaggcaggtattttccaatttttgttgaatgctgaattacataccaggccgcctgattggtaggttctcctaccagggttttcccgggatagccatattgagcaataattttttcaatcttctgcatgttcagactatcgtgttcggccaccaacatccagtttttctttttgaattcttcttggtcaatattcaggtctttcagcagctgttcttttttctcgggagtgatctcagtatcaaaaagcattctatacccctgatccaccttcataatagcatcaagttcttttttcaacacttcattcactttttgctgggcattaacgagaagggttaaaatcccaaaaagtaacataaatatttttctcatgttggttaatctggtgtttggtattaagttttataagtcggttacttttttccctattttgtagactgttcctacaaattttgcaatcaactcgctgttttgatttgtgatctgaatgtcatacactgctgttttccttgtatcattaaccaaaacactttctgctctgaaaacatcaccttcttttccggctttggtaaaattgatgatgcagtttaaggccacagcagcatctccggtattattggaagaaaatgccagcgcagagtctgcaaatgcaaaggtaacaccgccatgaactgtcttaaggccgttcagcatatccttcttgatcggcatttctattaaacagtaattttcttttacttcaatcatcctgatattcatccactgggaaaaataatcctgattgaacatataatctgctacttgtcttggattcatttctattaattatatgtttgttatttcttcatacagctcatcggataatctgtcgtaaacattcattgttttacccagaatgatctgcccgtatgaaagattttctgagtccgatgaattttcagagggataggattcgtttaaatcaattccattttcgttggctaatcttttgatcagctctttatatttttcattaaactttcccagtaactcgagtctttcctgctcattaacagaggatgcttcctgagttaaatactgtttctcaatcagcagcctggtttccagctcagccctgaattcatctatattcataattataagttaatttattcattaataatcctattcaaatctttaattccattttcataagatcttttgaaataaaatttaattacgaaatagattattgtataaaacatagcaagtggtaataataatgctaatgcaattactccagtttgaaagcaattaacaattatcgcaaaaaccggaagaataccccaaacaaataacattattctaaaagttttatgaaattttgaattcaactttattattgtctcatgttccttttgaaacaattgaccttcaaaaacacacaaagctcccaatggtacctcggcacttattactttaaaaaaatttttctccgtatatcctcttaaaaattttctagtgcggttcattgttagggaataacttttctcactattgctatttatatttgataaaatcttttcaacagagtttaaagattttatttcatcatatctttcaggaaaatatttcatattatattttcttcaacaaaggactttgcctgtatctttcttcctgatattcttcgtaaaggttttgtagggtttcggagatctttgtatatccaatctctttaccccagcttaataatcctttcggatagtttacgcctttctgcatggccaactcaatatcttcgtcattggctactcctaatcttttcgcttcaacagcctcattgattaacatggaaatgattcttaaaaagatctgctggtataaagcatcgtctttctgagcaacagatttttctgctccttcactgtaatcgtagaaaccttttcctgtttttctgccgtgaagtttggcttcagacattctttgctgtaataaagacggtttgtatttcggatcgtagaaataatctttgtaaactgtagttgttactgcaaaatttacatccactccgataagatccatcaattcgaaaggtcccattttgaagtttcctaaagttttcatggcatcatctacctgttccggtgttgcaatattttcttcaacaattctcaagccttccccataataaggtctggcaattctgttgacgatgaatccgggaatatctttggcaataacaggagtcttcccccattctttcatgaggttatagattttttctgctaatgttttttctgttaataaggatggaataacttccactaaaggcatcaacggagccggattgaaaaagtgaattccgatgaaacgctccggtttctttagttctgcacccagagaggtgatagagatagatgaggtattggaactaagaatacagttttctgaaacataattttcaagctctgtaaaaacttttgtcttgatctctttgttttcgataatggcttcaataatcagctcacaatctttgaaatctttcagttctgtagcaatggaaatgttggctaaaatttcagtcattttctccgctgaaattttttgtttatccaccaatttggtcaatgttttttccaaacctaccgtggccgtttctacttgttttgcgttggcgtcatacacccatactttgcatccgttcgttgcggctacctgtgcaatgccgattcccattgttccggcaccgataattcctacattcatattttaaatttgaaaatttgaaaatgagttaatttgaaaattactttaattttgaacttgaaataattttagacaggattaatagaatttcttttaaatcagatagtaatttttcgtttggagatttcaaatatggagactttaagcacagcaaaagccaatattctgtctcatcagcctctttagctgcaatttttaatttatgaataaaatctgccttactttctgcattttgagcttctcttacatttgctccaattgaagttcctgatttaaaaatttgatttgccaaaggaatttttttcgcatcgtataaatattctgaaaattcaatgatattgagtgcaaaatcaaaagtcttatttacaataatattttctttgtcattcctcattttcaaattctcaaattaactcattttcaaattaattatcttcctttataattaggttttcttttctgtaaaaaggcgtttacaccttcaatgaagtcttctgtttctgcagcttcctgctgaagatcaccttccaattcaagttgttctttcaatgtgttgttataagaatgggcaaatgcttttttcgtaagctttatggctgctgtcggcatgtttgccattctttcaaggatttccatagattttggaacaaattcttcttcactgaaaacttccgctacaaggccataagatttggattcttctgcagataattttttacctgtaaatgctaaataattagctaattgtctacctaaaagtttaggtaagaagtaagttcctccggtatcaggaatcaaaccgatatttgaaaatgcctgagcaaaatatgctttttcatttgctaaaacgaaatcagagatcaatgccaacatcgctccagctcctactgcaggaccattgactaaagcaataaccggttttttgcaacgggtaacttccaaaaccagtggattataataatcgaccacaatttttctgatgatgtcatgatcgtgatgttctttgcctaccacaaaagcttcatccagattctgacctgagcagaacgctcttcctcttccggaaatagcaacacatcttacggtttcgtcttcactgcattctttgacaaagtctctaagatctgctaaagccggcttggtaagggcattcatggtttccggttgattaagatatgcgattttaagcttcccgtcaaaatgcgtttcaatatcaagttgtgtatacatagtttttattaatttattatttaacaacgcactaatttaacaatataaattcatgtaaccacctaagattttaacaatctagcaataccatcgttatgctctgcatattcgtcaattttattgatgggctatggttaattcattgtttacagttattgcattattaatgacatttaaaataatcaaaaggctccagacagtctaagcattgataagaggccttacacaaagtagacccaaatctgctgatctgcttggtattctcagaaccacagcgtggacattttttcggttttccgatgtgatgttcgtctgctcctttttcgggaggagtgattccgtacgcgcggagtttttctctcgcttcatctgttaaccagtctgttgtccagatcggaaacattttggttactacttttacttcccatccgttttctttcatcattttgataatatcctcttcgatggtaaacatagcaggacaggcagaataagtaggcgtaatgatcacttcgcaggtgttttcacctgtaacctttgcatctcttacaattcccaattctacaatattgattaccggaatttccggatctgggattgtttttaataaatctaaaagctgattcatattttattttttatcagaatcaagaattattttcattgctttctgataatctaaattatctgttatgccgttgtgatactgatcttttaatataatcaggctatcatcttttttaaaattattcttaagttttaaagatgccctgtaattaataatctcatctttatcgccatgaaaaataattatcggtgacttaactgtttttaaatatttaccggtctcaaaattatatttcagtaaaaatctcggaagaaatgagaatttctgactcatttcatcttctgtgctataatatggagcctgtagaataagcaattttgcataatgctctgacgccagttttgcagccagtcctgttcctacagaatatcctaaaataataatcctattctccggatatcgtttcaaaagttctttatacgcagcatcaacatccgaaaaaatctgatctttactgctaattttatcttcactttttccatagccccggtaatcaagtataaacgtatcatagttcatacttctgtataactgagctacttctccccagtcttttattgatcctccatttccatgaagataaaagatgacgccttttggatttcgagctttaaataaaacagcatttaagtgcttactatctcttgttctgatcgttacttcttcaaaatctccatcaaatttaaatttgtaattatccggcagcttttccggataaaaaataattttctcctgatagaaataaagtccaacacataatatcaaatataccgcaaggaaaaaagccaatattcccaggagcaatctcttcatgactttttaccaagtacatccaggatacgctctctgcatatactgaagctcacaaaggatatatccgaaatattctgtgtgatatcctgttctggattttggttgcatgaaaggattctccggatattctaaaccgaaatctgcaaaatctttctttgtaatcgcaaggaattctccataaagggcatctgtatccggagcaatattcaaagctaccaagtcttcctctccttctgttttcgcaaaaagaccttttgtatattcccagatattttcaacagcttttactaaacgggacttactttcttctgttccctgggcaaagattttcatccatgatgcggcgtgcgtataatgatatcttacttctttcaatgatttctgagcgatggcgctcaattcttcattagcagagtttgataatgcttcatacatcagtttctgatatactgcaaaaacataaactttgagaattgtttgggcataatcttcattgggaagttctgtccagtgggcgttcagatactcgtgctcatatcttaaaaacgcgatatcatcttcacttttaccgttatcaatcactcttgaagcataaacataaaagttattcgcctgccccagctcatccaacgcaatattggtcaatgcaatatcttcctctaagtaaggaccttcaccgcaccattcagacagacgctgtcccataatgaaactgtcatctgctagttttaataaataattatataatgggttcattattttagcttttggcttttggcatatagcttttagcaaattgcaagcagctaatagccattagcgtttttacatattttttacatcgttaggaatctcgtagaaagttggatgacggtatagtttatcgtctgccggatcaaagaaagcttctttatccactccttccgaagtcacaatatatttgcttggaacaacccaaacagaagttccttcttttcttcttgtataaacgtctcttgcgttctgcaaagccatttctgctgttggtgcctgcacaattccaacgtgtttgtgagataatcccggtttagtctgaataaacacttcccacatatctaaatttgccatagtcaaattaatttaacaatgtatcaatgtaccggtttaataatgagatgcttcgacaagctcagcatgacaatgatggttacatttctacattagtatattgttacattattatattacttctttttgttgtttctcagcaaaagctgctgcagcttcttttacccaagcattctctctctgagcttttctcttcgtctcgatacgcttcttgttacaaggtccgtttcctttcagaatttccatgaattcgtcccaaggaagttccccaaaatcgtaatgctgtctttcctcattccatttcagatctttatccggaatagttaatcctaaaaattcagcctggggaacggtaacgtcgataaatctctgacgaaggctgtcattactttctctttttactctatagttcatagaaattttagagttgggtgagctgtcatcattaggtccgaacatcatcagagccggccaccagaaacggtttaatgaagcctgagccatttctttctgctgttttgtaccacggcaaagtgccatcaggatctcgtatccctgtctttggtggaaagattcttctttacagatcttcaccatcgctcttgaatacgggccataagaatttcccatcagcattacctggttcataatggcagctccatctaccagccaaccgatggcgccgatatcggcccaacttaaggtaggataattgaagatacttgagtactttgcttttccttccaacatatcatcataagtagcatctctgtctgctctgatgcttccgtctcctagagtttcagtagcagagtaaaggtataaaccatgacctgcctcatcctgaactttcgctaaaagcgccatttttcttctcaatgaaggggctctggaaatccagttggcttccggcagcattcccacaatttcagaatgggcgtgctgtgaaatctgacgaaccaataatttcctgtaatcatcaggcattacatcttttggttctactttattttcttcgtgaacgtattgaacaaatttttctaagtccataattttttaatttgaaaatttgagaattagttaatttgaaaattattttgagaaactgagaataagttattaatcattttcaaatttccaaattagcacattttcaaattgaattaaacatcataattaagcatcaccacattcgttgtcgggtgacattggcaggtaagaacatagcctctggctacttcttcttcggtaagcgcatagtttttctccatgaaaacttctccttccagaacttgtgctttacacgtacaacaaacacctcctttacatgcaaaaggcacaggaagattgtctttcaatgctttatctaagatactctcttttttggaattaaggtggaatgaatattcatcatcatcaatgattaccgttaccatactttcaatattggcaatggctttgaattcatcgctcatttcctccgtattttcttcatccggagcggtgaaatattcaaacaatacctggatagcaggaacctttttatcttttttcagataatctgcaattcctttgatcatttctgaaggtccgcagatgaaataagttgcttctcttacatcaatatctgcgtatctttcaaataactgctccagtttttcagcagaaattcttccttcgaatacaggatcttcgtgcttttcacgacttaccagataaactactttaagccttccgttgaactgttctaccagcttatcaatttcagcttttcttaaaacatgattcatacttctgttgctataaaacagatatgcattactgttaggttcctggtaaagactttctttaatattggataaaacaggagtgattccgcttcctgctgccaatccgacataggtcttcacatttgtcggatgataagatgtattgaaaccacccattggaggcattacttccaatacttcatccatatgaagatgctcattgaaatagcctgatacttttccgccttcaagcaacttcaccaatacttccagtgtattgcttttttcactgggcgcattacagatagagtaagaacgtctttcctcattcccgttgatcatcatccggaaattcagatactgtccctgtttgaacctgaacttatctttcagctcttcaggaatttccaccgctacatttactgcatcgggagtgtctttctgaaccttaactgttttaagtttataaaatgaattcattatttttttagtattctgttaatttttccaccttcgcactttggcaggctgtcctgggcatgaactttcacttttgtagtgatgcctacccgtttttttatttcgttttctatgttttttccaaagttcccgacaaaattaaaataatcatcggtattggcttctattttctgagattttaccaggtcatcatctatttcaacatcaatatccaaagcgatacacatgtgctctttctccacaggagttaaatagtagttaggaactactccttttacatatgaaaaggcatcttcaatctggcttggataaacattaactcctcttacgatcagcatatcatctgctcttcctacgattggcttcattttcaccattgttcttttcgcattttcatcgtagtaaaggcttgtaatgtcattcgtccagtaacgcaaaagcggcattgcttttttagttaaagtagtaattaccaaaaccccttcttctccgaaaggaacaggctgctttgtgatcggatctaaaatttcaggatagaaatgatcttcccagatataagctccgcctttttcctcaaaatcctccatggaaactccaggtccgataatttcgctcaatccgtagatattggttgcatgaactcctaatctttcttcgatgtgccctctgataatttcggtccacggctctgaacctaatacagcatatttaagactgatttcatctgccgaaattcctctttttgcaaattcatccgcaatcgttaaagcatatgatggtgagcagcagattacttctggcttaaaatccataatcagatccacctgtcttgccgtcattcccccggaaataggaagaacgctcattcccagcatttctgcaccataatgaagtcctaatccaccggtaaaaatcccgtaaccgtaagcattatgtaactgcattcccggtttggcaccagcagcattcaatgatcttgccactacttcactgaaaagatcaacatcttctttagtatatcctaccacagtcggttttcctgtcgttccgcttgagcaatgaatacgctgaagctcgcttttaggaacggtaaataatccgaatggatagttatctcttaaatcctgtttgtaagtaatgggaagtttcgtgatatcctcaatcgaccttatatcctgttgagatatttgcagttcatcaaatctctttttataaaattccgacttctcccccaaatagctgatcaggctgatcaaccggtcggattgaagctgtctcaactgatccagcttcagatattcaactgaaaaatccataaaactaactaacatttgttaggtgtaaatttaaaaagattttggaagctggcaaaatttttatgacttttgtcatattttgaatgattctaaataacaaaataaaagctcaatgcttttcttgtaaaaaaatataatgtaaaatgtattaataattcttcttgtcaaagacctatgaatgttggtttcccaacaggccgaaaagaatcttttcccttatttcatctgtgatttcatccgtggaatcactgcttcttttgaaccagaaataggagttatttaaagtatgaaggataaatcttgtggtaaacgacggagatttcagttcccagttttcagctttataaatttcagaaattagtttttcaacctcctgttgataattttttctcaattcaacaaattcgggaagcctttcttcaagatgcttccattcattggaataaatatgggtaacgtcacggtttttaagaactacggaaaggtgcttgtccagcaataaattcaatttttcccttggagttacatcagtattttttacttcctgaagctcatcaaaaaaatcctgggcaataccaaaacaaatccattccaaaatttcttcctttgaacggatatgtgcatacaatgaagctgctttaatattgagtttagtagccagatcccttaccgagcttcccatatagcctttttctttgaaaagctctactgctacatctagtatttttctctgtttttcttttagttccatctggtaaaatgcaaaagtaattattctgaattaaactgctcgttttttgatcataaaagattaatccatctgaatcaattcaatccgtgcatttaccttctgttgttagctgctgtaattataatatgactatttgttcatagattttaaataaataattacgaaatcggaaattttgtcaagttaaatttccgttaaaaatgcaaaatccggaaattttgtctatattttttgtaaatttaataattgaacagtttttgcgatacagtcatcgattaaatgattaaataattgattggcattaagaaactgagcctcagaatttggtttcttgatgttttttaaaaactaaactttgaacgaatcattaccaaaaatatataaaatatgaacttaaaccaatatactgtaaaatcacaggaagccatccaggcagcacaacaggttgcgatggaatttggcaaccaaagcattgaaccccaacatctccttgaaggaatttttcaggtagatgaaaatatttcgcctttcttattaaaaaagtctgaagcagatgcagcattagtaagagagcgcaaccgtgaaaacttagaaaagcttcctaaagtacagggaggaaatatttatctttcacaatctgccaacaaagtattgctggacgcccccaatattgccaagaaaatgggtgatgaatatgtaacgattgagcatttatggctatcacttctggaaaccaactcagaagtatccaaaatgctgaaagatatgggcgtaaccaaaaatctcctggaaggtgctatcaaagaattaagaaaaggaagcaaagcgacttctgcaagttcagaagaaacgtatcaatccttaaacaaatatgctaagaactttaacgaattagcagcagaaggcaagctggatcctgttattgggcgtgatgaagagatcagaagagttctgcagatcctttccagaagaaccaaaaataacccgattcttatcggggaacccggagtaggtaaaacagcgattgctgagggaatcgctcatagaattatcagcggtgacgttccagaaaacctgatggataaaacattatattcattggatatgggagctttgatcgccggagcaaaatataaaggtgaatttgaagagcgtctgaaatcggttgtcaacgaggtcatcaaatcggatggtcagattattcttttcattgacgagattcacacattggtcggtgccggaggtggcgaaggagccatggatgcagccaacatcttaaaacctgctctggcaagaggagaattaagagccattggagcaacaaccttgaacgaatatcaaaagtattttgaaaaggacaaagcgttggaaagacgtttccagaaagtgatggtggaagaacctgatactgaatctgcaatttctatccttcgtggtattaaagataaatatgaggctcaccacaaagtaagaatcaaagatgaagcaattattgccgctgtggaaatgtctcaaagatatatttcagaccgttttttaccggataaagccatcgacctaattgatgaggcttcggctaaactgagaatggaaatcaattcaaagcctgaagaactggacgtactggacagaaaactgatgcagatggaaattgagctggctgctatttcaagagaaggcaaccaaaccaaaattgatcaccttaaagaagatattgccaaaatatccgagcagagaaatgagatcaatgccaaatggctgaaagaaaaacagaaaagtgaagatcttacccagatcaaaaaagatattgagtctctgaaattggaagcagaaagagcttccagagctggagattatgccaaagtagcggagatccagtacggaaaactccgtgaaaaggaagaagagctcagcaaagtggagcttgaaatgcagaatcatcagaatgaactgatcaaagaggaggttactgcagaaaatatttctgaagtcattgctaaatggacaggtattcctgtaaccaaattacttcagtctgaaagagataaattattaaatctggaaactgaactgcaccatagagttgttggacaggatgaagcaatccaggcagttgcagatgcgatcagaagaaacagagccggattgagtgatgataaaaaacctatcggatctttcctattccttgggacaaccggagtgggtaaaaccgagcttgcgaaagcactggcagaatttctattcgacgatgaaaacaatatgacaagaattgatatgagtgaatatcaggaacgtcacagtgtttcaagattggtaggagcgcctccgggatatgtaggatatgatgaaggcggacaattgactgaagcggtaagaagaagaccttactccgtggtactgctggatgagattgaaaaagcacacccggatgttttcaacactttgcttcaggttctggatgatggacgtcttactgataataaagggcgtgtggttaatttcaaaaattcaatcattattatgacctcgaatttaggttcacacctgattcaggaaaattttgaaaatcttacggaggaaaaccaggatgagattgtggataaaaccaaagaagaagttttcgatcttcttaaacaaacccttcgtccggaattcctgaacagaattgatgaaattgtactgttccagccattaagaaaaaaagaaatcggaaaaatcgttcagtaccagttgagaggtttcaatgaaatgttatctaaaagaaacatcattatgactttcactcaggacgcagtggattatctgatggataaaggttatgatcctgccttcggagcaagaccattgaaaagagtgatccagcaggaagtattgaataaattatcaaaagagattcttgcaggaaatgtgaatgatggagacagaatcactttagattattttgaagaaacaggactggttttcagacctactgaacaataaaatagttttttttcatatacattatttttgtgaataagtgctgtagattactctgcagcacttattttttatattgtcattcatgcaaaatttctataagcttttgctaatatatacaatccgtaaaatcccggtaaaaataacagtataattccctgttcaccaatacttattctaccatattttttccgagatttgcatattaattgagttttatccgtaaaccactaagttatgaatacagaatcaaacaacccactacaacctggaataatgtcaaatagtctcatccagactctgatcgacaattaccgtcaaaaccatctagcagctattaatactgctttaggaatgcaagatgctcattctatctggtttgaccttccaaaattaaaaaatttcattgcaaagattgaagaagaagtagccaaagtgaacccagctgcatctgcagaagatttaggaatcagattttattattctgcctatccgaagcaagaaaactggtctatcatgcaatcacatcctgtcccaacagaatatgctgaaaaacatacattagtactaatcccaacattgaaaagagccaatgaaacaggagagcttattgattatgatttcaatccttttcaaaataccgaaggaaaatctttagctttaaatgcacgcaatggaaaaggattgggagatgatgatgacgacactggtcttggagaaaatttgggaacattgatcccacctggaaattctatttcggaaacttactaatcttcattttaaagcattcatattaataaaccaatgactgaattccaaaagttttttttacaaatcatgtacaccggtgaaggaattgcagccttaacatccatcatttattttaaccgtgtaaaaaaacaatattggaaatatttcgcattatatcttatcactatttttctatgcgaatctgctgtaaaatggggtgagaaacctcttcacattaatagagtactgttttacaattactttgtaatgcccttacaatttatcttcttttattggttgtatgcaaaaaaatcattaaaaaaaacaaaactgttttatacattttctgccacacatcttctatcatatatccccagccttttattctttccggataataagattgttttttcttttaattatactttcggctgtttatttttaatgattcttgttatcatggaatattataagcaggtaaattcatcggagattttaaaattcagcaccaataagatgttttatattaatttaggtgtcacacttttttatataggaactcttcctttcatgactttcatgtctctcctatggcagtatagaaatatttgggatttatattttgcttattttcaggtttcaggagcagtgatgtatattttatttgcaagttcattcatatggggaaaacagagctcttaataactattatttcattcaacatcttttttttgatgtttgtaatcgccgtaattatttatatacggaattacagacagcgcaaaaaagaatacctgaatgagatcgagatgaaaaatgaacttcatcagagagagcttctggctacccaattggaaatccagcaggccaccatgcagcagatcggaagagaattgcatgataatatcggccagaaacttaccctggtaagtctctatgttcagcaaatgctttatgaaaacaaagtcccggaggcaagtgaaagaatagatcaggtttcacaaatcattaatcaatctttacaggaccttcggagcttgtcaaaaacattaacggatgacaatatcaaccaaaaggaaattgtaactttgatacaggaggaagtagacaataccaattcttttaaaaagtgtaaagtaagttttgagcataattttaaacagctggatttgggttttgttcataaaaatatgctgctaagaattacgcaggagtttattcagaacagcataaaacattcccgctgtaaaaatatttttataactctgaatactactgaagacatactttgggaacttgatatccgcgatgacggaatcgggtttgatacatcacagatcaaatccaacggaataggtcttaccaatatgaaaaacagagctgaaatcataggagccagctttcatatggaaagtaaagaaaatgagggaacccaacttaatattatcttaaaaaaacagtcatgaaaaaaagcatcgtaatcgttgacgaccatatactcattgctaaagccctggagggcattattggtaattttaatgaatttgaagtcatttatgtctgtgagaatggcaaagatcttattcaaaaatttgaagaaggaaacgctattccggatattattcttctggatatcagcatgcctattatggatggttttgaaacggcagtatggcttacaaaaaatcatcctggtattaaaatcatggctctgagcatgcagggagatgacaacagcgtgattaagatgatcaaaagcggagcaaaaggatatcttttgaaaaacacgcatccgagagatctggagactgctcttacgcgactgaacagtgacggcttcttttacccggactgggcttccaaaattatattcactaaccttaataaagaaactgaatctgaaattgttgtgaaaatttccgacagggaaaaagaattcctgaaatatactgtgactgaactcagctataaggaaattgcagacagaatgtgctgcagcccaagaacagtggaaagctaccgcgaccagctgtgtgaaaaactcgatctgaaaacccgtgtaggccttgcagtttttgctatcaaaaacggttttgccaattaagactcaacgcgaaaattttattttaaaaattaaattcaaacgaaaagtattcatgcaaaatcattaaaaaaagtaaaaatgcataaatataatttgaaattaattaaaattcaaaacatactcaataacattaaatttaattcaaataaaaagacagatacttgataatatcttaaatattttcaaaaaaaatttgcatatcaatttcaaataatataatttcacatcctcaacctaaacgatttttgatatgaaaaaactattatttggagcttttatgctcactgtaatggctgcgtgtaacactgacagcatcaccaatcaaaacgaaaatccgactgacgaatcagttaccactccgggattagttcaaagaggctgtgcttctgaggaaatcagacaggaggcattaaaaaaaagccctgaacttcagcaaagatttgctgctctggagaccaacacagaaaaatttgccaacgatcttaaagtaggaaaagttcttgcggacggcagtgtggaaattcctgtgattgtaaacgttttatacagaaccactgcagaaaatgtttctgatgcaagaattgctgagcaaattgccgtattgaatgctgactattcaggcaccaacagtgatgtcagcaaaattcctactgaattccaatccgtaagctccggtgatacaaaagtaaaattcagactggtaaatacggttagaaaatctactacaaaaacgagctgggctactaatgatgatatgaaaaaagcctcaaaaggaggtattgatgctactaatccaactaattatttaaacatctgggtagttggtaaaatgaccagccagggacaaactattcttggatatgcaactttcccggagtctgcaggattatggaacgacggtgtagttattggtgctccgtattttggaaaaactggagcttcttcacctttcaatcttggaagaacagctacacatgaagttggccactacttaaacttaagacacatctggggagatgccaattgcggaaatgacctggtaagcgatacgcctacacaaactactgctaattacggaaaaccttcttatccgctatacaatacatgcagcggtgtacaaagatctgtaatgttcatgaactatatggactatgtagatgatgcagctatgtttatgttctctgcaggacagaaaacaagaatgcagtctgtagtagcttcttctggtgcaagatccggattaagagtttattagaatatatttttaaattatattaaatctatcccaaaccaatggggtagatttttttttaccctttagcctggcaaaatgtttacgaactctatgaaggcaactttataggcagtatcagcatttgaacaaaagccgggataagataataatctgcacagctggaatattataaaaatattaaaatagtctgtctcaattttttggatagatttttttaatatttttacccgattttaatttcagcaccactaccgatgaaaaaaacagcattagcatccggaatactattgcaattatactgtattaaagcacaggatactatccaatccagaaacctcaatgaagatctggcactcatcaattcagggtatacaattcaggagaagacaccgtttttcaaaaaagaatgggttaaaaaatcagtggctcctgcaattctttttactgccgctgcagcaacatggggagagaaagagaatatccgtgaggtaagaaaccgttatcttcccaacttcaaagtcaaatatgatgattatcttcagtatgctcctgctgtcgctgtttacggattaaaactctcaggtgtaaagggccggaacaatattgggcgggcaaccttatcctatggtacaagtttagccatcatggctattttagttaactctatcaaatatacagcaaaagttgaacgacctgacggatccaaaaataattctttcccatcaggacatgccgctatggcttttaccaatgcaagttttcttcacaaagaatacggaatggtaaacccggcatacagtattgcaggatatggttctgctactttaacaggccttggacgaaatttaaataacagacactgggttccggatattcttgccggtgccggtatcggaattatatctacagaactcgggtatttctttattgataagatttataagaacaaaggggataatttgagcctcttatccagaatacagggaaatgactatccttcttttcttgctctgaagatgggtacagcattaggtacaaccaacttcctgaaagaatcagagcttgatgacaaaaaacaaaccgggtttgagggcggactggaaggtgcttattttttctctaaaaaatggggtgtcggcgcagatatagctttcagcagcttcccaattaaatctcaaagaataacatttgatgatgggcaggattttggtgatcatgaaatcaaaacacaatctatgggattccttgctgcaggcattggtccctatttttctcatgaattatcagataaatggcagcttactttaaaattaaccggaggatatgccgcaactgcaagtggaaaagtatttgtaaaaggaaacgaaatagacactcctaatcacgaactgcagatagccagatataaacctaaacccgccttccgatggaatacaggagcttccatgacttataaatttaatccaggattaggtcttaccttttatacagattataatcagatcaactctactattcgttattacttcagtgatgagattaaagaaagcgctgaactggaccaggaacttaataacctgattgcaaaagaaaaagttaattatatcacattaggtttaagattaacagcctatttttaaaatacaaaagccttcaaaatctgaaggcttttatattataaatttttgcggttattttccggagtataatccataaacaggtcaccatccagctgcaccgattttactttcttcttaattggaatcacaagatcagccatcttctgatctttttcccagacagacggtgaaaaatgtaacttttctgtacttccgtcttcataagacagtattacatcaaaaggaatggcaaagcctcctacattggcaacatttacagtaagcatatcattcatctgggatgcccctgataccttcaagtcaatataattgttggtataaaaccagttctggaagaaccagttcagatttttacctgaacctgtattcatggaattgaaataatcccatggaaccggatgcttcccgttccagttgttcatataatgatgtaatgcttttttgaacagctcgtctcccagataatctttcagagccagataagacaaggatgcttttacataggaattatttccgtacccggcaccactcacctgcgtactcattgtaattacaggctgatcctgttcggcagatggatcattaatccattttttaacgcggaagtttttataaaattctttagctgcagcttctccgttttcatcaattcctataagatattccagtgtagtagcccagccttcatccataaaagcatatcttgtttcgttgattcccatgtaaaaagggaaataagtatgggcaatttcatgatcagctgtcaatctcgcatcctgaagatcatcgggaatacttgtatcattaatcatcatcggatattccatatctgcatacccctgaatagctgtcattacattgtaaggatattctacgccaggccagttcttggagaaccaatccagattataacgcatccagtctacatagtgttcaaaatctttcgctccggacttatatcctgcctgaacgcttgctctttttgtttttaactgaacacttgcagcgtcccaaacataatgattactcagtgcaaaacagaaatctgtgatatggttagccttaaatttccatacattccatttattaggtttggtcacttttccggacctcatttcctgttctgtagcaacgtgtaccagcttatcgctttttaacgaagctttataccgttttaaatattccggctgaagaacagcttccggattaaggaaatcaccggttgcccagaccacataattctttggagctgtaatactgaaactgtaatcattaaaatcattataaaactcctgtctgtctgagtgctgaatcatatcccatccgttataatcatcatacacggaaattcttggaaaagaataggctacatagaatgtttcaggatcaatctgaccttctctttcactctttacggacaacggatactcccattctattttaacctcagctttggattttgactttaaaactgttttcagttttactttttcaaccgtactccagtcatcactgttgatgtcatattttgcaccatttacgataaaagatttaatcttaagccctgaagacaggaaatctttggatacaaaccctgatcttggcgactgtggtttatgaaggttatttacaaagcgtatggccagctcattcagactatcaggactgttgttgatatatacaatcgtttcttttccggaaactatttttgtactggcatctacttttacctctacattatacactcctttgttctgccagtaatttttacccggtgctccggagatatcacgggttcctctttcgtatgcttttttgatattcctcggcatatacaattcctgtgctgatagttgcagcaaagaaactgctaccagcatcatggaaaaaattttcttcataacgatctttttaaagattgacctcaaaaatagcgaaaatctgacatcggtagatcatttgttatataataatattttattgtaacgattcttatattaaattcgcttacaatctttcctgttctgcagttttctttattgtttttgcatttttcacagactgatttccaaaattgaatttcaaagaaaatgtaaaactctgagtatcccggtaatctaaaaaataattatcctgattggcatactttgtacttattttttcctgtgaagttttaaaaatatcattaaacaaaaagcttgcttccaattttttgttaaagaattttttattgaccaccagatacgttgcagaagattctgagatcctgaaagttccctgtatccccggagaataataacggtgtccgatttccgttttccaatcgctgtttttatcgagtgtaaaactcgttgagatattggatgctaagttccagactttgtttttatagattactccatcgattcccttgaaataattctcattatgctcaagattttcagacacaataatattccaccatggcttgacctgaaagtttttgtaaaggcttaatccaaaagcttctcctttctcaatattggtaaaataatagataaggctgttggtacttggctcctgataggagatttccatggatggatagatttctttccggtaatataaatccacattccactctttccatgaataggtaagattcagattgtgcgtgatggtagcctttaactttggatcgccctgatagtaggaaaacaggttataataagatttcgcaggattcagccatgaataggaaggtctgctgattcttttcccataagaaaatccgaattcctgcttattttctgtggtatactgtacataaaaagtaggaaagaacttccagtaattgtttttattcagctcatagggctcagagaccaccccttcaagatctgtcatttccgcacggagacctcctttgaaattccatttcccgatattgtaagctaatgaagaatatagggcaaaattgtgttctttataatcaaaaacactgcttttttccggcctgtattgtaatgctccgttctcattatctgagaaatcaagcttactgtttgtctttacaaaactatatttcaccccggattccaactccagtttatctcctttccactgataatcgaattgagtggaatacagctggacatctgctttattctttgtaataaaattatcttcttttggaacctgtcctgcgaagttgagatagattatcacattctgatatttatcggcattatttccggtaaagtaactgatccaggaaaggcggcttttcttattcaacttacggtctatctgaaaacttacggcgttattgatggaacgtgaacggtgatcattgatcgttgtataattggattctacgatatcctgctgattatagattaacgtaggcacattgtagaccccgaaggattttggagaaaaataccctgagtagttgaggctaatattggtcaggctgtccaattcatattccgcattaaaattcagggtattctggttattgtttttatccttcctgttcattgtactgatccatcgggtttgactttccgggtagttcacataatctgttccttcccggtagtatgtccccaatcctctataatagcttcccataagagaaagtttattctttttataatattgggaaatcccaaagacacctttcgcatattgtgtctgtatatatttggaggagagaattccgcggtagccttcaatcttatttttcttcaggacgatattcagtacagcacttcctgacgcttcatattttgcaggcggattggtaatcacttcaatcgacttcacctcatccccttgtgtattttccagaagatttttgagctcatcccccgtcagcattacttttttgtcattaattgtcaccagaattccggtacttccctttacactcaatacactgttgtttattgtaacacttggagtattttttagaatttcccaggcattaagtgatgaaatattactgttttccacattaaattccagccggtcaacttttcttttcaccagaggtttacgcttggtcattaccactccttctatttcgtgagattcttttttaagaatgatatccagaggttcaggttcttttaaatccaattttttctcaaataaagaatatccctggtttttaattaccagctttatatcctgatctgtaatatcttccagcacaaacttcccattcccgtctgtttttaattctttgattaatttattccgaacatcatacacttccagctttattgatgacagcttttcattttcagtgttcataactgttccttcaagtttttgtttctgggcaagaatcaaaaccggcaaacacagaaaaaaaagaattttatacatggctattttttttattctaacaaaacactgttctgttttatgcctacaaaattctatattgaaagggagaatttcggttaacgatgggttaatgataggttaatgtcttttctttacaataacaaaacctgaattcgtaaattcaggttttaaaatcaacagagtatattttttatggataaggaatggctttatccagttctatcggattataatatttttttatgtctatctgcgtttgtttagtcaaacctgcaaattcttctttgcttttgatttgctgtccattaatgcggacattccagtccggctgaaattcagttctcattctggcataaggatcattataaaactccagattctgtttcacccatttcttaaaatcaatggcaataggagacaatgaataatgcttttcgagaaaacctgttgtatcatatattttggagaggttaatatttctggagaaagagtatatgaagtctttcttatcatcctctacatacatcaccaatcccggcaatcctctgaatttataaggaccttcaggaatattgatgtccggagtaaaccaggcagtccagtttcttcctccaaatactgcagttgctttttgcaaattataattattgatcttttgggtatcagcctctattttccacggaacattatcttccgtttcaaaaacataataatagggcatcatcataatctggacaaaatttttatttttattgcccccttttttccggataatagtctgtccggactggctggtatgctgagaagacatctccccatgaagaatattcagagaatcgtttaccaaaaatgcaaattcataaaatttcacttcctccggattgacatccagtaccatttcttctttctcataatttgtacctttaggatcaggcctgtattgaagttcgtatataaagcgatgggtctgggctttgatccccatcccaaatagcagaacaagaagaatgaatacctttttcattacatcgttttaattttctaaaattaccaaaaaacacactaatcatcaggttaataaaaggttaatgataaaaatactatttcagtaaaatgttaaagttttatctttgtttttaatgatagccaagagtaaaattctgatcccggtttttgccgctctgttcctgcttttactgggaatacaggtttactttatgtataaaacctatcaggttaaagagagagaaatctacagaacagtacagtctcctctcagagattatactgatgaactggaagataacggcggtgcaaaaaaagctgataatgattctttacaatcttttttcatccattataacaataaaaaaatcagtaaaaaagatttcctcaagttttttgaagaaaacaggaagcagacgatggaagcattcagtaatcatgttgacagtatgtttagaaaagaaggatatagaattgcagtaaaaatagaatacctgtctatttctttcatgcctgacaatatcaatctcctggacaggcccattgtactatacgaaacgaaaaacaaaataataaacccggaaattttaagcaggggaaaatgggaaacaagttctacttcaaaaatcaatcataagtccgggaaagatgatgtttttctggtaaaaagcagaaccagtctggaaatattaaatattaaaagtattgttttcaaagaactggcatttctttttctgtcttgtattgcgattttatcctgcgttctgatgctgtatatttttactattaaaaatctggctgcccagcaaaagcaggtagaagttctccacaacattgtagataacatttcccacgagtttaaaactccgattgccactttaaaaatagcttctaaagcattaaaaaaagaatggaatcaggaaacacttcctcttattgacaggcagatttcccggctggaaagccttatgttccagcttcacaaggatgaaatacctgatgagatagttgaaatccatcctaaagactgggattttttcattcaggatcttgcgcttacttatcctgatattgattttaaacctgaaaacaaaatttcacaaaaacttccttttgataaaaacctgatggaaacggtgattaaaaacctttgtgaaaacagtgtaaaatatggggcttctgttgttaaaataaatatctgtaacagttcccaacaattggaaattgaagtttctgacaatggtcagggcatggaaacaaaagaacttaataatattttcgaaaaattttacagaatacagaataacaatattcataacagcaaagggcttggcttagggctttatttcgtaaaaaaaatcattgcttattacggtggaaagattgatgtttccagccagcttcatacaggcagtacttttaaaatatcaattccttatgaaaactaaaatccttctggcagaagatgatccggatttcggaatgatcctgaagcagtatcttgaactggaagattttgaagtcatttggtttcagaatccggaagatgtcattccattacttcatactgattttccttttcatataggaattctggatgtaatgatgccgaatatagatggtttctcactggcaaaaatgattttgaataaaaaaaatgatttcccattgttgtttttaacagccaaaaaccaaaaaatagaccgtctgactgggttgaaaataggcgctgatgattatattgccaaaccctgcgatcctgaagagctcgttttacggatcagaaatattctgaagagaagtcttcctggtgttgcagaaacccaaataaaaataggggaattctcactggatactaccaaacttctgttgtcacatcctaacggaaacaaccgcctgaccatacgggaacaggaattattgctgtatcttctgaagcataaccgatctattattacaagggataatatactggacaatctttgggaaaccaatgattattttaccggcaggagtcttgatgtgttcatcagcaggctgcgtaagtacttcaacagtgatccccaaataaaaatccaatcccttagaggaattggatttgaagttgattttccaatcaagtgattttttatagcgacagatgtacaatcaccgggaaatggtctgacgggtataaaagattttctcttctgtcattgatatgccggtgagatcttattttaaagccttgcgtaaagatataatcgattctgtctttcgggactgtattaacatcaaaagctgtaaaagttcctacagggccataatgcttggtttcagaatggtaaaaagtatctttcatattccgggaaagaattttaatcggttctgaatcatctgtcaggttaaaatctccgcttagcgttaccggaaggttctttggattgagttctttgatctttttcaggatcaattcggaagatttcactcttgccacatttccaatatgatcgaaatgaagattcattgcgagaaattccttttttgattttttatctttaaatacagcataggtacagattctgttcaatgcagcatcccagccttttgaaggtttttccggagtttcagataaccagaaggtgcctgattttacgacatcaagtctgttggtgtcataaaagatagctgaaaactcccctttttctttaccgtcgtctcttcctactcctatataatcataattctttaatcctgttttaatatctttcatctgctcaggaagagcttcctgtacgccgaaataatcgggatggtaataggtaagtaaatctgcaacgtcctgcttcctcttcggccaggcattgtctttatctgactctacattcagcctgatgttaaaactcattacggtaaggtcctgtgaaaatcccaatgcaaaaagcatcaggaataccattgaaaatctgaaattcatatgttatgttatcaataagaaaacaaaaataaaacttctctttgacagagaagcctgatttatatgattatattgttaaattatctttttcttcttctacagatataaaatatgcctgaaattcagtttcagaaaccggcaatgcactttcgagtttcacaacgccaatggttttataatgggccgcaagtttgatctctttacttttaagaaggatttcaagctcgttaaaattgatatttttttttaaaactgccagataagttttcataagtatacctgtattaaaccatttcctatatctctgtattttatgccttcaacgggccttgctttatgttcaataagctcccagatttctctggctgatttatcaggaaactgctccatatataaggctgcaagtcctgaaacatgtggtgcagccatacttgtgccgctcatggtataataaaatttttttttgttctttgcatttttaggataggcgcttacaatatccactccgggagcacagacattgatacttccaccggtagatgggttaagccctgcatttgaaaattttgcgatcttcatctggctgtcaatagctcctacagccataatcgattttgaattggcaggcattgaaacgggttgtggaatctgcggtctgttgctgtcatttcctgcagccgctataataagacagttattttccaatgctctttccccaatggtttcaaaaagaacagaaggctggtcgtcaagctttaccggacatgccagcgataatgacagtattctgaacttcttcgtaatcgcccagtctattgcatcaatcacactgctggtagtacctcttccgttatcagccaatacttttgctattttcaggttggaatccttagcaactccataacgttttccggtatcacttcttacgtttccggtggcaattcctgcacagtgtgtaccatgtccattgggatcccttttccagtcttcaccatctatgaaggatttaccttcaatttcttcagatgaaaaatcaggatgggaggtttcgagacctgtatcaagaatacagatatcaattccttttcctgtgtaatgagtattttcgagaccaattgcctgtaatccccattccatctcaatgaatgagttttgaggtaaaggcttgctggtcatatatttttcaagctctgaaattttttctgcgagccctgcagactgttttttaagttcgttgatcagctgcagttcatctgccggaaaaaactcacgttctttttcatagtaaactatagaattggattcatctttaacagcgcttttcaattgttcttcatccatatgatccaccacaagaactccaagatttttataaagcacactgttatcctgatcgatgacttcataggaacggttttctttggaaagaaattctgaagaagtaatactcacttccagttctctctctatttttttaagcgatgtcttctgctgatctttaagcaagacaatatatcttccggtttccataaggttcttttttaaattaacttcagaaatactttttccagaataagaaaaatatcctcaggaataatggtcagcctgagcttcttattaattccggatatggctgtattctgctcagacagagaagtccagaaacgttcaattttgggaacagaattcatttcttttaatttttcatcatcaagaatcccgttctgatacagggatacaatgattcccgaaataagttcttccgcctcctcaagctttttattttccctggtatatatctctatcagaattccataaatactttccattccgttgaatgaaaatcctccaagaatttcacgtcttccagttagtattttctccatttttataggattaaaacctcttttaacggttgcaatcatattcataattttcagcacttcagattcatggcttgtgtttccttttgtacggaaatactccagcacttcgttgagaaatacatcaaaacgggcatcaaaatcaaatgatttcgacagataaagcgtctgaacttcattgaaatgctccagcagttctttgattttctgtaccgtaaagtgaataagttcctgcattactcaaaagttatctgttctatttcattaccgtctttatctttataggagacaatcctgattccttcttcttccatttccacatggagattgataaacagtttatctttatcttccgcagcgcttgtattgggatctatgtaaatattgttcagctttgcgttcaccaatgtatatttattcagcaacacttttgaaaaaatttctttcagctcatcagtttcttctgctgttccttcctgaggcctgaagattccggaattaagaagctggatttttttcctgagatccagcttaagaacttctgcagaagggagcttaccgaatttctgatcatttttttccagtgtgttgaacagcgttttgaattcctcggtctggagctgtcttttactgatttcaggaatattcaggtttttctctttgtttgcgagacggattctctcatttatttcggtaacgaactgatcctggttcagcttaaaattatatttggaatctgaatcgatatccgttattttgatgggaatatccatctttacactgggcagtgcatatctcgggaccttaaaatacttaagatattcatgacgggcatattctttggcaataagaacagcattctcgtcagcttttttacgagcctgaattatctcattgttgagataatccaggtaatctgataattttatcatttttcgtaaaatgttttattgtgaaagaagtccaagtactttttcaagtcctgcaggcatttcatcattggttgcgcgtacttttaccccaagagaatattctttttccactttgattcctgtgctggaagttcttttgtaggagacatccactttgaatttcacaggaccccagccaccggatactcctgcattgataccgaactcgtcacttatatctttggtgtatgtcgaattaagtttcacattaaagtctacttcacaggtttcaattctgaagctcggaacattcagcaatgcaataaacggcactgaaatttccacatcattaggaatcgttttagggttggtatcacttactggctcatcttctttaaaatccggattgggaatattttttttgtatttgaactctgccattctcagttttttagcactggctgcattggcaggatctgtaagctcaaaaccgacttcattgatgaaattaacggtagctatagaagcgttggactgcgcttttacacaggcatccaaaggtccgccaataatggtagcgaagtcaatacttcccagttctgcagcaaaatctgcgctggcagcatctgaagttctgaagatctcgtcatcggcagccattttaccggcaataagcttcataatttctgaagaggcaccggaaaaagatttttcccacttttcatcataattctttttgaattcgtctacaatcgctaacaattccttattggttaatgaactcaattctgaagtttcaattcctgacactttttcatagaccgcaggggtcagtactttttctactcctgacaagagatcaattaactcattttttgtttttttagcgtggcttgcttcaagcactgattttaatgtttccatgttttttgtttttgattaatattgtgggacaaaattatatcactgatagacaaaacatttcaggagaacacctctacttgttcaggaaaaacaccctaaaaaataaaagcctgaacttacgatggtaagttcaggcttttgtgatgcattttgcagatatttattttatagacgcaaagattatattaactattattattaagtaagctaagaaagcaacaagttgctgatgaagctgcatgaatatgctcatgcttagaaaaaatcaattccattgattccatctttgcccccttaaaaatcaaacagcggataccagatctttgcgttaaatttaaaggtaattatatacaattttacattaatctgctatcttacttattattatgacactaccattctgaatgtaacgcagtgaaatgaagaatccaggttttacatgagattcttccttcgtcagaatgacaatggcgtaaaattgtatatagtcgccaatttaaatagattcaaacgtttctatgccggctttttactgttgttttccagattgacatcaggaactacggaatccggatcaagctttacctcatctatttcctttttagaatccactttgaatgtccattccgtatttcttttccaaacttcaacaggaattttcacgatctgagctgttccgtctttgaatctgatctgtactgttgtaggcattggcagctggccaatattttcaaccgtaatctgaactccatttttaaagtctccgttaacatattgtacatttttaaccgactgatcaattttccatttgttaaagaaccatcctctccagaaccagttcaattcctctccggaaacattttccatcgtgtggaagaaatcccatggtgttggatgtttaaaagcccagcggtctatataggttctaaatgctttgtcaaacttttcaggtcccagaatggcttctcttaaaacctctaatcctgttcccggtttaaaatatgccaaggctccgatgcttctttctttcatattatccggtcctaccattacaggttccagattgtcattcagaaggtaaactcctgatcttgccagatttggtttacgataatattctcctttattgaaggcttcggtggaaagtccgttgataaaagtgttaaacccttcatccatccatgcaaacaatctttcattagatcctacgatcatagggaaccagttgtgtccgaactcatgatccgtaaccccccaaagatcttcccctttggaatccatatgacagaaaacaattcccgggtattccattccaccttcgtttcctgctacattggtggctgcaggataagtatattcataccatttttttgagtaatgttctatagctgcctttgtatattctgtagatcttccccatgctttatcaccggcactttctacaggataagctgaaatagccaaagatttcttgccacttggcaaattgatttttgcagcatctaaaatgaatcctgcagatgaagcccatgcaaaatctctggtctgattaattttaaatttccaggtctttgtgccggatgctttatttttaccgatttcagactcgggacggatcattaccgttttatcactgtttctggcctcattccatctgctgatttcttctttgctatacacctctttttcattcagaagttctccggatgctacgacataatgattagccggaacggtaatattggctgtgatatttccatattccagataaaactccgaagctccaaggtacggaagcgtattccagcccatcacatcatcatacacgcacattctcggataccattgtgcgatggtaaaaattttaccatttttagtctcctgaactcccatcctgtccgaaccgtaatccggagaaacaaaagagtattcaatttctattttggcaactcctccattagctttcagttctttcggaagattaatctgcattcttgtatcagtaatggtatattttatttctttaccatcaagcctgactgatttaatcgtatatccaccattaaattcttctccatgagcaccatttctgcttcctgaaagcggaactacgccatttcctctggaatcttttgcaaacaggttctgatccagctgcagccagagaaaacctaatttatcaggactgttgttggtataggtaatctgcgctgtgccggtaatctcttttttgtcttcattaaggcttacatttaaatggtaatctgctgaattctgccagtaagcatgtcccggctgcccgcttgcggaacgggttgccgtacccgtctgcgggtagaagaatggcttaaatgcttctacgtaatcgtatttcggagtctgctgtgcataggcagatcctgtgaacagtactactgcaagcgtcgaaacaagggttggaagtttaaaattcattttgaaaaagtattatttactgtataggtaaaaaaaaatcccggatttgttacatatccgggaacttttttaatataagtttaatttaatttgacttttttgctttaatcatggcttccaaagcatcccacatttcacgaggaattgcttcaagcatattgaattctccggcaccctgaagccattcgcctccatcaatggttaccacttcaccattcatataggctgaataatcagaaaccagataagcggcaagattggccagctcctgatgttctcctactcttctcaacggaactttctttttcatatcaaatttctcctgaaggtctcccggaagaagtctgtcccaggctccttttgttgggaaaggtcccggagcaatggcattgaaacggattccgtattttgcccattctacagccagtgatctggtcatcgccagaactcctgcctttgcacaggctgatggcactacataggcagaacctgtccatgcatatgttgttacaatgtttagtacagttcccggagttttagaatctatccagtgttttcctacagaaagtgtacagtttttcgttccttttaaaacaatatcaaggatagagtcaaaagcagagtgagtgagtttttctgttggagagatgaagtttccggcagcattgttcaacaaaatatcaatcttcccgaattctttcaatgtagcctctttcatggcttccacctcatcccagtttctcacatcacaagctacacaaagaactttacctcctgtttcgtcttccagttccttagctgtagcctgcagcttttccaggtttctggaggtaatcactactttggcacccaattcaagaaagtatttggtcatcgcttttccaagaccgcttccgcctcctgttacaattgctactttatctttcagtgcaccttcgcgcagcataggttgtgtatatagactcataaaatattttttcttaaaaataataaatattgaaatgcaatcccttaaaacaggttgataaataatgctacaaataattattctttacattattcatcaaatcatcactctgttttaaaaaaaatagcctgataatttctaccagactattttttattttctaaaacaatatattaagatgctgtaaccactcctttgaacgaaagtgttttaggagttttactgtcactggttgtaacgtttacagtcttcataaacggacctgccgctgctgcgttgtaacttgcttctacaaatcctttttttcccggctggataggtgtttttgtatagtctgctgtagtacatccgcatgaaggggctacgttttgtataatgatcggctttgaacttgtgttggtgaattcaaatctgatgagtttcggttttccctgaggaatatttcccacatcaatagattctgatttccatttaatagcatcagctaccatttttacaatggaaggtgcatctgtagatagtacatttgcataaaacggagagaatgccaaaactgctaaaagagctgtaatttttaattttttcatgagtatatattttaatatttgaaactgattgttttctttcggtatcacaaatgtaaaacagaccgtaattacaacttgttaaccgctgtctaacatttgttaatgagttgttaatgataaaaaataaatagatatttttggataatattgtttcaggaaatgaaaataaaaagactcaatattattataacgctgggatttgttgctattatcggaattttaatagcacagctgatgtggacgatacaggcttataatcttgaagataaaaaatttaaccagaaggtcaacatcgccttaatggaggttgcagaaaagctctctggcggaaagacatcctatacagaaaatcctgtgcagaatattgcgaatgattattatgtagttaatattaataatgaatttcatcccgtagttctggaatattatctaaagacagaatttacccgcttccagatcaatacagattatgtatatgcattgtacaactgtcacagtgataaaatggtgtacggaaaatatatgacatcccatcaggaaaaaccgggcaacaaagtgatcaatttcccgaagcataaaaacctgatctattacttttccatacggtttcctgataaaacgacttatctgatcagctccttaagattctggtaccttcttacatttgctcttattatcattcttctggtatatgtatattctatctataccattattcagcaaaagaagttttcagaattgcagcgtgattttatcaacaatatgactcacgaatttaaaacgcctctatcctccatacttttagcgtcagaagcacttaataaacaggatcaggtacaggataattcaaaactgcagacctacacctccattattatcgaccaaagtcataaacttaataatcacattgaaaaaatattgaatattgctaaaaacgatgccggaggattatcgttaaaacctcagaaaattctattacttccttttattcaggaaattgcagacaatattcagcataagaataaagacctcaatatcgagattgatattgaaaacagcacttcggtaatggctgatgaatttcacttcaccaatattatttacaatcttttggataactctgtcaaatattgtgaaacaaaacctgttattaaaatttcagcttataaagattcaaaaggattatatttaaagtttaaagacaacggaatgggaattcctgctaaaaatattcctcatatttttgataaattttatcgggtacataccaaaaggagtgaagaggttactggttttggactaggattattttatgtaaaaaaaattgtgcagcagcaccactggaaagtttttgtggagaataatgaagataaaggaataaccactacgcttttctttccgttttcaaataatcatgtgtaagtatggagaaatctaaaattttatatgcagaagatgataaaacaatagcattcctggttgaggacagcctggaaagttattatgacatcagctgttattctgacggtgaatctgcattggaagcatttaacagtcagaattttgacatctgcctgctggatattatgatgcccggtatgaacggatttgaggtagcacaacagatacgcagcaaaaatgctgaaatacccattatttttatttctgcaaaggcattaaaagaagacagaatcaaaggacttaaaattggtgctgatgattatctggtaaaacctttcagcattgaagagctgatgctgaaaattgaagtctttctcaaacgtacaaaaaaaacagatatagcacctgcgaaatataaagtcggaaaatatgtttttgatcctaaaaattatactcttcaaggtgtggaaaataatattacccttacccaaagagagtctgatcttcttttatattttatccgccataaaaacctggtcgtcaaaagacaggatatcctgaaggcaatctggggtgatgacgattattttatgggaagaagcctcgatgtatttatttcccgattgcggaaggtattggcggaagaacaggatgtattgattgaaaaccttcacggaataggcttccgtttttccgagaaaaagtaataataactcaattcaaataaaataaagaacagcaaatgctgattttaattaattttaaactttgaaaattgatcattaatgaaaaatcataaatattctgtttttttattccttttatttttaagtgtacattttaaggctcagaaattcgagaaattaatccggtatgtcaaccctctgatcggaaccgaaaaaatggggcatacctatccgggagctactgttccttttggtgctgtacagctaagtcctgaaacagacactatctcgtacgagcttaacggaaaatataatggtgaggtttataaatactgtgcaggttaccgttatgaagacaaaaccattgtaggcttcagctctactcatttcagcggtacaggacattctgatctcggagattttctggtaatgcctacggtaggaaaactccagctgaatccgggaactgcttcccatcctgaaaatggttacagaagcagattttcgcatcagaacgaaactgcagaagccggatactacaaagtaaaactggatgatcacaatattcttgcagagctgacagcgacaccaagagtgggaattcaccgctatactttcccaaaatctgaccaggctcacattattctggatctgatggccggaatttataattatgacggaaaaaatgtatggacctacgttcgtgtagaaaatggaaataccatcacaggttacaggcagaccaatggctgggcaagaaccagaacagtttatttcgccatgaaatcttcaaaaccttttaaatcttacggtcagcagaactatgatgaaaaacaggtttacaaaggattctggagaaaattcgaccagaataagaacttccccgaaattgcaggtaagaacctgaaaatgtattttgattttgacaccaatgaaaatgaagcgatcgaaataaaactcgctatttcaccggtaagccagtccaatgcattagaaaacctggaaaaagaagcgggaaatatgacgttcgatcaggctaaagctcaagcccaggaaaattggaataaagaattaaataaaattgtcatcaaaggttctgatacagaaaagacaaatttttatacagccatgtatcatacttttattaatcctacgacttatatggacgtcaatggtgaatataaaggactggatcagaatgttcataaagcagatggctttaccaactatacaaccttttctctgtgggatacataccgtacacttcatcctttctttaatattatccagcctaaaagaaatggcgatatggtaaaatccatgatggctcattataatcaattttcaatgaaaatgctgccaatctggtcacattatgcgaacgataactggtgtatgagcggctaccacagtgtaagtgtagtggctgacgctattattaaaggaaattatgacggtgatcctgaagaagccttaaaagcctgcatagaaacagctaacaaaagaaattatgagggtatcgggcagtatattgatctcggatatattccggccgagaaaaacggaacttctgtttccaatacattagaatatgcctatgatgactgggcaattgctcagttggcaaagcatttaaacaaaacagaaatctacaatcagtttatcaaacggtctgaaaactggaaaaataattttgacaaaaccatcggctttatgcgcccacgtctgacagacggaagttttaagaaagattttgatgtcttaagtacccatgggcaaggctttattgaaggaaattcctggaactacagtttctttgttccgcaaaatccggatgagcttattacgatgatgggcggaaagaaaaaatttgcgtccaaactggatgaactgtttaccatgcatttacctgatgaattctttgcagatactgaagatattacccgtgaaggaattattggtggatatgttcatggaaatgaaccggcccaccatgttgcgtatttttataactgggccggacagccatggaaagcacaggcacagatccgccgtattctggaaatgcagtacaaagcaacaccggatggcctgggcggaaatgatgatgccggacaaatgagcgcctggtatattttaagttcattaggcttttaccccgttgctccgggatcagagaactattctatcggaagccctgccattgatcatgctgtactgaatctggaaaacggaaaaacttttgaaattgaagccatcaatcaaagtccggaaaatgtgtatgttcagaaagttcttctgaatggaaaagagattaaaaactttatattaaaacattctgagattatgaatggtgggaaacttacgttttatatgggaggtaaggcaaaaaagtaaaaaggcgaaaaagcaaaagaaaagttctctacggcggaactgtcaatcagtgagattgcttatgagccgggatttgaacattcacagtcttttaattaaaataagttttggctaaagccaatggaaaggttaaatataaagtgagcgggctaaagcccgctcctattaatcattatagtttctattttgtatgaagagagtttttacgattttaccatttcgcttttttacctttttacactattaatccctcgcttcaaaaagcagcctctctccgaatttatcttctgcaattttaccattatcatacaccagatgtccattgacaaaagtatgagtaactttcgaatggaaatttgttccttctaatgggctccagccacatttgtacagtaaattgtctttagaaactgtccagtcctgatttaaatctaccaaaacaagatctgctttataaccttcccttacaaaacctcttttttcaattttaaaaagaatcgcaggattatgagccatcttttcaacaattttctcaagggatattttaccgttcttatagttttcaagcattacaatcagtgaatgctgtaccaaaggtgcccctgatggacatttggtatacacattatttttttcctctgtcgtatgcggagcgtgatctgtagcaatcacgtctattctgtcatccagtaatgcttcccaaagtgcatctttatctttttgagtttttacagccggattccatttgataagtcctccttttgtttcgtaatcctcgttggtaaaagtcaggtggtgcacacatacctcagcagtgatctttttatcttgtaaaggaatatcatttcggaaaagttccatttcttttgctgtcgaaagatgaaaaacgtgaagtctcgcccctgttttttttgcaagttcaatagctttggatgaagatttatagcatgcttcttcacttctgatcaggtgatggaattttacaggaatatcatccccatattcatccatatatttctgagtattggctctgatggtagcttcatcttcacagtgaacagcaatcagcattttggtattgctgaaaatattttccagcgtttccggattatcaacgagcatatttcctgtagatgaacctaaaaataacttgattcccggaacatttctggggtttgttttcaaaacttcctccagattatcatttgttccccccatcataaaaccatagttggcatacgctttttgaaaagcaatctcatatttgtctgctaataactcctgagtaacagcattgggaacggtattcggctgatcgataaaactcgttaccccacccgcaatggcagcgcgtgattcactttcaatatctcctttatgagtaagtccgggttcacggaaatgtacctgatcatcaataactcctggaagaaggtatttacctgacccatcaatgacctgatctgcttcttcagaaataccaaccgctattttagagattaaatcattttctattaagatatcactttcaaaaatttttccctcgttaacgatatttacgttttttataagaactttcatttcaatttatttccctgtaaaattaagattttaagttttaattcactccaaaatcgcaaaacgaatgcttaaagttttacatttgcaaaaaaatttcgactttgtataagaaactattaggacagacaatcatctacggagtgggagcaatagcgccaaggattatcctattcatccttaatccacttttgatctataagattcccaatgaaggttttgcgattttcacacagctatatgcatggatctcgtttgttaacattatcctttcttttggttttgaaacagcgtatttcaggttttcagcggaagaggataacgaaaaaaagactttcaatacctcgttctggtttttattttcaacttccactatttttctggcattgtgttatttattcaaccagcccattgcagattatgcaggataccatgacaatcccgaatacatcagatggtttgcactgattgccttttttgacaatttactggttatcccttttgcatggctgcgttttcataataaacctatcaaatactctgcagtaagaattgttcagtctacatttcaggccgtttttaccgccgcattatttttctggatcccggaaaatatatcaaaaagtatgggactggatcaaaatgtagattatcctttcttcagtaatctcgcaggaagtgcacttggttttttattattgttccctattatattaaaggtaaggttccagtttgtgacttctctattcgggcgcatgatcaaatactccttccctcttatgctggcaggtcttgccttcatggtgaatgaaaactttgacaaatctattcagaggaatcatatttcagatgaagaagccggggcttacggaggctgctataaactggccgtactgatgacattatttgttaccgcctacagaatgggtattgaacctttcttttttaagcaaatggataaaggtgatgctaaaaagacttatgccaacgtagctgaatactttgccttttttgcatgtgccgttgctttagggattattgccaatatatcctggctgaaagccgtttttattcctaataaatcctactggattgctatagacatcatcccgattatcgttattgccaacctttgcttcggaatatactataacttttcaacctggtataaagtaacggacagaaccagtatgggaacggttatttcatggcttggagcaggaattaatattgcactcaatctggtagcgctaaattactatcacagcatgattggctctgcatgggcaacctttggagcgtatgttattatgatgattgtttcttatctgctgggacagaagtactatcctattccttacagaatgaagaaaatgtctttctttctgatactgcttggaatttttagctttatcattgtaaagtatctcaactataatgttctgacaagtaatctgctgtttctgatcttcaccggaattttgatttattctgagaaaaacctgattttatcaagaatcagaaagaattaaactttggtctttattttgcttgtaaacaaacctattgttaatttaaacaaatatttaaaaagatataaattataccacatcaaatgttttaattattatctttagccttaatataaataacaactaataaaacatcttttatacatataatttatgaaaattattgtccctatggctggacgtggttccagattacgtccacataccctgacagttccaaaaccccttattcctattgcaggaaaacctatcgtacagagattggtggaagatattgctaaagttgcaggagaaaatattgaagaggtagcttttatcatcggagattttggtcctgagatcgaaagatcccttattcagattgctgaaaagctgggagcaaagggtagtatttattatcagaacgatcctctgggaaccgctcacgccattaaatgtgctgagcagtctatgcagggagatgtcgttattgcttttgcagatactcttttccgtgcagattttcagctggacaaaaattctgacggtgtaatatgggtgaaaagtgttgaagatccatctgctttcggagtggtaaaactggataattacggtttcattaccgactttgttgaaaaacctcagacttttgtttcagatcttgccatcatcggtatctattatttcaacagtgcagaaaaactgatggatgagatcaattatatcatggataatgatattaaaaacggtggtgaatatcaattaaccacagcacttgagaaccttagatccaaaggcgctaagtttactctaggaaaagtaaacgactggatggattgcggtaacaaaaatgctacggtagagaccaacagcaaaatccttgaatatgaaagagaagcaatgactcattatcctgcttctgctgtgattgaaaattctttgatcattcagccttgctttattggagaaaatgtaaaaatttccaattcaaaagtgggacctggcgtttctttaggaaacaacaccactgttgtgaattctaatatcgaaaactcgctgattcaggaaaatacaagaatcaatcatggaaacctgtccaactctatgatcggtaactcggcacagtatttcggagttgccagagaaatttcattaggtgattattccgttttagattttttatctaaataggaaagaaaatatttaacttaaacaatctatgatcaggccacacaaaacattttgtgtggtttggcgttaatattgcaacgtatttttaattaaagataaatacatgaaaaactggatcccttttcttttgttacttctagccttatcatcctgtaagacccgtaatgctgctcaaaatgatgcagatcatacacaggacagtattaacgctacaaaagataaagattatggaaatccaaaggatgccaatgaaccagtgagagacaagctcactttttatgaacatgtactgatcccgccaaaatttgaacaaattaaaatagacagtaaagtaagagtagaaacaggaagctatgttcctacgctggatgcaaccatctatattgaaaatgataaaaaggtgtggatgaatctcagagctttgttcatcaatgctgcaagaggtattgcaactccagaggggataaaaggacaggataaaatcaataaaacctatatagattcggattttgattatcttaataatttactgaatgttaacttcattgattacaaatcactggaaaaaattttactgggaagaacttttgtaaaaatcaatgacagacagtttgaccttacccaaaatgcacagggttttaaaatgatttccaataccaatcagaaaattgtaacggatgaaaaaaacagagagtataaagtagctctccaatatgataccaactatgatttactcaatgtcaacttaaaagatattctctcttcagatgagctggatgtttcttacagtgactggaatgaatacgcaggaatccgccttccgaaaaatgttaaaataattataaaaggctcaaaatctagtcagattttactggaaaatacgaaatttgacttttcgaggatggaaacaccttattctgtaccatccagttataagaaaattgagattaaatgattaaaaaatttagctttttaataggtgttttgatgtttggactgcaccatggacagcagaacaaagaacaactgcagaagcagaatgccgaacttaaaaaacaaattgcccagataaataacgatttagccaaaaccagaagtgaatctaaactttccatcgcctatctttccagtgttaatcaaaaactggttttaagagaaaaggtttataataatacccagaaagaaaaaagattcattgaggacgacatttatttacgtcagctggaaatcaaccgtcagaataaagagctggctgttttaagaaaaaactacgctgaggttttagtgaatgcttacaaaaacaaaggagtacagaataaagtaacgtttatcctttctgctaaaaatctgggagaagctatacgaagagtacagtatctgaaacagtattcagattatcaggataaaaaagctgctgaaattaccaatgcagctaatcttatcaaaaaaacaattgcacaaaaacaaaattctgtaaaagcaaaagagacccttttgatcaaccagcagaaagatctggcaaccattaatgctgaaagagctcaaaaagaacagttagtcgcagaattcaagaaaaatgaatccaaactgactgcagaacttaagcaaaaacaggttcagtctaaagcattagaaggacagatcagggctattattgctgaagagatcagaatcgcaaaggctgaagaagaagccagaaagaaagcagaagcagaaaaaatacgtttggcaaaattagctgccgaaagagagaaagcaagaattgaagcagaggctaaagcaagagcagaagccctggaaagagaaagaagacttgcagaagcagaagccaaaagagctgcagatcttgccgcaaaaagagcagaagaagaaagaaaacgtaatgaagaggccgcgaaagcagaagctaatgcaagagatgaagcaagaagagtagctgctaaaaaagcttcggatgaagctaatgcaaaagccaaagaagctgcagataaactggcagcagcaagagcagcagaagcagcacttaccaagagaaaagaagatgagaaaaaggcagctgaaacaaaagctatgacaagctacggagtttctactgcaacgggaagcagttttgcagacaacagagggagacttggttatcctgcagacagagccggacaaatcacccaccgtttcggaagacagccgcacccggttttcaaaaatatcactgaagaaaataacgggattaaaatttccgtcccatcaggtacacgtgcaaaatcagtgttcccgggatcagtatcttcggtactggcaaacaatgacggaacaaaaactgtcattatcaaacacggaagctattttaccatttactccaacttaggaaatgtaagtgtttccaaaggacagcaggtttcctcaggaactcctgtaggaacaatagctcaggattttgatggcgcctatacccttgatttccaagtatggaacggaagtacaccagttgatccgttaggttggatttcatattaaaaaaagtgtacctttgtagaaattttaagagatgaatacattaacaatacttgccttatcttggcagcatatccttatcgttgcaatcattttggtattgcttttcggaggaaagaaaattccggaattaatgagaggagtaggttcaggaatcaaggaatttaaagatgcagtaaaagaagaagacaaaccaggttctgagaataaatcggcttccaacaataacaattcttcaagcaactaaaattccttagaattaatgaaatttactgagactgcatggaaagtcttcaatcaagctattgaagactatcacgtgtctgatgacgttaacactctaattaataacccgttcgaaaaagatagtttggaacggattttgtatgcaaagaactggattgataccgttcaatggcatttggaagatataattagagatgaaaatattgatccggctgaagctcttcaactcaagagaacgatagatgcctccaatcagaaaagaactgatctggtagaatatattgatggctggttccttaataagtttgaaaatataactcctaaaccggaagcaaaaataaatacggaaactcccgcttgggcagtagacagactctccattcttgcactaaaggtttatcatatgtcgttagaagctaacagagaatctgcttctgaagaacacagaaacaactgccaggctaaactggatgttctgcttactcagaaagaggatttatcaacttctatagatcagttgcttgctgatattgaaaacggtaacgttaagatgaaagtgtacaaacaaatgaaaatgtacaacgatgaaagtcttaacccaatcctttatcaaaaagggcaacaaaaatgaaacgactatttttctttggagtacttatcatattaacatcttcctgtgcaacggaaaaacttaatctttctccgttgtcaagtaatttttatagcgatgccaaaggttctgattccgacagaggctcaaagaagaatttcaatatcaatataaaacagaatgtaaatgcttctgaaatttcaaatatgatctccacttttcccaagtttaaaaacaacggattaaatgatgagattaccagcatgaaatacagtcttcagaattatttatatgctattgatgccagcaattctgcaggaaagagcagagccctgaagagcttcgaaaaatcatacaaaaaaatacagaagctaaggcagaatcttgacagagatgaagatgaagttcttaacagatatcttgttcgtttaaaaacaaatgtttctgttattgaagatactttgccaggaagttaaaaactaattgaactatcaatgattaaaattcaggcggaagccaatgttcctacagagcacggtactttccgaatgatagctttctccgaaaacgaaaatgactggatgcctcatatggccattattgcggaaaacacagatttctcaaagcctgtcaatgttcgttttcactcagaatgtattaccggagaagttttccattcaaaaaaatgtgaatgcggccagcaactggatgctgcaatgaaatatatccatgaaaacggtggaattatcatctaccttcgtcaggaaggaagaaacatcgggatcatcaacaagctgaaagcttactcactacaggaaaaaggattggataccgtacaggccaatcttcagcttggtcttcctgcagacgacagaaactttggagtagccattgaaattcttaatctgctggatgtaaaagatatcaatcttttgaccaataatcctgaaaaggtaaagtatgtggttgacagcaatattcacctcaattcaagagtaccgctacagattcctgccaatgaaataagcaaaggatatctgcagacaaaaaaagatttctttggacatcttctggatgacaatgataactaattttataaactaaatattaaaaagctccaaaaaatatattttttggagctttttaattactgaaattaataggacattccatttctataacaatttcaccaattagtgtattttttataaagttttatttttgcgatgaaattataattttatgaaaaaaacactattcgttatttcttcattatttttcattggctgtgcaagtagtaatgacatgctttatacccaagatgaagaacaaaatttaaacttaaaagaagctttaccatctgtatcaaataaaatgttagccttaaatggaggtgaaattcctttaatggatttggatttaaataaacctcttggtcaaccagatggtggaggatgttcattcaaaaccggacatagtgttgacaatatttatacgtcaaccgctgcatttggccccaatccactatctttttttggttatacatttagaggatatggaaaaccaagaaccgatggatttaattggaaaggtataagatttcaagcaggaaatcgtcctgcaactgtcttaagtagcagaggacaaagccgattagttaatgatctttttgaaaatgccttatctatagaatttccttttgaatcaaatgcaacttacgaaatcatattagatacaattattgaagactttatatacacagagcaacatgatcaatatgaccaaaacgatgactaccatggtttacaacaaagtcaagcattccctacattagcagtggaattggcaaacacacctgaaatttatggcagcgctccttgcgcaggaaggccagtattaaacaacagattcatttcagaaaattactataaaacacaaaaagtagaaataacagttccaccatcatatgagaaaaaaacatttgtatttaatttctctactacggagtcaaaggctgcatttcttatttactacctacccgaaagaggatcagacccttatatccctgaaagctcttttaaaatgaatctaacaggtataaaaataataaaaaaagcatttgatccaacctatattgtccccccaaaagttacgactccagaccctagtcttccctgtggttttagaggaggatgttaatcacaatacaatctaataaaaaatcaaaagccccggaaaatatttctcccgggactttttttaattataaaaaactgaaaagatatttctaaattacttagtcttgattttagactcgtcaatattgtaatatttgattacactattgtagtctgaataatcaactgcagcagcagctgcactcttagatgtacctgtttttgcaggaacaattactactctgaattttttgtttgtataatataccgggttattatccaagttaactccaatagtagatcttacatcaattccgatatcaaacttactgaagtcatatgaatattcaactttatcagcaccgttattaggatattctgtataagtaagcaatttccagattggagaattattattggtaagacctgtctgtaaataaatcagaactacatcagattcaagtaaaggacttttaaatgcgtcatcaaaatgataagtatagctatcctgtttattaaatttcgggataatatcataagctgttgaatatgtatcattatcctgaccttgtactaccacatcatcactattatcacagctataagctgtaaaacctacagcgcccaggaataagaagagaagtatttttttcatttctattaaagtttagttattatttatattgcgtattcaaatcatataccaaaaatttcaaaaactttgttttcatcatttttttaattgtatttttgttcttattcaaaaagtcatgaagaaattaatatatacttcactctttattgttgcattgataagccctaaagttaaggcgcagtaccagcctaaaaatgcatccaaagaagatttgaaaaaggctcagcaatgggttgataaaacttacaaaaatctttctcaggatgaaaaactaggacagctttttattgttgcactgtataccaataaaggagaagactatatcagccaggtaagaaatattgttacaaatgataaaataggcggtctgattttaatgcaggatgatgctgcaagggaaatcaatctggtgaatgaatttcagcaaaaatctaaagttcctctcatgatcggtatggatgcagaatggggattgtatcagagaattgcaacagctcacaaatttccatgggcaatgacgttaggtgccatccaggataaaaaccttgtctatcagatggcagcaaaaattgctgaagattgtcacaggatgggaatcaactgggattttgctcctgtagtagatgtcaataccaaccctgataacccgattatcggtaacagaagtttcggatctgaagtgagcaatgtaatcagctctgccctatcctactctaacggtcttcaggataacaatatattagccgctatcaaacatttcccgggtcatggggataccagcacagattctcatcttgatcttcctgtagtttcccataatattgacagacttaatacagtagagttggcaccattcaaagctctgatggataaaggaattggcggtgtgatggttgctcatttatacgttccgaatttagaatcaggaaaagggattcccgcttctgtttccaagaatatcattaccggtttacttaaagacaaactgggcttcaaaggcttaatcattacagatgcattaaatatgggtgctgtagccaacaaatataaaccaggtgaactggatgctatggcctttaaagcaggaaatgatattatgcttttctcacagggagtttctgaaggcaaaaaactaattcagaaagctatagataagggtgagatccctcaatccagagtagaggaaagtgtgaaaaagatcttactgaccaagtatttccttggtctgactcaatatacccctaaaaatcctgaaaacatcaatgcagatcttaataataattctcataccgaattggtacagaatctttattccaatgccttgactttattaaaggatgaaaagaaactgcttcctcttaccggaaagcaaatatattatgttcctctggaggaagcgccttaccagacttttgccaacaggttaggaaataatgtgatcataaaaaaagccggagaaattactactattccggcaggttcaacagtaatcgtaggtttccataaagataattcaacggcttataagccttataaaatttcttcagaatctaaaaaaatactttctgatcttactcagaatcaaaatgtaattctgaatgttttcggaagcgcttatgcactgaaagatattgatatttccaaagtttcaacagttcttgtctcttatgaaaacaatgacgattctatgaatgccactgctgatgctttaaatgggaaaacaaaaatatggggaaaacttccggtactggttaatgaccaattaaaaccgggaatgggcatagagcttaatgcagtaatctctgcaaacaccaaacaatacaatatcaaacaacaataatctaatgaaaataggcatactttgctatccgacatacggaggaagcggaattgtagcaacagaattaggaatgtcccttgccaataaaggatatgaagtacatttcatcagttctgcacttcctgcaagattagacatcaccaacccgaatattttctttcacagggtaaatgttcagacttatccgcttttccagtatcagccttatgatattgcactgagttcgatgatctacagggttgtcaatctttataaactggatcttctgcacgcacattatgctattccttacgcatatgcagcatttaccgcaaaacaaatgcttaaggaagacaataatgatgttcctttggtaacgaccttacatggtacggatattacccttgtaggccaacatccaagttataaacatgctgtagaattttcgatcaatcagtctgatgcgattacttctgtttctgaaagcctgaaaaaagatacccttcagtttttcaatatcaaaaaagaaattcaggtgattaccaattttatcgacaattctgaatttgatgactgcactgaatgccagagaacacagtttgccaatcctgatgaaaaaatcctgattcatgtatctaaccttcgtcctgtaaagcgtgtggatgaagtacttcagatctttaaaaatgtggagaaaaaggtaaaatccaaactgatcattattggtgaaggtcctgatatggaaaaggtcaatcagttcctggaagaaaacccggatcttatttccaaaatccgtcttttaggaaaagtaaatgatctttataaaatcttacagctttcagacgtatttttacttccttccgagcaggaaagctttggtcttgcagcgttggaagccatggcagcttatactccggtcatcagctctaacgctggaggaattcctgaggtaaacattcagggagaaacgggatatcttgctgaaatcggaaatgtggaagcgatgagtaattacactatcaaactgttgagcaatgatgaacttttagccaaaatgaagcaaaatgcgaaagatcaggcaataaaattcgatttgaaaaacattcttcctatctatgagaaaatgtatagaacaaccatagaaaattttaataaggagctgacgaaagtataatatttctattatatttacgtcacacttatgacggaaaaactacttcaatatctttggaactataaggttttcaaaaattttgacttcaaggatattgaaggaaattccgttgagatcatccattccggtaaatggaataaaaatgccggccctgattttcttgataccaaaatcaggatcaacggattacttctcgcaggaaatacagaactgcatgtccgttcctcagactggatttttcacaatcattcacaggatcccaattatcagaatatcattcttcatgttgtctttcagcacgacatggaaattcatgaacataccggaaagcatattcccactttggaacttaaaaattatattgatgaaaatatcctttggaagtatgaaaagcttatcaacggagacgaatttgttccctgtgaaaaaatctttgatccgaaaaaaatcccggtcaactttcatgaagagaatattctgcaaaagctggatgagaaatcctctgagcttgagcaaagcttagatcaatacaaaaataattttgaggctgttttattccacagctttgcctattcatttgggttaaaagtaaacgcccatattttccggcagatggcagaaagcatcgattacagcattattaataaaatccgtcagaacccgcttcagcttgaagccctgttatttggaatttccgggtggcttgatgatcctcaagatggtcagatgaaaatatggaaaagagaatttaatttcattaaagctaaattttctattcctgatttaaaattccatccgaaatttttaagattaagacctcccaatttccctacaatccgattatcacaattagcagacctgtataaacatcagaatttattttcaaagattatggaagctaagaatgcagatcagctatatgctgttttcaaatctgtaaaagcttcagaatactgggactttcatttcaatttcggaagtatttccaaagtgcagcctaaaacattgagtaaagattttattgatcttcttattctgaacactgtacttcctttaaagtatacttatcataaatatcatcatgaggaaactgcagatgaaatcattgaattgtacagaactatttctgccgagaaaaacactatcattacaggttggagaaagcttggattaaatgtgaccaatgccttggagagtcaaagtctgatttaccatcacaagacctgttgtgaatttaaaaactgtctggcctgcagtatcggatttaaacttttaaaagaataatcttatctggacagttttgtcatcaaaaatctttgtcaaaaaaatttcttaccttgcagtattggattaaacttttaaatacaatctgaaaatgctgagtaatatccgtcataaaatggaaagagaatggtttggtgtactgacaagaatgggtgccaagttgggaattcctgtttctaaactgagagttttcttcatctactctacttttgctaccgccggttttttctttctgatttatctgggattggcatttaccctttggattaaagacattttcatcaccagaaggcctagtgtctttgatttataaattatggaatttttaccgattacttccgctgaagacccaagagttcaggaaatctatgcttcttatacagccacttttcctgtagatgaacaaagagataaggatcagtttatgggcttgttttcaaatccatatgtaaaattcatgtctgtaattcatgaatcggaagctattggatacctcatcctttgggaattgagttcttttgcttttgtggaacattttgaagtatttgaagcattcagaagtaaaaagctgggttctcatattatgaatcatttatcagaaaattatccgagcattatcctggaaattgaacctgcagaattgagtgaagatgcctcaagacgatattctttttatcagagaaataatttcagtctgatagataccactcatgtgcagcctagttatggtgaaggaaaaaaatctctgaacttatggctgcttgccaactacactcctgaaaatatagaggaagctaaaaatgaaattcataaaattatttatgcttaaaatataaaacgctggaattgtttttccggcgtttttaatatcttgataggcttgttaatttacttcgtactcaagctttattgtaatactggcttctttttctttggacgaagtattgaaagttcctccgtaagaataatcctcgttagagttaggtgctgtaatctggatcactcccatggttgctttcttcagatttcccaggctgcttcctgaattttctgcaattttttcagcacgttcttttgcatccttagttgcgctggcaatcatttcctgttttacagttgccagtttagtatagaaataagcaggagaagaagacgtgaattcaatgccacggttgatgatttcggtaatatttctggataggttttctattttaccaacttccttactttcaatagaaactttttgggtaaggttatagccggagaattctccctgcatataatttccgtttgaatcattatagcttctgaactgtttttgaatatctacggaagaaaatacgatttctttttgctgtatccctttggaaagcagataattattaattacctttctgtctgttgccagttcatcataagcagatttcagatctacattattcttggagaaactcccggaccaggtaatcagatctgaggtaaattgttttgttcctaaacccgttacggaaatggtgttctcggatttattcctgttcttaatggcatttcctaaaaagccgagaccaatgacaaaaccaagtgctgcaatagctacggcaagaatgtttttattcataaaatttgtgaattgagttggttacattatgactgcatcaatttctattccaatattttaagattttattaacatttctatttactttgattctgctttagcctctccatgaagagaggtactgtttcttccagcctcagcattacgccggaaagatttcttgcttttacataggttcgtacctgaggttttgctaaaaatgaaaactgaataaactctgaaatcctgtcaccaggaattcctgctttgataaaatagtcatcacttattctgtcccgtacccaggcaatatgctcctgaagatcatcatatctgtactgtcttttctgtctccttgctttaccgctgatcaggtcatatgcgccctgtacattcaggtttcctaaaagtattggcagaagaacactttttacctcagctggtttttccctcatttttcctaccggctgcggaagacctacagcatctcttacctgttctcctttatctgcttttgctacaatgcgggaatccacttccaggtctcctgtgagttttttaacaatctttacttctcccacatctttcggaatctgataaagagtgataaacaatggtaaattgcttccgttggtaagaacccttcttgaagttctgttgaaatcttcctttacaaatcttaattcatcattaggattggcatcaatagagaatataccttctgtatcagaatatacttttttatcggtagacatgttaataacaattactttactcagattttctccgttatcatccactatccgtcccgtcacggtctgttgggaaaaaataaaaatactgcacagaagcatcaggaaaacaaaaattttccgtcttccaaatacgtcaatattttcagtactataactcaacttttagttttaataagaactattctttacttccttctaatttattcattttactgtattccccgaacgctattttaagctcatattcaataacatcgatactaaaatccttccggtatctttttgccagtgaacgggttttatctgcatagagaagaaatatatcaatctgctcttcatccattccatatttcttcagaaagctcagattcacttcattccttactcttttaagaaaatcctgagtttcattataattcgctttggtgaccttaggcttcgctaatttttttacagcattaaagacaccaaacaggttaacctgccctgcattaaaatcgtgtccggtaaaagttttagatatggcattgcttggtaaaggctgattaagcgggctcttcatatactcttccatatctgatttcaatgcctaaagttttctggattcattcaaatgctgattatctttcgcaagatttccggtaggcctgtattgaattttcacttcgggaatctgaatctccatttttctcagaatgatattgaacggagaactgatatcttctttggtaattttcttatcaacccggtaatatccttcttttacaaatcttatttcatcattttcccttgcttcgatttcaaatgttcctgacatatcgctcaatatgcttttgcctgctgaaatattaacaatgagaacaggagctaagtccatttcatctcatgtgattacctttcctgatactttctgctgtccccacaatactgaattgatacaaaaaagcacaataagaaaagttctgctgatatattttgcttccatttttatctttgagtttgcggagcacgataagatgaaattcttgtcaggacaaaacgctgaaacctgttcaggtctgcatcactgcaaaatccgtatttcagtattttttttctttcaaaaccgcctgcaaaaacataataaataaaatggtctatcagaggcttttctattttaagattggtaaaataatcgtctcccagacttactcttatatatttcattaaatctacgtcgtcccatttatctttaactttcccaatagagaatccctggccttttggctgtacaaattctccaggttttgcagccaggattctgggatctgatttctgagcaatataccgatccatatctttgagtagtttttcaacctttttaggtttattatagagttttgaatcaatcttcaggtttccggtcagtccttgttttacttctacttcaggaatctgaatggtctggcgaacaatatttatatttatcggagattgtgtattttcctgagaaactattttggtgatacgttcataacccgcttttaaaaaacgtaattcatcaccctgccttccggaaatcataaagtgtccgtcccggtttgaaactacaatttcatttgttctgatattaatgacattcacatcctgtatttcagcaccgttttctgaaacaatcttaccaaagatatagctttgggcatgggtatgaataaaaagaatgaaagatagaaaaaagaatagtttgagtttcacgggctattttttataaagcaaagctaaaattatttttaatttataccataagtttaaccacagttaacgcgttttaatatttctttttgatttttgctctgtaaactgttaaataggctgattaaattgttaaagtttcttttaaattttagctaacttgcagtctcaattctctttcaacaatgcaaaattcttatacagtcatcaatgcttctgccggatcagggaaaacgtatgctctggtgcaaagacttctgatgatctgtctccggtatcctaatcagcagcagacgatcaggaatattctcgcactgacttttaccaataaagcagccaacgagatgaaagagagaattttatcgtggttgggcaatttttcagcaaaagattatgcagagaatgtggatctgaaaaatatccagaaagcatttgaagaacagggattgaaaattaccattgatgatcttcaccagcgttccaaaaaattactggattacgttctccacaattattccacattgaatatcggaacaattgaccgctttaattcaaggttagtacgaagcttttcatatgagctgggactggctaagaattttaatcttgaaattgaagcagaaccgtttctgatagaagcggttgataaaatgctggaccagatcggagaaaatgaaaccatctccaattctttcatggattatgtagattacagtcttgaaaataatgaaagaattaatctcaacaaaaatctgtacgattctgcaaaggaatttgtaaaggatattcattacgagcatctgaaaagcaataaaagttttgatgatgccaattatgaaaatataaagaatgcgctccgtaaagagatcatacaaaataaaaagcagtccgcagaactggcagctgcttctattgagttattcaaatcaagaaatatagatattgaagactttgcccagggcaaaaatggaatcggaggtttctttactaaagtgatcgatttttatcagcaaaaaaggcctggctttccttttccaactactttggaggaatctgttattaacaattacaggaaaggagcttcatcaaagtcaaaacataaggaatccgaaatttttgaaatccttgatcagcttctggaaaacaggatgaaactgattcttctgtatattgaaactcaaaagaaagagaaagttttatcagcgcttcttcctttaaaggtcaacaaggacatccaggatgaacttcaaaaaattgaggaagaaaatgatcttgttcttctttccaagtttaatatccttattaatgaaaacctgaaaaatgagccctctgcttttatttatgaaaaggtaggttcacagtttcagcattatttctttgatgagtttcaggatacttcagagctgcagtggcagaattttgttccgctgagagatcacagtgtttctacagaatatacttcttttacactggtaggggatcccaagcagagtatttaccgtttccgtggcggggaaagtaaactgatgcttgatattatcaacaaaaaagaattctcaccgaaagaagcagatcttcttgtcttaaaggacaactggagaagtgccagaaacattgtacagttcaacaatgaattgtaccgtttccattctgaaggacttcttgaagagcataaaaacatcttcggtgctgatgctgaacaaagttccaaatcaaagattgaagggcgcgtaaagatcaacctgatcgacaatcttacgaacgaagatttttataccgatacttccgcacggatgcagaaagacatccaggaatgtctggacaatggatttaagttctctgatattacgatcctttgccgggggaattttgatattttcagttattcccaaaagcttggaagcttaaaagttaattataaaggagaagaaaccaatattaaaacgatctctgataaaggtcttacccttgagctttcaaatactgtaaaagctgtcattgaatttctgagatgggaacttaacccaaagaataagccttgtctgatcatgatgatgtaccatctgaatacactagggaaaattcatatgccggattttacttcaggtatgaaagaaattctggatattgacggccaggaggaaatattgcaattcattcaggagagatattcaattcaacttaaacaggataattttccaagatttaatctttataattttattgaatattatatcaacgaattttctgttgaaaacaaggaaactgatttcttgttgaatttcctggaaatgcttttcaactttacacaaaatgccggtgctagtaccaaagagtttctgaaatactgggatgaagaagcatcgtcgtacaccattcaggcttcggaaaacattgatgctatccagatcatgaccattcacaaatccaaagggctggaattccccatcgtttttattcctatgatgaacaaaaaccgtgacagtgaatttaccaactggtttgacacgaatgaaaatgaaacactaaaatctgtgaatatcaaccagttcagtaaaaatctggaggcttatgatgaagaaattctttttttcaacacaaaaaatgcctataaaaacctgattgacaggctttgtttacaatatgttgctaccacaagacccgttgaacagctgtttttctatctacagaagcctaataagacgtctaacaatctggagcttctggaattccttcaaacaaaaaatccggaacaggccgatgaatttgatgtgtatcctgtacatcctgaaatgctgaagaaacattccagggataaaacttcttcttttaaaacccagaatatccggcatctgaagaacattaatgaaaagagtacatccatcaagattgctactccgtctaaaaactatcaggtacggaatgaaaaggtaagaatcggactttttgtacatgagcttttatcaaagatcaatacagaaaaggatatcattaaggtattggaaggatatgctttggaaggacagattacattagaggaaaaaaatgaaatacaggctacactacaggaaattgtaagaacttatgcagaattcttcgatgagaaatgggaagtgatcaatgaaaaagatattatgatcactgagagaggagaaagccatatattcaggcctgaccgtatattaaagggtgaagaagggtatattattgtggatttcaagaccggtgagccaaaggcgaaggatgaggcacaggtagaaggttataaaaacatacttgaacgcctgggcaaaaaagtactcaaaactcagatcatttatctataatctgaacatttccaaaatattactataaaaatttctgtaaaaaatctttcaaaatataaaaggttttattatttttaattaaagacgaatacaatacagtctttgattatattttgattacaactaaccaaccatgagaatatacttaaactcctttttaataagtctgatcatcatgttattttctacagtggtcacttacaatattgttgattgtttagatccacccgttacagcagatggtcgccattatatgcctgctgaaaacattgccaattctttatttctgggttttgtattgggagcagtagtatttattttcgctgtgaggatccaaagacagccgtacaggaaataactatatcatctcaacaaaaaaaccgctatcccggaagataacggttttatattttgaatgtttttcaatcttaagctgttgtatcaggagtaaacactctctgagacaattcctggtcaaaaaggtataatgctgatggattatcacataccattttgattttcgttacatattgagaggcacttgcttcctcttctacctgctcattgataaaccattgaaggaatgatgttgttgcaaaatctccttcctcatttgcattttttacaatattgaaaatacttttagttacgattttctcatgtgccagtgctttctcaaaaatatctgttgcgttttcgaactcatgcggaggttttggaatttccccgatgataatttccccacctacatcattcagataatcaaacattttatctgcgtgcatcaattcttctttgctctgtactctgaaatagttggcaattccatccagatcttttcctgaaaaccatgcagacattgaaagataatattgagcagcgtattgttcgtgggcaatttgttcgttaattaatttcgcaattttttcgctaaccataagtattaaatttatagtcaaaaatagggaataaaagcccgaaatcaaaagttttagggaaaattaatacaaaaaggatggaagtatatccatccttaacacattaaaaaactaaaattacaaactgttattttacatcagcagttcctgtattcataggctttttcatcattcttctttctttcattgccattttcattttctctgcttttgcttttctgtcagcctgccatttatcgtattgatcaggagtaaggatttttttcatgtcagcatccatttgtgctcttttagcctgcatttcctccattttagcttgtctgtccattttatttttttcaaactctgccttcatttcagcctttcttttatcctgaagagcctttatctgagctacctgagaggcattaaggttaaggtctttctgcatctggtctaagcgttcctgttgtttctgttccattctctgcttcatttcaacagctctggtctgtctgtcctgtggggtttgtggggttatagtttgttgtgccattgcaaaacttcccattccgataaatgctattgctaaaactaattttttcatctttttaaaatttaattaattgttatatgtctttttgattatgaattaaaacacaagttaaattaataaattcataaataatgttaatttttaataaaaataaagcaacataaagcaaaaaaaaggacagattataaaaacctgcccttcacaccacttaaatataatatatgaaaattaattccttactaagctgcctctaaagccgccaccgccaccacggttttcttgtctcggagcagacgtttcagatctttgtctgaatccacccccgttatttcctctgaaaccgccattgtcttctcttttaggagcttctcttcttacttcactgtttcctctgaaaccaccaccgttattcctgaagccaccgccatctgcatttcctctgtttcctccattatcagaattccctctgaaaccgccaccattgctgtttctgaaacctccgttattatcatttctgaatccggaattattgttatttccgttattaccacggaatcctcctgaattctcatttcttgtgtttctgaaaccattgtctggtctgctgtctcttctgataatattaaaagtagggttatccattcggcggaatcttgaacggtctactctgtagatattaacattgatatttcggtatcttggcattacagtataccttggcacataatacgttcttctgtaattctgaaagtatacaacagggttgtaacctctgtaataattattctgaaaaactacaaatactcttggtccaaggattctttgcagtgcataaaacctgtcatagtaccatctgtccggattatatctgtagaaattattccatgctgagaaacttgcatacagattattcaatctcatgatctgatctacctgccatctgcttaatctgttctgtacgaaaaatccgttccagtctatattaataatacttcctctgtagtcgttataatagctttgataataatcatttggataatagtcctgaggataattgtagtaataatcgtcaggaaaataatttctgtcatcttcatcgctgtaatagcctccgtcattctgataataaccgtcatcattccaaccattattcggatattgctgagcagacgtcaaaacgcccaacccaaaagctaatcccaaaaatatttttttcatctctatagtcgttaattggttaatatatagcagaatatcttaattctatctctttgatataaataaaaaaaagaagttaaatcctaaaatcaaacttcttttaaaatattattaactaattgataatcaattattaaatttacactcttccactatcttttatccaatgggcgatttttttattgaaagatgttctttctttcaggtcttccagttttatatgcatcctgtaacgccagtaatgtggaaaaactgcgggattattaattctttcattatcaatttccttattggcaagttctgaatcggttgccaggaattcctgaatcggaaaaatagcaagcatagcctcattatacagatgttgtttcataataatttctgcaagatgaggattcaggtcttcaggtgctttgccatactgtatcagctgttcattataatatctttgtgtaagaaccggatcttctttccaccattgccttaatgttgagctgtcatgggaagaagctgttaccacattcatataattggcatatttaggattatagaatggtatattttcagaaggcattctttgcactttaagagctataatggccaattcatccattacaacaggaacacatgccggtaccattcccagatcttctccacagatcagcattttagtagcattcagaataacgggaagtttctccatggctttttcataccacaaatgatcctgtcttctgaagaaatagtcatggtataggtcataaatatttttctgctcagattccggaaggtacttataagattctgtattgtatacattgaatcttggatggtaaaccgttttcccatttctttcctctggaaggaataaaacgttggcacatagagaaatcagcttttcttccaatggaccatatgattttttcttaaagaaattaaccagctttctctgggtatcaaactcttctttaaaagcgtaggtcccgtcatcattacgattcataaattcaagagcctttccgctttcctctccaaaataatcccataagatcttgttgttgataaacggcttacaatacctgtcaaaattgaaaggaatctgccaggctttaaattcatccgcgacaataggaacagcgggataaaagtaccctaaaattccttgtacagctgaaacaggcattctccatattctgaagaaacctaaaatatggtcgattctcatggcatcgaaatattgttccaatgctttgaatctgtttttccaccacctgtagtcatctgctttcatagcttcccaattgtaagtcgggaattcccagttctgacccagttctgtaaactgatccggtggtgcgcctgcctgaaaatccataccgaataactcaggttctgtccaggcttccacagagtatctgtaaataccgataggaaggtcacctttcaacgaaattcccaggttatgggtataatctacggcatccttcagctgcaggtgtaattgatactgtacccaggcatggagcattgaagtatcataatctttgcttttcgtgctaaaaaactgtgaaattttaccggcaatatactttttgtgggttttccattcattaaaattcggtgtcttatatttatccctcaaaacacagaatgctgaatagggtaccagccagttttcattatccttgatgaattttttgaaatttctgtctttataaattttatctttttccttattgaaaacagctataagatatttccatttccccgcaatcatcttttcatagtcgatcagatctaaggcgtttaaatcctctttttcagacagatattcttcgactaattctttcggtatagagtaatcaaggttttctaaagagatatactgtggatgtaaagcataaacggatactgcagcatatggatacgaatctgtccaggaataattggctgtcgtatcattgatcggaagaatctgaataataccaagattggtttctttcgtccagtctgccagtttttttaaatccgtaaattcccctactccgaagccatcttcacttctcaaagaaaataccggaactgccacaccggcatcatggtacatctggtatcctttaaacctgaaataatgattggaaacaatctgcagtacatcattaaacagattgggagccgtggatcggtttccaccggtttccacatctatgaccctgttttctttggtatcatatatacaatatttaaactcgataaattcattctccggaatttctacagaagcttcccacattccaaaatcggtttgctgaaggtgaataaccttgtcatagttccagtttcccaaagatgctgtacttccaaaaagaacaattctccaatccggattataaataggagcttctattctgaagagatgggtatgtttttttaaaaccgtgattctttcaggaacaaaatcatgtagtttgttatagagaattttgttgtttaaataattttcaggaaagtttttattgttccattcgtcaaaaatgataaactccttataattatgaggaaaacttaaatgatgaggaacgaattcttctcttaagacatttcctttttcattaaccacccgatattgatacgtaatggattttgagaaatagtctacttcgcatttccataacccattttctgcataaaacatagtatggacgtgtaaggcatgttcatcttcaccaaataccagctgcaagctctcccccgcctttacaatatatcctacattaaagtatagtttcatctatatttttttataaaagtacattttaatatcgaaaaataaaacttattgaatatcaaataatcattaaaaaaccttctcaaaacagattgaaaaggtttttatatattgatttatagcaacctattatttggttacaagaatctttttgttgaatattacttttcctgattcatcagtaatatttacaatataagcaccggtcaccagtcctttaaggtatactttctcatctgatgagccttcttttactgaaacattctgagtcataacattcttacctgccatatcaaagatattcagcttaacagtgccttttattttgttgccagcatgcacattaatgtaatgttcatcaactcttgtagggtaaatatcaagacctgcaaaagtgtttactattgaaggtttatcattcacaaaatatttacttgccagatcataaatatgaagcccttgctctcccggaagctgttttgcctgtaaagttgcaagatctacttcatagaatgcccctccttttgcacttgctattacaacttttccctgagcatttacagctgatccgtttacagaatagttatccggaatgcctgcaatcttacctataaatttagcttttaaatcttttgtcaggactttgaaaacatttcccgaagccgaaaaaatataaaaattattatctgcatctgctaccatatcccctccaaaaccagtttcaatagcggtaaatgaatttcgcccattagaagtatcatctttgatgattcccaaatcattcacaagatattgtccatcttttctgctgatttctaaaaattgcgttccggcattatttacagcataaattttaccgttatatccggttgccatcctggtaatatgagaatttatgtcacatgacgacactcttgccacattattttccaccaaagtgatttcttttgttttcgggtttaaaatatagatattcgaggaaaacataggcatgtacaccagattattattcgaagcatcatatgcaagcgcagctaatgttacagcctgtgaattgctgtaagaatttttgtcttctgttacaactcctctttttgtctgtgaaaacacttttgcagaagaatctgccgtaaaaagcttctcaccagaagttccgtttgtaccgtcaatagcacggaaatcattgaaagtaatactttgattgttttttccggtaatcgcaaagaaatcctgctgtgcttgtgcatttacacctaatagcagtaaaaataaagggaataaatgttttttcatattatatatttttagattcataatgaatttgatcttactaagttacgcaattttagaattctaaaaacaaaaatctcttgtaaatgaataaagttaattacaaattaaaatgtaccagctatcatcaagagtggggtatatcatttatttctgttgttcaacatgctgtgatgaacatcaggatgataaatgatgaatgataagttataaatgatttgacgggattcgggatacaggtttgctgttttggatttctgagatttgaactggaagtgataaaggtaattctattctcacttgtgtcattccgcaggaatccaggcttacttatcagagccttaaaggttcaagatgaatgatgaatgataaatgattaatgattaattataaaagcattgaatgcttaagtaatttagtgaaccattattgcttgaataaatggcttgtttagactcctacggagtgacaatagggatgtgatgaatgatgaatgttaagtgataagtgatggttgataattgatagttgattgctgtatcgtttatcatttatcaattattactcattactcatacgtccggtataaagcaaaaaaatcctttatcatttgataaaggatttttaaaaataaaataaaaactggcggcggcctactctcccgcgttagcagtaccatcggcgctggtgggcttaacttctgtgttcggaatgtgaacaggtgagccccaccgctaaaaccaccctaaagaaggtatacaaaccagacagattttgaagaaagtagggtaaaaatcaaagaccttcaccctacgcaagctaactcaaggtcgcttttataaatataaatgtataaaaaatatttggaagttaacacagaatctaaagccagcagagaatgtatttttgtaaacgggttaaaacccgtttctactgaatgtcttttctttttaaccgcagataacacagattgacacagattatgatatattttttatacatatatggaaactgtttttattttgtcgcgacttattacttattacttattacttattacttattacttattacttattacatccctgcttccctagccctgatagcaatggttaccccgcagctggagctggagcgcaggagagtttgagcgtgggagagcgctggcgcgaggagtatgaatggatagcaggaaatagctacataagaaagtgggaatatgggagtgtgggagtgtgggagagtttgagtgtgaaaaaggttaagagtattggtgaagagatataaaaaagaggaatatgaaattctgatggattttctgctgtatctaaaaaaaacattccgtaagaatcttagtaatagtaattcttacggaatggggataaaacgaagttatattctagttcagaacgtatgatgttccgtctcttccgtcttttaattcgattccttctgcaagtagtttgtccctgatctggtctgaaagctcgaagtttttggattttcttgcctggtttctcaattcgatcaagacttttagggtctgatcaagtttctcattgttattttcttctacggtctgtaaccctaaaacatcaaagataaaggcgttaagcgtagtttttaaatcctcaagatcagcagttgaaatcgtttctttaccatcattcaaagcaaagatgtattttaccgcttcaaacaggtgggcaatcaggattggtgaattgaagtcatcagttaaagcgtcatatgctttatttttccattcctgcagattgaatccggattgttttgtatcatccggagtaatagaattcaatactttcactgcttccattaatctgatgaatcctttttcactcgctatcatggcatcgtttgaaatatccagaacacttctgtagtgtgcctgcaggaagcagaaacgtactattgagggatggaatggtttttcaaagaagtcattatctcctgtaaccagctgcatcggaaggatatagtttcctgtagatttgctcatacgctgagaattcatcgtcagcatattggcatgcatccagtaattcaccggcgcagcatcattgcaagcttttccttgtgcaatttcacattcgtggtgaggaaacttaagatccattcctcctccatggatatcaaatgtttcaccaagatattttgtactcattgcagtacattcaaggtgccatcccgggaaaccttctccccaaggggaattccatctcataatgtgagctggagatgcttttttccataaggcaaaatcctgtgaatttttcttttctccttgtccgtcaaggtctctggtattggcaaaaagttcttctatattacgttttgaaagttcgccataattcaagcctcttttgttgtattctaatacatcgaagtatactgaaccgttactttcgtaggcaaaacctctttcaatcagtttttgagtcaattcgatctgttctacaatatgtccggtagctgtaggttcgatattcgggggtaacagattgaacatatccaataccttgtggaaatctacagtgtatttctgtacgatttccataggctccagtttctcaagtctggtctgcttaacgaacctgtcgttatctacattcccatcatcggtaaggtggcctgcatcagtaatatttcttacatatcttactttataccccaaatgcatcagggtacggtagataaaatcgaaggaaaggaaagttcttacatttcccaaatgcacattgctgtacaccgtaggtccgcagacatacattccgacatttccttccaagataggtttgaatatttctttttccgctgtaagggagttatatatttttaattgcatttattttaagttaaagatttaataattttaaagattcaaaattgagttaaaatacttttgtcacaacaaataattgtcgtgataaaaattttatctgaaacttttttaaattttatcataattaaaccgcttttaaatgatgctgcagatggtctacataatcattgataataaactccagcgtaaaaacctgaggtgttgttttggtagtatcacaggttctttgtaatgcttcatccggaatattttcaactacatgaacaatctgatagttcaaagatttccacagatcgataaggtctgtagtaggaacattctgatagttctgagctttcacccaaaagttttgatcataaacaatattctcgttctctttgtattgggtaacaacaaatctacggatatttgttaaagcactgtcacaaagatggccaataatttcttttttggaccatttttccggtgtactcttgtgattccattcctcttcagatatattttgaaatctctgaagttcagtatcaataatatttttgagaatctggtagttcattttttatcaatctagttttgcgtggcttcctacgtaatgcaagaattcctgtcttgtaatagggtttgttctgaaaataccacttaattctgctgtaattgtagaacttgcagtatcttttattcctctgcaattaacacagaggtgttttgcatcaatgatacaagctacatcttttgttcctaaagcttctttcaaagcgtctacaatctgcatggtaagtctttcctgaacctgaggcctttttgcatagtaatcaacaatcctgttaatttttgaaagaccaattacttccccattggaaatataagcaacatgagctcttcctatgatgggtaaaaagtggtgctcgcagaaagaatatacggtgatatctttctccaccaacatctggcggtatttatatttattggagaaagtggagatccctggtttgttttcaggaagaagtcctccaaaaatctcattcacatacattttggctacacgtcttggggaatctttcagagaatcatccgtcatatccaatcccagcgtttccataatctcgccaaaaagctcagtaattttttcaattttttcctgtggcgatttatcaaaagcatcttcccttataggcgtatgttcttttcctgtgaaaatatcatcgtcgttatcagtaaaatcaaccatttttatttaatttgcagcaaaaatacggataatatctgttcatctctattcaatgaggatgaaaaacattatcttttataaccagctctgattaaaaagcctatgattattgtcgaagaagtacaaaaccacctccataaaagggaatttctggaattcccggcccgcctttaccgggatgacaaaaattatatccggcctttagataagtatattgaggaaatttttgatcctaaaaagaataaattctttaaaaacggagaatgcaggaggtttctgtttaaaagggataataaaacagttggtaaagtggctgtttttatcaatagctgttatgagcaaaagcaacctaccggaggaattggttttttcgactgcatcaatgatcaggtaacagcgaatttcatttttgaccattgcaaaagctggcttcaggaaaaaggaatggaagcaatggacggccctattaattttggagaaagagataaattctggggacttttaattgaaggatttattgaacctttgtttgggatgaactacaatttcccttattacaaggatctttttgaaaattacggatttaagatttattttgaacagctttgttttaccaggccggtttttgcagaagtttcacggatttttactattgctcatgaaaagaacagaaggaatcctgcaatttctgcacaacctatgaaaaaaaataatctgccgaagtttgcaaaggattttacagaaatttataatagagcatgggcgtctcatggggaaggaaaacatctggaagaagtaaaggttctgaaaatgttcaatacgatgaaacctattatcaatgagcatatttcctggtttgtctatgaaaacgagaaacctattgcgatgtggatcaatattccggacctcaaccagtggtttaaatatctgaatggaaaattcggaattttggaaaaacttaaatttctgtttttaaagaggtttaagaaaaatgagaaaatggtgggacttgtttttggcgtcgttcctgaatggcagaagaaagggattgacggatacatgatctgggaaggaacccaacatttgagaaaacatacagactttacgattacagaattacagtggatcggtgattttaatcctaaaatgatcaagattgcggaaactcttgatacaacggttacccgaaagcttgcaacttaccggtatttgtttgacatgaataaagagtttgagagacatcctaatttatgataaataacaatattattttaattgaatagttgtatttttgaaagtaataaactaaataagccatatacaatgaaaaaaataattacaagtattttattagtattagccattgctctttctgcacaacagatgaccacattgagttatgatggatcaagattactaaatcatacattttatcagaatggagattcaagtggcaagggaatcagttatgatgacatacaaggaagtccgtactacgaaaaggtattttctcctgctaaatttattgttgctgacaaagctgaaactgctgtagcgcgctataatatgtactttgatgaagttgagttcaagaaggatgaagagacctattctctagttcccgacagcccttttaccagaattgaatttactcgaacaaaagaaatattggtaaaactagacacagatgatgatttgaaaggatatttctttgaattagtgaacggtaaaaacgcactttataaaaaagtaaagtctcaatttaataatgctgttgctgcaaaaaattcatacgaaatagacagacctgcaagctttaatactttagatcccgtttactatattaaaacagaatcaggatatattaaaaaaccaaaaaaaataaaagagattgctgaagcttttccagcaaagaaggaagagattgaaaagttcgcgaaatcaaataacatcaaaataaataaagaagaagacctcatcaaactggttaagtttttaaatcaataaaaaaataaacccctgtgaaaattcacaggggttccttcatttttggtacttctattagaatagctcaccggctacttttttaatattatcactttttcccattgaatagaaatgcagaacaggaactccgaagtccagtagttctttgcattgggtaatggcccattctattccgatctgttttactgcttcattattttttgcactttccacttcattaatcagttcttcaggtagatctattttgaatacctgtggcagaattttcaggtgtttttttgttgcaataggtttgattcccggaataattggaaccgttattcccatttctcttgctttctgaacgaattctatatactttttattgtcaaagaacatttgggtaacgatataatctgctccggcatctactttttgtttcagccatttaaggtcataattcattgaaggggcttccatatgtttttccggataaccggcaacaccgatgcagaatttattcaactcatcactgacctgttcttcgttatgaagatattttcctcttccgagatcattaatctggttaaccagatccatcgcactggcatgacctccctgggtaggctcaaagtactgatgtcctttcatcgcatcacctcttaaagccattacattgtctattcccagatacatacagtctaccaacagatattctgtttcttcttttgtgaatcctccacaaagaagatgtggaaccgtatctacattgtatttatgctgaatggccgcacaaattcctaaggttcccgggcgcattcttgtaatacggcgttccataaggccatttcctttgtcgatgtatatatactcttccctggatgtcgtaacgtcaatgaaaggtggtttgaattccattaacggatctatattcgtgtacagatcttcaatcccgattcctttctgtggcggaacaacttctaaagagaataaagtttttccatttgcatttttaatatgttctgttatcttcatgtcaatgttaatctgctaaattgggtgacaaccatttttttgcttcctggatgctacagcctcttcttgctgcataatcttcaagctggtcttctgtaatttttcctaatccgaaatatttggcatgtggacttccgaaataatatccggaaacagatgctgtcgggaacatcgcaaggctttctgtaaggaaaacacctgtattttcttctacttttaaaagttcccatattgttttcttttccaggtgatccggacaagccggatatcccggtgccggacggattcctttatatttttcggcaataagctcttcgttgcttaagttttcctgattggcatatccccagtattctgttctgacttttttgtgtaagaattcggcatatgcttctgcaaaacggtcagctaaagcttttaccatgatggaattgtaatcatcatttgctttttcatattcagcggacagttcatcggttccaaaacctgttgttacacagaatgctcccacgtaatcagtttttcccgagctttgaggagcaatgaaatcacttaatgccagatagtcttttccttttgatctttgagcctgctgtcttaaggttaaaaatttcgcctgttcgttattgttttcgtcaaaaatcaaaatatcatcagaatcattggaattggctttaaagattccgaagatagcctttgctgtcaataatttttcatccagaattcttttcagaatcacctgagcatccttaaataattctttggcctgaacacccacaatctcatcttcgagaatattcgggtatttcccgtgcagatcccagcttctgaaaaacggagaccagtcaataaaaggaaccagttcattcagatcctgattttcgattatttgtattcctaaattattcggagtgaagatttcttcgttttcccaatcaattttaaaacggttttctcttgcctctccgatcgaaacataatctttatctacctgtctgttcaggaacttctctctgaattcagagtagtcattctttaaatccgaaacatattctttatttctgtctcctagcaatgcgctcaccacatttacagctcttgaagcatcattcacatgaacgacagcatttttatatttcaaatcgattttcacggccgtatgtgcctttgacgttgtagcaccgccgattaatagaggaaaatccaaattttgtctttctaattctgaagcgatgtacaccatttcatccaaactaggggtaatcagtccgcttagcccaataacgtctactttttcttcaatagcagtctggataatcttttcggcaggcaccattactccaaggtcgacaatttcatagttgttgcaacccaaaacaacgcttacaatatttttaccgatatcatgaacgtctccttttactgttgccattaatatttttccgttggcaggttttgttccgtctttttctgcttcaataaaaggctgtaaataagccaccgcttttttcattacccttgctgactttaccacctgtggaagaaacatttttccgcttccgaataaatctcctacaactcccattcctgtcatcagattcacttcaataacgtgaaggggtctttcagccaacagccttgcctcttctacatcttcttcaataaaacgatcgattccttttaccaaagcatgagtaatcctttcctgcaacggattatttctccactctaagtcttcagtcttttcttttttaacggatttatgcttttcggaataatcaagaagcctttctgttgcatcatctcttctatccaggattacatcttctaccagctccagcaattctttattgatttcatcataaacttccagcatggccgggtttacaatacctatattcattcctgcctgaatggcgtgataaagaaacacagagtgcattgcttctcttacggcatcatttccgcggaaagagaaagaaacattgctcactcccccacttacagaagcataaggaaggttttgtcttacccagcgtgtggcttcaataaagtcaatagcatttctcctgtgctcttccattccggttgctacagggaagatattcaagtcgaaaatgatatcttcggcaggaaaaccaatctgatttaccagaatgtcataggatctttttgagatttcaattcttcgctcaaggttgtccgcttgtcccacctcatcaaatgccattacaatgactgccgctccgtatcttttaatggctttggcgtgcttgataaattcttcctctccttcctttaaactgatagaatttactacgcactttccctgagctacctgaaggcctgcttcaagaatttcccatttggaggaatctaccataatcgggattcttgcgatatccggttcagaggcaattaagttcaggaatttgatcatggaagcttttccatcaatcaatccatcatcaaagttcacgtccaggatctgggcgcctccttctacctgatggcgggcaatatctaatgcttcggagaatttctcctctttgatgagtcttaaaaactttttggatccggcaacgttcgtcctttcaccaacattgatgaaattactctccggtgttatgataagaggctcaaggcctgataatcttaaatacttcattttattcttctaaaatatagtaggcattattggcattctgcctcaataaatccctatgcttacttaaagctgtaatcagtggaaatctcttgtacgctaaattgtgttctttagcaaattcctcaatttcctcagtaatttcattataatacatataactgtagtttggaaacagatgatgggccacatgaaaattaaagtttcccaatacatttcttacaaaccagttattttctgttaaatcattggtcacctccaattggtgacgaagccagctgaacggaaggccgttctctttatttaacctcggaaaggcattatcaggaagcggatgcaaaggcaacagcacaaacaaggcaaaaatgcttgctgaaatcacctgtaaaaaccacgctcctaaagccagtcctattgatactttaaagaacacaataggcaccacaatctgataaaagaaatagaacagcttataactcaccattttcactttttcaacaaccggtattcttccctgggtttttaaaatcactctttccttatcaaagaaatcccgaaagtctcttataaacatccaattgaacaaatacaacggatatactagaaagaaaaacttatgctgatacttctgaattccttttgccttgatccatggaacgatcaggagcaatccgctctgttcgatatctgtatcccatccatctacatttgggtaagcatgatgacttgcgatatgtctttttttccagatataggaattggctcctataaaatcaaaaatgtggagaactaaggcattcagttttttacttttatagatgttgttatgggctgcttcgtggattaagtttaaataaattaaaaccagagaaatgcccattaaaacaaaactcagaatatagacccaatgtttttcagctttcaaaacagccagaaaatataagccaatataaaccaatgggagtattaccgctttgatctgaatatagatatccctgttttcaggaatggcttctactcttttgttcactttctttctaagctcattaaataatctgacatcttccgaatcttttaaataaattggcttttccatatatttaactttgtggtttacttaaagttaacatttataatccagccttcattcttgattttaattaaaaaaatctatcaaatcacacaaattccttcaatttcctcggtggataatctttcaccagctctgcaattgctttaatatgttcaggcgttgttccgcagcatcctccgataatattgatcaatcctttttccacatattccctgatctgtctcgccatatcttcgggtgtttcatcatattttccgaaagcatttggtaagccggcattcggatatgctgaaacatagaattctgaattatgggccagtgtttcaagataaggagtaagctgatctgctcccaatgcacagttaaaacctacgctgagtaaattcaggtgtgaaacagaaatcagaaaagcttctgccgtctgtccgctcaatgttcttcctgaagcatcggtaatggttcctgaaaccatgatgggaattttaattcctctttcatcctgtaattcatcaatggcaaacaaagctgcttttgcattcaaggtatcaaagatggtttctaccagaaggatatctgaacctccatccagtaacgcttcacattgttgtttgtatgctactcttaattcttcaaaagtaatagctctgtatccgggatcatttacatcaggacttaaacttgctgttctgttcgtaggcccgatagatcctgccacaaatctcggtttgtccggattttttgctgtatattcatcacaggcttttctggcaatctttgccgactcatagttcagttcatataccagatcttccatatgataatctgccatcgcaatggtagtccctgaaaacgtattggtctcaataatgtctgcccctgcttcaagatatttcttgtgaacttcttcaatggcctgaggctgtgtcagagaaagcaggtcattgtttccttttaccggatgttcccaatctttgaaacgctctccgcggtaatcttcttcttcaaacttatacctctgaagcatcgttcccatagcaccgtcaagaattaaaattctttcggatagagctttatataattgttctgaatttttcatttttaaatgtctgattaaattctgtttctattgaattaatccaacgcctgcttaaggtccgcaatgatatcctctacattttccaaccctacagagcaacgtactaatcctgctgtaatacctacttcattcctttcttcatctgataatttggaatgcgttgtagaagccgggtgcgtaacgatcgttcttgtatcacctaaattggcagacagtgaacacatttgtatcctatctaaaaagtttcttcctccttctattccaccttttatttcaaaggctacgatgtttccaccaagtttcatttgtcttttggctacttcatagcttggatgggatttaagaaatgggtattttactaactctacattcggatggttctctaagaactctgctaccttcaatgcattctcgcagtgtttttctacgcggattgccaatgtttctaaactttttgataatacccaggcattaaaaggagacaatgcaggtcctgtatttcttgcaaaaagatagatttctctgatcagttcttcttttcctacggctattcctcctagtactcttccctgtccgtcaatcagctttgttgctgagtgtacaacaatatctgcaccatatttgatgggctgctgaagataaggtgttgcaaaacagttatctacaataaatataagattatgctttttggcgatctgaccgaaaaactcaagatccaggatttcaattgccggattggtaggtgtttcaaggtataagatctttgtattaggcttgatatattgttcaacattcgctgcatcttctgctttgaaataagaggtttcaatattccatttcgggaaatatttggtaaacaaagtatgggtagacccgaaaaccgactggcagcttacgatatgatccccagcatttaacaaagctgcaaatgtagaatagatggctgccattcctgtcgcaaatgcatatcctgcttctgcaccttccattttagcaatcttatctgtaaattctgttacattaggattggaaaaacggctgtataaatttttaggtttttcttctgcaaagcttgctctcatatcttccgcatcctgaaatataaagctggaggttagatataatggcgtagaatgttcatcaaactgggttctttcagtctgggttcttattgctgatgtttcgaaattttccatatagttttaattaatttaccaatataacagtctaacaatataacaatgagattcttcgctttgctcagaatgacaattgtagtaactgttacactgctaaactggtagattgttacattaaatattatttagtttcacttactcttaaaatatctccaaatacccctctggcagttacctgtgctccggctccggctcccatgataacgatcggattttctccgtaactttctgtataaatttcaaagattgaatctgaacctttcagctgtcctaatgcagaagttgcaggtacagaaaccagttttacatccaactcacctttatctttctgcaaatcgccatgtaaatcgcctacatacctcagcacatgtccaggctcttggttttctttaattttctggtattcttcgtccagctcttcaagtctggaaaggaattctgattttgaaacctcaagtaagctttccggaacaagattttgaatactgatatcttcgaattcattgatcagatccaattctctggcgaggatcagtaattttcttgccacatcatttcctgacagatcttctctcggatccggttctgtatatcccttttccagagcttcattgatgatggttgaaaatttatcgtccctcaaagaaaaattgttgaaaacatagcttaatgttccggagaacactcctttaattctggtgatattctctcctgaaaggtgcaataatttaatagtatcaattaatggtaatccagcaccaacattggtttcatacagataacgtctgttatttttgttcaacgtatatcttagttttctgtactcttctatcggaagggtattgaaaattttattggaagaaacgagatcaaatccgttttctgccagggcatgatagtttttaacaaaatccttgcttgccgtgttatccacaacaatcagattttccagttgattttcgttggaaaagttgatcagttcttcaacgttagacggatgctctgcggttaatacctcatctccccaattggtatcaaacccctttttgttgaaggcaattttctttgagttggctaccgcaactactttaaggtctatttttttacgttttttaatttcttctgcagattccagaacctgctctatcaatgtttttcctacgtttccgtgaccaataatagccagatgaacggtctttggttttttgaaaatttcagattctatgatatttcttgttttttcatcctgtgaagaagtcactacgatattgactctgttctctcctgccacctgattcaaaagcaacggaaaaacattgtttcttgccagctcagcaaagactttattgaaatcttctgctacaaagccaatcacagaaacattattgatactatagatctgggaaactttccctgactttctttccgcttcaaattcatcgataagacaagcgactgctttctctgcatcattttcatgaaccagaatggaaattccgttttctaccgcctgttgagagattactcctacactgatacgcgctaaggtaagcgctttaaaaattcgtccgtcaataccgatttctcctaagaaatcttctccttcaaatttgacgattgatctgttcttcaaaaattttatttcgttagcatttttcatttttcctgtaaaatgttttttatgatattatttaattgttgatattccattaggaaggcatcatgcccgtgtatagattggatctcgtgataagaaacatccttatttttctcttttaagttttcaaaacacatccggatttcagaagccgggaaaaataagtctgaatctacagagatcatgcgcattcgtgcctgtatattctccagtgctgtttcatcagcatttatattcatcaggagatgattcatcagttggtaagcttttaaactaaacctttcgtttagagcattaccatgataaatcagccagtcttctgattccaggcgttgtttttcctggttatattggttttgaaatctgtcattgagtgactgcggtgttctgtaacacaacatggcatgaattctcgctttttgtaatggttcttctttatcatttaacaagaatttctgaaccagacattgcgcatgaagccaatcgtgtgttctgtaatcgcaggcaatgggaataaatatctctgcaagatccggctgctgggcaagcatttcccaggcaattcctcctcccagagagcctccgataatggcatatagttttttgatctgcaaagcttcaagccctttcaggaatatcgcagcgatatctgaaggggtaaagtcttcatagtcttcaattaaaaaattgtcataaccgtttccgggtatgttgaaacacagaactgtgtattgatcggtatcaacaatctgattttctcctaccagctgcttccaccagcctttatctccggatacattcgagtttccggtaagagcgtgattgattaaaatgacaggtgctgtaaacagatctttcccaaaaagctgatagcttaacgggatatggtattccttttgggaatttgtttgatacgtaagattaatatagtttagttctgttttcaattctattatatttaaatacaattgaaaatgccacaggaaatggctgaaaagaacttcagtaagttatctgtccaaaattattttggtagaacgtagcaccttctttacttgcgcaaagggttgctaaggtttcacagggtctaatccctcaacctttcttgataacattttcaatatttgaatgaacgaatggtgcaaaggtagttcttttcttttaaattcaaaaaaaaattattttaatatttaaaagagctcttaaataaaggcgtttcaaggtcatattaataattattcagatgaaaaaaattggaattacttttcaaaaaaactaacttcgtatggaaaaatgatgacatatgaccgccgaaaaagaaagattacaagataccaaatggaaaaactggggaccttatgtaagcaaccggcagtggggaaatgtacgcgaagattatagcccgaacgggaatgcctggaattttaccaatcataataatgcagaaagctatgcttaccgctggggcgaagaaggtattgccggaatttctgatgtaaagcagcttttatgttttgctttttcattctggaacaaaaaggataaaatggtaaaagaaaggttcttcggattgagcaatcctcagggaaatcatggagaagatatcaaagaaatcttttattatctggataatacacctactcatagctatatgaagatggtatataaatatccgatcaatgagtttccgtatgatgatattcttagtgagaatggaaaacgcagcaaaaaggaacctgaatatgagcttttcgataccgggatttttgataacgatgagtatttcgatattttcattgaatactgtaaggcagatcataatgatattctgaccagagtgacagtctgcaaccgaagccagcatgaagctcctatcgtggtggctccaacggcatggttcagaaacaactggaaatggggatataatacctacaaggcagagctgagtgcttctcaggatggaagtattaccattggccacgacagtatttcaattaaaaaactgtattccagaaatacaaatgcacaaagtgtattctgtgaaaacgaaacaaatactccaaaactttacggtactcctaaaacagagaatacttattttaaagacggaatcaatgattttataattcacggacgagatactgtaaatcccgaaaaaagaggaaccaaagcatcttttctcattgatgaagttatagcagcaggtgaatcaaaagtttttgaattcagattatgtcctgaagaaaacgatgaaccttttgaaagctttgatgaaattttcaatgcccgaaaggccgaagctgaagagttttatcaggaaattcagagtgataccgtgaatgaagatgaaagaaatgttcagcgacaggcatttgccggacttctctggaacaaacagttctatcattataatatcgggaaatggctgaaaggtgatccgaactttgaagcgccaagaaacttcagtgaatatgtaagaaatacggaatggaatcatcttcataataaagatattatttctatgcccgacaaatgggaatatccgtggtatgccacatgggatcttgcatttcactgcgttccattttccatcatcgatgcagagtttgcgaaaggacagttgttattacttactaaagaatggtatatgcaccctaacggacagcttcccgcttatgaatggaatatgagtgacgtgaatccacccgtgcatgcatggtcatgcttccgtgtttttaagatagatgaaaagaacaatggaaagcccgatttattattcttagagaaagttttccagaagctgctgcttaattttacatggtgggtgaaccgaaaggataaaaatggtaagaatatttttggcggaggtttccttggtctcgataatatcggagcttttgaccgtaacatggttttaaaggacggccagcatcttgaacaggcagacggaaccagctggatggccatgtatgcattgaatatgatgcgtattgcgatggaacttgcccagtattatcaagtgtatgaagatatggcgatcaagttttttgaacattatctttacatcgctgaagccatggaaaatctgggtgaaggaacgaaaggtctgtggaatgaggaagacggattcttttatgatgtattgcaacttggaaacggagacagcgtttctttgaggttaagaagtattgttggtttgattccaatgtttgccgttgagattgtagaccaccgtttactggaaaagatgccgaatttcagaagcagaatggaatggatcttaaaaaataagccggagcttaccaagcttgtttctcattgggatgaagaaggacatggaagaaagcatctgatgagcatcctccgcaagaacagactgaccaaagttctgaccagaatgcttgacgaaaaagaatttttaagtacttatggaatccgtgccatgtctaaggtatacgaagaaaatccgtttgtattttctgtgcatggaacggaaaacatggtctattatactccggcagaaagtgacagccgtatgttcggcggaaacagcaactggcgtggtcccatctggtttcctatcaactttctgattgttgaaagtctgcagcgattccattattattatggaaacagtctgaaagtagagttcccgacaggtagcggagataagagaaaccttgatgaagtagctcaaaacatcagcaaaagactttgttctatatttttaaaggatgaaaatggaaaaagagcgttcaatggagataatccaaaattcaattacgatgaacatttcagagattatattacattctttgaatatttccatggagataacggccggggcgttggagcttcccaccaaaccggttggactgctactgtagccaaactgataaagccaagactcaccttttagatgagtaataaataatcagtaatgagtaataaaaaggccggatgaatcatccggctttctatatttttaagtaagagattaaattttttctccgttcacatagacttcgtatccgatttctacattcggttccagagtttttgacactgaacaatatttttcaaaagaaagttctgcagcctttagtgcttttttaggatcaatttctccttccaaaagaaatttaacattaattgatttaaaaggttttgcatcttctatctgtactctttctccttctacctctgcctgaaaacttttgatctcctgacgctgcttctttaaaatggaaactacatcaattccgctacatcccgctactgccatcagtacactttccataggagaaactccttttgctcccggctgggaagtattatccaaaagaatagaatttccctgagcattggtacattcaaataaaaaatcgtcgtttattctgttaagtgtaattttcattatgtattgcttattgcttctgcaaagttataaaattcctctcgcttttatctccagatatttattgataacatcaatattcaaattttccggaagggtataaacggtataaattccgtatttacggagttcctggataatcagtttcttttcaaactcaaatttttcagcaataatttcatcatagatttgctgcatattttcaggatttttgttgatcagtgtctgcaattctgaatttttgaagaaaacaacgaccagcaaatggtttttagcaattccacggagatatttcaattggcggttcaatccatccaatgtctcaaaattggtaaaaagcagaatcaagcttctttgattgatagaatattttacatcctgatacaaacggttaaaatcactttcaaaaaaatctgttttaatattataaagagcttcggagattttcttcagttggccggacttattatcggcagcaattttattttcagctttcttggaaaaggtcatcattccggctctgtctccctttctcaaaataatatgagacaacgccattgttgcattaatggaataatccagcagacttaatccgttgaaaggcattttcatggttcttcctttatcaatcagcataaaaatacgctgtgacttctcatcctgaaactggttgaccataagacggtttgttttcgaagtggctttccagttgatcgtcctgatatcgtctccgggaacatattctttgatctgctcaaattccatggtatgtcccagctttctgactttcttgattccgcctaataaaaattcactctgaatagccatcagttcatattttctgagatggataaaagacggataagaaggcagcatagcatccttctggaaaataaatctttttgagatgaatcccaatggtgatgatgcatagacattcagacctccgaaatgatattcacccctttctttaggctctaatgaatattgaaaaaaggtatttgctccggaagcgatctgttttttgatcaggaaatctcttttctgaaactgaaacggaatttcatcaataatcttagtggatatggtaaagctataattatttttgatgtcaatttttacaaaattctcatctccgttggacagtttttcaggcaaaattctttgcacctgtaaggcgttcttttgattaaaaagcagcagaaaatctaccattgctgccagaaaacaaatcaacagtgtaatatgggcaacccacatcaacaccggaaagaaaaatgccagaacatacagtatccccactccaacgagcgtaaaaaagaaacgggtattgatgtataagtttttcattatttaaggattaggatttaggacaaagggatcaggtattactactcatccacttccctctactaacctatctaggtatttctattccttctaaaatctgacggataatttcatctgctgtaaggccttccatttctctttcaggagatacaattactctgtgtcgcagaactgcgtaacaagactctttgatatcttcaggagttacaaaatctcttcctctaatggctgcaaatgcttttgaagccgtaagaagcgccaatgaagctctcggagaagcaccaagatataaaaattggttttctctggtgttaatgataattttagcaatatattccatcaactgggcttccacaatgatttcttttaccagatgctgataattttttaattgttcagcggtgataacacggtgtatgccttctgttttatcttcttttttactttcgtgctgatttttaataatggcgatttcctgctcaagattagggtaacctacattaattttgaacagaaaacggtccagctgagcctccggaagacggtatgttccttcatgttcaatggggttttgtgttgctatcaccagaaaaggttcttccattgtatagcgtgtgccatccattgtgatctgtctttcttccattacctcaaataatgctgactgggtttttgccggcgatctgttaatttcatcaatcaggataaagttggaaaagacaggtccttttttaaattcaaattctgaatttttcacattaaatacagatgttcccaggatatcagaaggcatcaggtccggcgtaaactgaattctgctgaagccaacatcgatggtcttagccaataattttgctgtaattgtcttggctacccccggaacaccttcaatcagaacgtgtccgtttgaaagtaaagcagccaaaagatgttcaatcatcttctcctgtcctacaattacttttccgatctcagattttactttttctaagcttgcgcgaagctctatcatatcaattctcgactggaactgctcttcctgtttattaaggtctatcgagccttggttttctatattggggttatcaaagttttccataataagtttttatttaccaatctagcaatgtatcaatataacaattattgagaaactgctatcacttcatattattattattttgttgtattatctaagtatttcatcaagaagcttattaatccttgttagatcttccttcattacactggcatagggatcctgagcttttttaataagcattattgcctcattgatcatctccatggttttaccggttttcagttgtaattttttagcaaattcctcgtccagatgctgagtgtcaatcaacagatccattctcactttattcagaaaatactgagctttttttgccatcatatcatgaaaatcaccttcctgaagataaagatttccaatgctttttacaaaatccagggaagtatttcttaatggctccgttacaggtactatcctctgttttcttttggcattaaagaaaataaaaagcacaagacctcctaaaaacacccaccatgcatattttaaagccggatttgacaatacaaaccgcataaagaaacgtgatgttgaacttttatttgaaacgaaccaaagcgtttctctatccggaagataggagaatacatcctgtgcgtattttgcatttcccggtttcagcagataataattagtcagaaaaagtggttctgtgtgtgcatagatatttccttttccaaacttaactttaataaagttggcctgatccgtattctttttctccacagttttcccaagtacttctactttaggcttgatgaatgaaaatccccttcctgacggaaatttatccagcttaataaaatcattctgaaattttttgtcggtaagcttcagaacattttcttcttcaaaagagatttccgaatcataatatccaatactgtctgaaacttctttcggcattcgggttaccatcagaaaggcatctgaaccttcggatacctgggtaaggatttttttccacgattcgccgtcaaggttgttttcaataacaataatattgtgaacaccttttttatgctggctgtaatattcataaggagcctgctctacttttttcagattattcttaaaaagatatttggcttcattattaaagacaaacagtccgaacggtgacttttcattgagatcaaaattcttccgccagtctgttgtttcttttttgttaacttcaagcaatgccagaataatcatcacaatgatgaaaattgcagcatatgttttgaaagttttattcatggttactgttgttatggtttaaatgcctgatattgctttttaaatttctgatagctctcttcttcaatactgaattcgccataccagacataatcaaaaatataagacaggtttgaaaaatcgtttttcagatgaggagtttttaactctgcggaataatctttatttgtcttttcaggattccagctgatcagttttttgtcgctcagctttttaagaataaacaggaactgataacgtattgcagaacggtaatctcctgacagctcaaattgggcaatactttccgggaaattgatctcatggatattctcatgaagctcctgcacattgatatccagttttttattctttttaccgaaaataaaattcccgtcctttcccatgatgtatttaatgatgaaatacagcaggaagcctaccagaataattgcaaaaaggcggataagaatggtagtgaattctgcagacttagtcatagctgtttcaccaaaaatcccctggataatctggttgatttttctcatcagcttttgaaagaaagattctctcggttttgacaccgaataatcgaactcatttcctttatatcttgaaggaatattgtctttaaaagtcttcggataaacctcattctccgataccggatttttcatcaatacagagtctgcacgcagcatatttctgtaatgcccggttgtatataaagaatctaccagatcatcagaagtatcatcctgagcatgaaccagcccagaagaaaagaaaagcagtaagaaaaaaagaattctattcattgattccgatagtgtctatttccgcaagttctactttctggtgaagatctgttctgctgtcataatacatcaatcccgcattaacatacatcagattggaaagaaaaaaagaaagcagcattgaaattccatagaatacaaaaaacaagatgcctgcagttcctgtaaaaggattctgttcaaagtttccatccggtgtagtggtaagaagagatccgtaaaaaaacattatcggaatgaatgtaaaaattgacgtgatcatgtaaataataatgaacatgacaaatgcagctccccagtatttccagtagggagatttttcactgccattcggataggaaaactgcgatcttaaagcatagctcaagcttccccaaaaacctctgtccgaattaaagtaatcatacatcagaaatgtagtgaaattaaatattgtgggataaagaagcagtatcaaaaaaaatccgataataataaaaatcagaatataagaaaagcctaacacaaataaaattgccggtgtgacgataaagatcattccaaggcataatttagctattctcccggcattgttcttaaaatcactcagaatttcatctgtttttatcttttctgctccctgtgcaattctttttaaataaaaaaccggatacaggtaattcacgatcattaaaaccatgaaaagaaggaaagtcagtaatccgaccgtaatcagcattccggaattttctgaaaaatactgttcaaaataataggtttcaccacccagattagatccgaatatctgggaaaaaagctctttatacccgaaaatcacaacagtgaccattaagatcaaaagcaaaccattaatcaggatgtagtttttaaagtaattcttaccgtataatttgaaaaaattgaagctatcacttataaaagttccaaaatctctttttttataaaattgtatcattgatcagtttattagtttttttgtaaacaacagacggatatacaaaatagtagtatccaataattgccagtgagccaaaaataatgataaggttcaaaattaaaggcatcttcaatgcgtgtctggtgacatatccttctataattcctgcacagatagtgaaaggaaccgtactcaaaaatattttaaatgaatctttaaatccttttttaaaagaattaaaccttgaaaaggttcttggaaataaaatagaggctcccagaatcaatccacacatggcttccaccaccatggcaaaaatttcaaaaaccccgtgaagccaaattcccctggcactgtctttcaaagctccataatcatagaaaaagtattgaaaagctcccagcatgacactgttcgagagcagagcatataacgtccctactccacccgcaattccgtaaatatataactttgcacctacctgaatattattaaatataatcccgatggtacttccccatgtacttccattctgataaacccctacagcattattacttttaatattttcaatggtttcattcacatatccttcgcccagaatgatattgacaaagtctttatcataaactgcagaaagaacaccaattaaagtaaataatatgaaaaagagaaaggcatacataagatatctccggtaatggtatatcagcagcggaacttcagttttgaaaaagtaaaccagcctgttctcttctacccttttggttttataaatcttctgaaaaatctgtgcagacaaatgattcaggtaaactgttgtgttacttttgggataataggtctgggcaaaagaaagatcattgatcaggtttatatacaacgaagacaggtcatcaggattttttttaattttcccttgaataacctgttctattcccaaccatttttctttattttgtttaatgaaataaacttctctcataattgttaaggctaaaataataaaaaatatgtctcaaatcgcgataaatacctcacaaaatgtaaatattaattttaatattgcaggtgtaggagaaaggatgctcgccttcattattgatcttctgatcaggattgcctatgtaatgatcatcctgtatctgttcttcaatattttcgatctgggatatttattagatggccttgatgagtggtctgtaagagctgtatatcttattcttacatttcctatctacatttatcctcttgtcctggaaagccttatggaaggccagactcccggcaaaaagctcatgaaaatcaaagtagtgaagattgacggttaccaggcaagttttgcggattatatgattcgctggatattcagaattgttgatgtttcctttgctggagtggtaggacttatctctatgattgtttctaaaaacaatcagcgtttaggggacattgcttccggaacagctgttatttctctaaaaaacaacattaatatctctcataccattttagaaaatatccacgaagattacattccttccttcccgcaggttattgccctgagtgataatgatatgagaatcatcaaagataattacactaaagcattgaaagccgatgaccgccagatcatcagtaaactgtctgataaaatcaaaagtattctgaagctggaaatagatcctacaaaaatgacggaaaggcagttcatcggtataattatcaaagattataattattatacgggaaaagataattaggtaggtcaatggtcaattttgcttcgcaagtgaatggtcaatttgaaaagtattaagcgagatttatagcaacacttattgcttattgcttatgcaaaggtcggttcaatttttgtatattaaccataaagttcagaatcatgaaatttgaaaacaataaatccggaaacggcggagttcttactttaaataacgaaataaaagaagtcggcagacttacctacactattttccctgaagaccacaaactgattatctcttttgtattggtacatccggaatttgaaggcaggggaatgggaaaatttttagtggaagaagctatcagatttgccagagaaaacaattggaaagtatatccacactgttcgtatgcaagatctgtgatgatgagaatgagtgatgtggacgatatctttttaaagaattaaaacttcattgaccaggatatcttcaatatcatccggataatccactttaagatgatgatcagaagctacccattccataatttcattaagatttaaaactttggaattcgggattcccatttgatcaagggcacatgcgttacattcctgttcatattggttatgaataggaattacaaacaattttttgtccataaataatgcttctgcaggagtctcgaaacctgcattacacaaaattccgtcacagccttcaaaatacttcagatactgcatttcatcaattggaaatacctccacattttttactttaacctgtactgtgctgtattttgaaaagactttccattctacaggaatttttcttaatactttaatgatgttttcatccgcaaaactcggaagataaacaagataatatccctgtttataaggattaagatttcttatttttcttctgatcacaggctttttgatctgtggatgataattttcaaaatgaaaccctatttttctttcactgggaacataatattttaaaatcatttctcccagaaagtctcttttctttggttttggtgttttcggaaagctcatggaagcctgatggctgagttctatcatgggaagcttcttaagcttggaagcccatcctgtcaaaggttcataatcattgatgattaaatcatactgtgaaagctccaattctctgattgtttttgcagcttcaataaatttattctctgtaaacgttttccgataggataaaccgcctgttttattataaagtaaggaaatacctctgtactggaaatcaatatcaaaatcagcttttaactgcgattggtgtccactgatcaatgtatcaaccgatgcatgctttttgaggagaggaattatttcctgcgctctggccacatgtccgtttccggtaccctggaatgcatataaaatcttcatctaagagaaattcgttacgatttttaaaagtgcagaattatccatttcaggaatttcttccacttcatcatctttcagcaaatgtttatgctcgtcataataaaaaatcttccattctttatcataatattccaaagcagagagattttcaatccagtcacccgaattcagataagtacatgatccttttttagtaacaacctcccggatttgcggctggtgaatatgtccgcaaacaacatagtcataatgattatcaatagccaattcagaagctgtgagttcaaaatcgccgatgtattttactgcttttttcacattgttcttgatctttttagaaaatgaatacttctccttccccatcttctctaagaaccaatttacaacattattgataataattaatagatcgtagccttttccgccaagtttggcaatccattttgaatgctggactgatgcatcgaaaacatcgccgtgaaaaatccaggtttttttctgatcgatattcagacagattttgttacagactttaagctttcccagttcaaaatctgtgaacttacggaacatttcatcatgattgcctgtaatgtaatagacatctgtgtttttggtagcgaatgaaagtatctttctgattactttcaagtgaggtttagggaagtaagactttttaaactgccagatatcaataatatcaccgtttaaaactaaagttttaggctgtatagaattgagatatctcaacagttctttagccttacatccataagttcccaaatgaacatccgatataacaactaattcaacgtttcttttcatagttttatacaaagaaactaattgaaagttaactatatatgaatgctatattattttttataaagagttcatcagctcttctgtgatttccatgttgtggtaaacgttttgcacatcatcgtcctcttcaaaacgctcaagcattttcatattcgctttgaactgttctgcgtttacttcttttgtattgtttggaattctttgtaattctgcactctttgcttcaatcccaagctcatccagtttgtgagacagagaaccgaaatcttcaaaagctgttgtaatcattacttcttcttcatctttttccacatcttctgctcctccgtcaatcatttccatttcaaaatcatcccaatccattttgatctgtgcaagatcgattgtgaaaattccttttctatcaaaaataaatgccagctcaccatttttccccaggttaccatcaaacttattgaaaaccgctcttacgttcgcaacagttcttgttgtattgtttgtagtacattctacaaaaaaagcaacaccaccctgcccgtagccttcgtaagtgatttcttcatagttttctgcgtctgcaccacttgcttttttaattgctctttctacgttatccttaggcatattggcaccttttgcattctggatacatcttctcaatgccgggttagattccggatcaggtccgccagcctttacagccaatgcaatatcttttcctattttagagaatgttttggccattttatcccatctggccattttagaagcttttctatattcaaatgctcttcccattttaattttttaatttacagcaaaattacttaaaagtcaacaaaaaaaaaatacctccaaaaaattggaggtattcattatttagaaaaattaattattttttctttttagcagcagcttttttcttagctggagcttttttagtagcctttttagtagcttttttcgctggagctacaacatcagatttctgatatttgttccactcactgtcatcaccaatgtatctaacagttacttttctatcagattgtctttcagcgtcagatgcagattctgcaactttagcattttgctctccaataccgattgatttcaatacgttagtatctacacctctcgcatctaaagcagcaactacagaagcagctctttctttagataacttcaagttgtaagcatcacttccttttttgtcagtttcaccaactagtaggaatctacctccatctttcttaatgatttcagcagctgtatctaaagctcctttagattcaggcttgattgtagctttgttgaaatcgaagtatacgctcttaaggtttttctcaacatcagtagctgttacttcttttggtttaggacatccgttgtattctggaagacctggaacagtaggacaagcatcatctttatctaggataccgtcaccgtctgtatctggccaaggacaaccgttgttttcagcaggacctgctactgtaggacaagcatcatctttgtcgattacaccgtcaccgtcagtatctggccaagggcatccgttgttttcaactggaccagccacatctggacattgatcgtctttatctggaactccgtcaccgtcagtatcaggacatccttggaattctggtaaacctggagtatctggacaaagatcatctttatctaggataccatccttatctctatctctgtttccaaatctgaataagatggaagcagaagcttgccagaagttagcaacagtagatttgtcacctggagttgatacgtaatctccctgaataccaagaccgaagttcttagttacccagaagttagcaccagcacctgtagctacagtgaagtggttagctttaccgttttcgttaccatccttaccgtttgttacagtttcgattgggttaccgttagcatcaacagatgttctagggaaagtaagagctgtatagtcatgtcttaagtagttagcaccaactcttaaatatggatcaaaccaagattcttcgttccataaaagacctgcagcgtgagcctggaaaccaagacctgtcattaggaaaaattctttccccatgttgaatcttttgttttcaacatttccaacagaagtttgccagtcaattactaaacctttaccaatgtttctagcaactgttaacttagatagtggaggtgtaatagaaaagttgttcacattgaacatactttttgtcaaattgttagcagagaacgtattactgaagttacttcttgctgctacgtggttttcagcgtgagcaccaactccgatcaaccacggattgttggtagtctgcgcgaaaacagtagaggcaacagtaagcgccaatgctgaaattcctaattttagatttttcatagaattaaatgattaaataattgataatgcaaaataaatataatttttctttatatacaaagtttttcaaatgatttttaacttttctttaatattctgtccaggttccgtttattttctctatcttttatcgcctctcttttatcgaaaagctttttccctctacccagcgctatcagcacctttgctttacctcgatcagtgatatataattttaaaggtatgatggtgttcccggcatcctttaactttttttcaagtttttgtaattcttttttgtgcaagagcaatttccgttccctttttgttttatggttgtaaaaagttcctaatttatactcatcaatcatcatgttgatgatgtacaattccccatcaataaactgacagaacgattctgtgatagatgctttggatgaacgtaaagattttatttctgtacccgtcaaaaccattccggcttcgtattcttccagaatttcatattcaaaacgggctcttctgtttaatatattaactgttttctcaatcttcatcattttaaaatttcgttaatgaaatgtataaaaaataccgtacatttaaaaacttgactattatattattacaaaatacccaaattcttttcgtatttttgcgccaaatttacaaaactatatgttaacagtatctaacttatctttacaattcgggaaaagagttctttttgacgaggtaaatattatgtttaccaaaggaaactgctacgggatcatcggagcaaacggtgcgggaaagtctacattcctgaaaatactaacaggaaagcaggatcctacaacagggcatgtatctctggaaccagggaaaaggatgtcagttttggaacaggatcactttgcttatgaccagtttactgttcttgaagcggttttaagaggtaataagaaattatttgagataaaagaggaaatggatgcgttatacgcaaaagaagatttctctgacgaagacggtattaaagccggtgaactaggtgtaatctatgatgaaatgggtggatggactgcagaatctgatgcgcaaaccatgctttctaacgtaggaatcactgaagacatgcactggcagctaatgggtgagcttgaaaacaaagacaaagtaaaggttcttttggctcaggcacttttcggtaatcctgatgtattgattctggatgagcctaccaacgaccttgacattgataccatttcatggctggaagatttccttgctgattatgaaaacactgtaatcgttgtatctcacgaccgtcacttcctggacactgtttgtacacacattggtgaccttgattattccaaacttaacctttacacaggtaactattctttctggtaccaggcatctcagctggcaaccaaacagagagcccaggccaacaaaaaggctgaagagaagaagaaagaacttcaggacttcattgcaagattcagttctaacgtagcgaaggcgaaacaggctactgcaagaaagaaaatgatcgataaattaaacatcgatgacatcaagccaacatcaagaagataccctgcaatcattttcgaaatggagagagaagcaggagatcagatccttgacgtaaaaggtcttgagaaaacaaaagacggagaattattgttctctaacattgatttaaatcttaaaaaaggagataaagtagccgtactttctaaaaactctttggcaatcacagaattttttgaaattcttgccggaaatgttgaagcagataaaggaacggttgcatggggagttacaactactcaatctcatatgccgctagacaacacgaacttcttccaggaagacctgagtctggttgactggctgagacaatttacaaagaacgatgaggaacgtcatgaagaattcgtaagaggattcttaggcagaatgttattctccggtgatgaagctttgaaatcctgtaaagtactttcggggggtgaaaaaatgagatgtatgttcagcagaatgatgcttcagaaagcaaacgttcttctactggacgaacctaccaaccacttagaccttgagagtatcacgaccttaaacaactctttgtctaatttcaaaggaaacattctgttgtcatctcatgaccacgaaatgctttcaacagtctgtaacagaatcattgagctgactcctaacggaatcatcgacagagaaatgaattatgacgagtatcttgctgataaaaaggtaaaagaattaagagaaaaaatgtattcttaatttttaagaacatcagataaaaatcaaaggctgtcctgaaagacagccttttttatataaccctatttgttttataagcaccggatggtaccgccatcaaccctaattacagaaccactgatataatcggcaaaagggctgcaaagataggccacagctcctgcaatttcttcaggctccccaaatctgcccgtatcattaggaatgagctcctgtacagccttgtatctgatttcctccggatcggtaccccagttaaatttcggggctgcatttttaagccactcttcaaccattggattcataattgctcccggtgaaaccacatttgaggtaattcctgtatctttaagcgatctggcaagagaaactgacatattgtgacgggccgccaaagttgcattgtaatgaggctgctcttttatgggctgtatgcccagccctccaccaatatgtattactcttccccaacctaaatttttcatctgaggaacaatacgctgaatcatccgaacataggaaactacattagtattgtaaatatccagccagtcatcggcacttgcttctccccatgatttatgagaagttgctcctgcattattaacgagaatatcaatctgcccggactttaaagcttcagccgcaacctgatccgcgccttcatccgttgaaagatcacctacagcaacttctgcaatgcctcctttctctaatatggaatgcatcactttctctgcacgttctttatctctgccatgaataattacagaagctccttcatctgccagcatttttgctattgcttcgcccaaacctgagcttgagccggtaacaagagccctttttccttttaattgtaaatccattttgaactggttttaattgtttgatttttactgaaagctattttattttattcagtattttgataaagcaaaattacacagcacatcatgatctggttttgttggaaagctcaaatcgttttgttgaaaggtccattcctactggaaatattgaaaagaaatcaggaaagttgaaatcataatccaagttgatcgtattgcagggcctttttttaacatttacaaagtcaaaacttcgttgcgcttctgttcggaatgctattttttttccttatttttgtgaaatgagtcaaaaatggatttacaagcctgaacccgatgaggaagttgtggacagactaagttcgtcacttggttttggtacttttgaatctaaaatcctcgttctaaggggaattgacaattatcaaaaggccagagaattcttcaaaccgaaccttaacgatatccacaacccgtttttaatggcagatatgcaaaaagctgtagagcgtattgccaccgctattgaaaacggtgaaaaaatactggtatatggtgactatgatgtggacggaaccacagccgttgctttaatgtacctttacctcagcaagattgttgagaaaaaatatctggactactacattccggatagaaattccgaaggatatggaatttctactgaaggaattgatttcgccaaagaaaatggcttttcactaatcattgctcttgactgtggaatcaaggctcttgacatgatcaattatgcctctaatctcggtatcgattttattatctgtgatcaccaccttccgggcgaagagattcctaatgctgcggctgtgcttgatcctaaaagaagtgactgccgatatcctttcaaagaactttcaggatgcggggttggctttaagctttgccagggattgaatactatttataaattaccggaagctgagctatttgagcttacggatcttctggcgatctccattgcagcagatattgtttccatgacaggcgagaacagggttctggctaaaatgggattaaaaactctacggaagaccagaaatcttggcttaagattattgattcctgaagacaagctttctcattttgaaatttccaatatcgtttttgagatagctcctaaaattaatgctgccggaagaatttcccatggtaaagcagctgtggagcttatggtttctgacaatctgaagcatgccaaccagattgtaaatgacattatgaacctcaacgatgaaaggcgagaactggatatgaactccaccctttctgccctgaatcagattatagaatctcagcaggaaaccaaacatactacgatcgtttatcatcctgaatggaataaaggagtaattggtattgtagcctcaagacttattgaaacgtattataaaccgacacttgtatttaccgatggtaataatggtgaaatggtagcttccgcaagatctgtttcagattttgatgtacatgaagctctggatatgtgttctgaatatttccttaaattcgggggtcatcatgctgctgccggactttcaatggagaaagacaagtttgatgctttcaaggaaaaatttgaaagaattgtttctgaaaaaatccaggaacatcagaaagaaccttcgattaccattgatacggaaatcaaaattgatgagatcaacagagaatttatcaatttccacagaaaactggctccattcggacctcacaatatgaaacctatttttacattaaccaatcagaagctttccggatatgtgaaaaccatgggaaaagataacaatcatctgaagttttatattaagcaggaatctacgggacgaaatattgagtgtgtaggtttcaaacttggacagttcgtggaggattttaaaaataaaaattttgatctggcttttaccctggaagaaaaccattggaaaggcaatgttacccattatcttaatatcaaggatgtgaaattcagggattaattactattacctataatcttctacctgctacctgaacaaatgaaaaaaatcggtttatttttcggatcattcaatccaattcatatcggacatcttattctggctaattatatcctggaaaactctgatatggatgaactttggtttgtagtaagcccgcaaaatccgtttaaagacaaaaaatctttattgaatgaccataacagacttgatatggtacagctggcagtaaagaattatccgaatatgagagcttccaatgtggagttttctcttccgaagccaagctatactattgatactttaacctatcttcatgaaaaatatcctgattattctttcagtttgatcatgggagaagataatctgaagagtctttacaaatggaaaaatgctgatatcctgatcaaaaaccatcatatcattgtttatcctagagtatttgaaggtgagaaaaaagattcggaatatctacaacatgaaaatatttcgctgatcaaagctccggttatagagctttctgccaccgaaatccgtagcatgatcaaaaatggtaaaaatgtaagacctatgcttccgcctgaagtttttgaatatttggatggtagtaatttttatcaataagcaatgaagctatacttattcttattctctgtttttttgcaaggctttctatgcggtcagaaatcaacaactttaaaaagtgactctcttaaagaattacagaaaattgcttttgccgaaaggataagctataataaaaagcgctgcagtgaagattcaatcagggctgtaaaagcttcggaaattcaaaataaatattttatcaatattgctgctcccaatggtgataagtttttgcccggtgaagaactcagaataattttaaaaaagcataatatcatttggggcggagaatggatgggcagtgatatgggtggctattcaggtgaatgttattattctgtaatgactgaattgactgaaaaaaaattcggtaaagattttattgacggtctcgttaaagaatctgtagccatgtatgtaaaaaaacacccgaaaaaaatctttgataatgatgaacattgtgaatggacttataaagggacctacctcagttatacagatgataatgatcagttaaacaaagatttcttccatagttttatttatccggaaggttatgaaaattataatccttcttttcagaaataccgctcaagtactgtggttacactcattttagatcaaaatggaaaggttttgaaggatcaattcagccatcgtatttataatgatcacaatttgaagtatattccttattttgaaaaagaaatcaaaaagtttataaaatacactaaatttgagccagtaaaatacagaggatatcctgtaaaaagcgaaacatccttttttatcttctataaataattattcatgaactttattgaaaaatttttctcaaaatattctcaggaaaaaatcatcagatggtttaagcaaatttgtcttgcagaagccgtttcatgtctcttactgtattgcgttgcgatgatctggatccgatatgatgaaaatttatattctattatctttatcagtgttattggtagtttacatggattattttttacactttacctattactctgccttcctgccagaaaaatttataactgggatgatgaagattttgtttttgccttattatctgccttctttccttttgcaacggtttgggtagataaaaagcttgcccgattcgacagagaataaataaaataaaaaaggaccttttcggtccttttacttttacatgattagaaatctctctttacatgtcctgttgcagtgaaggtatgatttcctgaactatcggtgtacgtgccattaactgtaaaatcaatatagtctcctacagctccaaaagaggttatgtttacagtcatatttccattatttgttgtgatataacctcctgaaaattcaaacccataacctgtgttaaaactttcagcaactcccagcacattgatttgcttcatatggaaaaaaggtcctgcagaattcgttgagtttattatcaattgcttggccgatacaacaggcgacgtggtcgtcaaccctccccactttacatcaaacaatcccactatatttacggttggttgattatcaattttataactgatcaattcgttcaaagaattacaaaccatgatattccccaaattgactatagcagacggagccgtgaaagttacttcatgagtgctttgcaaattagcggcatcaaacccttcgtaggtaaactgaggatttgcagtacatgcataggtgttgaatgtaaagcctccggtactgtttactggtactgacatatattggaaatagtacatacccgccactggcttaagtattacatagccatcggtaacatcagtatttatacatgttttaagacttccctgaatagtataattgacagatgtagacgggtttatggcaatttcaggaattgttgttatgactccaaccggaagaggggccacattagaggtatataatacattattacaaatatcataaacttttaaaacgagaacctcacctgctggaacaattcccgagaccattcctgtattatctgtcattccgtaagtttcatatgcttgagaagttctctttaaagcgactctaatattaggtaaaacctgtcctgccgcgttttttactgttactttcaaggttgcctgtggaaactgtgcatcataattccaccaggaaaaatggcttactgttcctacataggtatttccgatctttgttgcagcaccttcttctttccacattccggtctcttcgttataagaccataatggtattgtagctggtgagctggaagtttgtacagcatccaccggaactgtaatttctgcagtatggccgtttgcaatctgaagattttgcccggaacttcctgttaattgtacatggagcattccaaaagtttccattattctggcattccctcctaaattggctgccaaaaaggatcccggcattaattcattaagatattggttggacggagccaggtgaaaaatcccgacactcacatttcctgaataagcatttccgttagcgtctttaaaactcccatcaaattttactttggttccattgggcagtgaaactgtagatgcagagcccgtcgtaattgtagaggtaactgttgcaggaatcatcatgatgttcaccctgtttattccatgagtaggaaccaaaaccctggatgcatttacataaccggcctttgtcacttttacatgggcaaaattttcttttaccgaaacatttttaaatgtgaagaaacctctaagatcggttgtaatggtacttgttccgatggtaactgttgctccggaaaccggatttccacttgtatcaagaattattccctggaaatttcgctgtgcagtatttccgaaattataattagatggaggatttattgtttcatctcctgtttctaataaagattcatttttacatgaaaataataatacaagtaataaaaataataggtaaaattttctcatatggtattagtttttaatttttactaaattaataataaaagacaatcgcaaacattttttattttatttcttcatctttttcaaaaaattcttcaatattttttgatttggtgtaacatttaacatctttcatttgtcttattatacagaaagttcaaacaatcaatattttaaactaaatttttattaactgataatcaattgattacaataattaaaaaatatttttaagtactttgtattgcataatactaaatttattatatatctttgtaatgttaaataacaaaccatacaagctattaattaaaaaataatatcatgaaaactcaaattcttattgcagctctatttttcggcggacttataactgcccagcagaaaaaagacagtttgaaagtaaatgccattgatgcagtgactctcaagaagcaggttttcaaaaaacaaggtgaccgtttggtatatgatgtagcttcttcatctattgctaaaggaaccaatacttttaatcttttaaagcagacgccgatgatttccagtattgatggaaaaacattaaagattctgggaaaaaatgacgcagtaatttatatcaacaataagaaaaccaatatggattctgaggcattgattgaaatgctgaagtctactccatctgaagatattcagaaaatcgaagtgattacagttcccggaagtgaatttcaggttgaatctaaagaaggtgtcatcaatattgtaatgaaaaaaagcaaaaacaacggttacaacggaacgttgaaaatgcagaacgagcaggcttattacaataatcccaatgccggagcttcttttaacttcagacaaggtaaatggtcggggaactccaatttcagaacgggaagctggacagacagacagagatatacgctttccaacggagattctactttcaaaaatgaatcattcggatttaatgatgatccgaacaaaaattttggtggaggcttcaatatcgattatgagatcaataaaaaacacagtcttggattctcctacaacatgagatacaataaaagcttcaattctgtactggacattaccaacttgcaaaacggagtattgaataacagaacagtcaattatgaagatgcacagaccagaaatcactcttttaatctgaattatgagatgaaaacagattctttagggagtaaacttacctcaaacatttcttatctatggttcaacagggataaagtgagctttaatgagagtttacctttaacaaatgatacgattaataaatattctgcattgcatcaggcggtaccacagatcatcaacaattatgcagccaatatcgattatctgaaaaagacagctaaaggagccacatggttaatgggaatcagttacaatcacaccaacacagataacgatacccggcaggataagctgaaaaaaggagagtttatcatagatcccaatcaaaccaaccacttcatttataaggaaaatatattgggaatttatctgaactatgaaagaaaacttactgaaaaaatatccggaaaaattggtgcccgctacgaaatgaccagaagcaccggagacattgtggataagacaggttttgaaagaaattacaacaatctgctgccttatctgaatttaaattacgctatcaattccgatcataatctgagctacactttttccagcagaatcagaagaccgagattctgggagctgaatccttcaagaacctactttactccaaccaattatacacagaacaatccatttatactggcatcaaagtattataatcaggagttaaattatatgtataaaaatgcattctatgccaatcttagtttcaatatggtggaagatgcagcggcttcagacctgattccattgcagggaactgtaacggctccccaaaaagatgctgaagggaacatcataaaggacatcaaaggtaatccaattaaggaaaccaccagatttttaaggtatatcagaaccaattatggtaaaaacagggagattgctttaactcttggaatgaacaaatcctggtttaaagacatatggaccaccaactattctgtcaatttaggatatattgcctacaagggtggagtatttgaagatcctactgccatgccggccccgggagaaactgaagttatagatccttatatcattgatgttaaaaactataatatgtctgtaaccatcaataatgttataagactgtcttcaaaaaaagactggttcctgggtgttaattacttctttgccagccagaccgctatggaagctggaatgataggtgcaagacagagttttgacttcagtctgaaaaaaattgcgggagactggactatcgtagcagaagtaagcgatctgtttaaccaaagcttttacagcattaaaggggtacagcctaatggaaaatttaacaatatcaccaacttcaactatccaaggttaatgagcataggcgttacttacaatttcggaaatcagaaactgaaaaaagcaagggaaatgaaatcagctaatgatgctgtaaaatcaagaacctaacctataaaaacttatttcactaaatccactcttaaataaaaacaacatgaaacgtataattttgtcaatggctcttgtattcggtacctgcgcatttgctcaggaaaagaaatctgatacggcaaaaacaaaaaatatagaaggggtaaccatcacaaaacaggtttttaaaaagcaaagcgaccgttttgtatatgatgtggcagcatcacctgttgccaaaggaaataccacttttgaccttctgaagcagactcctttattatcttccacagatgataaaacattgaaaatcgcagggaaaaataatgcgctgatctatatcaacggaagaaaaagcaatatggattctgagtctctggttcagttcctgaaaaatactccggcagaaaatatccagaaaattgaagtgatcacggttcccggaagtgaatatcaggttgaatcatcagatgggatcatcaatatcgttttaaagaaaaaaatgagcgacggtctcaacggaaacatgagaatgtctaataccaccaataagtacaacggaagtcaggcgagtttctcggccaactaccgaaaggacaagctgggagtaagtgccagtcttagcggtggcgaaaatattgaagcacaaacgtatactctgagaaatggtacagccaaaacatccaatgaatctacaggtgatattgatgatccgaacaaaaatatcgggggttatctgaatattgattatcagcttaatgataaaagcaacctcgcattatcatggaatacctgggcgaataaaagctataactcaacggtagatttattcaataccattaaaaaaacagatacggaatatacatggtccaaaaacagagaagattcaaggtcttacaacaattctgtcaatttgaattatgaattgaaaacagattcactaggcagtaaactgaatgtaaatgctgcttacctcaactatagaagattccagtttacagataatcaaacttttgcttcagatatcaacagaaatgtgggaggaaggaaaacacaggtgcttcaggatcttccgcaaattattaataatttctccggaatggtagattacaatcagaaatttaaaaatgatcttaccgtttcagttggaggaaactacaataaaaccaaaacagacaacgattctaaaaacattacttattcttttaatcccctaacatccccggattcaagacccaaccattttatttatgatgaaaacatctacggaatgtatcttaccgttgagaaaaagatctctgacaaactttcaggaaaaataggagcccgatacgagatcacaaacagtttgggaacttctgacaatgctcctacagaagcgcttaaaaggattgaaagaaactacaataacttacttccttacctgagcctgaattatgcgattaatgataaaaataatatttcatactctttttcaagcagaatgagaagaccgagtttctgggaacttaatcctgtaagaaacatcctgacggaagataattacactcagaatgacccgtttgtaaaagcttcctctacctacaatcaggaacttacgtacatgtacagaaattcgtattttttgattttaaaccattcttacattcaggacgtgattacgcaggttccgcttcagggatatccggtatcgccggatggtaaaattggagataatcctgcattgagatatatcagaaccaattttgggaataagcaggaaatgtctgccatggtaggtattcagaagtcgtttttcaaacaatactggacgaccaactttaatatcggagtacagcataacatcaacaatggaagtcttgataccgatcctactacgggagaccgctttaagaatgataaaggacctaacggaaattttattacctacaccaataaaacgaattctaccagtcttctgatccagaccaacaacaccatccgtcttgataaaaagaaaacatggttcttcggagttaattatttctttgtagacaagcagcagattgagcttggttccctgaaaaacttaatgagcttagatctcagccttaagaaaatgtggaacgactggacttttgcagtgaatgtaaatgatgtcctgaataccaacattgtgaaaattgaagacttccaggaaaacgggaattacaattatatccaccaaaaccgctataacagaagtctcatagtaagccttacctataatttcggaaaccagaaagtgaaaaaggtaagagacatcgaaggggcctcagatgccatcaaaagcagaacaagataagattatctttcttcatatttaattattcttacggtatccgctgattcttttcagcggattttttatatttaatcattatgaaaaaagatataaaaattattttgatatccctcagtctcctttttctatggacaggctgcaaagaaaaaaagataaaacttagccatgatatccattttgataaagaagaaaatattcattatggaaagagtgctgaacaggttatggatctctatattccatctacacgaacaaataaagaaaagaatgtttttattataattcatggtggggggtggagagcagggaataaatcgcaattaacctttttcacgctctctataatgcagaaatttcccgatcatattttcgttaatatgaactacagactagcttcagctactaactttggacttccaaaccaaaccgatgatattaaaaaagtaactgaattattaaaaaataagctaggctacaatccaagtgtgattttattaggcaacagcgccggagcccatttatcgatgctgtatgcctacaagtttgatgcagataaaaaagtaaaagctgtaattaatattgttggcccggcagacctctctgatccgggtttcaaaaattatcaggagtattcttttgtggaaagcagacttgtggatcctgaaacaattaaaaccggaatatcaaagatcgattttgccagccctgtgaaatggataaaaagtgattcccctcctactttgtcttactatggaagttcggatcgtgtaattccttctacacaggaaaaaagacttgattcagccttgatagccaatcatattatccatgaatcttatcaattcaatggaggacatctggattgggataaacatccaaatgatctgtttcttattgataaaattgaaaccttcattaaagaaattgacaaaaaataacacgttctgattcttcaaaacgtgttatttttattttaaaattgaattttattcagattttgcaacggctgttctttctgaaactccattggcattgaaagcttcaatctggaaatagtaagcatctgtcctgtctgcacctgtgaagaagtattcattcttcccgtacaccatgatgcttccgtacaatttatccggagactttccaaaataaattacatagccgtctgcatcaggattctgctgccatttcatccagatacttcttctttccccatatttctttggatcagctcttaaaggtacaaacccctcaacctttgaaggttgtttccctgctccttttccaaacactctgaaaccgcttaatgcaaattttccggtaggcattttcagattttccattttcaggaaacgggcttttgccggtttttccaactcaacatagtcgtgaggaacatctttagtgtttttgcttttatccacaatcacattccatttcttgccatcattagaaccgtagattttatactgatgcatttttccaagggttttccccatgaattcagcatcctgatccgcgtaattgatctgaatggcattgattgtagaaacttcacccagatccgtctggaaccattccccggaatttccggtcttagcactccaatacgttttgatgtcctcatctaccgcatagttaggctgatatccacctaaagtagatgaaacctgaacgggtttattataattcaatagcatccatccggcaaaaagacctttcgtaaaatcttttccctgtgcatactgcggaaggtaagtaggataatcgccataagcggtattacagtacatcacatcatctttatcgaaacctgccggccatattcccagccttctttcaaaattatttttagtagaaataaaaattgtggaaacatgccaccagttcttgtaattgtcttcaaacgttgctccgtgccctgcgcctctggcaaatcctcccggtttataagagaacggattatgctgctgatattcgaaaccttccaaaggatttttactcacatacactccatcagaatacccactgaattctgttgccggagcgccatactgcatataatatttcccgttatgcttcgtcatccatgctccttctacaaaaggctgaagaaaaacattatcattgtattccccaaacctttcccaaccatgatcttcaggttttagcttaataataggttttacgaaaccttcggactgaaggtttttcacttttacttctgttcccagcaacggccattcgttgctcgagccccagtacaagtacagtttatttttgtcttcatcataatggaatgcaggatcccatgctcctacttttaaagtatccactgctattttccagtcatctttggttgggttggtacttttccagatcggaaaatcctgttcccaggttgagccatacacgtataaagtatctttcatggcccaaactgccggagcattaagatcatgaatgtatttattgtctctgagaaatttccttttcacaaatttccagtccagcatatcatcactgtaccagtatccttcctggttggtagagaaaaggaagagtttatttttaaaattaacaatcaccggatctgctgttgcacggtgttttccctgttttgaaaaaacttcgaagggagtataaccataatcaatattgataggattacagaatgttttctgctgagcccctgcaatcattccaagaaagattgctaatgacagaaaatattgtctcattttcagattttaaacgttccgggcaaagttaattaacttttttcggttttctccaaataaagccatccagaagataatgagtaagctgcggaacaaccaataaaggaaccagaaactgaaagagattttctgagatcatcatattcagggaaaagtgttcattccaaaccaacgtttcccataaaaattcttccagaaaagcgaacaataaaatgacgccgacaaatagaaatatccctgaaaaagatttaaaaatctgcatccggttcagctgatgattttctttttgctgtatttcccggatataaatcaatgcgatataaggaatgccatgagaaactacattcagaaaagtaaacaaaagatcattgttgaaataaacaattccaaaataccaggaaagaaaagttccggtgatcaacgctgttttaggaatattaatccatttggatttaaaagcttcaaaagcagttttaaaaagccaaatgatcaggatggcaaagtagattgcagtaagtaaaggaatgtaatccggaagattctgaagccagtcaaactcattgttgacaaaccaggtaaaggcacgaggtgttttaaaccaatacaacatcggataaatcgttgcggagtaaacagcaatctcatctatttttttactccagttgcttggttcaaaacgggcatagattcgcataaagccgtactgctgcctaataaaatgaaaaacggcaatcaatgccagtactgaccagaatgtcaggctgcccaactggaacaggatcattcccaagatccagctcaaaacaggaattcccagatacagcagcttatttctctgtacctctccttttacaaaataggttttaaacagtgtggaataaacgtgggcaacatcaacaaaaacaatcaggaaaagccatgtgtaaaaggaataatgattttccagtatctgaatctgtttctgaaaaaggaagataatcagcagcaccagaaaaggtggtgataaaataaaccaccagtctgtttttgcgttatgtatccacggctgtttcatagtattatattacatcatttgttctgcagtccggagcccctgatagaaagcttcttcaaaaatagaaattcccgacagatcagaatgggcaaagaaaattttattttctataggttcttttgcttttctggcttcttctccaaaaatctggttaggaacaggagcgatcatcgcatgccctattttatgaaactgcatttccaaaatgaaatcttctatcaacggatgtgctttcttcagatcatccaaaactaaatctttcagttcagattccttcatgccgtagagttttttccttgcttttttacagtccgaagttgaaaaacttttatagtgagtaatcaccttttcaccgataatctggttgagattctgatgctggtcaaaaatataccccaatcctgaagaaccatagatcacattatcccaggccagctcttcatctcctccgaattcatttttcaccgtaatggtggttaaaagccagggcacgtaatgaaaggaagatgcttttttatgattaaaaattctctcattcacaaattgaggtgaggcaaaaagtactttatccgcaatgatcttcttcgttttcttttgggtattatcaaaacttaatacctcaactttatcattgatttttacatcaaaaaccagatttcccggcatatgttttccctcggtgtattttgaaagatgttttgccagtcttacatttccttccggccatgtgaatacctgatctttatatattgtactccagttattctttcttccggcaaaataatgtattcctgcccatgcagaaacgtagtctattcctaatccgaaatcgtccctgctggaataatccagaagccagagaagttcttccgaccggtagttattttctttcagccattctttaaaaataattttttcaagctttactacctcatcttctctgctggaatcatgtacaggaatagcaaaccaatattttccctccgcatccttcttgacacggaactcgtccatcagcttaaaaaagcgggtaagctcctgctgagtttgtgctgaaattcctctttggggaacaatatcgttctgccaggaatttttataaaataatctttcctgctgaggaaaagtcatttggtattcatcaagaataggttctccgttttcttccgctcccaggcagattttacattctttcaggaattctatgatttctgtattctctttgttcggtaacggtaaataatgggcgcctaaaggaaattttgaaaatgagttttctccgttggaagaattgccgccaagatgattttccatttccagaagaagataatcattttcatgatgctgactgaaaaatctacacgcagaaagaccagagattccacccccgacaataagatatttagtgtggataacttctgaaaactgtggaaaatcttttgcccaaagcttatgccctagtacatgattcgttccagtgatcttcagcagcaaagttttaactttctttccgcaatactgcaaaaagggaagcataagactacctaaaaatatagttgtgagaaaatcttttctactgtactttcccccactcttcatcgaaatatcggactaatatctggttatccagacggttaacttctacgtctttcaccttcatatctttattgaaataagacatctgtgaaaagttgtaatcatagtatctcaaaccgggaagctttctgtagattctgttgttgacgggttcaaatgaagccatagaaaatccccattccccaaaagacggaacgtaagtgtgatatgctgctgtaaaaggaaaaatctgatggattgttttttcaatacaccagaaagatttcggagcaaaatacggagaggtggtctgaactacaatcttggtatcaagagttgtcaatctctccagttctttataaaactgtaaggaataaagttttccgaggctgtaattggacggatccggaaagtctatgataatgacatcaaacttctttttgttctcttttacccagatgtaagcatctttattgatcacttccactttaggattggagaaagaactttgattcagtctgcgcatggtttcattggttttgaaaaactgggtcatctctccgtcaagatctacaagtgttacttttttaacatctttatattttaatacttctcttgctgcaaaaccatcaccgcctccaagaatcaggacattatctatattttttgccatcgacattgcaggatgtaccaaagcctcatgataacggtattcgtctgtggatgaaaactgcaggttgttatttaaatataaacggaattcatgagtgtttctagttaaaacaattctctgataaggagagcttttggtatacactacattttcaccatataatttttcttctgaataggataaaatagtatctgagaaaatgaaaagtcctaaaagaaatgcaaatgctgcaagagattttactttgagcgatagcggttttgataattcctttgtaagataatagcacaggaatatcgcaatggaaatattaatcaatccgaaaaacaaaggggttttgacaattcccagcttcggaatcaaaaccaatggaaacagaatagatgccagtaatgccccaatataatcgaatgcaaagacatttgaaactaaatctttaaactgcaccctgtcttttaaaatattcatcagaagcgggatttccaccccaaccagacatcctgtgaagaatacaaacagataaagaacactttcaaaatgggcgagcgtattaaacagaataaacagcacaacagagctgattccccccacgattcctacaagaatttcgatctcaatgaatttatcaataagatttcctttgatgaatttcgcaaggtaggaacccactcccattgagaacaggtatactccgataatgaaagaaaactgctttacagagtctcctaaaagatagcttgccagcgctccggccaccagctcataaatcagtccacatgtagcaatgacgaatactgaaaacaataaaagcagctcaagaggaatcctcttcttatccatgaattgccgcacttataatcattgaaattccgataataaatgcaccgaagacaatagcaattgctatatttttattccgggcgatctcatgccatgttttttcaggagtcagtttttcaataatgaaataacatgcaagcaaaatagcgattcctaaaaatgaataaagaaccgagtttagtatgggtaagaaattgatgttgtccatagttttatattttatttgtgataatatctgtagaatcctactctggaatgacttcttgtggttccgtcgcggtatgtttctgtcttggcacagtcgcagacctgattgccctggtatgtaaggtatacaaaccaggtcaggcagaatcctccgatcaggcagagtatccagttttttcttaggtaattggttatattagttatcatcatttgcaggataaggtgagtttgaactatttttccatttatttacattaaagtaatgttttcctatccacattgccacaaacacggcaatcattatgaataaaataatcccgaagttccagaatgaaacgggaagccatgtagctttgagttgtacataggtattgcttgaaatggggtctgtggtaagtttaagtgcttcagaattaatcagggagtccagcttttgagttccgaacgatgctttggcaagtctgatcacttccgaggtatctttttccagcgtctgcccgtctgtaaaagttttggtctgcaccttgaatatgtcagtaacctcaattgttcctgatttatcccgtgatatcatgacctttgaatcaggcgatgtaaggcttgaaaatgacggcaagcctccttctttttcagctgaaataatgaaatgatattttccggagcctaccccacacaggttaaaatcttcagactggcttccttccgtccagctttccccgccttcgtacccatgatactgttcaatatctttggaggtatagataatttcgttggtattttcgttcacaaggcttagctgaacattcgcccaggaattatcaacacctgaaaaagcattcacttttaatggggccgaacctccggaaagggtaaagcttttgctgaccaattctttatcttttacatctgcaaaattgatggtctctgcaaaaacggtttcgttggttcttgaagtgtagacatacatctggagcaaacaaatcattaatgcagccacacaaaagatgttcacggcttgtctgatatcgaaatagtagggctgaacaatccctattcctgtataattgggcagattagctattttaaaagctttcttaacttcatattttgaaatgtgaactccatagaaatactggcttttcttagcggtcttctcctgagagatcatgcgggttccgttgacatattctttgtaggtcgcaatggtgaaatccagatgttcatcaaaaaatccggctgcagcatcaatagtgcatggagtattttcgtaccatcggtaggttcgcccgagataggttggtaattttgaatctttacctttaaaatcatcaggatgtatagagatcaggaatacccaatgtccatcgctctcactcaggaaagcatcatttcctttgctgtcttttaaagaatattctcgccagaaaatactgtttccgtattttttaacagtaatcgcaacgactgtatattccgtaccgtcaatttttcctttttgtccgacatccaatacaacattttccgttgggactttcagatgtttaatttttttgttccaggctacatcaatgagatgggagcaggtcatacaaacgtattcttcaacaggaaaggtaagatctaatatattttcggattcgcatgctgggcagacatagtgcatttttatctgtaaattttgtgtttttgaatggtattagctttaaaatactgaaccacctcatctgcaatctgctctactttctccgtattgtcctgagtataattacaaagaaatacatcaaaggtaagctgtttaaattccggccacgtgtggatacaaaggtgagattctttaaggatcactgcagaagtaaagctgttattctcaaaaatatgattggttactcctacaatttccacctctctggttttcagaatttcttctgtaaacatcagaaaacctttgctgtctaataacaaatcttctgactctgtttccaaagtcagaagaatatgtaaacctttacttgataatgggttcaattaatttttttggtaaatatattatttttttggaagaaaaacctcggcaagcatacatcttgcgcttcctccaccatttacttcaatggtattcaggtctgaatagataatttcgcagtatttttcaatagctgctacctgttctggagtgagagactggtaagcggtctggctcatcaccaaaaatttctcaccctctttattctgaacctgaagcatatttcccgcaaactgctgcatctgttcttctgagatctcaatgatttctttccccgagcccttgatagtttccactactttttctctttcaagctcatcgtcaatacaatcaaggcagattacgacaaattgatccgccacacacatcattacgttggtgtgatagatcggaagtctttctgttcctacggtctggaatgaatggaatacaacaggagtgaatccatattttgcacagaattctctgaacagtttttcatccagcctcaaagaaacagaaccatatgcaattttattatcgtgatcgaaaatcatacttcctgttccttccaggaaatggccctgggtttcaggaaaagaccagtcatcaatttcagtaacttcaaacccctgatctttgatactctcaataatatcttctcttctttccactcttctgttggaagcgaacatcggatataaaaccacttttccgtctttatggaaacttacccagttattggggaaaatagaatccggagtatgcggatccggagtatcttttatagtgatcacattgattccttttcctctcagctttccgacaaaggtattgaactctgccaaagcttttgactggatatcagaacctgtctgttctacctggaaataattgttttttgctgtttctgcgttgtaaccgaatgcaatcggctctatcattaatacggtatctgttgtttgcatttttttgatttaaaaattaaaagattgaaagattaaaaactcccactctcaaacactaaaactctcccactcaattattctctcacaagcggcattgtagagcatctcaacaatccacccattttggagatttctctgtaagggatttcttctactgtcattccccactcgtttctcaggtgattattcattctcgtaaatgctttatctgaaaccactacatcaggagaaatagagaaaatattagggaacatttcaaacatttcttcatcattgatatggaaacagttttcttctccgaaaatatcaatgattaggcggtaatcgctttcatccacaaatccgtttttataaataatacatttgtcttctcctaccggattaaatgtacaatccagatgcagaataccttcaaacggaactttatcatttttcttcagctccagatcgatgattcttttcttcggaaaatattcttttaagatttcaatggcatattcattggttcttgccgttttatagtttcggtaatcttcgctgaagcacgtcccaatgaaaaggaaatcatcccatacgattacatctcctccttcaatatgtgcagtttcgggaaggttgatgatctttctccatgctactttttcaaaaacacttttgtatgcctcctgctcatctgccctgtctgcgatcacattggaaatgatcattttgtcatcaattacaaaagctacatctctggaaaaaacctggttgtagtctttgatgatgcttggacgaagtacttcaacatcatacttttttaaaaccgcttcaaaagcgttcatttctttaataacatcctcttctttaggataaatgttgtgttcgattgagtaatatgactttgcgtcataactttcctctagtgtgggaaccggccccaatgaattaggctggcctagaactactgacttcagcctacccgtttcgtttttaatgtttagtctcataaagatttatgcaatactacaaatataagtaaaggtctctacctgtaaaacttttggattattttatgcattaaatttgtttggcaaaatcaccgctcttcaacaaaatttccctgtattttagccaactgtagtgaatagttccaaaaacctctgcaacttgctattttccatctgcataagaaaagaaaaacagataatcatattatttaatttcctatattagtgatataattttcgcgaaattataaacaataaaaacttaactattaacaccaaaaatcaaagtcatgaacaagaacaatccggtgctgaaaaatgcacaaaaattaggtagagatcaacaaaaatctgtaatgggaggcgctccaatctcaacagccagaagatgctgtgaatgggatgatgcaggaaactgttatatctggacatgtgacagatgtgtatgtccttaataaaaaagaagacctgctttttcaagcaggttttcttatcttgttctgttttcttcgtctgtcttctgggtttctttcacctgatattttgaacttcctatgttataactaagcgaaaataccagcctgctgctgtcccaccaatgggtaaaacggttatccataatctgcttatgcctgaattccaatcgctgatcataagaatcgaaaagattgttaaaaccgatttttgtgttcagtttattatcaaaccatgccttttgcactgatacatctacagtataccgtggtttaatactataaaggctgtttcctgttttagattcataagcaccaaatacatttacagtaaatcccttgggaagcgaaaatacctggttgattctcaattcgtaattataaatgttcaatgcaaaaacctcattcagataaggtctgaattcataattgtaatagcccgcaatctgactggtgatattccaccattttgtaactctcaccggaaagcttgtttccagcacagcaaagttccggtaaggaagattcgttcctaaatattccaatatatttgtctgcggattgtaaagaggataccgtgtcataacatccttttctttcccgatggtaaagcttgtcacccagtttttataccgataggttgctttaatctgactggtaaaggaaggcaatagatatggattccctatccagtaatttaacggactgaaataaaatctgaacggattaagctgcgaaaatgctggtctcgttatttttctgctataggaaagagaaagctcactggatttattaaaagtatagctggcgcttaaagacggcagccacttcagatagtttctggaaaccacagagtctactgtaattgctttggaaatactgtttgtgttttcaaatcttaatcctgcattgatctgaagatttcccattttttgtctgtatgccagataacctgcccaaatcttttctttgtatgaaaatatattgctcctcgaatgatcaaaaacgaaatgattgccaacagataatgtatcatacctgatattgttttgagtttctgaattgctgtattttactcctgcttcaatatcgatctcttttattttctgagatgcatctatctgtgcggtataaatgctgattttgttcaccagatcagatttccaatatgagagaagattttctgtaaccctatctttattgatgaaatcatcattctgtttatttttgactgaaagataattccctaaaaaaacaagcttaaatcccttattctgaaaagaataatcggttgtcatcccatagttatcctgagaataatctgtagggttttcactggctgtattcaataccaattgggttccggtcttatcagttgtataaagtgatccggtgcgtattctgtcattattccggaaaatacctctcagattaatgccaagccggtttttatcattcagattaaaatctgcacctgcctgaagattgtaaacttttccagcatcttcctgataggtttgagtacgcataatattggtattggccaatcgctgcaaggcgtgataacgataggttgaaattccatcattataacccgcctgcagattgtatgtcactctccctgtatgataagatatattgagtgcattttcccgatagttgaatttattaacataaatattcccattatagcttgctttcaagccaaggttgacattccttttcagtttgatatcaataattcctttaaattctgcatcatatttagaggatggattggtattcacttccaccgattctaccatttccggagataaagaccgcaaataggcctgtaactcctgattgctcataataacaggcttcccgtcaataaaaacagcgggagtgatcctgcccccaataaaaattccatcttcctgatctactgtgacgccgggtgtttttcttaaaacatcaaggaggtgcgtggaggttttaaagtctttatttccggcaacagacagtacaagattgccttcattcagtttcatttttcgtggagctgactgaataataacttccgaaatattcgttgttgaagattttgcctcagccagagaatccgggatttttcctttgacggtttcctgtgcttttccaaaaattgacaggaacagcagaagcagcaagagccataatttgaagatcatagattttaaattttatgacatcaaaagtatcggcctggagcagaaaagcggttttgaaattaaaattccgcagtactgaattataaatttgaactctgaaatcttgattcagcaagggtttgagactgtttatacaaaagaggcgttgtatttttaattttcttgaacgtagaaaagaaagtcgatttggaattgaatcctacttcatatcctatctcttcaatttttaaataagagccattttctatcttttcacaggcttcatgaatacgatattcattgatataagtggaaaagcttttaccaagattatcatttagcagttgggaaagctgatgggcagagatattcattttagatgccacatcacttaatttcagattgggatttttataaagctcttcggtattcatcagccgctctaatctggacgaaaagctgtctgcctgttcttcagagatctttttattggagtatctttcagtttcctttaccggaagctgctgatattttttattgaataaaatcaaaaagttggcatacagtacaaatgaaaatacaagacttcctcctgcacagtagatttgcacccagcctgttgagatcagctgataggtcagaaagataatgatattactgatcagaaccggaagaacaaactggtttggatttttaaggttctgcctggaaaagttgtagtactgatacactgtaaggaatacaaatacggaccagacggtataaataaaggttccgaaataatgctcccacgtaacagggaaaaggagatataataaaccgacagcccccaaaatgatcgtcagtattccaaaccatttccggcagttcttccagtcaaagtgttcctgttgaaaggaagatttcacataatagtatagcgccggcccggtataaaataaggcagacaatcccaaatgcggaataattcttggcagatccggataaaagtaaatgcatacagcaatgcccactctggtgctcagcatcagcaaaagaagtccgaggaaaaaatccgggaggtatttcagtttcttaacaaacagcagataaatacccagcagaagtccgttgaatgctcctactgcgctgaagaaaaataacatctgttgtccgaaagtcataataatttatttatttttttgtaacgatcaccattcggctttgatcatatcaataatttcataaaagtaaaattaataaattattgaattcaatttcagcaacatatacattttttctaagaaatattgcagaccgatatctcttttccatctgcatattctttgccccattcacataagtttttcagaatcggaataagatcttgtcctttgttggtcagtatatattctattcctgcaggaatggtatcaggaatttcttttttaatgataagtttatgagtttccagttctttaagttgtctccctaaaacctgttcagaaatattagacagttccttcttcaaaagatgaaaccggttatttccctccgatatcgaataaataatctgtgacttccaacgcccactgatgatacttactgcggaattcagttcacagataccgaacagaaactgttcgtttgccacattggttgaagtttcttttctcataatgatcactcacaattttgttcgttattgcaattcacacacagcctgcagaaatttacattaaaattacaaaattatgagtacaaaaaacatcctgtcgattattggtcttgtaataagcctgcagctgttccaggcacaggaaagatgggttctgaaatccgggtttatgtcaaaaccggatacggtattgatttttaaaccccgaacctacatgaagacagaaaaatatccattagtctatttattacacgggtatagtgaaaactaccgtcaatggtcccggacaacagatcttcagaagttttctgatcaatataaaatgattattgtatgcccggacggatttacaacatgttatgtaaacagtccttatgataaaggggcaagagctgaagatttcttttttaagcagctggttcccaaggttcataaaaacttcaatattgataaaaagaacattttcatcagcggattgagcatgggaggatatggtgctatccgatattttctacttcatcaggattattttaatactgcaggaagtacaagcggcgctttttctctggatcctgacattatgaggaatgcaagcttgcaattctttaaaacagaaaggattactgatgacctgaacaaaatacttggttctccggacgaatggaagcagtataatatttcaaaactgttaaaaacctacaataaagggaatccttttttaatagattgcggttcggaagatatactttatccttccaccattgaaatcaaaggtattgccgatagtctgaaaattcccattacatttatttcccaacccgggaatcataatacagaatattggaaaaactccattgaacatcattttatttttttcagacaacattttaaataaaaaaatcccaaagcatgctttgggatttttttatgatgtaagcaaatattatctgcttgcaatatcgatgtagtttctttgctgagcaccttggtaaacctgtcttggtcttccgatcgggtctcctttcaatctcatttctttccattgagaaatccatcccggaagtcttcctaatgcaaacattaccgtgaacatttctgtaggaattcctaatgctctgtagatgatacctgaatagaagtctacgtttggatatagttttctttctacgaagtattcgtcttccagtgctactctttctaactgcattgcaatgtcaagagctttatcctggattcctaatgctttaaggatatcgtcagcagcttttttgatgattttcgctcttgggtcgaagtttttgtacactctgtgtccgaatcccattagacggaagttatcattcttatctttagctttagcaacatatttagatacgtcaccaccatctttctcgataagctcaagcatttcgattacagcctggttagcaccaccgtgaagtgggccccaaagtgcagataccccagcagagatagaagcgaaaagacctgtgtgagcagaccctaccattcttactgtagaagtagaacagttttgctcgtggtctgcgtgaaggattaataatttatctaaagcatttactactaccggatcgatttcgaaatcagcgtttggtaatctgaatgccattttgtagaagttctctacgtagtttaagttgttatccccgtggtttaatggtaaaccttgagtttttctgtaagtccatgcacaaaggtgagagaacttagcaatcataagctcagcagcatgatccatttcctctttagagtttacattaacggctttcgggttgaaggctgtcaaagcagaagttaaagaagataaaactcccatagggtgagcagagcgagggaaaacatcgatgatttttttcatctcgtctgcaataaagttatattttttaatgttgttttcgaaagaagtatactgatcctgagtaggcaattctccatgtaataaaaggtacattacttcagtgaagttagatttttcagcaatctgctcgattggataacctctgtagaataattctcctttatctccgtctaagtaagtgatgtcgctaatagtagctcctgtatttttgtaacctaaatccagagtgatcaaacctgtctggtctcttaattttgaaatatcaatccctctgtctccgatagtactatccacaattggatattcatatgaattacctgcgtaattcaatattactttgttgtctgacattatttatttttttttaaatatactactttccataaaatacggcaaacaaaaattatcgcttgccgttatttataaattcgattatcttttgattttaaatgcgcctaaaccagggaaaattgcagtctcaccaagagcttcttcaattcttaataactggttgtattttgccattctgtctgatcttgaagcggaaccggttttgatctgtccgcagttcatagctactgctaaatcagcaatggtagaatcttcagtttctcctgatctgtgagacattactgaagtgaatttgttattctgagccatctgtacagccgccattgtttcagaaagagaaccgatctggtttacttttacaaggattgagttggcaataccttctgttactcctcttgataatctgtctacgttggttacgaataaatcgtcacctaccagctgtactctgtcaccgattttgtccgttaacattttccatccttcccagtcatcttcctgcataccgtcttcgatagaaatgatcggatatttagcagccagctcggcaaggtaagaaacctgctcttctcttgacctgtgagctcctttatcgccttcaaattttctgtaatcgtaagttccgtctttgtagaattctgaagcagcacagtctaacgccagcataatgtcatcaccaggcttataacctgctttttcaatcgcctgaagcaatgtatccaaagcatcttcagttccgttgaaagtaggagcaaaacctccttcgtctcctactgctgtagaaagacctcttcctttaagaattgacttcaggttgtggaaaatttcagttccttttctcaatgcatgagagaaagaatctgcttttaccggcatgatcatgaattcctggaatgcgataggagcatctgaatgagatccaccgttgattacgttcatcattggaacaggaagtgtgttggcatttacaccaccaacatatttataaagaggcattcccaattctgcagctgcagctcttgctaccgccaaagaaacaccaagaatagcattagcaccaagatttcctttgttagccgttccgtcaagattaatcataatctgatcgatataattttgttcgaaaaccggctgtccaaccaaattctctgcaattacttcttttacattttcaacagctttcaggactcctttcccctgatattctgaaccgccatcacgtaattctaccgcttcgtgttctcctgtagatgctcctgaaggaactgctgcacggcccattgccccgctttctgtaaatacatctacttcaatggtaggatttcctctggaatctaaaatctgtcttgcttctatgtaagaaattgcactcattttttaatttttttagtttagacaaatttaatcaaaatttaactttcaggcgtatttcacgggatttttttgagataattccaagttaaattttagttaatttatattatgataattgtgcaatttctttattacaattcaatgggttaaaacggaagagtgctgaagcccggacattgtaaaatgccggagcttgatgattgatttcaggcctgattggttttcagtataatgtaaaaaatctttatttcctgggtgaaggagacagcagtccggctaaagcacctattgctcctgaggaaatcgttgcaaaaatagtgaccagctggctatcgggagttttcccattaccccagaaagatataagaatcaaaccaattataatcgaataatggcaaaaccaagcatgatcactatgattctgtaaatccagcaatcggtatctttcggacttcttatttccacttctttaatagcttctatgggattggtcctgaacttttcctgaagatcagtatcattttttaaagctgcttccaaatctccaatactgtcattaataagagttttcatggcttttaattttatataccaaatttcttatgaataagtttaacagtcaattacacaaaagggttatttacagctatgcggaacaccaggcaggttccatgattttcgtgtatcatgctaaattcaccggacaattcattcattcttcttttcatatttctaagtccgtttccttctttctgaccttcagaaataccagttccgttatcggatattttcattgagaagctatttttttcctgtaagaaagaaagattcaaagtatctgcatggctgtgtttataaacattattgacggcttcttttaagcagagaaaaagattacgcctcatttctgtggaaatgggtgttttcactatgatatcttcgctttctgaatacaccattacttttgttttctttaaaaaatttgtggtataaagaatagcatagtcgataaagcttcccagggtatcatttccggcattcaggctccagagcatttcacgcatggagatattcatttcttctgaagtcttcaggagctcttcgatatcgctttgcagatcatcattttctgctttctgcttcagaaattctgcctgaagcttcagtgcggagattcctgccccaaggtcatcatgcatatcatgggagattcgttcccgttcctgttcaagaattttttgtttttccagttctttctgaaggagctggttttgatgttcagcttctttgagctgttgctgttgaataaaaaaaagctgtcttttattatacagaacaactattaatacaataaatatgacaaaagttattaacaaaataacagcaataatataagccaatcgtattgtgtccggtagttgcttcatatggtgtttttgttttcaaatttccctaaagcaatatagaacattccatacataatgatattgacacaatactgcattacttttagaatttgcagaagcccgggatcattatcccgaaggaaaaacattgggatcgatctgaaaataaagaaaatgctccagaaaagcaatccacaggaaacccagaaatgcggatcatccagaatttttatttcttcaaagtttttcagtctgatatacagccaaaccaacacattaatgatgaaataaaaacatgctaatattcctaatgtattttcatagttttcgccataaaattttacaaacagaataatataggccagtatacccatcagaatgtaccggaaaaatactctaactttccgggggaagattttagcatagtagatgttaaagaaaataatcaaaaagatgctgtagtaattaaacaaataagcaaagtcaaattctttattcaatattttataatgtccatacaactccagacaaagggacagaaataaaaataccgcaaaatagttttggctggaaaggcctttttttccagctaaaactatagactttacagtagccgccaaaagtacagcgatgtatattatctggattaccattttacggatataatgaacccatatcgtaatatccctggtctgtattaaaaaccagcgtcatttgtttttcgtgagtttcaaagtgttttttatattgatcttcccgaaatcgatctccaagattattttcaaaaatcactttcttcacatcactgatctcgcatagattgatgataaatgtatcactacgatcttttgacagggtatctatcaaatcaacgatatgataactgatataaaatgtattatttcgtcctaaataattattcaatacccgatgtccgttattaagataaaaatcattaagctctcttaaactttcattggagattttcagatctttgagtgtaagatcctgattggcattgatgataaggtaattattctcatctatagtatttttctcctgtgtttgtaaagaggctaccatatacatcattctgttttcagaataaggtgtaagtcttaaccttacatcctgaggatctatctgcacgaaagtaaatgttagataggtcgccctaatttctttcatgatctcacaaatatcttgcaggagagaatgctgtacagcataaatacctccgagattgaaattcacattctgattttgcataaatggcaaaacaccctttctagcactatcaataaagctttctgccagaatgcggctaattggcagcatttccagcccatccactaactgctcaagcttattaccaataggaccttctctgtacgctagatgatcatcaaggacctgacttgttggatttgaattttccataatttcttagttttttgattgattaaatttattgacagcctccactttgttatttacatgaagttttctgtaaatatttccgacatgctttttcacagtatcgatgctgatgaattttttgtctgcgatttctttgtacagaaggccctgtgaaagaagctcaagaatttccttttcacgttccgtcagttcatcaaagccttcgacttccggaagtttgttttcgaaatgtttcagtactcttctcgcgatagaaaaactcatcggagcaccaccgttataaacatcccgtatcgaagaaagaatcttatccatgctttctccttttacaagataccccatagcaccggctttcaaagaattgaagattttttcgtcatcatcaaaactggtacacataataaattgtgtatcgggcatttcttttcgcagcttttctatgatctcgattccaagcatatcctgtaactggatatccatcattacaacgtcgggagaaataccgggcagattcatcattgtgtcatttccatcgaagaactgagcgataaccttcatatccttctgataattgatgaccttcttcaacgcattgttgtagtttttctcgtcttctactatggctatggaaatgctcatgtctttgtttgtttgaagcaaatttcaacagaaaacaatttgaaatcaattacacctttgggtaatattaagggttgagtttgtggttatggttcagttttttagctgttattaaatttaatcaatttttcattttaaaaacaatatttacctgactattttatagcaaattaaaataaaaccaaaaaaattgagataaatattacaatatcgattgttatttcgcaagctgatctagaatgggatggtcaataccacttatcttattatggaatttgatctgttcaaaaatctgaatcttgtttctgccttttttcaaccatacaccgggaatataaagtgtttgctgggggccttctgtactccagtatcgtcctgcatttcttccgttgataaaaacaattccttttccaaaatttctcatatcaagaaaagtatctcccgtttcattaagggtaaattctgcttcctgaatcacaggtgaatggtcttgaatatctttatttttaaaatgatgtttcggaaaggcatcaaaaggcagaggaagcatttcccagtttccggaaacttcagttccattgattttcacagggctgataattcctttcaggttatgaacgatctctgctccataattgatccttcccatattttcaaccagaatttccaggcggtctccggatttgatttcaatatccagatcatattttttatttaccctgttcagttctcctttccattttccgttgatataaacattcgcataatcacgcaatccttttatctccagtaatcccttctggtctgtatcaaacttttttctgtagagtatatagccgtttccgatattcagatcttcgaacgtaagcggcatatcacttttaacaggtttcatacggtcagtaaggtcaaaaaggctgcttacttttgaaaattcaatttcaggaattgtgatcacttttatcggctttggaacatccggaagtttattcttatgtattttctgaaaaatttctctcaacgcattatattttggggtagcccacccggcttcactgatgggagcatcataatcataactcgtaagatccggttgaatatcatgatccttatcgtaattggcaccgcttgtaaatccgaaattggttccgccatggatcatataataattgaaagacactccattttctatatataaattggtttgctttacgacttcatctgtagaaactttaacaaaaggctctgcccaatgatcaagccatcccgggtagtattctgcaaccatgtagggacctttacctccattatattcattgatacttttctttaaaacatcaatatcactctctccatttgctgttggcaaagcaccttcaacagaacctcctttaaaaagtgaacttccatctgaagtaaataacggcaccgaaattccacttttcaacagcatttctttaatcttatggctgtatttcctgtgctcttcgagcgggatatctttcctctgagccacataagaaccaaattcattttctgcctgtaccataatcaccgggccgccattcgtgatctgcatgggtgtaatctgttctgccagttgactgatatatttccagcattcttctaagaaggctttattatctcttcttatttcaagctctttatttttctgcagccaccatggatatcctccaaattcccattctgcacaaacataaggtccggggcggataatgacatacaatccggtttcctgtgctgtttttataaacttctgcaagtccttttcaccagaaaaattccactttcccggagcttcttcatgataattccagaaaacgtaagtagtaaccgtgtttaaacccattgctttcatcatctccaaacgatgcttccagtgtgctgacggaactctcggatagtgcatttctccagaatatatggtaaacggttttccatttaagaggaaatgtccgtctctgatttcaaatttccctttttgggaaaacacagtattcaaagagaaaaataaaagaattatgctaaaataacggttgaaatttctcatattgtaaggcatgatttttgtaaaatttaaaatataaaaatcaattgaatatcaaataatataatcatgaaaaaaagtcttttagcactgggtgctgtattggcactgacaatagtcagctgcaaaaaaagtgaaagcggaaacaagagcgttattaaaacagacagctcagaaactgtaattacggataataacggaaagatagattcggtaacacaaagttcttctactgtagacatcaacggacagaaaacagagaaaacagattttgtttacaaggctacagatggaacattggtaaaagtagttttcaaaaatgatccgaaagaaagtacagtagccattaccagcaataaaaagacgtttatccttcctaaatcggaaactaaaggagacgaaacaatctataagaaagatgatatgactgcaagagtgaagggggatagccttcatctggagcaaggaaataatattatagaactgaaaagaacgaagatataatataaataaatgcccgctcaggattctgagcgggctttcatttattttttaatcactttttcaaagtatgttttattattggtggtaattttcacaaaataagttcctttcgtaagatcagaaatatctatggaagttcctttggggtgatcaatatttttaaagactttacccagcatatctgcaacaacaatattctttatttgttctttactatcaaaaaacaaaacggaagaagtaggattgggataaatcctcattgtattcttggtttctattctttcatcattggttgacaaggttccatttaccaaatccaatgcataaaatccatacggtgctgttcctattatatagtccttataaatagcgaactttcccatattcgctccaattaaatataataattttgtattcagtattttttgccaggatactccataatctgttgttttccaaacatcacctttataggctccataaccaataccatcatcaaaaatttcaaaatctttaaaagatgatgtcatgttattatttataaaccatgtgtttccaagatcaacagaacagtactgtcctatatatattcttgacgaatttccaaaaacaatatcccggggttgatcaaacactccaggaaagttaatgacagcccaagttataccaccatcaattgttttcatcattttttcactagtaagaagaaatcctacattattatctacaaatttcattactctaacatgccgccctacttcaaaaggagttgaccatcctgtagatgcattgtaagtagtaacgtatcctttataagaatttgcattgtcgcctcttgttgccattgcgaaatctccattaggtttcattgcaagtgcaccagttaaaggatacggaatattttgggcagtccatgttaaaccgctatcttgtgttctccaaaattcataggaactgttacgtattccaattcctttaccattagaaagtatacttaaagaaccagtaggtacattaggaggcatatacttccaggtcattcctttatctactgaaacataacctcctactgttgccaaatgtttagatgcataggcattattatatattaagcccccgcgtaaaatccatttgacatttgtaggaatccaattaataagatctgtacttttaaaaatagaatggtttatttcgtcacttgtttcattatctgtacccaaaagaaattttcctccgcttactgccaaagaagtaaagatatagtatgaagaagggtatataagacttgaatcccatacttctcctgtagctgttctatataatttgtttggaatgccaagtccaactgcaacgaattcattattatatatcttaatatccctcagtccattgatgctaacatcaatccatgtattaccaccatctagtgtatatctcgtagttcctccagtaagagttgcaatgccattgagtggatttttaaaaataattttatcaaatttttcagtggtttcacttaccttagtccatgttgctgctccgtcggtggatttaaaaataaaactcttacctaatgtagcatcggttacgcagtatccagtattagcatcggtaaaaaagacactggtaattttgtctgcataaacagtaggtatcatatacacattccatgtcaccccgccatcagtagatttcattattctgctatttgtagtactaataaagattgtgttatcattcagaacaaataaagattggggaaagtatgagctaggtaatggatgggaaatacccggagtagagaatttagagtctgtaattatcagattatatcctattactgcatatcctttgttattatgaattgtaaaatctgctactgaactcatttcattgatttgtcgccatgttttaccatcgttttcagtaatcaataagtcatcatattcatttctcttttttaccaaatagcttccatctggtaaaatttccattttcatcactcgttcaccttttaaaaatggggtagtaagttgccaatcagtgttcaatgactgactggaaaataaagtacagcatagtattgctgtaaaaagtagtattttcttcatagattagtttttaaaataaaaggagcttgtagtaaactacaagctcctttagcatattttgaagtataaaacttattattcttcagttttttcttcagtagtatcagctttagcttcttctactttctcttctactgcagaagcttcagcaactactgcttcagcttttttagcagttgtagatcttctgcttcttcttgtagcttttttctcttcagcattagggttgtaaagctcgttgaaatctactaattcgataagagcagtatcagcagcatcacctggtctgaatcctgtcttgatgattcttgtataaccaccgtttctttcagcgattttaggagctacagttctgaataattcagcaaccgcatatttattttgaaggtaagagaatactactcttctgttgtgtgtagtatcttcttttgcttttgttaatagaggctcaacatatactcttaaagctttagctttagctacagtagtgttgattcttttatgctcaattagagaacaagccatattagaaagtaaagcacttctgtgagaagctgttcttcctaagtgattgaattttttaccgtgtctcattattaattatttatcagcgtctaacttatattttgcaacgtcgaaaccgaagttaagaccttttgaatgcactaattcttctagttctgtcaaagattttttaccaaaatttctgaatttcatcaaatcagacttactgtaagaaaccaattctccaagagtttctacttcagctgctttcagacagttaagggctcttacagaaagatccatatctgctaatttagacttaagaagttgtcttgtgtgaagagtttcttcatcgtactggatagatgcttttacagcttcagtttcaagagtgattctctcatcagagaataacatgaagtgataaattaatatcttagaagcttcagttaaagcattctgagggctgatagacccgtcagtttctatatctaatacaagtttttcgtagtctgttttttgctctacacgataattttcaatgctgtattgtactttcttgattggcgtgaaaatagagtcaatagcaatagtacctacaggtgcattgtttgacttattttgttctgaaggaacatatcctctacctttttcaatattgaaagtaatttcgaaagttacatcagtgtttaggttgcagatcaccaaatccgggttaagaacctcaaatccgttgatagactttcctaaatcaccagcagtaataaccgtttgacctgaaactttagcaacaacctgctcgttagcctggccttctgctgcagcttttaatcttacctgcttaaggttaagaataatttcggtaacgtcttcgattactcctggaatagttgaaaattcgtgctctacaccttctattttgatagatgaaatagcgtatccttccagagaagaaagcaacactcttctcaaagcattaccgattgtaagcccgaaacctggttctaaaggtctgaattcaaattgacctttaaattcatcagagttaagtaaaattactttatcgggttttatgaattgtaaaattgccatattattgggttgagcaaaaatttgattaaaaaattatttagagtaaagttcgacgataaggttttccttaatgtcctccggaatctggattctttcaggagcagaaacgaaagttccttcttttttctcatcgttgaattgtaaccactcatagtttgacttagaagccaatgcattggtaacaacttcaagagacttagacttttctcttacggcgattacatcaccagcttttaccaagtaagaagggatattaagaatctctccgttcacagtgatatgtctgtgagaaaccaattgtctagcagcagatcttgttttagcaaaaccgaatctgtatactacgttatccaatcttgattcacaaagttgtaatagaacttcccctgttacacctttacttctgtgtgctttgtcaaataagttagcaaactgtctttctaaaataccgtaagtatatttagctttttgtttttcagctaactgaactgcatattctgattttttagcacctcttcttttgttaggaccgtgttgtcctggcggttggttttttcttttttcgaagtttttatcatctccgtagattgcagcaccaaactttctagcaatcttagttttaggtccaatatatcttgccataatgggtaaattctaaaaattaaactcttcttctttttggtggtctacatccattgtgtggcataggagtcacatcaatgatttcgctaacttcaattcctgaattgtggatagatctgatcgcagattctctacctgcacctggacctttcacaaacacctttactcttcttaaaccagcttcgtgagctacagcagagcaattttcagctgccatctgagcagcaaatggagtattctttttagaacctctgaatcccattttaccggcagaagcccaagagataacctctccgtttttatttgttaaagaaatgatgatgttattgaaagaagcctgaatatgagcttcaccaatagcttcaacttttacttttcttttcttaactactttagtttgttttgccataattcctaacgattatttactagcttttttcttgttagcaacagtttttctcttccctttacgtgttctagagttgtttttcgttctctggcctcttaaaggtaatccaagtctgtgacgtattcctcgttggcatcctatgtccatcaatctcttgatgttcaattgcacttcagatctcaattctccttctacttttacgttttcagagatatatgttctgattgcagccaattcatcgtcattccattcgttgactttcttgtcttcgctgataccggcagctttaaggatttcagaagaagtacttcttcctactccatagatgtaagttaaaccgataacacctcttttgttttttggtaaatcaatacctgcaattctcgccataatttaatgttaaccttgtctttgtttaaattttgggttcttcttgttgattacgaacagtacaccttttctgcgtacgattttgcaatcagcgcttctttttttaattgatgctcttactttcattttgatagtatttattttttacaaatgccaaatggaatgggtattccatttggctaattgttttaatatctaaatgtgatcctcccttttgtcaaatcatagggagacatttctagttttaccttatctccaggtaaaagtttaatataatgcattctcattttgccggagatatgagcaataaggatatgcccgttttccagctctacacggaacatggcgttagaaagtgcttccacgatcacgccatcttgttcaatatgtttttgttttgccataaattaatatccagtcgttcttgataatttagactgcattaagccatcataatgatggttcagcagataagtattaatctgttgaactgtatctaaaattacacccaccataattaatagggacgttcccccgaaaaatagggcaaacgcatctgtctgaacaaagcttccatgcacaattgccggaaggactgcaaagatagataaaaaaattgcacctggcaaggtaatttttgataaaatatcatctaaataatcagcggtctctttaccgggtcttactttcggtactaaacctccatttctcttcaagtcatcagccatctggtttaccggaattgtaatcgcagtatagaaaaatgagaagataataattaatagcgcaaacaatacgttgtactgccagctaaaaacattcttgaaacctgcaagaaaagtattagactcatcgaattttgttaataatcctggtacgaacatcaatgcctgggcaaagataatcggcattacaccagcagcatttactttcaatggaatccattgtcttgctccctgcataagatttctgtttacacctcctcttgcttgagctctgcttacatactgaatcggaatttttctaacagctactgataagattactgctaaaagaactaccaacatccagaataatacttcaataaggatcatgatagatcccattcctcctttaccgttctgcacggccatctcctgtacgaatgcttcaggtaatcttgaaaggattcccaccataataaggatagaaataccgtttccgatacctttgtcagtgattttttcacctaaccacattgcgaatactgaaccggcaaccaggataacaatacttggcaaccagaacatgatagaatttggctctacataatatgcagactggaactgagcatacggtaagaataattgagtaatagaagttaagtaagaaggtgcctgtaccagacaaactccaatcgttaaccatcttgtaatttggttcaatgtatttctacctgactctccatctttctgaagcttctgaagataaggaatagccatccccatcaactgaacaataatagaagcagaaatataaggcatgattcctaacgccattacggaagcgtggctgaaagctccccccgtaaacgacgaaagcaagccaaggagacctgctccttgcttgttaccgccttgatttttataatgctctaagagatctcccacctctgcaaggttaattgccggaagtgagatataagatgcgaatctatacacaaggattatacctaaagtaaagagaattttatctctaagttctttaagactccaaatatttttaagtgtttgtataaattctttcattagtaagtattataaggtaattgcttttccacctgccttagcaataagctcttcagcagatttagtgaatttgtcagcagagattgaaaccgcagatttcaattctcctctacccataattttcactaattcgtttttagaaactaaaccattttctactaaaacttctttcgtgatatctcctgtgatggatttgttctcgattaaagtttggattgtatcaaggtttactcctctaaactcttttctgtttacgtttttgaatccgaatttaggtaatcttctttgtaaaggcatttgtccaccttcgaaaccgattttctgagaataaccagctctagacttctgacctttgtgtccttttgttgaagtacctccttttccactaccttgacctctaccaattctctttgagttgaaagtagatcctgcagcaggttttatgttatttaaattcattttaatttctcttttataaaattatttttgaacttcaagtaagtgatttactgcagcgatcattcctaagatagaaggagtagcttcgtgttctacaacttggtgaagtttttttaatcctaatgcttcaagcgttctcttttgggtttttgttctaccaatagcgcttcttacttgctttactttaattgttgccattgttttaattattaaccgttaaacactttacttagagaaattcctctcattctagcgatctcttcaggtcttctgatgtctaataacgctttgaaagtagctttcaccacgttgtgagggttagaagatcctttagattttgaaaggatatcgtgaataccagcagattccaataccgctcttaccgcacctccggcgataagtcctgtaccgtgagaagcaggtcttaggaagatatctgcaccaccgtatctagcagtagtttggtgaggaatagtgtggttcattacaggaactttcacaaggtttttcttagcgtcttcaactgctttagcaattgcagaagcaacctctttagattttcctaaaccgaaaccgataacaccttcttcgtttcctactacaacgatagcagaaaatccgaaagctctacccccttttgttacttttgttactctgttaacagctacgagacgatcttttaattctaatcctcccggttttactctttctatattatctagtcctaacatattttccgaaatttaatgattagaatttaagtccaccttctcttgcaccatcagccagagcttttactctaccgtggtatacgaatccgtttctgtcaaatacaatactttcgattcctgcagcgatagctttagcagcgatagctttaccaacagcagcagaaacttcagtcttagtacctttagcgtctacacctttctctctagaagaagcagatactaaagttttaccatttttatcgtcgattaactgagcgtaaatttccttattacttttatatacagataatcttggcaattcagaagatccagagattttccctcttactcttcttttgattcttattcttttttctaatttacttaatgccataatacttataatttattaagcagatttaccagctttacgtctaacattttcaccaacgaatcttacaccttttcctttgtatggctcaggctttctgaaagaacggatctttgcagtaaccattcctagaagttgcttgtcatgagacgttaaagtaataattgggtttttacctttttcagtcaatgtatcaacttttacttcatttggaagttctaatacgataccgtgagagaatcctaaagctaattcaagtttttgacctgagtgagaagctctgtatcctacccctactagttctagtttcttttcgaaaccttctgatacaccaacgatcatgttagcgatcaacgctctgtataaaccgtgaagcgctttgtgttgtttagaatcagatggtctgtttacgttaagttcaccatctttttgttctaaagtaattcctgctgtaagctcctgagaaagttctcctttagccccttttacagttactacaccattgttttcagtgattgtaactcctgctggaattgttataattgctttaccaattcttgacattttcctgtgattaaaaattaataaacatagcagattacttcaccgcctactttctcttctctagctttcttgtcagtcattactccttttgaagtagagatgatagaaatacccaaaccgtttagtactcttggaagctcagctgaacctttgtactgtctcaaacctggtctagaagctctttggatagacttgatagccggtttgttagtttgcttatcgtactttaaagcgattttgatcactccctgaacagcgttatcttcaaacttgtagtttaagatatacccctgatcaaataagatcttagtaatctcctttttgattttcgatgcaggaatttccaccactttgtggcctgcgctttgtgcgttccttactcttgttaggaaatctgaaattggatctgttaccatttttcttttataaattattggttaaagaacaatcagttttgcaaagacttgaagagtaaaatatcagacttcagaaatcttcagtctgatatttttatctttagtatctgaacaacttaattgtcccgatttttaattagtaattattaccaactagcttttcttacacccgggataagaccgttgttagccatttctctgaaagttactctggaaataccaaacgttctcatgtatcctcttggtctacctgttagtttacatctgttgtgtaatcttacaggagaagcatttttaggcaatttttgaagtccttcgtaatcaccagcttctttaagagcttgtcttttagcagcgtatttagcaactagtgcttctcttttgcgctcacgcgctttcattgattctttagccatttcttagttctttttaaatggtaaaccgaagtgagttaataatgctttagcttctttatctgttttcgcagtagttacgaaagtgatgtccatcccctggatttttttcactttgtcaattacgatttcagggaagataatctgctcagtaatacctaagttgtagttacctctaccatcgaaaccatcagctttgattccagagaaatctctgatacgaggcaaagcagaagaagtaagtctgtctaagaattcatacatctgatttcctcttagggtaacttttgcacctactggcattccttttctcaatttgaaagcagcttcgtctttcttagagattgtaccaacagccttttgaccagtgatattcgtaagctcttctacagcataatcaatgattttcttgtctgcagtagcatcacctaaaccttgtgatacaacgattttctctaatttaggtacttgcattactgacttatacccgaattcttccatcattgcaggaacaattgtttctttatatgcttttttgggtcttgctatatattccatgtgttatttaaaattataaagtttcacccgtttttttgttgattcttactttcttatctccttcgattttgtaacctactttgatagcttttccgtctttaccaactaaagctacgtttgagatatgaatagaagcttctctttcaacgattcctccttgaggatttgaagctgaaggcttaacgtgctttttgatgatgttaagtcctgcaacaactactctagggtctcttccttctttcttaatcacttcaataacttcaccagtcttacctttgatatctttcttaccagtagtaatgattacgttatctcctctttttatttttaactttgacatttctttaaaaaattttaaaaattaaagtacttcaggagctaatgaaatgattttcatatattctttgtctctcaactcacgagcaactggtccgaaaacacgagttcctctcatttctcctgctgcgtttagtaatacacaagcattgtcgtcgaacttgatgtatgaaccatcttttcttcttactgcttttttagttcttactactacagctttagatacctgaccttttttagcgtttcctgatggtgtagaatccttgatagtaacaacgattttatcaccaactgaagcatatcttcttctggttcctcccagaactctgataactagtacttctttcgcacctgtgttatcagcaacttttaatcttgattctgtttgtaacattattacttagctttttcaatgattcttactaatctccatctcttgttcttgctcaaaggtctagtttcctggattaaaactgtatctccctcgttgcattcgttgttctcgtcgtgtgcagtatattttttcgtttttaatacgaatttaccgtacatcgggtgcttcattctcatcgtttcactaacaacaatggtcttttccattttattgctggaaacaactccgattctttcttttcttaaatttctttccattgtaaaatgaaattattgtttgttagttaactcagtgtttagtcttgcgattgtttttctcaaatctttgatttgaatcgggttttcaattgggctgattgcatgagccaatttcaatttagaatattgagcttttgcttcagttaattgagcttgaatatcacccgcgcttaaatttttaatatcagcttttttcattgtattcaaagattatagaggtttaacaaaatcgttagcaacgatgaatttagtaactactggtaatttttgtgcggcaagtctaagagcttctttcgctacttcgtaaggaacacctccaacttcgaacataattttacctggttttactacagctacccaatattcaacagcacctttacctttacccatacgtacttccgctggtttcttagtaatcggcttatctgggaagattttgatccatagctgaccttctctcttcatatatcttgttgcagcgatacgcgcagcttcaatttgtctggcagtgatccaagcaccttccgttgctttaatcccgaaagttccgtaagcaagttgactacctctctgggcattccccttcatcttcatcttatgaactctacggaatttggttctttttggttgtaacataatttctaaattttagattttagattttagattttagatttttttttattttaaaaaagtaacggtaatttaaaactcaaaactctaatctaaaattttaattattattgttattgttgttgttttttctaggtcttctgttgtctctgtctcctcctctgtttcctctttcagactgacctccttttttctgttgtcccactagtggagaaagttctcttttaccgtaaacttcacctttcatgatccaaacttttacccctagtctaccgtaagtagtgtgagcttctgcccagtggtaatcgatatcagctctgaaagttgacaatggaattcttccttctttgaaagattctgatcttgccatttcagctccgtttaatctaccagagatttgaactttgataccttcagcacccattctcatagtacttgccattgccattttaacagctcttctgtaagaaattctgttttcaatttgcttagaaatactatcagcaaccaatacagcatctaattcaggtcttttgatttcgaaaatgttgatttgaatatccttaccagtcaattttttcaactcttctttcaatttatcaacttcctgacctcctttaccgatgataagtcccggtctagcagtagtaatagttactgtaactaattttaaagttctttcaatataaatttttgaaataccacctttagataatctagcttcaaggtatcttctgattttgtagtcttcagcgattctgtctccataatcgtttccaccaaaccagttagaatcccatcctctgatgatacctaatctgttaccaattggatttgtcttctgtcccataccttgattaattttctttgttacctaagattaatgtaacgtggttagatctttttctgattctataccctctaccttgtggagctggtcttagtctcttcaattgtcttgcactatccacaaatatttctttaacgataaggtttgcttcctcaatgtcagcaccttcgtttttcacttgccagttagccatagcagaaagaagtaatttttctaacttgttagaagcatctttcttagaatattttaggatataaagtgctttgtctacctgctctcctctaatgatatcagcaactaatctcatttttcttggagaagacgggcaattatttaatgaagcttttacaacgtctttgttagcttcttttcttgcgattgaactatcttgttttcttgatcccatgattatctgcttcctttgtttttgttaccaccatgacctctgaaagatcttgttggagaaaattcgcctaacttgtgaccaaccatgttttctgtaacatatacagggataaaagatttcccgttgtgtacagcaatagtttgtcctacgaagtccggagagatcatagatgctctagaccaagttttgataactgtcttcttaccagactctatatttgcctgaaccttcttatctaaagtatgatgaatgaacggtccttttttaagtgatcttgccataattattttcttttagatacgatgtaacggttagacactttgtttttctttctagttttgtaacctttagccggtttaccgtttctagatcttgggtgacctcctgaagaacgtccttcaccaccacccattgggtgatctactgggttcattacaaccgctcttgttcttggtcttctacctaaccatctgcttctaccagctttacctgatacagttaattggtgatctgagttggaaacagaaccaatcattgccatacattcagtaaggatcattcttgattctcctgaaggtaacttgatgattgcatatttaccatctcttgaagttaattgagctgaagaaccagcacttcttgctaaaatcgccccttgtccaggtttcatttcaacacaagaaattacagtacccaatggaatgtttttcaatttcattgcgttacctacgtttggttcaacgctttctcctgatactactttctgatctactttgataccgtttggagcgatgatatatctcttctctccgtctgcgtattctaataaagcgataaatgcagttctgtttggatcgtattctacagattttacagtagcttcaacgtttgctttgtttcttttgaagtcaataattctgtatttctttttgtgtccacctccggtgtaacgcatggtcattttacctgtattgttacgtccacctgactttttaataccaactactagagatttctctggcttgttagtagtaatttcctcaaaattgtttacaattctgaatctctgtcccggggtgataggttttaattttctaacagacattactattatttataattaataattaatttacagcaaaaatatcgataacctcaccttcagcaagtttgattaccgcttttttcaatttgtttgtctttcctacttgaagaccttttttagtgtattttgaagaaaccttcggagcataaatcattgtgttaacgtctgctacttttacaccgtaagctgcttcaacagcttttttgatctcgattttattcgccttaggattcactaagaaagaataagaacctcttaaatctgtaaggtaattagccttttctgaaataactggtttaataataactgacatgatttatttctttaaattttcctggaatttttcaactgcaccttcgaagaaaatgatctcaccagcgtttactaaatcgtaagaactgatttcgttgaagttcattactttagctttaggtaagtttcttgaagataaatatacattcttgttagcttcaggaagaacgaataaagattttttaccgttaagttccaatgcgtttaatacattgatgaaatctttagtcttaggagcagcaaagctcatatcttctaaaactttaatgctgttgtctctcattttctgagataatacagattttttagctaatctcttaagagctttgttcaatttgaatctgtagtctcttggttttggtccgaatactctacctccacctctgaataccggagatttgatatcaccgtatctagcagatcctgatcctttttgcttcttaagctttttagtagaagcagtaatttcgcttctttcttttgctttatgagtaccttgtctttgagcagcaagatactgtttaacttctaagtaaaccgcgtgctgatttggctcaattccgaatactgtttcgtctagagttacttttcttccggtctcttttcctgatgtatttaatactactagttccattttctgataattacataagaatttttagctcccggaacagcaccttttactactaaaagattttgttcttgatcaacttttaacacttgaaggttttgaacagttacctgtttacctcccattcttccagccattctcatccctttgaatactcttgaagggtctgaaccagcaccgatagaacctggagctctaagtctgttgtgctgaccatgagttgcctgcattacacctccaaatccgtgtcttttaacaacaccctggaagcctttaccttttgaagttcctgttacgtcaacatattcaccttctgcgaatagatcaacttttacttcttctcctacttttacttcatcaacgaattctctgtagaattcaactaatttagctttaggagcagaaccagcctttttaaaatgaccagctaacgctttaccaacgttcttctcactcttgtcatcgaaacctaactgaacagctttataaccgtctttttctaaggttctgacctgtaaaaccgagcatggaccagcttggataactgtacaaggaatgttttttccttcttcgttaaacaaagatgtcataccgatttttttaccaataatacctgacattgtttatattataataaaatttatcctttatttatcaccatttttcgggagtctgaggtaatttctacttttgatataggcataccacgcccctaaaatgagtgtgcaaatttatgaataattttgtaactgacaaatatttcgactaaaatattttgatttttaatcatttagcgatttcagaaaaaaatctatccgaaattttgaaaatgctctttgaagtttaaaagaaagtcattaatatatttttttccaacatccgatttccttactaccaaataatgttttctttttaaaccgttattgccgatttttttaaaacttaattcatcggacagcctgaatgaatttaacgcccatttcggcatacaggtaatccccatattggcttgtaccatttccaaagtaacttccgttaaaggaactgcagaagttttgacaggcattattccgttaggatttagaaattgttcataaacagaaaccgtttttaagggaaaagaatgaataatcaaatgagcatccagaaaatcttcagcaacaagatattcggtattgttcaaaatattttcctcatgaataacagcaaaaatttcatcctcaaaaatctcaatactaaccaagtctttattaccggaaggttttgaagtgaccacagcaatatcgatttcattggatataactttttcaacaggtctatgggtcgcctccaacaccagatccacttcaatttcaggatataatactttcattttctgaataaacaaaggcagcccctgatagaatgaataacattccgtactgattttgatagtacccgccgctccggctctgatctgttgaatggtattcaaaccgttcccgatactttctattaccgtacatgcagttttataaagaatacttccctcttccgtcagctcccatttgttcctagttctgtaaaacaccttaaaaccaagctggatttccagatccttaagctgatggctcaacgccgactgtgtcaaaaaaagcttttcggaagaacctgcaatactcccttcctccgcaattgttttaataagctttaaaaacttgatttccattatgcaaagttaacaatataacgcaagacaatgtttgaaaatatttcatttaaaactgcagagcattcaatttcaatcttaggaaaagaatataccctaacatagttttgcaccataaacaatttaaaaattatgcaagaacaaattgaattctaccagaaaaaattaatgtatgaaatagatccttcagatctgtatgatgcatttcaaaacagtacagattatatagcagtagataccagaagaccaaatggctacagcaaagagcacattccatccgcaattaatcttccccatcgggaaatgacagaggagagcacgcagcaccttgacaagtcaaaaatatatgtctgctattgtgacgggattggctgtaatgcttccacaaaaggaactttaaaaatgactcaattaggttttaaagtcattgaattaattggaggaatcgaatggtggaaatttgacggctacgccacagcaggaaacgagcctaccaatggttccacttttgtatgcgcctgctaacccaagaataagagacacatgaaaatacgatttgccgaagaaaaagacctgagtttcattattgaattatgtaaagcccatgcgcagcacgaaagaagctcttttaaagaagaaaataaaaaggaacagctatctaaacacattctcaatccggattctgagataaaatgcctgattgcagaatctgatactgaaataataggatatgcaacatttttcaaacagttctccacctgggatgccggctattatatgtatgttgactgtctgtttttaaaagaaaatgcaaggggaaacggaacaggaaaacaaataatggaattaataaaaagttactcaaaagaacaaggctgcccgataatccagtggcagactccaggttttaatataagagccatcaaattctacactttgcttggagcggaaagaaaaaacaaagaaaggtttttctggaaagtataacccaaatgattcttaattaaaacagagacattctggcttcaggatgtctcttttttaactatttgatcaagataaatgtagtttattttacaataactgtaactcccctttcttctaatgcggacttatcttccttacttataccatcatctgtaatcagataatctacttcatccagtgaggcgatcttcccgaaacctttcttattcaattttgaggaatccgccaaaaccacggtcttatctgcacattcgatcataacctgattaagatgcgcctctgcagcattggaagtactgattccaaattcaagatcaatcccgtctacacccagaaaaagtttattgcaggaaaactgtttgagaattccttccgaaatagaccctacaatggaagtcgagcttttcctcacttcccctcccaactggatcacattaatattaggattattgcaaagctcaattgctacccgcaaagaggatgtcaacactgtaagcggaccgaagttcatcaacatccttgcaagataatgcatcgtagttcctgatgccaatataatacagtcattctcctggatcaatggaagtgcagcccttgcaatagcctgcttcgcctctacattaatattttctttctcccctacattcttttcataagcataccttacctgcttacttgctcccccatgattcctgaaaagaagccccagactttcgagatagttcagatcctttcggatcgtaaccgaagatacattgagcttttcacacaagtcctgtacaagcacatgccctttatcatccagctctttaagtatttcatcctgccttggtaatagcttttccattttattcgtttcctcaaaattaccgattttttccgacatcttaaaatttcatttattttctttttgctttcatttttaatttatatatttgaaaacgaaacataaacgaaacatttatgaaacgaaacgaagaactcagtaaattaaccaatgtaaaagaatgggactttattgtcataggaggaggagccagtggtttaggttcagcattagatgcggtaagcaggggattcaaaactttattgcttgaatctcacgatttcgcaaaagcaacttccagcagaagtaccaaattggtacacggtggagtaagatatcttgcccagggagatgtcggattggtaaaagaagcattaaaggaaagaggacttctggcaaaaaatgcagcacatatcgtaaaaaatcagtcttttattattcccaactacacatggtggggagggatctattataaaataggattgtctgtttatgattttcttgccggaaagctgagtttgggtaaaacaaaatacatcagcaaatcaaaaacagtcgaaaagcttcctactattgaacaaaaccacttaatgagcggtgttgtttaccaggacggacagtttgacgatgcaagacttgcgatcaaccttacccaaactattattgaaaaaggcggaagtgcagtcaactatgtaaaagtaatcaatcttttaaaagatgcttccgataaaataatcggtgttgttgcagaagaccagttttccaaacagcaatatcagattcatggtaaagtagttatcaatgcaaccggcgtattcacgaatgatatcctgaatatgaacaaccctaagcatggtaaacttgttgtaccaagccaggggatccatctcgtactggacaaatccttcctgaaaagtgatgatgcgatcatgattccgaaaacttcagacggcagggttttatttgttgtgccatggcatgaccgggctttggtaggaactacagatactcttcttgaaaatgaaagctttgaacctcgagcactggaagaggaaataagcttcgttttaaatacagccagacaatatctggctaaaaaaccaacacgtgaagatgttaaatctgttttcgcaggccttcgtcctcttgccgctcccaaagacggaagcaaaagcacaaaagaagtttcccgaagccacaaagtgattacttcagaaacaggattggtttccattattggaggaaagtggaccacctaccgtaaaatggcggaagacaccgtagatgaagctatgaaagttcacaggttgggaaacagcccatcaaaaacagagcatatgtccatccacggaaatgtaaaacctgaacaggtagacagaaccaaccacctgtatgtgtatggatctgacattccagccataaaagcattgcaggaaagcaaccctcgttatgcacaaaagatccacccggaccaccctttcactgtagctgaaattgtatgggcagtgagagcagaaatggcagaaacgattgaagatatcttggcaagaagagtccgtttattgttcctggatgcgagggcagcaatagacagtgctcataatgtagcaagaattattgctgaagaaaaaggatattctgaagaatgggctcagcagcaggaaaatgaattcattgaactggcaaaaggatatttactgactccttattcacctaaagttatcaacctaaattagcactatatacatgaatgaaaagcttatcctcgctctagaccaggggacaacttcctccagagcgattctcttcaaccatagtggagaaatcaaatatgtatctcagaaagatttcagacagatattccctactccgggatgggtagaacacgatccgaatgaaatctggtcttcacagatctccgtagcagcagaagtgatagcgaaagcagggatctccggactggaagttgccgctatcggaattaccaatcaacgtgaaaccaccattgtatgggataaagaaaccggtgaaccgatctacaatgccattgtatggcaggaccgcagaacttcaaaatactgcgatgaactgaaagaacagggacacactgaaaccatcaaagaaaaaacaggacttgttttggatgcctacttttcagccaccaagctaaaatggattcttgatcatgtagaaggagcaagacaaaaagctgaggaaggaaaattgtgcttcggaactgttgatacctggcttgtttggaaactgacccgtggaaaaatgttcatcacagacgtttccaatgccagcagaacaatgcttctgaatattcatactttagaatgggataatgatttattagaattgtttgacattcctagaaacattcttcctgaagtaaagcaaagcagtgagatatacggagagaccgctactaccctgttctctaccaaaattccgatcgcaggtattgccggagaccagcaggcagccttattcgggcagatgtgtaccactccgggaatggtaaagaatacttacggaacaggatgcttcctgctaatgaacacaggaacggaagctgtttcttctaaaaacaaccttcttaccactgtagcgtggaaaattaacggagaagttaattatgcgcttgaaggaagtgtattcgtaggaggtgccgctattcaatggctgagagatggtcttaagcttattcattcttctgagcaggtaaacgaactggctgcttctgtagaagataatggcggtgtttatttcgttcctgcattaaccggtcttggtgctccttactgggatcagtatgcacgcggaacgattgtagggatcacccgcgggactaccgatgcccatatcgccagagctaccctggaagggattgcatttcaggtatacgagattgtaaaagcaatggaagctgattccggaagagccagccttgaattaagagtagacggcggtgcctccgcaagtgatcttctgatgcagatccagtctgatcttttcggatttaaaattacaagacccaaaacattggaaactacagctcttggagcagcctaccttgcaggacttgcagtaggatattggaaaagtattgacgaaatccaggaacaatggatagtagacaaagacttccaccctcaactggacagagagaaggtaaataaaatgacccacttctggaagaaagctgtaaaaagcgctcaaagctggattgaagattaactcacttattaaaaaaaacttatatgaccccatttattgcagaagttatcggtacgatgcttcttatattgttaggcaacggtgttgtagccaatgttgtcttaaaagatacgaaaggaaataattccggatggattgttattactaccgcgtgggcattggccgtttttgtgggagtaaccgttgcagggccaataagtggggcccacctgaatccggcagtaaccattggccttgctgttgcaggaaaattctcatgggaccttgttccttcctatatcgcagcgcaaatgatcggaggaatgctgggcgcatttttagtatggctgtttcataaagatcattttgctattacggaggacgaaggtgcgaaactggcatgcttcagtaccggtccggcgataagaaaaacatcttctaatcttatcagtgagatcatcgggacatttgtactggtattctgcgtattttactttgcagatccaagtatttccctgcaggcagatccaaccgccaaagtaggcctgggttccatcggagcgatccctgttacctttgtcgtttgggcaatcggtttatctctgggaggaactacaggatatgccattaacccggcaagagatcttgctccaagaatcatgcattccattttacctgtaaagggaagcagtgattggggatatgcgtggattcctatagtaggtccgattacaggagctattatcgcagcagtattatatggacttttaaaataagacaaatgatgagaaaaatcttaaagggaatcttcgttcttgctttaggcacaggaagattattttcacaggaaaatggtgaaaccaaggaaaccaaagaaggaagacttgattttactgccaacattcagaacaatcacttatggagagggcttatcattacggataaacctgtagtgatggggaatctctcttacgccctggatgcagagaaaaaatggaaggtaggaatctggggagcttctgcattagccgatgataaggacaacacccattataaagagatcaattattatgttcaatattctgacgggcgtttttatatcgggttatgggatctttataattccagaaatattaatactgcagtagcggcagatgacattttcagttattcacagagaagaactgcccatattattgatttaagaaccaattatactttcgggccttcattccctatcaatattgaagcggatatcatgttgtacggaggggccaatgccggagaagtaattctggaacctgacggaagctacaagaaaaacagatactctacttacgttcaggcaagctatcctgttattaaggggcagaaagtcaatctggatgcatttgtaggagccggatttgctcttaatgataaaacctttttgtacggcaacggcaaaaacagttttgacattgtcaatgtaggagtaaaagcaggaaaagttgttaagattacagatcattacagtcttccggtatcaatgatggcgatgtggaatccttctaatagatttgcaagaattcagcttgcagcaactgttttttaaactgatttaaatgcaataatagaaagccacttcttttaggagtggtttgtttttataaaaaacatgcatcaaatcaaaattcacaactcattttatcaaagaaatttcttttacaattttttaattttaaacaacagtgtttttacggtgaatactttgcttaaaaaattttacttttgaaaaaaatagatatgaaaaagtttttcagtttaatggttctgtgcatcagtatctttacatgggcacaacaaacggatgttccttttatcggatacaggaattttgatattttgaaaggatatagcggcaccggtactcctcattattatctggatgtaaaaagtaatggtgatgtacattttggctatgttcagatcaatcaggccaacggggaagaaacaacggaagaaatcaatgcaggaaaatatgcacctaataaggtaatgaaagtagtctttaaaaaatatgaggaaaccttttttgtgaaattcaacaaagaaaaaatctaccttaccgacgaaaaaggaaatgtaaagaatcttgatggctgctgttcatccagtgaaagtatcactaaagagacctgcacctgtgaaagtgaatttttcaagtagtaaataatatattaaaaagccatccatttgggtggttttatggttgttggagaaaactaccctataattgtaaaaacatactattataattttccatcaacaaaaactttatacatttgtagcagcccaccttcacattataggttcgtccttcaatcaccgggattttacggtttattttctgctaaaatatctttaattttgaagggtgatttacaccaatgaaacatttaaaaattttatttctatttcttctctttcttatggtatcctgcagcaggaaagagaatcatccttatacattttattactggaaaaccaaactgaagcttgaccatgcagaaaagaaagcattggaaaaagcaacagttccttatttatataccagattctttgatgtagataaagtcaatgggaaatttcagccggtggcagtgattaccaaagacgtgagttttcagacaggaaaacaggttgttcctacggtttttattaccaatcagactttactgggcatttctgtagaagaaatcagatttctggctgaaagtattcatcttttagttcagaagaaagctgaagaatataaactgaaaaccaataatgaaattcagatcgactgcgactggaccgccggaacaagaaatgattatttcaaatttctgagggaactcaaaagaatctccggaaaagaaataacctgtacgcttcgccttcatcaggttaaagataaaaaacaaaccggcattcctcccgtagaaaaagtatatctaatgtgctactctacttcatcaccccttgaaaagtctgataaaaattctatcctggatgtgaatatcctgaaaagttatctttcaaaaatggaagactatccaatcaggaaaattgaagtggcgcttcctatttactcctggggaattatcaccaaccatttaggcaagcacaaactgattaatgctttatcaaaacgagatttggagaatcctgattttaagaggatatccgatcatgaagctgaagttctgaaagacggtttctactttggaagttatttaaacaaaggctttaaaataaaggttgaggaaatatctgaaggacagcttaacgacgctattgactttttacagaaaaaaataccacattttaatattatttattatcaattagatagtaaatttgtgtcagaccgtaaattttaatctccggcaaatggagatcagccagcctgaaccttatcatacaatattataaactaaaaaaacactacaaaccctatgaaaaagtatattctttcacttgcggttgtatcacttttctatacccaatctgatgcctgtgcatggtcggatcctgattatgattacttcaacctttttacacaaacgatcattaaagacaaagcttatcttccctttctgcacaactattcaagcaggttttatggaggttacaatccggcattgattcctgatgacaacgttgaaacatggaaaaagtttttcaacaatcagcttagctatactgagactcagaatctggtctataaagtgagtatgaacgacctgaatgccttaaagaacggaaatccgaccaatcctcttttacaaaagcttggaaccggattttaccagaagtataaggaaggtattgattatttgattgaagccaaatatcttgagccttatatgagcatcaattacatcgaaagtgaaaattcattttactacgacagagatgccaacaggaaaaatgcaacagctctggattaccctaaaactattgctgcactaacatctttatataatgcagcaaggaatcctgaaatcaaacagcgttacggatatcagctggtacgtctgaatcattataccagaaattacgattctgctgtacaggctttcaaaacttatgttgcgcctgtgaaattaagaggaacggtatatttcatggctcttgatcagcttgccggagcacaaagaggactggaaatgaacagcgatgccaactggaatttctttcaggtattcatgaacagcaaagaccgcaaggaatctgcatttgtctctatgaagctttcagatactgcctctttcagcaatatcatgaaaagagccggaacgaatgaagaaaagaatatggcgtatttccttttagggtatgaagatttcaacaacccgattcctacgatggaaaagatgtatgagatcaatcctgattctgaaattctgaaggtaatggctgcaagaagcatcaatgaactggaaaggagctaccttccagtgtattattacaattctgatgcggctaaaagtccgtatgtacaaagaggaaaagcagataacaatgtctcttcaaaggatgacaaagctacctccacaactgaagtaaaggaagaaaagctttcattctggcaaaaaattgtgagattctttaaaaacctgttcgggggatctaaaaaagaatccgctgatggaagtaaaacagatcagagcgatgatgaattactggatgacccaaacagaattccgttctatactacttccggttatggttatgatgataagatgaaggactatcttgacgatcttcagaagttcactgacaaaaccaaagaaaagtctaaggatgagttctggcagattgcagatgcttaccttaaattccttaaaaaagattacaaaggaagtacggaaatccttaccgatatcaaaacctccaatccggaatatctggaagaaatcaaaagaatgaaggttctgaatgatatcgtttcccagccaagaattgacgcagcatatgaagaccgcctgatgaaagattatgcggagtattttgtagagaaaaaggtagaaaaggatactgccacaactgataattttgattattacggtgaagtaccgtctactgctgatttccttaaagatgtgctcgccaaccgttatttccttcagggcgaagatggaaaatcattcctgatgaacaacaaactttcggatctgcaatataaccctaactcaagccttgtgaagagtgtggaagccttttacagaaaacctaataaaacccagtttgaacagcagatcattgctaaaaatatggacagtgtaggtgatattgatgcctttttcaatacaatttacggagacagagccatgagacttgcggattttgaaaaggcgaagtcttattatgaaaaagcaaaaaactttgccggtattccaagacagaattatgaatggacagaaaaagaaggacagactgttacagctaaacagtatgctcctgctgaatacaacggatttaaaaatatttcaaatcttgtattcgggcataatgtatgggaaagttttggaagtcctgaaaacgaaagtatggaagcagaaaattataccgacttccctttcatcaaaacaagcatgaataagcttgagcttgccgatgcattgattcagcttaagaagattggatccggtacggatgaaaaggcagcaaaagcgaatcagcttatcggaaacctgttgtacaatacttctatcttaggatattaccgtcagttatttgtgatggatattgacaacagcaacggaggtaaatatgacttctggaatacggacagaaagaatccttatcagtattattataaaaacttcctcgatacttcatatattgaacctgataattttgatctttcaattaattattatcaaaaagcccttaagctttcaaataacaaggaagaaaaagcaagaattctgttccagatggcaagtgcggagcaaggtaaatattaccagtatgaagctaaggcaccaaaagattttgattattctgatccgaaatggtctgagaaagaagatgcccgccaaaaggaaatggaccaacttaaaaatcaaaaatacagaacctatttcgctcagctgaaagcgcagtattccgatactgaaacaacgaagaatttaatgggaagctgtagttattttaattatttcatgagataactattgtaaagtatagaagtaaaaaaggaatcaattcgattcctttttttgttcctgcttctgaatccattcttcatgttttcttttgaagaattcatacttgtaatcctgatttctctgggcagcatcaatagaatgggaagtatggatatcataatctttttttgccagttgggcaagtctttcataatagcaatgaagctggtccagctctgcttctgtaagatcttcaatatctacaattctgttactggctttttcatgggcagcaataatctcattcagcttaatctgtattgcctttgaatctttattctgagccttctgaataaggaataccatcagaaatgtaataatggtggttccggtgttgatgaccagctgccatgtttcggagtagttaaaaaaaggaccggtaaccgcccataccacaacgataatgaaagctcccataaaagcatgtggacttcctgtaaattttacagcccagtttgaaaatttttcaaaaaaatgatttcccgtatgtcccataatcttggtttttaacataataaatgtataaaattaagaggaataagaagtaacaaataccaacaaaaaagcattaagacaacttactgtcttaatgctttcaattaaaattgatatgaatgattgaaactatgttatttaattttttctgagaaacgattttccaggttttgcttttcttctgcaattatactctttccaatttgagcaggtgaaaaagcttttggataaaatgtattattccagtgatccttccatggagaaatgttaccccatgagtatatacttttaggattattgtaatttttttcgatattttctctggcagttttcagttcttcttcggacaaatgttcttcggaacatgacgctacaccagctcctgcaatcaatattaagagtattgttctaataattttcatactgttttttgagttagaatttatagtttacctgtactgcaaagtttctcggctggatctgatcgatatacccacctctgaaataagaattgtatcctaccgaatcaaagatgttattaaagaagcctcttagtcctaatccatttttgaaagaataccctatttgagcatctactgtcgtatattgcggcatgaaaaaaggtttttcccctggctgggttccatttacatgtccattctctgtattggtatatttttgtttataatcatcgacaggtctttctccaacaaaataaattccggcacctatatcaaggcctgtaagaatccctgtaccaaacttataattcagccaggcattggcagaatgcttaggtgtattaataggagctgaaccgtttacaaatgaagggctatctttatactgtgcatccacataagcccatccggtcattacctgtaggtttggaagaatttttccgatcaattcaacttcaacaccctttctttttaagttaccggcaagtgcatattttccggtcggatttccaccatccagaagttcgtatgataaattatctgtgttaatatcaaaaagagtgacattaaatcttaatctttcattcagccagtcagatttaattccagcctcccattgttttgtagtagatgctcctacagttcctccgctgaacaatacattatttgaacttctgagtgatgtagtacttgtataggaaccaaatatgttcatattttcaatgggagagatcatgattcccaaagaggggttccaggcgtaatctttttctttgtctgagccaattaatctgctgtagcgaactcctaaatgagctttaatatatttattaaatgtaataacatcctgtgccatcagacccatggtaggtgccactgtattaatagaactggctgttgataagtctatattaactccggcaggaaggatattgttgatttcgttcaacacattgatctggtcaacatctttagccttataggaagtagtcgtaacatttgattctttccagtcaaaacctacctgaaaagtatgcttcatgaatccagtcattatatcagctccaataaaatcaaattgaaacaccttattcaaatcctctctatcagaccttgtcaatgttctgtttcgcaactcggttggattatctctctttaaaggagtcagtgctgcccctacaatttcagtctgataagatgaactcatgtaggcagctcttaatttcaatttatcagtcagttgtcttgttacagttgttgagaaattgaatgtttcggtctttgccttatctgtagaaaatccaaggaattttcttcccggcattctgtatattgcctcagtatcccctttagcaagatttacagttcctctatccggcgtggtattgttatgcatataatccatttccacaacaatctcagttttatcatccggacggatggcaatggatgggtttacataaatacgttctgtattaataaatcttctgaagctattattattttgataagctgcatttaatctgacagcaatttttccctgtgggtctaatactctttgaaagtcaactgttggtctatagaaatcccaacttccatatctgaaaccaacatttgtctgattaataaatttaggaactttagtaaccacattaatcactcctcctgcagatcctaaaccatctccaattccctgagtaactgcagcagatcctttaattatctgaatactttctatcccctgcatatcagtaagcattcctgcggtacgaaaatcagaatccatctgaaccccgttctttaaaaccggaactcctctatatcctctgatagacatactttctctggtcccgccataactaccgaattgagttaccccaggcacattctttgctacatctgtaaccgttaatcctcctaagtcttctattactttatgggaaatcacagaaatactctgaatctgatctctggttttcaatggcagccttgtgatggcttccaaaccttgcggctgcttttttctttcaccaaataattccacttcgtcaatttcattcgactttttaatagaatcattaattttctgtgcatttacaaaaaccccacccaatacaagcagagaaaaggatactactttattcatctgttaattttttacaaaattattatttttattaattctaaataaacaaatggatgtgacttatgtcaccctaaagagtactgtaattatcagatcgttaatcagcaatgaggagcctttaaaaccttgaaacagttattatcaatcgttagaagtattattcttcagactttatatggttaaaaaaagtacaatacaaaaaaagcagatttgccagccacaaatctgctctattctgtcagataatatcataaaaaaatccgcccctaaaaaagggacggactgtataatcattgcaaagtatgcatttatcacactttaatttcaacgtctacacctgaaggaagttctaatttcattagagcatcaacagtcttagaagaagaagagtagatatccattagtctcttgtgagctgaaagttggaactgctctcttgctttcttgtttacgtgcggagatctcaacactgtgaagattctcttatttgttggtaatggaataggaccgtttacaacagcaccagtagcctttaccgtttttacgattttctctgcagatttatctaccaagttgtaatcgtaagacttaagttttattctgattctttgtgacattttaatctaatttaatattaacctttagctttagcgattacttcttcagcaacgttttgcggagcagcttcatatctttcaaactccatagaagatgtagctctaccagaagataatgttcttagtgaagttacataaccaaacatttcagaaagtggaacgaaagctttgatcaccttagcattgtttctgtcatccataccgtttacagtacctcttcttctgttaaggtcacctacgatatcccccatgtattcttcaggagttactacctcaagtttcatgattggctccatgataacagctttagcagctctaccggattctttgaatcctaatttagcagctaattcgaatgataactggtcagagtcaactgcgtggaaagatccatctttcaatgtaactttcattgattcaacctcgaatccagctaatggaccattcttcattgcttctctgaatcctttttcaactgaaggaacgaattccttagggatgttaccacccttaatttcgttgatgaattcaagacctactttaccttcgtcagccggaccaatttcgaatacgatatctgcgaacttacctctacctccagactgctttttgtaaacttctctgtggttagctttttgagtaagagcttctttgtattctacctgcggctgcccttggttaacttctactttaaactctcttctcatacggtcaacgatgatgtcaaggtgaagctcacccataccagagatgatagtttgtcctgaagcctcgtcagttttaacctggaaagtcggatcttcttcagctaatttagccaaagcgttacccattttatcctggtcagctttagttttaggctcaacagcgataccgattaccggatctgggaagatcatagattcaagaacgattgggttcttttcatcagataatgtatctcctgttttgatatctttaaatcctacagctgcaccgatatctccagcttcaatatattctactggattttgcttgttagcgtgcatctgatagattctggaaattctttctttgtttccagatcttgtgttaagaacataagaacctgcatcaagtcttcctgaataagctctgaagaatgctaatctacctacgaacgggtcagtagcaatcttaaatgctaatgcagagaaaggctcttctacagatggttttctttcgatgtcagcatcagttcttgggtctgttcctttgatattatccttatctagtggagaaggaagatatttacaaacagcatcaagcatgaactgtactcctttgttcttgaatgaagaaccacaagtcataggaatgatagaaagatcgatagtagcttttctaagagcttcgttgatttcttcttcagaaattgaatccggatcttcgaagaatttctccatcaaagtctcatcgtaatcagcaacagcttctactaatttctctctatattcaagaacttcatctttcatgtcttcaggaattggaactacttcataagtagcaccttgtccagcttcatcccagatgatcgctctgtttttaattaagtctacaacccctttgaaatcttcttcagcaccgattggtaaaacgattggaactgcattagatcctaacatttcttttacttgttttacaacgttcaagaagtcagcaccttgtctgtccattttgtttacgaatcccattctagcaactttgtagttatctgcaagtctccagtttgtttcagactgaggctctactccatctactgcagagaaaaggaataccaatccatccaatactctcaaagatctgttaacttctactgtaaagtcaacgtgtcccggtgtatcgatgatgttgaagtggtaaggttttgtttcaggtaatttcttaccttgatctgttgggaaattccagttacaagtagttgcagcagaagtaatagtaatacctctttctgcttcctgttccatccagtccattgtagaagcaccatcgtgaacttctccaattttgtggtttacacctgtatagaataaaatcctttctgtagtggtagtcttacctgcatcaatgtgagcagcaataccaatatttcttgtaaatttaagatctcttcccatttcagattagaatttgaagtgtgagaaagccttgttagcttccgccattttgtgagtatcagttttctttttgaaagctgcaccttcttctcttgaagcagctacaacttcgttagctaatttcaaagccatagacttatcatttctagctttagaatatttgattaaccatttcattgccatagaaatttttctgtcagctctgattggcataggaatctggaagttagctccacctactcttctagaacgtacttctacgtgaggcattacatttgtaagtgcatctttccagatttcaagtgcagttttctcgttatctccttttttagtttctacgatatctaatgcatcatagaaaattttgaatgcgattgacttcttaccgtcaagcattaagttgtttacgaatctcgttaccaattgatcattaaatttcggatctggtaacaacggtctttttttcgcttttgtctttctcattgcttttgtaccttatttaatgattactttttctttccttttgcaggcgcagcagctgcttgtcctggtttaggtctcttagctccgtacttagatcttctctgtgttcttccatttacaccagctgtgtctaatgcacctcttacgatgtggtaacgtactcccggtaggtctttcacccttccgcctctaaccaatactatcgagtgctcttgaagattgtgtccttcgcccgggatataggcattaacttctttaccgttagaaagtcttacccttgctacttttctaagtgcagagttaggtttcttaggtgtagttgtatatactctcgtacatacaccacgtctttgtggacaagaatcaagggcagccgatttgctcttcttggcaagcgtggctcttccttttcttactaattgttgaatagtaggcatttaattgctttttattttagggtgcaaaaataggaataattttttaatctgcaaacacttatataaaaattaaaatcaaatacttacatcaaaaacagaagacgtttcagtataacaatcggtgaagcataatatataggcgaaaaatccaaagaagtacatctgttttgacacttaaaaaatgaatattaaataattatgaaatttatcccgggaaaggtttttcataattttttagttctcaaacagatttcaggagtaaattcgatacatccaaactcttttaaaaaactttcttatagttatcatctattaataatcaacggtgttcggcacgatatttcgtaaatttgaaagacaaatgataaacgcattgaattaccacacacttttcgcttttaactgaagttggtgatgaatttaacttaaaaaataaatatatacatatgaaaaatgctagtattatcggtcttaaagaagccgactgcaaaaagatctcagaaaaattaaatgtactgttagccaactactctgtattttatcagaatacaagaggttcacactggaacatcaaaggagagcagttctttacccttcatcctaaattcgaagaattatacaacagtcttgtattaaaaattgacgaaattgcagaaagaattctgacattaggagcaacaccggctcataactattcagattatttaaaggtagcaaccatcaaagaaagcaaagaagtaacagatgccaccaaaagtgttgagcagattttaagttcatttaaagtagttattgatctgcagagagaacttttggatatcaccgatgaagcaggagatgaaggtactaactcgcaaatgagcgattatattacagaacaggagaaagaagtttggatgtacaattcttatcttggaaaataactccggcaaaagcatggaaataattcaaaaaaatcgccttacatttaggcgattttattttttatttttatatttgcgttaaaattacacatattatgaacgacgtcagattaaactctatccttgataatgacttctataaaataaccatgcagaatgccgtggtaaaactattcccgagttctattgtaaaatatgaatttatcaacaggggaaaacaccactttccggaaggatttgacgttgctttaagggaggccgtaaataaaatggctgaacttaaacttacgaaagatgaaaaaaagttcatggcaagaacctgtccttatatagatctaccctaccttgattttttagaaggctaccactacgacccttctgaagtgaaaattcatcaggagggaggcgatctttctgttattgttgaaggactttggtatagaaccatcctttgggaggttccgctgcttgctttgatcagtgaactgcattatgaaatgaaccacatggaaagagattctaatgaagtggtcatgagcaaaacgattgaaaaagcggactcactgggaagacttggggtaacttttgctgagttcggaaccagaagaagacattcttataaggtacagaatcttgtaatggaagctttgactcagaaaaaggattctacttttatcggaagctcgaatgtccactttgccatgaagtatggggttaagcctattggaacccatgctcacgaatggttcatgttccatgccgcagaatatggattcaaaatggctaatgaactggctctcgaacattgggtagatgtttacagaggagatcttggagtggctttgtctgatacttataccacagatgttttcttccagcagttcgacaaaaaatttgcaaagctttttgatggtgtacgtcatgacagtggtgatgcgctggaatttgcagataagactattgcccactatcaaaaaaatggcatcaatcctatgtttaaatatatcattttctctgacgccttaaatcttgaaaaggtagaagaaattaccaactattgcagaggaaaaattggtatttcattcggaatcggaaccaaccttaccaatgatgtgggactgaaaccaatgaatatcgtcatgaaacttattggcgttcaggctcccaataaagaatggattccaacagtaaaactttctgatgaacatggtaaatataccggagatccaaagatgatcgaattagctaaagaatttttaagaattaaaaattagtaatctcatcagaataatcagataagacctcgtagccatcgaggtttttttgtttcatatcaccgtttgaaattcagcttacagaaatctgtaaggatttattatatttatcaaaataaaaacaagatgaaatcaagaatactactacttgcaggtctccttctgtcagcattttcttttgctcaggacacgaaagcagaaaagcctaaatataatcaggaactggccacttctttaggagctgacaaatatgggatgaaaccttatacgattgtcatgctgacaacaggcactacccatattgaagataaagccaaaatgagtgaacttatgaaaggacacatgaacaatatcggtaagctggccaatgaaggcaaaattgttgttgccggaccttttcttgaaaaaaataaagagaactaccgaggtatgtttatcttcaacaccaaatctaaggaagaagctgaacagtgggtaaaaacagatccggcagttcaggccggcattttcagctatgaaattttcccatggtatggctctgcagcgttaccattgtatcttaaacatcatgatgaaatctcgaaagaaaatccttaataaataagaaatccctcagttgagggatttttttcttaatcgaaacagataaatggttttcttggtggatagcagcaataagggttgctgcagaatgtgtaccctgccggacatcccccatctacaggcgcttcacaggctaatgctgcacctcctaaaacagtctttaactcttttctgtttaagctttttaaatttttcatgattaatttagtttaatttgatttcctactcttgaagattttcggattcctctttattatttctctttaattggaaataaatatacaatttattttttaattcattacatttcaaacaattatatataaataaattaaaaattttaattaatacactttgttttgatgaattaatttaactattttagcttattaacaattagcattattaaactaattaccaacaagttaaccatcaatcaacatcataattaaaaattaatctcatgaaaaaaaagaattttacaaaactctcgagaacagaactgaaagatgtattcggagggacactgtacccggcacaatgccccggaggatgtcatggtgaagcgatgatcagatgtcctgacggtaccaccacaatgactaattttatatgcattgggggaacctgtcaaccggcagccatgtgcaagccattgattcttgaaccatttcctgatccgattatcatcaccccataatctgatgaataaaaaagtgagctttccggctcacttttttagtatatttaattaaataaaaaccatcatgaaaaccattgaggaagttctgaaaaagctggatgaaatcattatctggtgtaaagagaaccaaagtccggcaggatattttgcatgtacttatagaataatgaccgcacaggtcctgaaaggaattcagcaaaaaaaatttgaagacaatccgaggatgacaacacttgatattgcttttgctcaaagatatcttcaggcatgggacagttacagcaaaggcgagaaatgcaccaactcctggtatattgcgtttgaagctgctaaaaataaaaatctgctgatcttacagcacatatttctgggaatgaatgcgcacatcaatctggacctgggtgtttccgctgcttctattatgccttaccggaaaataaatcctttgaaaaaagattttgaaaatattaataatgttatcgcctccatcaatcagaacgtacaggattctttaaacaaaatctgttatcctgtagatcttgttgacaaactttccagtggaaaggataatgctgttctcgattttgccatttccaaagcaagagaaacttcctgggcaacggccgtcattgcatccaatacatccattttcttaagagaatctgtgattggtattgtagattatgcagcagcaaaagtcgctactcaaattctgaacccgaagattctcactccttcccttttaaaagaattaaaaaaatgtgaaagcagtgatgtcgtgaagaatattgaaattttagaatctacaaaaaactcataaaaaaggccgggatcttcctcacggatcccggcctcataatgaacaaaataaaagaaactataatgcttccttatgctttttgcgataggcataatggaaaataataggcagtattgtaaatgaaagcagcatacagatgattaatcctcctacaatcatgatggccaaaggcttctgaatttccgagcccatcccattcgacatcgctgcagggagaagtcccatagaacccatcaaagcaatcatcaccacagggcggattctactcttcactccttctgcaatggattctttgagagaaagtctgttttggagattttctttcatcactccaatcaggacaataccatcgatcgttgccactccgaaaaggataataaacccgattcctgctgaaattccgaagatggttcccgtaaaccaaagggataaaaatcctccgataaacgcaaatgccaatgtaatggaagaaatcaaggtatctttaatatttccgaagttgaaatacaacagcatcagaataagaactaaagaaatcggtactaccatagccagctgttttgctgctctttctttgctttcaaattctccggcccaggtcattttatgatttttcggaagcttcacttctttctctactttttcttttgcttctttgatggtacttccgagatcacgcccttcaatattaaatccaactccgatatatctgctgtttccttcccggtaaataaatgacggtccggtatgataatcaatggtggcaatttccttcagtggaacctttttgttatcctgagtcgggataagaatattccccattttttcaggggtgtcccggtattgtttttcaaacctgagcatgacatcaaacattctttcctcttcataaaatttcgtagcagcctgccctccgattgtcatttcgattacggcctgagcatctgctgtagagactccatatttggccattttagaatcatgaagctgtattcttaattccggaagcccgatatttttgaaaacatttacatctgatattcccggaacggttctgatggaattggctactttattggcatagttttcaagctcgaaaagatcatttccaaaaatcttaataaccagcggagcttttacccctgctacatattcttccacattatcctgtatcggctgactgaatccaaaattaatacccggatatttctcaagagaaactctcatttcttcaaggagttcttctttggatatttttttcttccactcattttcaggtttcagctggatattaaattcgatattaaagaaacctgtgggatctgtcccatcattcgggcgaccagtctgggtcataacaaatttcacttcatcatacttcatgagaatctctttcatctccttcgtcaatcgtacagactcatcgagattaacactgtttggaagggtagctcttacgtagattgcaccttcgtttaatttaggtaaaaactcagatccgtaattggagaatctccatccacatactgcaagcaaagcaacgaagccaataatgaatccttttttatggtggtcactgaattcataaattctgtaaatattcactctgaaaaatctggaaataaaattttctttctcttcaatatttttagtcaggagcagtttacacattgcaggaacgtaggtcaaacttaagatcaaagatcctaacaatgcatatcccaacgtaaatgccaatggagagaacatttttccttcaactttctggaaagagaaaatcggcatcagggcaacgataaggatcagcagggcaaagaaaatataacttgcgacacttccagcgcttttcttgatgattcccagctttgaaattttgttgaatctccgcagtcctatctttttcgctttgtgctcgagggcgacaaagacgtgttctacaatgacaagcgttccttccaggagtaatccgaaatccagagctcccattgaaataaggttggctggcaatccctgaattttcagcataatgatagcaaacagaaaagctaacggaattactgatgctacaatgaaagttgttctccagttgtaaaggaaaataaatacaatgatggaaaccagaataactccctcaataaggtttttggaaacggtatgaaccgttgtattcacaagctctgtacggtcaatgatcggaacaatctgtacatcaccgggaagttctcccccgttcagttgttcaattctgtctttcagccttgcaatcacttcactcgggttttctccacgaagcatgattacaattccttctacaacatcattttctttgttataccctacctgtcctaatctcggctttgcagaaacttttacttcggcaacatgtttcaccagaataggcgtagaaccttttacttcaatctgaatattctcaatatcttcttttttctccaaaagaccgatcccccgcactacataagcctgatcaccttttgccactacatctcctcctacattaatattactcttcgaaaccgcttcatacacatccaggggggaaaggtcataattgtgtaattctgtaggattaatttttatttcatatattttttcttcaccaccaaaacttacaacatctgcaacaccaggaacggctagcaattctctttctactacccaatcctgaatagaggtaacttctttgataggaagtctacttttaatgatataccggtaaatttcaccggttgcaccggaaggaggctcaatactgtagtctgctccggcaggaagctctacattccctagtttattggaagcatattgctgtgcatagaaatcattgacatgatcatcaaaaatcacagtgactacagataatccaaacaaggaaatagaacgtaccgaagttttgttcgggatggcattcatttcctttgaaatgggtaaggtgacaaatttttctatttcttccgcacttcttcccggccattgggtaatcactcttacccttgtattggtaacatccggaaatgcttcaatgggagtatgcatataggaatagattcctccggccagcaatagaaaagttcccaaaagaacgatcaatgagttttttaaagagaaggaaactatattctgtacaaattttcgcattacttcttggaattgtttaattgatttttcaggttttcatagatcagcagtccattggaagcgatgacattttcacctgattttaaatttccttctacataaatataccggctgttggaagcaatctcggtaacaggtcttatttccagctcacaatcttttttgtaaaccactacataactttggttgttatcaaagatcagggcctttgcaggaatagccagcgcgtttttgttttgtgaattaattggcagtacaacatctgcagacattcccggtctcagcttcattccattattgtccataatgattttcgctttgagtactctttcgttttcattgaaaacctgggaaatattatcaatcttcccggagaaactgtcatcaggataggcaagcgtttttaccactacaggttgatttacataaacatgcctcatgttggtagcatagacattcgccattacccataccttatccaggtttgaaatggtaaaaagctgatctccacccgcggtaaccggcattcctttggaaatattctttgaaataacatatccgtctgccggggctttgatctgaatggtattccctcccgctgaatacagctgcatatttttctttgtcttggaaatattggattggagtatagccacttcggaacgtgcttcctgtaaatctttctgagaagcaatatcatctttatacatcgcttctacagaagacagctttctttttgccactgccagctgagcctgcaaagtctgggtatcatcctgcatttcattcacagctgtactttttacactggccagcgtctgtccctttttcacgtaatcaccaagggaaaaataagtatccatcaccactccgtccacgaggcttacaaaaggaactgtcttatcagaattactttccacttctccggtaagggttatactttcttctatgggaagcatttctgccttagccagtttaatatctttttttagctctttgctgatgcaatatcctttttcggcttccttattttctgctttaccggcacaacctgtaaaaataatgagggaagaaaggtaagccgcagcaatgtacttggtcaaatttttgttcatatcttataaatcttgtcctacaacatactgcaggttttcgtagtattgattaagttcttttttggtatccaggatgatcattttgttcccgatgtaggtgtccagaaaatccatatattccagcatgctgatattcctcagtctgaagtttttttcatggctcaccagcaaaccgtccagtgtagactcataattttcatcgatttcttctgatacctgctgtgtcctgatatagtttctgaaaacagagacaatttcattctcagatttcagcatggctttacgggtttcaagtttgtttttctcaatttccaatttagcttcctgaatatttcctttattacgatcgaagatcggcagatccatagaaacccctagtcctataaaatctttcatgatattccctccgcggtcgtattcgatagaaacagcaacatcgggagttttcatagcattttgaatttccaggtttttggcggcatgcctctctttattttttgcgatcataatatccgggcggttttctttagccttttctatccattgatttacttccagctctgaaatttgtttttcaggcatagcgaatgaatcagaaataatcagataagattgtgatggcagcatcagcaaagcttttaactccatctgttgatcttcaatttcctgttttaatgaaatgagtttctttttgaattcaatttcctgcgcttttaagcgtacatattcagctttactgatgtttccaaggtttagctgattattgtatgattgagttagtttctcaatggaagcaatctggccctgatagattttctgctgttcctgattgtaaagaatttcagtgattgtatttctgagtgttttcttaagctcacgcagaacctcctgcagttcatacttttcaccttccacttctattttctgaagttcaatattttttcgtcttttacctgctgtctgaatcacctgctctatttcagcggcaacctgcgtgttttgcccccagtttccaatcagttttggctgctcttcaatatcataggttctccacagattgatttcactgatacttaatttgggattgggccagtatttagcctgaactgctcttgcttcggcttgtgaaatctcaagcttctgagcaataagatcaaggttttttgccagaaaaatagtttcagcttcccttctgcttattttcagggtatctgaaatctgtgcagaaaagaaactgaaacaatgaatataaaatagggtaaaaaatagcttcttcaagggtctcttatttaagaccacaaagctatttgtctaagattagagggaattttaaagaaaattaaaattcggttagttcaacattagagtttgattagaacttttttaaaacacgaaaagcacaaataatttcacaaataacacgattacgagtgaaccggaaatttaagaaggacagttgttccgacattgacagtagaatcaattttcatgacaatatgatgatggtcaaaaatactttttgacagcgataagccaattccacttcctttaatggtatctacatttttccctctgtaaaatgtttcagatattttcatcagatcatcagccggaattcctcttccttcgtctcttacttcaatatacagctgagcatttttttctgacagagtaatgattacaggtttatcataagaatacttgatggcattttctacaatattatataaagccagatacagcagcgtttcgtttccgggaaattcaagcaaggcgggttgcgttacctgaagctgaattttaatggaggaatgattttctttggctttaggttctaatttctcatagattttccagaccagttcatctactctcattgattgatgtgaagattcaagtttggtcattcctgacatcagtaaaaggttattgagaatattttcgatctcatatacattttccagagactcttttgctactttcttatattcttccggtgtacggtccttttgggcaaaaacttcaagattcccggagatagctgctaacggagttttaaattcatgagaaacatagttgataaaattctgctgtaagagtacattttcagaaattctgcccagcagtttattgtaggatttaataagatcttcaacttcatcattggtattggtagaagtaattgctgtagaaatattattataatccactttattgatgcgttccacaacattggaaataggtttataaaccactttagaaagataccggctcagaaaataaatcgcaagcaaaccaatgaccagcactgaaagcataataatggaaagccttaatatctgggattgaaatgaatcgttggaagactttacaaaaacaacaaaatcaccctggttatccggataaaaaataccatagtaaaattggttatcagacatgaactgtattcctttattattccggactgcctgtaaatgggaaggttttatattcttatcattaaggttatgcccaaaggtaacctcgttattctgattatacaccgctaccctgttattctgaatcagatgattatattcctttttgatctgggcatggcggtctttcggaagttcatctttttcgagataataaatagcagaaataagagccgtattgcgaagtttttcaaaataaaaaattttggtactgtcataataggcaaagaatatcaccgcagatgtgatgatagaaacaatgccgaatgaaaggcttgaaatgagggtaaacctgtttctgagtgtcatgatcagtctttaatcaaatagccggttcctttcaccgtatggataatcttctgttctgtctcgtcaatcttattacggatgtaggaaatataaacatccactacatttgttgtattatcaaaatcaattccccacacattatgtaaaatctgggttctgctgagcaccttatttttattctccatcaggaaagtaaaaagtttgtattcagtgggagaaaattctatttctttatcattctgcgtcaccttatgaagatctgtgtcaatagtgatattgccgcatgataaatattgatcttccttcttatagcttaatttatttcttctggttaaagctttaattcttgatatcagctcttcaaaatgaaaaggctttgataaataatcatctgctcccatatccagcatcttaatcttatcgtcaggactgttcagggcactcaagaccaaaataggagtataatttcctttaaatcttataatttgtgtaagctgcattccatccagcccgggaagcatgatatccattaaaataatatcaaaatcataggtatgaagaagttcacgtgctttttctcctgaatcggcaagggttatattgtaaccggcctcagaaaggccttttatcagaaaattgctgattctttgatcatcttctaccaacaaaatattcataagtctctgaaatttcccataaatataggtattctaattcagaaaggaagccgggagaccggaagagagaagtaatggagctctggtaaatcgtctcagacatttcatcaatatttaaaatagtagaacaaacaactattattttgcccatacagcttccagccttttttcataattttggaagatggagatgatatatttaattattggatttgttgccggcggcttactgggagccattatactgtattttgcactgaaatcatcaacagtatcaaggagttcttatgatacactgaacgccttatctattaaaattcagtccgagcttgaaaactccaacctgaaaattcaggaacttacgcagaacatcagtaaagaaaaagaaaccaatatgctgcagcaggatttaatggatgatctgaaaaatgagttttctaaaatctctgctgaatattcttctttaaatatccagtttcaggaattaaaacaaatcaatcagagacaaatctcacagattgaaacccatatccttgaaaaacagacgctttttgctaaaaactctgaacttctggcaaaaaatgaaggccttcaaaagtctcttgatactcagaaagaagaaatcatcaaaattcaggaggagtctaaactccagtttgaaaacctggccaataaaattttagaagagaaaactgaaaagtttactactttaaatcaaaataacttaaaaaatatccttgagccttttcaggagaaaattgctgatttaaagaacaaagtcaatgaagcttatgaaaaggaaaacaaagaacgtttctctctggcagaaaaagtaaaagagcttgcagaactgaaccagcagatttctgaagatgccaaaaaactcacccgcgctctgaaaggagaaagtaaaacacagggaaactggggagaaatgatccttgaaagtattcttgaaaaatcagggctggtaaaaggaagggaatatttcctggaacatgaattacgtgacgaagataataatgctttattctcagaattctccggaaaaaaaatgcgtccggatgctgttgtaaaatatcctgatgaaagaaacgtgattattgactctaaagtctcgctaaccgctttcacagaattggtagatgaaaccgacgccgatgtttacaccataaaactgagccaacaccttggatccataaagaaccacattaaccagctaagtcagaaagcatatgatgactatggaaaatcactggatttcgtgatgatgttcattcctagtgagccggcttatatcgcagcaatgcaggcagatcagaatctttggaattatgcttatgaaagaagaatcctgcttcttaatccaagcaatctgatcacttccctgaagctgattgccgatctttggaaacgggaatatcaaaaccgaaattctatggaaattgccgaacgtggagccaagctctatgacaaattcgtaggctttgtagaaaatctggaaaaagtaggtagaaatctggatcaggccaaaaacgtttataacgatgcgtacaaacagctctacaccggaaatgacaaccttgtgatccagacccaaaaactgaaatcattaggaattaaaaataaaaaagatctgccgcagagtctcattgacaatagtaatcttattgaaccttcagaaagctaaatcccggtttgtatgttttcttttgcatcatatccttaccccaaatccgaatctttcaaagaaattttcgtttcttcgctgggagcaggagtttctgtgtatttgtttctgattatttttcagccttttggtacggaaaactttcaacacccttacaaattcttactactttttccctattgcgtaatctttggaacagtatttttaatggccaatcttataactttccgttttacccactggaatattggtgcagagtttttaaaaataattttcatcttatttttcggttcaattctatcctacttttacaattcattattcttaagccacgtagaacttgacctgggcaattacttttatatgttcctatattcccttgctgttggaattccaatttcaatcatctatattttatcccggtatatctatttaaacaatattcacgaaaagaaagcacacactatttctcaacatcttcccgttccagctcctgaacaacaaaatctgttaaaaatatcagctcagaatacagagcttatgatcaatgaaaaagattttctttgtgctcagtccatggaaaactactgtacgttttactttttggagaataacagcttaaaaaaaacattgatcagaataagcttttctaatgttttacagcaaatcgaaactgattctgtcaaaaaatgccaccgttcttatattgtcaatcttagaagagtaaaaaatctcaaaggaaatgcgcagggttataaattaattcttccgaaaattgactttgaaattccggtttccagaagttttattccttcaattattcctcaattacaacagccgaatccatagtttttgtcattcgtcactattctttgtcattcatcacattaaaatgaaagcatagatttaaagccacatttttgctcaaaatttaacagacatgagtaaaaacatccgcttctttttcatctttattctaggttttacaatctattatttcttcgattttttcttttttaaaaacattcagacgttttcaaaaaattggtttcatagcaaagccattgcccatataacggcttattcagtaactttaattccactgatggttacattaaaaattttgttacccaaaagaaatattttagacctgctttcattaaacagacctgttatcaaaggattttcttttgcggttatcggaacgcttccgatgtttatcggatacatgattcattttaaagcagtcagtaaaataaatttggaaaccttgtttatcaataccttttcatcagcattttttgaagaaatcatttttagagcttttcttattggagcattatatcgctttacccgacttggttttttatcatctgccttattcggttcactgctatttgcgcaagtgcatttataccaaagtcaaaatatgacagagcttattgagatatttactattacgttcttaggatcaatattcttcgcatgggcctattttgagtcggaattcaacttatggacctctatattccttcatttctttatgaatctgtactgggaaatctttaatgtatcagaaaatgtttcaggaaatttctatggaaatctgtataaactgatatcaattgtagtcctgattgcagctatcatctggtttaaaagaaaaaataaaatcccgtttgaggccacctggaaaagtctttttatcaaaaccagagaaattcaatcataaattttgcataattttgcaacatgttgatagaaagtttccagaacgataaaataaaaaatgtcactaagctccttactgacaacagatttcgtaaaaaatcaaaagtttttgtagtagaaggccagcaggaaaatgaaagagctattcagtatgattttgaacccctggagttctttatctgtgaaagtattttcaaaggagccgttcccgatggaaaaattcattacgtaagcgagaaagtatatgaaaaaatagcttacagaggaagttcagaaggaattatcggggtttaccacgcaaaggaaactcctctttcatcttttactccccaaaaagattctaccgttattattgttgaaggtgtagaaaaaccaggaaatcttggcgcaattttaagaagctgcgaagcatttggaattgatgcactgattgttgctgacggaaaaacggacttctataaccctaatgtcatcagatcaagtgtgggatgccttttcggaatggaagtgtatcaggctgaaaatacggagacattggaatttttgcaagaaaacagcttcaatatctacacaacgcttatggatgaaagtgctgaagatctttataagcgagatttcagacaacgttctgctgtgttattcggtacggaacattccggattaagtgacttctggatcggaaaaggaaaaaataccctgatccctatggccggaagtattgattctttgaatctgagcaatgccgtagcgattacctgttatgaatctttaaagcaaaagaaaggataaataatatttgattagtccttgtgacttttttattaatgagattgcttcgccttcggctcgcaatgactaagcataaaaaaaccgctccactgggtgaaacggttcttttattattaagcgtatgctagaattatttcttagcagcgtcttttgcagcatctttagcagcgtcagcagcacctttagcagcatcagcagcacctttagcagcttctccagctcctttagcagcatctttagcaacttcagcaccagcagcagttgtagcagcagcagcatctttagtagcttctacagcagtagttgcagcagaatcaacaactttagcagcagaatcagaaactacagcagcagaatcagctacgttagcagcagcagaatcagcagtaccttcagtagaagtagcttcagtttttttacaagcaactagagagattgcagcgatagcagctacgaataatgactttttcataataaattaaatttaattttgttaatattgttttataaaattttcttctgttctgttatttgaacaagacaaaggtagagcagttagaaagtttgtctatgaaaaataattgtaatacctttgtaaaatcgttttacaaaaaaacatagctgataatcaacaatttaattattttttgaaaaattgacagatttagatctattacactttgagcaacttaaaaaggaagttcagagtcaatacttaaaagaatataccccttcccacgatgatatttccaagtggaagggtatagatattatatattttcaggaagacctgcgaaaaaaagcaaaaggtaacatcagtgaaaagtcattttacacttattttaaaacttcaccggttaccaaattgccaagaatagatatgctcaatttactgagtatttatgcgggttacgactcctggtatgaattcaaaaaacaacatctttttgccggcgaattattgcaggaaaatgaaaatcctgacgaagaagaaatcgaagaactagagaaaacggtttctgaagctcctgaacttccaaaaactgaaattcagcctaaaaaaatcgaaatcagcaccccggaaaatgctgatttacaaaaatcaaatactgaaaatcaaatagttaagcaaaataacattacaacaaatgaagttgaaatttcatctgttccgccaaagaaaaacttctttaaaaagaatgcctgggcacttgttacctcagttttgattaccattaccggtattttaggttttaaagatgtacttttttcgaaaacatataaatattgtttcattgataaagacaggggagtttctgtgatcaatactttagaaataatggtagtgaaagaaaatgaatctccactgatgtataaaataaagccgggcgagtgtttttactattctacgaaggataaaaatttaaaaatgcggatcagtgctcctttctacgagcctctggaagtaaacagaaaccttgaaaatgctcccgaagaagaaaaaatagaattaaagccagatgattataagatggctgtctattatttctctataaaagacatcaagggaggaaatcctgatgaacaagttgctcttatcaagcagaaaagaagtcaacttgaaaacctgatcagcagcaatgcggtaatctatcaggtgtacgataacgatacttatggaatagaaagactggataaacagaaatatatcactcttgtaaccactccaacgacctcactgaaaaacctgaatgtaatagaaatgaaaaaggataacaaaggtaagattgtatccatcaaatttaaaattgctaccacagatgaaaagaataaataattttttaattttcaccgtgcttctgactttatttattgcctgcaataataagacttcagaggtaagcgacctcgataaactacgaaacagcaacaatgaaaaaagttatcctgccgtacagatggacagtatgcaggccattaactccatcaccaaacagaaagttcaggagcttctcgacctgtcgactctttacctgagtggaaacagaaatacagaaatagacacgctgatctattcccagatggaaagctacttccacaagcctgattcccttacttttaaaaggctgctgaaagagctggacagtatgaaagtgaaaacagcaaaggtgagcaacctgaatgtttataaagaattttataaaaaggacacattggattatgctaaattcaatgtagaatacttcgataataaaaacaagtctctgggaagttttgaaaagaatgcacaatacatcttattgtctacttcaaaactgaagaaagaatttaaattctactttttagatttttattccaaaccgcttaagaaagacagcacttctgtaggagtaaccaaatagtcaaggggaatatcattttcccagacattacccacatattcatcgggatcaaaataattgattccgattttttttgtctcaggagaaatactttgaaacagaccatcataaaatccttttccatatcctacccgatttccatttccgtcacaatacagtaagggtgtaatgacataatgaaagtaattttcaccggaatcttcattggaaacaggttctgtaatgccccaactattggtttcataaacagtatcttcgaagatttctatattaatcagtttatcagcaacaatcttaggaacataaaccctgatattttgctctaaaaaatactttatgaagatttgggtatcaacttcctttctacccggaatcgggatgaaaatgtgtactttctccctctctttcggcttgaaatacttgataaagttttcaaaaatcttctgcgataacaagaaagcctcatcatcagacaaggcttttcttttttgggtatatttttttctaagctcagctttcagcataattatcaagttgttttaactgaaataattgttacaagacaggctttggattatgcgttctccaaaattctatacagtttatcagacagacgaactctgaacggaagttcgaaagtaacctgatctcccggttttgcagtctcacaagggcctccgttggcgtagatctgagtaacagtaatttcctgctctcccgttgtaggacctgaaatcaatattctatctcctactgacaggtctttgttttcaattaagaactgtgcaatttttgattttgaatagtaatgttccgcttttccgatcagctcttttttaacagcaattttctgacggatattttttgtttcagcttttgccagaggcttgtccggtaagtcacctgattttttaaacttcaaagcatccgattttccttttctgaatactttattgccaacctgcagtccttttctcagttttacctgctcatcccaaggcaaatgtatgatatccagacattctgtagaacagcagttttccatggcggctttacattcgtcacattggataaataacaaatggcaagcgtcattagcacaattcgtatggttatcacaaggtttaccacactggtggcactgtgcaataatatcatctgtaattctttctcccaaacggtggtcaaatacaaagtttttaccaatgaacttacttttgataccttcttcttttatctggcgcgtgtattcaatgattccaccttccagctgataaacatttttgaagccctgatgtttgaagtaagcactggctttttcacaacggattcctccggtgcaatacatcaacagatttttatcttctttaaaatcctgcagctgttcattaataatcggtagactttccctgaagttttccacatccggcgtaatggctccttcaaagtgccccacttcactctcgtaatggtttctgaagtctactacaatcgtattaggatcttccagcatattattgaactcctgagctttcagatgaatacctttattggtaacatcaaaagtttcgtcattgagaccgtcagcaacgattttgtttctgacttttatggttaattttaaaaaagaataattgtcctgatctaccgctacattcaagcggattcctttcatgaagtcataaacttccagcgtatcacgaaaagcctcaaactgatctgcaggaacgctcatctgagcattaattccttcagtagcaacataaatacggccaagtgcatccagtgcgttccaggctataaataattcgtcgcgaaattttttgggatcttcaattttggcatacgcatagaaagacaaagtaaggcggtctttaccggcttcatcaataagtttagctctttcttctgcgcttaaggtgttatacagttgcatgctataaacgttttaagtgagaataaaatttttgcaaagataatcatttagaattaaattgattgatgataagaatcacagctatatccaataagtgatgagcaatgaatattaaataataccttatattgagaaagtctgacatattttccttaatttttttttaagttttgttaactgtgacattaacaattatgatttaagacacaaaatgatataatagccgttaaattttagttaaaattgaaacatagcatactaattgcttacttatttaacattaaatttgtttactcaaaaacataaaaaagaaattaattaataaacaagaaagatatacaatgaagagtactttaaaaaaactattaccatttgcagtagttggggtaatttccggagctactaccgttggagctttacaatatttcggacctggttccaacaatggagatcaatcttatttcacaacagccgcaccaaacacgtcgttcgcaggaatgaatacggcagctgtaggtgatgactttgtaaaagcagctaaaacaaccgttccggctgtagttaccattaaaaattatcaaagcagaacttcaagcagagcttcagagcaggatttgtttgactttttcttcggagatcctttcgggggaagaggccagcagagacagaagcagcagcaggctcctgataatatgccatcaggaatgggttcaggggtaatcatctcgccggatggttatatcatttcaaataaccacgtggtggccggagctaataagctggaagtcgtattaagcaacaaaaaatcatatattgctaccttggtaggtacagaccctaacacggatatctctttactaaagattgaagaaaaaggtctgccttatctgaattttgccaactctgacaatattgatgtagggcaatgggtgcttgcagtaggaaacccgcttgggttaaattctacagtaacagccggtattgtttctgcgaaaggaagaggtatcggaatcttaggaagccagggaaaagcggctaaccctatcgaaagtttcattcagacggatgcagctatcaacccgggtaactccggaggtgctttggtgaatactaatggagagcttatcgggattaactcggcaattcagtctactacaggatattaccagggatacggatttgcggttccttccaatctggcaagaaaaatcgttgaggatatcaagaaattcggaattgtacagcgaggattcttaggagttcagtctctggatctttcaaatgatcaattggtaagttcgtacaatcagcaatataaaacgaacctaaaagtagggtccggaatctatattacaggatttggtgaaaacagcggtgctgaagatgcaggtttgaaaaaaggagacattattacgaaagtagacagctatgacattactgatttcgcagatctttctatgtctatcggaagcaaacgtccgggtgataaagtacaggtaacttatctgagaaatggtaaagaaggaacaacgaatgtaacgcttagagaccaaaaaggcggaacttccacaagaacaaaagcagatcttagcgtaactgaaaaaatcggagctgagttccagagcattgatgacagaacaaaagcatattacggtctgaatagcggcgttgttgccaaaaacgtcttagaaggaggcgaaatggccaaagcaggaattgtagacggttacatcattacagaaattaatggtaagcctataaactctcagaaagacgtagaaagtttattgaataagttctccggaaccgcacaaataaaatatatggacgactacggaagaaattatcagagagggtttaaaatgccttaattagaaactaaattagtttttcatatcaacaaaaaacgctgcagaaatctgcagcgtttttttatttacttatttattacttattcattttttcagcaattcttttcttcttattgcgctcatagatcacttctacaattttacctccgatccaggaaaaaggaaagaatgtaaggaaaatcgagatcttataaaatgtaggatgataaggaaaaataattacatccagcattgcgataaagagcataataaaaccgatcagaatagcataggctactttagcatatttaacgatgattgcagtcgcaactcctcctatcgtagttcccagtccggaaataaacaaaaggaagccgaagaatgccttatcgtctttcatgctgaaaagaaacctttgccagtgctcaaacggagcaaaagcctcaaaagttacccattgcggaaaagcccttataccaagagtgattataagccctgcaataccaagacctatcagaaccgcaattgtatttcttataaagttcattaatcctgatgtgcaatcatagaaatttcgatatccacgtttttaggcaagcatgaaacctgtactgtttcacgggcaggatagctttcagagtcaaggtaagaagcatagatatcattcattacagcgaaatcatccatattctttaagaagattgtagcttttacaacgtttttgaaagtcatgccggcttcagtaaggatcgcttcaaggtttttcattacctggtgcgtttctttttcaattccttcaaccaattttccagttgcagggtccacaggaatctgtccggagatatacaaaactccgtttgccatattagcttgtgaataaggcccgatagcagcaggtgcattaactgtgttgattacttgtttcatatgcggatatttaatttttttctaaattcatagactgtcactgccttttaaattctttggtattcgaatctgccggcagtggctgcatcagaaattcttttggttgcaaatataaaatttatattcacaaatgccaatctgatattagaaaggcgcattaggctgggtaaagcttctgtctttgtacttcagtgcatcacttaagatattggctttgatgccgataaagaagtcgtatactttatactgtccgaacggaacccagttgaaattgattgtaaaacttcgctgatctcttgaaaaaccaattcttgtatatgccaattctttggtcaccatatcataatgggtacttccgttaatattccagtaaggcgtcagcttgatgctgccatctaatcctaaggatgcaattttattaccaaatctgctcagtcctttagaatatgcgtaattggcgctgatatttaaagtccatgcctgatcaaaatgtgcataatgatcatcatcaaaataataattttcatttcggacctctcccttagaagaatattttttggcataatctgttttttctccaaaaatctcactgcttaaaggataagataactgaacgttgaatccctgcacactgaaatgcccgaactgctctgttcttattcctgtgtcctgtcctggtaagaaatcaatcttataaggttcaagtgcaagactggtattaaccgttaatttattattgaaaaaagaagactgtccgttgattgaaaatacagaccaggggtggtctttagcagcgaagttatagcttcccgcaaggtttaaggattcaaaaattttgattttcttcactcctgtagaatcgctcttagactttattttcatctcgatattgttaccgatattgaaacctaaagctccctgcattccgcttgacggacttccgataatccctttttcaaagatagaataaggcgtcaatgctcctgtagcattataatagttcctatagtatccgaaattaggacttgagaaatccggagaatatgtgaagcttacacttggagtcatcatgtgtcttacagcttccaccgctgaaccttttttaaatttcagcattccgtacaatgtagtctgaagactggctgaagtagagaatgtagagtatccgctaaaatttttctgaatctcatcaacagttacattttttacaggatcataatacctgttcagtgtttttgtagtcagagcattgtcaatattggcacttaagctgaatgtaaagtatttagccaccgttgtattggttgccaatgcgatattatttttaagtccggtctgcattttatcccacatttcttttttaaacagctcattttcctgagtatttacgaaattggtaaggttaaatccggtatttaccgtgatattttcaaggagtccctgtctgatccctgttcttgatttaaacagatagaactgattgattgctacgttcatctgcggaagacgaagatctgccaatcccgttgcaaagttctgagaataagaagctgttcctgtaatagtcatcggaagcttcaggaatcttttggtaagggttaccgtagagttctgctgggtattcagtacattctggttgaaaatgtaattgttgttaagcgggttattatagaatttggtacttacaatatccacagaagcactgaatgtaaggaaaggattggctttagaatcctgagagtgagtccagttgattctgtatgtactgtttttggtataatcatccagacctttaattcctcttaccatggtaccgatatctgccgtaaagtttcctgagtaacggtatttcttctggtaattcacctgaggacgcaggttccagcttcctttggtataaatgtctgctaaaactttaaggtcaaagtgttccccgataggctgataataccctatcccgttcaggaagaaacctacatcttccctttccccgaaactcgggatcagaatacctgcagctcttttatcagagaatggtaaaatggcaaacggaaggtaaaggggtgtaggaacctgctcaataaacatctggataggccctgttacgatctgggattttgttttggttttaatcagcttaatattgtaagctctcataaagtaatccgctgccgtatcttttttcttgataaaataatcatccgttgtataatccgcttttctcatcgcgaatacagaatcattgtatttttttgttttctgtgctataattactccttcactttcttctgttcttgcattgaaagcgatagcttgtttcgtttttgtattatagctgaactcgttggtttcgtatttttttccggcctgtgttgtaatgacaggttcaataatctttcccaatgagtcctgttttcctctggcgtagatcaggtttttgttatcatcaatagagatataatctgcatcaatctgcatatcctggtattttacctgcgcatttttattcaggaatgtcatttttttcggaacatctctcctctgatcgtctgcttttgtacgaagaacatcatttaaagcttccttttttacaactatggtatcctttttggaaatagtatcattaaccgcatttttaggcaatttttcaggagttttctgtgctaaaaaattgttaaaaattaggataattaaaatttgtaatatatttttgaagacggttttggccaattttatactatataattaaggcccaaaattaatataatttttataactgtaagatgcacaaacaaaattttaaaataattttatcatttctccttatccttgccagtaactttattttctctcagaagaagtttacgatcgttttagatgccggacacggaggaagtgatcacggggccaacaggacctattccgatatcggaagaattgccgaaaaagacattacacttgctatcaccttaaaagtgggtgccatgttagaaaagaacaaagatttcaaagtaatttatacccgaaaaatagacgaatatccatctctttccgacagaacaaacctggccaacaggagcaaagcagatcttttcatatctattcactgtaactcttcccagagacctacagcttacggtacagaaacttatgttcagggacctaaccagaataacgaaaacctggaggtagccaaaagggaaaatgatgtgatcttcctggatgaaaaggataagcagatctttggttcttataatcctgattccccggaatctctgattgctttgaaacttcagcagagtaaatatctggaatcaagtcttcttttgggaggattggtggaagataactttgtgaataaggacaaaagatcttcaagaggagtattccagaaaaaccttcacgttctgcgtatgaatgcgatgccatctgtgttgatagaaacgggatttatcaatcatcctgaggaaagtcattatattgcttctgacaaaggacagactgagattgcagaaagtatatacaatgctgttattgactataaaaaagcaattgacagaaaatccggtggctctattgctgtcagaaaacctgagcctgaaaaaccggcagaagttcccctgaaaaatgacttcagaatccttctgatgagctctcctatgaaatacaatgaaaatgaccctgctcttaaaggcctaaattatatccttacccttaaagaaaacggacaatataagtattactatgctgtgaccaatctggcgtctgtaaaagatattaatcttaagaccgccaaggatgcaggattcagaaatgcttttgctgttggatttatgcccaatcagagaatcaatatgggttattatacaatagaagtatatgccggagataagctgaatggcaattcttatattcttcagaatctgaaagacgtggaaagagaaaaagacaatggagtattctattatacctatggaaaagtgtacacattagaagatgcagtgaagcttcagaaggagcttgaggctaaaggcatcaaaaatactgtgatacaaaaagtctacaaataaatcccgaaataattttgaagttaaaaagttaattattacttttgcaacctcaaaattcggcctattcgtctagtggtcaggactcaagattttcattcttgcaacaggggttcgattcccctataggctacaacaaaaacaatccctgatcagtaagttcagggattgtttattccaaaagttaacagaatcttcacgaattttaaaagaactctcatacacgctttgtacaaggcgaatttcgaaaatcttttttgttcgctaaaattattctttccttttgttatctttttgtttcttgaaattggattggaaatattttcttcgctctcaggtatgaaagttctttgaatttgcttctttgtttgaaaaagagattggattgggaaaacaaaaaacaggttcaaaataagcttgttcttttcagcctctttttgtgaaattattcttcaatatccaaatacccatgaggagttatgatatataacaattcccctgtttttgcatgaattaaaattcccatacttctttcttcaattccccaaatctctccataggaaattgcataatgatctatcttttcccctttgtattttccataagaaattggataagtcatttcttcttttgacgtaagtgcaattttatcaatgccatcaatacttgagtaattaatatttttatctaaataacttttaattttattataagcttcttcttttgtaatcataattatttaatttttaaaatttcacttgctttaatttcttttctgacctctggtattttattgatgtcaaaatcaactgatacgggatcttttccaaatcttgcccttacaccaagactagggttgggattattaatatagtcaaaagcatgaactatttcactttttgttagatagtccttattcttcattagcatatcgaaaacccattgttctttttcaagttctcccaaagttccacgtcctcccaaagataaatatttttcgagtcctaatacttgagagtgtctataatgcataaattcgtgaaaaaactcataaattgttgcctcttctctcaagacaattttcatttttgtaccatcagtaataaaaattgcagcagccctctcaggcatcattgcaggaacgccttctctaacaaagaatccttctattggtaatgaaccctctagtggatgtaattctaattctacttttaattttttaagttcctttattaaatactcaatatccactttcctaagtttttgcccaagtcttctacctcttccagatacagccacttcatcccattgagctaaaagttcctcttgcgatggagtttctccaattaattcatagaattttttgcgaaaatattttaagagatttcctgtttttacagcttcaataagctctaaaaattccttttcaagccatttatagacgtcttgtgcagtatttgaaattttctttcctaaatttttagaaaagttcatagcttttgctcctgcctgttctgctttggctgtcaacctactaatttttgcagatgcttcagcaactaatgaactaccacctgtaaagtaggcaataacagcatctaaaatcaactcaaatgctactccaccaataaagtaagcccaaaaatattcattaaggttggaaaatttctttcttaaaaaagatattaaagaagaaacttctttccatattttatcatcagtgaagagctttctaacaccatccagaaactcttttgcattctcattaaataaatctacaaaatcttctataaactctagattctcttggtgctttgtcagttctaaaggacttagcctttctaactcagaaataggtaaattgtccactaccattgctaaaagcataataatcagttgaactaaagatataagaccattgagtattccacacagaaaagcattgatttttgcaatttcttggtttagcttttcactgattatacttcctatacccgaaacaatatccagaatttccttaaatagcacttttagctgattgtaaatattctttatgctgtcaggcatgttatcctctataaagttttttgcaagaaatgtaacagcaaacaaaatatcatcagcaatcgtaggggttgctgcaacgatattgaaaacagcagcagtggagatttcatcaaacgaggcaacaaactccgaaagcttttttaatcctgcttctgcaatattctgagcattatcagacatatttttgtactcattacaaggaaatagaacaggaataataggtttgtattttacttcttgtttcgggaaaccatttgcccctattttattttgaaagttgttatacatgggttctacataaaacttgatataatcatagttttcctctgtaaatttccatttctcggtagcttctatgcctcctcttaaccaatctgccaattggttgtttaatgaagagacttttttaaaggcttcgttgattttacttttttcaagtatttccaaataaatagcacctttcaataaggtatcatcaattccataatctttagcaatcagctttatgagaccattaaaatctgacacacttccgtctactgtattaccatcgtagttaatagttttccccgtgctattgtaatcctttattaatctttgtcttgcatactcccccatttttacccgacaggctgttccaaaaaaattactagtgcttttggaagtcatctcatagtaaatagtaaaatagtttgattcaatggagtctttttcatacctgtcaaaaacttctgttccactttcgcaaaaaacagcctgatggtgaactacactatacttttctgatttgggatagctttcttttaactctggaggaacaacaaatgtttcataaaatacactgttttctcctaaggggctgtcaatgtctctgctcaagacataatctaatctttgtatcatatcatttgaatttattatgagccaaatgtagatacagacagcgacagaacttggcgttttattttgagtttaatttataatattattcttttgaattcaaattcctattaatctttgtgatgcattgaattatttaaaaggtattctatatatgttatatgtaacaaaagcattatatttgcaaaaattttagccatagttggtcacacaatatggtcacactgatgaaaaataatattgataaatcattgtttgtagtttgctacaggctatcaaattttatatcatgccggatttaaaaatacaagaagcgaaattgctttttaagaaaatccactctaacccaaaaagttatgatttacaaatcaatgaagacgggattacaggcaaagatgataaaatcagtttcagactttacaggactggagaaagggttgcttttgaagtaacaattgacggacttactttcaccaatactactggagaatggaacaatgcactgatcatgctgggaaatacgatcaaaaaattagaaaaagaacaagaaaatttaaaaatagaacaggcaataaataaactcagaaagtacctatcagaagaaaattaatttttttaaaaataaatttggtagtttaaaaaaaagtttatagttttgcactcacatttaaacgatatggcaaatcataaatcagcactaaagagaatcagacaaaacgaaactagaagacttcgtaacagatattaccacaagactgctagaacagctttaaaagctttaagaaatgaagagaacaaagctgctgctacagaacaattgccaaaagttatcgctttattggataaattagctaagaaaaatattatccacaaaaacaaagcggctaacttgaaaagcaaattaacaaagcacgttaataaattagcgtaataatatagccggcccgttcgtctatcggttaggacctcagattttcattctggtaagaggggttcgattcccctacgggctacttacatcttgaaaaaccactgtataacatcagtggttttttaaagacaacgtagtaaagctatataaaacataactaaccggcccgttcgtctatcggttaggacctcagattttcattctggtaagaggggttcgattcccctacgggctacaataagagttgatacttataaaaacaaaaactaacctattactccggtaatagaagatagagggcccgttcgtctatcggttaggacctcagattttcattctggtaagaggggttcgattcccctacgggctacaaaaggactttttcggaagtccttttttcgttttcatacatctatattcagctattatttcaaaccatatatagatggtgacttctggatatcttctgatttcagattaggcaaaaactttctcaattataatcccattaatcaaaccgataatgctatttcattttgagcaagctatattaaattttattaaaaatatcaccagttgtagaaatattattttctttttactccttttatacttatatttgattaaactattcactctaaaatatataaagtgtaataaggaaaacctgtttattaaattgtaattaaaaaatttaatcataataatataagtacgataaatttttaaactgcgtattttaattcattttcaaagtgatacgaaaagaaaaccactattaaataaaataaattcataatcacaaatatcaacaaattattaacaaatcacacaaatatgaaataaattagccaacataatcattttatttataaatttacaaaaaagctaaaacccaaaattttctacatatgaaaacttatttattacttagccaacgcgcgatgaaagccgcaattttggcatcgttcttatttttaacaagcgcaatgtcttttgcacagattgtaaaaacttatgcaagcagtcagaccaatcaggtccttggaatatgtcttggttgcggtgtattgaatccacagaatgctgtagggagcaacgagaatgactactctactttgcaagtttcagtggggctcctggcgagaacagagcagacattgatcttccctactaccaacattgcaaataataccaataagcttgttctggcgattggttcaaatggcacgcctttatctgctcaagtgttaggtggcgtttctattgaaacatttaatggagatgtttccaataatgattacaaaacgcttgacacacaaattatcacccttggcgcaggagatccaagcaaaggtgaaattgagcttacaatgaacatcccttttgaccgtattaaaattaatgtgaattcaggattattgaatattggtggtgaacttagagtatactatgcttatcagtacaaagatccatacatcaattttatggctcataaccaaaacggacagtttactcttgataaaaatatttcaacagccggttcagaagtaacgcttacgaatacttcaggaaaagaggtattccgttccaagctgacatcaaatacttttgaaaccaagcagccacagggagtatacattctgaacatcactacaaaagaaggaaaaacatattctaaaaaagtgaccattaagtaacaaaaaatacataatagatcgggcccggcaagcttaaaagcttgccgggcttttatttacaattcatgcttataaaaaaccctgaccaatttggccagggttagactaacaagattaactatctaaatagttattagtttttgataactttttgctgatataccgctttatctgttactgcttttacaatataaatcccctttggaagagcacttacattgatttgcccgttattcagctgtgcattaatgactctgcctgaagcatcataaatggaaacattctgaattttctcctgtgttttaatagtaagaatatcagtaaccggattaggatagatactgaattcaagtttcttcacctcagcagtagctaaagtagatgttgtactagttaccacaagtgttttctctactaattttccgttagagttaaagctgatcacaatatcagatgttcctgaaaccagtggtgttaaaacaagctcatcactattattaattactgcggaaacgactgtaggattgctgtttgattttatagttttaacaacggataccgccatgttgtctgcatcagaaattactgatttcagatcgattgaagtcgtatttgctgctgtaacctgtgaaggtaaaatattacttacaacaggaactgaattattggtaaataccgtcaacgcagggaaccaataataatcgttcagtgttttggtattggtaagcgttccgctcatattgtaggtatgaatccagtttttctggaagtgtgcaccatacccgctttctgtggtattcagaacaagttcaccggtaacggggtttacacgaagagctgcaccgtaaggaatttgcttaaactgtcctgtctgtcccggaattgcggcaaagttttcattaaatgtttttgttgtaacatcaaatcttacaatctgtgttcctgaactaaagctgctgattgaattgatccagtataaggcattttctttgctactcgctgtaaatctacctgcattccatgcaccccagtccccaatgtatttagtggtaggtatattgtaaacctgtgttgcaaaagtggtaggattaatgctgatcagcttttgatcctgaattccccatacactcccgtctttagcctgaactactgaatagaatccgccggcaacagtactcacgatggtatctgtattgggatcgattactaaaattccgataccctgctttactgcaaatacatattgtgaagtacggatcatgtttccaatctggccggtcccgccggttccggtaatcaaagaacctacctgcagattatcaatattgaaaaggacaattccggtagaagtaccgatataacctttatgtacattcactcccacaaaagatcttccatcaccacctccgatattattaaatcctgcaattttctgcatggtctgcgcattggcaacaaccagtcttccacccggagtatactgagtatctcctccatcggcagcctgctttgatacgaagtaaaatttatccccgtagattgttccatattgtgtagtggcaccgaaagcctggttattattggcattactgtacactcggtaattgatctgaccattattgtcaatgaagtttacagagccgttggtatgaccaaaccattcttcgttcaccataaaatatccgttggtatagttcgtagaagctatatatggagaaaccggagtaatggtagaagaaacaggtgtttcattaaatcctacattgaaattccatacatcccatgaaccattttgcaatgtacgtgaggaagctccaacactggaatatccgaaatctgcatcagccggatttttcacccaatacgcccagtatccgttaacggtccatcctgactgccagtgatcattggcagcatctacaattgtatagctgtcaaaatcataagccgttgtgtttacaaaaccgtttacaggatataacggatatgtggtatttccgtttttaatgagagcattggtaccttgaccgttaagatcaaaacctattcccccgacggctgatccgaactgtgttccctgatacagcaatgtgtacagcctgtgatctgctttagcaatagctttaagcatgtcttctcctgtggcatttccgtcccatttgaatccccagaccatagcatcaggatttttagcgtcattccactgtactacaaaagcagcctggttggctcccgatcctacccaatactgaatatcagaaaaactgatcgtagtggtattaagttgactgatctctgaaatatcatttctgggtacaccctgaacttttatctgtgcattagataaacatgcaaacagaaaaagcatcataaaaagataaaactttttcattttttattaatttaaatagattgtattattgacttattatttaaaatgtaaatcgtaagctcctgccacttccgtagaaacttctcccagccagccggcttcctgattgactcctgtatatattttcataaaatcaattccgggaagttttacatattttccgcttctgtctactgcccaggaaatatcgatgtttgaagcttcatcattattcggagcattatcagcatatccaaacgcatacgattttcctacccaataggaaccgtctccgttctgatcgaagaaattatttgcaagcctggtccccgaaaagccgtaagaagtatcggtaaaccacaaaggataatagctttgcgcatgaaaggtattttttgttttgaatccctgattacccagattgtcactccacttgatatattccacatcggtctgccagaattcagttccggctacaggtgttttattttcgttaggtttataataggttatactgtaatcttttacggttgtgtttttaaaatattcactgccggcaatttcataccattcatcattatccggctttccgtttttgtttctgtcataagcgaccataataattcccggttcacaggatcctgaacgaggttcactggcatcatttccaaagaatgcatttcccagtactttaaaatctcttccattcaggttgggaatcgtgtgatcaaaaccgaacactacatatccgccatatcctcccaggctgatcatggtagagtttcctcccaccaaagattcattggctttctgaagcatattcgcagcagtattccctggtaaatattccgggatttcattcatgaactgccctaccgcaggacggaactccaatacttttgaaatgtatttactgtaaggtgttttttctttggtaacaatgattttagaatgaaaaatctgttcgtttcctttactgttaatctttaaagtcagaggataagcatctgcattcagacttataaattcaagctctgggttttgagaaataatagaatcgttaatactccacgtaaccgatcctgatgcattcgtaggaatacttaatactttcaagcgctcaatagtgtaagaatcatcaagccctttaaatgtaaattcatcttcgtcatcgtgtttacacgctattactcctataaggaagcatgatagaattccggcttttaaataagtaaagctatttctgttcatttctttaatatttggttatttgtataaaaaagcgaaatgggcagggatatttccgccttccgttttccatttaaagtgtccgtttttatcaaagcagtacacaaatcccatggaaacgtaatttctggcatctgtgatgtagatatcttctgtaatggggtttacggctattccgtaaggggttttaatagcggtttcatattctttatcaaaaatactgttggcgataatctcttctgttttcacatcaatgatcccgaatgattttttatagctgtgggtattgtaattgaattcattgccgtagaaatagagtttatcattaacaattgtcatttcactgactgagagatgaaaatttttcttgacagttcctgttgatgcatctattacataaaggttggaaggaacattgtaatagtctcctctggagctcacatacagatcaccgtaattgtcttttttaatgtgatgaagattaatggcaacttctatttttttaatttctgtaaaagtattcagatcgactacggaaactgtattgtcataatcaggcgctttgtatcctccggaattggctacaaataatgtatttcccacaatttccatttcttcaggctggtatcctactacaacttcacgcttgatagtgagagatgttgtgtcaatttccactactttccctttcggggctttcgggttaatcgctaccgggccggcataactgctcgcataagcttttccatttttgaaagcaaggtatcggcagttttgcaaaggaattgaagtaatacgtttagtggttctggcatccagcacttcaattttgttggaaacgttaacaacaatatagagtttgcttccatagattttaatatcatttcccacatctcccagttcttttaccacattgggattgatttccgcataaatatttctgaaataagttcccttcgtataatcaaaaaaatcgagggtacatttattacttcccatgtttccttcattcagcatgtaaaagccttttattgctgtgttttctgagggaagtccttccaccacttcctgacggacaataatatcatctgtacggcatgacgtaagaaaagctaagacaagaaataaaaaataaaagtttagttttctcatagggtgaagtttagaataagtttaaagtttcttccgggcatcggataattgattacaacatcgtagtattgattgaaaatattattcatctcaaggcttactttaaattgatgatttgcccagttgaattttttctgaacagagagatcatgcgtataccagggttgcacataattgtactgaatattgtcctggttcacatcatatctttctcctacgtacattgcactgtaattgaaactccagtctttataatctgccatcagactgaaagatccgctatgccacggtgtgtaaggaatctgatttttgtagaaagtatcttcaggatcactcacatctcttgcactttgataagtgtaggaaaataacggtctaagagttacttttcccagctgaagttctgtctgtatattcacatcagcaccaatgatttccaccattccaaggttcatcatcagccagcggaacatgcttccgttgggagcggctacaattttatcctgtactttattgtagtaaccatctactttagcataaaaggttttaaagaaacgattggtataattcttctgataggtaaatccaaggtcatactgattggtaaattcaggttttaaatacgtgttcccgatattggtataatacagatcattaaaggttggaagtctgaagattcttttatagaatgctctaagggtaagctccggaatgatctccggctgataactcataaatacggctggcgtccattctctggcatctcccggccttttgttttttcttacttcttcaaatgtaaaggttcccaacaggcttcccagaattttgaatctgttccactgataggttgttgccaaggctaccaatgtggtataccgtgtaggataagaaaagttatccagattagcatccagattattgtactgaaaatccccactcaggctgacatcccatttgggagtaattgaataaatattagatgaagaaagataaagctccctttgaatataggtgttatcggtatgaataatagactgcgaacgaacggtatccataaaatgggtataatcgtaagcgaatttagcttttagctgagtttcgaatttcgggaacagctttttcctaagattggcctgtacaaaataattctcatcggaaagtctcgctcctcttcctccaaaacggccattcacaatgggagccggcattccacggtctgaaatataaccataccctctgatattccagcttccgttatttaaagttccattgatagcagtttcaaaacgttttgctttgatatctgagtcctgtctctttgcgatggtatcataagcctgctgtccgtccggatatttcttcgcataccggaacctgtaaattccgccactctgcataaattctccgctgaagctggcagaaactctgtctgaaatcttctgttccagcctgaatgaaggattaaagagatctatagaagcacttttagctcttatcacaagattggtttttcttgtccctttaaaaacaggtgttttaggctgtaaatagatagagcccgaagatccgaagtcttttgcaggttgaaaaatttcacttttctgcccgttgtataatgatatttcttcaagatcatccagagaatatcttccgagatcaacaagtccgttctgggcattccccaattgaattccatcatagaaaacccctacatgctggcttcccatacttcggatattaatggtttttaaaccacctaatccgccgtagtctttaatctggacacccgaaaaataccgcagcgcatctgctacagaatgactattcaacctttccagctgctcgccctgtaacgtttgtgcaggaaggatttctttaaaattctttttataaagattgattcctttaatggtctcctcctgaagactgtcttttttcttagtttgggaaaacaaaagctgagatgttaacaccagtacagtgaaaacagctttatgaattgcagaagtagttagttttgccaccattagctcatttaggataatgatgacgctaatggatataagaatacaaagataaagcacagctatcactgcacagaatcattgatgtcctaagctttattccacgaaagcgtcaaacgattattatctggcaggtcttctgacttactccatttttgaaatccttcccattcctaaaaaacagtggatatattcttcaaaaactttggtgcggagcttacagcagcgggtctgtcccggatttgcaccggattcccttttaagagctttttacggctcaccaaattccggcaaagataaataattattcctaatacccaactaaaatcatgatttataaacaattaaagctcccgaaggagctttaacatgatttcaacaaggatttctttttaaattccaaaattcagaaaaatactgaatcttgatttggcttcaatatctcctcctgccagatgagtgtacatgggaagcatgacttcacttcccaggctcaacattttataggaagcttcaaagcctaattttccgtacaaggcacttcctgcagtattcggtagcgcttcatcaaactgtttattctgagcatatacttctccctgaactccggtttttacagagaatatagatttttcgtttccggcaacctgataaaaacctgtcgcagcatagttccattggtttccgaaacggtaatttttcttgttctctgttttgatcgtataatctgtattcaccagtactgccactttatttttctgaaatttatagtttaaagcggcctgataatcccagcttccggtccccaattgaaaacttggattgacaccggatgctcctttctcatcaaattttcccagaggaattttcacgcccaagcctccgctcagatgatggaaattatctttagaactcatcaactggtaaattcccatcaggttcaagtctcctatccctttgattttaatatctccctgcatcgttttcttttcatggaaatggaagggcagacttgcgtaaacactcagttttttcgtcaatggaattttcccccaaagctgcagggtattaaaatactgatcctgcgtaaggtcttttacaaataaattttctttggctttgtaatgctgggcgaagtatttgattccaataaactgtggattcagcaaagattcaaaaccggaagatccgtttcctgcagcacaaccacaagcatcacaatcatcatcaaaatcgaatctgctaaaggtctccggagtgctataagcactgtctcttatggtttttgcctgatactgattcaacaggatcaaactgagtattattataatcttcttcatgtttctataaattattctgcaaattttggattggatataaagcttttatccgataatgttttcaggaatgtaatgattgattgtttttcctgactgttcatggcaattcctacatgaccgttctgtttcagccggggatcaagattgggattatcttccacctgatctgaatagaaattgagtactgcttccaaagtgtaaaaccttccgtcatgcatataaggtgcagtatattccacatttctcagacttggaacccggaatttcatccagtcaacctgattgagagtaaccctgtaacgtccggcatccttgaattctgtattgtaatacattcctgtatttcgaaaactttcatcagtaaacagttctccgctatgacaggaagcacatttctgattaaacaatgccattccctgagattccgttgcagtcagctgttcttttccctgtctaaatctgtcatattttgaatctgcagagattaaagaagccataaactgtgataatgcctttagaattctttcaccggtaatggtttcgtctccataggcttctctgtacagttttttatatttctgatcgtcttttattttcgaaatggcttccggtatagagctgtccatttcgttcacgtcggtaatcgggctgatgggctgttcattcagattatgaatcacaccgtcccacatatatcgtttcaaaaaagccatattctgaatgggtggagcatttcggattcctattctgtcatccacgccatggcttactgtatgcccgtgatgagtaaaagcattttcctggatatggcagaagccgcatgaaatggtattattcctggaaagcctgccttcatagaagagttttcgtcccagctccactccgttttttgtcaccggattggctgattgattaaaagtcatttccggaaaataagacggaaactgcaggttgtaggcttcatccttttccaatggctggataacctcatcggaacatgaaatacagcttaatataaataaaagcagaaccaatatcgttttgataaaaaaattaatcattgtgaacgtggtctactttgaacatttttgtaagattattggtaacgtctaccagatgctggtttgaacccatcaacatgtcattggctgtagtaagagtaagtgctttatctccgctcagaaattggttcaggtccgccagaatgtgaacagatggacgaatctgtcctgtaactcttgctgttgttggaaagctcaatgtgatttcccgataaaggttcggtgtattattggctgcagtattgcccatatttccggtatgattcatgaattctttagctggagcatccgtaccatattttccttccagctttacaaaaacatagccggcagcccatgaccaggacattcctttctgcttggctttcgtccagaattcagcctggccgtcctggcctaataagtaggctttctgactgattcccaatccgaatcttatttttttataattgtttttcggaataccatccagattaagatagataattccggctacggcatctgcctgatcgacaataaatgcacctttatcagggttgttttcattgtatttaaactcgtttccgttctcgtctatcagtgcgatattactgatgacgtatttcaaagcagaaaaattatgtttctgaccgttggaagaggtctgaacagtctgattcagaacaatgtctcctacgttattaaatccgttttcaaacttgatctgaagttttccgagcgtagtatcctgtgaattttcttcatccctgctaccttcgcaggctgtaaaggataataaaataaaggcactaaagaatagtgataaaaattgagaaattttcattgttgattttttaagttgaattaatttgaattgctgcaacagcattgtttttaccgtaaaaggcacaaaaatccccacacttaagctatattaagtgataagctttatgtagaacaataagaacacttaagcttttaaaaatcaaacatttaaataagcttttgtgacttttgcgattgaatagtgatagttttaacttaaaaaaccggtggtttgaaaatatgggttagaaacaggaaagaataggctgtttcgtaagtgaaattgaagctaaaaaacggacttctttccgtagtattgatcgctgtagtttcaggaagaatataagtatctagtattttctgtcctgagtttttgagtttctgaaaaggggaagattctgagtcattggttttagccaattctttactcagataacattttccattacagtgaatctccggtctgtttttattaatacagagaactttagcgatataatcataatttacagcatactctactactggtactaaaggccttagcaccatgtaacaagtaaaaagtatgctgtaaaataatttcatcagattatttcttgcttagagcttcgtcatatcttctgctgatttctttccagttggtaacattccagattgcggtaagataatctgctcttttattctgatattttaaataataagcatgttcccagacatcaattccgaagataggagttcctttttcttctacgacatccatcagagggttgtcctgatttggcgttgaggaaacgaatagttttccgtttttatctacagaaagccatgcccaaccggaaccgaaacggtctgctcctgcttttgccattttttctttaaaagcgtccatacttccgaaagtctcattgatggcttttgccaattttgcagaaggctgtgtatttttctgaggcgtaagaaccgtccagaacaactcgtggttataatgcccaccagcattatttcttactgcagcaggcaattttgatacattggaaagaatctgaaacaacgtttctttttcctgtggagttcctgcaatagctttatttaaattggctgtataacctgcaccgtgcttcgaataatggatttccatagtctgtgcatcgatagagccttccagtgcattataagcatatggcagaggggtctgcttaaactgagccagtgcaaactgagccgcgaaaactgcacttaaggcagctattttcataatcttcataacttttttgtttatggttgaacaatgttttattcttaagctggaagatgggagactgaggctggaagtaatcaatgtcataacatcaattcataaacatctatttatctttacagccatctcaaaaatcgccagcgctgcatcgtctggaataacttccagcttctagcttccggcttccctcttctctattttaataatttcttaatatcctcaatcaggatttccctgtccggattgtattttcccgtcagcataggttttttaccttccggatcttcataatttaatcctgagtaataaaggatcggcatattttctttattatatctgcaccggatatttccttcctgatctaccagagcaatcattccgctgtgattcaggctttctccttcatcttctttatcaccaacgtagatattaaatttatctgcaagatcaccaatataggtacggtccccggtcaggaaatgccagttcggggatttagcgcctattctttcagcatgttctttcagtgttgcaggagtatcattttccggatcaatactgatggagataataccgaagccgggatcattgatctgattctggatcgccttcatattggtattcatcaccgggcatatggtagggcatttgctgtagaaaaactcaacgagatatacttttcccagcatgtctttattggtgatttttttactattctgatctgtaagttcaaagtccggaaccttcatcacggtataaagattctttttaaaatagcccattcctacccctattccaaggaaaagcaatgcaaataccgcaatgggtatgattactttacttttatttgtggtcttcttatttttgggcatatttctcaggactttttttaaattcacctttgcaatacacactgcaaaaaccgtacgttttatttttatataccgcagtatctttaagagatccggcagttttcatgtggcagataggatcttcttcgttcactacctgtacattttctattttcttccctgaggagtccatgtggcttgcatgctttaccttaggcgtttctttcgcacatgacattaatgagatcgacagcacagcagccgaaataatgagagatttcatttttaatcttaaattgaaatttataatgttaaaaatttgtaacacaaagacacgagcttaaacttacaaaatggttaagtctgaaaaacacagaacttcttaaaaagaactatgtattctgtacagcttgcaattgttattgtagacatgcagcgtgccttctatgaggtattgatgagtgtttctgaaaacctcaaccaataaactaaaaatatagtttaaaataaaattaagctaaaggaggatgaaatatccttgaaaaatattctgaagaatgagaattaaagtagcttgaatccggaacctctgtcactaattctgagttcagctgtgtggaaaatgaaagaatatcatgagagataaagacatctagccctgcaatctttatggtttgagagctattggactgtttttctgttttggccagttctttttccacatagcatttcccgttacaggttgattgcggtacatttctgttctcacaaaggtttttaacaatataatcatagttcacggcatagtttaccagtggcaaaacaggacgtaatgcaacggtaaaaatgatgaatatagaaagtattatcctcaatgatgtattctctgttacaaatatactacttcaaaattgttttataacagatttatgatgaatgtcattatggttatctactgttacctataaaaatcacaaaactgtgcctgtcaccggtataatattattccgaactttgaataagactttagatctaaataaaaatttagttctttatatacaatttaatcttgttgataaaagctttgctgatgtttttggcagagctttttttatgttttgttgggtagacgcaaagacgcaagttttttcaatgtttactgttttaaggcgcaaagattttatctccgataaaattgaatactcgtttgatttctctttgtagagattcctacggaatgataagctgtgtgtattattttttgtaatagctgcgcaattgtcagccacatagtttaatcacatagtttaatcatatagtttatacagaaagtaaagcggtctctttgtcactccgcaggagtttcaattgcatacggcaaatttcaatgacttgcatgatattaattaaaaaacaaaagccctgctgaaaatccagcaaagctttattaaatataattgagttgtgtttattatttgcttcttaaaatttcattctctgaatccttaccgcatttaaaatcgcaagcagcgctactcctacatctgcaaaaacggcttcccacatggttgccagccctccggctccaagaacaagaacaactgcttttaccgcaaaggcaagaataatattctgccaaactatctttttcgtttgtttcccgatattgattgccattggaattttactcggcttatcatcctgaatgacgacgtctgctgtttcaatagtggcatcacttcccaatcctcccattgcaattcctacatcacttaaagcgactaccggagcatcatttactccatcgcctacgaaagctacggtttggtttttagctttgatttctttaaccttattgactttatcttcaggcagcagatcgccaaaagcgttatcaatactcagctgttctgctacatatttcacaacagtacctttgtcaccgctcagcattgttgccttaacattcattttatgcagcttgtctacagtttctttggcatcttcttttatactgtctgcaatcgtgatatagcctgcaaattttttatcatatgctaccgcaattaccgtgtagacaatattggcatggttgagatcataactgatattgaatttatccatcagcttaaaattccctaccagaagttctttaccgttaatggttgctttcagtccgtgaccggcaatttcttcaacattttccagaggaatagaatgattgatatctcctacaaaattatggatggccgttgcaaccgggtgtgtacttttactttcaaggacatttaccatctggaggatttcttctttattaaattcagggcttatgcttacttcctgaactttgaacactccttctgtcatcgttcctgttttatccattactacattctgaatttctgcaatgctgtccaggaaattacttcctttgaataaaatcccgtttcggctggctgccccaattcctccgaaatatcctaacggaattgagatcacaagcgcacaaggacaagaaatcacaaggaaaatcagtgctctgtacagccagtctctgaactgataatcgttcacaaagaagtacggcaataagcagattcctatggcaagaaataccactataggagtatatactttggcaaatttcctgatgaacaattctgtcggtgctttctgcgctgtagcattctgaacgagttcgagaattttactcagtttgctgtcttcgtaggctgtatttacttttaccaaagcaatactgttcatgttaatcatcccggcaagaaccacttcacctttatttttggtatcaggtttactttctcccgttaaagctgcagtgttgaatgaagccgaatctgacagcaattcgccatccaatgccagcttctcacctggtttcagctgtataatgtctccaattttagcttctttagcctttatggtctttggctggttgttttccattaccgttacctcatcaggacgctggtccaataatgcttttatgtttcctttggctctggtgaccgccatagactggaatacttctcctaccgcataaaacagcatcaccgctactccttcaggatattctctgatggcaaaagcaccaatggttgcaatactcatcagaaagaattctgagaacacatctcccttaatgatacttttataagcatctttcaataccggaaaccctacgggaatgtaagccgccagataccagaccaaacgcacccagcctgtaaaccatgctggttttatatagttatcaaaggcaattcccaataataagatcacaaaggatataatagccggaagaaacatctgaaagaccgtttgatctcctgaatcatgagagtgatcatggccatcgtggtcgtgtccgtctccttcttcatggttatgtttgtgcccttttgtatcgggtttttccggggttgtactacagcatttttccataactgatatttttatacaaatgtaaagatgagaatgatgcaatgctattgcaaactttcaagacagttttcgcagattcctttggcaaacagccttatttcgtcaatcctgaaattggtctgtatgttttcaggaaaggaaatatcttctttgcaggtggtttgcttgcaaatcttacagtagaaatgcagatgccagtctttatgtgttttttcatcgcaatcatcttcacacagtttgtatttcgtagtggtattttcctgaatgctgtgaacaattcctttttcttcaaaggttttcaatgttctgtaaatggtaattctgtcagcattgtcaaaatgattttctatttcagaaagggatagagccgcttcctgagaacttaagaaatcatataccagaatcctcatactggtaggcttggtatttttatcaatgagtttgtgttctatatcttttttcattgtacgtttttaatttgttacagatggacttcattttcttcatagccttcttcttctatctgaaaagtggtatgacttattttaaaattattcacagtagtatccgtcaatatttttaataactgattctgtgaatatccattctcttttacaacatgtacactcatcgcattcacactggatgttagcgaccatacatgcagatcatgaacatctttcacaccaggagttttctccaatgattcacgaagttcatggatatcaacatcttttggagttccttccagcagaacattaatggcttctttcaggagtctccatgttcttgggaagatcaacagtccgatggcagctgaaattaaaggatcagcatagtaccagccggttgtcagcataattattccggcaatcattactcctacagaagtaagcatatctgaaaggacttcaaaataagcacctttcatattaagactgctttctgaatcttttctcaggattatcattccgacgatattgacaatcaaccctattcctgctacaatcagcattgatttactttgtacctcaggcggattctgaaacctctgataagcttcaaataaaacatagactgaaattcccaacaatacaacagcattgattactgctgccaatatttctgtacggtaatatccatatgttttggaaggatctgcttttctttctcctattttaattgctataaatgccaacaataatcctaccacatcggtcaacatatgagctgcatcggctaacagcgcaagactgttggttactattcctcctattacctcagcaatgagataagttccgctaaggcaaagtacaatgagcaggttttttttatgccggctccctgcagaaactgtttgtgttggtgaattttccataggatgtatggtttatttacatttcataataagatgtattcttttttttgggtggaacattgtgttctcccgtcatctgtctgatattgatttctatggtctgcgccaaagaagtcatcggagtatctacaggaccattctcaaaaggatcctgcataatgatggatgttttttcaatcgcaatgaaagtcaccggaaccaggaaagtcactgcaatttctaccagcagctgtgaatcatcaagtccaaacggaaggatggccgcaaaaacatagatcagaatatgtactaaaacactgtaagaacgtgggaaaaccgtattcttcaatctttcacattttcccatactgtcgcagagtcttgtgaggatatcattcaactgcatctgctggaaatccgttaatcctttcgaagctgcaatttctttcagctgtctggagtgttcgtccagaattgcattgggaatattgacagctttgatctgatgtttatccagatattgctgaactttttcagaaaatggaagttttctcagagattctccaagagcatagttccagatgatctgtctttctgcgaattctttgattattctatcattacctgccggcataaactggataatcagtcttacaaaagttcgggaatcatttacaatagcaccccagactgttctggcttcccaccatctttcataggactgggaagtacggaatgccagcagcaatgataccgctgttcccaacaatgccggaatattcaaaggcagtgagattttgcggaaccatggcaattcgtccagaagaccaatggctatagcaaatattccgatcagcagaatttgggtttttatttcacggatgaaataccagactgatatttttttgtttagtaacataatcaggtcatttattaaaaattcggtgagatactctttactttttcctgccgtttttaaattccgtaaacagctctaatgtaaggataaaaatcgacattttacgggttccggctactttcattaatgttcgtgctccccggaatttacgagttttgcgttcacaaaaaaggctcctttcactacaatttttgcattgtcaggaatatttcccactggagttatcgcagtatatcccatatccgttgttccttttactatttctattttttcaaagtttaaggttttcggatgtggttttcctttttcctcatgttcttcttctacttttttatcagtctgaataaacacataatacttcccatctgcttctacaatggcttccgtaggaactgccggtgttgtacttttatcaaggcttacaattcccgtaatattcattccatcgatcagtccggatttgtttccaatcacttcgcaatgcatagaaatggttttactttcgttctcaaaagaagatcctatgctgtaaatttttgcatcatattcagtttccggattgttcgtcagtttaaaatgaacaatctgccctaccctcattttaggaagatctttttcaaatacctgaagatcaagatgaatagaaccgttatcaatgactgttgccaccggagaagaaatatcaacatagcttcctatctgtgctgtaatactactgattgttccactgataggtgctgtgatcacaagacctgatttcatattgccattgctgacttttcccgggcttattcccatcatctgaagctgtttcaaaagggaagctctttttgttcttaatgttttaagctctgcatcggcactctgaaggtttttcttcgctcctgcatcgttatcaaaaagttctctctgtcttctgtattcctgctctgcataggtaattctgctgttggtggtcagataatcttcctgaagctggatgtattccgggttagcaatagtggcaattacctgccctttttttacaatactccctacctgaatattgatggttttaatgattccaccataaagagatgtgatggtagccttattgctgttgggtacactcagcaaaccatttgcttttatcgtagaggtaagctctttcatttctacagttcccaaagcaactcctacagatttcatttgttcttctgtaagagaagctatgttttggggctcttcgtcatggcctttttcggactgctcagtttttacatcagcatttcccgtttctttttcctgttttccgcagcttatgatcgacagggccgtgactgcaagatatatgatattgtgttttagtttcatgttatttattgatgattgaattaatagtaacgacagattggttcacctgctggatagattccaggtattttaactgaatattggttgctgtctgcagggcaaaaagatattctacataggaaatttcccccgttttatatcctaattgcgctgctttcacgattttctcagcgttaggaagcgcctgacctgtgtaatattcatattgctggatatcctgctgatattggctaaaagcattttccaactgtgcagaaagctgtttttgctgcattttagcattggtttcagcaacctgcctttcatattccaatgcctggattcttgcttttgtagctccaaatgtcaacggtatcgctactcctactgttgctgactgaaaacgctttccggaattataaaaattctcctgtccgttgatggtatggaaacctatcagcgattggttggtatatcctaaactgaaatcgggaagcccaagcgatttttcaacttttttgtttttttcggcaatctccatttgctgataaaaagcttttacagcaggattgttggcaacaactgtactgtcgagtacactttctgccttcagaggaatatagtctttattaaacgggacttcaatatcttctgaagtgttcataagggtttttaaattcttatacgcattgttcagaaagacttcattttgtctgagcagcagatcaatttctcctttttgtgtttctgcagtactgatttcaatcttttttatatcacctgctttgaatctcacggtagcaattcttataaattcctcatagtattgggccagactggtcagctcggctttattatattggagatattcaatctgataataataggtacgcacctgttttatcagttcattcgctgtgatttccttatcaatctgtttgcttttaatattctcattaattaagtcttttcttgctttaaatagtgttggaaaaggaatactttgtgagattgcaaatgactggtcaaacttaggactgttgtattgcccaagctgagcttcaaaacttaacttaggaagttcttttgccgtaggtcttaatgcttcggcggatttaatgcttaaatcttttgactgcaaagtcagattattattcaaagcctgttctactgcctgttctacagaaactagtcttgactgtgctttgaaggtctgtcccagcatcatgaaccctacaacaaggatcgcagtatacatgcctgtattattctttcttcttttcaaaatctttgtgttaaaaatgatgtacagcatcggtaaaacaaataacgtaaggaaagttgctgttaccaaacctccgatcactactgtagcaagaggtttctgtacttcggctcctgctccggtggaaatagccatcggtaagaatcctaacgaagctactgtagcggtcattaatacaggtcttaatctggtttttgttccttcaaatactcttttcagaatatcggtttcaccctctttttctaattggttgaatgtcccgatcaaaacaattccgttcagtactgctactccaaaaagtgcaataaatccgattcctgcgctgatactgaatggcatatctcttaataaaagggcaaatattccacctatagcactcataggaatcgcagtaaagatcagtgcagcctgtttaaatgagcggaatgtaaaatacagcagcataaaaataagaagtaacgatacgggaacagcaatcatcagacgcttactcgcttcctgcagattttcaaattgccctccataggtgaagtagtatccagaaggaagtttcattttatccagttttgcctgaatatctttcaccacactttccacatccctgtctttcacattgaatccgatcacaattctacgttttccctgttcgcggctgatctgtgccggtccaagtttatagctaatattagccacctgcgataatggaatctgtgctccgctggcggacgtaatcatcagattattcacatccgaaatgtctgttctgtgaagactgtcgagacgaactaccaggtcaaagcgtctctcattttcaaaaacctgaccggcagcttttccggcaaaggctgtgcttactgcattattgacatcttcgatattcaatccataattagctattcttgttctgtcatactgtacattgatctgcggaagaccgctcactctttcaatctgaggagctgtagccccatcaacagtctgaatgactttcccaactttatctgcatatatggcaagagaatcaaggttttccccgaagatctttacggcaacatcctgtctgatcccggtcatcagctcattgaaacgcatctggatgggctggtttttttcaaagaatactccaggaatcgtttccagtttttcactgatctcattagccagttcgttgtaggatttcttggttttccattcgctttgcggttttaatactacaatcatatctgtagcttcaggaggcatcggatctgtaggcacctcagcggaaccagttttccctactaccattttcacctcatcaaactgcttgataattcttgatgcctgcatggaggtttctatactctggctcaatgaacttccctgcggtaaaatacagtggaaagcaaaatctccttcctgcagctgcgggataaattccccacccatatttttaaagataaaagcagagataagaaaaactactgcagttgcggaaacaatgatatattttactttgattgctttctgcaataatggctgatagatcttctgcaggcggttcatcattttatcagagaaagtttctttgtgggatattttcttggataaaaacagggcactcatcatcggaatgtaggttagtgacagaatcaatgctcccagaatggcaaatcctactgttttagccattggagtaaacatttttccttctacgccggccaatgtaagaatcggaatgtatacaataaggatgatgatttctccaaaagcagcactgcttctgatttttgatgcagaaaggaatacttcttcatccatttcggactgcgtcaaagcgcggacagattttctgacacccaaatgatgtaaagtagcttctacaataattaccgctccatccacaatcagcccgaagtcaatggctccaaggctcatcagattggcacttaccccaaaaacgttcatcattcccaaagcaaacaataaggaaagcggaatggccgaagccacgataagtcctgctctcaggtttcctaagaaaatgacaagaacgaaaataacgatcagggctccttcgatgaggtttttctctacagtattgattgccctgtctaccaaatctgttctgtcaaggaatggttctatcaccacatcatccggaagagatttctgaatggtgggaatttttgctttaatgttattaactacttcattactgttggctcctttaagcatcatcacaactccccctacagcatctacttttccgtcatatgttaatgccccgtaacgaacggcgctgcctaaacggacatcggcaacatcctttataaaaatcgggacgctccctgtttcatttttaacagcaatgtttttgatatcctcaagtgaagttaccaaaccaattccacggatgaaataggcgttgggctttttatcaatataagctcctccggtattttgattatttttttcaagtgctgtaaaaatttcggtgatgctggttcccattgcttttaaacgattgggatcaatagcgacttcgtactgttttaattcacctccgaaactattgatttccgccactcccggcgttccgttcagctgtcttcggacaatccagtcctgcatggtacgaagttccttggcattgtatttcttctcgcttccttttttagggtgaagaatatactgatacacttctccaaggcccgtacttacgggagcaagttcaggagttcctactcctttgggaatttcttccactgcatttttcagctgttcattaatgagctgtctcgcaaagtacacatctacattttctttgaacaccacggtaattacagagagtccgaatcttgaaatacttcttgtctcctgaatatcgggaacattggcaatgctctgttcaatgggaaaggtaaccagctgttccacttcctgtcccgccaatgtaggacatacggtaataatctgtacctggttattggtaatatccggaacagcatctatcggtaatctggtggcattccatgttccccagatgatcagcaccagggtcatcaatccaatgatcaccttgtttttgatactgaattttataattttatctaacacgatttgtatttaatttttattgaaaagtgaatgcatacagcgtaaaatgctgcagcaaaaatatcctgaaaacctctgcaatggtattgcaaagtttcaagcacagataactatcagaaagcaaaactttctgaaaatcaataaaaattaaactttaggaggctgccagataggatcgtaaatctggtaagcaaaatcgtttttgtgaaataagatcttttttgaaaaataagcgggaatctgctcaggaatttccaataacggatccatcttaaatgccgaaaccgtcatctggcaacagctgcatgcacacaacggagaacagatgtctcctttttcttttgaatgattttcctgaacactcagggaagctactttccctgaattctgcggatgagacacgtcagcacatggcattaatgataacgccataaagtaaattgccagtatccatcttaagagattcattgttacaaagatagagattttttataaaatgaatatttgttgagcatttacccaatattcttttataaaaacttattcacaaatactataccagacctttatgataaaattcatatcattgaaaataaaaatatcttaacatcaaaaagacacatatgaataattttcccttgatcaccttttgttcgcttcaatacaaatgaggtgaaacaacttttccattatagcatgccaataaaaaatttttgattatgattaaatatattttttcaatactatgtatgatgggattcttaaatagttacggacaaaaactatataaaatagaaaaagatcaattcggggaacctttattaaataataaagcacaatattcatttacaggaaaaccttctggagaagatttaaaaaattgatactacaggatattatgttctggtctttgaggggagatattacaatgaagaagaaatgaagaatccaaggataatcatttttcataatgatggtttttttaagaatgaatcacttatgtattttggaaaacttaatgagcagagaggaaaaaactctgtttattatggggaaaaatataggataaaaaataatatcatccaactagaacaatttggaaaatctccagattcaaaaaaatggtataccaggagaataactaatggtagaatagatggtaataagattatttttaatgaagggctagtttctgtttttgaaaaaagaaaaaatttgcccgcaaaataacaagatctttagttgagaaccaataaatgaatcgggttaataaccaacaaactggaataattaatttgaggagtgaatatttttcaataatctatagaaataattttaaaacaaaaaccgttgctaaaaagcaacggtttttttaataaaaaaaaccaccgcaaaagcagtggcttaaaaaatcaatctaattatggactatatcctataaattcgggttattctcaaattctctttgtggaatactgaataaataatagttgctgttcggtacaaaagcagatttatcagggaaatcaagaacagaatgtcctttaccgtctacggttttcacggtaccatccggtgtagttacctgaacttttatcggtttgccgtcagcatctacaaacggttttcttactactgttccctgcgttctgataatatctgaaagggaaaatccttctccgaataattcttttcttctttcaatcagaactgctgcgataacatcactttgcgataacgagtcattataaatattggcatttctggcagatttcaactggttcagtacggttaccgcctgagaaacatttccacttcttgcttcagcttcagcttcgatcagatacatttctgcagctctcatataaacaatatctgcaataagagtaggtttaaatttaaacttagcatacctcagcaatccttctcttcctttctgcccgtcccatgaaaataattgatatctgatgtcattggtatcaaaaaggtctttaaaataaggatccgccataaagctgtaataataactccccgaagaagaaacatccagataatggaaggcataactttcatcagactgctcctgggtctgtgcatgtccccagatccactcgacattgttgatatcattgaaaccttctttatacttttccggagccatcaacgggaaaccttctctcgcaattttcgcagatgctgcagctttactccactcgcccgtattcaggtaagttcttgctaaaagtccgttcaccacagaacggttgattttatctttattatttcttgtataatttttcaacaggttatcggcgtcggtaagatcacttttaatcaatgtatagatttcttcaaggcttgctcttttcttccctaccgtacttgttgtggatggttctgtataaataggcgcagtcaaagctgatttgtctttgagatagctgaactgataaaagctcgccagattcagataacagaaagcacgtaatgcttttgcctgtcccttcacctgatcttttttctcctggctgccttctgtgccatcaattcttgtaatcacattgttcatattattgatggtggaatacaacagagaccagataaacaacggccggctcgctgtattattcaccatttctgtaaaagcataagtagaagcaaaaccatatttattggtcaatactgccacatcacttcccatcgcatcactggctcttaacacagtggaatacccgatattggcataggttgtcccgtcattattaaactttgcccaggtaccgttcactactgtttcagcactttcagcggttttgaaaacttctacactattggcctgatcagtcggagcagtgtccagatcactttcacagcttgccagtgacaaaaatccaatgattgcaaacgatatgtattttatttttttcattgtttcaattttaaaaggttaaagcgttgcctgaagaccaaaagtgatcgttctcattgcaggatatctgtaatacgttgttccgtccaaagcctgttcaggatccattcccttatgtttatagaatgtgagaaggttttctgcctgaatatatattctgaattttttaagtcctattttctcaaaataatcttcaggaagagtatatcctaaacttacatttttcagtcttgcatacgtaccggaatacaggaatcttgaagacgttgatgtccagttattcgttgttgtacttaatgcaggaacatccgtattaggattatcaggcgtccatctgttcaatatttccgaactccatgcgcgtcctccggcacttccgttatgcatgatggaagtataatcggtatccagaattttacctccgattttgaatgtcaataatcctgaaaaatcaaaattcttataagtaatactggtactgattcctcctgtcagtttaggcaatgcggaaccctgcagcaattttgtagcttttgaatattctgaagtcgttccttctactgagtttccgctggcatcagtagtcaccgttttccacaaaggctttccattgcttggatctactcctgcccattccggaataaagaaatcatatactgaacctcccactgtcagtaacttagttcctactaccaaagaacctccgggaagtttggttactttattgtttaaagtactcagattcacatccacattccactggaaatcatcatttttaaccggtgttgtgaataatgaaaattcaaaccctgtattctgaatcgttccgatattggctggataatcactgattcccagcgatggagccaccggcatattaaacagaagatcctggcttttccttttaaaatattcaatatttcctttaactctgttattcagaattgagaattccaatcccacatttaaattaaggttggtttcccacttcacattattggtatacgttttttccagggttgttcccggttctccaccaagactgataaacctgtacaactcctgataagcgtaataaagtggttgaccatttggacgaagtaatttatcattaccctgccccccatagctggcacgtaatgtcaactgattgaaaacatttaagcttttgatgaattcttcattggatattttccatgaacctccaactgaccagaatcttccccatctgttattttttgcaaatcttgaagaactgtctgctcttcctgatgcagataagaagtaagtattattgtagtcatactctacttttcccaggaaactcaacaaacttagtttattgctgtttccactgaaacttcccagcagtgaggcagcatccggctcataataataaggcagtgaaaactggcttcttgttccggaaattgtctgataatcgtatttatagaattcatgtcctgctaacgcattaatgtggtgctttccaaactttttatcatacgtcagaatattactggttgtatacgaaagcgttctggtatttgttttcgttaccgaacctccaatttctgctccctgaccaagtaatggatttgaataataatgtccgttataattcacaaggtcaacagaaaagcttgtcttgaattttaattccggtaagaaagtaaattccatgaatccctttcctgaaaagttatcttctttattttcgtttttgtctaatggaagggttgcagcggcattttgattctgtaaagcattcgtaggtctgtattttccaaaatcataaaccggatttccatcagcacccaaaacgtaagttccatctgcatttctttcataataaggatagaatgaaggaataaaccttgcggcattgatgatattgctcgccttggaatctgaagaagttggtgcctgctgaatactgttggtatagcttaagtttactcctaaattcaaccatttcttaacttcagaattaattttcaacctggtattatatcttttaaagccagattcaatagccatacctttatcatccagataaccaagggaaaagaagtaattgcttttctcacttcccccgctgatatcaagatccacctggtttcttgatgctactctctgtaaaatatctctccagtcatcattccagagtggtgaagcaccagctaataactttccatctgttcctacaggttttggataagctgtcccatatgggttgattccaagggtagaaacaagattatctgtagccatctgagctgcctgctgggaagaaacttttccggactgatatccgtttctcaacgcttcccaatataattgaaagtactgatctgtgtttacctgctcataatctttgacagctcttcctgagaaaccctggctgatattaaaattaacttttgcttctcctttttttcctgattttgtggtaatgatgataatcccgtttgctcctcttgaaccatataaagcacttgccgttgcgtctttcaaaacactgatagattcgatgtcgctcgggcttatagagttcaggttaccatcaaaaggaattccatccactacatacaatggatcgctggaagcacttattgaaccaattcctctgattctgatggtagaaaccgcacccggctgacctgatgcacttgtcgtctgaatacccgctacctgtccttccaatgctttggtgatgttggtaacaggcctgttattgatcttatcactggaaattgtcgccacagaaccggtatagctgtttcttttcgcttttccataggctaccactaccacttcatcaatctccttttcatgaagactgtctttttttggttttgaattctgcgcatttacattagccactcccaaaaaaaatgcggctaccggtggtatccatattttagaattgaataaatttttgctaatcataatcaattttatttatcatatattaaaattttaccctttgcagaaaagtcagcaaatggcatcaataaatacgataaaccaaatgcttatttttccataaaaggctgaatgtaacaccttgcctcacgggtaggttgttaagatttcacagggtcagttccctccatctttctttataagccgatcgaaatatggttgcaaagctaaaaacttttagtctacaaaacaagtagacttattaatatttaatgataaatttttaataattaacataaaattttaataaaacccattacagtaaggagttataacagttacactattttcaaacatgacaaatatcattattaataattcaataatgtaaaaattcagcagagtttaatttctatgtgattttattggaaaaactttttaattttatagtatgaaagttttaattataaacggaccaaatcttaaccttttaggcaccagagaaccggaaatctatggaagcgtttctatggagagttatttggaaattttaaaagccgaatttcactctcacgaattaaaatattatcagtccaatattgaaggggaacttatcaacagacttcaggaagatgattttgatgctataattattaatccgggagcttatacccattattcttatgcgattgcggattgtttaaagaatattcgtaaacccaagattgaagttcatgtcagcaatatttataaaagagaagaattcaggcagaaatctgtaacagcagctaatacggatgctgttttatctggttttgggatggatggatatagactggctttattgagtttgaagtgattttagattatattccccaaagatcgcacagattctcacagataattatgcatacagaggaataatttatgaatataaagaatcaaatttatttcaataaaatactcctattactaaaaaataaaaagcctcatcagtgatgaggcttttatatgtttatggataactattagatagtctgttcctgcaattgaggtcctgaagcaactaatttctttccttcttctgtatcacagtactgttcaaagtttttgatataccttgaagcaaggtcttttgctttctcttcccattctgaagcattttcatacgtatctcttggatctaagattcctgtagaaacatttggcaattcagtaggaatttcaaggttcatgatcggaacctgagttttaggagcattgtcaatagaaccgtcgatgattgaatcgataattgctctggtatctttcagagaaattctctttccggtaccattccaacctgtattcaccaaataagctttagctccgtgctctttcattttaccgatcaatgttttagaatacattgttgggtgcaatgtaaggaatgcttcgccaaatgcaggagagaaagatggttctggttctgtaattcctctttctgttccggctaatttggacgtatatccgcaaaggaagtggtattgagcctgatcttcattcaggatagaaaccggaggaagtactccgaatgcatctgctgaaaggtaaacaatcttcttagcgtgacctgctttagaaggtaatacaattttgttgatatgatagattggataggaaactcttgtattttcagtaattgatccgtctgtataatctgctactccattgttcaccacaacattttcaagaagtgcatctctcttgatggcagcgaaaatatccggttccttttctgcagataagtcgataactttagcgtagcatccaccttcatagttgaatactccgttgttatcccatccgtgctcgtcgtcaccgataaggtatctcttaggatctgctgataaagttgttttaccagttcctgaaagaccaaagaataaagctacatcacctttttcccctacgttggcagaacagtgcattgaagccataccttttaatggaagataatagttcatcattgcgaacatccccttcttcatctcacctccataccatgtacctccgatgatctgtagtttttcagtaaggttgaacatgatgaagttctcagagttaaggccctgagcttcccagttagggtttgttgtttttgatccgttgattactgtgaaatccggctcaccgaagttttcaagctcatagtgagaaggacggatgaacatgttggtcacaaaatgcgcctgccatgctacttcaacaataaatcttaccttaagtcgtgtatctgcattcgtaccacagaaagcatctacaacataaattttcttagcttcggaaagctgattcatcactagttctttacaagacccgaaaatttccgcggttgtaggtaaatttactttaccatcccagaaaatagtatctcttgtaacatcatcctgaacaatatatctgtctttaggtgaacgacctgtgaaaattcctgtttttactgatactgcgcctgattctgtaagctcagctttctcaaacccctgattttcaggagaaacttcagcctggtataattcttcataagaaggattatacactacttcatagtttcctttaatccctaatttctctaaatcctggatgattttagtgtttttcattttacttatattttctatttctttattgctttcaacaaaaataatattaattatttgttaaaggtggtttaaatatactgatataagtcagaatggcaaacaaaaaaacggctttgtaaattcctgattattaaccgattatttcagaccattcaaaaacaccaggaaaacctttctcccaaaaatagttcttatagtccccaaatttggcactcatcacgaaatctccgccccatgcgcctaaacttttgacaaatgaagggcaatctgagaacaatctctccttaactgtgagaatttcaagaaaatccgctatttttcgctcatgaatcatcattaattcagaaaaagcttccaattcattgcataacattattttctttgtgatttccgaaaattcgtttaccagttccggagacttcttttttgatttgtaaaaactgattccttccctgctgtcctgtttctgatttaagtggataaaaatgagttcatttttaaaagaaggattaaagtttaccttttcatatttaatttcaggtttactttggaaaagaactgcagatttttcttttgcaaccgcaatatcatatccacttcctcccagacttatcgtattcagataaaaaggatcaatctctgcccattccgcaagattggtcatcagggtagaactgcttcccaaaccatagtctgcaggaaactgaaggttggtttttaaatggtaagtaaggttagttttgaatttagtatgggaaagctgctgaacattcttcaatgttttcgtaataaagtcagcgcttgatggaatattggtttccagaatctgccatgtttgataatcaatgacagcttttaaccataatgtattctgatgataagcttcccaaagaataagagatctcccatcttctttttcttcaaagaaaaactcttgtcccagcctggtaggtaccgctaagacaagagctccatcaattgcgaaatattctgaagtaagcataagcttgcccggtgaaaatatcgcgttcatatatttttattagattgcagaagtagcttctactgacccatcaattttcttgattaatccctgaagggttttccctggccctacttctacgaagttagatgcaccgtctttaatcatattctgaacagattgtgtccattttacaggaccggtaagctgatcaatcaggttttgcttgatctcatcaggatttgttacggctgtagtagtgatattctgatatacaggaattgttgcttttctgaatttggttttttcgatcgctgccgcaagtctctcctgtgcaggctgcatcaaaggtgaatggaaagctccgtttaccggtaacagcaaagctctttttgctcctgcttctttcaactttacacaagcttcttctactgccggtgtttctcctgaaattaccaattgtcccggacagttataatttgcaggaacaacaataccgctgatctgcgcgcagatttcttcaacttttgcatcgtctaatcctaagattgccgccatagaacttggatttgcatcgcaagcctcctgcatagcttttgctctttcggaaactaatttcaaaccatcatcaaaggataaaactccgttggcaaccaaagctgaaaactctcctaaagagtgtcctgctaccatttcagcaccaaggccatttacggcttttaatgctgctactgaatgtataaatattgaaggctgggtaacctctgttttcttaagatccgcatctgttccgttaaacataatggaaagaatatcgaaacctaaaatttcattggcagattccatcagatctttaatatcttttctagaatcatacaattcttttcccattcctacgaactgagaaccctgccctggaaatacaagtgctttcatgtattgaattaaatattatgcaaatataactataatgttaacaatattcgttttaagtgctatgaatcatttatggtactaacctgattactctgtaacctgtatttacataagcaccgttagctttggattttacaaactcaaatttggtagcaagctgagtctgaactttattcatctgtttaaagatttctccttttttattttctctggttaacatgtcatttaccacatcaaaacctacgatagcatattttggcggagttttacagtatttgctcttataggcagccagaatttctttttcaaagctaccatctgtattgatttttctatccatcagataaaccagatttgcctggcttaattcatccacttttttctcaaaaaccggagcgtagaacatactgaaagccttcactccctgaacttctttagaaatagcaatgattctgttggcaaaagcatcccctactgcattatcatcatttgccagaatagcaataaccggagcagactgtcctgtcatcatattctggtccagctgaatatctgccggagaattaacaataatgatatttggatttttcaccgctttttcaagtcctgccttgatataattggcattgtctttcttggcatctgccaccacatatattttctgatctgaatagattccttttacctcttctacaattttatcagcatacgtctgattattggtttctacgataataaggttactgtagttatagagttccggagtgttggcaaatggtgctactaccgggattttctgattttttgtaaaatcaaggacgtcaattacgtttgatttaaagaagggtccgataataagatccgtattatcgggattgatctgcgttagagaatttttaaatgaagcttcatttcctgagtctaccactttaatatccagcttttgtcctcctcttgcatttctttcaatggcaagtttggctcctgttaaaaagtctagtgccattcctctgtactgagtttcgttggtactgtatccgaaaggaagcattaagatgacacttaaggcatcaccatttttctttacgtatgccgcatcttgttttttgattttcaaaaccattccggttttcaaaccatgtgaaagatccgggttcagagcaataagttcatctatagacactccaaatttgttaacaatagagaaaacagtgtctccctgctgcacggtataggtaacgtaatcatctcccgctacaacattggaagaggttgttgatttttcgtttccggaatccatttttgcttttggattggcaggttcagcagcggcgtcagtacttgtattgttagtattggatgtttttactttaattgtatcaccaggcttaagtcctttttcttccaatccgggatttaaagcgaaaagatcctgctggctgataccaaactgttttgtgattctgtaataattatctttagcctggatcacataagattctccttctgctgcaactggagtcgtagttgttacaactttttctacagctttctccacaggcttttcagtggctacagcctgttgttgttcaccaccatatttcttaatactagaaagaggtaaggtaatttcatcaccgattttcatatgagaatccagttcaggattcaattttctaagatcagtttcagaaattctgtattgctttgtaattccatagatggtttgctttggaagtaaaacaattttacctaaagcagaagcacttgtgtttgaagttactttttctgccggagctgattttgtcacaaccggagaggctgctttgtctgattttatggttaaaacatctccgatcgccagtttgccatctttatgttttgggtttagcttcagcaattcatctacagtcattccatacttttttgcaatgttgtaaggattgtcaccttgcacaaccgtatgtgatttctgggctgaaactcccaaaaccatacataaactggatagaataaaaaacctctttatcatattcgataattataatttacaaaaatacttctttaaaattaaatggcaacaattattaatttggaatcttgaaccaccatttcttccaaacaattttcaagccatgaatagccataatctgaaaagaatacgctaaagttatacaccctttcctgccatgttttagccgggtgaacatctaaaaacagattttcaagtctttccagcaattcattctgttttattttctcggcatgaagcaagcgttttttcattcttttaaatgatttcaactgtcgtacttcttctgctttcaccatatttccgaaagatttctcagtagtttctgccgcagccttcaatgctgaaaaattactagccagcaattcttctttttcttccagtaattgtaaaatgggactatcttttaaaatcttctgattagtcaaaaccgtaaaattgtgaaagaaatcttctattttcagatcaagtttctcaattttccccagagttttttctttcaggaagagcatagagtttcttggaatcaggatcggaaagggagtgttgatttttgagaagtaatctttcaactccagccaatacataatttcggcatttcctccgatataagccagattaggaagtacattttcctgatataccggccgcatcaaagcattcggactaaatttttcaggatgattttccaactccgtcagaatttcttcttctgtaaagtgaattcctttatctacaatgatatatttttgtccgtcaaattcaattctgtctctggtttcagaaaggtaaaaaaggtttatttcacggggatttacctgaaccttaccatatttttctgtaagaaaattcactttagcttcagaagctttatgtaaactgaaatgaagaagctcatctttaaaaatctccttcatctgatttttaagttccacggaatctccatccagaatcaaaagcccaaattctgaaaaaagacgattgacaaggattttaatagcttccgtcaacgtgtttccctgtttgtaagcttccttcatcatcaggataagttccgtaccgaaaatagaatctttgaattctttttcaaattcagaaataaaataggtatcactgatttcaattcgtcctaccgggcctcccgatttttcattggtttcgtaataattattttcggttttaaaatgattaatctctgcaaaatcatgatcttccgaagccatccagtacaccggaacaaaattaaaatccggaaaattttctttcagataagtacatgacttaatggtctgaagaattttatatacaaagaaaacaggccctgaaaacaggttcagctgatgccctgtcgtaatggtaaatgtgttaggcaatttaagattctcaaggttttctttctgccttgcagaaagagaaagacttgttaactggctttcgaatacttcagctaaaatatttctcttctctgatgcgaaagaatcttttttcaggtgaatctgctgtctgaaatgctctaaggaaaatgtattattttcaaaaccctcgattttctgatttaaaaaatcttttactaattgaggaatgctttctatatcgttaaatgatattttattaattgttttcaacctgtacagtttttagttgaacaaataccacacaatcccgatgttcaatctgaaatcatataccggataatgtggaaatgcgtatgctttgttattggaaataacagtcccgatctgctgaccttctatgaaaaagaacatttttttcactttcatattaatataaatatcggcaataggctgtcctccaattgaaaatgaatctgctcttggaagaatatattcgttaagaatagggaaatattctcttgaagcaaatttagagaagtaatatactttaacaccagcctgaatttctgctgcttttttaaacgcttgtgtctggtagaagaaattagctctaccaacaaaactcggtaacggaagtagttctttgttagttaaagtattctggaagtgtaatcttgtattcaaatggaatttattgaaactgaacgtggcatctcctccaatctgagaaatatttacagaattatcactttgcttcggacttccgttgctgtcaaagtaagtatagttatcgatcctgaagtagttggcaaaaatttcagttttaaaccatttcaagttgatacttcctcccacttccatgacagattggttcttcgcattttcaagataatagttgaaattgttataaacggaagtatttaataagtaattaaatgatggatatgcactttggaaattcaccttagcattaacaaaataatctttaacaggttcaaatttcagattgttggttgttttcagatagcttttaaactggcttccgtttgagaattccaggaatgaattcaattgaattttgtcccaaagttttacctgcagatttcctacagcaccaattctgttttctttaagttcattcggaaaaggaaatccattattaatagacgcaatatctgttaccccaaacttaatgatctgataacgcacacctgcatccagtttgaatttttcattattaaagatcaggcttaccgtattactgaaattttcagaatatttttttgttgtcagcggaaagccattcaccaaatctgtaggagcactataccaatatgcttcaggagttgtctggttgtaataatatttatttccctgatgagaaatagtatgtctgatactgaaaggaaatttttcagcattgaatggagtaaactggtgactaagatagtatcttctgtaagaaaactgagagctggaagaggctaaacttacctgagcattttgtctgttactataattgctgtcaccactctgaaacagattatcttcagtaatacctccactttcctgattgtttacattctggtgaagatagtgggcaaaaagctcataattcccgctttttgaaacatagtgtccggagaataaagtattgttattcgctgctaatgaatttctgtaaagtccctgagaacgaagccccatatattcaagagcaaaattgaacctctttcctatattttgggtataggtagatttcagagctgcaccgttacgcattgcattatgataaataaatgatgcggtaggtgtttttacgtcataatacttcacatcgttggctccaatgatcatataagatttattggaaggcagtaaggaaagattttgctcgtcgttcacttcaaaaacaagaggattgaaccccgaaccaatgttggcaggctgtactctcccaaagttatctttattattttgctgtgaaaaaatgtatgttttatcaaaagtcattacggtatcaaaaactttcttttcagaaaactgagtctgatactgataatcattaatcgtaggcttgaaaattttcagagaatcttttttcccggagtctatcaccagcgtgtcttcttttttgggttgcggcttcacatcggctttatttacgacctgagccctagctacaaaacttaaagagaagagtatgaaaaggatgtacttcattattcattattgtacagcaaaaataagaaataaaaggacataaaaaaccccacaaaaatgtggggttaatttatataagtatatataatttacttattgacctgtaaatgtttcgtcatagtctccgtaacttcctagtgaagcaccagtagtaggatttttaacaaaataattaacacgaagcttcaatattctcgtacatgcattgaagcttgatttacttccatcagcagcatctttcatatagtttatacctccattagctgcagaacctaaactctgttcaggagtagtcacaacatatgtatcaggattatatttcaaagtaagatcactaccatcatccataaatccgatcactttaaatgtacctacaccatttacaacacctaagtcctggatagtatagtttacaccagcagtcccccaagaagctaaagtattcttgaatactccatttccaacgaatgatgatgatggacaggctttagtatatgtaagagtataaacctgatcaaatgaagcattagcaatggatgaagattgcaacttaaatacaattaccttagggtctacagtagcccctgcttccaaaagtttcacttggaattgcccatctattttacctgcatccacagtctgattttggttaacgatctgaaaatcagcaccctccactgctgttgaaagacttgtatctacaacaagctttacttgcgctgatccagaaagtgcgtgagctgtaccaaagctaattcctacagtagtaggtcctgatcccatctttacaacagcttcacttcttgttcctttattaaagtgtaaataagattcgccatcataaacctgagcttcatctttacaactgttgataaagaacacaacaaatgctaatattaaaaatgcaatttttttcataaattctaaattattatattaatacccagggttttgttgaatatttgggttcgcattaatttcatccaatggaatcggtaatgtaaacctataatcactagcaggtagtgtaagaggtaatgtcttgttatcatcatcataaacatctctatccactcctactccagcagctacacccattctttttaaatctaagtaacggtgtccttctaaacacaattctcttcttctttctaaaagaatatcagcatatgcttgctgcgcccccgtatagacaggtaaaggagatgctccgtttttagatctagcttttctaactttattgatattatctgccgcagtaacccaatctccttgatttgccgctacctcagctaaaataaaatacatctcagataatctgaacattttaatatcatttcgaatctgcattaaagaacttgcaagggtaccagatttccctggatatttgttaataacgattacatcatcctctctcgcattagctccgttaggataaaacgcatcaaatatacttgtagcatctacataaacatcacgtcggatatctcctgctcctgaattagataattggttattgatagtagaaaataattttcttcccatatcataatttactgagccattaagatctgtagagttagtagtccataatcctgcgatattggaccaagaaccagtagaactatttggtctgtatagagaccaaagaatttcacctcttgcagtatctgcccacatagcagaatatgatgaactaggtgttaaagctaaaccacttgtattgattgctgcttcagcattaagttttgcattaacattatctcctttatagttataatatcttgcagcgattgcgttaattgaagcttttttatcaaagtaatgctgtgcagaaacccctgtagaaacaacacttgagttaaaatttgtaagtgcatattgtaaatccgactcaatcaaagcaaaaacttcagagttcttaactcttggtaatttagtattaaaaatgtctgctggtttagtacttagcattactcccagcgcattcggatctttcatattcgtagagaaataagactctaaagtaatataagcatatgctcttactgctcttgcgtttaccaaaatacctgtatataaagctttattggctggtgatagtgaattataatcaatcagagcacttccctcaagaagaatatttactttgttgataatattataattgctcacccagattccagaaacctgacttgttgtagaattaagaacaaatctatgcgttaagatatctgaagtgcttacactactcggtccaaatccaacttcatctgtaaaaagagacgtaaaaaagatctcatttgttgggtttacagccggataaacacttccgttaagaaacttctgcatgtcatccactgactgaaaagcaacattcgcatcattaatctctccatcctggacaatttccagtgcgtcattacacgaagtcagcactaagaaaaacgataatatatataatacttttttcattttaataatttttttagaaatcaattttcacccctactgtatacattcttgggttaggatatacacttaaattagatcctgtaattggttcagggtcgaaacctctccattttgtccatgtataaaggttctccccttgtacatatattctaagcccagttattggcaggttctgtaactgctcttttcttagctggtatcctatggttacggatcttatttttaagaaagaagcatctttgataaaataatcagaatctgcagtatacccccagttggtagctcttaagcttggagtgtcagaatttgaattctgaggagtccatgcattaagtaagtctgttgacatatttgacgatcctacagcactagatcctaatccttcaggattggctaaccaataaagtgcattatcaaatttcttaactccttgttggaatgtaaataatccatcaaagaaaaatcctttataatttgtttcgaaaccaaaacttcctgcatatttaggaataggactcacgtcaaggaattgtgcatcttcgacttttggagcttcagtaactcccccgtctttggtgtagaacaataagttaccattacttttattaactccagcatatttataaacataccactcacttagagtatgaccagccatattaactgttgaacctggttcaggatctccgaaaattgtatactcattaactttgttattgttataagaaccgttagcaaatacacttaaagtaagatcactcgtttttataacattataacgtaacccaagttcaatacctttatttgtcatagccccgttgttacctgcaatagtataggaaccagacacacctgaaactggtattgtactgaatagattggtcgttttcttctgatacacatcaagagtaccttctaatttattattaagcagtgtgaaatctagaccaatgtttgcttgagctacatcctcccattgtactaatggatttccataagcaaacccaaatccaatagcattaccatatccgataggggaagtatataaatctcttacaacctggctagccgttaataatgggtttgaaccaggagtagcagcaacaatattttgattaccattcgtaccataagatgctcttaacttaagagtactgaatgtagatccttccatgaagctctccttatcaatattccatctacctgctactgaccaataagtcgcccatctgttttctccaacaaatcgataggatgcatctcttcttaatgtaccactgaaaccaaatcttccagcataatcatagttaacagttccaaaaacagctacagttcctgctgtaactcttgaagcacttactgaagggatgtaaggtgatgttgctgagttatcaaacggaatatatcctgtacctgaaccaggcacataagttcttggatctaatccattttgtcttcttgtcgtagatctgtaatacactttattgtattccatgtttacggaagcatctacagaatgttcatctagtttcccgctatatagcgcagaaataacgttattaatagttaaatctcttgttgttgattgatcttcaaaacctgtgtatttatttgcgccttgtgttgctaaagccaaatatgcccaaggagctctacccgagattctatcactttgtctataatcaatacctaatttattactaagagtaaaattcttattaatattataagacgctcctaagtttgcaccgattgatacctgatctacaaagttcggaagatttcctcttgttaataaattttgtagtacgtatatattattaccattattgaaattcgtcttaatatcattaaataatgcctgtccatttgcatatttagtaggagacaaatatggtaacccttgaagaactcctaaaagtgggttttgtacagagttatttctgataccagtgtttgtttcttctaataattcgtttcttctggagaaagcaagagcaatctgcgagttaacgtttaacttgttatctttagatttagcctgaatgtttgatctaactgtaaatctcttgaaatctgtagttggcacagcacccccttgctccatgtaaccaaatgagttataagaagatacattcgccccacctgtagaaagtgcaacatcgtgagactggaacatctccggcttaaagaaatagtttttccaatccgtattaattccttgtgctaaagcatctttagctttaatgtattctgagttagtatcagaaaaaccatacagtttcataatccccatatactgttcagtattagcaagattatatttatcaagtggtcttagagacatacccgtcatccctgtataggaaagcttaaatccactgttatatttacctctttttgttctgataactacaaccccgttagcaccacggttaccatatacagcagttgctgctgcatctttcaaaatggttgttgattcgatatcattaggattcaggtttctgtactctgaagcgttagatggaatatcatcaataacgattaaggcatctgtattaccattaatagaactcgtcccacgaatcaataagctaaacttagcagaacccgggctaccagaacctccgttcataatcacccctggagcagatccctgtaaagaagttaacatattgacatttggtctgttctcgaagaatacttccccaacagtattagaagctacagttgacttaggtttcgtaatactttttgagtatcctagcaaaaccacttcatcaattgatgtttctttttttaccgtgtcttttttcttagttgttgtctgctgctgcgcaattaccattcctccaaagaaaaacagcgccccagcactcaatacacgtaatttaacattcatattaacaaattttaatatatttaatggacaaatatgttaataaatattaacattcacaaattaaaccagtgtttaaacagtgtttttttttaatgttttatttataaatcacgtaaatagaatgaaattaaataataatagctgacttttatttaataaaaaacaatttttaagcaaaccattttaaatttaacaaattattgataatgtaaaaataattatttagattgattataaattacaagaggttggaaaataaaaaaaccactttataaaaaagtggttttcacatatttaggatatatttatttcagtttcttcttaaccgctacttcctcgtacacttcaagaatatctccgatttcgatgtcgttataacctttcaggttcagaccacattcatagccttttgtgacttctttaacatcatctttgaaacgcttcaagctttcaagttctccgtcaaatttcacaataccatctcttaataaacgaactttagactgtcttgttacttttcctgtaagcaccatacaacctgcaatggttccaactttagaaatcttgaatacctcacggatttcgacgttaccgatcacctgttcctgaatttcaggagaaagcattccttccattgcttcttttacctcatcaattgctttatagatgacagaatacgttctgatctcaatttcctcacgatccgcaagttcttttgcattagcacctgctcttacattgaatccaatgataatggcatctgatgctgctgctaagttgatatcagattcagtgatttggcctacacctgagtgaagaatcttaacactgatttcttctgttgataatctttgtaactgatcagaaagagcttccacagaaccatccacgtctcctttaaggataatattcaattctttgaattctcctaaggcaatacgtctacccaattcttcaagcgttgtatgcttcttggttctgattgacaattctctttgtaactgttctctcttattggcaatagctttaccttcactttcatcagcatatacacggaatttgtcacctgcagtaggcgctccgtctaaacctaaaatggttgcaggaattgatggacctgcttctttaagatttttccctctttcatcaagcaaagcttttactttaccatggtttttacctgctacaacatagtctccaactcttagagttccggactgtaccaacatagttgccacataacctcttcctttatctaaagacgcttcaataacaactccatttgctgaacggtcaggattagcttttaactcaagcatttcagcctgtaataaaactttctccaataatacatctacattattaccgaacttagccgaaatctcttgtgcctgaacatttccaccccactcttctacaagaaccggaggattcaaaccagaaagctgttgacggatgttgtcagggtttgcgttaggcttatcaaccttattgattgcaataatcattggaacctgtgcagcctgtgcgtgggcaatagcttcttttgtctgtggcattacatcgtcatcggctgcaattacaataattgcaatatccgtgatctgtgcccctcttgctctcatcgctgtaaaggcttcgtgaccaggagtatctaagaaagtaattctctgaccattctccagtttcacgttataagcaccaatgtgctgagtaattccaccggactcaccagcaattacgtttgtttttctaatgtaatctagcaatgaagtcttaccatggtcaacgtgtcccattacagtaactacaggagctcttgatacaaggctttcttctgtatccacttcatcttctgaatctgtatcttcaagatcagcatctgagaattcgattttatatccaaattcatctgctactaataataaggtatcagcctcaagtctttggttcatggtaaccattacccctaatgagaaacaagcagagattacttcggttggagaaacattcatcaaacttgccaattcacctactgtgataaattctgttactttaagagttctgtcttgtgcttcaagctcctgctgacgctcatcctgctctctacggaaggttcttttatcttttctgtgttttgcagatttagatttacctcctttattagtaagtttttctagtgtttccttgatctgattcttaacttgttcatcagtcagttcaaccggcataactctttgaccaggtctgttgttttgacctccttttttgaagccaccaccttgtccctgacggtttccaccaccctggttatttccaaaacggtttccaccctggccaccctgaccttgaggacggtttccttggccgccctgaccttgacggtttccaccttgtccaccgttattatgctgacggtttccttggccctgaccaccctggttgttatttcctgagttttggttattcccctgaccttgctgattattctggccaccaggtttttcaattctctttcttttcttttttgctccggcacctggttttggtgcaaactgagttaagtctatcttttctccaacgatcttaggaccatcaagtttctgataaactgtttcaattttctgtggttcctgagattcagactctgtctctacttttggagtttcttcttttttctcctctgcaatcactggttttggagtttcttttaccggttctgccggcttaacttcttcttttttctcctccatttttggtttgtcttttttcacaggtctgtttctagattctatttgagacaaatcaatcttatccaaaaccttaaattcctgtttttcaggcgctgctttaacttccggctgttcttctttcacgatttcttctttcttttcttcaaccggtgtcgcaacaggagccacaggagcttcttcaacttcaggcttcttagtttctaagtctattttacctaaaattctagtttctggtttatttgctttagctcttatcacttcaggggttttcttttcttcaatttccagtttttcttccggaactttagtgatcaccacctcatgggaagcctttctctgttcgccgtctttagcaaactcagcttccaatgcagaatatgccgcttcttccaattgagcgttaggattgctttcaacctcgaaaccccttgactgtaaaaattctactaatctggacatcgaaatgttgaattccttaaccgctttatttaatctaatttttggcatttatattatttactgttttttaatttttaaaattaaagtatttcctttttactgtttattaaaatttatttaaatcttaatcttcaaattcctctctcagaatacgtttaacctcttcgattgtttcttcttcaaggtctaccatatttaaaagactctcagtttctttatccaatactgattttgcagtcgtaagtcctactttcttaaactcatccaaaatccactgctcgatatcatcgttaaattctttcaattcaacatcatcatcctcgctggactctctgtatacatcaatctcatatcctgtcaaccaagaagccagtctgatattctgaccttgttttccgataactttagaaatttcctcaaccggagtatacaccaaagcgtagttggtctcctcattgatttcaattttgttaatggtaacgtttcctaatgctctcttcaccaagatctcagggtttttagaccactgaataacatcgatgttttcatttctcaactctcttacaacgccatgaattctggatccttttactccaacacaagctcctaccggatcaattctgtcgtcataagcatctactgcgatcttcgccttttcaccaggaattcttactacctttttcaagataatggtaccgtcctggatctcaggaatttccagctctaataacttctcaaggaatttaggtgcagttctggaaataataatctgcggtttagaacctttaaaatctactgtctcaacaatagctctgatattctcaccctttttaaagaaatcggatgggatctgattttctttcggtaaaataaattcatttccttcatcatccagcaaaattacgtgcttatgacggatgtggtggatttcccctacaactatttccccaattttatctctgaactgttcgtacagcattgcattattatgctcctgaagttttgtagccagaatctgcttcagggtaagaatatttcttctccctaactgagcaacaggaatttccattgtaaagtcttcccctacttcgaaggtagggtcaatctttttggcttcagaaatttcaatttccaggtcatcatcttcagacatttcgtcctctacaattgttttatttaaaaatatctgaaaatctcctttatccgggtttacaatcacgtcaaaatgatcatctgaatcaaatctctttcttaaaagagttttcagtgaatcttcaataattgccataagatcaatcttactgatccctttttcgtctttaaaatcaccaaaggattcaatcaacgctatattatccatctattcttttttctttttaaaatttaattactactaatgcttttttgatctcagagtaagaaatctctttttcctcctctacatctacttttccttttccgatatctttcggcttacggtaacgcaaaacaagtgtgatcttctcatcatctacttttgacaattccccttcaattttagaagaatcctccagcatcacctcaatctctcttccaatgtttttactgaactgtcttggtgtggacaatggttcactcagtccggcagacatcacctgaaggctgaagtcgtgctcttcacgatccatattgaattctattgcacggctcgcatcaaggcaatcctgcaaagaaactccgttatcaccatctaaaatcactgtaatatcatcccctgcagaaattttaagatcaataagaaacagatcttttctggtctcaaggaattcatttaataattcttcaattctttttctaaactccatatatttttatcttgatttacagtacgaaaaaaggctttcttccgaagccttcccattttttccgtaaatccattgcaaatataagctttttttctaaaaatgcaaaattatcttaagtatcaagcaaatagcgtaagattcatttaccataaattaaaagaatatgtcccgggatttttattacttttgtctttagaatttaaaaacatacattttgaatataacgattgtaggaacaggctacgtaggattagttacaggaactactctggcagagcttggcaattcagtatactgtgttgatattgatgaaaaaaaagtagaaggtatgaaaaacggcattgttcccatctatgagccgaatcttgaagaaatgtttttgagaaacattcagtctgaaagattatttttcacaaccaatcttaaagaagctttagacaaaagcgaagttatttatctggcattacctactcctccgggagaagatgggtctgcagatctgtcttacgtacttaaggtagctcaagatattggtgaattgatgactgaatataaagtcattgtcaataaaagtaccgtccctgtaggaactgctgaaagagtaagagaaacgatctcttccagaacagatattccttttgatgtggtatcaaatcctgaattcttaagagagggctttgctgttgaagactctatgaacccttcgagagtagttgtaggtgccagctcagaaaaagcaaaagacattatgtctaaaatctatcagccttttaccaataccgggattcccatcatctttatggatgaaaaatcatcggaactcaccaagtacgctgccaattcatttttggcggtaaaaattacctttatgaatgaaattgccaactactgtgaaaaagtaggagcagatgtggataaggtaagacttggaatgggtagtgacgacagaattggacacagatttctgtttccgggaatcggatatggcggaagctgttttcctaaagatgtaaaagcgcttataaaatcggggaaacaggaagattttaatttccagatcctggaagcgactgaaaaggtaaatacaaaccagaaagtaattttagtatctgaaattgaaaaatatttcggaggaaatattgaagggaagaaaattgccatgtggggacttgcctttaaagccaatacagatgacatcagagaagcttcatctttagataatattgctcttttattggaaaaaggcgcagaaattgtagcatatgacgctgttgcagaaagcaatgttcaaaaacttttaggtgataaaatacaatacgcaaaaggaatgtatgatgcactggagaatgtagacgcactgtttattgctacagaatggccggaattcaaaaatccgaattttgaacttatggctaaaaaaatgaaaaacaaagtcatttttgacggtagaaacatgtatccattggaaatccctgagcaaaacggatttcattataaaagtataggaagaaagaccatctcaaaataaatcaatgaaaaacattatcattacaggaggtgccggattcatcggctcccatgttgtaagagaatttgtaaaaaacaatccggacactacaatcatcaaccttgacgccctcacctacgccggaaatctggaaaacttaaaggacatagaaaatgaacctaattatgttttcgaaaaagcagatatcacaaaacctgaggagcttagaagtattttcgaaaaatacaagccggatgctgttgtgcatttagctgcagaaagtcatgttgacagaagtattactgacccgatggcatttatcaataccaatgtaaacggaacagcaaatcttctgaacctgtgtaaagagttctggacattaaatcccgatcacactcacggcagattcccggatgaaaaaagaacaaatcttttttatcatgtttcaacggatgaagtctatggaagcttaggtgaaacaggattctttctggaaacaacatcatatgatccccaatctccatattctgcttcaaaagctgcttccgaccatttggtaagagcttatggaaatacgtatggaatgccattcatcgtatccaactgctccaataactatggacctaatcatttcccggaaaaactgattccgctttgtatttcgaatatcatcaatgaaaaacctcttccaatttatggcgacggaaagtataccagagactggttatttgtaattgaccatgccaaagcaattcatcagatctttaaagatgcaaaaaccggagaaacgtataatattggcggctttaatgagtggcagaatattgatcttgtaaaagaactgatcaaacaaatggatgccaaactgggaagaccggaaggctattctgaaaaactgattacttttgtaaaagacagaccggggcatgataaacgttacgccattgatgcaacaaaattgaataaagatctgggatggaaaccatccgtgacttttgaagaaggactagggaaaacgattaactggtatcttgaaaataaggaatggctggagcatgtaacaagcggagattatcagaaatactacgagactcaatataattaatcatgaagctggtttttctattgctatttgtcatgtcttctctttttaatgctcaggcactccctccgcctccggcaatggcaaactcttcacagcaaaaactgattgatgagtttatagaagtttcccattataaggaatcattgattaattatgcaaaagattatctggaactgaaaatgtttgactacagtgtggatccgcccaaagaactgattacaaaggaacaggcaggatctattatcaacggttttaattttgatgagtttaaaatttcactatacagctcattctcttttattccggaaaaaaatttaaaagaacttatacaatttcacaaaggcataggaggaaaattatccaaagacaattcggtattcctcataactcccaccatagatttaaatattaaaaatcaaatggattatgccatagaaaacatacaaaaataaaagatgaaaggaataatattagccggaggatccggaacaagactttaccctctaacgattgcagtaagcaagcagctgatgcctgtttatgacaaacctatgatctattatccgctttccacattacttttggcgggaatcaaggatattctgatcatcactactccacatgaccaagaaggtttcattaaacttctgggcgatggttctcaaatcgggtgtaatatagaatacgttgtacagccaagccctgatggcttagcacaggcttttattttgggcgaccagtttatcggcagtgattctgctgcattagtgctgggtgataatattttttacggttctgaaatgggaactttgctgaaaaataaaaccaacccggacggaggtgttgtttttgcctatcacgtggctgatcctgaaagatatggtgttgtagaatttgacaaagatctgaaagcggtttctattgaagaaaagccattaaagcctaaatcaaattacgctgtacccggactttatttttatgataacaatgtagtcgaaattgccaaaaacattaaaccttctgcaagaggtgaactggaaattaccgatattaacaatgtttatttaaagaatggtaaacttgaggtagctgttcttaacagaggaaccgcatggctggatacaggaacttttgactctcttcatgatgcttcagaatttgtaagcgttattgaaaaaagacaaggatttaaaataggctgtatcgaagaaattgcattcagaaataaattcattaatgaagaaaaactgcttgaaacagctaccaaatatggtaaaagcggatacggtgaatatttgaaacagctggtaataaaataataaattcatctacaaaaatcaaaagctatttctataaaaatgttaatagcttttgattataatacaactattaatatattagttgtaattttcctgttgtatgtaaatactatttcataatacataaaatcaggataagattaattattataaatttgaaaaaaaatctactttgaaaaccgtagtatacacatctgataaaaaaacacatttcttccaagaactcaaatcaatttttcgagatataaaatcatctaattttctggcctatcaaatgacaaaaagagatatacaatctcaacacagacagtctttattaggtttcttttggatattagcccccgtaattataaattctttaatttggttatttttgaatggttctggagtcgtaaatgtaaatataccgggaggaataccttatcctgttttcgttattttaggcaccacaatctggaatatttttgcagaagcagtacaaagtcctataaactcggtaaactccggaaaagctatcatatctaaaatcaatttcccaaaagaagcattactgatgaaagggatatacactactctctttaatatgttaataaagatgattcctgctgttgctattttgatcatttatcaggttacgccatcagcgagtctgctcctttttccattttatattgtagccttaatcattttttcttttgcgataggattaattattactccactgggattgatttatacagatataagtaaagttctcattacaggtattcctttattaatgtatatgacgcctgttgtttatgctgtaccgagatcaggaatttttaaggttttattcaatttaaatcctttaacttatataattaacgatacccgaaatacactggtaggattggaaacgcagtcattaatgtttacaatgatattaacggctgttagctttattgttttattgataggcttggttatttttcgaaagtcaatgccaatagttattgaaaaaatcgcaggataatgggaaaagatagagaggtattagtttcggtacagaatgtatctaaaaaattcagcaaaaatctgaaaagttctctgaaatatggagcttcagatattatccgtagtacactgggattatcaataaataaagaattacgtcctcaggaattttgggctgtgcatgatgtaagctttgagctgagaagaggagaatgtattggcttgattggtcataatggtgcaggaaagtctactcttttaaaagttctgaacggattatacactcctgataaaggacaaattgtaatgaaaggaaaaataggtgccttgatagaattaggcgccggttttaatcctatccttacgggtagggaaaatatttataataatgcgtccattttaggatttacaaaaaaagaagttgaaaagaaattaaactctataatagatttttccgagatcagagaatttatagatactcctgtacaaaattattcctcagggatgaaagttcgtttgggatttgctgttgcagctcatcttgaaccggatatattaattattgacgaagtattagccgttggagatctgggctttattttaaagtgcttcagtaaaattgatgaattgcttcctcatactgcggttatctttgtttctcacagtatgccaatggtatcacgaatatgtaatgaaataattttaatggatcatggcaaagttgaatatcagggaaaagaaataggaaaaggcatacaactttattacagcaagttttcaaataatagcgaaaataaagtatatgataatggtatattagaattgatatccttacaaactgatctggtgaacaatgaaatacaccgccatcaggactttaatcttacttttgaattcaaaattaataaacctgttgatgaattacctactttatatcttgaatttaaagataaggagcaaaagccaattgccggaatttctgttcaggaatacaaagaaggtataaaccaatctgcaaaaatcgtttataaaacaactgtgaaaaatcctcttttcactttaggaaagtatattatggatgtaggactatataaccctaccacagaatccccttatcttcgaatcaataacattctggagtttacagtaagtggagaaaaagaacaatggataccgtttgagcttgatagcgaaaatatcataactttacactaaaatttattatgattcccgtaacacaaccctttcttccacctaaggaagaatatgaaaaatacatagatggcatctggaaaagaaactggcttaccaatatggggccattagccagtcagcttgaaatggagcttaaaaaccatttaaagcttaatcatctgctgtttgtaaccaacggaaccgttgccattcaaatggcaataaaagcattgggaatttcaggtgaagtaattactactccattttcttttattgcaaccaccagctcaattgtctgggaaggatgcacccctgtttttgttgatatcgatgctaaaagcttatgtatagatcctaaaaaaattgaagatgccatcacggaaaaaaccagtgcaattctcgcaacccatgtttatggaaatccgtgtgatgtagatgcaatagatgcaattgcaaaaaaatataatttaaaagtaatttatgatgcagctcacgcttttggagtggaagtgaacggaaaatccatttttgaatatggtgatatttcaacctgctcgctgcatgcaacaaaactttatcatagcgttgaaggaggcttattgataacaaaagatcctgaattattaaaaaaactggcttatatcagaaactttggaatttcaggctttgattcattctcggaattgggccttaatggtaaaaattcagaatttcatgccgcaatgggacttgttaatctaaaatacatttctcagatacatgaaaaaagaaaagcactcgcagaactctatgatgaaaaacttaaaaatttacacgctgtaaagcctctctggcattcaaaagctaacaataatcatgcttactatcctgttgttttggaaagtgaaaaattattactgaaattaaaaaatgagatggataaacaggaaatttttacaagaagatatttttatccaagtttagcttccgcattgccgtatttgccaaaactggaactttctgttactgaagatatagccaagcgagtgttatgtcttccgttctattatgatctcacttttgaagaggttgaatatattgcaagattaatgttaagaatacaaaataattagtatgaaagtagcgataatgcagccctattttttaccatatcttggctatataagtcttattaagcattctgatcttttcattctttttgatcctgttcaatttataaaacatggctggatagagagaaatagaatcttgaaacaaaatgaaggttggttatatgtacaggtacctttagtaaaaagtccccgggaaactcttataaaagattgttttattgataattcgcaaaactggaaaaacaaaattttatctcaactggagatttacaagaaaaaagctccttattattacaaaacgcttaaggtaatacatcaaatatttgatgaagattacaatgatattgtcagtctaaataaaaattcattagaaaaaatatgtgaatatttaggtttctacaaagatcttcctgtattttccaggatgaatcttgaaattgaaaaacctactgcacctgatgaatgggctttaaatatctgtaaaaaacttccggtaaatggtaatttacactatataaatcctattggtggaatggatttttttgatagagataaatataaagctaataatatagatatttcttttcaaaaaatggaacttcctcattatgatcaaaaaagagagtcctttgaaagtggcttatctataattgatcttatgatgtttaattctccggaggaaataaatgatatgttggaccagtttgaattaatttaatgagtacaaaatcaataggaggatattttgagctagaacttcccaatacagtaaataattgggataaggatttcattgagttaaattcagctagaaactgtttggagtatatcctattggcgagaaaaagcacaaaaatttaccttgcatattatacttgtgatgttcttttagaacccatcaaaaaacttaatattaactacgaattctatgatatagatttcaacctggaaccaatatttgattattctaaaataaaagattcggaaatatttttgtacactaattattttgggataaaagataagtttatcaatattctgtgcgaaagactttttgataaaataataatagataatgctcaggcgtttttctctttaccaataacaggcattgatactttttattctccaaggaaatttgtaggggtagctgatggaggttttctaagtagtaataaaagaattaatttggattttgaaaaagatgaaagttatgatagaatgagccatcttttgaaaagaattgatctgtctgctgaagaagcataccttgatttttgtacaaatgatcggtcattggaaaaccagcctataaaattaatgtccaatcttaccaaaaaaattctttctaccttaaattttgatgatataaaaaaaagaagaaaagaaaatttcgcatttctaaatgaaaaattaaaagaaaataatcttttaaaaattgatatttcagaagattcagtccctatggtttatccttttagaactaaaaataaagatctcaaaaggcaacttatcaataagaaaatttattgtgccacttattggcccaatgtttttgaatggtgtagtgaagaaaccaactcctacattttggcagaggaaattatagcacttcccatagatcagcgatactctattaatgatatgagaaaaattttagaaaatgtataatgttttaatcagacctcttcaaaaagaagatgcgcttatttcatatcagtggagaaacgatccggaagtttggaaatttacaggctcccgtcccgatatagaaattactgaagaaatagaatccgaatggattgtaaaagctcttcaagatgaaaaaagcaaaagatttgctattttatgtgacagcgaatatatcggaaatgttcaccttaataatattgaaaataatactgcagagtttcatattttcatcggtaataaagacttttggggaaaaggaatctctcaattagcaacataccagatactttattatgctaaagaagtattgaagctttctgaaatatacttatatgtaaagcctgaaaatattgcagctgtagaatcttataaaagaaataattttgtagttattgaagagaatctgggcaatgttaagatgtcattacagctatctcaacttaaaaaaactaccgttagcatatttgtaatggtatataaccatggtcaatatttaaaagattgccttgatagtttattagagcaaaaaacaaatttcaactatgatattgtagttggagaagattgctcaaaagataattccagagaaatactgctaaattatcaaaaattatatccagggaaatttaagcttttacttcatcctaataatataggagcagtagataaccaaaatattacttatgaaaactgttccggaaaatatattgcaatttgtgaaggtgacgattattggattgatgctttaaaacttcaaaaacagattgactttctagaaaaaaatccggaatacagtcttacttttcataaaatcaaggaaatcacaacaagagaagagagatattcttatgataatccaaatgaggaaaaaacatacactttagaagatttatcaaaagaaaattttatcgttactgtttcagttgtattcagaaaaaattttgaaaaacttccggaatggatgaagtattctcctatcggcgattaccctttacatttactgaacgcttcttttggtcttataaaatattttccagaggaaatggctatttaccgagttggaagcgggatatggagtacacaaaacatagttgatcagattgtaaataccatgttttctctgaaatttttattacaacattttaaaaataataaacccgtatatgataacttgaaaatacaatatggtaattttaaaacagctcttaaaaagccttttgaggaaaaaagagaattagaattaaaaataaaagattacaattatctcgaaagaaatattagcactaattatcttttaaaaatgctaaaaataaaaattttaaaaaagttgaaatttaatttctgaatctttacaaaatgagtgaaacaaaaaaaatattattaatatcccacgaagcatccttatcaggagctccaattcttgttttaagtgtcttgaaaaagcttagacaagaaaggaaaaactataaagttgatgttttattattaagaccaggtcagctttatgaagattttgccaaactttctgataataaaatcattgtcgccaactattacaaccaatctttatcgtttgtaaaccgaaatttcaaaaaaattcagaatgcttttttcccaaaaacagaaagcaaagaagaacaaattgaaaaaataacaggaagacttcttcagaataactatgatttggtttatgcaaacacagcggaaacgttaatctggacaatacctttttataaaaaaaacattcctaccgttgtagcaatccatgagcttacttttggtattgaaagcgcatattcaccagattttatcaaagaaaatatatcaaatgtttcaacaattattgcagggtctaatgctgtagccaataatcttattaatagatacaatgcagatcctaaaaaagtaaaagcgatccattcgtttgttgatgaaaagcttgagattcaaaaaaatcagattcaaataaagaaagaactaaacattgcggaatcggacattattatgggaatagcaagttctcaggaattaagaaagggaacggatttagtgccgcttcttgtcaaaaaaatcgcagataaaacagatattaattttaaattcattaatctgggaggttcttcaagcattggtccggtaaaatgttcaaaattggatgcagagaagttgggggttctggataaaattatatatgtagatcataacaagttcccgaatgattacataaatatattcgatatttttttactattatcgagagaagacccatttcctttggtaatgcttactgccgctaagcttaagaaacccattgttgcatttgaaaatagtggaggtgcggtagaatttcttgaaaatggcttcggagttttagccccataccttgatcttgatgtcatggcctcagaaatagtaaaacttttacaaaacaaggaattaagagaaaattatgggttgaagattcacaacagattggaaaaagaatattctgaaggcaagcttacatccgagattttccaaattattgatgatcttataaattaattaaatgatctccatcatcatctcatcataccttcctgactatttttctgcacttgaaaaaaacattgcagaaacaattggagtgtcttatgaaatcattaaaatagacaatcctggattgatgggaatttgtgaagcttataacaaaggtgcagaaaaaaccggttttgattatttgcttttcatccatgaagacattttattcaaaaatgaagattggggcaatacgctcataaatcatttaaaccagaaaaacacaggaataataggactggcaggatcatcttatgttccctctgctccatcaagctggactgttacagagaaatataattctgtcaatattttacagggaaataaagagaacacattgtattttcctatccaaacaacaaaggaaaacagaaataaagtctttgcagttgacggcgtttttatgggaattaaaaaagaaatatttaatcagtttaaattcaacgaaaatctgctgaaaggcttccacggctatgatcttgattttagtttgagagtttctaaaaaaaaccagaattatgtagttaacgatatcctgattcagcatttctctggcggtaatctggataaaaactggttagatgccaatatcaaagtaagggaaagtataggatcagattttcaaaaagaaatcgacactgaagctgaaaagaaaatatttataggctttttgcacaattttttcaaatattacccggttaataaaaaaaacatatttctcacattaaaattttatcccaaaaaacttaattttaatgagcatttggaaatagcaaaaaaatattatgcctacatacgatacgccggaagtatcaataaaaaacacaacacaaagaattaaaattatttaaaattgtttaaaaatgatcataggaaacggacttattgccaattcattaaaaaatatagactccgaggaaaatcttttttttgcctccggtgtttcaaattctctggaaacgagaagttcagagtttgaaagagaatttgctcttttggataagtgtattgagagtaatagtaatcacaaattaatttacttttctactctaagcattcatgatcaatcaaaacaaaacagcctttacgttttacataaaaaggaaattgaaaattacattaaaaataagtgcaacaactacctcattctcagaatcgggaacattgtaggtagcggaggaaatcctaataccttattcaattttcttaaaaatcagattaaaaattcaaaccagtttacagttcatacaaaggcaagaaggctattgctggatatagaagatatttctaagtttttagagtctcactgcctgcatcttcctaataaggttattaacttttctttcccctataattttgatttaaaagaaattattagcgccattgaaaaagaaacccttcaaaaagccttctattcagaagtaaatgaaggggacttttacaaagtagattttgatgaagaagttcacgccttcttctcaggtataagtcctgaaaattacctggaaatgttaacccgaaagtatatttaaaatggcggctattcatgtaatcattgttacttataatgccatgaagtgggcagaaagatgtttttcaagtttaagaacctcttcagttcctgtaaaatgtattgtaatagataatggatccacagacggcactcaggaatatatcaaaaagtattttcctgaagtagacttcactcaatctccacaaaatctaggttttggaaaagcgaataatacagggattgaaaaagcgtataaagaaggagcagattttttttacctgatgaatcaggatgcatggatttatccggacagctttcaaagactattggatgtttacaacgcatacccagacaaaaatcagctgggaattttaagtccgatacatatggatggcagcgaaaagaagctcgatatttttttcgaacgttatctggcaagaaatacgcctgataacagaatattttcagacagttttaacaatagtctgaaagattattatgaaatagactttgtaaatgctgctcattggttacttcccaaagctacgattgaagaaatcggtggttttaatccttacttctttcattattccgaagactatgaatatgtacaacgtatttcatttttcgggaaaaaaattatcgtatgtccgcctagcacagttgtacatgatggtaaacaggatttccataaaaccagccatatcaatgccctgagagtacaacgggaacaacgctatctgaatccggcgctcgcgtttgattccaaaatattgaacagagatttcattcctaaaataataaagcaggctctccaattgcagttttctgctgcttccgatactttgaaagaatatcaatatcagaaagccagatttaatgaaatcataaacgcaagaaacatcattaaaaataaaggtgctgcttttctcaatatgttgaagtaatcccactgatgaaatattaatccaaattgacacaaatgaacagagccagtcttattaacaacacaatacaaaagggaaatcttaaaaataatcctcaggaattaataaatttgagacctaaagacattctttcatcttttattaacagatttcattactaaatcaatgaagccagaaatatcggtcattatgctcacttacaaccacgctccttatttaaaggaggctattgaaggtgtgctttctcaaaaaacagactttccgtttgagttgattatttgtaatgacaattcaccggatgattctgacaggattatttcagaatttgcaacgcaatatccgaatatcatacggtattttaatcataagaccaatatcggttttgtggaaaatcaaagatttgcattcgctcaggctaaaggaaaatatttggcctactgtgaaggggatgattactggactgatccggaaaaactacagtttcagtatgatttccttgaaaacaattcagaatacgttatggtgactgccagaaatttactgtttcatcaggatgaaaataagatgaaagaagatggaaaagactccatgttcaacggacagaaatatattgattacacccaagacagcttttttgtacagcgccctacccaaactttcacttatctgatcagaaaagagtgtattgatgagaaatggattgatatttatcccaattacagagatctttactatttttaccatgcccttgaattcgggaaaggcagaagttttaataaagtagtgggagtctacaggcttcacagcggtggtgtatacagctcattagaaacagaaaaacaataccgcacttccattgatatttttaaaaatattaaaaggattaataatgacccgagagcagaccagcagatattaaaaaccttggatcagctcatcaataaatattattatgaaaaggaatttatttcacctttatggaacagaaagctttatgcagccatctttgaacgcttttccatttcaaaaaatataggaatagggataagccagctgttaaagattataaaatatactttcaccagataatcaacacctgtaatggctgatatgtatggtgaatatcatcccgctctttttcattatgaatgtggataatgaatatatcagccgtattcatttttcaaccatttcaacataatagatcaaatagtttgagggatcagctgatgtaaaccgatcatactttccttaatttatcgtaatttagccgtacaaaatgataaaattaatgatgaaaaataaaagcatatgtgcggaatagccggaattgtaagcaataacgcagcaaattatcaggaggaaatcaaaagaatgacagattctctgattcatcgcggaccggatgcttcagactttgagttctatgataatgctatattaggccaccgcagactttccattatagacttgtctgaaaacgggaagcagccgatgttctccaatacaaaaaaagaatgtattgtccttaacggagaaatctatggatatctggatctcaagaggcaatatgcggaatatccataccatggaggctccgatacggaagtgattcttgcaatgtatcagagaaaacagcagaacctcatccatgatcttccgggaatgtttgcttttgccatctgggatgaccgtgaacagcaattgttctgtgccagagaccgttttggtgaaaaaccgttctactacgccatcggaaataataatgaatttatttttgcttcagaaatcaaagcgattctggcgtccggattaattcatcctaaagtaaatcctgaagccatttccaactatcttcaatatggatacgtaagtacctatcaaagcatttacagcaatatatatactttaccacctgctcatcagctgatctggaaagatgggaagattactgtttcaaggtattacagcctgccgtcaaaagacagggtgatcagcctttccgatgctaaggaagaatttctgtaccttctgaaaaatgctgttaaaaaacagcttatagcagatgtacaggtcggaagttttctgagcggcggtttggattcttcgtctatagttgctctggtagatgagttcctgcctcatcagacaacaatcagtttcggatatgatcataaagacagcgagctcaaatatgccaaagagattgcagagaaatacaataccaatcatatagaagttcatgagcaaaaaaaggacttggctgaatcattactgcatgtttctcctttctttgacgaaccttttgctgatacttcttaccttccacattatgagatttgtaaaaatgcaagaaaaaatctgaccgtagccctttcaggtgatgttggagatgagctgtttggcggatatcatttttatacggtagaaaatatgatgaaaaatcatttcagttataaaaatttaatcgccaaattcggacttaacctttataaaaaagcaaagacggtttcgtttgtaacccaacagaatttaaagtatgactctattctggattttcatctgaattccgtcagaaatgtatttaataaatcggaacgtagtcttttggggtgttcaacggattatcagcagggatacagctttactccaaatcctgatttattaaatgatatcatgagggtagatctggaaaattatgttcctggaaatatgatggtcaaatcagacagaatggcgatggctaattcattagaagtaagaactccttttcttgatgtcgattttgcagaattctgtattcagcttcctgatcagctgaaaattaccggtgaaaatgataaaataattcttcgtgaatccatgaataattattggaccgatacaatcagaaaacgtcacaaacaaggtttcggacttagtgttaagaactggtttgatgaagaaaaccttataaaactctccaacgatcttctaaaagattcgtctcaaaaggtttttaactatattgattttgatatcacccaaaaatttttgaacaaggaccataagcactggaatttattgcagcttgctctttgggctcataataataaatcggttctctgatgcttgatatttctgtcattatccctgtatacaatgctgctgattttctagagaaatcagtacagtctgccctgcaatttgaagaagtgaaagaagttattttagttgaagataaatcttctgatcattccctggaagtttgtatagaattagctggtgaagatcaaagagttcaattgttccagcatcctgacaaaggaaaccatggtgctgctgcttcaagaaatctgggtattgaaaaagccacctcaagcttcattacattcctggatgctgatgattattacctacccaataggtttgatgcggagaaagaactttttaaagagccgcaggtagatggaatcttcaatgccataggggttgaatatctcaccgaaaaagggaaaaaggaatttcagtcgaaattcagtgacaatgcattgacaactgtaaattatccggcagaaggaaaagaagtattcagagggcttctcgggcttacaccgaaaactttcggtacatttttccatttgaatggattaaccgtcagaaaatctgctctagaacggaataatctgagatttaataatattctccacgtacaccaggactctgattttatcattaaactggcttaccattgccatctgaaatcaggtagtatagaccaggccgttgcgatgagaggaatacatgatgataacagaattaccaagattgtccgatactcgccacaatacaacaggagacaattccttttctggaattcattatacgagtggtccagatctgtgtccatggatacagatgccgcaagtcacctttatttacagaaaaaagcatttgaactttctgagaaaaaaggagtttccaaaatggtgaatctattggctgccattctaaaaaatccagatatcctgaaaacgcaataccgctttacgtacatccgctcatgaagcttaataacctacaaatattaagaggaatatcagcattactggtatgctgctttcactttgctgattatattaattttcaggatctgcggttgggtgaaattttattcagtaaaggaagtatcggtgtcaatattttttttgtaatcagtgggtttatcatcacttttactacctataaaaagaaatttacagcaaaccaatcttccgaattaactttgttttataaaagaaggataatcagaattattcctttgtattttatattaactttagcctggatggtgcttggtggaaattttatgtcttattttcatggcgagggagccaagagacttattcattcggtattttttcttccccaaaaggatacttttcccgttctgtatcttgggtggtcgcttaattacgaaatgtttttctaccttattttcggaatctctctcttatttaatacaaaaaaatattcttttattgttcttttctttatttgtacttatatcctgggaatcatttatccattcgaaggagcttatttgcagttggtaaccagttcacttaatctctattttgttatgggaatattattggctgtattttttaatagattcacagttaataaaagccgggccagctttatcagtatcataggagtatcgtttttcttactctatttattcgagtttttgaagatcacaaatccgctcatcaccttaatggtagtctcactattggtattttcttttctactttttgattttacctttcattataaaggaaaccgttttctgatatttctgggggatatttcttattctctctatctatcccatccttttgtagaaatattcttcagaaagttcaaagtagcaggatattttaatattccctattttatatttaaaatacttgtggtaattgcagtagctgcattcctatatcactttgtagaaaaaaagataacccattacttaaaaataaaattaaaagcttaaattcttgcaataagaaataacgcataaacacaatataattcccaattgaaaaaatgaaaatctcagtcatcattcccgtttataatgcagaaaaatatgtctcccaagcagtagaatctgcgcttcaatttgatgaagttcatgaggttatattagtagaggacaaatctcccgataacgctttggaggtctgtcagcaacttactgaaaaatacagcagagttcagctttaccagcaccccgacaaaggcaaccacggtgcaggccctaccagaaatcttgggatagaaaaatcaaccggtgattttattgctttcttagatgccgacgattattaccttccgaatagatttgatgctgaaagagaattatttaaaaatcctgaaatagaaggtgtttatggtgcattgggtgtacattattactcggaaaaggcaaaagaacagtattataaactttttcaggatcgtttaactacggtgtacaaaatttatgagcctaaggacgtatttccgggacaaattaatatgttgggaagctttggtttatttagtattgatgctttaacgatcagaaaagaatctatgctgcgcaagatgaatcctttatttaaaacaaatttaagattgcaccaggataccgaatttttattccgtttatcctattaccttgatctttatcctggtattttagacaaagcagttgcggtaagaggtgtacatgaagacaacaggattacaaaagtagattctaagaaaataaaaccttccactacaagagttttgctttggaaagaagtgaaagactggtcagaaaacgaagatacaattcccgctcatatgaaactccacattaagagaatgcatcgtagttttgaaattgccaatgctccctttttcaaaaaatggaatatgattctgaaatatcttgtcacagattatccaagcatccgctccggcctgtataatattaatttcaggaaatatctattctgatgtaattatctttttgttttggacagaatcgaatccgctatttgtgcggtaaatacttttccggattctttatacatatgattcccatctgtatattgatagtccttggctttggaagagaaatcgaagaaataaacgccatattttttggagacctctttcattttttcattaaaatcaggtgaataggactgttccagtgctaccattttttctgaagcaggaattcttacaagatagacagtccctttacttttaaggaatctgataatgtcttctaaggcattgaacctggcttgcgaaatattctggttctgagccaattgtttgtagaaatttattttctcaatttccctcttggctatagaatctttttgcatgtttaccgttacttccatccaaccatttttatgcagataagtatttgatcttcctgcttcctctctctccgtgtaaagcttaaaccagcttcgggtgtaatttctcaatagatattcataattcggggacagatcataaaaatgcatattctttagcggagaatgattttccggaaagtcctcttcttttttcacattcttatctaaggatagattccatgggtctacggttataatgaataatccgtttttggtttccgggtccagttttctttgtaacgccttataatagatttgtccgtacggagactgaacaacgttcaatgcaaaattatcaaaatctcttcctaatttttgatttaaaagctggggaagaactgcctgagcccctcttgaatctcccaaaataatattctgtggtttttttacggcgaaatgcatataattatcatctgtatttccatccgcaaaccatcccaaaaccccgaatacgattaggactccgacgatataaaaagatattttaaataaaaattttttcatgttaaaactgaaaataaataaattcattatttccgaaattggcataccgcagaataatatagatgataaccagatatagaattcttcttatccacggcctgaattggtcaatttccaacccatggttcttccctctgttgatccactcaatgacaaacatgacagcaaccagcgaaaagactttaaaaggaaacggttggggaattataaataaagccgggtcaatgatctttttaatatataaaacagcctgagtaacagactctgcgcggaagaaaatccatgcaaaacaagtaagaccaaaggtgagtaatattttaaaaaattctttaaaagagggcaaaagtctgtccattgcaactacttctaaattctgacgatttttatcggcaagcagcaatggcataaaatataaggcattcaaccctccccaaatgataaaggtccagttagctccatgccagaatccggaaacaagaaagataatgaatgtatttctcaccttcatcatcagccctcctttacttcctcctaaaggaatataaagataatctctgaaccatgaagacaatgaaatatgccatcttctccaaaactcagcaatatcccttgagaaataaggaaaagcaaagttcttcagaagttctattccaaacagccttgaaacacccaatgcaatatctgaatatcctgaaaaatccccataaatctgaaaggcaaacaaaacagctcccattaagagattagcaggactttcagtttgataattggtaaaaatctcattaactaatggtgcacaattatctgcaattaccattttcttgaagaatccccataaaatctgtctcatcccatccgcagcctgctcataactgaatactcttttcttttgtatctgcggtaaaagatgggtagctctttcaataggtcccgcaacaagtaacgggaaatagcttacaaacagagcgtaatctatgaaattggtctctgctttgatcccttttttataaatatcgatcacgtaagaaagaccatggaaggtataaaaagagatcccgacaggaagcacaatattgagtaaccagacatttaccgtaaagccgaatccgcttaacagatcggcaaaactttcagcaaagaagttgtaatatttaaaaaagccaagaaagcctaaattgattacaatgcttagtgtcaaccagaatgtagcttcttttttcgttttgcttttttctatctgaagcccggacacaaaatccagtcctatagaaaacatcagcaaaaataaaaatctccagtcccagcaggcatagaaatagaagcttgctaccagtagcatcagattctgatgctggtattttttcctgaaaacaaaccaatataatataaatacaatcggcaggaaaattaaaaagccaatggaattaaataacatagatattcttcaatgcgttaatactaacttagattatcagcagtaaaaaaatatccggaaaagatgggaactattaattcattcatgtgtttatgtatttgtgtaattatagcaaaagtaaatattttcagcttatttttagttttttcaggtaatctcttaaaggcttttcaatccactgatagaacaaagcagatataatcagcaaaacagctatatatatccagaaaaccgtatcaatgtcaagcaacaaatgctgccatttcaaaatctcccttacgatatacaaaaccggaatatgcacaatatagattgcataacttatttctccaagatattccaaaggctttaaagagaaaagcctggtgagtactccattattataagagatcagaataattaatgggatgaaaagcactgccataaggccattatgaaaattaagcggaataaaaataagagccagcaatactgccataaataaaataatgacaggaacgtcatagttcttttgcttaaaattcttcacaaaatacattcccgccagatttcctattaaaaattcattaaggtgcatgagcggaaaataaaatccaaattcatggcttttcgtatgaggtccttcataccacaaagattttacataaaaattcgagaaaacctgtgtgatcagccatattaagattgtaatcacccaaatgctcttattcttttttgaataatatctgttgtataatagaggaaacagcaaatagaaaaggaattctacagaaatagaccatccgggaaaattcaggactaaagcttcgccagggatccagctttgaatgccaaacagatacaatatcactttatataaactgaagtcggaggacctggtaacaagatataacaaaagccctacaagatataaaggataaatcctggcgaatctgttccggtaaaaatccaggtaatcaatggaattctttttatgataggcaaccatcataatgaatcccgaaagaataaaaaagtagcttacgccaacattggcccggaggaaaatatctgacagataattgatctgatataaaaataagtctttattaaaatgcgaaatgacaatcgcaatagctgctacaaatctcgtaaaggtaatctgacttattttcactgatcattcaatgctgtataactttaaagtttatttgataaagacacctacatatttgccttcaaactctactacagttgtgttaatattatttttttcacaaaaatcctgataagcggaattatcaccaatatcatcactaatgaaaacccctccttttctcaaatgcttataaagctcatcataagcccatattcttccattataacttttatcagaatcataatgaagaacatcgaatacaggattttcagcgaagatttttggaagtgattctttatcggcaaaacgaaataatttccaattactttttagcttttcaggaactacatatcctacatattgatctccgtcctgtgccagataaggcatgtccgagctatacaaacgtcctcctctttttgcaagagataaaagagatgccagtgaagaccatccgtaagcgacccctgtttccactacatgctgtgcatttgtaaattcacaggcataataaataagctccaatgctccaggcccacccatttttacaggacattctttttctctttgttctgcaaaacttaaaatttcatggtattcaacgcgaaaaggtttaatatcaagtccaaaaagtctggacactgcctcttcttgtgaaatgcatctttctgcggcccaggaatttgttttttcctttcctttaaaggcattacctctattaactgtatttttaataatttttcggcctaattcgggataaagatcaggtcttttcaaatagccgataaaagttttgagaactcttgtaatttcacccattgtgttgtctttgataagaggcaaaaataaagatttttttttatttttataaaaaaaccttctacctgtccgaaacattataggttaagttacaattgaataaatcatttttaaacaattggtacaggtttttataatacctccaaaaagagaaatgaaaaaagtaatctatcatttctcttgtataaacaaaaacattgtaaggctggtatttttattggccatatccggatagataaaggagatattgtttttgatttctacaaaaacagattatatttgtaaagctcaaatgatcaaaaagataggatatgctctatgattttttcgaaaaaataagcagaatgaagcaattatttcttctgagaagacatccaaatgtttattttgaagaccttaaattaggtgttggtaatcgttttattctagataaagacttaaaaaaattaagtattggtcccgctgcagacttcagaaactataccagtattctgatcactaaaaacgctactttagaaataggcagccattttttcatgaataatttctgctctataaactgcctggaatatatatcaattggcaacaacaccttgtttggcgaaaacgttaaactttatgatcataaccatttatacgaaacctctcctactatgaaagtatatccctccttattttctaaagcacctataaaaatagggagcaattgctggctcggaagcaatgtaactgttttaaaaggagtcactattggtgataactgtatcattggtgccggatgtaccatttataaggacgttcctcccaatactcaggtgataaacaaacaggaccttttattcagagattttaaataatgaaattttcaatactcattgctcattataacaatgcagctttattcagggattgttatgactatttaattaaacaaacgtatcccaattgggaagctattattctggatgatgcttccacagaaaaagagaaaaaagagattctggatattattcacggagacgaaaggtttaaattttttgaaaatgaaaaaaattccggggtcggaattacaaaaagtaaacttattgagcttgctgcaggagaaatatgtggttttgtagatccggacgatgctattcttccgactgccattgaaactgcgattcgggtttatgaacaaaaaaaggatgttgttcttacctattccagattgatgatttgtgataaagaccttaagcctattaaacccttcaagtccccaaaacaggtcatcaacaatgatatgttttttttcaattttcctattcagattgcacattttgtaactttcagaaaaagtatttatgagcaaactgaaaaaataaatccggagcttaaaattgctgaagatcaggatctttaccttaagatgtacgaaaaaggtaatacttactttattaacgatgtcaattatctctatagaactcatgacaaaggtatttcacaaaatgataataaaggaaaatcttacgactatttcgcacaggtcatttttaaggccatgaaacgcagaaaccttaaaaaaatcaatggaaaaaaaatcccggagcaatactctgacagcaaagaaatctttgatcttctggaatatcaaactaaatttgtgtataggctaaagaaaaaaatcttcattactttacataaaattttctgataatgtctgcaaacaataaaataaaagttctttttagacatcgttctatggaaatgggcggggtagaaaaagtaatattaagtatacttaacaatcttaatcctgacaaatttgaaattacggtttgtcttaacctcaaccagggtgaacttcgggatgagtttccaaatcacgtaaagaaggtctttcttactgatggcaaagaagagttttctcagaatccattccttcataaactacagctattgcgaaggaggataaagctatcgagagcattaaaaaatcatgcaatttctgaccgtattttaggaaatcaaaaatttgatattgaaattgctcctacatacagtgcattttcatccgtaatcaattccagcaataaagcttcaaaaaaaataggatggttccattctgagatcaatattccaggcatgaaacctttaatcccggacattcttaaaaattttccaaagtttgatcacatgatttactgctcgcagaaaatcaaagacatcatgcatcagtgttacccggatcttaaatatcccgccgagagtgtaatcatcaatgcaattcctattgaagaaattaaaaagaaagcagaagagcaaatagaagatttcccggaaggaccagtattcgtttctgttgggcgtcttcatagcagaaaaggctaccacaaactaattgaggctcatacacgacttattagtgaagggtttcaccataatattataattataggaaatggtgaagaaatgaaaaacctgactgagcagatccaacgtaacaatgtaacgaaaagctttatcctggctggaaacaagatgaatccttatccttatattaaaaaggcagattattttattcttccttccgaatctgaagcatggccattggtcattgctgaagcattaatacttcagaagcctattattgccaccaatgttggggatgttggtttcatgattaaagacagggaaacgggatacctcattaattatgagatcgatgaaatgtattcggctatgaaaaaatttcttactgatcccgaccttgttctccatatcagggagaacctaaaaactattgaaagtcagtttgataataagaaaatatttgacagtgtggaaaacatcatagagacgttacacaaaaaataaattactgtgcggaatatcctccgtcaatcacaagattggaacccgtaacccatcttgaggcatcagacagcagaaaaatacaggcattcgctacatctttaggttcacctattcccagcggatgtttttttatgatctctgatgaagcttcttcaccaatatctccaaacattttttctaaaatcggagtgtttaccatagcagggcttacactgttgacacggatattacttcttgaaagctccatagccaacgaacgggctccggaaattaccgctcctttactcgcagaatatgcagcttttcctgcttctcccaccattcctgcaactgaagagataaatacaaaactggaggtttcgtctttatatttttttaaggataaaattttagcaatttcgagtcctgcaatgacatttatagcaaatatatcctgatacagctgaggattatgcttttttagcggtaatgttttttcgataccggcacagtgtataaatcctgatatcttacccaaagccgaaactttctctgctataattgcttcaagattttcagactgagtaatatcttcagtaatcgtttccactttcgtttcaggattcagcatggagacggttttcataagttcttcatgatttctacccacaaggatcaggtctgcaccgcttttgctgcattctacagaacagcttctcccgatgccggaagaagcgcctgtaatgagaataattttattttttaatgagaaagcatccattaatcttcaaaattttctttccctataacatccattaaatctgatacggtttcgatatctttaaagtgcttggtatcaattttcttgctgaaattttcatctacaaacgcaataacagaaagtaagctgatagaatcgtagctttccagagacttaagattcgtttcagtagttaatgtttcatcttcttctaattcctcttgtagtttttctaaaaaaacggatgttttcatattgtataattttaaatgtttgtttattaaatttccataatcgtagctccccatgaatatcctactccaaatcctgccattaaaactttatctccctctttcagcattcctttatccatcatatttttaagagcaataggaatggttgcagaaactgtattcccggttttttccatatcaatataaaacttttccgccggaattttcgttttctttctcaaataattcaacataaaagaattagcctgatgaaaaacaaaatggtcaatatcatccatggtcattccgttcacctccaacgtctcttttaccagcccgggaatattatcaatcgtgaaattaaaaatttcaggaccattcatataaatattttcagggctgaattcatgctcaggattcagtttaaaatcttttttgaaagctcctttcttcacaataagattttctgcaccgcttccgtctgttcccagacagaattgataatcattaccctcagacttttcgataatggcagaagcagaggcatctccgaatatgcttcggtttcctttatcgtcagggtgaatgtgcttggtatatgtttctgaagtaaccaaaagaatactctttgcaattcctgcagagatcaatccttttgcaaaagccagcccgtacacaaatcctgaacagcccaggttaaaatctatagctccgatattttttctaagccccaatctgtcctgcaaaagacaggccgttgtaggcagaaaatattcgggactctgggtacagaacaaaataaaatctactttgctcctgtcgtagttttcgaaaattttttctgaagattgtactgccatatccagtacggtttcattatcagaagagatgtgtcgctgggaaatgcctactttctcctggatacgttctgagctccattcggggaactgtttttcaagatcgtcgttagttaacacctgctgaggcagataatattctatttttgaaattttcatcatattaataaattctctttctttgcaaaagtaacgaaaacaaatttacacttgtgatgatttttatattcagaatcttgttaaaaatagacgctctctatcattcttttttgaacagagccagtcttgaagtggcaaaatacagagggatgaaggtaggtaaaaacttcaacatgcctgacaaagtgtatttcggaacagaaccttaccttatcgaaattggtgataatgtgaatattgccggagatgtaaggtttgtaaatcacgggggaaccactactcttctcagaaaacttccgggctatgaagatgcaagaatactgggaagaataaaaatcggaaataactgtaccataggacttaattgtgtaatcatgcaggatgtacagattggcaataactgtattctgggagctaattctgtactatcacagtctatgccggacaataccgtctttattggaaatccggcacagtttctctgcaccattgaagattatggagatattgttcttaaaaacaacccggaatatccccgtgaacttgagaaagacagaaaaaagctggatgcttatatcaaagaaaatcttccttacaagtataaaaaagcaagaaaaattaaataaattaatcttgtaaaatcataaaataaacaaatttgaaaaagaaaaaactcctcattcgtataggttcattacgtcatggtggtgctgagaaagtattaatcaattttttgaaaaatcttcctccagataaatatgaagtagaccttttagtaaatctctattcgggattatacataaaagaggtcccgtcatgggtaacgctgtactatttgacaaaaggagaaatgatcacaaccaacaggccgcaggatattccagtgaaagcttacagggtgctttatcagaaaatgtttctttggtttccttctcttctttataaatttgttttaaaaaataaaaaatacgatgtagaaattgctgctatccatgcaatgcatcaggagatcctctccagccctcaaaaagattcaaaaaagattatctgggtacagaatgacatttttaatctgaaaggatacactcctgagctgatcagacagttttttaagtttgacaaaattctggtgatttccaataagctgcaggaaggcatgtttgaactggcaaaaaatgaagctgaaaaagcatctgtaattaagattttcaacccgattgacaaaaacgatacattaagaaaggcagatattgaagttgatgattatcctttcaacaatgatcttcctacttttgtaacggtaggaaccgtatatccccagaaaggctacgacagattgcttaatgttcataaaaaacttattgatgaagggctgaaacatcaacttctgattattggagacgggtatgatttcaataatattcaggatcagctcaataagcttggacttcaggaaactgcaaaaatgcttggtttcagcagtaatccatatccatacatgaaaaaggcggatttttatattatgtcttcacggcatgaggggtttcctacaattattgctgaagctcttattcttaacaaacctatttcggcaacagacatttccggaattcgggatcttctgcaggatggaaaactgggaaatattaccccgaattctgaggaaggaatatatgaaggaatgaaaaagtttcttacggataaaaatatcactgaagaatacaaaaaacgaatctcagaaaccgagcttccttttgttctggaaaaatccgtggagcaccttcagaaaataattgacgaagtataaaaacattgacaatggctgattattcgattattcaaaaagacttttaccgggaaagcggaaaatggctttcaacatttcagatctggaaaaagtgcatcaatcccaatcttcattttgtctacattttgagaaaagctcagaaatatcagaaaacccctgttctgaatgttttctggagaattgtactcagacattatcagatcaaatatggttttcagatttatccggagacccagattggcgaaggtttctatttgggacatttcggaagtcttgtcatcaatccgaaaacagtgatcggtaaaaactgcaatattgctcatggagtcactattggccagcaaaaccgcggaaaaaatgaaggatctcctgttattggggatgaagtctggataggcaccaatgctgtagtcgtaggaggtattactattggcaataatgtactcattgttccgaattcttatgttaattttgatgtaccacaggattctatagtaatgggaaaccctggaaaaatctttccaaattcaaaagcgacacaggggtatatcaacaataagatatagatccgtcaacagcaaaagattttaatttcagatctacaacttttccagacaagcagaccggcatcttctttggtatccggagcgggtcaacaatgcggaagttcattaaaatcattaaggaacaatcattctcggtattgttatgattgtttagtgaaaatttagaatattttaattcacaagtctcagattttgatttatactttgtaattttatactgttttttaaacgtttggattaaacttatagatctcaatagttttaaaataaaagtatactggaatattgaatatgattttaagcatattttaatattaaactttgttaaaagtgattgattctttaacaaaaattatatttttgtatgattattgatttgatctattgattttgaaaataatttaaacgaaatgaataattataaaccttaaaatttaaattatggcacaatcgtacgaagttattttcgaaaacaacaaaaaatgggtagagtccaaattagctgaggatcctgacttctttcatgaacttgcaaaaactcagcatccggattatctgtatatcggatgttcggatagcagagccacagcagaagaactgatgggggcaaaaccaggtgaggtatttgtttacagaaacatcgccaatgtggtcaatactttagatatgagttccacagccgttattcagtatgctgtagaacatctgaaagtaaaacacattattgtttgcggacattacaactgcggtggtgtgaaagcagcaatgactcctcaggatctgggattactgaatccatggctgagaaccatccgtgatgtgtacagactgcaccaggcagagctggattctattgaagatgaaagcaagcgttatgacagacttgtagagcttaacgttcaggagcagtgcatcaatgtgatcaaaatggcctgtgtgcaggaaagatacattttagaagagtatcctattgtgcatggctgggtatttgaccttagaacaggtaaaattattgatctggagattgattttgagaaaatcctgaaagacatccaaaagatctacaatcttacaagttctgattgggtaatgagcagaaagactaaatagtttttctaaaaagaaggtaaaatgaaattctggagtattattgtattaacgttttttctgaattttacagcgctgccaggcattgctgcggttgcgggctgggatattgcaagaacgaatgtaataatcaacgaagaagaacctcattctcacccatcctcattcattgtttacgaaaagactattccgaaacctttagatgttttcgattatctgaagttttccgaacctgatactcagggcgtgtcttttgttctgattgatgattcttttcatctatcacctttacttactatattttctccccctccggaagcttaattcctatagttagatttttttgatactatttccatatcatttttgatatcggatacacacgtactttaaaaaattattttttcaacttttataacagacttatttaaagcagataagccggttataccttacagcttcacattatgaaaaagacatcattaataggaggaatcaaggagaattttccttcaggactcgtggtatttttagtagcacttccgttgtgtttaggaattgctttagcatcaggcgccccacccttatccggtattatttccggtatcgtaggcggtctggtagtaggaacaatcagtaattcaaatatttcagtatcaggtcccgcagcaggtctgacagctattgttttaacagcaataacagatcttggcgcatttgagcttttcctttgtgcggggattattgcaggacttattcaattggttttaggctttgtaagagccggaagtatttccaactatttcccgaataatgtcattgaaggaatgctggcagctataggaatcattattattttaaaacagattccgcatgcattgggatttgacaaagattatgaagggcacgaatccatttttgataacggcctgaatttcggatattttacagaattgtttggagcgattcatcccggcgcggttgttattactttaatttctgtagcgatccttatcgcttgggataaaatccacgttctgaaaaggatgaaaatgcttccaggagcattggttgccgtcattgtaagcatccttttgaaccaattatttaagatgtccggaagctcgctggctatcgaaacccagcatttggtctctttaccggtaccacagtcttttgacgactttaagaatctgattacgactcctgaccttaacggctttaccaatcctaaagtatggattgtaggagcaacgattgcgattgtagcttctattgaaaccttgctttgtattgaagcttcagatcgtctggacagacagagaaggattacggataccaatcttgagcttaaggcgcagggaatcggaaaccttgtaagttcattcatcggcgggcttccaatgacttctgttgttgtaagaagttctgccaatgccaatgcaggagctacctctaaaatgtccaccattattcatggtgtcttcttattgatctgtgtattgtctattcctgttgttttaaatttaattccgctagcaacattggctgcggtgttaattctggtaggatataaactggcaaagccggccacattcaaacatttctggcatttgggaaaattccagtttattccgtttgtagcaacggtggtagcggtagtggcaacagatcttttaaaaggggtgggaattggtctcgcaatctccattttctatatccttcagggaaatatgaagagagcgtattatttaagcagagaaaggctggatgatgcagacgggatcaatatcaagctggctgaagaagtatcatttttaaataaggcagctatcaaaaaaacacttaaaaacataaaacctaactctacagtaatcattgatgcaagaagcacttcctatattgcaaccgatgtactggaaatgattcaggactttgccaatatccgcgccaaggaacaggacatcaatgtagaactgataggctttaaaacttcatacagagattacgaaagaagtcaggattcccatattctggttacccacaaaagggctatgtaatctccattattaattaatttttttaactttaaattcgaaaacaataaaaatatgaaagcacatacacacgaaacccaatctactattacccctgagaaagcgttagagttcttaaaagaaggaaaccagagatttgtgaacaatcttaaagcaaacagagaccttcttgaacaggtgaatgcaacccgtgagggacagtggccttttgctgtagtattaagctgtatagacagccgtacctctgcagagcttatcttcgatcagggattaggagacatcttcagtatcagaattgccggtaactttgtgaatcaggacattctgggatctatggaatttgggtgtaatgttgcagggtccaaacttattgtcgtactaggacataccaagtgtggagctttgaaaggaggtcttgacgctgcgaaaattgaaggtatgggaatggacaacctgaaccaccttatcaatcacttcaatccaatcatcaatgaaattattgaagagaatgaagagcgttcatctagcaacagctctcttcttgaaaggcttaatcagcaaaatgtaagaagtgcgattgaagatatccgcaagcaaagttcaacacttaaaaatcttgaagctgaaggtaaaattaaaatcgttggcgccaattacgatgttgaaacaggtgctgtaacctggctataagaagcaaattcatttaattccaattataatttacagaaatgccatcggaatccgatggcatttattttttattacattatatatattataaaagtaaatatttaaacagaaagtgtgttgaactgacaaaatcaccgatatatttcatttcaaacagacagaattttatttttcaaaaaataattttaaattggcgtcctttaaataacttgaaaaccagattacatgatttttccaaaagcaaaaaaaatagccagagatcttgcctggcataaaacagacaatggagtattcgggctttacaaaggttacttttttaacgtttcagacgcaagcctgatgagcagccctcaatacaaatttgtaacagcaacaaccggcaatttgaccgaagggcaaaaacaacaaattgtaacagaattagttaaaaacaaaaagaaattaaaatttacaggtctcgaaatcagagataccactatcttttttcaatttgtggaaaatttaattcctactaagcttaagactgtttattctttacttgactttttatctgatcttttcaaaaagctaaacataccagagcaaaataaatgtcacagctgcggtacagatcaaaagatcagctattacaacttaggtgataatggtgtaatattttgtgacagttgcttccatcagacaaataataaattctatgaaattgaaaaagaaagaatttcaaaagaaaaaggttatctgacaggttttttaggaacacttattttttctatcccaggcattatactatgggttttgcttgccatatatgtaggaaaacttgcctctggaatggcctttatacttgctttttttgcttttatggggtacaaccttttaaaaggacgcgaaggtacattgaaaaaatatatcatttttctgacaaatattgtaagcatcattatcgcaaatgttattactgtacttgctttgttgctaaaacaaggctccactataaaacaggcaatatcagaattacagacaagtgaatccgtaaaagaagtattttatgcaaatatggtattttcttttgtactggcattaggtgcctggatctggatactatttattatgaaagatgataagttatcaataaaacctgctgaaaaattttaaagagcataaataaatgactgcctcacaataaggcagtcattcatttataaactattttgtaattgcagttttttcctttctgaaattattttccgttaaaggcagacatcgtattattcaatccggcaaaaacgaaagaaagagcggctttggaaaaggtttcaattctttcggtaagcttttcagcttcttcttcattccaggttcctaatacataatctacctgtcgaccggcagcaaagtctgcagagatcccgaagcgaagcctggcgtagttttgagtctgcaatacttcattgatatttttaagtccgttatgacccgcatcagatccttttcctttcaatcttaaagttccgaaaggaagggcaaggtcatcggtaacaatgagcacattctccaaaggaatgttttctttctgcatccagtactttacagcatttcccgaaagattcatataagtatcaggtttaaggataaaaacttttcttcctttatgttttccttctgccagccatccgaaattcgatgtattgaatgatacttcaagggtttctgctattttatctgctactttaaagcctatattatgtcgtgtattttcatattctgagcctttgttcccaagccctacgattaaatatttcatcagaaattttttgcaaaattaagggataaaaaataaaaaactcaatcttcgtaagattgagtttgaatattgttaaaaaaattctttattgtggtttgtagatgtaattaacgccatatccttttgtcatataagtctgaggatcataaacgtaatttgtactcttaacaatcggagtaggaattggtggcgtaagatctgtcaccgaccatctcttagggttgttcggggaaaggataagactttctttatcattgataatagtagataataatcttgaaattttatacacatgcggcaataatgtgaatgggctcacctgctcatcataagcataatattcgtagctgtattttcctgtaacagctccaaatgcacctcctgacattgttccgtagtatcttacaacttttgatacattatctcctacatagctataccctgttttggaataatctgtgaaagtaagaggagctcccggaacgtccggtccgtttctcataatgatagaatccagttttcctgtagaagcgctgtatttgatatcataagcagttttctcttttctcagcaaagtctgtggccccggagtcgttgcaggtggaacaggcggaggtcttctgaagattgaacggctttcagaaataagctgcaatctgttgttatttgcgtaagtgaataattgagtgtaagacacactgtctttatccagcttcccgtttccgtcaagatcaagaaaaccattgaaattgatctggctgattttatcaccactgtacataatatccgtaacggaagcactgtctgtgattacttttgtcacaagaagtccgctgtaacgatattctgcgatagtatctttatctgtaatttctctgtataatgctctggggccgcttaatcctcctgtatcgttaagatccaacaatggatttccatcctcatccaacatgtccttgcaggaatgaattgaggaaaaccctgcgatcagtaaaataaaatagaaaatttgtttcatttccttgtaattgattatttttttgacaaatataatttttttttgcctaaaaattgtattattatttatattatggtaagattaataactatatttctcctataaatttttataggtaaaagttaaattctggtttttttcaacggttacatacccctgattatcataagaataactttgggctgtatttacaggtgcagccggtgatggcagttctatgaacattgaagtagggttgttcggagatattttatagaactgggccggattgatcaaacttcgtgtgataaaatacactgacggaagtgttgaatacgggcttttctgagcatcatagttctggaagctgtacttactaatcacagctgtgctcatatccgggtttccattgatattcagtatacctttggaacaaaccacctgtataacattatcaccattgtatacaaaactatagtcaataaatctgttataggcactgattcctccttcttttctcttctcaagaattttggtaagcttattagtagttgcgctataagtaaatgcatagtcacttacaacagatacagacggggtggctcctgttgctgtagaagtagcattgtaaatctttttaccggtagcatcaggaacaatgttgaattcatacacaaggctggatgacgcagaacttacatatttaattttagtaatattcttatccgtataggttactgttccggtaaaataagcacttcccgaagcaaattcatctttagacacggcagtctgcaagtctccggttaccgctgtagtagtgtattcttcctgagtgacattattggagctgacttttgccaaaatctttttaggcggtggaccatcatcaggattcgggatggattctgtaggatccgaggtagtattacatgctgtcagcatcccaagaaaagcaataccggcaaacattttaaaaaaatagttttttaccatatagaatttttttagcttgtccaaatataattcaattttcgataatacactttactttatctgaacaaattcacaataaacagagttaataaacaaaaaaaatctaaaaacataacgtttttagatttccaaatattgtatcattatgaaaattaataaggctgcaatattgatgtcgtcaaaacagactgtgacatatcactgttgaggaaagtagcgtcaacagctcttcctatcccaagcactgttcctgcaatagctctttttatacaggctactttaacagaatactgattttgaggggtaagattggtaagggtagcattaagattaaaaatcttataagccccactgtctcccaggagcacatctgttctcaccgctctaagtgcatcatttacaaaaacaccacaggcaaagcttgcagaatttgtacctgttttctgaacagttgtctgaaatgaaaaagtagctttgtttgtaccgttggtaacagaaaatgtatctaccgtcccagggattacagtccagcctccagtcagaggatctccattactataagggttagtagagccactggcaccagaaaagcttattccggttttatccgaaacagtattgatggaaaacaaagacatacttccctgcccatcagcaattttaatagctttccagtcattagtacttaaatctgcattattgtgaaatatatcaccggctgtaccggcagaacctttcagtaaatcagtacctcctgttcttaattctttcccaacattaagatctccgttcacatccagcatattagtcggattaggagtattgatacccacctgggcatttgttgcagctgctaacaaaagagatgtaacaaataatatttttttcataacccttcttaatttataatattgttaaatacctccggaacttcatatacatctattttaagagaagactgggcaataaacttattgatattactatatacattggtgcctatgctcagcgtatttcctgaacctccataagaacctaatcttgtacatgcaacacttaccgtatggtttcctttggaaagattatctacaatcccgatctgggtatgggtaaggaaaggatatgaggtagtaatggcctttaggtttcgctgcctcaggttgaccagtttgtcatccacaaaaattccacaagcataatctattgaattatctgtacttcctgctcccccaaaatctgcctgtacaacagtttcaaactgaaaatatgccttactttgggtactgaatacactgattacttgtgaaagcccatttatttttttgaagttagtaagagtactatattgttttccctgtgtaaatgttcctcctctggaagccagacttactgaagagtcttccgaagaggtaaaggtaatccctacatcatccgagaaagaattgttataaatcaggtaaaatttattgggttcatattcaggaattcggagtgatttccacaccggcggaaaaccttccccctgagaaaccagcaactggtcattatttccatggaaaacggagttatcagtagaattaaaaaccccgattttatttctgaaattcacatctccgtttacatcaagtttggcttttggagactctgtttttattcctacctgagctgatattaaaagacccatggtaagaaacagcgtggataatagttttttcatcattagttgtttttatagctcacgtattcgataacatccattttcattgtagattccagcgtaaacgcactggaagcaccatttgaagactgcacattacgtcctatcgcaaattgtgaagatgaacttgaagtatcaatctttctgcatgcaatgtcaatattatgaacgcctacaggaacgttctgctcagtataattaagcgtaaagatataatcctgaagccctgcttttccgctgttattattggaagctattctatccggacgtacagccacaagtgctccgtttctgaaaacaccacaggcaaatcttacactctgtactgtagtagatgtggaagccttcatttcaataccagtctggaactgatacgtaagcctgttcttaccgtttttgatggtaaaagtattgctaagcccgttaattttcttccagtttcctttggtaatatccgtgatatcgtccccaactttgttggtgtagatcccatcacctgcaactccatcggtaagtgatataatacccgtttgatccgacgacagataagaatcaatcagcttatactgcccctcttccataaaggaaacattcaaagatttccacacaggaggtaagccctcaccctgagaaaccaaaacctggccgttcaatccagcatctccagcctgggttgaagtcccgcctactctaagttcttttcttaaggtggtttttccgttcacatcaagaacagacttcggtttagcagtaccgattcccacctgtgcgttggcatagaatgatagaagtccagccacgcagcaatatataatttttttcataataaggactgcaaaggtacacaatgaagtccaaaaaattccagttatatatcggtaaacctatagaaataaacacattacagaatagaattaatcacacataaaagtagaattatttctacataactccactttttatatttaaaaaatactacataaggtctcaaacccttactgtacggggatttacaaaacttctttactcattaaagagtgattttatagcctcaaaacaggccttaattctcttcatcaggaatattgcaagagaaaaacatgataacaatcacaaaaaaacgtataaaaatttaaagcttttatacgtttttcacaatttttataaagttgttcccaaagaacaaatcgtaaaatttaattatgctcaatgatggctttcaacagtagatttacctcatctacatttttaaccttttccttcctcatcatcagctgattgccttcttttcctgacttttctttcagctgagcttcagcagggtttctggtcagataattaataatatgcctgaatctgtctgtctgataaaacttgtcgtgaggatttcccggaaagtatcctaaaaagacaccgtttttcataacaattttttcaaaaccgatctctgccgcaagccatttcagggaaacactcttcaacagatttatcgcttctttaggcaatggcccgaaacggtcaatcagctccagctcaaactgatgaagatccgcctcattattgatctcggcaattttctgatataataacagcctttcttccgtattagatatatatgaatccggcagcatcaactctaaatccgtatcgatattgacatccttcacagatttgaaaagcttctgcctgtcttcttcattttcaaacaggttttcaaaatcagcatcatcttttaactcttccaatgcttcctgcattaatttctgatacgtttcaaatcccatttcattgataaaaccactctgctcagcccccagaagatcaccggcaccacggatttcaaggtctttcattgcaatctggaaaccacttccaagatcagaaaactgctctatcgcttccagacgtttcctcgcatcggaagtcatcatatcataaggaggagtaatcaggtagcagaaagcctttctgttgcttcgccctacccttcctctcatctggtgcaggtctgccataccgaatctctgcgcatcattgatgaaaatggtattggcattgggtacatctactccactttctacaatggtggtagatacaaggacgtcatatttaccttccataaaatccaggacatttttttcaagctgtttcccttccatctgtccgtgtcctgtaatcactcttgcatccggaaccaacctctggataagaccagcaatatctttaaggttttcaatcctgttattaataaaatacacctgtccatctctctgtagttcataagaaacagcatcacgaagggtttcttcattaaatccgatcagttgcgtctctacaggctgcctgtttggtggcggcgttttgatcacggataaatctcttgccgccattaatgaaaactgtaaggtcctcggaataggagttgccgtaagcgtaagagtatcaacattattctttaaagttttcagtttatcttttactgataccccgaatttgtgctcttcatcaataatcagcaacccaagatctttaaatttaacagaactgcttaccaattgatgggtgccaataataatgtctaccttcccattcttcagtgcttccaaagtctctgatttctgcttcgccgttctgaatctgttgacataagcaacatttaccggaaaatcttttagcctttctttaaagcttctgtaatgctggaaagccagaatagttgtaggcaccaacaccgctacctgcttgccatccgtagccgctttaaatgctgcccgtattgctacttccgtttttccgaaaccaacatccccacaaacaagcctgtccatcacggtatcagcctccatatctctttttacatcgatagtcgctttttcctgatccggcgtatcttcgtaaataaagctcgcttccagctcgttctgcagataagaatccggtgtatacgcaaaacctttggccgtttttctctgagcatataatttaataaggtcaaaagcaatctgcttaaccttcgctttcgttttctgctttaaggatttccaggttggagaaccaagcttgctcagtacaacctctcttccatctggtccgttgtacttcgaaattttatgtaaagagtgaatacttacatataataagtctccgtttttataggtcagtttaaaacattcctggattttcccgtcattgtttacttttaccaaacccataaattttccgatcccatgatcaatatgggcgatataatctccgattttcagagacatcagatccttcagagtaagctgttcagatttggcaaaagtatttttagctttgtacctctggtaacggtcaaagatctggtgatccgtataaaccatcactttatgtccgttatctacaaatccttcatgaagttcagatttaaaacttttaaaaggaagctcatgctcaagctcttcaaaaatagattccagcctttctttctgtttttctgttgaaaaggaaatccaggtatcgaatccattgctctgcttttcctcaatatcttcaatcaataactcaaagtttttatgaaaagatggttgtggaagctgatccatttttacttcagtaacttctttcaacccttcaatcaccactcctccaaaatcaactgttttgaattttttataatcgaataagaactcctggtcagaaataaaaagttcctgcggagttctgtgagcgatatctttactcagggtatcatacttttccagggacttttcatagaatgttctgattttctgcattcctaccatgccgtttttagaaacaacaaagctttcatgaggcaataattgcaacaaagacacccttgttcctgccactgaaaagttcatattggaaaccaattggaaatcctttactttatctacagaaagctgtgtttcaatatcaaaagttttgatgctttccacttcgttaccgaagaacgtaatcctatacggcttttcatgcgaataggaaaagacatccacaataccgccccttacagaaaattctcctggttcagaaacaaaatcagcctgctggaaatgataatgattaagcagttcatccacaaaatcaaaatccagctggtcacccactttaatatgatgggatattgctttaaaatcttcctttttcaaaaccttttcagataaggctccagcataagcaacaatcactttcggagatctcccggaattgattttatttaaaacctcagttcttaaaaccagattggcattctgtgttttttctacctggtaaggttcaaggtgggttgccggaaagtataacactttatccttacccaaaagatcctccatctccgtattggcatacaaagcatcctccttatcatctaccagataaacaatatttttcttctggaccaaaaagagttcagccacaaaaatagaaaccgaagatccggcacttccttttacggcaatatgctgattattttctagcttggtaaaaatttcttttccaaattctttctgtaaaaggtctggaaggaacttttcattgatggattttaactgcataaatagtaatggtataaacgacaaaagcgatttcgggagttttccgaaaccgtttatgatatacaaagatacggatattttttgtgttgctttgaaaaacagaaagactgatagtttaaaatgaatcacttacattcattactcttaattttttacaattttatttaataacctgttaaaaaaattcaagtattttctccgtggcacagtgtttggcttttaagtcaaaaccaaacattaagaatagtattatgaaaaaagcaattaaaatcttaggagttatgatgctgttggtatttacagcattgtctttctcgtcgtgcagcaaagatgacgaccctgttaacaatgaattttttgcaggaacctacaagggaagtgtctcttataatgacggaggctctaccaacatcagtacggacaacggaagtgtatttgtaacaaagatagcaagtggtaccaaatacaactttgctttctcaaacagcattccggacattaatggtgtagagtttaatcaggaaggagatcatacacttgtgatgattggttctactgcgacctcttacatcagaattgacaacaatactttaaaaatattatttgcaaaagacggcaaaacgtggacagccaactgtacacgctagatttgtctatttatatattatgcaagcctgtcttcatcttttgaaggcaggctttttaattgtaaatgaagtgttttaatctttttttaagctgtaataaactttagttaagtttgaaaatcctaattttctagcctgctttttgtatatctttattcaacaaaaacaaacaataattcttatgaaaaaattattatctgcaatgtcattgatccttggattaggacttgcaactgcccagcagactgctcccgctaaaagcacaacaacacatccacctgtaaaagcaactgctgtaaaggctgctgctaaaccggcagaagtaaaagctgccaaacctgcaatggatgcaaaagcagcaaaacctgcacaaccggctgccaaaatgaaaaaagacggtactccggacaagagatataaacaaaataaacacttgaaaaaagacggtactcctgataaaagatataaggagaacaaataagcataacatcaacatatagttgttattttcataatcaaatttcgaaaagccggtggaacctgttccatcggtttttttatgtgatgctttgtaaaaaatgattccagattctctacttatttataaatttgacccatgttaaacttcttcaagaaaaatgcagcactgatctgggcaaagaaacatgtccgaaaagcagaggatttcaaaaaaaatgctgaaagagaccaggagaacctgttactatctcttgtacatacagctcaaaaaacactttttgggcgtgagcatgattttgaaaacatccatagtgtaaaagagtttcaggatagagttccggtagccgattatgaagatctgaaaccttatattgaaagagtaaagaaaggacaggcaaatattctctggacagaaactcctgaatactttgccaaaacttcggggacaacttcaggttctaaatacattcctatttccaaagaaggaatgccatttcagattgccggagcacaaagtgctcttttccattacatcagcaaaaaaaataatgcagattttgtaaacggaaaaatgatttttcttcagggcagccctgaactggaggaagtattcggaataaaaacaggaagattatccggcattgtagcgcatcacatccccaattaccttcaaaaaaaccgtctgccaagctgggaaaccaatattatggaagactgggaagccaaggtagacaaaatcatagaggaaacggaacatgaaaatatgacgctgatctccggaattccgccatggctgatcatgtattttgagaagctgacggaaaaacatggtaaaaagatcaaacagcttttcccgaatcttcaactcattgttaccggaggagtcaattacgagccttatcgtgacaaaatggaagaacttttgggaggcaaagcagatatcattcagacctttccggcgtctgaaggcttctttgcttttcaggatgattatagcagagaaggactgctgctccttactaaccatggaattttctatgaatttatccccctggaggaatatggcaagcccgaagcaagaagattaacgttaaaagaaattgagctgcataaagattatgcattgatccttacgaccaattccggattatgggcttactccataggagatgttgtaaggtttatcagcaaagacccatacagaattctggtaagtggaagaaccaaacattttacttctgcttttggggaacacgtaattgcttttgaagtggaagaagcaatgaaagcaacccttgaaaaatatccggcacagattacagagtttcatcttgcacctcaggtaaatccaactgaaggacttccttatcatgaatggctgatagagtttgaaaaggaacctgagcatttggatgtattcagaaatgagcttgatcagcagctaagggcaagaaacacttactatgacgatctgatttcgggaaatattttacagaaactacagatcaccaggcttaaaaagaatgcttttcatgagtatgccaaatcccacggaaaattgggaggccaaaacaagactccaagattggctaatgacaggaagattgcagatctcttagaaatttacaaactttgatcatattttttcaattccagaaacgtatattcgaaaaaaattataaatttgaaaaactaaaagaaaataatgaaagcatctgtactgttgaaatcatccttactaacgtctttatttgttattacatcttgtgctacgacaaaatacagcgaagatatttcaaaaaacaattactctaatcttgaagccggaaaaatttacaaagtcaccatgagagatggttctccgaaacagaccattttattcagaaacgtcgttggtgaaaatcttgtaggcacagcgggtaaaaaagacagtacagaggtaattattcctaaagcaaatgtagcagctgtaaaagacagaagaaaggccagaattgctgcgggcgctactcttattggcgctgcaggtgttgctgcaattgtattgagttccacaagagccgactaaaatagattttatcttttgggatatatttactatatcttttaaaaatcaacatatgaatagtcctaaataaatttttagggctatttttgttcatgatttcctttaccccgttacaaacattacaaaatgttgagttcagaaatcttctcaccgggagattttttattgttttagccttcagaatgcttgccactttattgggatggtgggtatatcagttaacaaaagatcctttttcaatcggccttatcggtctttcagaagtaattcctgccgtaagctgtgcgctgtatgcaggacatgttattgatatgaatgagaaaaagaggctactcctcatttgtaattatgcgtatatttttcttatcggacttctgctgattcctgcgttttttaatgtagaaatgcattttaccggccatcagattacttattttatttatggagttatcttttttacagggattgcaagagcttttatcgggcctattgttccttccatgattcctaaaattgtaaagaaggaaaatcttcccaatgctgtaactctgaaccaggctatattccttatatcttctgtttgcgggcacgctattggaggtgtccttattggatttatcggagtaaaatggactcttgttgctattttatcattaatctttattgcttcattatttttctggcagcttcataaacagcattcagaatacaaaaaagaaacggtaaatgttgtggaaagtatgcgtgaaggaatttcttatatctttaaaaccaaagaaatcctgggagcgttatgccttgatatgtttgctgtactttttggtggtgcagtggctatgatccctgtatttgctacggatattttaaagtcaggagcggaaggcttcggattgctgaatgcagcctctgatattggttctatgtgtatcattactattttatctattgttccgcttcgaaaaaatcaaggaaaaatcctacttgctgttgttacgggattcgggctttgtatcattggatttggcctgtccaaaatatactggctgtcttttatgtttttggtaatgagcggaatgctggatgggatatcagtcgttatccgtggaaccattgtgcagcttaaaactcccgatcatataagaggccgtgttctgagtgtgaattcgattttcattatgtccagcaatgaaatgggacagtttgaaagcgggcttatggctaaactactgggggttgtacgctctgttgtattcggaggatgtatgactgtcctggttgcattggtggtaggaagcactaatcctaaactgagaaaaatgcaatattaatttattgtttatcaattgttttaaattcccgatatatcaaaaaccggaattcgaaatacttaaaatcagaatagaacgttttctattctgatttttattttatagctgttttttttaaattaataaaagaattaaatctcaaaaattcataaaaaccgctcatatctttacgatgtctacataatttaatctcaagaataaaataccacatttaaaaccaatacattactttcattaaatatatctcaaaatctttaatttaacgttaataattttttatatttgcctcataaactatccccctatgactaaacttttactaattatgagctttctcattgtaaattattgggcagaagcccaaactttctctgacaaagcgttaacacaagccgtcttgcagctcaacgcttccaaaacagccaatgattacgacaatcttttcaataaattttccggagcaaaaacgtcagaaacatggccgtctaattattacgcagccgttgctttataccttaagaacgaaacactgttaaagaaatcatccggagcaagtcttatggatgacaatgctttagcaagaaaaatagcaacaggagtatggactgcacaaagagacaatgctgagatcaacatattactaggcttactgtatgttcagaaaatgcagatagacaattctcaaagccaaccggaccagaatattatctctcaaagtatagcaaaagctgaagccaacgctgtcaataatccaagactaaccgttcttcaggcaaaaatcaaagaaaaatcaggtgataaatctaatgccgacattttataccgtaaagctttaaacgaattttccaacccaagctcttcagacagtaaatctccaacatggggaaagcagctaatacctttccaataatctgaagaccaaattaaaatgatcaacatgaaaaaatatctactcgtttttctattttttatagctcaggtggcttttgcgcagcaggactgtgctactgccataccgatatgcagcgatgctgctatttctcttactcctaatggttggggaaatgtaaaagaaggtcaggtgggctgtcttggtcctaacggagagagtaattccatatggcttactttcagcatagaaacagccggaacacttacttttttagtaactcctacgggtcctaatgctgtgggtattgactatgattttgccttgtacggtcccaatcataactgtgccaatacaacagctactccattgagatgttcttacgccagcgtcaatgcaaccattatcaaccctaccggtcttaatatgacctcagttgatacaactgaaaatggtggtggtgatggttttgtaaaatatatcgatgtccttccggggcaggtttaccatcttcttttaaataattattccacacaaattgctccatttaccttaacttttgggggaacagctaagcttcttacaccgtttgaccataattcagcgcacgtttatcaacctaatccgtttttacagcctggtcctacccaaaatggagagattccggtatgtggaaaaattgtgaactttgatttttcaacactttcctcacaaatcttaaatgctaaccctaattttatagtaaaatattatgcttctgcaacagatgcattagacgatacaaacgcaattactacacctacgaacattaatgtagcgaccacttatacttatgcaatcagctatgttgatccaaacagcccaaccagcttcttaaaccagtgtagagaatatgaacagataaaattccttgataaatcttttacgctgaaccccgcaacactgacttcttgcagcaacaacaattcagggacggcaatgtatgatctatctaccgcaactgtaggagctgctcccaatcatatattaaagtattatccttctatgtatgatcttaataacggaaccaatgagatcaccaatccttacatgtttgtttcggcagaaggttctgttttcgtaaaagcaatcaacgaatttggatgtactgcatctgcagaaatcactcttaaattctatcctttggttacagcaacagatgcttcattaagatcctgttttatagaatccaacccggctactgctttattcaatcttgcaaatgcaccagtgacaagccctacgggaactacaaccaagagatatttcccatcactgacagatgcaatagatgcaacaaacgaaattttaggatttaataattatatagcaccgaatggatttgtatacgttagagtatcagacacaagaggatgttataccgttgcaaaaatcactttaacagtaatccctcctgtgacatcaagtgttctgaaagacaagatcatctgtatggaggacactacaactcttgatgcaggaccaggattcaacggttacgagtggagcacaggagcaactacccagtcaatcaaaaatgtaggggtaggagtctactgggtaaaactgaaaacaggagattgtatcgcaacacagaaagttactgtatatccttctgaacaacctgtagtaaacggtgttgatgtttccaatacaactcttacaataaacgttataggaggaacaccggattatcagtactcaatggataaaatcacatggcagaactcaaatattttcacaaatattgccagaggcacttataaagtatatgtaaaagatgcttatgactgtgatcctattgaagtgactgtagtggttccaaaccttatcaatatgattactccaaatggcgacggtgtgaatgatgttgtagattattctgctatggcagacaaacaaaatcttattttgagtatctttgacagatacggaacaaaaatccaccagggagacaaatcaaacggttacaaatgggacggaactattgcagggaagaaaattccaacaggtacatactggtattctgtaacttggaatgagaatgataaaaagaacactcctttcaagttttcaggttggattgtggtaaaaaacagagaataatctttacataaaaaagccgctttggcggctttttcttttacaaataatgataaaaaatttattgattttctaacttgtttaacaaaaatagttttaacaatgaaaaaaatattacttctttttattttattgataacccaaatggcctactcacagtcagactgtgtcacagcaatccctatctgtggtaactctgacatttcttataccccgtcaggcccggggagcatcatagaaattcttaatcaaaacggaggttgcctcagcaccaatgaaagatatactgtttggtataccttcactgtatctacaccaggtacacttgcgtttacaataaaacctaacgaccaggacgatgattacgatttcgcagtctatggcccaactacaaacggctgcgcttctttacaggacgcaaatcatgtttttatacagccaataagatgtaactatagcggtactccgggagacacaggactggatcttgctcttgctccaccagctgtattcccaaccaatcctcctggtaccacagcgagtatgaataatggaaaatggagtccttatatgaatgtactggtaggtcagacttactatctggttattgacaacttcagtagatccgttaatggtttttctttagaatggacaggtactgccagcttaagttctgcatttaacgatcctgtactttcacctcacccatttatcactccgggaattccgggaactaatcctaatgatccaagccaggtgatggtttgctcattaccaactcagtttgattttacaacactgacagcatctattattaatggtaacagctctaacttctccgttacttatcacaaaactaccaacgacgcccttacaggcgccaaccctcttacagtaactactgtagacggaacaacaacatactattaccgaattgtataccatgatccaagcaatccgaataacccaatcaacggatgtttcattaccgggaagttcaagtttgtcaatgtcggtattacagctaattcagccactttatattcctgtaacaacaatggagccggtaccgcaaaatacaatttaacaacagccaatatattcggaggctccggagcaacaattaagtattatacttcggttgccgatatgaatgccgacatcaatgaaattactgatcctaccaactacgtttctgctgaaactactatatatgcaaaaattgtttctaacttcggatgtattgcaactactacgatcagattgctattctatccaacagtcgtattaaaagatgctgtacttcagaactgctatattgaaaatgatgttacccgttcaacatttgatctttccaaagctgatatcggggtagccgttccaactcctacaggaactattattaaatattatacctcgatagccgatgccaaagctcaggcgaatcctattgtaggagcattaaattatctttcagaaagcaaaacgatatatgcaagagtagacaatgacaaacaatgttattcaattgccaagatagaactggtggtattgcctccggtaaaatcagccgtactaaaagacaaaacaatttgtgcagaagccaaaaccactctggatgctggacctggatttgtaagctacgaatggagcacaggtgaaactacacaatctatcagcaacgtgggagttggcgcttattgggtaaaacttcagaccggaaaatgtttcacacttcaggaagtacgtgtgcacccaagccttcagccggtgatttcaggaatagaaattaccaacaacaacatcactgtaacagctacgggaggcgttcctccttacaagtattctgtagatggcgttacatggcaggattccaatatatttacaggacttccgagaggtgaaaatacaatatgtgtaaaggatacttacaactgtactcctattcaggtgactgtaacggttcctaaccttattaacgctatcactccgaacggagataatgtaaatgatgttattgactattctgcattagcatacaagaagaacctcatcttcatcgtgtatgacagatatggaaacaagcttcacgaagccaataaaatgagaaactttacctgggacggaaccgccttcggtaagaaaattccaaccggaacttactggtacacgatctcatggaatgaaaatgataaaaacaataccgaaaccaaatattcaggatgggtattggtaaaaaacagagaataagctccgctaaaactattttataaaatcacctcggtttgaggtgattttttttatcaacagattcaacctcctgtttacagtattttccgaaagactgctaataatttgttgaatactattttttaattattttttaaataaactatctttgcatcatggcgcagaaagaaacattatcatccctgacacacggaaactttgcaaaagaattgtctattgcggatggaaaaatgcctcccaatgcagtggactttgaaagacttgttatcggaacttttttgattgacaaaaaaggtcttgatcattccattgacctccttaccccggaagtattttatgacccgagacatcaggtcatcttttctactatcctgaaactttatgaaggcaaccatccggtagacttaatgacgattattcaggatttaaaaaaagaagacaaactgagtcaggcaggtggagatcactacatcattgatcttaccatgggagtaagctcatctgctcatattgaataccatgtacgcgttattcttgaaaaatatattttaagaagccttatcaacgtttctgccaatgttattgactcttcctacaaagagtcaacagatgtttttgaacttctggacaaagcagagcagtctttcttcgaaatcaccaacggaacaattaaaaagggattcgacactgccaattcattggtgaagcaggctatcgataccattaaatctttaaaagataagcagggactttcaggagttccatcaggattcagagatgtggataaggaaaccggtggatggcagaactctgacctcatcattattgcagcccgtccggcgatgggtaaaaccgcattccttctttccatggcaagaaatattgcagtgggtcacaaaattcctatggcactgttctctctcgagatggcgtccgtacagcttatcaccagaatgattgcttcggaaacaagaatttcttcagagaaattaagaaaaggaacactggatgatgaagaatggcaaagactgttctccaatgtatctgaactggagaatgctcctttatatattgacgaaaccccttccctttccatattcgacttccgtgcaaaatgccgaagactggtaatgcagcatggcgtaagacttatcatggtcgactaccttcagctgatgactgccggcggtggcggtaaaggagtcggaaaccgtgagcaggaaatctccatgatttcacgttcattaaaggcgattgcgaaagaacttaatgtacccgtaattgctctttcccagctttcaagaagtgtggaagcccgtcccggaaaaagacctcagctctcagacctgagggaatccggagcgattgagcaggatgcggatattgtatctttcatcttcagaccggaatattataaaatttctgtttgggataatgatgaagagggacaggaaacttctactgaaaaccaggctgaacttattattgcaaaacacagaaatggtgctacagcagatgtcagattatcattcttaaaacattttgcaaaattcggtgacatagaagcagcgtttgatggcggagccggaggaggatatccttccaatttcggggagcaaagcggatttgacaggatcaaaacaacaattcagccaggagccgcatttgaccttccggacagctcaaaactttcgggatcatcaatgaatgatttcgacgatgatgatgattttccgttttaaggaagattgaaattcaaaccaggtcagtttaatgtactgtcaataaatcattttaaaaagcagatttgagaatcgaaatttataccgatggcgcttgcagcggaaatccggggaaaggcggatacggaatcctcatgcgtgttccggaaaaaaattaccagaaaactttttccaggggtttcaggaaaactaccaataacagaatggaacttctggctgtcatcacagcattggaaaaactgaagtcaacagaaaatgagatccatatttatacagacagcaaatacgtatctgatgcgatcaatcaaaactggattgcaggttggattaaaagaggatggaaaaatgtaaaaaacccggatctctggaaaaaattcgttgagctttacaataaacacaatcctaaaatgcattggataaaaggtcacgccgggcactttgagaacgaactttgtgataaattagcggttgcggctgccaattcttcagacctagaaattgatacttattttgagaatctggacaataattccttattctagtttaattagtacaaatacgtaatcaccactagaatattcaccattatatcataataagcgataaatttttaaaaaattattaaaattttagcaaaattaacattaaatacatattaattgattgggatttaatatctttacatattaaataagtcccattataaatgaataaaaatctattattgtatttatctgtttttttactctgtatagccgggaagtcctttgcccagacttatcagcttgtcggaaaccctgtaacaacgaccggttggacaatggtttctcccaccgtggtaaacacagattttattcagcttactccggataccaacaaccaatccggctccatcaggctgaatgaccctatcaatctaaaatattgcgacaaatggagagtggaatttgacttcagaatggactccaaccaaacctccaacggagatggaatcgccttctggtatcttgccaatccgcctgttgccagcgtattaggttccggtcttggtgtttctcagaatgcagttggccttatcgtagggctggacacttataacaataccactacagctacaatgagtaaggtacatgtagcttacgggcaggttcaaaatacaacagataccaataacgttgaattcttcaatgttcctggaagctcctttcactcaccggatttaaatacgacacagccttttcagggaactacctttaagcacgttgaagtaacggcacaggtagatcctgctgctccaaccagctggattataaaaataacaatagatggtaatgtaatatgtaatcagtcttttgccccttccggaacggctgctgcaatgacagtaggatattttggattttcagcatctacaggaggtgcaagatcaagacattccattaaaaatgtaaaaatttatacggataaagttcctattttacagaattcagcaacccagtcgttctgcccaaatcccactacaggatatggctccgtaaacctaacttctttcaattcgcagtttgtcagcaatccttccaattatacattcacttactatccttttggaagctcaacgcctatcgcaaacccagccaattatcagtttaataccaacaccactgttaccgttgttgttaaagataacgcaggactgctctgtgataacccggatgggaaaatattactggttcttgcccctttcaaagctgaagacaaaaccattacggtatgtaataacaacaaagccggaaccgctacattcaacctgaataccgcgaatgtcacggatgttcccggcgtcattaaaaaatattataaaacgctggccgacctcaatgctgatagtaatgagattcaaaatccaaccaattatatatctgcaccaggagttgtttatgtaaaagtaacgacgcctcagggatgtacaggcacagcaaaaatcacactggcattttaccctgacactcctgtgaaagaggctacccttagatcatgtttcattgaaaataatattaccagtgctatttttaatctgactactgcagatgttaccactctgggaataggagctgcaaaaaaatattatacttcaatagcaaatgctttagacgggaccaatgagatcatgaatcctcttcagtatttatcaacaagcacagccgtgtatgcaaaagtaacagatgccaacggatgctttaatattgctaaaatcaaccttatcgtattacctcctgtaacgtcctctgttctgaaagacaaaatcatttgtattggcgaaaaaacagatctggatgcaggtcccggattcgatggttatgaatggagcaccggagaaacaacctcatctattaaggatgtaggcgtggggccttattgggtaaagcttaaaaccggcaactgtattactacacagattgtcaatgtaaaagcatctgcaaaccctgtgatttccagcatcaatattgacaacaacacaatcactgtaaatgtagcgggcggaacccctccttatcagttttctgtggatggagttaactggcagaccagcaatatattcacaggtctcgcaagaggagaggtaagagtttatgtaaaagatgtttatgactgtacacctgttgaagttcagattacagtacctaaccttatcaatgccatcacgccaaacggagataatgtaaatgactttattgactactcagcacttgcctataagaaaaacctgctgttcattgtttatgacagatatggcaacaaactttatgaggctggaaaaatgagaaacttcacatgggacggaactgcttccggtaaaaaagtcctcacaggaacttactggtacaccatctcatggaatgaaaacaacaaagacaatactgaaaccaaatactcaggctgggtattggtaaaaaacagagaataaaatttactatttgaaactacctcctttggggtagtttcggtattaaaggagactttatcctatccgaaattgaaaccatacattacgttcgtaattaatataaacataaaagaaacaatttataaccaagaacaaataacatcataatccatccactatgaaaaaagatatactcattttatttttggctatcttactctgtcttccgggaagattattttcacaaacctatcaattaacaggaaaccctgtaaatacaacgggctgggatctggtctctgacgctgtggtaagcggagactttgtaagacttacaagtgatcagaccagcagatacggcgctataaaactatccactccaatcaccctgagctactgtgataaatggaaagtggaattcgatttcagaattgatggaaacggaaccgcacagtttggaagaggagacggctttactttctggtaccttgcaaatccgccaacaggattcgtctcaggaggaggattgggtattccggccaatgcctcaggactgatggttggttttgatatcttcaacaatacaactgaagggcagatgagtaaagttcatattctttacggcaccaacaatacagcaggtaacaacattgaatacaacacgactccgggaagtacttttcactcaccagatcttattgctaccaatccatttgtaggagatacttacagacatgttgaagtaaacggagaaacagaccttaccaatcctaccaactggattatcaaagtaagaataaatggtgttcttattgtagatcagtcttttgctccttccggaggtgctgtgggaatgtcacagggatatttcggcttctctgcagcaacgggaggcgccagcgcaagacattccattaaaaatgttaaagtgtttgtagataaagttcctatcttaagcaacaccgtaacaccgttcgtatgtaccaatccagctaccggaaatggggttgtagatcttacttcttacaattctcaatttgtaaataatcccggtaactatattttcacttattatttactgggaagccctactcctattgccaatcctgcaagctttcagtattcaggaaatactacgatcaaagtagtcatcaaagaccctacttctactctttgtgataacggtgatggagttatccagctaaaccctactccatttgcagcaacagatgccagtcttaccgggtgtaataataacaatgccgggacagcaaccttcgatcttaatacagctgccgtaaccactgttgcaggagttaccaaggaattctatcctactttatatgatctgaataatggaacgaaccagattaccaatccttctgcttatgcatctgcagcagcaacaatatacgtaaaggttaccactcctcagggttgtgtgagtacagctaaaattacattgaatatttaccctgttgtggttgtcaacgatattgaaatcaaatcctgctttattgaaagcaatccgtctatggcctcctttaatctggtaggagccgtcgtttcacagggtggacttacaaaggaatattacccttcattaactgatgctatcagtggaactaatgcaatatctactccggcagcatacattgctcctaatggagtggcttatattaaagtgttcagtgcaaacggttgctactctattgctaaagttacattaaccgtaataccacctgtttactcaagaactttacttgacaaaacaatttgtatagaaaatacaaccactttagatgccggagcaggtttcaaaagctacgaatggagtacaggagcgactacccaatctataaagaatgtaggagttggcacatattgggtaaaacttaaaacaggcgattgtattgcgacacaaaaagtaacggtatatccttccgacaatccggttattaccacgattgatattgcaggaagcactgtaactgtatacgccaatggcggaactcctccgtaccagtattcaatggataatatcaactggcaggactccaatgtctttaccaacattgcaagaggagaagcaaaagtatatgtaagagatgggtataactgcgtccctgttgaagtcaatatcacagtacctaatctgatcaatgtaattacgccaaatgatgacggcaagaatgattttattgattattcagcgcttgccaataaacagaatctggaaatagcaattttcgacagatatggttacaaaatgttccaggcagataaaaccaatggttacaaatggacaggaaccaccaacggaagcaaaaaagttcctacaggaaattactggtattctatttcatggaatgaaaataataaaaacagtactccgataaaattctcaggctggattgttgtcaagaacagagaataattacactttccaacacatcaaaaaaatcaccccgctggccggggtgattttttgtattaacaggaaggagatatttcattttaaagaccctttattcacattcaattcttaaatttgtcctatgaattatttggaagctttaagcagaagatattctgtaaaaaaattcaatcatcagattattcctcaggaaacccttcacaacattcttgagtcaggaaagctgtctgccagttcgctgggacttcagccgtacaagatcattgttgttgagagtgaggagatgaaacagaaactgattcctgccttctataatccatcacagatttccacctgttctcatcttattgttattatttcaaagaaaacaattgaagagaattatatccgtggctattttaatcatatttctgaagtacgggatactcccattgaaaaactggatcccttcagaaacagcattaatcagcatatcagccagaaaacacatgatgaaattttcaactgggcagaaaagcagtcctatatagtattggccaatcttatgtatgccgctgctattgaaaatatagactcatgtcccatggaaggtttccgtcaggatattattgaagaaattctggatatcaatcctgaaacagaaaaagtaaccgttaccctcgctttaggctaccgttctgaagaagatcatttccagcacatgaaaaaagtaagaaaaccaaacgaaaaattgtttaaatttatttaatattttaaacgattgtacctaaagccagcatatgataaaagcggatgtattagtaatcggttccggcatttccggactttcctatgccattaaagtttctgaacagctccctgatgccaaaatcattatcgtaacgaagtctgacgaagacgaaagcaacaccaaatatgcacagggcggtcttgctgttgttacagatttccagaatgacaatttccaaaagcatattgacgatacaatgcgtgccggcgacggggaaaacaaacgcgatgtcgtagaaatggtagtaagagaggccccggcgaggtttaatgaaattgttgaatggggagctcagtttgatatgaaaaatggcaaattcgctttaggaagagaaggtggccatactgaaaacagaatcgtccatcataaagatatcacaggttttgaaattgaaagagctcttttgcaaacagccaacaacagccccaatattgaaattcttgatcatcactatgtcattgatatcattacccagcaccatgttccgggaaaagaactgaatgaaggggatatccactgttatggggcttatattctggatgaaaaatccaaaaccattaaaaaaattacttcgaaaataacactggtagccacaggaggtgccggacacgtctataaaaacaccaccaatcctacgattgcaacaggagacggaattgctttcgtagcccgtgccaaaggtaaggtttccaatatgcagtattaccagtttcatccaacagctttatacagcaaaatggacggaatgctatttctaatttcagaggcggtacgtggagacggagcaaaattaagaacaaaaaaaggggaaaagttcatgcacaaatatgatgaacgtgaagaattggcctccagagatattgtagcaagagctatcgacgctgaaatgaaaattaccggagatgaatttgttggtttagactgcaaggaaatgaatcatgaaaaattcttagaacatttcccgaatatttataaaaaatgcaaagacgaaggaattgatcctttcacccagctgattcctgttgtacctgcctgccactatctgatgggaggcattgaagtagacagggacggacagtcttccatcagaaaccttttcgccgtaggagaatgtaccaactcaggacttcacggtgccaacagacttgcttcaaattcacttcttgaaggtttggttttcggacataatgctgccatgaaaaccgtagatcttctgaatgaaaacaacttcaacttcgatgatctgaaagccgttcctgaatgggatgaagaaggaatgaaaattatggatgaaatggtcatcatcagttatctgagaaaacagcttcaggaaatgatgagcgatctggtaggtattgtaaggagcaaccgacgtttgaatatggcactgcaaaaacaccaggagattgccgctgccgttgatgaaatataccactactctattctttccccacaattgtcagaattaagaaacttaacaaccgttgcacacctcatcattacccaatctatggaaatgacagagaataagggagcattttataataaagatttagcctaaaagcaaaaatataatgaaaagaccaagctacgttacagataaagcattaaaaacatttataaaaaccgctcttgaagaggatattcaggatggagaccactctaccttgtctaccattccacaggatcttatacaaagtgcaaagcttttggtaaaacaggattgtattcttgcaggtgttgagctggcagaaatcattttccacacgtttgacaaaaacctgaaggttgaagtttttattaaagacggaactccttgtaaagtcggggatgttgctcttattgtaaccggaagtgcaagatctatcctgtctactgaaagattagtccttaactgcatgcagagaatgagcggtattgctacgcttacccacgattgggattccagattggtaggtacaaaaactaaacttttagatacaagaaaaacgactcccaacttcagaatgtgtgaaaaatgggcagtagctattggtggaggaaccaatcatagatatggtctttatgatatgattatgctgaaggacaaccacattgattataacggaagtatcaccaatgcagtagcaatggcgaaagactatgttaaaaagaataagaaaaagttaaaaatagaggttgaaacaagaaatctggaagaagttcaggaggccatcaacgctaaggttgacagaattatgcttgataatatggatgtaaaaacgatgaagcaggctgtaaaaatgatcaacggctcatgtgagtctgaagcatctggtgggattacccgtgatatgctgaaagagattgcagcaacaggcgttacttatatctccgtaggagcccttacacactctgcagagaatatagatttgagtctcaaagcagtgaaatagcgttgaatttttaacaaaaacacccccactttgttaaaaattcaataacatgacttttttcatacaaaaattcaatttttagccataatactgatttttaacactttaacattattaagactgattaaaaattaacattgagttaataatagttaaatttaattttgcgaattttgcagaaaattaaatctaattattactaacgattatgaaattaatcaacaaatcaatactaactgcggtaattacattatctacagctagtgtttattacgctcaacaagttcaggacacagtacaaactaagtccaaagatattgaagaggtaatcttaagaggtgttacggatatcgctaaagatagaaagacacctgttgctgcatctaccattaaagcagcacaacttgcagaaagattaggtaaccaggaattacctgagattttgaacactactccatctgtttatgctacaaaatccggaggtggttttggtgatggaggtcttacaatcagaggttttgaatcaagaaacatcgctgtaatggtaaacggtatgcctgtaaacgatatggaaggtggtgctgtttatttctcaaactggactgggctatctgatgtaacaagtacactacaggttcagagaggtttaggttcttctaaattagctattgcttctgtaggaggaacagtaaacttccttacccgttctgctgatatgaaaaaaggaggggtaatcagattaggtattggtaacaacgattatttaaaaacttccttttcttataatacaggaaaatctaaagatggtatatccgcatcattcttgatgagcagacaagctggaggcacttatattgaaaatactgattatgaatcttatgcatatttctttgcattaggttatgaaatcaacaaaaaacataacttacagtttaccataacttccgctcctcagtggcatgatcaaagaacttttgctccaacaatccaaaattatatcaactataatcctgaccacgatggaactccttatagaagatataactcagattttggttactatactgatgccaacggaaacaaagttgctttagcaaacagatcaaactattatgctaaaccggtaatgatgttaaactgggactggacaatgagtgaaaaatctaaattaagtacagttttatacatgtctaacggtagaggtggtggaacaggtgatttaggtaaagtaggaggaaaaggaatgacagacttctatgatgcagcaggacatttcaactatgatgctatttttgcagccaatgcagccgttaatttaaatactgcaggtgcaggaagtactttggttcgtagatcaaatatcaactctcataactggtatggtatcttggctaacttccaacataaaatcaacgacaactggaacttctcagtaggtacagatgatagatattattatggctatcactatcaggttcttacagatctttacggagctgcgggatacaaggataatgcaaacaaaaacttacctgctccaagaatcgtaaatactctttatgattataaaaaacttacttggaatcctttcggaggaaaattagctccagctgaagatcaggtaggatatagcaatgatggagaagttctttggtacagtggatttgcacaggtagaatatactaaagataatttatctgcattcttacaaggttccgtatctaatcagggttaccaaagaattgataactacgtagtagacggaagtacagtaaaaggccagactgtaaacacaaaaacaggatttaaaaatatttttggatataatattaaagggggagctaactataacatcaatgagcaacataacgtttttgctaatgtaggctattatagcaagcaaccatttcttaactctgtttatccaagtaaccaacagcttattaacccttatctgactaacgagaaaatttcttcagctgaaattggatatggattcagatctgcaaaattcactgcaaatgttaacgtatacagaacacagtggaaagacagatggctgagaaagccaggtcagactttcactttagtagacgattcgactactacaggttattctgaaattaatggaattactgaagttcaccagggagtagaatttgatggagtatacagacctaaccgtttcttggaagttcagggtatgttctcttggggagattactattacaaaggaaatgctagtgtagcttctttcgatgataacaacaatcctgttactttagctggttcaggaggtaacgaactatacttagataaagtaaaagtaggaggctcaagcaataacagtattcctcagatgactgcatcattaggtcttactgtaaaaccggtaaaagatcttaatatcttcggaacctggagatatgtaggtaaactttattctactattgacgctggaacatttacaaatatttcagctcaggaaagaggagtattgaaattgcctgatttcaacttattcgatgtaggattctcttacaaaatcagattacaaaatgaagctcagtatttcactattggagctaacgtttataacctgtttgataaaatttatatttctgattctgctacaagcatcttcggaactgataaaattacagcaaacaacgatcctgataaaggaaaaacgtatgaagaagctggtagaatgtacaatggtatcgcaacgggtaaccgtgcttatttcggtttcggaactacctgggcagcaacattatcattcaacttctaacaatataacaatattagattttctcaatatcaatcccggctttgagccgggatttttttatttttatggaaagcaaagtttatggaaaaagcacttagtcaatttttagaccaatggagaagtaaaaaatacgtaataggtattttattaacgggaagtcatgctgtagggcttcaaacagataattcagatatagacattcgaattatatttgattcatcaaaaaacaaaacattaaagggcttagagataattgataatcataaattttcttatctgggcagaaatatagagtccattaagaaaaaattcaataatgaatttctcaatcgacaaaaatttgaagcttacatttttaatgttggcaagatattatatgacagaaaaaatgttatgtccggattaaaggagttagcccaagtctacgtctctactcctctattaaaaaaaacacatataaaaagtgaagttaaagcaggtttatacggcctatacaatcataaaaaccatatcctttctttggatgaatcctctccttttttcagctatcattattatatatttttaaaaaaaatactcttttactattcctcttacttaggatatgagacatttttagatacaaaaacagaaaaagtcctgtgtgatcttacatacagagaacattatcattggccagaattccctgacaaaaaatttacagagcaatggatttattccataaatccagaaaacattaataaaaattcattgataaacatttatcactacatagagaacaaaatagaaaaaatcaatgaagaaaagtttagtatgcaatggaatgagcattaaattttactattttaggtttacttaaaccagaaatactcaacttatgcaaaagaaaaaattagcactgaagaaaacgaaaatttctaagcttaacatcactatccttgacaaaagcaaaaaagcaaatatcaggggaggtgatgtcgttcagcctgatactcatccaacaccggtatatggaggtgacggtggttctgctcatggcgcatggtaccatgaaagttatgatgcacaaaccaactctatacatggtccgacatgctactatgactgcggatcttaaagattaaaattttattatttaatattaacaactttctaaaaacaatgaacatgaagaaaaagctaacactgaaaaaaacgaaaatttcaaatcttaatgttagtattttaagcagaaacttacagggtcatatcaaaggaggagacgtagttcagcccaacacccatcctacgcctgtaataggtacagaaaatgcttcaggtcagggatactggcagcacgcaagctatgatacacaaggtaatccgattcatagtgaagaatgctactatgtgtgtgtttcctaaagccaacatttaaaaaagagccatagtaaattagcttttactatggctttttattaaaaacttttaccatgccatctgattcaaacaaagatatttcaaagaaactcgagaatatctatatatatcttaacaataattatcaacaatataaccgtataggagctttaaacggtcttgcaggtatagctcttttccagtcttattatgaaataaagttcaatattcagcaaagccacagtttaaaaacaatagattattgtattaataaaattaatgaagaaaatctaccctcaacatattgtaatggtgtagctggatttgcatggcttcttcatcatttagaagaaaaccaatttgtttccgaaactgaattttcagaaaccttatcaattctggacacttatctggaaaatgaattatcaaaatatattataaataacaattacgatttccttcatggagccttgggatatattttttattttctaaaaagatcaaaacatcctgaacactataaaaaacagatttctgctctattttcaaacctccctgaaatttacaagacaattacccatcatgagttgagcaaaattgcaatgcgtgaaatgactaatggtagattagaaaataaacttcattttggtctcgcacacgggatctcaagcattattgcaatactatgtttgtgctatgaaaaaggttactttaaagagcaatccaaagaatggattgaaaaatttatactattcctctcacaatatgaaatggtgcaagattctttatcactattcccgatgtggatagatttgcaaaccggtaaaaaatcttttagcagcctaagctggtgttcaggagatattggaattgcaatagcccttacaaaagcatcacaaatcgtagaaagtaagatgctatcaccaattttaacagcgattctagagaaatctttccaaaggacatataatgataaagcattgatcaaaaactatggtatatgccatggatattttggagttgcacgaattttttcgagaatctacaatgatactttatcagagaaatataaagaaacatctctcttttggttaaataagggaatcgattctctaacaatgacaaaagactctccaatgagtattttaaatggacttgcaggtgcaggactagtattaatggactttcgtttgcaggaaataaatagctgggatgagtgtcttttaatttcataaaatcaatcatgagtaaatttccttataaaattttaaatcaatatgttttgaggactccctcaaaacccattaacatcataaccaatctcttgaaagaaagagaggtttcggacgaagcccttaaagctttatccgaagatcctctttttaaagaagcattattcttagcatctcctttattgcacgacatgcttataaactggctgacagggacacttaataaagaaaaagaagaaaaggttaaaatgtctcttctaaaatacataagcagaatgtcatcccggtgtactcctttcggcctctttgcaggctattcattaggccgattaagcgaagagaataatatagaaatagctgaagagaacaaatataagagatatacaagactggatatgcaatatcttttatcactttcacagtctatctccagtaataaaaaaatacgggcttatttgacctatcactggaatactagtatttacaaggctggaggacaatatcggtatgttgaatacacttataccggcggactaagaagagttcaccatattgaagcggttgagatcactccacatttagaatatcttttaaacaatatatctcagaataactcaattcaaaacattgtagattctttaattcaatatgatccggaaattacagacagagaagctaaaaatttcatacatgaacttatagacaaccaactccttataagtaatataggagggtcttctattggagaagattacctaagtgctcttaataaagttctttcaacaattaagggcaatctttacaaccaaatactcaatgatatcagcttcgacctaatccaagtagacaatgccatacccaacgatatagatatttatcattccattcataaaaagactgctcaattaggaatacaatcagatcttaaatttttatttcaaacagatctttctgtaacaactaaaaataatactcttaacaaaaatatcataaaagaccttcaggaaggacttatgattcttaacaatatttcatctgcatcacaaaaaaacactaattctttactggaaaaatttattgcaaaattcaaaaaaagatatgaaggccgtgaaatcccattaagtattgccttggataatgaaattgggataggctatacttcaaatcatcatattatcccaggcaatcattttcttgaaaaaattcacattccacttccacaaaaaaagaaagaagaaatacaatgggatgctgtaagtagtcttttccacaataaaataatggaagcttataaaaatcaatcaagaacaatttgcctgacatccacagatattcccatacaggaaaatgctctttggaatgattttgcagatacattttcattaatgacagagatgatttatattgacaatcagcaaaaaatactttttcatggattcagtggggctagtggagccaatctgttcggacggttttgttcatcagatcctttactcaaagaacatgctgaagcaattattaatatagaaaaagaaatcaataaaaattctatcattgccgaaatatctcatattcctgaggccagaataggcaacgttatctgcagacccagttttacggagtatgaaattccttatctctccagatcagaaaaaaacgaaaattttcagatcaatatacaggatcttatgatttcagtaagaaataataaaattctactacgatcaaaaaaattggataaatttatcatcccaagattacatacagctcataattttagtagaaattctttacccgtgtatcatttcttatgcgacttacaaaatcaggagaataggtttgggcttagtttacatcttgggcaaatggaaaaaaaatataaatatattccaagaatagaatataaaaatataattttaaaacccgctgtctggaatttaaatataaaggaccttcctcttttatctcaaaaaaaatcatctggagaagaacttctaaaactaatgaattgttcacgagaagaatggcaccttccacaatatgtactattaacagaatatgataatgagctgttaattaatctcaaaaatattagtagtattaaaatgatgattgacgccatcggtaaaaaagaaaatttcacattaaaggaattcctctatacagatgaatatcagttggtaaaaagagaccaagatttctttactaatcaatttatttttacattttataataatcaaaaattatactcaatcaagaatgaaagataaaatacaacgtatttttacaccaggagatcaatggctctactacaatatattttgtggttataatacttcagatgatattttaattaattatcttagtccattaacgcagtcatttctttcaagaaatataattgatcaatggtttttcataaggtataatgatccttcctaccacatcagatacagagtaagaataaaaaatatagcttatataggtgaaataatacacaccattaataacgttctggagcaacttttaaaagatgaatacatctcaaaactccagattgattcttatataagagaaattgaaagatatggatataatacaatagaaaatgctgaaaatattttctttcatgacagtaataacattctaaaaattattgcatcgcttgatgaaaacaaacctaatatacgcagtttatggggattgaaactggttgatttttacctttctactttccgtttttcaatttcagaaaaagttctattttctgagaaactgagaaattacttttacaatgaattcaaagtagataaaaacactaaaaaaaatctggacagattatattctgattatcaaacaagtatacattcatttatcagcaataaggatagaaaaatatataagtcggaaattataaaagatgtagctaaaattgtagcaataaaagaaaaaaatcttctcagagttgattttgatagtttaatttcaagttttatccatatgtcccttaacaggctttttgtaggtgataacagactccatgaacttgttacatatgatctcatgtggagatattacaaaaaagagttttatttcagcaaccatacaaccacacatggaacagaatcaaagagaatcttatcttagtattgtagatgcattaaagaaaatatcttttgcttatccctttctgggcttgaacggaagatgtgggggtgctatttttttatttaaactatctcaaaaattaaataatactgaggtttatgacctggcaatagaattaatagaacaagaattaaatgaaataaatatcattgaaaatttaagcttatataatgggctctgtggtattgcatggactgtccaatatttatcagatgaagattttattgatctcaatgaagactccttcattcaatatatggaaaaacattttatccaatttaaggataacaatcatgaaatcaaaaacctttatcaatttcaaacatttatagatctactgttctatttctccagcagatatattagtgttacaaaaaagaaagaaaaggtaaaatatgcgggattattaaaccagattcttattattttaactcatcaattttataaaattcaaacatttgaaaaactaaataatttatctcaccaaaatttatattctctcttacaaacccttatctatcttattgatatagattttcaatcacctttaataaaaccattaataaaaatatctgtcaaacagactgaaaagaatagagagattgaaaacataaactcatatcccaaatatattcttcaaaaagcaactctttatacttccaaagccagactctcagttgcaaaaatgcctttaataaaaggcagtatacagaatgataagaagaaagaactcaataacaacatggggatttgggataacagtattgtccatgatgccattaaaaacatatgttcgcagaagtacaaaaaagatttaggattacattatatattggaatgtcaatataattcataatgagccagccgggatttttgttatctttgtgtacaaaaaaataggattatggatttttacaacattttacttaatgcccacaaaggattcgggtatcttgagattcttttggtaacattatttatcattgcacttttagctaccatgttcggtttcagtggaaaagtgaacaaatttttgaagaaaacgactctttttacgatgattttcttccacgttcagtttttattgggaatcattatgctgatcaccactttcagcaagggattaaatatgggagaagtaatgaaaaatgcagcattaagatttcaatatgttgaacatccattctctatgcttattgctgcggttttgatgaccattgttaacaaaaaagtaaaatccaacgatactatttctttaggagtagttattatgggactgattgcagtaggtttatttgcattcgcattcccttggacaagagtctttggggcttaaaaagataaagaaattatatgcgttataatttataaatagtttaatcttaaatttttaattaaatcaatgaaagtagctgtagtaggttcaacaggaatggttggacaagtcatgcttaaagttttggaggagagaaacttccctgtaacagaattaattccggtagcatccgaaaaatctgtaggcaagaaggtgaagtataaacagaaggaatttacgattgtaagcatgaaggacgctatagctgccaaaccggatattgccatcttctctgcaggaggttctacttctcttgaattcgctcctctgtttgcggaagcaggaacaacagtaattgataattcttctgcttggagaatggatcctgataaaaaattagtcgttcctgagatcaatgctgatgttttaacaaaagaagataaaatcatcgccaatccgaattgttctaccatccaattggtaatggttcttgggccattgaacaagaaatatgatttaaaaagagtaatcgtttctacgtatcagtctgtaacaggaacaggtaaagctgcagtagaccagttaaacggtgagattagtggaaatgaatctactgaaaaagtatatccttatcagatattcaaaaatgcattgccacactgtgatgtatttgctgatgatgattacacgaaagaagagatcaaactgatgaaagagcctaagaaaattttaggagatgatactttcaacctgacagcaactgctgtaagagttcctgttcagggaggacactcagaaagcgtaaacatcgaattcgaaaatgaatttgaactggatgaagtaagaaaaatcttatctgaaacacctggtgtaattgtaatggacgatgtaaaaaacaaccactaccctatgcctctgtactcagaaggaaaagacgaagttttcgtgggaagaatcagaagggatttatcacagccgaaaacgctcaacctctggatcgtagcagacaacctgaggaaaggagcggcaacaaacgctgtacaaatcgcagagtaccttgtagccaacaacttagtataaactaacaaaataaaaaagagtctcagaattgagattcttttttttatcaaacacatttatgaatacccagaaaaatgcccatcaggagaaaataggatttcaaaagctcatcgccatatttggaatcatccttttcgttggaaaaattattgcatggaaacttaccagttctgatgcggtcttttccgatgccatggaaagtatcgtcaatgtcattagtgcgttcatgggactttattcattgcaccttgctgccaaacccaaagatgaagaccatccgtacggccatggaaaggttgaatttgtaacatccggtattgaaggtgcccttatcgctattgccggtgttatgatcatttatgaaggagttcatagccttattgtgggaaaaacgctaagcaagattgatctcggaatctggattattgcaggaaccgcggttgtgaattatcttctgggatatatttccataaaaaaaggagaaagagaaaattctctggttcttatttcatccggaaagcatcttcagtccgataccattacaacgtttggcgtggttgccagtttagtgattgtttatttcactaaaatatattggcttgattccgcagtagcattaagttttggactttatatcatatttgtaggctataaaatcgttcgaaagtcattaagcggtattatggacgaacaggatcctgaaatattaaatcagatcattaaaatcctcgaagaaaacagacatacagaatggattgacgtacacaatatgaaaatccagcagttcggttcttctttgcatattgatgctcatattacccttccctggtattacgatctgcgtgatgcacatagtgaaatggaaaacgtcattctacttcttgccggaaatataaaacgcagtattgagttcaatttccatatggatgactgcaaaccaatctcatgcccgatctgccagatcaaagaatgccctgtccgggaaaaagatttcattaaacgcgtcaaatggactccggaaaatgtaaccagtgtggataaacacacagcaactaaagatgagtaagaaataaatcggtctggttcagctttctttactaaccatttgtttcctgtaataaaacatcggtacaatcagaagtatgattaacggctggattacgaatcgcctcatataaaaagaaaaaagataccctatttcaaatctgttatgaatacaatacagataaataggcaatgtaatggcaaaaacaacagtcatcattattgctccctgtattgtccatcccttatttttaaataaaccgtaaataatcagacaggaaaaaaataagtttaaaataaatctgaaaacatgtccggcaatcagattaccccattcaaatgcaggaaaatcaatattcttattggcttcatgaaagtaatcaaggaaaggatcataaaaaatagttccttccaggattcttacccctatcaacccgcagatccctgcgataaccagaagccagttaagaattttcatgttttaaagcaaaaaatttaatccagatcagccaaagaacaacaacactcccataaataacagcaggaaaaacaaaatcgtgaaatatttttccatactctttatgatcagtcatcacgatatttaatcccataattctcaagagattcattatatacaggataaccaatcctgcacccacaaaaacaaaagtctttattcctttatagaaggcaaatacaaaagacacaaataaaatgatgacagaaaccgcattacagccttctaccattcttgttgcataattttgcttaacataaaaccaaacctgttcgttttttatatcatcatatatttccgtaggatatcctattgcgttctgcagggaagtcacctgattggcaatcacccttgaaaatgaatccagcccggaatctttaccactgttcagatagaactgataagcgaaaagcaacaccagataaataacaataaagcgcaataaaatacctaaaacaggtttaaagtctttcagcataatgcaaagataaaaattagcatgtaatatcctgaatctgaatcaggaaacttaaaaataatagaataaagtctacaattatggagttaaaaggaaaaattcccgctaaaatattcaataaaagtaatatccaaaatatttattataagaggcttcccttttgatattcaattctttaaactataatttccaactcatgttaatttagtatatttgtttccatattatgacttctgaaaacgcaaaacgattttttgaaaaccagttaggtaaaaaatcttctgaattcgtcacattagctcaaagcggctctgcgagggtaaatttcctggccactgccggtacagaaaaatacatcattacctacaatgaaaatattccggaaaatgaaagttttctttactattctgaagtattttcgggcctgaatcttaatactccttctattcttgccgtttcagaagaccggaagatgtatatccaggaatttttaggacagcatactctttctgaagtgattgcaaaagaacagctgtctcccgctgtaagatctttggtacggcaaacgttagaaaagctttaccagctgcagatccagactcaggggaaaattgatttttcaaaaacctttgagtatgaaagttatgatgaacttcccgtgatccatgatctttattattttaaaaactttgtagcagattttctggagcttgaatataataagtcatctcttttgaaagaattcaaaaaaatagcagtccttattgagaatcttgaacctaaaggaattatgatccgtgatttccaggcaagaaacatcatggtaaatgaacagaatgaagtctcttttatagattatcagtcggcaatgaaagggccattaatgtacgatgtgatctctttcctttttcaggccaaagccaattttcctgaagatttcaaacaggaaatgctggatttttatattgagcagtttgatgatcctgcaacaagaattcagttgaaaaatacagtgatgcctattcagatgatgagatttctacaagttttaggtgcttacggattcagaggtttgatacagaggaaacaacatttcatggccagccttgaaaaaggaatccggaatatcatacagttttcaaattcctgggaacacatgaaggattatcctgaactgactaaggttattcagcaattggcatcggaaaaggcacaacaaaaaattgaagaaattataaattcgaaccaataagaagctttaagttattaaggacttattggtctaaaaaaattaaaaacatataaatgctacacatcgagatacacagtttttcttacaaaaaaggaggaattcccaaagataattccggaaatggaggaggttttgcctttgactgccgtggaattttaaatccgggaaggattgaagaatataaaagtcagaccggaaatgatataggagttcaggagtatctggaaacaaaaaccgaaatgccaaagtttctggaactcgtaaaatctcttgtttcaattaatattgacaattatttagaaagaggctttgagcatctgcagatcaatttcgggtgtaccggcggacagcacagatcggtatactgcgcaataaaaatcgctgaatttatcaaagaaaaatatcctgacgggactgagatcactcttcaacatgatgaacagccgcaactgaattcataaaagataagcgatgattgataaatgattatttttccactgttattttaataatcatttattaattataaaagttttatcactcatcaactatcatttatcaattataagaaatgaaagctctaattttcgcagcagggaaaggtaccagacttaaaccgtttaccgaccatcatcctaaagcactggcaaaagtaaatgaagttccgcttctggaaagaaatatcaactatctgaaaagtttcggaataacggattttgtgatcaacatccatcactttggagatcagattgttgattttttaaataaaaataataatttcgggtgtaagatcgaaatttcggatgaaaccaacgaacttctggagaccggtggcggcttgatttttgcaagaaaatttcttgatcacggagaagattttttaatcatgaatgctgatattctgactgacctgaatatcaatactttggtagaataccacaaaaagataaaagattttgctactttagcggtttcggacagagaaagttcgagaaaactccttttcaatgatgatatggtattaagaggctggctgaatgtccaaaccggagaacaaaggcttgcagaattcaacaaaggctttaaagcactagctttcagtggcattcattgtatcaatcctatcatctttgaaaaaataaaaagaacaggcaaattttctgttatggaagaatatctggatctgatgcagaccgagcatatacatggctttgtgcatgacagtattcttattgatgtcggaagaccctcatccataatagaagccgaaaaacattttaaataaattttgcaatggaaattgatggaaccagagatgaaagtttggtaaatccagaacttgatattaacgaaacaaaactacataatagcttcagacaaaaaacatgggatgaaacgatcactaaagacagctggatggtctttaaggtcatggctgaatttgtagacggttatgaaaaactggctaaaattggtccgtgcgtttcaatatttggttctgcccgattgaagccggagaacaaatattatgaaatggctgttgatattgctgaaaaaattaccaaacttggcttcggaattattaccggaggcgggcctggaattatggaagcaggaaataaaggagctttcaatgctaaaggaaaatctatcggacttaatattgatcttccgtttgaacagcattttaatcctttcatcaacaaatcctattcaatgaatttcgattactttttcgtgagaaaagtaatgtttgtaaaatattctcaggggtttgtggtaatgcccggaggtttcgggacattggatgaactcactgaggcgatgactcttattcagaccaataaaattgggaaattcccgattgttcttgtaggaagtgaattctggggaggactactggattggtttaaggcaacgctgttaaaagaaggaatgattgctgaagatgatctggatctttatcgtgtggtagatagtgctgacgaggccgtggcacatattaaggccttttatgataaatattctgtgaatgtaaatttttaattggcatattatttgtgacttataacgaacaagtatgattgtaaatctattaattaagatgaaaaaacttttatatatatcaggaattttaacattttttgtgttaatgagttttatgtatgtagactttttctcttcaatgaccaaagtggattatattgatggaagcaagacattgaagtttaccacaaaaatgaatacaagccatatctctgatgctattaaaataaaccctaacacggctggatttgaagcggaggtaaaaaaatatgtgaacaataattttgatgtatttgtcaatggggctcctaaaacgataaccttcacaggaagtcaggtcagcggagaaactgtatgggtatattttgaaaccggaggcgtttcagatatcaataccttaaagattaaaaatacgatccttttaagcgcttttcctaagcagatcaacattgttaacattgcctataaaggcagccagaaaacgatgaacttccaaagaggaaaagaagtgaatgaggtttctttttaaaatgtaaattagatttaaccattataaatgggtaccctggaaagttaaatttttcagggtatttttttgaatcaaaaacacttctaaaataaagactacagggaaagagaatttctatgtacagttcagactttatattcgattgtgttgggtctaaccattacggttaaataataaaaagccaccacagatacttggatttttattttttaacgggttaaaatcctgtactccataaaagggttgcaaggtccagctcgctgatattaaaatcattctggtgatctttaaaaccgggcttatttttcaattcttcaatagctttttctgctttttctaaagaggaaaataccccgatatacctttcgtcatccagaaagttgtgtatggtataataatggctgacactgaaaaccgtatttaaacgtaattcttttattgaaatacagttgtcatctatctcatcacctttttcaatatagtcacgtccaatttccccaataacctcctgaaatccttcattccaatgtatcttatccagaatataacaatttgtaacaaatgattcgggataatctctgaatccagatagaataaccgcttgggtttttaattcatccaaatcttcaatactatctgaaaatcctaagaattttgtatctgtatgagattcatctgtgtatgtatgatttagtgcataaataaaatattccatagataccgttttcttttcagatacaaaagtataaattatcacctgattcaaattgttcctatccttaaaataaatcaggcagcttttcaagctgcctgattttatagtatatgagaatatattctatcgaagaatattactcaattgtgatattgtcaatctggacatcatatactccaccatttccggttttgatagcaaacatatcttttccggctgtagtgttaacgtctgcaatacctgtaagggtaagctcaactagtctccattgtccgtttgtattgatagaaccgttgtaagagttagcactttctactcctaaagtagcaccagtagagaatgtacctaagttaaacacgtagaaacctccacctgctttatatacgttgaaagacagtgattttcctgttgcattacctttgatatacattgtaattctttttggtacagccggtattcctgtagcagcaacagatgtaaatacataatcattagctgtaggagtacctttgatctgaagtgaatttgtaccgttatatcctaaaccaacaccttgtgtagcgtaaggcttaagtccgaaaccgtttacacttgataagaaagtcgcccagttttcaaaatctgaaccagcaaaaaggtttacagcagaagctgaaggagcatctggttcacccggattgaatcttgggttcgggaagttaatatcatcaagagttctgatataagcctgatctgtgaaaatagttgcgttacttgaacttgtaaaacggctcaaaagaagaacgatatcaccacttttttcatatttaggagagatcggagatttcgcaaaagttgcatagttactgaaacgaagatccaatcttcctgcttttttatccgtaatataacggtcacctgtagctgactcgtcagcaaaagtttttgtcagttccggttcttcaaactgaacgtttttaatttttacaagctgattgatgtgagcaccatttttaagggcatcagcaatagaattaaactctaatggctttattgcagttactacagccttttgtccgtcacaaacccttgccatgtaattggatagtttattagggttgattctaccgataggataattaggatcaaaagaacctactttaatgttcccattaactccctgaacgatcaatcctttcaggttgattcttactaaagatccgataggataatcaagatactgatttccgccatcgatgtcaatttcaatcccttgtgtcgggttttcaggcttatcctgaaggaacatcattttatagatatttcctgattcatcgcttgaggaaacatatgcttcaacaatgtaatcttctttaatgatatcagcttcagttggttttgcttttgcaatggcagcaaggtcagtcagagggtgatttgccgctgcaaacttattggtacacttgatttccggcacctcataatcatcagtttttacacaagatgagaaggtcagcattgaaatagcactgaaaatcgccgctttaaaatatatatttttcattgttttcgatttttaatttaatttttttagaatctgaattgaaggttaacaaaataagatctaccctgattataccaatatttaggagcgaataccatatttccgctgtcataatcattagcataatcaatatagttaacgtttctggtctgttcaaatcctcctgtaatataatttctgttattaaggatattattgacagatgcagacaccagcacataatacttaccgatcatccacgatttccctgcattgacattgaagaagaatgctgaaggcagttttgtaggtgtaagaactcttgcaagttcttcatcatttacctgatcataaggtactcccggcgtattaggatttgtgtagaatctttctgttctggttacaggagacggatctaggaatgaatgtccgaaataattccatgttgctcctaaccaccagtatttagggctgctgtaacgaagacctagcgtatatgcctcctgaggagttccgccctgtctgtagtttttaagcgttgcttcccccatattggtataagatcttgaaacgatatttccgtttccgtcaagctctctgaaagttccaacagcatcagatgcaaaataaacggtagggttattagtataagtatactgtcctaagcttaataatccactggccgttaaagtaggagtaagttttacctgtgcaccaagctcaatacccatatttcttttgttggcacctgccagaacctgggtaatgaaagcaccatcctgaataggagcctgatctccgctttcagtaagatttgtcagtttaactccctgtgcaaagtatctttgtacacttgtttcgttttgtgtattaacaagataacctgtcagtctaagtttaataatcggagtggaaattacataactcagatcattggcatcaacaacaacatttttgattcccggcgttgtaacaccacttactcttgtattaaaataaatatcattcaggaaaggagactgtgaaaagtaagctccgttataaacaaggaagtttctaccattgattttataggtaacctgccctttgataccagcattccagaagttttgatctgcaccttttccataagaagattcatacagatagtgctggaacaatccttctctgctatttgtcgtatacccgaataatccggaaacaaacacatcaaactttcctgttgagaatttaaaagcaggatttattttgaattcctgtcttctgaaaatatagctgtatccgattttatcaccttctcttttggcaacatcagtatcgctttctcttgtattgaattttccccaaacacttccagcattcgtattggatgcaaacgggtccatattaagagcaaaatcagcacccaaaagatcatttacttctctgtactgttcagatctgtagttctggtaagataggtttaagataaaacgggaagtatcggtgaagttataagtataatgagtagatacattccataccttatcatcttttacatcatcaacgagataataagctgctcttcttccccctaataatgcattgtattctacgtttctgttggcattataaagattatcccagttgatctgtgtgtgtgactgatcatcattcgtccaccagtctctcgtaattccgatgttagcggcctgttccggagacggatctttataatttaaccagtaactcggcaaattacggtaataagttggagatgggttattcgctctgtaccagtctaatcgggaactgtattcttttccaaactgataagaaacagaagtccataattgagagtttttattaattttccagaaatcctgtaattggatcatcggctggaatcctctttttaccctttcatttcttttatctccattctgccatccccagtaagagttataatgaactcctctgaagtcgtatacttcctgagtacttggacttgaagagcttcttgcgtatttagacccaatggcatttaaagtcatcgtatggctatcgctgaatttcttctcaataccaatatacccactgtatgcatcataggcagtaccatcctggatcccttcctgtgcccatcttctggcgatcattcctgtaaatgcccatccgttcttattcatcccggaagagaatctgtaggataatctgtttctataatttctgttggtaagagagtatgtcagctggcttccttttctgtactcgctggcttttgtattcttataaaatactccggtagttcctccgaaagcatattctgaaggggcatggttagctgaaatttccgggtaacgggtaatttcgttcaatcctccccacgtactgaagtctacgtccccattatctgcagcggccatagaaaccccattgatcatattttcacctgttctgctatcaattcctctcggacggaaccagtatggtcctaaatcgaaacttgcaattctgttgaaaacatcttgtgaagactgtaataatcctacagtcgccgtttgctgtgcaccaccgctgtcactttctccggaatcttctacaatagctaatccctggtctgcaccattcaatgcagaataaagagtaattactccaagatcttttcttttctcatcactggttacatcaaattcaaacattttagtttcaaaattgggttttgtaaccataatctgataatgtccaggcatcaaatccgtaaattggaaatatccgattttgtctgcctttgcatcatttcctgctccttttaaatctacatttgcttgctcaacaggcttaccgtctgcatccttaagatacgcaaacactgttgtctgcgcataataatatgaagcaggcagcaaagtaaataaagagatcaatgatagttttttaatcatgagtatatttattttttaatacttttcttgttaattttcaacagtttaaaagttgggggcacaaatttaatcaaattttgtaattcagaacttttttaacattattttttcttaacattgcaatcttttaagaatcattataaaagagtgattcggattactgcttttaaatttacaaatatttaaaacgcagtgaattaaaaaaaggtaaatttgcaattaatagtataataaaactctaagagatgaagagattttcgagtctgtttgccctatttctttcaattgtggcattctcacaacaacagggaaaactgagaaaagtagctaccgttggttttttaaatgtggaaaacctttgggacactatccgctcagcagattatattgacggaaccaaagacattaaaaatcctgcttttcacagaagtatccctatggattctatccaatttctggaagcagaaaaatatgacgggccatggagtgatggagctttaaaagggaaaaaagcagtaagactacaaagtggctctgaagaatttactccaaaaagtgcaaaaaactacggaacaaaaatttataaagcaaagctggccaatgaagctaaagtaatttctgaaatgggagcgcagtataccaaaacagctcctgcagtagttggccttattgaggttgaaaacagacaggtaatccaggatcttgtcaatgaacctgctttaaaaaaatatgattatggaattattcactacaattcttatgattacagaggaattgacgttgcactgatctatcagaaacgaagattcactcccaccaattcattaaaaaaggagctggtcatttacggtgacaacggaaaaagagaatatacaagagatatccttgtggtaacaggatttttagataatgaaaaagtagctttcttcatgaatcactggccatcaagaagaggcggtgaagcaatttccttacctaaaagaaatgcagccgctgcattattaaaacaacaaatggacagcgtaagagcagccgacccaacaacaaagctttttgcgatgggtgactttaatgatgatcctgtaagtcccagtttaaaaaaccatctgaaggcgcaggctaatccaaaagatttaagtgaagaaacaccataccttaatctgatgtatcctttatataaaaaaggagttgcttctctggcttatcaggatgctcccaatctgtttgaccagattattgtttctaaaaacctaatttcagatcaggtaacaaaagaatattccgtatataagacagaaatctttgcaccggcgtatctggtgaataaagaaggtaattataaaggctatcctttcaaatcctggaacggagaccagtttacaggaggctacagtgaccactttccggcgtttgtagttctccagaaagaaccataaaaaagttaggcactcttattggagtgctttttttatacaaatatctcaatcatgaaaaatattattttattagtaatgattgcattgattccttttagctgtttttctcaggaaacaccaaagaaagacaaagagcagcatgagatgaagccttccaaaaatgaagacggagaatgggatcttacagtcattgatacgcagtttgattattttctgagtgctgtggcgaaacctattagccaatactcagaatcttatctgaagacaaaaaacacatttctggttaacgaatggaacagttattactattccagcagatatagaaatattattgaatcaggaatagattatgatccaaaagagaattacgggatcaagtttgaatataaattataccaggtttttgtatacgtcaactggaagtataaactaagactgaacggtttatccggaagcgatgcaataaggtaaattaatcctcaataaaaaaggtccggaaattccggaccttttttattttttataacagctgaaaattatttattgaataattcttctactttatcccagtttactacatcgaagaaagcagaaacatagtcaggtcttctgttctggtagtttaaataataagcatgttcccaaacgtctaatcctaaaaccggagttcctttaacatctgctacaggcattaacgggttatcctggttaggtgtagaagaaacagatacagaaccatcagcattttttaccaaccaagcccatcctgaaccgaatcttgttttagcagcttcagaaaaatcagttttgaatttatcaaaacctccatagttttcgatagcaacttttacatttcctacaggttctttgcttcctccaggtgttaaaatttcccagaataaagagtggttgaagtgacctcccccgttatttcttactgccggcttatcagttcctgtctggcagatttcttcaattgtttttcctgctagttcagtaccttcaattgctttatttaaattgtcaatgtatgcctggtggtgttttgtatggtggatttccatagttcttgcatcaatagttggctctaatgcatcatatgcatatcctaattttggtaattcaaatgacataatttttatttttaatgttatacccaaaaatagccaatatttaaggtattatcaaagattggggattactttaataaatctttaacattgatacattgatttagaatgaattaaattttggatcaatacgtttgaagttaaaaaaagcacgaaccaaaatcagtccgtgctttccaattaacaataattaaattaatttatttattcatagacatcaggaattcctcattattaagggttcctttaatgtttttatctacaaattccattgcttctacaggattcatctcagaaagatattttctaagaatccacattctctgtgaagttacttcatccagaagaagatcatctctacgggtgcttgatgctacaaggtcaatagcaggataaattcttctgttagcaatttttctgtccagctgaagttccatattacctgtacctttaaattcttcaaagattacttcatccattttggatcctgtatcaatcaatgcagtagcaataattgtcagagaccctccgccttcgatttttcttgctgctccgaagaatcttttcggtttatgaagagcattcgcatctaccccaccggaaagaactttacctgatgcaggtgttacggtgttgtatgctcttgccagtcttgtaatagagtccagtaagatgactacatcatgtccgcactcaaccattctttgtgcttttgcaagaacaaggttagctacttttacatgtttttcagcggcttcgtcaaatgtagaagcaattacttctgcattcacacttctttccatgtcagtaacctcttccggacgttcatcgatcagaagaaccatcatatatacttccggatgattcgctgcaattgaattggcaatgtctttaagcaacattgtcttacctgtcttaggctgtgcaacaatcattgctctctgaccttttccgataggtgcaaataaatctacaattcttgtggacactgtagaaccacttcctgcaaggttgaatttctcttcagggaaaagtggtgtcagatattcaaaagctacacggtctttgataaatgcaagatcacgtccgttaacttctgtaggtcttaataatgagaagtatttctccccttctttaggaagtcttacaattcctttcactgtatctccggttttcaaaccgaaatttctgatctgtgctgtagaaacatacacatcatcaggagaagagatataactgaaatctgaggaacgtaaaaatccgtagttatccggtagaatttccaaaaccccttcaatacttaccaatccatcgaaattaaattcttttttaggatcgttctgctcctctgccttttcagaatgtctgttctgattctgattctggttttggtgctgttggtgctggttttggtttttatgctggtttccactgttctgtggatggttttgtcctttttgaggtctgttagcctgtggttgttgagaattgttaggcttttcttctgcctgggcaggctcttgtgattctgtgtttttgggaacttctgttctttcctgggctgtttctgaactagctgtattggcagaaactctttttcttttcttttttgcctgggctgttgctgtgggttcttctgttactgcagcaacttcagcttttggttcttcctgttttacttcttcggaagccggcaccttttcttctgttttttcctctgcatcaggttctaccggagcttttgcatttgcttttggcttggctgccgtttttttcggggcagctttttttgccggggctttggcaggtttttctgccggagcctcttcagtagttatactggcggtttcagtggcgttgaaataatcttttgcaactttagggttagaagcctgaaagtcaagaatagcaaagatcttgtcattttcattgctgtttcttgcaactttaacgcctaaatcttttaagattttagtcagttccgttacggattttgaccttaacgtttctatgttaaacatatttaatgtaaaaatgtaattaattgtgagtaagaaaagtaagtccggtgacttttgttttcaagtacattgtataatgcaaatctacacttatttttgaattgtgcaaaatttatattatttttgccaagaatttaatattcaatgctacagagaatacaaactatatggactttattagcagttttggctgctgttttccttttcataacaggtcaggatgttgtcatttcagacagtattcctttacttaatatcggctgtatagtccttgttattattggagcattaagtattttcagtttcaaaaacagaaaaagacaaattttgctgaataccatcagcatcattataaacgctttgttgattggtgtattggcgtactggttactaaacttatccggaggaattcagtttcctgagaagggtattgagccgattttcccatttatggcggtgatctgtctgcttattgcaaacgtttacatccgcaaagatgagaggctcgtaaaatctgtagacagacttcgatagccttacaacgattttttgagtgagaacagcttcttttcaggagctgttttttatttttcatactttcttattaatttatgtaaattcattgcaactttttagtcagaaatacgacagatcatataacttttaataaaagacaatgaaaaagctaacgtatcttaccttatcactattctccatatttacttttgcacaggaagtttccagggaaagagtaaaaacagttctctccactcttgcctcagatgaaatgaaaggccgtgaaataggaacccaggaaaatgaaaatgcagctcattatatcgctaaactttttaaagaaaataacctggaatattgtacaggaaattcttatctggtgccatttgactacaatggaaaaactgtatacaacgtttgtggaatcaaaaaaggaaaatctgatcagtatcttgggttttcagggcatttcgaccatatcggaaccagtaacaaaaacggtgataatatttacaacggagcagacgatgatgccagcggaatcaccacactcgtaggtattgctgattattttaaaaataaaaagcctgaattttctatggtttttatggcattcaatggagaggaaaaagggatgctgggttcaagagctatttcaacagattctaatctggatcatatttataataaaatgaccgctcttttcaattttgaaatggtagctacagaatcccaatggggcaaaaatgcattatatatgacaggagacggattctctgatcttgatgagcttttcaataaaaatgccgtaaacggattaaaaattaatgctgatccttatgcaaaacagcagctgttttaccgttcggacaatgtaagttttgtaaaaaagaaaattatagcccattcattctctacggttgatatgacgaaagcttctcattatcaccacgaaaatgacgacatcaatattgttgattttgataatatgacacagatcatcaataattttggaaagacattggataaactgagtcctaaaaattttgctccaaaatataatgaccaggtgaaattttaaggaaaccactataaaaggaaccgctgaataagcggttttttttattagactgctttgctgttttatctcttgttccggtacgaaagtttcgtttatttattttaaaaataaagtttaacagcccttagctgtaacaaaaaaacgatttttggaacatatccattaaagtaaaacaggattaagaacgtcttatcttttaattttacgtaattttgctatccaattttttcattgaatgaacgaatataaaaaaatcttaaagttcgcgaggccgcatcaaaaatatatctacggaagtttatttttcaatatcctgtattctgtatttcagattgcttccctggggactattctaccagttctgggaatgctttttggcactataaaacctgaaaaatatgagaaagcaccagtatattccggtgatattgttgattttttctcttatgtaaaagaatattccaattattatgtacagacactggtgagcaattacggagcacttactgttcttgcctggctgtgtatcattactgcatttatgttctttttaagaaatgcattccgttatttcggttctttattactgatcaattaccgtgtaggagtaaccaaagacctgcgtggagcgatgtacagaaaaatactttctcttcctgtttcatttttcacagaaagcagaaagggagacatgatgtcccgtatgtccaatgacgtaggagaagtggaaggaaatattttaggaagcttgattgaactgataaatgcaccttttatgctgatcagtacattggttaccctatttttcctgagtccggaaatgactcttttctcgctattggttcttcctgtgatgggaacaatgattgcattgatcggaaaaagccttaagaaagactcacacgaagcacaaagcgaactgggaaccatcttctctattgtggatgaaacattgaaatcttcaaaggttattaaaatattcaatggggagaaaatcatgaataacagattcatgcattctatgaataaatggatctcaagttctatcaatttaggtaaaaagaaagaattggcatctccaatgagcgaattcttaggttctattaccttcctgattattgcatggtatggtgggaaacaaattattgttgagcagagtatttctccggcagatttccttgtatttttaggaatgttcttccagatccttcctcctgcaaaaagtttatctacttctatttccaatgtacagaagggagaagcttccctgaaaagagtattggaaatccttgaagcggatgtaaaaattgaagaaattgcggagcctgtttctattacaacacttcagaataatattgaattcaaggatattggattctattatgataaagcaaatcttattcttaaaaacttcaacttaaccattcccaaaggaaaaacggttgctttggtaggacaaagtggaagtggtaaaacaaccatcgcgaatctgttagcgagattctatgacgtttcggaaggtgaaatccttattgacgggacaaacattaaacatttaaaattacaggaataccgccagctgctgggaatggtaacacaggaatctgtattattcaacgattctgtatacaacaatatcctgatgggtaaacctgatgccacgaaagaagaggtaattgccgctgctaaaattgccaatgcagattcttttatttccaatctttctgaaggatatgataccaatatcggtgatgatggaaacaagctttccggaggccagaaacagcgggtctctatagcaagagctgtattgaaaaacccaccgattatgatccttgatgaagccacatctgccttagatacggaatctgaaagattcgtacaggatgcgctggagaaaatgatggaaaacaggacttctttagtgattgcccaccgtctttcgaccattcagaaagcagactggattgtggtgatggaaaaaggtgatatcgtggaacagggaacccaccacgacctgattgcaaaaagaggaatgtatcacaaacttgttgaacttcaaaacttcgactaatcttttaatcaaattaaaatgaaccctatacaagagtatttctacagaatcggagagcctgaaagaagtactcttttgtttttgcgcgataagatcctggcttctgatccgaaaaacattacagaaaccttcagtttcggacttccgtttatcaaatacaaaaagaaaatgctgtgttatttctactacagcaaaaaataccaaaaacattatctgagtttttatcatggtgacagacttgattatcctgaactgatccaagatggcagaaagaagttcaaaatccttctcattgatgcggcagaagacattcctgtagaatttatattaaacctgatacaggagattaaaaagcatataaaataaaaaactccggcacgaatcatcgtgccggagccatctttaaaaaacttttatcattgtgtgtttattccgttgaattcagcctgttttattgcccaggcaatcatattagcaaaaaggattgaattctgaacctgcattccacctgctgtatatccgtttccggcgtatccgtaagaagacttctgaaccgggaagtaccctcctgaacttggcgctacaaaaggctcgatagtattacttggatactgatttccatttgcattttcattacttaagaatccaccgtcaccaaaccatataaagtttaggctggtatttcttaatcctgaaattcctgttctggcagttgtactgttgattggctgcgcgtagctgtaaggaacaaatccacttgtcaaccctgaaatatttactgtggtagaagcatcttcaccccagtttttccctcttacgtctccaaaaggtccgttaaggatgggatcatcagaattggtaagagcatacacagaacctgcaccgcctccatatgatgctgaaatggtaggatctgagaatattcctctgaatagattctgtgcagtgcccgtatcatctgtcatcgcaatgacaactccttttttattaagataggaagcaatataacctgcatctgtagcattaggtgtatagttgtaaccaatgataacaatatccggtttattattaagagctgtctgaagagcagctgaagaaggtgagttccctaatgaggtatgcgtaaagccttcatatttaacaatacttgaagcagtagtaccgaaatttgtcggagaatccatcagacttcttgatggaccggtataggcgctataaccgtaagctgtttctaatccgatatgaagaaccgttttcttaggaataacaactactacatttacggaacatgttgtagacactccaccctggctgtccgaagtgattgtaattgttttcaccgaggtagaagttggaattccttttccgctcaatgtaatattctgatttccagtggcagtaaatgttcctgacccactgaaagaaattccgtcaacagtattagttgtaaaagtatagcttcccagtgctgctacattaactggaagagtaattgtattggaagctgttaaagctgtaccaaccttgtatactccgtttaccgttgcacttccgcaactcatggtataggttcctgcaggacttaatacattcactgtaacagcaggtgtacatgtaacatctgtcccgttggcatttagtcctacggtatccacctgtatcgcaataggcgttccctgtcccggaacttggatagtttgcgttcctgtattaagaaaaacacctgttccgtagaaattatatccatttgttgtagtacctgtaatcgtataatttccaactttagttacgtttacagacacacttaaataattggatgctgtaagctcttttgtctgaacataggttcccattgcttttgtactggcacagtcgaccgtaaaaacagctttgcctatttgtccgcagacacttttccattcattatcagcaagactccagtaattaatacagtcctcagtaatgttataaattgtcaaaccatcatccttggcagtattaattacaatagcatttctctgggtttcagtaagccttggaataagaactcctttgttattatttcctgaaacaacatccaaaacggaatttgaattgggtgtggtagtattgatcccaacggcaccgttattagtctgtgaaaaaatttttccaaaaacaaagagcattgcaatcagcaagactttgatccggggcagtgtaaattttgtgtccatcattgtatatttataattgtttaatgattaaaattttcaactaagtcatttaaccgtcacaaaattatcacccacagacaattacagatcaattcacgctacgcaatactactcacgcgtagtaaaactcacaaaacattaataattacaatcacaaaaaaagcctaaataaaaaacagaatctttcaacaaatgctaaccataaattcaaaaacacaaacaaaaaacaatttaaaaaccattattacccatttattttaaacaataaaacagaagaattaactaaacgtaattccggttataatttaaaaatagttttccatttggtgattgtattccggcttatcttaaaatgatggctgagctgaagattgctaacctcattctttttctgatatctgagaatttttaaaatagattctttgtcataagatcgcagcctttgattattgaacccgactgtaaattccggttcaccaaaaatcagctgattaaatttcagaatatcaatagcagaatgtaaggtttccagcttaagcctgatagctgtatcaattaatttttctggaaacttttctttgagaatatcagtgtaaatctgtttgtaatcaggtatcatgttatatttttttcaaccatttatataaagttgtcttcggaattttatacctatccaccacttcgctggctgtcattgttccaagttctattttttcaaggatgaaatctttcacttcctgtgtgtagatgcttttccggaaaaccattgtatttccgtttttgccggttgtgttatcaattctcgcctgtggggcatataaaattagatgaccggtataaaatctgaagaaatcaaattttaaaagcttacaccatttcagcagaacatcggtatccatactttttgcctgatacatcatttctatttcatcatctgtcctgtttaaaaaccgggaaattctttctattgaaatctgatgctcttccactttgcatctgattagatttccgatatgaatgttcttaatattcattacaatatttttatttaaaaatattgactagaaagacaaaaaatatcatcagacactactcaacactacgtataagtaacaaaaatcagaatttattaaattttaataagaaagctgttgatattgatctcagaagagatgttcagcttttttcttatcctgtattttttgctctctacagcacgaatactgttgttggtacactgtgctattttcttggtatcaaaatcaagcttcatcaaagcacagaaatacagttcagaatgaataaggttgggatttatttttaatatatccgggataaaatgaggaaaaaatacctggaatttttcaaaaaacaccggagagttattttctgccagacttaagatttcctggatattttcttcagaaagatggttaatcaacatctggtgtttcatcagttccgaatttgtttttaccagatccttgatggtagaatccttcactttcctgtcggtaatcaagccatggataaggccatccttctgggtaataaaaacgatatccatcagaaaagaggctatggaaaataaaatattcaacagctttattgttttaaaatcctctttttctatgaatctgctttttggcaggaaatcaaaatcaaaatacaggcaggcaataaaattaatactgatgatgaatgtaataaaaaagattgtaagggagtcctgtttgtatttcagaaagaacggaacagcaaacagaagacaaaagtaaaaatattctacacctgcatttttgtaagtataaatatgaaaaaaacttacgataaatgtgagtaagacaaatatcccgataatgaaaggttttaaaacctttctgaaccgtttggtttttcctttgatggccatgaggagcagccagaagaaggtaataatggtaagaaatatggagatcagcatatccccaaaaaaagtaataataaaaatggagtaaaacaggaatatgaaaaacaataaaagcaaataccggttaataagatgaagataactactttcaaaatcatcatccatcttctcagcttcgtcgttaatcatcttaaagaaaaacttataaatcatcttgttgtttttttatgctctcacaagcttaagttggcatttgtactcctgaaagtataaattttccaatattaacagcctttcatgcaaaatagaaatctacaaaacgaaatgtatcagtctttttcagcattaaaaagaagatgattaaggtgtttttctagctacaatttactaaaattcgatattaaaattatcaaatgaaataccatttttgacaataaattaacaatcatttacctccaatcacttaaaaagcatgagcttgtgtttttaagcatgcaaaattattgttccttacggaaaagtataactcttcccatacgcaataatactcatgcgtaattaaactcaaacaacaaaatattacctttatacctcaaataaaaaagagagctttaaaagctctcttttgattttttatctacgataaggattttaattttctttcagtttggcaatcacatccaaacctccttttgtaatatctccgatcttacagataatttcagtatccagaggcagaaaaacatccattctggacccaaatttaataaatccgaactcatgtccggcttttgctttatctccttcattacaatagaagacaatccttctggccacgtatcctgcaatctgtctgaaaaccactttatgattggtcagagtctggattgctaccgtagttctttcattctctgtagaagacttttcatgccatgctaccagatattttccgggatggtattttttgtaaatcacttctcccgaaaccggatatctgcagatgtggacattcaatggagacatgaaaatggaaacctggattgcttttccttttataaactcatcttcttccacttctttgatcattaccacctttccgtccaccggagcaattacgttttctctgtggtcaagaatggtacggtccggaactctgaaaaaccagaagactaaactgtaaataaccaacaaaggcataatgatcagcagggaccatattttaaggaaataaatcgctaaagctcccagaatgataaaaagtatggtagcaacggttatcgttccttttgattctctatgtaatttcatgagactaaataaatttttctaaaataaagtacaaatatacgacaggaacgcagataataaaactatccagtctgtctaaaactcctccatgccccggaatgatgtttccactatctttcaccccgaagtttctcttcaactgactttctacaagatcccctaatggagcaaaggctgcaaccagaaatccgacgatcatccagtttcctctcaattcaggctgataatgttcaataaagtaagataaaaccagtgtcaagacaactcctcctgcatatccttcccatgtttttttgggagagattttaggagccattttatgtttaccgaagaatttccctaccagataggcaaaagtatcactgctccagatcagaataaacaggaacagaacctcgagagaaaaatgatcactataactggagaacttaggcaagcctaaagcaaaactgaacggcagagtcacgtaaatgaccgtaaaaataagtttcccgctgtcaaagtataattcgttaggatatttaaataaagtcaccacagcaatcccaatcagagcgagcgccagtatttcactaagcctgaaatcaaaaaagaaatcgtggttgaaatatcttttggagaacatataaaaaatgaagatgaccagtggatataccacccacttttcatacccgtttccaaatttcatgattttgacacattcccaggtccctacgatcagaagtaagctcattaggccatgataaagatattgctgtttgatcaaaccaggagcaatactgttcagcaattgcgctcctaagggagtagaacaaagaataatgatggctacataaacaatacctgatacggttctttgaatgagatttttgtccaaaatttaaaatttagaagtggttgcttaatcttcaagcagcaataaaaacagttttgtactggaattggaagaactgtccattttagactggcttccgctgatggaagtaaggttcttgatatttccgtttctttttatttttcccatagcatcattcaggttgtttacaatctgagaaacattggcaatgatgataattttatcaggaagcctggaagaatgatagtgaaggatattattatgagaaagcatgattctgccgtcataggcaatgaggtactcacaggtaatgaatgcggcatcattagactgctgcagttctgaagtataagaagtcttcacaacgtttagaaagttctgaagttctttatcccagcagaataaattgtggatgccttctattttgataatttgatttaaagtttgtagagcctccgcttcatctgcacaataattaaaaaatccccccgaatgcgtaaataattgcgcaaacttatagtcaagatccgcatttttcagcgaatccccaagcttctccaggctctgtttttcctcttcttcaggctggttggtaagtttgcttacaatcctcttgaataaattcaacttaatctatttttagtcaactttatacaaaaatagaaaataaattacaatagtattcaaaatatctctttaaatatgaaaaaacctggcaattttacagttgccaggtttttgataattctattttttaagagtcttaaagctgcgtcgggctttcaggagcctgaatttcgctttcttcttctttttctttgatctgaggtgctacctctgctattggctgatctttttcaggaatagtgttggtaacaggcttctctgtcaattccggatcccatgctctctttccgaaaatttcttcaagatcttcgcggaagattacttctttttcaagaagtttattcgctaaagcatccagcttatctttattatctgcaaggattcttacagctctgtcatattgattttcgataatcgacttgatctctgcatcaatttttgtagctgtttcctcagaataaggctttccgaaattatattcagactggcctgaactgtcatagtaagaaatattaccgatattcgggcttaatccatagatcgttaccatagcctgagctctcttcgttactgtttcaagatcagaaagtgctcctgtggaaatattattgaatattacctgctctgcagctcttcctcccagtgttgcacacatttcgtccagcatctgctcagtagtggtaagctgtctttcttcaggaagataccatgctgctcctaatgaacgtcctctcggaacaatcgttacttttaaaagtggagatgcatgttctaccagccaggaaattgttgcatgtcctgcttcgtggtaagctactcttcttttttcagaaggcttgatggctttgtttttcttctcaagacctccgatgattctgtctacagcatcaaggaaatcctgttttgtaactgaagtatgattatttcttgctgcgataagcgctgcttcgttacaaacgtttgcaatgtccgccccactgaatccaggggtttgcttagcaaggaattctctgtctacattatcatcaagtttgatctttttcaaatgaacatcaaagatctgtcttctttcgtgaagttccggaagatctacgaaaatagaacggtcaaaacgtcctgctctcatcaaagctttatcaaggatatctgctctgttggttgcagccattacgataacatttgtatcggttccgaaaccatccatttcagtaagaagctggttcaatgtattttctctttcgtcatttccgcctgagaaattattttttcctcttgcacgtccgatagcatcaatctcatcaatgaagatgatcgcaggagatttggctttagcctgagcaaaaaggtctctaacccttgaagctcctaccccaacaaacatttcaacgaaatcagaacctgaaagtgagaaaaacggaactttagcttcccctgcaacagcttttgccaataaggttttaccggttcccggaggccctaccaacaggactcctttaggaattttacctcccagtttagtatatttttcagagtttttaaggaaatccacaacctcctgaacttcttctttcgctccttccaatcctgcaacatctttgaatgtcacctgaattctttctttttcgtcaaaaagtttcgctttggattttccgatagagaaaatttgtccaccgggacctccgccaccgcccatctttctgaaaagaaggaaatagaatagtcctaaaattgaaatccagaccagtgcaggaactaaaatatccattaaggcacttttacctgttccgtaatctttagttgttttgattgccgggttggtcgctttgatctgttcaaatttttgaaggaaaagctgaaggtctccatattttacagaaaaatctgctttaggagccatatctaacgccgaaaaagggttgttttcttttccggctttggaaaccattgccgattttgcttcttttgtcaggaaaacatcagctttctctatgtctttgtatataattatattctggactttccccgcctgcatttctctaaagaaaccatcttcatcaatagattttgcactgtcacctccaaggaaattggagccaaagaatagcaaaagagctatgattgcaataggaaagaaccagttgaatcctttattattcatttaaactttttaaaatttttattattcattttcaattctggtaatgactgcgtcaccccaaagctcttctatatcgtagtactcacgtacctgtttctggaatatatgaaccaccactgaaacgtaatctaccagtacccacatcgcattttcagcaccttctacgtgccaaggtctgtcgtgcagttcgtttcttacttttttctcaacacttcctgccaatgcagccacctgtgtatttgagtttccactacatattacgaatgtttctgctacggagttttcgatgttggaaagatcaaagatcataatatcttcaccttttacgtcctggatagcttcaacgattttatctattaatgcttgtttttctgctgttttattcattaaaaaaatactataatctgcaaatttattgttttttctttactttaaccttacttttaccctcttaatgtcttaaagttttcttaaatgagccaactcttctacctgaaagaatgttcttctactaatgacgaaatatcaaagtttttactttacgaaaattcagattttacaggacttcatacttttaatcagactaaaggccgtggtcagtatggaaatacctggactcagactgccggaaaaaacctggcgtatacgctggcagtgaatactcagaacatcttgtgctctgactttatattcaattactataccgcaatgataatccgggatttccttgccaaattgtctgactcagaggtaaaaatcaaatggccgaatgatattatccttaaaggtaaaaaaatcgttggaattttaatagaaaagaaaaaatttaatcaaaataattatttcatcataggagccggaatcaatattctgcaggaaaattttgatgaaatatccaacgcaggatcactcctgacgcaaacaggaaaagaatttgaccttgaagtccttgcccaaaaccttcatgaattcctgtctgaaaaactgaaaaacattccatctgatcaggaaatactggacggattcaataccaaccttttcaggaaagatcagatatcagtctttgaaattgaaaaagagcgacaaaatggcatcatccgaaaagcagacgaaaaaggtgaactctggattgagctggaagacgggatgcattccttttatcacaaggaagtaaaattactttactgattggctcttttgatataaaggtaaagagtaagcggaaggaatacaagattgggcagccacattgctaatgccggagacaaacttttattttccgaaactacctttaaggcttcaaatgaaaatacaaaaataaaggctaatgaaatccctatcgccaggttaattcccaatccacctcttttcttttgcgaggacagggaaagggccaggaacgttagaatgatgattgatacaggcattgaagttctttgatgaagctcattcaggtaagaattgagattgctgtttcctctttccttttctctttcaataaattttaaaagttccggagtggttttattctgccccaaaagctcgttcgggaaaagctcttccggggaatgcccatagtttttccttaattctattccgttattaagcttttcagaattgtctttattgattgttttttccaaataattatttaagacaaactgctttttgtctttatcccaatatacttcactggctttcagctcgtaagtcattttcctgtctttatcatatttctgatagacaaaacttgatcctcttttttctcttttattccaggaatcaacgaagatatattcggttttacttagctgtgaagatgccggagcggttcctaagattttttctttattggctgcattataggtataagcttccagctcatttttcttgatattagcccagggaagtaccatatgatataccaccagggcaatcagaccaataaaaatagaagtgagaagataaggttttgaaaacctgtgaaagctggctccactactgatgatggcaacaatttcggtattatttgccattctggaggtaaaataaatcaccgaaataaaaaccaggatggaaagaaaggtcaccaccagattaataatccagaagggatagaaatgaatcaggaaatacatcagatccagtttcggatcaatggctttggcattttctatccttggaattttctgctgtacatcaattaccaggacaactatagacaacaatacaagcatgaaactgaaagttccaaggtatttttttatgatatatctgtctacaattttaagcatatttttttatagtctttgtctgagaaccggtactacagagtttttccattcatagaagtcacctgcaatgatatgttctctggctacttttaccagatccagatagaatgcaagattatgaattgaagcaatctgttttgccagatattctttagatacaaacaggtgacgaagatacgcttttgaatattcacgatctacaaagctggtcccgaattcgtccaaaggagaaaaatcacgcttccatttttcatttttaagattcatcaccccttgccatgtgaaaagcattgcatttcttgcatttcttgttggcattacgcaatccatcatatcaatccccagccctatagattcaaggatattccaaggagttcccactcccatcaggtatcttggtttttctttaggaagaatgtctgttacttcatctgtgattctgtacatttcttcttcaggctctccaacggaaagtcctccgatagcatttccttctgctcctgcttcggaaattacttctgcagagatttttctaaggtcagaataggtagatccctgaacaatcgggaaaagtctttgcttgtgtccgtataattcaggattattgttggtccattcaatacatcttttcagccatcggtgggtaagctccatagatgattttgcctggttataatcgcacggataaggagtacattcatcgaaagccatgaaaatatcggctccgatctgtctttgaatctccattgatctctccggggaaaacatgtgataacttccatcgatatgagacttgaatctcgccccttcttccgtcatctttctgttactggccagtgaaaatacctgaaaacctcctgaatcggtaagaataggaaggtcccagttcatgaatttatgtaaaccacccgcatcctgcatcgtctccataccgggacgaaggtaaaggtgataagtatttcccagaatgatctgggctttaatgtcttcttttaattctctctgatgaactgtttttacacttgctacagttcccacaggcataaaaataggcgtctgtatcttcccgtgatctgtggtaatttcccctgctcttgcttttccttcagaggttttttctatattaaaaaatttcatctctatacttttttaatgcactgttttatcagtgattccttgcggacagaaacctgtatgctcttttaccttactaaaggcattacagcaccattctgttttattttatcctttacgtatttatctgctttgggatcttttttcagtaatatttcctgtgcatcattagcaatcccatccatttcttctttaattacatagtatttgaaactgtctacaaaatcatcaggctttaccttatatgatttcaggacagctcttgtacctgcttccatatttttgtcaggatatacatagatagcctgatcattgatcgcaagatcagcaattatttctgccatcatacctttatcaatcaggtttttaggcttatcaatataatcgccacacgaaaacagccccagcaaaacgaaaataaggatcagctttttcatcagtttcatagtctgttgatgattgatttccattttaagttcaatactccgaaaacggcctcatggataattccgccgttcattttgctctctcctaaaattctgttggtaaatataatgggaacttctacaattctgaagccttttttaaatgctctgaatttcatttctatctgaaacccgtaaccttttaattttacattatccaaccctatttcttccaatacttttcttgaaaagcagacaaatcctgctgtcgtatcatgaattggcagtcccagcacaaaccttacatattttgatgcaaagtaagaaagcaatactcttcccataggccagttcaccacatttaccccttttgagtagcgggaaccgacggccatatctgcatttaaacaggcttcgaaaagtctcggcaggtcattcggattatgtgaaaaatcggcatccatttcaaaaatatagtcatatttattttcaatagcccatttaaacccatgaatatatgcttttcccaaaccatctttcacatgcctcactgacagatgaagataatgcggatatttcttctgcaattcctttacaacctctgctgttccgtccggagaagtatcatctactactaaaatatgaaagtcatcttccaaagcaaaaaccgcggaaataatattttcaatattttccttttcgttataggttgggatgatgacgagttttttcatttcagtttgcaaagatagtttatttaacctttttattttatacaaaataatctataattttgcaaaaatatttctcggggattaagcggatgaaacagaaacttttattcaacagatctgaacaatacgtaaaatcgatgagagcaaatattttaactgcagattcatggatcaggtgataggaaaatctatgccgcactgtgtaatccgaagttaaataataaataaaaaacttaaattttgccatcatcacaacaacacttcatcaatcacgtaagaatacctgagaataatgattgggtaatcttcatccttgtgggctgtatctttttgtatgtttttatgatgaacgtcatagaaagggatgccagcctcaaagattttctgcttcagaaatattttgatgcaagtaataaccttcccagctggatgattacatcctgtgtaaccactcttaccctttctgtattaatctcacaatatgttcctgttgtaccgaaatttattgcggatcttcagcttttaggatatcagcttaataaattcgggtatactttgctggttgtgatgtttttttatttaataaaatccacattagggtttttattttatcaaagtatcggggatggaaaaaaatggactattttttattttacctccacaaaattttatttcattctttcttttttactgataattctttgtgtagcccactattacttcccgatagacagaaataaaatgtttttatattatttctgcttcttttcttttgtattcattttcaaggtttttttctatttatttcacaagaacaagattcttccggagaaatggtattataaatttttgtatatttgcaccctccaaattgcaccattattattgctttggaagttgttatttttttaataaaagtcaatgatgagaataaagtctatattggtttctcaaccagcgcctagtgagtcttctccatatctggatatagcgaagaaggaaaaaataaagattgatttccgtccatttatccacgtcgaaggggttgacaataaagagctcagaacacagaaaatagatctgacgcagtataccggtattatttttaccagtaaaaatgcgattgaccattacttcagactcgcagaggaattgcgttttgccgttccggatacaatgagatacatctgccagtcggaagcaattgccaactatcttcaaaagcatattgtgtacagaaaaagaaaaatcagctttggggagaaaaatttctcagacctgcttcctcttttcaaaaaattccctactgaaaaatatctgttgccatcttcagatgttttaagtccggatattgtaaaaaccatggatgcatctaatgtagactggacaagagcaatcatgtaccgtaccgtatgcagcgaccttacagatatcaacgtcaaagattatgacatgttgattttcttcagtccacagggaatcaaatcactgcaacaaaatttccctgacttcaagcaggaagaaaccaaaatcggagtttttggaaacacgactttggcagcggcggaagaagcaggattaaaagtagatttaatggcgcctacgaaggaaactccttccatgacaatggccctggaaaagtatattaaagcacttcataaatagtctttactataaaaatacaatcaaccatcttttcaataaagggaagatggtttttttttacctaaatttgaacaaaaattaatattgaattgatttatacttaaattacttagtttcagaagaaaaaagtatagaattccaattcgataaaaaaataaaataccccggatgaaagctccacaggcaaaaaaaattgaaaaaatactagaaacccacggcgataaaagaattgataattatttctggctgaatgaaagagaaaaccctgaagttatcaaatacattgaggaagaaaatgcctacgcagaatttatcatgaaagatactgaagctcttcaggaagagcttttcgaagaaatgaaggcacgctataaaaaagatgatgaatctctgccttatttctttaatgaatactggtatattgtgcgttatgaagaaggcaaggaatatcctatcttctgcagaaagtataaaagtcttgaaaatgaagaggaaattgtacttgatgttaatatactggcagaaggagaaaacttctttgaagtaggaagtgtagccgtaagtcccaataacgaacttgcttctttttcatcagataatgtgggaaggagaatttacacactgaatttcaaaaacttaaaaaccggagaaattcttcctgatacaattccaaatactacaggaaaagctgtctgggctaatgacaaccagcatattttttatatcagaaaagataagaatcttcgtgcatttcaggtatacagacatcaattggggacagattcagcggaagatgttctgatctttcacgaagaggatgaaacgtttgatgtaaatgtgtttaagacaaaatccttacaatatatttttattgcaagctcaagtactatttctgatgagcaccgctttattccttctgacgatgtatttgcagaatggacggtgatccagccaagaatagacgaccttgaatattcagtagaacattatgaagatgagttttatatcatcaccaacgcggatgacgccatcaatttcaagattgtaaaaacaaaaattgataattgtggtatggaaaactgggtagatgtcattccacaccgtgcagaagttttgctggaaggttttgaaatctttaaagattatcttgttcttgaagaaagagaaaaaggattgcttcagatcaaaatcattgatgagaccacacaggaatctcattatctgcctttttctgatcctacatacacggcttatatcggtgtcaatctggaattcgatacagaaattttacgttacggttatacttctcttacccagccaagctccacttatgagtataacatgaaggataagactacaaaactgctaaagcagcaggaagtcctgggcggaaaatttgttcctgaaaattatgtttcggaaagaatatgggcagattcaagggatggtaaaacaaaaattcctatttctttagtgtatcataaaaataccaaaaaatcagctgacactcctcttcttctgtatggatacggaagttatggacataccgtggacgcaagcttctcaaatgtaagattatcgattcttgatcggggatttatttatgctattgctcatatccgcggtggagaatatctgggaagagaatggtatgaagacggaaaaatgctgttcaagaaaaatacattcttcgattttattgatgcaggaaaatatctgatcagggaaaattatacttcttcaagacatatgtatgcgatgggaggaagcgcaggaggactgctggtaggtgctgtggtcaattatgagcctcagttatttaacggaattgtagcacaggttccttttgtagatgttgttaccaccatgctggatgatactattcctttgacaaccggagaatatgacgaatggggaaatcctaatgacaaagaatactatcattatatgaaagagtactctccttatgataatgtagaagcaaaagattacccaaatatgctaatcacgacgggattccatgactctcaggtgcagtattgggaaccggcaaaatggaccgcaaaactgagagagctaaaaacagatgataatattttaatttttaaaacggacatgagctccgggcacggaggggcaagcggaagatttgaatccctgaaagaagatgcgttggaatatgcatttctgttgaaaataaatgataattcataaaagataattgatatgaatacagacaacaactacaatcaaatgcttgcacaaaagaccaaatctttaaccattgctatcattaatgagttgtctgaaatttcatattctgataaaatatcaaatataagcaaacaagtttttagatctgtttcatcaacagccagtaactatagagcaatgtgcagagccagatctatcaaagaaaagtattctaaaatctgcattgttgtagaagaagctgatgaaactttattctggcttgagctaatagatgagctccatttacttaaaaaagaaaaattaggtattcttattaacgaagccactgaaattttaaaagtaacttctgcttataaaaagaaattaagtgaagaattaaaacgttaaatcatcaattattaatcatcatttatcaattatatgaacgagtccgaatattggaaaaaaatagaacagttcttcgaagacaactttcagacagagaagaaccctcccattgaaacccttttatttctaatagggttacaggagctgggaagcggtcagcaaaaatatacaaaagacgacaaagtaaacctgattcacattgctgtgtgcaggctgcttgagccttttggatattataaattcacccattatgaagacggatggccgcagtttgataaactggaagaacttccggaattaaagccaaatgagcagaccctgctgatgaaaaaggctattattcagtattttcaggaggaagagctcttgtaaaagcaggaagcgtgaagatggaagcaggaagttaatccctgttgataaattaaaagagggttttccaatggaaaaccctcttttttataaataagtatttttacatcttcaaattcatccaatcaattcttccagctggttcaatcccatggtaaatccctgttcaaaacccatatccagcatctttttcattacttcctcagactggtagtgaatattaatggttactttggttccctcttccactcctgtaaagccgatcagccattttgattttggaaaatcttcgttgacattgcctttctcatcacagaaagcactcatccagtcaagacttctgtgctctgtaatttctccgtattcagaacgggaatatcccttttctccgttaggccctaccatggcgtaaaaccagatccctccttctctgaagtcctgacttactgtctcacacctccagggtttaggtccccaccattgatccaataactctgccttcgtaaaatgattccataccgttgaaacatcagccttataaattttcatgacataagtactgagcgcatcaaaatctttgttgaaaataatattagattccatacataataatttttattaaagttaggactttatttattgaaaggacttttcatatgacaagtaaaggataattcataaataattgttaaaaaacactcttttaagaaaaaaaagacaattttttggctcgttttttgtttacgtagtcttaaaacaattaattttaacattcatctttccaaaacatatataattaaataatgaataacaaattcatcccaataatttcggtgtttatgacaatctcactgattgtctttgtgacgctccaattttattggttgaaaggctattacggcgtactggaacaggatttttcaaataaagtgtatgcggttttggaaagtacttcaaaaagtattgaagagattgaagctgacaaatacctgaatcaggattacaaagatttcagaaaaaatattattgccaacagtaagcagccatccttaactacgattcagcaggtggaagactccggcacccagagacaaatcatctactccaaaaatattattgaaaaaacgcagcttccgatttctcaaaagggagattctattaagctgacaacattatatacagacgaggcagcctacaaaataaagagagatacgaccaatcgcgaacttcttaccacggatattaaccaggaaattgaaaccggtgattattccatgaaggagtttgtaaaggtatacggaaataatcttcccattaccaaaagagttgattcgaaaacgcttgattccgttattgcgaaagagcttaaaataagaggaattacagctaaattcggatacggagttcttgaccgtaacaacaagcttacaagtatagcaaacaaagcttacaaagagaaaaaagacagcaatacctacagcttccctttatttgcagataagaaaaataccttatacagccttgcattggtattccctaaaaaagaatattccctggcgatgaacaactggccaatgctgctcggaacattcctttctcttcttaccattcttgggatttatattatttccatcaattatatgatgaggcagaagaagcttgctgaagtaaaaaccgacttcatcaacaatatgtcccatgagtttaaaacaccattggcaaccatttctgtcgcaacagattcattggctaatgacaaaattgctaccaatccggataaggtgaaatattattccgaactgatcaaacaggagaatctgaggatgaaaaagcaggtggaaaatgtgcttaatatgtctaagcttgaaagaaatgaagtagaacttttcctaaaagaaaccaatgttagggagcttatcaaaaaaactacagaatctttcaatctgattgtacagcaaagaaacggaacccttacacaggagttcaatgccactcattataattttaaaatagacgaattccatatctcaaacatgctggtcaacttactggataatgccaataaatattctcctgaagcaccggaaatacatgtgaaaacaagaaatgaaggacactggtatgtgattgaaatttctgataaaggaatgggaatggatactcagaataaaaccaaaattttcgagaaattcttcagggaagaaaccggaaatatacacaacgtaaagggacagggattaggactttcctacgttaaaaaaattgtagaactacacaaaggacagattatcgtggactcccataaaggaaaaggaagtacgtttacgatcaagctgccaatgagctagaaagataaatgacagatgataagcgataaatgataaaaatctcttttacatcaattatcaacgatcattcatcaattataaaaagtaaaaccaaatatcaaaatatagaagatagagtgagaaagttcattcttaattgttaatttttaattattaaaattatgagcaacagaatattattagtagaggacgatcagagtttcggggcggtgcttaaagattatttgaccatcaataattttgaagtaactcttgccactgacggggagcagggacttaaagaatttacagaaaatgaattcgacatctgcatatttgacgtaatgatgcctaaaaaagacgggttttcattagcggaagacgtaaaaaagattgataaaaatacaccgatcatattccttaccgcaagaaatatgagagaagatatcttaaagggataccagttaggcgctgatgattatatcacaaaacctttcgatactgagcttcttttatacaaaatcaaggcaatccttcagagaagttccactttggaaaatgaagaacaggagcagttcaagatcagcaatatcttctttgattctatgctgagacagctgaaagtaggtgataaggaatacaagctttctcctaaagaaaatgaattattgaagcttctttgcattcacagaaatgatttcatgccgagagatcttgctttaagaaagatctggaaaaaagaaaattattttacggcaagaagtatggacgtatatattgcaaaacttcgtaagctgttaaaagatgacgagggattggaaatcatcaatgttcatggagaaggatttagacttttggtaaaaaattaatccaaaaatcaaattataagtataaaattagcaaaacaattgaaaatgttttgctaattttgttttcatacccatggatatgaagaatacatttataggtttgatcgccgtatcactattagctgcatcctgtaaaaaggatgaaagagctacttatttaaaagaagaagctaacgccggacaaccgaacgtagcctttaataccacatcaaaaacagcgctgatggatcaggcaggcattcagtctaacccaacccccgctcctatggctacagctccggggatgaatcctccacacggacagccgggacaccgatgcgatattcctgtgggacaacctttgaacggacaacctgctgcagctgctccttcaacacaaaatgtaaatgtgaacggaggcaacaccatacagattgacccgaatgctttatcacctggaaaaattacccttgataacaacggaaagcaagtaaaaacggctccgggaatgaatcctccccacgggcagcccggacatcgatgtgatattcctgtagggcaaccattaaacagcaagcctgctccggctcctctacccgctcaaaatgcagtacagacaactccggccccggctcctgcacctgctgcacagaatctcgcaatgggagaaaaaccaaaattaaatcctgcccatggtaaaccgtggcacagctgttctctgaaagttggtgatcctttgccataaatttcttatttttgcagacatgaagctgtttcacctacttgcaatagtattttgtctgggaatctttctggttcccaaggataatttctatgcgcagggaatgcaggaaacatgctgtaaagcagagtcttccaagaaaatggactgctgtaaaaatcattcttcaaaagaggaaagcaaacatgataaaacaaaatcatgtaatgatgactgttgctcatcatgtgttgcctgctacacttttattgaaacccctttctcaaaaaatctacgtttggaactgtcttattacaaagccaataagaatcctcagtttcaatattcagacccttatctctcagaccgtttaaaagaaatctggcagccgcccaagataggttaattaaaatatccagggttcattatgtcgtatagtgaactgttttttaattaatttaaacttttaaacaaaatgaaattatatatttccaggttgatacttggtgcattattcttatttacacaattgatatctgctcaaacactttcaaaaaatcagttcaaggtaaaagggaactgtgaaatgtgcaaaacaagaattgagagtgccgctaaaaaagcaggtgccaaaacagcagtttactcgattgatctgcaaacattaacattagaaacagacaaggtatctgctgatgatattttaaaaaaagtagcagaagccggccatgataatgagaaattcaaagcttctgatacaacatacgaagggcttcctggatgttgccattatgatagagatctgcagccttcacaggcagaaactcatcatgaacatcattcagactctaagatttccagtaaaaaagaaaatgaattctatgtaagaggaaactgtgcgtcatgtaaagccagaattgaaaaagcagcaagagaagccggtgccgatactgctgaatgggatgcagagaaacaaacagttattttaaactttgatccgttaaaaacctcatcagataaaattttaaaggctattgctgatgctggtcacgacaatgaaaaatataaagcttcggatgctgtttacaacgcacttccggcatgttgtctgtacgacagggattttacttttggtgaacctaatccaaaagcacattacgaagaagaaacaaagcatgaagatcataaaaatcatgaaacctcatcagctaaagaagatcattcccagcatgaaaaaagtattggtggaattgtcgtcaccggttctaaggcggcaacagctttaagtaagaaagaagccgggcttgtttttaatattgataaaaaagagctgttaaaggcagcctgctgtaatctgtcagagagtttcgaaaccaatgcaacagtagatgtttctttcagcaatgccgttacaggaacaaaacagctgaaaatgcttggtctggatcagaaatataccagcttaacaaaagagcaattgccagaaatcagaggcttggcttctgcctatggtctaaattttatcccggggagatggattgaaagcatccagcttaccaagggaggaagtactgtgacaaacggatatgaaagtatcacaggacagatcaatactgaacttttgaagaatgcaaagacgccggaaacatccctgaatcttttttccgatttcaatggaagagctgaaatcaatattaccaatgtttctcctatcaacgataaatggtcacagacattcctcctgcacggaaacggaactttcggaaatacggatatgaatcatgacggctttctggacagaccgaaaggaacgcagatcaacgcagcgtatttgctgaattataacgatcttgaaaagtcggggttcgggtctcacttcggaattaactttatcagagatgaaagaacggcaggagaaattggttttgataaaaaactgggccaggacaaacagcctttttatggagtaggcatcgatatttcaagatttcaggtctggaataagacaggatatatttttaaaggaaaaccttatcaaagtatcggctggatgaatcagtacgtttatcatcagcaggacagcttttttggattgagaaactattccggacagcagcatacctattattccaatttaatctttgaaagcatcattggaaataccaaccataagtataaagcaggagcaagtttcttatatgacggttataaagaaacgtatttactgaacgatctgagaagaaacgaaattgtaccgggtatttttgccgaatatactttaacaggtttaaaatatactttggtagcaggttccagagtagattttcataatctggcaggaactcagtttacgccaagacttaatttcaaatatgacttcacgcctcagacaattttaagactttctgcgggaagaggtttcagaacagcaaatgtatttgcggaaagccagcagtattttgcatcaaacagggctatcaatattttatctaacggaggaaatatttatggattaaagcctgaaattgcatggaactacggagcaagtttacagcaggaatttaagttattcggaaggaaatcaagcattattgcggacttcttcagaacagacttccaggatcaggtattggtagatctggatcaatctcctcagcagctgacattctataatctggatgggaaatcttttgcgaattcatttcagacccaatgggacttcatgcctgtaaaaaatcttgaggtaagactggcttataaatattatgatgtacaggcagattatatcggtggaagaagagaagttccttttatggcgaaacacagaggatttgtgaacttggcgtattcaaccaataagaatgataacggcgggttctggagctttgatactactttaaactgggtgggaaaacaaagacttccggatacatcaacgaatccggcagagtttcagctgccagcctattctgaatcttacgctgtgctgaatgctcaaatttcaagaaatttcaataaaaagatcagagcatacctgggaggagaaaacctgacttcttattatcagaaaaatgcgattgtagattttaagaatcctttcggaagttattttgacggcggaatggtatacgctcctattatgaaggcaaacttctatgtgggactggatgtgacgttttaaaggctggaagcttggagaatgaagctgggagtaatgctagtcggtaatgttcttattttgagacaaattactggaaggtattctctgactaaaacaaaaccttataggtctttgagacctataaggtttatttttttgctactagcttatagatatataaataatgaaggagaataaaaacttctgatcacttccagaaacttccttcttccagcttcaagcttcctgaccccaaaaaaaaacagcttcaaaattgaagctgttttttgtattttatcttccaaagtcatcctgaactcttacaatatcatcttcgtcagaaggattggatgcatcggtatgttgccagatttcagcgacaattccccaacctgcaagaccgattaatctgtgtctttctccttgctgaagtttcacctgatcttttggaccatattctcctaattctccttcttcatcggtattacttcttttgatgcctacagttccttccactacctgccagatttcggctcttctgtggtggtactgccagcttaatcttgcttcaggggcaacaataagaattttcgggcttagcttccctcctattctaaggctgtctacatcaattccgtcaaaatactggttggcgaagtcctgtgcctgtgtttcatcaatcacaaagaaacctccccatggccttgtatcatcttttgcagcgatcgtaaaaccctgtgtctgcagcatattctctactctttcgaatatttcttttttttctgtactcatacagctatatttttaattttaaaattatttatttgattcttcttttgacattgaatacggaaagtctttttcctgtgaacctctttctttattgggtttactatccattttaaagtctaaaacagctcctttcatcagttctttatgacttagccagtttttggaataaggctgctgatttacattcaatgattttacatataagttttcagcagtattttccggagcttttatttcaattttcttaccattttccaaatggatggtagcttctttaaacaaaggtgctcctaatacatactgatctgttgcaggtgttaccgggtaaaatccaagggctgagaaaatataccaggcagaagtttgcccgttatcttcgtctccgcaatatccgtccggtgtagcatgatataatttattcatcacctgtctcgcccaatattgggttttgtaaggcgctcctgcataattgtacagatagatcatgtgctgaataggctggtttccgtgggcatactgccccatattcatgatctgcatttctctgatctcgtggatcacacctccataataactgtcatcaaaaaccggaggcaatgaaaatacctcatctaatttggcttcaaatttcttttttccacccatcagctctgccagaccttcgatatcctgaaaaaccgaccaggtgtaatgccagctgtttccttcggtgaaagcatctccccatttgaaaggattgaaaggtttctggaaattaccgtctttatttttcccacgcatcaagcctgtctccttgtcgaatacatttttataattataagctcttttcttatagatatcaatttcagaagcgggtttccctaatgcttttcctaactggtaaatagaaaaatcatcatatgcgtactctaatgttctggctgcattttcattgatatttacatcgtaagggacataacccagttcattataatactttacccctgcacgtcctacagcttctataggtccttcattatctgctccatgttttacagcctgccaaagcgcttcaacatcatacccgcgaagtcctttgatataagcatctgccactacggatgcggaattgtttccaatcataatatcggaatatcccgggctgctccactccggcaagaatcctccttctttgtaagcattggccaatccttcctgcatttctacattgatgcttgggtaaacaaggttcaggaaagggtacaaagcacggaaagtatcccagaaaccggttcctgcaaacattcttccgtcaacaattttaccattataagggctccaatgttttattttgttttgagcatcaatttcatataacttttgcgggaagaataaagttctgtataaagaggaataaaaggttctcatctgctgatctgttcctccttttacgtctatttttcctaatgttttgttccagatatttttagcatcggttttcacctgctcaaagcttctggtaccgatttctcttttaagattcagttctgcctgttcaaagctgataaatgaagaggctacttttgcataaaccgtttctttatttttaagcttaaaacctactactgctccggtatgatcactggtaatttctaattgatcattcaccagtttatcatctttccaggtttttgtgagttcaaagtctttatcaaactgaatgacaaagtagtttctaaaattctcatatttccccgtagaatatctcgttgtgtatcccaggatttttctttctttcggtaaaattttgatataagagcctttgttcagggcatccacaactacataagcactatctgttttgggaaaatcaaatttaaaataagaagctctttctgtaggggtaaattctgttgtaacattgatgtcagccagataaacactataaaagtatggagtagccacctcagctttatgactgaaccagcttgctctttcgtcttctttaaatttcacttttccaactcccggcatgatggcaaatgcgccataatcattcatccatggagatggctggtgggtctgtttaaatccttttattttatctgcatcgtaggtatatgcccatccgtcacccattttaccggtctgtggcgtccagatattcattccccatggaagtcctacagcaggataggtatttccattggataatgaaggtttggattgtgttcccatcaaaggattcacataatctacgggagatacattctgacctaaagcccaggcctgtaatagcagtaagcaagtggaaaatataaacttcattgtatcttttcgtttgttaatttataaaagcttttttaatgcatagctggcagctccaagaatggccgcatcttcaaatatggctgaaattttaacctgcaagttaatattattctttgttaaattctgaataaatcgttgttcaaaatgaggataagccttggcaatatttcctcctataactaaaacctccggtttgtaatgatccacatatttcacaataaattctgagaaagagtctgcgtattcatcaaacattcttttctgtatttccgctggtttattcagaaggtcttttgttcctgaaatttcttcaccagtaagttctttataacgattcacgaaccagcgcgtcgccagatattcttcactgatagagtctttaaaaggagaatcccacaagtcttcatcggtagctaattctccgttatagaaagttgttcccaatcctgttccaagagtgactccaaatatcctgttgaatccctgagcacaccctccgaatacttcaccttccataaaggctgccgcatcgtttacaaaatgaatctgtttctgagaaatagccagtctcttcgccagttcttccttaatatttacctgatagatatcgataaattttccatgctgcataagggatatcccattttcataatcgaaaggtcccggcattgcaataccgatcaggagatcttcttttaccagatcatgagccactttatgaatggctgaaacccatgcttcaaaaataacttctttattttcgaaagcatctacatgttctcttacataagtggaagaaataatttcacgtttttccggatctacctgagccagcgtaatgtgcgaccctccaatatcaattcctactatattctgcattattttttatttttaatttcctgtgactgaaaaaacagacaaacagaggcatcctcctgtctgtctgctttgtatttcagactttatattttcaattctgataactacatcattatctgaattttacttcacgattactttacccgttgatagtactttattgtttgaggatgtaattttgtaaatataagtaccgctgattaaatcctgcgtattcactgcattattattttgattaatattctgttttttgaataattttcctgaaatatcatacaaggctatctcagttgccgaattatcactaatagcaaagtgaatgtcatttcctctttttacaggattcggatacagtgtgctgttctcttttgcagattcaagatcttttaccgcaagagatgaagtacaggcaacgtctgttctccagttcgcatctgtcatattgatcagggttgcaaaatgggtatttgccgtagcatccaaagctcccattccactgccttcatccattttccaattggcttcaagccccgtggaattgggaggaacattacagctgttacttaaaatttcctgtggggtcagtgctcgtttccaaactctgaattcatcaaggaagccgttgagtgtacgggaattgtcatagtttcttcccagataaagaattccgtttgctgtaaagtttccggttacagcaaaggtcgcatcaagattaccgttgacataaattttcatggttgcaccatcataagtggctgctatatgataccatgtattggtgttgaatgctgtattcgtattcaatttcacctgtgatgaaccgaagctcaaaatgaattgaagcttattattcgcgaggtttccgtctccgaaacgaagcatcgcagagttattatctcctacttccactcccaatactgatgaaatgtaagggaaagctgttttgaaagcatttacttttacccagccttcaaatgtcactgcatttccgctcaggttaaattgtcctgcattaagatagtgcgtgcttccgttaaaagaaagtgatcttgctccgggacttgtaaccggtgcgaagccactattaaatgatccttctcctgaataggtacttgcagttcctcccgcacatgaagcctgtactttccatacatagtttgtattaggcgttaaattctgtaatgagtaggagttggtggtgatattcggaatttcagaccatgatgttgctgaagctgttttgtattgcaatgtatatgaagtagcatttcctgcatcccatgacagttgtgccgtattaccaaggaaacctccggaagttaatcctgatggtgtagtgcaaccacttccggagttaaaccttggtgcaaaaatataagtacttgttaatgtcggtgagcaattggactgaattctccagtcataatctgtattcagggtaagattattgatgacaatattatttcctgaataattgctggctacattcgtccatactgttgagttgaccggtttgtaatcaatattataagattgagaagcattggaaatccagttcagttttgctgaagttcctgttacattggaaacatcaagtcccaatggcggatcacaggtttgcccctgagaccatgaatatagctgaccgcttaagagcgtattttcgttgtaaaggatattggaacctgtgctcagataactggctacattagttcccggcaaatcataccacataaatactccatattggtcattcttggtgctggtcgctaagcttgccaatgttgttgcagatgtagaacctggattcgagttttggatccatgttgctgcagcagaaattttagatttatcaagaggtggaacaaccggagcattgtaagtgctgtacatcgcattccatgtataattgatataatttcctgctaaatctccgttataactctgccttgtggtagccggaccgtagtaataaaaggttatcagcttatccggcattgcggctttcaattcctgcaaaagcattacaaaagaactgttattaggctgtcctgttccgttatttccgtatcctgcatattcatcatcaaggtccaccccatccagtccgtaggtataaacagtatgagccacctgcattgcgaaatcttttgccgctgcacggtcaggaaaattggagattcctgctccctggtggtttcctaaaagatccagcaatacttttattcctttttgttgtaaaggttttacgtaggtattaacgtcgttcaggactttggtaacgttgttattgtttgagatataagctctgtttttggaaacatcataattgatattggctgcaaagataatcgcaacatcaaaaagctgtctgttcgtattctgcaaggtatatgaacctgcattcagcatattattgttgttcacttccacatagcagactcccaaaggatcaagctgctgtgctttgagcaatggagcagattgaagcatgagtgccattaagggaataaaaaaggatttttttctcatagtatatcaattttatagtagaaaaaatcattgggccgaagcccaatgacctggttattattttacaattagtttttctgactgtttcaggtttccgtcatgagattcaaactgaacaatgtagtttcctgctgaaattctgttcaattcatattgattgtttcctgagttcagtgattgtgtgtctacaattcttccgttataatcataaaccgttaattttcctttactatattcatccggaacagaaactgtaagtgatgaagatttgcttaccggattaggatataatttgatttgatttttaccgtttacctgcccttcacttattgccttttggctcgaagcatttcttgccaatagtgaacttcccgttgcacacggcagatctgttccccaattagaagagtctacgcctgtcaacgttaaagtcactccgtttcctgaagtatcctgaacggtagaaccacttccttcgttaaacttccagtaagcagccagtgaagtagccggaacagatacattacacatattctgactgatttccgtttggcttagtgcacgtttccatactcttacctcatctatttttccattgaagttccttgacgtgttgtataaatatcccacattgaatgctcctgttgaatttacacttccggtttgagctttagtggcatccagaacaccattgatatagattttcatattggctccatcatacgttgcggccacatgataccatgtattggcatttaaggctgttacagaagccagtttttgctgtacattattgatacttactacaaactgaagtttattattggccagactggcgtctcctaatcgtaagaatgcagaattgctgtcacttacttccgttcccatgattgaggaaatgtatggcgatgcagatttgaatgatgaaggtttgatccagccttcaaaagacaatgctgaaccgcttagattaatacttccggcagctcctgattctgtacttccatccagagataaggcataagatcctgtaggagtggttcctgaggcactggtaaatcttggtgcaaacatataggcacttttcacgctgcaattggttctgattctccaatcataatcggtattggctgttaatccggaaatcgttacagaagtagagctcgttgccgttaccgcattcgtccacgtggttgaagaagcgggtttataatcaacatcataggtattggttcctacggctgaccaattcagttttgcgcttgttcctgtaaggttgctagtgtacagtccgataggggcatcacagtttgtaccctgtgtccaggactgtaaagtaccgcttaaaacagttggttctccgtacaatgtctgagttcctgctgaaagctgtgctgtttcattggttccatgcaaatcataccacatgaatacaccgtagccgccatttttggtttgggtagccaggctggtggtggtagaattggaagtatttcccatccaaaccgctgcaggagaaatttgtgctttggtgagcggaggtacattgggagcggagaaggttccatacatcgcattccaactgtagttaacattatctcctactctggctccgttccaggaaagtcttgaagctgcggggccataatagtagaatgaaataatcttattcggtaataaagctctgagttcctgaacaagcattacaaaagagctgtcattaggctgtcctgttccgttatttccatattctgagtattcatcatcaaaatcaattccatcaagaccataggtattcactgtattggcaagctgtaatgcaaagtcttttgcggcttcacgggtaggaaaattacagattcctgctccctgatggttccccaaaatcgtcagaactactttcattcctttctgctgaaggggctttatgtaggtatctgcattggtaagaactttggtaacattattattggaatagagataggctcttccacggctgatatcataattaatattggccgcaaagatattcacaacattaaacaggtagctgttcgatgtctgcagtttgtacgctcctgcattcaggaggttgttgttattcacttccacatagcatattccggtaggattaagctgttgtgcgttgatcagagaacctgactgaagcatcatggcaatcagtgcggtaaagatggatttttttttcattgtataatttttttaaggtgttttggtgtctgaatttgatatagcattcccctgatcccttctttttggagaaggaatctcagataaatatgccatataaagtggtgtgctatgtcagtagctccgggttttcgttaaaggttttccataacaattctccaaataaagtattggcccatgcaaaccattctctggtgaactttttggcatcgtctttatggaaggattcatgcataaagcctgtcccgccgtgcgttttctgtagagtatcaatacaccatctgatctcacttttatctttggtagtgagtgccttcatgatgatactcattggccagatcatatctaatcctatatgtggccctcctattccttccgccagcttacctttgaagaagaatgggttgttttctgaccacacaaattttcttgtattcagataaacagggtcgtcagctttcaccgcatccagataaggcagtcccagtaagcttggacagttcgcatcatccatcaggttatagcttccgaagccatttacttcaaaggcatagatttttccaaattcaggatgattgtaaattccatattttttgatggctgcatctacctcatcagcaaggctgttcaactgctgagccaacgttttttcatttttaatctgagcaaccatttccgcagcctgacgtaagcttaccaccgcaaataagttggaagggatcaggaatccgtaaatggtagcatcatcacttggacggaacatagagctgatcaaccccacaggttttgttgggtaaccatatcctcccataggaacgccgtctgttgcccaagccgttgtacgctcgaatttgtaaggtccaaggtcatgttttctctgctgttctgtaaaggtctgcagggtaagctgaattcctttcagccagttcgcatcaaaaggttttgtatctcctgttgttttccagaagtgataggccagacgtataggatagcaaagcgaatcaatttcccattttctttcatgagtacccggcttcatatcggtatggtcatattctttccatttgctgatcttttggtcatcgttgtaaaaagcgttcgcataaggatctttcaggatgaaagtagtctgcttgtggatgactcccgagatcaacttgtgtagcttttcatctttcttagagaactgcaggtaaggaaaaacctgtgccgagctatcacgaagccacatggcatcaatgtccccggtgatgacgtaagtatccggagctccattggtttctgtatagtaaacagtagtatctaatgtatttgggaagcagttttcaaaaagccagctcagctccttgttttttactttcttcttaaacgctgcaatagcactttctacggactcgctggtaaaatgtcttttatctttaggaacacggacaacaggaaaatcgtccagtactaaatttttggcaaaaacattttgggtaaacagcaatccggctcctgccagtgcacttgttttaataaaatttctcctttccattgatacttttatttcgtttattgtatgattcttattttaccggtttacttcccattacgaatctcagttcgccaccgttcatgatgtcgctgtggttcagctcccagcttttgtattcttttccgttcaggaacattttctgaacatagatattcttgtcagagatcttgtcagcgattacagtaaaagttttcccattttctaattttaaagaagctttcgggaattgtggggctccgatggcataaacaggtttcccaggtgttacaggatagaatcctaatgatgagaagatataccatgctgacatttgaccgcagtcttcattattcacaattccatcaggttttgctgcatacatattgtcacggatgtattttaccattttctgagtcttataaggacttcctgcatagttgtacaggtacggaacatgatgtcccggttcatccccaaatcccaaagatccaatgaatcctgagatatctacgtgctgctctccttccatgtgaagtgcttctgtgaaggttttatccagcttttcttcaaatccttttttcccgccatacaaattcatcatttcatcaatctggtgcggaacaaagaaatcatacgcccagatattcccggaaacccagtgtggctgaagttttttccagtcattaagaacaaaatccgctaagaattttccgtctttttgtcttggccagaagtgattattttctttgttaaaggtattcaggaagttcatagaacgttttctgtaaacttctgcttcatcttttttacctaatttttctgccagctgttgaatacaccagtcatcataggcatattccagtgttgctgaaactgaagcaccgttttctgatggtgtgtatcctaatctgatataatcattaagacctccgccaccgtcgctgctgctcattttatccgttaaagaagcatctttcattgcagcaaatgctttttcggcatcaatgccgggaaccccttttgaaatcgcatcccagattaccgaagcactgtgatagcccagcatacagaagttatcatatccgcaaagctcccagatcggcatatggtctttacggtctgtatatctgcttattaatgaattggcaaattcttttgtatgcttctgatccataatggtaagcagcggatgcgttgctctgaatccgtcccagtaagaatatgtactgtaattcgtaaaccatttcgtattcatgttttcctgagcggcaacataatctccattcacgtccatataaaggttgggtgcaatgaaggtatggtaaacgcctgtgtagaaaatttttctctggctatccgttcctcctatcacctggaaccttccgataagatctcgccaggttttttgtgccgtttccttcgctttggcaaagtcaacatttgttgcttctgtatcaaagttttcctgtgcattttctgtgcttaccggagataaagatacttttacctcaatgctttcctgatcttctgttgaaaatcttacaaacgctttagcatctttggcaagggcaattttttcatcatttttgatttttccgtcagcatacacaccgtaagacttaaacggtttggaaaactccatcacaaagtaagcaaaccgtttacctccccagccattgctgtagcagtatcctttgattttattattgccttccacactcactaaagtatggtagatatttccgaagattttattggtaggatctataatgatattggcttcgctgctcttcgggaaagtatatttgtgaaagcctactcttggagaagcagtgagctctgctttaattccatagctgtccagcattacagagtaatatccgggagacgctacttctttatcatgggtaaattttgaacggtaaccagtttccgggttttcttctgatccgggaaccatttttatctgtcctacggtaggcattaccagaatatctccaagatctgcccatcctgttccgctcaagtggttatgactgaatcccatgatggtcttactgctgtaatggtatccggaacaccagtcccagtcgccgcttttagtattctgatccggacttaactgaatcatcccgaatggtgtggttgccccgggaaatgtatgtccatgacctcctgttcctatgaaaggatctacccaggataaaacatcatttttattttgctgggcattagctacagaaatcaaggtggtaaaaaagcagattaacagttcttttttcatgataagagaggtatcggaatttttttgttttaaagttggtttaaaaataggaaaaccattatacaattcccagaaaacaaaggaaaattaaaatgattaacctatttttcctaaacttatattactgtattaaattgaattctttttcataaaatctataatttctgagatatatccaaaagcaatagcaaccacagtatcagcagcaccgtaatataccgttactttatctccttctgtcaatgcggcgcaagggaaaaccacattgggtacatctcctgtcagttcatacaattctgccggcgccaacagataaggtttcgtcctgtacaataccttcgtaggatcttcaagatcaagcaaagccgctcccattgaatatctgaatcctctgcacgtattgatcactccatgatagaaaagcagccatccttcttctgttttgataggaaccggtccacctccgatttttgtacactgccatgcactgtcttcaaaaggcgttactttcatcacgcaacggtgttctccccagtatttcatatcagggctgtagctgatataaatatctccgaaaggtgtatgcccgttatcactcggacggctcagcatggcatatttaccattgattttttcagggaacaaaactccgtttctgttgaatggaagaaaggcattttcacactggaaaaattctttaaaatcaaaagtatacccgatgccgatggttggaccgttgtatccgttacaccatgtgatccagtaacggtcttcaataaaggttacgcggggatcatatttgtaatcggattcaatcatatccgtatttcctgcctgcatttcaataggatcatggttgatgtcccaattgattccgtctttactgaagccggcaaaaatattcatctgcacggccttgttatcacaacggaatactccggcaaatccatcttcaaaaggaattaccgcactgttgaatatactgttggatgttggtatcgcgtatctgttaatgatcgggttttcggaaaacctccacataatatcactgcaaccttccgggcgatcctgccaagggatcattactgattgagctgtcataaagtttttaactttttatttaaaatttgtttattaattgtgttcttgttctttctgattttcaggataagggaaaggaacaaatagggtgaccaaaaatgcgggaatggtagcaatcaacacccagataaagaacattttatagcctatccagtcactgatcattccgctgaacattccgggaatcatgacaccaaggttcataattcctgttgcaaatgcataatgcgctgttttgtgttttccgggagcaatctgctgcatcatatagagcattaaccctacaaagccaaatccatatccgaaatattccactactacagcaattcctacaggtaaaagatcggccggctgataataagccagtaaagcatataccacaaacggaatattaaatgcacagcacagccatatcagagatcttttcagtccacgggctgagataaaatatcctgccagtacagagcctaagataaatgctgcagaaccataagttccatacacaagccctatatctgatgtggataatcctaatcctcctgatgatcttggggctttaaaaaataatggggcgattttgatcgcgaatccttctgcaaaacggtacagaataatgaaaagcacagaccatacaatattttttttggtaaagaaagaggtaatgacttccaataattctctacggacatttccggctgttttttcttttttctgctcttctttattttcgttcggcagaatgaaatagtgataaatggctaatgcaaaaaacagtaaggcataaatcgccataatgatcatccaggcattggtaattccttttgttttttccaaaacgccggcaaaataaacgagcgctccactgctgataattttagcaagattataaaaagcaccctgccagccaatatatcttgcctgttctttattggtcaaaaagccaatatacgttccatctgctacaacatcatgggtcgctccgcaaaatgccactactgcaaaaagggcaatactgtatttgaaaaagtcgtgcatcggcagacttaaagctatcagagcaaacagaattcctatggcaaactgggtaaaaacaacaaagaactttttagttttataaatctccagaaaagggctccaaagcggcttcaatgtccatgcaaacagaataagcgctgtccagaatgtgatctgcgaatccgaaacacccatatctttatacatgattcctgaaaccgcattaatggttacaaagggaactcccattgcaaaatataatgtggatatccagagaattggctggatccgacgggttccggaattgttttttcccatatttaaaagtaagattctaaagaaaaagagaacatctcaaaagattcattcaggcttaaaaaacgaaactataaatttttcggaggttctactctatcctcccgcctcaatgtttgtttcagaaaaaaaactgattttgagatgtctctttattaatgagtgattctgaatatttttatttcttatcccaccaaagcttggttccgccggtatcagggccgttcagcatttgagcagcctgctggtaattatacaatgatgttttggtatcaatagtgaaaggaattcttctgatcattgcctctgtactgatggctcctccactatcattttttcttaccttgaaaagaaccggatatcctgttcttctctgctctgcccaagcttccggtccgtttggataaagggaaagccacttctgggtaataattctttctaattttctttcgttagtatcactgttattccatgcaatggtgatggtacttaactgtggatttccaacaggcacgttattatccggatttttcggatcaatataaggagcttcagtagaagttgtatcagcaaggtaagcggcaacgcttgcactttttccccattccccgaaagactgctgaaccccagtagtatagttggtttgaatatcacctgctcctgcatatcctctcaaagcagcttctgccttcaggaaccatgtctctgcagcggtgaataacttcattttaccatcggtaccggaaaaataatctccgttggcagattttgcctgtggctgtgagaaccctccgtatgttgatttaccatttaataaatcaattccctgacggattcctatatattttccctgtaagcttggatcagatgccggaatagcataagcaggaagccttgggtcattatacccgttcatataagccatcaatggtgcaccaattaagcaatctccccatgaatagataataaaactcaattctgattgtccaacgctgattaaagcattatccgcattatcagtaatcaatcctgcagatgaagctaatgcctcttcagcatattgcttagattttgccggatctgcataactcattctcatcgctaatctcagctttagtgaattcgcaagcttggcccattgagaaatatttccattaaatacaagatctgcttttttcaatgcagccttatcaccttcattttggttagctggcatattctgcaccttttgaaggtctataatagcagcactaagatcattaataaaatgcaggtaagcctcctgttgagagtcaaaatcagtgacaccgtttgcattaggtgtctcatatttgctgtacactaccggaccatggctatctgatactctggccgctgtgattacttttaatattttctttaccgcaaatgtagctgtaaagtctacgtcaggataaaagtttttagctgcattatctatgatgatggaataattgaaaatatcctgttgtctggcaataattctgttgttccaaccatccatcatgaaatatgtcaaattgttcttccctccattaaaaggagttgctgtgctgaacataccactgaacatatctgcgcttaaattaggatataactgatagtctgactgtaatcctctttgaatagattttaaaggattaacaaccgcattataatcagcataaaaaatctcgggatttccaagtttctcctggttatattgatcaagatcaccgcatcctgaagctgtcatcagaactaccgcacctaataccagtattttaatattttttaatttcattttcgttaaattagaagttagcctttaatgatagtccgatagatcgtgtaattggaagtccaaatgaatcaactcctaccccacctggtgtatttccggatacttgttccggatcgaatggagcttttttataaaagaagaataaattggttccaacaagacttactgtagcatttctcatatatttggaattaatatcaaagctatatgaaattgatgcctgacgtagacgaactgttgttgcgctatacagataagcttcatcaattcctgtcccgataccaccggcaccacctgttcttttataataagcttttgcatcagtaactccattataagcctgtccagcattaggagtgcctggagcatatacagcatttggaatagatactccgccggcgtctcttgcatcagcagtagcctggctcactccgtataaatcatttgctttctccgtaagagacaatactttgcctccaaatttaccatcgataaggaaagatattcccagtttaccaatattaaaagagttattaaaacccagaataaacttaggattcgggttgcccaaatactgaggatctcctgtagtacccagaggaacaccattttcatctaccaagattcgcccctgatcatctcttttgaatttaactccgtagagatctccaaatgatccacctaacctcagttttgtaaagtctcctcctcctgttaatgcaaacagctgactttctgatatgggcagacttgatggaaataattctacaatcgtattcttattcgctgaagcattcaatgtagttgtccagccgaatttttcgccaccaaagattttgtatgataatgaagcttcaaagcctgtgttacgtattttcccggcattaatataatatgaacctgacggaattcctccaaagtttgaccctatagtagtttctaacaactgattagttgcattggaattataataagtaatgtcaaaatttaatctgttattgagcattctcaactcagttcctgcctcaaaagttttattaagctccggtcgcggaataaggtctggacggctggtaacaaatgaactttttggatatacaatagttcctgcatctactccatacgaatatgcattgtaatatgccaccattgcattagaaatattggcaggtaatcctaaccctacagttgcataagaacctctcaccttccagaaattaattacttccggaagtttaaaaatagaagataagatcgcattagctcctacagactcataatcaaatccgcttcttcctgttaatgccaaagtagaatcccagtcatttctaaaggtcatatctacataaaacatatttttatatcctacggaagcacttgcaaataccgatcgtacttgtttttttaaattccaatagatattgtggtatccatctcccggacttctttctacgttccattgaaggttgtttaatgcgaacaaattaggattagacagatatgcgttatcaacctgtgttactttattactggttgtattcacacttcctccaagcgtaaaatctaaagaaatagattcgcttaattttgggctaccaacaagcaaaacatcaccgtaggtagaagaattttcataaacatttttaagcattcttccattttgtccacctgctaataaacttggtgctgagtatgcagaaatatcacgctggctgtctgaaatattccagctgtaattacctcttactctcgctgtcagccatggattaatttcataagataatgtaacagcactgtatgcatttttatttttaaccgtaaccgggtttctgtttaaaatccaatatgggttttgggtttccggatttcctttgaaacttccgtccggtttcacttcccaccagttttgtgcaggtaaaagccttttcttatcaaggtaagagtagttatccggtccgtattgatcaaaatctactcctcttggtaaccagtacaagcttgtcaaaggtgagaaagaagctcccggtgtttgtctgtttttactgtcctgcaaagaacctataaagttggcatccaatgtcaatttatcatccaggaacttacttgagtttctgaaagaaatattatattgatcaaaataagacatcggaattatccccttgtttgtcgtatttccaacggaaaaataattggttgatttttcatttcccgattggaaagaaaggctgtttacccatgttgttccggtttgcagaaagtctttaagatagtccttcgatgctccttttgctccccagctctcaatgttatcgcctggagattgattaggcacagagggatcataagacagataactgtgctgcagttttggaagactataagctctgtctactgttaaacttgtactgtaagaaatagaactcttgcctaatttcccttttcttgttgtgatcaggatggcaccgtttccccccgcagatccatacaatgcagaagcagaagctcctttcagaaagttgatgctttcaatatcatcgggattaatggaacttagcacgtcgcccggatccggcatattggaatactgacttatatctgcagatttccctgtgccattgatgattggaattccatcaattacatatagtggctgactgtttgatacagacttattccctctcataatcacccttacggagcttcctacaccattggttctgttaatctgtacgttggaaacttttccattgatcgaatttaatagattgggagttttcacttctgtaagctcatccccgccaatctgctgactggaatacgtcaaagagcgggcctgtctttttatccccaaagaggtgaccacgacctcctcaatactggttgtcttcgtagtgtcggctgattttttctcctgtgcattcgcagtaagtgaaaaaacgaacagaacgggtataactgcttttctcataaggtatagattcgttagatttaattgagaatcagtgacatcactttatttttcaatacaaaaaaaattattgttttttcagcaaaattttttcgtttatgtattaaattatttaaagttttgttaagatttaattcacattcacaaatctaaattttgtatccagtctgatataatactattttatcataaaacgatattattttttcagtatttttattttaacacaactaacagattaaatatcaatacaataaactactttatcaacaatcagaaaaataggatttatcttagttttcgccaaaataaagccggatacgaatacccggtttccattacgttttatgctgaattaattactatctaaaagcaaattccaaaaatcattcgatttttttcactcctttaaattgttctttaaattcagttggtgttgtctttttgatggacttaaataccttattgaaattggcaatattattaaaacctgcttcaaaagcaatttcgaaaacagtaagatttttctccatcagccagcgtgcagcatagctgatccttatttcattcagataattgacaaaggttttccctgttctttttttgataaacctgttgaatgtaacattactcatattcaccaatgacgctactttgtccagtgttattttattttcaaaattcttgtgaacaaagtcatgtataatcttcatcttgtcattatcatcaaaagtttcaagctcaatactgtatgatgaaagaagcgttttattttctgcaacagcaagttcattcagaattttcatgatctctatgaaagattcaaaactgttcatcttcgacaggttgagaaacgagtcttttagtttttcagctgtttcctcagaaaaaagaatacctctgatagagtccttcatcagattgttgatgggtttcagaatatttttctgcatcatggactgattaaagaaatcctgattgaactgtatggtgatttcgtgggtttttctgtttttacaccggtagtttgcccagcaatgcggtaaattaggtcctacaagaaccaattccagattaccaatttctccggtatgatctcctatcatcctgcgataaccctttcctttataaacaaaattaatttcaatctcaggatggtaatgatagggaaagtcaaaagaggctttaatcctgtcaaatacgagaaagctatcctcaggagatagtggagttatttctctcagaatgttttctaatttgctcatataggcagttttgaaaaaaggggttacgaatagggatcacagtacaaatctttgtaaaaatgataaaataatatcaatgtaaaaactaattttcgatttattttgttccaaattctgtagatcagatatcataaatttgggttttcagtaatttaatatcgttcaaatcctgcatttttgtatctttaaactaaagttaaagtatgccgcaaccgcttatttttgaagatcattataaaagactcggactggaggtattttcagagggaagcctgaaggatttcagcggggatcggttcagaacagatattaaaatattttttattcctgtcggatatgaacttacggtcgattttaaccattacaaaacccaaaaaccttccctgttttttctaaccaaccagcatctgagcatacaaaaagggaaagaggtatcaattctccttttttataaccgcgatttttactgcatccagattcatgataaagaagtggcttgtgacgggctactctttcataatgtatttgaaattccttttgtggagcttgaccattctgaaacggctcttataaaatccctgtttcagaatattcaggatgaacttgaatggaaggattcctcagcagaggaaatgataagaacctatgtaaaacagattatcatccgggctacgcggaaatggaaaaaacaaaatttagataatgatactttaagaattcctggcagcgagcttgatattttcagggatttcagcaggcttcttgaaattcatttcagggaaaagcataacgtcgctgattatgcagaactgcttcatatggctccgaaaactttaacccataaatttaaacatctaaatctcgaatctcccaatcagtttatcatcaacagaattttactggaagcaaaacgattgcttttttatacagacaagcctgtaaaagaaattgcctacgacctgggatatgaagatccggcttatttcaaccgccttttcaccaacaaaacaggaaatacaccagccaattttaaaaaaaattacacttcgggaaaaaagtacaatatttaagtcattttatctattgaaagatccttatcgtagacatacctttgtaacatcaaaatcaaacaatattaaaaataaaaaacaaacattatgagacgtaacgcaacagccgtttggaacggtactatcaaagaaggaaagggacacttaactactcagagtacaactttaaaccagactcaatattctttcaacagccgttttgcagatggtgtagggacgaatcctgaagaattgctggcagcagcccatgcaggatgtttcactatgaaattagatgcagagctttcacaagccggatataaccctgaagaattaaaaacaacttctgtcatcactttagatcctaacattggaaagattacaaaatctgaactgacattaaccgctaaagtaccgggaatctcagaagaggaattccagaaatttgctaaaattgctgaagagggatgtcctgtaagtgccgcattcaactttgaaattacattgaacgctactttggaaaactaatccaggttttcattcaacatcataaggaacgggctaaagcccgttttttatttaaaacaggaatccattgactttgaccaaaacctataagccacatatttatctgaataaactttccatataaaatataccaaatggtatatttttgtatatttgcatcatatttaaacatttataatgtcgaaggcagaaaaaacaaaacagcatatcattgagaaaacagcaactctttttaataccaagggttacatttccacatcgctgtcagacattacccaggcaaccggactgacgaaaggcagtatttacggaaattttgaaaataaagatgaagtggccattgaggtttataaatataatgccggagtattgagtaaaacgctcagccgttcctttggtgatgaattccccacgtctctggataaacttcatgcatttgtagatttctacagaaaaaactggaagtttgtctttgcgaacggaggatgtcctttgatgaatgctgcaacagaagcagatgattcctttccagccttaagagcccaggtaaaaaggtcttttgagcagtggatgataaaaatatcagatacaattacagcgggacaaagtaaaggggaaattgataaaaagatcagtgctgaacagtatgcttctcttttcattatgcttattgaaggcggcattctgctgtcaaaaacaatgggtgatcaaagttatctcaaccatgctttagataaagttgcccaaatgattgatcatgaactcaacattcttccatcataaataataccatatggaaacaaaaaaagtggctattgtaggatacaacagaattccttttgccagaatgaataccgcttattcggaacaggggaaccaggatctccttcttgcttctctgaacggattgatagaccgttatcgtcttaagggaaagcgactcggagaagttgccggcggtgctgtaattaaacacatttctgaaagcaacctcatcagagaaaccgtgatgaatacaacgctggatcctgcaactcctgcatgtgatcttcaacaggcatgcgacactggaattgaggcagccatttatattggaaataaaattgccctgggccagatagactgtgggattgcatgtggtgtggaagccatgagcaatattccttttgaatcttcaccccgtttgagaaaagccctgctaaaggctaacaaagaaaagtcagcattcggaaaattaaaacaattactgagcccgaaactgaaagactggatgcctattccctataaaggacaggaacccaagacaggccttgttatgggtgagcatacagaaattactgcaaaatattacaatatatcgagacaggaacaggatgaattagcattaaaaagccatcagaatatggcaaaagcttatgatgaagggttctttgatgatatggtcactccagctttcggtctggataaagataataacctaagacgtgacagcagtattgaaaagctttcacagctgaaacccgctttcgacaagcagaacggaactttaacggccggaaattcaactccatttacagatggagcttcagcagttttgctggccagtgaggaatgggcaaaagccaatgatcttcctgttttagcttatatcagcttttcagagcttgcgggaatagaatatgttgaaaataagcaggatttgcttctggcgccggtttttgcagcagagagaatgctgaaaaaagcaggtatgaatctttctgatttcgattattatgaaattcatgaagcatttgccgcacaggttttagctaccataaagatttgggaaaataatgagcttgccaaaaaattcggactggagaaagccctaggaaaaatagacagaagtaaactgaatgtaaaaggaggaagtcttgcagccgcacatccttttgccgcaacaggtggaagaattattgcaactctggcaaaattacttcatgaaaaaggcagcggaaaagggtttatatccatctgtgccgcccgtggacagggagtaacgatgattttagaaaaataaaaacgtaagtatggatagattagcacaattaaaacaattcatcggaaaagaatttgaccagtcaccctctccttttatgaaatggcttaatcctgttgttatttctgctgaagaaggtcagctggagtttcaatataccgtaagaccggaatggctgaaccctgtcggaaaccttcacggtggagttaccgctgctattgtagatgatatcattggtgccaccatgttttctttaaatgaaaattctttcattaccactataaataatgtcatcgattatttttcaactgcaaaagaaaatgataatattgtagccgaaactaaaatcattaaaagaggtaagcaattcgtcaatgcacaatgcgaaatatggaacgcagacaaaacaagattaatcgcaagaggaacctcaaatttattcaaaatcaataactaagtatgaagagagttgtcattacaggtctgggcgcagtgacgcctttgggaaataatgtcgaagaattttggcaaaacagtattaaaggagtcagtggtgcaggactcattacccatttcgatacagaaaaatttaaagtacattttgcctgtgaggtaaaaggctttgatccaaaagtatatctgaaccataacgaaatcaaaagaagcgatctgtttacgcaatatgcaatgtatgcttctgcggaagcgattcaggattccggactggaacttgaaaaaatggatccgttcgataccggagttatctggggaacaggacagggtggaatgtggactttcgaaaaagaagtgatggattttgctgctggtgatggtacaccacgttttaatccgttctttgtaccaaagttcattgccaatatggcatcaggaatgatttctatgaaatatggccttcagggaatcaattatactacggtatctgcctgtgcaacaggaaatacggcattaatggatgctttcaattatatccgtctcgggaaagcaaaagttatcatcagtggtggttctgaggcagctattacaccggcttctatcggaggattttctattatgaaggccatgtctacaagaaatgatgattttgcaacagccagccgtccatacgatacagacagagacggatttgtaatgggtgaaggtgccggagcattggtacttgaagaatatgagcatgctgttgccagaggagcaaaaatttatgccgaattagccggtgcagccatgactgcggatgcttaccatatgacagcaccacatcctgacggcgttggagctattaaagcaatgcagctggcagtgaaagaagcaggagccaatatggaagatatcgattacattaatccgcacgctacgtctacaccgattggagatacaattgaattaacagctatcaacaaagcatttaaaggaagcaagaaccttgatatcagtgccacaaagtcaatgaccgggcatttgctgggtgctgccggtgcggtagaagccatcctttcaatcaaagcgattcagaatgggattattccaccaacgatcaatcttcacaatattgatgagagtattcctaaggatatcaatattgtatttggtgaggcgaaagaaaagaatattaattttgcattgagcaatgcctttggattcggaggacataatgcgactgtagtatttaagaaattcagctaatctgattaaataattattcaaaatccctgtatgaaaaccatgcagggattcttttatagtttaaaacttaaaaaagcagccatttttggctgcttcaaacataacgaattatatattcccttagaaagagattgacttgaaattattgagcatccgggataaaaaaatcatccgcattttcagcaatcggaatatagagtctttcccactctttgcttttcaccatatcccagctgtgaccggttcctttaagatcttcagccagaagaaccactcccggtttaatcataaaagtagaaccatctgttactttaaatcgtatattgcctttgatggtaatcacatattgtcgtctgggtgcgggatgagcatttttttcccactcttctgttttattgctcatccagaaagttgtggtattcatatgtttaagagtaggaattttccctttctcaaaagtgcatgacccgtcaggattattaattaatcttatggcaggaataaactcagtggaggtttccgcagtgacgctcacatgattgttctttttatgttgtgcattcataaatcctacagtagttactactaaagcaaggctaaagcccttaatgatgtttttcattataaatttaatttttttatttttaattataaacagtatcgtaaaccagcattctctcaaaaaatggtttatattgctgaaccaatgccagatgttcgggaagtttcccatacgcttcaagctcctccagactatcgaattccatagaagcattataggtaaacgtgctgtctaaaacgcttctagggctggaagcagcaggttttccataacggagattcttctgataaggaagctttttaaggcctttaaaaaaattttcaaattcttttacttcagactcggaaagatcttttctgagccagaacaacaaataatggaagtacatttttttcttttttataggattaaacatgggtaaagcagaggcaaacatatttcctgaaatcagcagcaaagcagaagcctgaactgagcggaataaaaattttcttctttccattgttatgtattttaattaaaatctattctgtatttaaggacaaactgccattttctatcagaaactacggcattatttgatggatcattggtataaacgggtctgttctgagcgtcaaaggttaagcgcgaggacattccgttcaacaaaagggaaattccggcatcatagatcactgcattatcatgaaggcctttcagatctgaaagctgtattcctacagcaggctgaagctgaaggcttttcttttctttatccagataaggcagggttcctcccagttgtacataatatgtattcccggttccgataacaggcattgcatttcctgctccattcagactcgcctgggtaacatctgcagaagtcgcaggattattggtgcccacatatcggatataattgggtccatagtcgttatgcatcgccattccataagcacttattgacgttcctttttccttgttcagtggtgcgtcataaaacaaatctaccgcaaagcttttcatatcatcattcactgtatttttaccggaatccagatgccataatgcattgtgaatataatcaaacccggctcccagactcagtacattcttcttccctacataagttcctgaattaaaaggagtggaaatattttccttgtctaaaaaagcatatctgaaatatccggagaagtcttttccaggcgagttcttactaaaggaagctacattcagtttcggatcagaagttgccatggtataaggatctgccactaccagacggtaatcaaatcttccgagctgtcctttaatataggcactcaattcccttacggtataatctgttgttcccgcattggaggttgcgtaagctggaaggtcgtataacagcgtattcaaaggtcctgtagtaaatcttgaaagaccacgccatgtagaacgtcctgccccaaaagcaattttatcattaaacgcatattcagcataagcatccaaaaggtcaaaatagttactcccttttgcattgacatttacgttggtagttccaccctgcaatacaaacatcagcttttctgttggcttataagtcatttttacacgaacccttctaagcgaaaggtcagacaggtctgattttgcttcgttattgacaaggcttccagggttaagctgggtatatctggcccacaattctgcatatccgctaaaggaaatatatcttgagtgatcttcattgaaataatgagtcaatccgggattattaaaatcattttttttctgggcttctaatttccccataagtcctaataaggaaaacaacgcaattgctgtcttgaaagaggtagtcttcatatttttctattcttatcttttgttgatttcaacgggacaaaattagattgctaaaagcccgacaggtattagaaatctattagaaaccttatagaaaactattaaaagggggaatgttttctgataaaagaaaaatataaaatacctttgtacagtgctttgggaataaatgaaagtcaggcttttaaaatcaaaaaaacgtttgaaaaaccaacacccctattcatcgtatttctttatgaaaattttaattgtagaagataactcacgtgtttcaagtcttttgaaaagagggctggaaagccaggaatatcaggtgtatatttcggaagatgcagaagatgcgattatcctgctgaataaaataacatttgatctggccattacggatattatgctcccgaaaatgagtggtattgatctgtgcaaactgatcaaacagcaatatcctgacctccccattatcatgcttaccgctctgggaacgattgatgaaaaaattgaaggatttgacgccggagcagatgactatatggtgaaaccttttgagattagagagctctatgtgagaatcaaagccattctgcagagaagatcaattaaaaataaagaagcctatctgaacgatctggaatattatgatctgaagattgataagaaatttaacagggttttcagaaatggagcggaaatagaactaactcccaaagaatttaaacttctggtattcctggttaacaatgccgaaagaattcttacccgcgaagaaattgcagaaaatgtatggggaaatcattttgacacaggaacgaattatattgatgtttatattgcttatctgcggaaaaagattgataaaaattttgatcataaactgattcacactaaacccggagtaggatttatttttgcttcacaactatgaaaatagcaaccagaacagcactcatttattccattcttacggcgggtattctttttttgtttgcctatgttctttattttgtctccgaaaaaaacagagaagatgagtttaacgaccgcctgggatataaagtcatctggcggtcagagtttatctttgatgtcagaatcagtgatgaaaaaatccgcgagcttcacaagcgtaaccaaaaactattgaatgaagcagatatcagtgtttataacagtaaaaaagaactcacctttactgatgttcctcctcttaaaagcaatgacaaatatctggataaaattatccggtctaataaaaacagaatattctggcagcagggcgaccgccagtatattgctattcagttccaatcaaacggagaaaaatattatatcattggaagcgcagtagacgtcacaggaaaagctcatatttcggagtttaaaaaagatattattatcatttacatcagttcgattgtcattatttttattataggatttcttttttcctattatacgcttaaacctttaaaggatattattctccagatccgcgatatttcagagcacaatctgaataaacggctggatattccaaaagcaaaagatgagatttatgaactgacggaaacttttaattctaccttcaacaggctcgaaaaatccttcaacaaccataaacaattcgtcaccacgatctcacatgagttccggactcctctttctacgctcattgcagaactggagcttgccaaggaacttaatgtaaccttggatgattataagctttctattgacaatgcccttcaggatgccaatgacgcttcggagttatcatctgctttgttggattttgccagagcgagctacgatgtatcacagatcagttttaccaatctgcgcctggatgagatattggctgaagcaaagcttgcattgctgcagaaaaatgtcagctataaaatcggaattaattatatgggtaatgcttcagatgatgatgaaaacaattatgatttttatggcaatccttacctgctgcaggtcgctttctcgaatctgatggaaaatgcctgtaaatactcagcagacaaaagctgtcatattgaaatagaaaccaacccggaacatataaaaatccgatttatagatcacggtattggcatttcagaaaaggatctttcaaaaatctttgatcttttttacaggggttctaacaagaatttcgaaaaaggaaacggaatcggcctttccattgtaaaaagaattgtcgaaatacatgaaggcaacctgatgattgattctgaagtatcaaaaggaagtgtatttaccgtaaaatttctctctgagtcgtcctaaaataggttgacataaattaaacaatatttaatccggagagatattttatttcttcggattttttatgcactttatctggagtttgcatattaaggcttagatgtggtcttttagtctacttgagaaactattcttaatttaaaggctatactgtagtctttttgtgtgcgcttttctctttttaatacttgatctttcataaataagtcgattagttgtcaacttatttcaggacgagacactccaaaaaataaaagcagccaaaaactgactgcttttttattttatgctttcaaccattctgaagaagaaagatagttctgatcgggataatagatgaagaggcagtttcgtcctttaatggtattaatgatagactgcgtcagctctcttggtacggcagggcatccccagcttcttccgattcttttgtgcatggctgcaaatgcatcacttacataatctgctccatgaagtacaattgctcttctgtaggcagcatcattaaagcctttgtccattcccaataatttcaaagaatatccgttatctccctgataggttgcatctgtgatataaaatccgaggctgctctgcagcgaactttccctgttagaaaaattcgtcgcaaattcttcacctgtgttttttccgtgtgccaccaatgagttaaacagaactttcttgtcttcaagatcaattacccaaagtcttttcatgttagaagacatagaaaaatcgcagatagtcaataaatgcgagtcctgggtaagcaatcctgctttttttaaattttcatagccagtcaatgcttttgagaacacttcataattcagctcatgttcagggtcaaatgcgattgattggtatagtgcttctgatgaagatatggctgttgtgcccttctcagatttcgtgtcagctgcttttacagttttcgttgttttgacattctcacttttcaccgccactcttggagaaatgtagaatgaagtcgtcaccatgtaaacaaggcccagtacgctataaaatcctttcattcaataatatataaatccaaattagtggggcaaaattataaaaacataattaccagggggttataactctaaaaagtttaacgctatttaagaaactttaacgtcctgattttgtgaattaaagtggttatttttgagaatccggaacaaattccaaactaatagaattcatacaatatcttaatcctgtaggctttggaccgtcatcaaagacatgcccaagatgggaatcacatcttttgcaaagtacttctaccctgtccattccataagactggtctcttttgtaatagacgccctccttatctgcttcaaagaaactgggccagccgcagctgctggaaaattttgaggtagaacggaacagatgatttccacatacagcacaataatactctcctatctcatcaaattcgttatattttccggtgaaagctctttcggtagcagcttcccttgcgattgcatataattccggagtaaggatttttttccattcttcattggaaacattaagttttgtggtatcagttctggagtagtatggattgttttttgcttctgtattttccataagagtttttttaatgggttcatatttctgcgtacatgcctgcagaaagaataataagatgagtgaaactaaaaatttcattacaaattttatggtttaaccgcaaaagttttgaagcttaaaagcttttttaaagattaaacggtttcataaccaaatttagtaaatttgagaatatgaatgacgaagcaaaaagaaaacagctcagaaaatataaagcgtttgccacaggattatttgtcctgatggccgttattttcattgttaccactattttacagaagtctgacaactcccattgggtcggctatgtacgggcttttgccgaagcagcaatggtgggtgcgctggccgattggtttgcagtaaccgcgctgttccgtcatcctctggggcttccgattcctcataccaaccttattgaaaacagcaaacaaagattaggagacaatctgggaagttttgtagtgagtaattttctttccccacagaacatccgtccttatattcaaaaactcaaagtatccaatttcgccggtgaatggcttggaaaagagaaaaatcaggaaatattactgagaaacctgtccgatattgtactggatattcttaataaactggacgattctacagtgagccagtttatcagcaaaaaggtatcggaaatgacagatgatattaagcttaataaggtggtcggaaacgggattcactatattcttgaaaaaaatgatcaccagaggatcatcaccaatctttccaaacagatcaaagaatatatccttgaaaacgatgaaatgattaaagaccgcgtgaagaaaggcagctactccttcattccttcttttgtagataataaaattgcggataaaattgccgacgggctttctgattttttcaaagagatagaagaagatcctcagcatgaagtaaggtcattgattacccagaaaattcatgaattctctgttgatctgaaagaagatcctaagtgggatgaggaattcaaaaccattaaaagcggtctcctgaaaaatgataaactggatgaatattccaatgacatctgggtttctatcaaaaaaacgctgatcaaagaacttcaggaagaaaattctgcattgaagaactacctttcaaaaaacctgaatgagtttgctcaaaacttaaagacagatgaaaaccttcagaataaaattgaccattgggttcgtgtgacggcttataaatacattctgaaaaacacacatcagttcggaaacctcatcagtactactgtcggtaactggcagggaaaagaactcagtgaaaaactggagctggaagtaggaaaagaccttcagtttatccgggtcaacggaacccttgtaggcggtctggtaggactgatcatctataccattgctcactttttcatttaaataaaatagattctcagaaccattattttgtcattctgacaaagaagaactttaccagtcaatactctggattcttcactacattccacaattaagtccgctgacctcaatctgtgttaagaataacacttttattttaccttggtaatctgccagctctttttagaagctcctgattaatatcgttgatcaattggggaccttcataaataaatccggtgtacagctgtactaatgtagctcctgcatccagcttttccatagcatctttagcagagtgaatccctcctactccaataattggaaatgctctgttgcttttatcagaaaggtatttgatcattttcgtacttctctcacggataggttttccgctcagtcctccgtttccgatctgttctaaaacttccggagaagttttcagaccttcccggttcactgatgtattggaaactacgataccatcaatcttcgtttcagcaatcagctcaatgatttcgtctaactgattgttattaagatccggggcaattttcaggagtataggcttctgtacagcttttgattggtttatttttttcacttctgtaatcagctctctcagatagtctacatcttccagtttcgcgtgacttcctacattcggacagcttacattcagtacaaaatagtctacataaggatgaagaccttcaaaacaatccagataatcctgggtatagttttcagggcttgtatccgtattttttccgatgtttccaccgataattatttttcctttattggatttcagtttttcaatagcggcttcaagaccatcattattgaatcccattctgttgataattccgccatcctcaatgagacggaacaatctttttctgggatttccggcctgcgctctcggggttacggttccgatttccacaaatccgaaacctaaatctgccagttcattgaacaatactgcatttttatcgaaaccggcagccagtcctacgggatttttaaatttcaatccgaaaacttctctttccagacgtttgtcttcaacaggtttcgggaagaataatttagtgagaaatccaaaattcttaagtaccgaaaaggtaaagtgatgaacatcttcgggatcaaatttaaaaagaataggacgaatgagcgatttgtacattgaaaaaaagttttacaaaattactcattttaaaattaatgctcgatagatgtaagatattatatcgaaatggctcatctatagtatctataaactggaaaaacaactatatatgcaacataacgctgcgaccgcaaagaaagatgaccatcctgaaaacattttggttcgcaaaggcgttccactaagcaaattacaagctatcagcctttgcggaatgaagtgcccttgcgatcggaaataaaaatcattaattaaactttgtgaacattgcgttaaagcaataggaaacagagaaatatctccatcatccttggcaaggtttaaaaccttgccaaggctattaatctaagaataggcactcagatcgaatttcaggatgtctcctacccttttgaactcttcatctatagtggcatttaccgtaattctttcgttggaaacaggatgattaaaaatcaactgatgggcgtgaagtgtcattttgttgatttcaaaagtctgaagccacaacttattctgtttattgcaaccgtgtttcctgcagcctaaaatcggatgcagaatatgtttaaaatgctttctcagctgatgaaatctccccgtttcaggaatagcttctaccaaagagtatcttgaagtctgatgttttaaaaaaggtaagtctatttcagaagtctgcaaacggcgatagcttgtaactgcattttgcctgacttcattttcattaattaaatcataatcaatagtttcctcttcttttgtccagccacgtagaatggccagatatttcttctctacttcgcgtgacgaaaactgctcgctcatgattctgagagtatctttatctaaagtaaacaacagaacaccggatgttttcctatctaaccgatgtacaggatacactttttgcccaatctgtttcttcagctcctgaatagcatacgtatcggcttctcctgcataaaaagatttatgaaccagtagtccgctgggtttattgatggcaataagatgttcgtcgcgataaagaatttctaacatggggcaaaagtaaagattttcgactgatatatatgctgccgtatttgtaaacctgttaggtttaaacattcctttattaatagccccgatcaaagagaaaatcccacagtgaggaggcggagcgaagcagagccgccgagcgaggaattgcaacggagagcgggttcacggctccttaaaaattaaattgtaaatatttgtctgtttattaatgctttttttattgaatctcatgattttggatccaaattgctatttttgcatttcagacgttaaaaaaattatggcaaagcaagaagatgttttcaagaaagtgatttctcacgctaaagagtatggttttattttcccatcgagtgagatctatgatggtttatccgctgtttatgattatggacagaacggtgccgaactaaaaaataatatcaaacaatactggtggaaagctatggtacagcttaacgaaaatattgtgggtattgattcggcaattttgatgcacccgacaacatggaaggcatccggccacgtagacgctttcaacgatccattgattgacaataaagattccaagaaacgtttcagagcagacgttctggtagaagattactgtgctaaaattgaagataaagagaataaagagatagaaaaggctgcgaagagattcggtgatgctttcgataaagatcagtttgttgctacaaatccaaaagttctggaatacagggcaaaaagagaggctattctttcaagactggcaaagtctctggaaaatgaagatcttgctgatgtaaaagctttgattgaagagcttgagattgcagacccagatactggttctaaaaactggacggaagtgagacaattcaacctgatgttcggaactaagctgggagcttctgcagacaacgctatggacctttaccttagacctgaaacagctcagggtatcttcgttaacttcttaaacgtacaaaaaacttcacgtcataagcttcctttcggtattgcacagattggtaaggcattcagaaatgagattgtggcaagacagtttatcttcagaatgcgtgaattcgaacagatggaaatgcagttctttgtagctccgggaacagaacttgaattctatgaacagtggaagcagaaacgtctgaactggcacagagctttaggtttgggagacgaaaactacagattccacgatcatgagaagcttgctcactatgcgaatgctgctgctgatattgaatttaatttcccattcggatttaaagaactggaaggtatccactcaagaacggatttcgacttaaaggcacatgaagagttctcaggaagaaagcttcagttctttgaccctgaaagaaatgaaaactatgttccttacgtagtagaaacatctgtaggtttggacagattattcctttctattttctctcattgtttaagagacgaagtattggaagacggttcagaaagaactgttttatctttacctcctgcattggcgccaattaaagctgctattcttccattgatgaagaaagacggtttggcagaatatgcagaaaagatcttcaatgacctgaaatatgatttcaacttattctacgaagaaaaagatgcgatcggaaaacgttacagaagacaggatgccatcggtactccatactgtatcacggttgatcacgactctcttactgatcacactgtaaccatcagggacagagatacaatgcagcaggaaagagttcctgtttcagagttaagaagaatcattgatgagaagacgaacttcagaaatttactttctcagttatagtttaaaagccctgttttcagggcttttattttttattatcatatctgttaatttattatttttatccctcaaattttaaccatgaaaaaaataacactaatgatgtttgggctgatccaaacctttgcattttcccagactcaggacctgacggcacttgctgcaggcgatcatgtgggaatgaatgctctattcgatgataaagacaatctctacggttacgtttctctatattcttacggaaaatccggtgacaagactaaaaagttcgagtatgtaattctggacaaaaacctcaaccctgttgccaataaagaatttgaaggagacatcacagcagcttcttatttgggatatgttgatttcaaagggcagattatcctaaagccatccatgatggattattcccttgtaaaaagcaaagaaatatttactccggtttctatggtgatcgatccaaaaacaaactctattaccagaaagatctattatgattatcttgaaaacggtactttcaaagagatcaacgagccgaaaagctggaaagaacagcgtaaggaaaaccgtgacgagaagaaagaaaaaggctacaactatgtttctgccgttggagaactgaaagaaggcggttatttcgctattgaatacaaagattacggaaagtatgagaacagcaacagcctgatgaagtttgatgagaataaaaaggaagtctggagatacaaatacaatacagacggaagcaaaaaaattcacacttctttatctgttcttgaaagagatgagaactatatgtactgcatcatgaaaaaggtcaatgacaagcagaaaacattcagtctgatggttctggatatgaaaacaggaaaagaaaaatccaacaaacccgttacaggattatctgatgaaacgatagacaatattgaatccttctactccaattacagaaaacttgataatgataaaacttttgaggataaagtagtgctgttaggaagaaattatgatgattcccaatctgtaggatttgcaagaatgatcctcaataaatctgacttttccgttgatacgaaaaccatcaattatgagcccaatatctctgcttttcttcccaaagtggacaaatatggaatggtggaaagcggttatatgcttcagaccaaagacatgtattttatgaatgatggaagtgtaggtattttatcagaaaaatataagcctgcaggccagtacaacgcaccgaaaaccaccgatcttgtttacatctataccgataaggatttcaaggtgaaaaatgttcaggtctttgaaaaggaaaaatcaaagtgggtaaacagtgattatctgttttcacaatacctcaacgggggtaaagatgtggtatttttctaccgtgactatcaaaaagatgaagtaacgaaacagaaaagatggaatctgtttatcaatactattattgacggaaaattcaaacaggagattatcccgatttctgaaaaagacaattatgccgtaactccgtatgtaggaaaagaaggctatattctgcttcgtgagtataacgaaaaggaaaaattcaataagatccgtctggagaaattaaattactaaaataataagaaccctgatgtttcgtcagggttctttctttttatgttttggctaaagcccgtttctattgatattacaatcacttaaaataaaaatcaatttacttttgctatagtctcgtttgtctgataatagtctgctatattctttatttcttcaagacttaaattccacataaagttcagaaactgctggtagctttcgctttgatttttaggttctatcctgtcaagataccggttcaggttataattttttctcgcctcgtatattttggcaaagcattttcccagccagcttttataatatttttcctcctcttcatcctgcaaaaactgcatggcagcataaatccctaatccataatcttctgaatggaaataattgggtaaaatctccatccttgctgttttctgtaatgcgacaaacagatcagtgggtttttcagaagcagcgggtgttttcagttcagcaaatgttcttttaagcatttctattcttctggaaacttcagggtgtgatgccagggaatctttattcagcttttctttataaaagttgtagttatacagtgagaagtcttcctttttcatccatttttcattgaatgcctgcttgggaagattgaaaagttttttgtaggtttccacctttaattcccttggagagatggtatcaaaatcctgtaatctctgaagagcatttacaaattcggcttttttaaaatcactgtttctaaaaataacatatcccaaagaatccgcctgcatttcactttgtctcctctccactcctttcttataaactgtatttttaaaaatatcaaaagctttctgattctggatctggcttctgcttgtggtagtggattttatattctcaaccacgattttatcctgcttatcctgttcaatgatttttaaaaaggttttcagggaatgttcttctattttgtgcccgagttcatgggaaattaccgcagcaatctgctcctcattattcagccagctgtacaatcccatattgataacaaacgttccgtcagcaaggcaataagcattgggggtattgtcttttgcaatcagaatcttcagatcttgtggaattttagggttattctttttcagacgctgaatcatagattgtatactggcttcaaattcagatttgaaaatgaaatccttattcttcacctgtttttcaaagtcggttccgaattctttatagatcttggatagttctgagcctgttttcccggaatattgcgccctcaatctctttacagtagcttcattattcccttcaaaatgctttaaaaatgcttttctctgtatataatctgcagtatctatcggcttatacatttggggcattcccataatcgaaaatagaaagcaacccaatacaaaaagttttctggtcatagttttcatcaataagaacaaaaataacttatttgtggattcattttaaattttgtagtcaaattattctaaatttgttaaagacccattcatgaaaaaatgagaatactgaagtatatgataggcggagctgtagcaggtgcagcggctgcttattttctgggatatgattatttatttagtggtatttcaaaaacctatcttaaaggaagatcaagtgcacatatagatgacggaaatcttttcccaggtaatcctgttgctaccgtggaacccaaactctgggaagaagatcctgactataataaaactgaactacctaaacatttagttgaaaacttaaaacattcccggacagcagcttttgtggtgatcaggaatgggaaaatccttcatgaacaatattggagcggctacaatcagctatcacaaaccaattctttttcgatggccaaagcagtgacggtaatgcttttgggaaaggctctggaagaaagcattattccggatattgacaaaagactttcagatttttatccggaatttaaaaataaaacattcggaagccaggttacgcttaaaaacttagcgcaaatggaagccggactggattgggatgaaaattacaacaatccctttcttcccaatgccaaggcttattatgggaaaagtcttgtaaaagcagtattctcaagaaaatttaaagaagaaccaggaaccagatttgagtaccagagcggttctacgcagcttcttggctttgctctccgaaaagcactgaatcaaccattggcaagctacttatcagagaaattctgggttcctttagggatggaacaaaatgccaaatggagcacagatgattacggcatggaaaaaacctattgctgcattcattccaatgcaagagattttgccaaacttgggcagctgttcctggataatgggaaagccggtaatcatcaaatccttaatgcagacttcattgaaaagatgagaactcctacagcaaagtctgaaaacatttatggaatgggactttggattaatcatgacaatccggttaaacattattatttcctgggactacaggggcaatatattattatggtaccggatcataagatggttattgtaaaaaccggaagctatgctaacaatcctaagaatgacagaggaaggcctgatcaggtaaaattccttgtgaacgaaattgtacaattattccagtaaatgctatggagaaatacagcccgaaaatagatatctatattgaaaaatcacaggattttgccaagcctgttctgcattatatccgtgaaacggttcatgaattctgccctgatgctgaagaaaccatgaaatggagctttcctcattttatctataaaggaaaaaacctgtgtgcaatggcttccttcaagcagcactgtacttttggattctggctggaaaaggaaatgaaaactatgcaggagatgactcaggatattgagaaaaattcaatgttcagcttgggaaaaattacaagaattgaagacctcccatccaaacctcagctgaaaaaggctattaaagaagcgatggaacttacggatatgggagttaccatgaagaaagcagctccttctaaaacagaaatggaggtccctgattattttcagtcagctctcaattcgcagccaaaagcgctggaagtttttgaaaaagcttcaccatccttcagaaaggaatatatttcctggatcacggaagccaaaacagaagccaccagaaataaaagaatggagcaggctctggaatggattgccgaaggtaagggaagaaactggaagtatgaaagaaagtaaatttgatcacaccaaattattctgaattttcagaattcctgaaggtaagcaacaagctcagtatatgatatattttgtccttccttcaatatttttccggtttcagattcctcaataatgatatcaaaatgcccggtttgagaaaaatcaaatgttgaaatatagatgacaacatttcctttttgcagtcctaaagcttcagtatctgcgtcccaatagtcaacaagtttatatccataaaagtcttcccgggaaagctcatctaataaataactgaaatgttttattttccattcaaaaaaataggaaaaaggaaaaataagcagaatttttgaaataaaataattcctaatgaaatctgaaattggcttccggtaatgtattctttttcaggaacgcttcatattccggggacagctttgcacgtccaaaggtgttctctccactcatgcttcccagacgaactttgtccttcccaaatttccggttcatggcatccattgctttcattacgggaagatgctgattttgtatatcttcttcaaaaaggctgatctgtctctgatcttctggtacaaagtcattcaccatcactcctgcccttttataatgaaatccttctctgtaaatagcttcaaaaagctcattaaccactctcccaatcagaatggatgaattcgtaggattggaaagaatccttgtcatagcatttttatactcaggcagatcttttctgaaacggttggtctgcacaaaaacagtaatcattttacagcaggtattctgctttctcagcctttctgagcaatacattccaaaagtttctacccgttctcttacttcttctttattcgtaagcatctgcataaaacttcgggtaactgctattgattttttaggggaagggttgtccagttccagctggcgaattcccttcagctcattgatcattcttactccgtgaattcccatgatcttccgaacccacatttcaggtttctgaagaagatcccaggctttatacactccgctgtcattcattttggcggcaagtcttctcccgattccccatacatctcctatattaagccattttaaagctttttttatcttttcaggagtatctaaaatataaactccgttaaaattctccgggaactcttttacaatcctgttggccactttacacaaagtcttggtaggtgcaattcctatacttacagggatattttccttctctctgatctcttctttaattttaaggcagtattcatagatatcaatatacttaaatcctgttaaatcaagaaaaagctcatcaatactataaacttcatgatcaagaacgtaggatttagcaatattgataacctgctggcttttataattatataattcaaattttgcagaaaagctttttacatcatgcttctgaaaaagctctttgtacttgaatgcaggagctgccataggaattcccaggtcttttgcctccttacttctggatacaacacatccatcgttgttggagagaaccacaacgggtctgccttcaagatcaggatccaaagtcctttcacaggaaacaaaaaaattgttacagtctaccagagcatacatgacaattgtatcgtaaatatctgtacaaaattatagtttttaaagaataaaataatcttttaatccataattaacatcatatttaacaccctgaaaaacaaatggatatttttttttaaatacgacatgttttgtcgcataagcactttaattttgttttcaaaaacttattctttaaacagcattgttcgaataaatcatttaacttctttgttattgttttgaactaaaatttaaataaaacacgtcaagtttcgtcgctttcgtgctatacttttgtcctgtaacaaaataagaaatatggacaaagtaaccttagaacgaattcagaaacttcacccgttggtaagagatgaagtaaagcaaattatccaggaatgtgacgaagcactgaccggcagagccaagatacggatcactcagggattaagatcttttgaagagcaggaaaaactttatgcaataggaagaattacttcaggaaaaaaggtaaccaatgctaaagcagggcaaagcatccacaattatggtcttgctgtagacatctgcctgatgattgacggaaaaacagcgagctgggatactgtaaaagactgggataatgataaagttgcagactggtacgaatgtgtaaagatttttgcccgttacggctgggactggggcggaaactggaagacgtttaaagaccttccccattttgaaaaaaagaatattccatctaaaaaaggaactgtaaaaacaagctggagaacgcttttaaaaatgcagagagataagcagggttatgttattttataactctcatcgatttaagattaaaaaagcctatcaaaacataaccccctgttttacaatactattttttaccaaaaataattaaaaatatttataatacgacaagttctggcgcttcctccatctatatttgctttataagaaaaacaccaaaagcatccttataataagcttaaaaccaatagacattttttcggaaatctattggttttacttgtctaaagttgctaaatgtttcttctaaaaaatgaaaaaataacatgaaaaagacaaccattctttctttggacggaggcggaataagaggaatcatcacctgtattattctgcgttacatagaagaacagctccagtattatgataagcccactgcaaagctcggggactattttgatctggtagcaggcagcagcaccggaggtctgattgcttctattattctatgtcccgacgaaacccgaaaagcaaaatattctatccagaaaggattggaattgtatgcggaaaagggcggcgatatcttccaggtttccttttgggaaaaactggttaatccattcggattattgaatgaaaaaattccacaggaatcacttgaaaggaatttaaatgacttttttggaaatttagaattaaaagaactaataaaaccatgtttaataacaagttatgatatagagaacagaagagcaaagcttttcaactcatggaaagccaatctcagcacagataatttttacgtgaaagatgtctgcagggcaacctcggctgctcctacctacttctgccccgttcagattaaatctatgtatggacagatcttcagcctgatagatggtggtatgtttgctaataatccagcgctatgtgcttatgcagaagccagaaaaattccttttgcagaagtgttaaaaaaccatcagaaagccaatcatccgggagtaaatgatatgataattgtttccatcggaacaggaatagaagcaagaccttactcttttaaaaaactgcagaaagctggaaaaataggttgggtaaatcctattattgatatcttgatgtctgccaatgcagaaacggtagattatcagctgggacaaatgtttcagacgttgggattcagaaatcaaaaaaactattaccgtttgaacccctcattgaaaaatgcttctccggcaatggacaatgtaagaagatcgaatatcgagaatcttatacaagcaggattaagctatattgatgataacagagatactctgaaccagattgttcagaaactcattaaaaataaaatataagctttttaccttataacaaccctatataagctttaaagattatattttaaaattagaaaatcttttttaaatacgtcaagttttgtcgtttcgccccgctacctttggagtatcaaaaaggacgcaaaacaaacatccataaaaactttaaaaagcctttgaattcaacatttccctatgctgaacagcctgaaatatgttcaaaatataaccaacacccaattacacaaaacatggaaacaccagatcacaaaacagataccctcttcgatgaagacctttataccatagaatggagcgatatcgaaaatgctgagatggattatgaaaactatctcaatgacattgaaaacttcttcagagaagattttgaagaaggaatacttgaagaagatattttttaagtaaaaatttaaaacacgacaagttctgacgctgtccgacattacctttataatctacgaacagcaatctcattaatcatttccaacacctttgaattcaccattcacaaaatgctggacagccagaactatgtctgaaaattatagcaattataagcctgttataccaaaatacaggacatataatcaatttattaaccaacaaatcacacaacgttttatgaaaacaaaagaagaactaaaaaaatatttcgaaaacggagatatcccggtacaggaagaattctgggagtggcaggagtcatactggcataaagatgaaatgattcccttaaaccaaattgccaatgttgatgccgtaagtgtcggaggtctgctggacaatataaaaacaggaggggtcagagattgggttctgggctcttacaaagccggagaagttgtcagacatcttaatattttatggaaagctaaaatagatattacaagtgcagttcccggtaataatgctaattgggagatttattttccgtttcctaaatcaccgggtatattcacatcacattccaccactttaacaattgatactgttactaacacagttacattaattggtacctcaacaaataaacttattacaaatcaaggcgtatttaatgttagggcacagaccgttgatacctcggcaaatccaacatattatgcaattgtctataatacatcaagtacaaatgcaagagcggttacagtctatgataatgctgcaagacctttgggaattaatgattatgttttgttttatgtactcaatctaaattcgatcttacaggatgtttttggagctaaaggatatacgctaatcaataccacagaaacaaccacttaccccataaaacctgtagcgactgctgacgttttatataataaaacatttttaacctggcatgaatccagaacatcagatgaaaaattctggcttagtaaagccatcttagatgctgaattttataatgtaaaagacagtgcggtggttacattatacggactaggaaaaaatgttacaactaccaactcatatcttggttttatctatgcagaaagaggtaagtctgcactgttcttatatgcagacgaatttaataatgctttttctgccccttatgatcctgtactacactcaggagttaaaacctattttctcagatcaggaaccaaaagggaatccaatacaacgatatatggaaaagtaacaattgactggtctcaggttcctaatcagaaaagagtggttgaaagtaactcaggcgttaccaataatagtaacctaagcaggacgctgtataaaaaatcagaagtctttaataatcctttgggatttataaagtttgcaaagtcccgtagtttcaatgattattattctgctcctgcattagacagttatgcaggtccggatggatctggcattccaaaaaagccctatgaggattgcagagaatggtcattaaaatgggatgaacttgtcacaaatgtccctcccggatattcaattagtaaggaaacgcttacaactgatgtccctacggataccaatgctgaaggaaaactgccaatttatggatatacttttttacctggtaaactaaccgctggagaccctaccggaaataatgcccagacgttgccacgaattgttttaaattgttcaatccatggttttgaaaaaacaccttcatttgttgcttatgaactcatgaaacaagttctgacgaattggaaatctcatccgtttttagaatacctaagatttaatgttgaatttgttattattccgtttgccaatccgcacggatggaatgccggatccggtgcaggaacacgcaagaatttgaactcagtagatttaaacagaaattttccaaccttttgggcaggtggaggttctactcccgcagattctacatatcccggtcaggcagcattatcagaaattgagtctcaggcaatatataggtacatgcaggaaaaaatcactccaaacacaataatgggtatagattttcacaatttccatggtaccccccagacagatccgaaaaattacaatatggcatggattgtaaatcttggttctgaattaggccaaagttcagccaatattttaatgaaagaactgtcagcaaaatataaggcgaaatctttactaattccacaatctgatgattattgtatcggacagtcaaataactataacggcccgggctttagtggttctgctatgaaatctttgggagctctttatgcttcaacatttgaagtctgtcagaacttccgattcaatcccgcttttaaaagccacgacagtgatgctattacttttggtttggaaacatttaccaactatttaagaatttttcttgctgagcatttggaagaatacaacagaacaaaataggaaatagtttctgtatacggtgatttaggctttggaaatgctggcattccgtaaacctaaaacttatataaccctataataactcatttacgttaactcttgagtaaacaaaaaaataaacaaaaaatgccaacaaatattacatcaacaaaatccgcatttaccgtcggaaaatccttcataggagaaggaattattaattataaacaaataaacactatgaacacaaacaacccatcacaaacacttttcagattcgtaagcttaagaagcccgcaattacccgatgaagataaacaaagcaaaaaattcattacaattccggattctttaaaaagcgacaatacattttatgtacctgtagcctcaggaacaaggcccaagcaggaattgttaaaagaaagagctgctgtttttgcccaaaatgcgaattttattgctgatatggacgcattgaaacaaacctatggcattgtgtatgattacgcactttggcttgcaaaaaataaaaacacttgttcttataatcaatttaatgagaaaaagaatcaggtaaaactttcctcttcttatgcatttcctgaccttatcaatttatggaacaacttaatttatcagatagccacccataaagacttttatgttaaagaaggactcatgcaggttttattggcagctcatacccttactcttgaaaattcagctccaggagaagatgaatacaaagatctattatccgcaagagttgtaattcccagagaactgatgctggatactccggatgccaaccctattggcattacttcaaaaatggaggaaaaagaatcgggagaagttacatcaccatcctcttacatggaaaagcagcaaaatatccaggaagcccaggctcttcttaagagatatgaagtgttaaccaaagagatgtctcttatcgagaacagctataaaaaagaatatacacgagaatataaggccagtgaagaaaaacataacgaatccaaccaatccatccttgacgaatattatgtccgcgtagaagaagcaaggagaaaatattgtgagatcagaaatcctgagttgccatatgatcctgaagacccttgtaacaaaccagaagaaattccgtatccgaagcttccgaaatttgaattctccttccgccctgaagttgatgcgagaactcttgtaagtggattgaaacccgacagtattgatacaatattatcccttttagaatatgatttttcagagacgggtaaagaaaggattgatgactcatcactaattgatagtttgctggcaggaagaaatacgttcaatgaattaaaagacattatttccaatgctacagagagcgctaataaagttattctggataatatcatggataattcggaaagctatacaagcattggtggagtcattcttcctgtctcaagagtagaaacgattccttttacctatcagttatgtccgaggcatactttaagaaatacatgcctggacttatctatcgatgttcctgatgcttcctggaatgtagcaagtatgagctatactttctataccaatgcaggacctatttccgggacctattttgaaaaaagtcgtgttggtaataagattttcttaagtaaattattaggaagcgcaacaacagacggtgtatacatttctcaaacagagaactttacaatggatgttaaaatcacctttaccaatggtaaggtaacgactttcttcccaagaattatttcaatgaagtcctgctacacctcatcttttgagtttgtaaatgaaattaaagatcctgtgcaggaacctgatgattcttatatcccttccggatttggatttaagcaaatcggtattgctgactatcttaaagttgaacagaccacccatgcttatgtagaaggagaagtggctcatattgaaaacgtaatggcccgtgagtaccgtgaaaaagcaaccagaaggctaagaagaagcgaaaacactactactacatcttcagatactgaaagagaaaaacttacggacactactactgcaaccagatttgaaatgcagactgagattgccaaaatgttgcaggaatccagagatgccaatgtacaggcacattttgatgcaacatgggaaatgacagggggaggatctatcagtacaggaattgccggtgggtatgccactcattcttccaaagaagaaagtacaagacaagcccttacccaagctcaggatattacagcaagagcattagacagagtggtcacaaaagttcatgaggaaagaattgaaaagatcattgaagagttcgaagagaataacaaacacggctttgacaataccaaaggagataagcatgttgtaggtgttttccgttgggtagacaaacttatgaaaaatcagatctataattatggcaagcgtctgatgttcgaatttatgattcctcaacctgccaaactgcatacgttgggaataacattggacaattcagcaacgaagagcgatcttgtaaaacctgaagacccaagaaaagctagctatctgccattagaaaactattcatctttaggtaacgaagcggcattaaaatattggataagtaaatacaatgccgaaattgatgagagacctgcagaatcctttgctataagtaaatcattcagtggacgcgatggaaacttcggaggaaaagatgatgacaaggttcagattgtaaacggaaacggagaagttgaagttccggaaggttatttattaaaaactgttgattatactttccaaacctatccacacggctttaaaggtgctcaccaggctttcatgaccattggaggacaaggtacttactggatctcttcacctaacagtacacaggtaagtggaacaacaacaaccctgaatatcaaaaataaactggaatttagttttgctacaggagaaagcccaattatgcaaggtactctgaaactgaatttagagcttactccggaagcaagaaatgcatggcttcagaaaacattcaaagccattattgacagctatgaaaaggctttagcaatttacgaacagaaaatagcggaagaaaaagctaccggtatccagattaaaggatccaatccaggattctatcgtcagatcgagaatacggtactccgtaaaaactgtatctcctatatgatcaacagatcagccaattctacccatggctatggtatggcagggctaactaccggaagcacctttacagattatgaaacagacctgtcatcaacactggataaatatacagccttccttaagtttatggaacaggccttcgaatgggaaaacctttcttattatctgtatccttactattgggctaataaaacagaatggactaatctttaccaggctgaagatgtagatccgttattcagagcattcctgcaaagtggtatggcaagagttgttgctactgtacgtccgggatttgaagatgctgttcagttctatatggcaacaggtaaaatctggaatggaggcgaagttccagttattggagattctctttatctatctattgtagatgaaatgaaacaacctaaaggcataaaacaaggaaaggcatggattaccagacttccaactccattaaatattcttcaggctgaaagcatcggcttaaaagtagcgcatgctttaccatttagtgctgaagatcctaatgagtttgaagtaccgggagaggtgattacggaaagtaactttgtgaaggataattctttaatgggaaacaaatccagcataaaacagatccaattctctcttaaagaattagatagtacagcctcgtataataccattggagacctagaccaagcaggcgagtttcctagaacttacgaatgtatgggacaaagcattgaggttgtaagagacgcaacatgggcaaaaacagattctctagtgaagatttatggagctttggcttccggactttcaggaatagatggcattgaagcttttgccaataccgaaaatggagttaccatccgagtggacatagataaaatcaaaaatttcaaatttgtaaaacctccgtatactgatgccatggataccataacttttaccacagacgggctaacttatttaaaatttggcaacgacaattttgtaggttctgcaaacagactttttgacaaagatgataaactaattggtacccaagaatatgctgaaaagctttctctatcaagatttctaatctaattctctaaaaacaagaaccatgagtcgagtaaaactcgaggctatttggcagcacgaaaaagtgctgccttatatcctcacaaccttaaaggacaagattgatgatattactgctgtagaaaagatatttcttttcggaagcagaggtaggataccatttgataaatgggacacgctggaaggaaaagactgggatgttttggtacaggctaaatgcaaacttaaaaatgcccacgcactccttgataaagattactatctggatcttctcgtgttggatgaagaaacaattcagaagcattattacaacaataagcttacgatggtttttccggaaaatgtactagatgatttcataactaaaactcaatagcatggcaaagattaaagatattatcgaatttctgaggctgaaccgaagaaatgaagaagcaaacaaaacacctgtcactccgaattatgttatattggaatcccttgatacccataaggagtatactgttagcaaagatgattttgaaaactttgataaatatataaggctggtaaatgtattgaatgattataaagccaactatatttatattcttgaaaccaatgctaataaaacattttacataaaaaatgcaagtagcaaatttgttgatattattactcatcaagtaaacaatgccgttactgaaaatagtcttaaacaatatgaaattgactttggttctaatttttatttttatgatacttctcaaaataatgtcgtgatctcagtcacacaattagctgaaattaaaatttttagtgacaccattaaatacattcctaatgaagagcccataaaaagcttccagaatgacgattatgcttacaattatgacagtcatgaaagtatctcacactctattttaaaaagaattgccgttgcagcatcatctcgttataccccttccggaatatatagctctgatcggatggtaaaacttacaaagtctgaagaaaacggaaaaatgtttctgattccggatattaaacatgataccttaaagggaaaatattttttacaatatcagttttggaaacccaaacaggatagtgaacaaaaaataaagcccttttatgctcctatcggagatgttgcaatgactttagagtttaactatattggagcttttctctcttttcttaatgaaactattttcagccagccaaattttaattattcatctgaaaacgatggaaaaagagaagaattcaaggaacagtttaaaaatattgttattgttcctttagaaaattatgcccttagagatactgacaaatattatcgggaaattattgaggttttttattatctgcacgaagatgtagcttccaccattaatcctaatataatctggaaactcatcaataaagcaattgaaaatgatgggcttactaatttttctattaacgaagaagatctatttataaaacttctggaaactcttttagcaacagaaggcagagaagaaaaattccttattcggttaaatgaaactatttctgttaaaaataccacaactgttttagaatatctatatgacagactgaatggagaaaatggggtcaagtttgtaaacctcatcaacaaagcttggagaaaaacgagatttgcaaagcctgatatcgaaaaaaatcctgaatttgcttcaacagatggtcctttaatgtttccttatgaatcagaaaagtggttgggcttatattttagcaatgctaaggtcagctttgaaaataattcaaaaaaagaacgtcttttaaacgtcacagttactactgaccaatataaaaaagttaccaaaataactcctaagggtgatacttatgaaactcgcgaaaaaataaaagaacatttttggtatcacccgttttatcctgtttatttaaaaaatgttgagaaacaagactcagaattgaaattagattccattgttcctgcctttgtactaaaagcaaacgaagataagcagttctggagcaatgtaattacgagtgcggagtatgcattggatgtggcaacaaccttatctggtattggtaatattacaaaattcaggtatcttacaagagttacccaactggcagaagtcatagagggaacaaatgccatttccaaagtagcaaaagccgcaaatattttacgctatgtgaaaggagcggcaggagtggtagaacttactagtggaagtataaatctgatgataaagattactggggccaaagataccgagtttggggaaagcctgagtaaggtacttttttacctagaacttataacattggctggcgaacttaccacttctatgaaaatggggctaaaaaaaagtgctaaagaagcaatagaagaatcgaatggtgctatgcgtgtaaaacaccctgagctttttgcagaactttatcgaattgcaggattgaaaaaagtataccaacatgtggacgattttatgaagacccggcctaagttccatgacctaaatttgataaaccaattgtggaaagaaaaaattgtcacaaaacttatttttccaactaaccttagaaaactttactttaaatatctggatgaatttccagagttgaagaaaggatttaaccaagctgagtttaaaactactattttcaatcaaggggaaaaagtgaaagaagtggtagagttttctttatctggaaaacgagaaaagttattgtctgcttttggagatcctcctaatttgccggaaaatacaattgatattctgagcgattatgagaattttgaaacattcgtaaaaggagcagaggactttggaggaatcccaagaaattatgacagtgaaataaaatatattttcaattttcttaaaaatcatattgataaaggagatgaatttattattgaaacccgaaatattttcaaaacctgcggaagctgtcgaagagaatttgtgatgttggaagattatcttaaattgcaaggtaagaaagttaaaattatcgtaatgagtgatgagacaattgaaggaggaagaatgttaagagataaattaaaaatcaaatagctatgacaatagaatatatgacaacagtgaaagataatctaaaaattaataattttattaatagaggattttcagaagaaaaaattcaaaagatagaatcagaatataataaaggaaataaatttccaaaagcatttagagagtttttatacttagctggggattttaataattttggattcgatgatatcgaaggtatattaaaactccaggaattagctaaagaagaattggaaattacaggagcaaaaattgaaagaccttttttcgtatttcaccaactatctggttgtgaatattttacattcatttatttagatgaaaatacagctgatcctaaaacctacatttgttcaccttattataaatctactccgggggaagagtttattaagtataatggttttacatttacagcattagtaaacgaaagtattcatcgagtaaagaataacattccgttttaatagtatccgcctcaataagaggcggttttattgactagttattcgagaaattatggcctatgcacctcttgagaaagagaaatctgggcaattgcaaattattataaagttggttatttttatcctgatcattatatgatttatacagatttaaaaggtctatttagttggggataattattttaaaatgaataatatttttattaaaggtattgaaaatcttattaaagacaatatgaaaccgacaaaagaacaaatcatacaaataggattaaaagtagttgatgatgtctttaaagaagcttataatttgcaaacggcttcagcaacaaaagataaagtaaaagtatattcattaggcaatgatggatattatgaacatgacggatggcattttagtgtgaatagtaaagaaaaatatgataatgaatataaatctttttttatatactttttagatagtggtgttcctcttcacatgacctcttttttaggagatgacaaaccgaggtttgtttatgctataaaagataaaaataataaatacactgttgttgatgaagatacatatttcaaacatcaaaattttgactttaaaaattttgtaaggaagaatttttaacacacttccaataagttttatataacaaaacttatctacaagattaaacatgacatattttgttgtatcaatcgcatatatttgtctcataaagctttaccataaacgcatcactgtagcaacataaaaatagagaaagattttatttgacaaaatatgccttaatcgtgaaaagattaaaaagttctccagctactattcatagctggagaactttcttttaatttcaaattctctattctaataaacttcccacaaaattaaaaacacgtcaagttttgtcgttttcccagcctacttttgaagcataagtaaagacccagcaaataaccattaaaatcttaaaaactcttagaattcagcatttacaacatactgtacagccacaactatgtctgaaaatctaagccttgaaacatagtcagctttaaaaactgagcctttctaacttaacctatttaatacaaaaatcaccaaatttttattatgaaaacaaaagaagaattaaaactatgctttgaaaacggagacatacccacacaagagcatttctggtcatggctggattcctattggcataaaaacgatttgattccaataaaccaaattcaaaacagtgataaaattatacagcaaaacagcagtttcaatgattatatgaatccaaccctggaagttggagcactggccatttcaggctctgttggatttcctacaggttcaactataagaggaaggacggattcttttttagatatcgtctatgccaaccaaattgaacttctgggtgatatgttattgcaaactattttctattataccgatacgaatgtttttatttcaaaacaggatataaatgcaaaaacatttacgccaaccatccctgtaacagcaaagaaatggaaagtttccctgcatcatattgacaaaacgcaaacagttacccagcccgaattaaatgcaattaagatgaattgctactcatctaagtcaatcacatttaatgatattgtagaaaatgcaaaagcttccataaaagtcatatcagaatacaataatttagaaattaatttaggagagaatattcctacagaaatcggcaggatagccgtaaataatggcttcaattctacctctgatacagggataagaacagctttaattcctatagtttccggtaaatatttgattagccagaaatcaggatataaaatttcccgtgttgttttctataaggatggaatattcgctaaccagaatgttacgaccaatgacttttcagtagataatttgacctctaatcaggtgagactcgtttttgaaaagaatactccaacagacatcgttaccgagcaggaccgtcttgatttcacatatattttaaagaatgtcagtgtcagtaagtatgatcagttattaaatgaaagtaaaaaaagcaagccacttccatctactatttatacgatcaatgaacaggttgccatcctaaataccaatgatacggacatcaattttgatttagctaaccgtaagatcatcatttccggaggagcaatcattgacacgggaaacacaactgtgggaagaattagcctgcccatttcaactgcgggtatagatatgccttctgctataacggccggtgttgtattgtataataaaacaaacaatacaatcattgttcaaaaccagacatctgctcctttattaaaccatttggttttatttacttaccggtatagcggtgccttcactagtttttacgtcaccggcctgaaaaattattctgtaaacggagttccagtatctcaaaaggacattcgacaaatgaataaatttgcagtcgacaatttcggaattaaatattggagtgctccggtttatcctgccttcaatcctttaactcttacaacagatgttctttacccaatgtatgatcgtgtaatagcacccttctcaaataatgtcactaaaacagttataggccagacagaaggtcctacaccttatgatattttgcggattgatatttcattgaacagaaaaacgccgccaacacaaaggcgcagaaaacctcgcatattcgtatgtgctggtacccatggaggcgaaaagttgagtgtttacacaacctatttattttttaaactgttgcttgaaaatcctaataaggatgagatgatagatgctttacgcactaactatgactggacattgattcctttggttaatccatatgcgttgaatgttggaaatgtaggtggcacagaatcggtaagatggaatcataacggcgtggatattaacagaaattttgattatcgctgggcagaatatgcagacggtggtgctggctcacaatcctataaaggaattgcaccatttagcgaaaaagaatcacaattggtaagggatacttttaatgctattaaaacagacaccgtattatttattgactgtcacaattttggatcaggagtaaatattgattatcgtgctgcctggtttgcatcatcatttaatactgttcagaatgccatctattcattatgtgacagattagatgctgaaataaggaaacgatatagttatttagccgataaagatctgcttgctttttcagatattgatggcagctctccgatgtctcaggcctggatggggaatcagcaggtagtagcaatgacaatggaaactgatcagagtgattactacaatccaacagatccaacatcctttaacagtaatgtcattacaagaagcatagaaacctacgtaaatgcattttattcgatgggtaaatatgctgttgatttttataacaacagaatgtattagccgatataatatcaatacataagtttaacgttcaaaaactaatacccattaatatgaatatcggaagcatcccagcttgattcttagcaatactatgtgataaatttccaacaaaaaaataaaacacgacacgttttgtcgcatgaaccgcatatatttgtcttataaaactttaccatgaatcgcagcgctgctgcaccctaaaaatagagaaatgaagaaagatttttatctgacaagatatgccttaattattaaaagattagaaagttctccagctacttattcccagctggaggactatcttttaaactcttttgaattccaggatgcaggaatcaagagctactctatccgtacgctgcaaagggatatccgggagatttcagatcttttcaacctctccattcataacaaaaagaagggtgacaaccggtattatatcgagagccgcccgattatggaagtggatgaatacaatcagaaacttcttgagtccttccaggtgagcaatgccctgaaccttcacccggatttttcagattttatcttttttgaaagccgcaaaccaaccggtgtggaacatttttatgacctgttctttgcgatccggaataaaagagtagtgacttttgagcactacaattacaagaacaaactgatgacctccagaaaagtgcatcctttggctttaaaagaatctaaagaccgttggtaccttattgccatcgatacaaaagataaagttttaaaatcgttcgggcttgacaggatcaattatcttgatgtggctaaaaatcagttcagagagaaatacaaatacaatttcagagaacattttaaaaatgcattcggtgtcatgaatctggcagaacagaagccacagaatatcgtattgaaatgcagccgtcatcagggagaatatatcagaagtttcccacttcatcaatctcagaaagagaccagagaaaccccggaggaaatttattttgagttcttccttcatcctacttatgactttatgcaggagattctttcttatggaaaagaagtaaccgttctggaaccgaaaaccttagttgaagagattcgcaatcatttacaggaatctttgaaccgttatcttgaaagctgatcataaaggacatatttcatattttttgttatatttacataaatatacccttattgaaaactttattcattggcatcagctgttttatttctaccttttttctggcacaacagaaggaagagttcaggcttgtaaagagctattataaccagcacagaaacatgttgaacaaagaattcaaaaagaaatttgatgcagagtccaatgccgtaaaaaaagcagagattaaaggtgattttctttttttcatgaaaaaaatggacagcattgaaaataatgcgatgatcggagctttattaaaagtcagaaatctggaagaccttcagaccatcagaaatcctgaacgtaaaccctcatctgaagacttttcaagtgctgaaaagattgcagattacccgggcgggattaattctttaaggcaggaagtcgccaatctgctgtatgttgacggggtatattctaaagaaaaaactataaagacggatgtggattttattgttgaaaaagatggaacagtcagcaatgttcatgcccagggtgacaatttcaccttcaacaggcaggcagaaattgccttatattctctggcagaaaaattttctccggccatgataaaaggagatcctacaacttatcgttttaaacttcctttaactttaacgataacagattaaatgtttaccgacgaatattacatgaaaatggctctgcaggaagcagaaaccgctttagaaaaagatgaggtccctataggatgtgtagtggtttccaacaaccgcattattgcaagagcccataatctcactgaaacactgaacgatgtgactgcccatgcagaaatgcaggctataacttcagcagctaactttcttggaggaaaatatttaaaagactgtacattgtatgtcaccatggagccatgtgtcatgtgttcaggagcgctttcctggtctcagatttccaaggtagtcattggagcgcgtgatgaacagagaggttttatcaataaacatctttctcttcatccgaaaacagaagttatcacaggcattatggaagcagaatgctcttctattgttaaagaattctttaaaagtaaaagataatttaaaaacacaaagccggagaataattaaatattcccggctttttatcttataatttatcctgttaagatttcttctattcttttacaatacaatatctcaccagatcaaaatattctccatcctttttcacctcctgtacgagaacagcctcctgctccattcctattttctccataattcttccggaagcaggattgtgagggaaatgagtagcaaagattttatgaaaattcaattcattaaatccaaaatcgatcagggcttttgcagcctctgttacatatcctttattccagtaaggaattcctatccagtagcctaattccgctttatcatcatcgcggtcatggagaccgatcgctccgatgatttgtccttctttattcctgattccgaaagtatatccggtatcattatcaaaagcttccttggacatttccagccacatccgggcatcattttccatgtagggataagggatattagaagtaagatcagaaaaaattctgtgctgaaggtattcaacgataaaaggaatatccttctcctccagttgtgatagaataagcctttctgtctgtataatcggaaattttttcatattttaaaattaaggttgaggtgaagactaaggtattacccggattcaacctgaaccttaatcttttatttataaatctttcccaaggaaataaagtcctttcagggtgtgaagcctgtccatcacatgaattttatctgtcaaaggtttatagatatgagagactcctcccgttgcgactacgaagcaatcatcatttacttcttcattgatacggctcacaaatccttctaccattcccaggaagccatataccattccgctttgcatacaggttacggtgtccaaacccagaacagatttgggctttttcagttcgatatccggaagctgtgcagtttggttgatcagcgaattcagagacgtaacaattccaggagcaataattacccccagagtttctccgttttccgctacacaacttgccgtaagagcagtcccgaaatcgataataatctttttcttaccaggatataaattatgagcggcaacaaggtttgcatagatatccgtacccatttgtttggatttagcctgcactcctgaaggtgtattcctgtcaacaattacagggttggtcccgtggatttttttaattcctgagctcatgactttggtaagctgaggtactactgacccgataataactttatcaatttctttcggttcaattttatacgtctgataaagcatcagcatctgtacatacagctcatctgccgttctgtaaggctttgtattgattacccacgaaatatcacaattatcaccattgaaaagtccaaatctgatattgctgttccctacgttgattacgattgaattcattgacatatttttcagaagaaattcattatatataattgaaattcctgcttgattttgagggcttaaatttaatcattttaaaaaaaagaacctgccattatccaactaaattacaatgacacacttattttttctttctccggaacaattcagtatatttaaaacacaatattattattctgactatctcatgaaaaaattgatccttgttactttactatgcttcggtatctgtatttttgcgcaatccggcaactcaatggcaagcattttacaaaaaataaagagtcagtcaaaaattgatcctcaggataaggtagtttatgatctgatggatgaattttatcaaaaaaatcttcaggctgacaatgatgaagtaactcccgaacttacacacagaattcaaaaagcagtttctgatcccaataccaaaaatatacacctgctttatcttcttctgatgtatcagcagcatatcagccagactgtcgcagaaggaaaaaatgcaaatcctgaatttcagattgaaaccatgaatctccttgaaagcgaaactaaggaagtatatggaaagcttccggcaatcatctacatttttaaagcggaggccttagacagcggctcccagaaagaaaaagcaaaaattacggttgcaaacggtttaaaagaatatccggactctattcctttaaaagtttatagttatttaaacactaaagatgagactttgaggcaggatctcatccaaaatcatcccaatcactggatggtacagcaattcggaataaaataaaaaaaccacagaggaatctgtggttttttctttgtatatgcttatcgttatttcacctctacaaaattattttccatattcacatctgcaattctctggctgaaatcaattccgagaacagatagctgagatttggtataaggaatagtaagggtatattctttctgagtccatggccagtaaggcattgttttaaactcgccatacacatctttttctttccatgtatgggtcatattcattgggatctgataggtaacaattttcttatccgttgtcatcactccgaaatcaatcggcattggcacctgaccattattaaccagagtaatcgtagttgactttgcatcgtacttaacatccttaattccgtaatcgatggtttttgttgtattgatccagtaattgtggaaccatttcagatccatcccggaaactttttgcgcaatatgaaggaaatccctgtctgaaggatgcttcatactccactggtcataatattgctttagggtttcggcaagattctgctctcccataatgtatccaagctgcaccagatataattcaccttttacataagaggcataggtataagctgtaccgttatcatggtgatcacccaaccatacagccggttcttcgattccttttttgataaagtttctgtaagcatcaagtgttttagcaaatggattggggagatcttcagggaatagctgatacatggtataaccttctgcataactggtgaaaccttcatccatccacgggcgtacagattcgttagtagcaagcatttgctgataccatgagtgggatccttcgtgagccattaaacccattaaatctttaatgcttttagcttcccctaaaatcatggtacacatcccatactccattccgccgtctcctccctggataaatgcataagtaggatatacatattttccgaagtgggaattcataatcttgaaatacttcgtgatataaggctgtgcctcaccccatgcttttgttttatcatttttctgataaaccagatatactttcggaccttccggaacattgaagctttccacaaaataatctctgtcagcactccatgcaaaatcaagaatattttttgctgtccatttccagaccgcttttttgtctttttctgtttttattttggcattggcatcgtagccttttacttctgttggattttccagaattcctcctgctcctatgacataatctttattgattttaatggtaacatcaaaatcggagaacggtgcatgaaattctcttcccagataatcaaaagttgcccagccgtcataatcgtattctgcaattttcggataccattgtgtcatcgtcatgtcaactccttctttgttgtttcttccgcttcttctgatctgctggggaatcacggaatcccaatccattgtaaacgttgtggtagaattcggtttgatgggttcagccagatacactttcataatggtttcctgaacttcaaatttcaggtctttcccattctgcttaatccagtgaatgttctgagctccttcctgatctttcggaatggacgccagtcttgaaatgccatctttctgcagtcttgaatctccattttttccctgggaagccaccctctgatccatcatggaattaggtttgaaagcattccagtataagtggaaataaaccacattcagctcatccggtgaattattggtatattctatcgtttgttttccctggtaggtaaatttttcagcattgacatctatatccatcttgtacttcgcagcctgctgataataagctccttgctgagcctgaaattgtgaaatgataaacgcaaaaatgattgcagccgattttctcatttaaaattttattttttctaaaggtaggtaatttaaataagaacctcaaataggagttattttgagattttattctgtttattatggttttagatgaattttaatcagagttgttaaaatagaaattcataaagatgaagtgacttatttttactaactacacatgacacggattttcctaaactattatgagtcgttttttgatacggtgagcattgatgtgcctattggttcttcaacatttttttgattaaagtaatctgtcccaggtgatagtagctatgctcgatcattccatcaatgtttctccggtaagttccgtatttttcatcaacaaaaacctcatcaagtttagaatcaggcatctgttccagcaatgctgcaaacttttcagcatctttccatagcttgttcaacaaatcttcccattgttgctgagattctatgggaggaagatcaaaactgaatttatctttgatttcaagatcaccaccttcaaaaacattgataattcctgcaatataataatcaatatgaaaagtaagcattgcgatcgtattcagagaatcaatttttgccactgcctgttcccagcttacatctgaaagctgatctttaaaattggtattggcgatccagagaccatccagcaaaacctctctgaatctttttgataattgtgatactgaactcatgggtacaatattatttatgtttcctaaagataagtttttatttaaacacaaatctcaccaatgaaaacctctattttaaatccaataaaatagtgcaatttgtgcaaaaaatttgtgatattcgtgtttaactaattacaaaaaacctcaaatgcaaaatacatctgaggttaatattatactattgaattacaattatttcttcgtggaaacttctttttttccgcttcttaaaatcttttcaaggattcttagagtaatcagataggttggcttcactcctgtaagcccaagaccacccgaagataatgtacttcctgtttccagcgggttatctgatgcgtaataagcatagcacacgaacagatccggtgaaatatgatgtctgatcttggaagctacctggatggctttctgataatgtgctccttccatttcaagaccaattgccttccatgaagtgttcataaagtaagaaagaatatccttgttctgaagggaagttcccagaacagtaatcattggcccttcgaaagctttcaattcatcatcgatgaaatcttccagttttaaagcattttcaaaaggataattgtctgcagtcccttcaaaaatatgagaagtagggatcataatatctcctttcgctccggtaagaatacctgcttttcccatgatggaaacagattttacatgcatcatgtatacttctcctttatgttcaaaaggtctcagcaattcatccatcacctcgaaagcctgttctccgaaagcataatcaaaaaccattacaacatcatctcctgagaacttaatgtctgcaaacggggtattcttcagatctgttttgctgaggtctatgatctgaacgtcaatattacttccactcttgtccgcaatatgaatcatgccttcctccaaagcatattttaaaactttatcacgaagttctttcttgtttgaaatttcttcatacagtttataatcaacttcatgatgctgtttctttttaagtgcatgattcgcatacagcatattttttactgaatgcatattggcagaaataatgtgcaggggacgcatgtgaaggttattttcaaataaaacctctttcaccttgttagcccatttctctccaaaataatggtgtcccactctctcttttaatatagagctgaaataaatttctctttctctgcttccttttgcatcctcaagacttacctttcctaagttgtaaataattttgaaaagacggtcaggattatgatcatcaccaaaagtattgtaggctcttaatgtttcatcaaaagatcttcctattaaagaagaaagatgaataagcgccacttctttttcttttctgctgaatttcttttcccccttcaccacttcttcaataattttgaaggcacgtgtcggtttccagttttcatcctgaatgaatgccaggttacggattttatcagcttctataaacaggaatgtcaggtgggtaagaatgtcataaatttcagaacggcccaaaagaacctcaatattcatctggtgttcgtctattctataacagtttcttcttcttttctttggaacaataggttcgaaacttcctttatcaaacccttcatcagatgtaagatgaataaaagcacattcttcaattccttccggaagcctgtctaaaacatacatcaaaccgtccaattccaatttgctcggaatattcatggttccgtaaatttccggattgatggttttcaacaaacttctgatactctctcctgaaactcctcccggcttgaaaaatcctctataaaataagtgtctcatagagatgtatagtctttcaatagcctctgttgtttctcttgctctagaatttgtcataaaataaatttcacacaaatatacaaaatctttacccactttattttaactgtcttttaacaagtattttaatcattcagtatgattgtttattgcataataaatagtatatttactctgtattctataaaacaggcttaaaatctcattttttaaacattaaatcaccaaacacccctgttaaaaacaccaaacatttgtttaaattatataaattttcagaataccccttaaatttttagggttaaaatgttttcaattcattttttttgtaaatttgccctgtaaaaaatcaacccatttatgtcaaccttaagattcaaagcgttagaaaccctaccatttaaggatttcagaagagataactctgttgaagttcctgtaaaattatcagaattattctgccagaatgttttctcagaagaaacaatgagagaatatttaacgaaagaagcattccagtctattatggatgctgtaaaaaaagggactaaaatccagagacacattgcagatcaggtagctgtagcaatgaaagactgggcaatgagcaaaggagtaactcactatactcactggtttcagcctttgacagggacaaccgcagaaaagcacgattctttcttcacccctatcgaaggaggaagagctattgaaagattcagcggaaatttattgatccagcaggagccggacgcctcttctttcccgaacggaggaatcagaaatacgttcgaggcaagaggttatactgcatgggaccctacttctccggctttcatcatgggaactacattgtgtatcccatctatcttcatctcttatacaggagaaactttagattataaagcaccccttttaagagctttgaacgctgtagacgaagctgcgaccaacgtaatgcagtatttcgacaaaaatgtaacaaaagtaactcctactttaggttgggagcaggaatatttccttgtagattcagcattataccaatcccgtccggaccttgtattaacaggtaagacattattaggacattctcctgcaaaaggacagcagctggatgatcactatttcggttcaattcctacaagagtaatgaacttcatgaaggagctggaaatcgaatgtatgaaattaggtattcctgtaactacaagacacaacgaggtagctccaaaccaatttgagctggctccaatgtttgaggaagtaaacgttgccgtagaccacaactctttgttgatggatatcatggcaagaattgctcacagacaccacttccacattttattccacgaaaaaccattcgcaggagtaaacggaagcggaaagcacaacaactggtctttagctacagatacaggtgaaaacttattaagcccgggaaaaaatcctaagaaaaacttacaattcctgactttctttgttaacactattaaagcagttcatgagtatgctgatcttttaagagcaagtatcgcatctgcaagcaacgaccacagattaggtgctaacgaagctccgccggcaattatctccgtattcatcggaagccagctgttcagcgttttggaagagcttgaaaaagtaaccaacggaaaattatctccggaagaaaaaacagaattaaaattaaatgtagtaggaaagattcctgaaattttattagacaatactgatagaaacagaacttctccatttgcatttacaggaaataaatttgagatcagagcggtaggttcttctgcaaactgtgcagagtctatgacggtaatgaatactatcgcagcaaaacaattgaacgatttcaagaaagaagttgatgctttaattgaaaccggacttaagaaagacgaagccatctttaatgtattgagagagtacatcaagcagtgtaaaaacattatgtttgaaggtgacggatattctgacgactgggcaaaagaagctaagaaaagaggattaaacaaccttaagacaactcctgaagctttaaaacaggaaatggataagaaattcctggacctttatgaagaaatgggaattttcacccacagagaagttgaggcaagaaatgaaattaagttagaaaaatattctactgttattgatatcgaagcaagagtattaagtgatattgcaagaaaccacatcattccttctgcattaaactatcagaacagattaattgaaaacgtaaaaggtcttaaagaaatctttggagataaagaattcaaatcactggctaaagaacaaatgagtttaattacaagcatttctgaaaatgtttctaaaattaagcttggtgttgaagatcttatcaaagccagagaagcagccaaaagcatatcagacagccaaaaacaggcagaaagctattgtaataaagtaaaaccattatttgataccatcagagaagcttctgatgcattggaaatgatggttgacgatgagctttggccgatgacaaaatacagagaaatgttgtttacaaaataacacctgtaaagttccatattagtttaaattccccgttttccggggaattttttatttaacctaaaacattcatagacaaagacttctacaacttcaaatttgatacagaatttaattttacctttgttttcgttatgaaaatcctgatcgtagaagacaaccatgaacttgcccagagcatgaaatattatcttgaaggcgagaactatatctgtgaatgttcccatcattacaatgaagccctggaaaaactcagctttaattcgtacgattgcattttgttggatattatgctgcctgacggaaacggattaaacattctgaattacattaaaaccgaaaaaatcagcagtggaattcttattatttctgcaaaaaatgcattagatgataagatcaacggactggaacggggtgctgatgattatattacaaaacctttccatttaccggaactccatgccagattaagagccgtttaccgtagaaaaaaaatggaaggctacagtgaagttaagttcaatgagatcattttaaatacagacacttacgaagttattattaacgagacaagattggaagttacccagaaagaatttgaacttttgctgtactttcttgtcaacaaaaaccgtgtattatcaaaacaatcaattgccaatcatctctggggtgattatacggataatttatccaattttgattttgtttatcagcatgttaaaaatctcagaaaaaaaattggtgctgcacagggaaaagattatattgaaacgatctacggattaggctacaagttcaatgctttaaaatatagtggctcatgaatttattgaataaaatatcagtctggtttatcgccattgtattgctggttacccccgtaagcatgtacatatcatataccggtatcaaaaaaagactggataatgttgagatagaaaggttaaaaactgtcaacaattacgttatcaatcagctccggaaaggagaaaccccggcaaaaacctcacaggggctgcctattaccgtaagtttattccagggtaaaaacattccttcagaaccacaagtcatacacacctgccttgaagatcagggagtttccagaaatgaatgtaaaatccagatcaattcttttgcagacatcggcagtaaaatttataaaatttcttcatacggctacatcacagctacaaaagaaataatgggcggaatgctcattgccctgttctggaagcttttattaatcacagctgttgtttttattacagcacggatcctgtctaaatttatattaaagccttttcaccatgcaattgacaggcttcagaaattcaatattcagaaaaaagaaaggcttgaccttttacccaccagcacaaaagagtttaaaaaattaaatgagtttctgaaaacaatgacagacaaggccctggaggattatgcttccgtcaaagagttttccgaaaatgcctcgcatgaagttcagactcctttagccatcattcaaagtaaaattgagctgctggcagaaacagacatcaatgaaaatcaagcggttttattaacggacattcaaaattccatcgataaattaagcagaataaaccgctcactaattcttcttaccaaactgaataacaatgaatttctcactaacgaagaattgaagttctgtcgtgtggaaagagaagcactgtgcatgtattccgatcatttagcgttaaaaaatattactttacacagaaactgtgaaaagaatgtttatattaagatccaccctactttagcagaaattctgttaagcaatcttctttcaaatgccattcgtcataatcttgaagggggaaaaattgaaataaatttaaccaggaattactttcagatcaataataccggtcttcctcctcatgttcccacacaggaactatttaaaaggttcaagaaaagcaatcagtcacaggaaagcattggcctgggactttccattgtgaaacaaatctgtgaggtaaatgattttgctgttcattatgattttgcagacggatggcacagcataacggtatattttgacggtaacaaactacacggaacttcaatttccgaaaaaacaccagatgaaaatgaaattctgtttgaatccgtagagcagatagtaaattttgctaaataattaccatcaacattaatttttcaacttcaaatttgcttcaaaatgtattttttactttgaaaaaagaaaatacgttagatgctttcaagaatttttattctcgccttatcatccgtttttttgttcaacacagcaaaagcacagaaggtcctcacgctgcaatctgcgctggaaactgctgttcacaattacggaactattaaagccaaagaatcttaccggttatcatcgcaggaatcgatagagctggcaaaacggcaatacctgcctaacctgaatatcagcctgcagcaggattatggaaccgtcaacggacaaaacggtccactgtatggattcggaggctacggagtagcttcatccggacttcccctccctgatcaaaactggaatgcttctttcggagctttgtacctggctaatgtcaactgggaatttttcgctttcggaaaagccagacaaagagtgaaagttgcagaaactaaaaaccagagggatgccaaagatttatctgatgaaatctttcagcacaaaataaaagtaaccgccgcttatctgaatgttttagctgcaaaaaaattaaaactttcttacgcccggaatctcggaaggactgataccatcagaagaatcgttgaggttaaagaaaaaaacgggctcgttcccggcgtagatctatcacttgcaaacgcggattacgccaatgcaatgatcacgtacaccaaagcaaaagacaacgaacaggagcaggaaaataaacttgcccagctattgggaattcccgctcaggaatttgtactggacagtactttactgaaaagaattccggcaggtttcccaacagaaaagagctcttctctagagagtcatccattattggctttatacaaaagcagaattgatgtcagcgagcaggaaaaacagtttctaaagacacagtattatccgtcattctctatggtagggatctttcagacgagaggctcaggattcggaagcaactatgcacaaaaccagaatgattattcctcctcctactgggacggggttcatcctacaagaagcaactacctctttggaattggcgtttcctggaattttacacaaacctacaggctctcaaaggaaataagcgctcaggattatgtaagccagggtttgaaacatgaatatgacctcgcagaacaacagttaaaagcccagctggatttatccgataacaagtggcaaaatgccctccggatttatgatcaggttccggttcagctcaaatctgccaatgacgcttacacccaaaggtctgttctatataaaaacggactgactgatcttgtggatctgtcccaggctatttacgctctggtaagagcagaaaccgacagggatatcgccatcagcaatgtatggaacgccttactattaaaagcagccgctatgggagacttctctgtatttgaaaatgaactgtaagattaatatcaattataatcaatagtatctcaatgaacttaataagatttgcattaagaaaacccattacgattttagtgattgttgccggactgtttttctttggaatacggtcggtgaactccattaaagtcgatatctttccaaaactggatttaccggtaatctatgtttcccaccctttcagcggatatactcctcagcagatggaagcatttttcgccaaacaatatattaacatttttctattcgtcaacggaatcaaaagtattgaaactaaaaacatccaggggctgacattaatgaaaattaatttctatcccggaaccgatatggctcaggcagcggcagaattgaattcattttccaccagaattcaggccgcttttcctccgggatcaaatcctccctttatcattcgctttgatgcctccacacttccggtcggacagcttgttctaagcagtgataaaagatcaaacaatgaactgcttgatctcgccaacgtttatgttcgttccacatttacttcaattccgggaattgtttcgtcacctcctttcggaggaaatatccggacagtggtgattaatgccaatcctgatttgcttcgtcaacataacatgacaccagaccagctcgtagaagcactgaggctgaacaaccagaccgcaccttcaggaaacgtaagaataggtgataaatactatattaccccaaccaatacgatgattaaaaatgtaaaggattttggaaatattcccctctataaaggcagcgttcaaaatctatacttaagagatgttgccacagtaaccgacggggcagatatgacctctggttatgctttggtaaacggacgccgctcggtatatctgagtattgctaaaagtgccgatgcctctacctgggatgtagttcagaatctgaaaaaacaactgccgcagattcagtccaaccttccggatgatgtaaagatcagctttgaatttgaccagtctacctatgtcatcaattctgttaagagtttattgagtgaaggaaccatcggagccattctcaccggattgatggttatattattccttggggatatcagaggtgcactgattgtaattcttacaattccaacctctattatttcagccgttttattcttaaatcttttcggccagactattaatatcatgactttaagcgggcttgcccttgccattggaattctcgttgatgaaagtaccgttaccatagaaaatattcaccagcatctggatatgggaaaacctaaatcacttgccgtctgggatgcctgtaaagaaattgcttttcctaagctgttaattctattctgtattctggctgtttttgctcctgcatttacgatgggtgggattccgggatcattattcctgcctcttgcattggccatcggtttcagcatgattgtttcttactttcttgcacagacctttgttcctgtaatggcaaactggattatgaaagtgaaacaccacaaagcaaaagacggccatgttctgacagactctgaagaacttcagcaagctgggctgagcgacgaaaatgatacatggagccagaaagaaatcttattacaaaacgaagacggcaaccgtgacgggaaagtaagtatgtttgaaaaaatcaggttccgttacctgaagtttttagacagaatcatgccctacagaaaaatattggtttccgcctatattatcctgatgatggtaatggtagccttattcttaaacagtatcggacgggatgttttaccccaggtaaatggaagtcagtttcaggtaagaatgcgtattccggacggaacgagaattgaaaaaacagagctgcagaccttaaaattattagatggcattaaagaaattgtcggaaaagacaatgtttcaattacatctgcatatgtaggaacccatcctacccttttttccgtaagtcctatttatctttggatggcaggctcacatgaaaccgttttacaggtgggactaaatgaggattatcataccaatatggatgatttaaaagataaaatcagagaaaaagccaaaagtattaatcctgatatgaaattgtcttttgaacccattgagctgacagaaaaaattcttagccagggatcacctactcccattgaagtaagattatcaggaagggataaaagtgtgaatgaagcgtatgccaaaaaaatagaaactgaacttaaaaaaattccatatttaagagatgttcagatagggcagtctataaaatatccagctcttgacatcactgtagatcgtattcgcgcggcccagcttggtgtggacatgtcagacgtttcccgttcattggtagcatccacctcatcatcaagatttaccgaaaaaaatatctggacggatgaaaaagcaggttacagttataacgtacaggttcagattccggaaaataaaatgaacagcaaagaagaaattgcaggaattccattgcagaaaaattcaaacagaccgaatctgggtgatgtggcaacgattaaaaacagtttcacatacggggaaactgataacctgggagcaatgccaacacttactgttacagccaaccttaaccataccgatttaggaactgcttcaaaagatgttcaaaaagtcattgataacatgggagagcttccaagaggacttaatgtacagctgattggtttaagccagacattaaatgagacactgagcagcttacaaagcagcctgatcattgctattgttgtgatattcctaatgcttgcggctaactttcagtctttcaaagtttctggggtagtattggtaactgcaccggcagttcttgttggatctctagcattattgatcatcagcggatctacattaaaccttcaatcctatatgggaatcattatgtctgtaggggtttcaatttcaaatgccgtgctgttaattaccaacgcagaacagctaagaaaacataatggaaatgctttactttccgcaagagaagctgccgccctgaggctaagacctattgtgatgactgctttggcaatggtggtgggaatgatcccaatggcattaggactgggagaagccggagatcaggtgtcaccgttgggcagagctgtaatcggtggtttggttgcctctacatttgccgccctttttatccttcctctggcatttgcatggggacagggaaaagcaactacccaaagtgtttcccttgaccctgaagatgaggaaagcattcactttatgcctgaaattgttaaataaataacctttagctactaaaaaaaatatgaaccgactatataaatatttaattccggcaatacttattttcagccttcaaagctgtagccatgcggaaaagaaagaaactaaaaagtcagaagaccctgcatccccggaaatcgaaacggttaatcccaaacaggatgatttttcttcatccaccacaatccccggagaattgcagccttatcagaaagtagatatctatgccaaggtcagcagttttgttaaaaagttatatgtagatgtagggaacgaagtaaaagcaggtcagttactggcggccttagaagctcctgaaatcagttctcaacagagcgcagcctcatcagctttaaaatcaaaagaagccctttatattgccagcaaagcgaaatatgatcgtttaaaagaaacaagtaaaactcccggaaccatttcagctcttgatctggagcaggctttagcagcgcaaaaatctgaccttgcgcaactggaggctgcaaaagcatcctatcgggaagttgcagatgttaaaaactatctgcagatcagggctccgttccgtggtaatattgcaacaagaaatgtaagtgcaggagcttatgtaggaccatcaggaaaaggctccgatcttcctatgttcagccttgtacagcaggacagattacgcttggtggttaatgttcctgaatcttataccggactgttgaataaaaatggagatattaagttctccattcaatctattcccggagaaactttcactgcgaaagtatcaagatttgcaggagcactggacagcaaattacgctctcagtgggtagaaatggatgtttataacaaagacaaaagacttttaccgggaatggtagccaatgttattcttcctttaagcgaaaacagcaagtccctgtccgtcccttcttctgctgtacttaattcaacccttggagtatttgtaattaaagtagaaaaaaatactgcccattggatccctgtcacatcaggaattgccaatggcgagaccacaacaattataggacctgtatctccaggtgatgtaattgtaaagactgcaacagaagaaatccgcgatgggcagaatattagaattaaagccccaaaataggcttatagccaaacatttattaacaaaatttatactggcttttttagacttaaaaatttaaaaaacatgctgattcaggataaactgaaataagtttgttaaagaatcttaataaaaaaaaccgcatactgaccaaaaataggctgttgcggtttatttttctttaacatatgtaaataatatgttaaatagtgttaaaataagatcctgataattatcataacaggggtcttttgctcggaatctctacttttgtaatgcttttgaaaataaatattcctttttaacacggataatcaaatatatatgaagaaaagagttttgttttatttagttgctttagtttctacagtttcattacaatcgtgtgctacaaattatgtggtttcaaaaccagcaacttacacaaaagaatacaaaacagatgccaaactagcttctatagataacaaaaaaatggagcaggataagcaaagacttatcgactctttccttgctgaaaaggcggcatctatcgccaacgctaaaaaagcaattaagaattctgagattgcaaaagcagtcaaacataataaaaccattgatggtatccttgaagaagctgaaacataccttggaactccttacagatatggaggaactacaagaaacggtatagattgttcagcttttgttctttctgtatttggagcagcagcaggtcttagcttaccaagagtagcagcatctcaggctcaggaaggagaaagagtagaaagaggagaactacagaagggagatcttattttcttttctcatggaagaagaatttctcacgtaggtattgtagaaagtgtttctgaagatggtgagatcaaatttatccacgcagcaacatcaaaaggagtaatgatttcttcactgaatgattcttattggggtcctaaattcagatttgccaagagggtaatcaacgaagaaggagaagcttataacaatcttgccgctgttactccagctacaccagcaaatttttaattttataaataattgatttaaataatgaagccatcagaattctgatggcttttttatttgatatttcacaataaattcaggataaatccgtgtcatataatatcaactcaccgaatagccatgagttcttaactgttcttatcaatttcaatatccagtttatacaatagtccatatatttcagacagcgaaaatttagcttttttaagcctgtttaaagccggatctatagaataattgaccgaagttctgaaatctgctttttcgaggtttgtaccatcgaaaacagcgcctgacagatcgcaattattgaagacagcatttgataaatcagattcagcgaaatcggcttcaattaatctggaatttttgaaaaccgttttcttaagagaggtctgataaaaaactgaattatttaaagcacacccatcaaatctgaaagataatccgaatggattacaatcattaaactgtagcccaaacattttacaatctttgaaaagcacctcatggaaagctgtcttagtaagttttaccatgctgaggttgcattcattaaattcacagtctgtaaaactgaacccagacagatctgcatattcaaaattacagttgttgaaagtacagttctcgtactctcctttttctatttgagaaccgtttgtatttacgaaatcctggtcagagacataagcttctttcatcatgtaatgatttataaaacgacactatactctgcaatgtgcagatttgcaaaacaggcatatcaaccttttgcgatttatatcaccgcttaaaagatttacaccaaactgtttttatcggaataattaagtttaaagaagataaacgtcatcattgagaaggcaagtaaagaacttcctccataactgaaatacggaagagggatcccaaccgtagggaaaagccccataaccatccctaaattgatcgaaaagtgcatcagtaagatcgaggcaaagcaatacccgaaaacacggttaaatgtggatttctgcttctctgcaaggtaatatattctgccgatataaaccatgtaacataaaataagaattgcacttcctaaaaagccccattcttctcctaccgtacaaaagatataatcggtttcctgctccggtacaaatttaccctgggtaacagatccttcacgatatcctttcccccaaagtccacctgatccgatagctgtttttgaatacagcaggttgtatcctgaagtatccctgaacgccttctctcctttgtaaagaacctcaattctttctctctggtgtttaggaagtttttctaaaatataaggagatccgaaagccagaccgcacagcaaaagaacagaacctgcaattcctgagatagaaatcacatcccatgacattctgtgataattcatggcaatcagaacaccggcaataactaaaactgccaccgcaacataaaccggaggaaccgccagtgaaatcagaaaaacgccggcaaaaataaatcctatcccgaacaaaagcccactcagaccttctctgtataaagcaataaagaatgcgataaacacaagcatggaaccaacatccggaatagcaagaacaactgcagccggaattcctataatggcaagagccgtccagagggactttttatttttaagattaaaatccggacttgaaacataattggccagcattagtgccgtcccgatttttgcaaactccacaggctgcatagtaaaactaccgaacttataccagttcttctgcccgagaatctctttaccaaacggaaaaagtcctatcaaaagcaggacacctccaatgtaaataataccggccatattctcaaagaatttgcttcttcccacgaatataacaagaccaacaacaagagagatacagaagaagaccaattgtttctctcccagtttctgatcaacactgtaaatatttgcaatcgcaaaaatgcaaagcaggaaatacagcccaaggcccagtttatctattccttccgtccatttcattgcttcacagtttttttagcagtgttattttttttagcttcttctattttcttttgcagctttgctttttgttgttttaccaactccaggctatccttaattcttttttgtttaatagaatcaggtttagggtcaacatataaacctttacgcttcaggtctgcaatccattgccttttatactcaggcatgaaactcgaagtgatcatttttttgtaaagattttctctttttaaatcacctgtaatatatttttcagcaatcaccgtacaggccggacctgcccatgtagcaccgaaacccgcgtgttccattactgccactaccacaattttaggtttctctgcaggagcaatcaatacaaaaattgagttatcttttccttggggcacctgtgcagtacctgttttggctaactgcgtaaaatcattggatttcaaaccacgggctgttcctctcaaaactacggcttccattcctttcagaaccggttcaaaatgctttggatctacaagtgttttatgttttactttgaatcttggatcagggtttggcttcccgtcaattgcttttacgatatgaggagtataataccatcctctgttagcaatagctgccacataattggctagctgaataggcgttaccaaaacatctccctgtcccatcccattataaatagcaccggttgacatctcatcccagtttttgaaatcagttctctgagacccgctggccttcatgatcgccttaaatcttctttcgtaaaaatctcctgaaggtattctgcctcttgccccaacagcaaaatcattatttaaaaactccccaaccccgaagctgctcatgatctttttccattcatcaactccttttgaagggtttcccgggtattttttgataatcgcaataaatgcataagtaaagaaacagttactagaaacctgaatagaaggaataagcggatcagctccaccatgacctttgattcttttacctttatagaagaatccgccaccgcaagggaaaatagttttttcatccattactcccatttgcatagccgctaaggcagtcaacagtttaaaagtggatcctggcggatatcctgcctgtaatgcacggtcaaaagtgggtttattttcgtaaagcgtatcttttgacagcgcatataaatttttggatttgttgggtccggtaaaaagattcggatcaatatccggtccggttgcagaaaccagcacttctccattattaggatctaaggctacaattgccccgtgtttattgacgagcatttcttcagctgttctctgaaggtcgtaatcaatcgttaatgtgatatctttacctgtaatgacgtctttatcaagggcaccatttttataggaaccaatattccggagcctgatatctttctggatatattttactccttttaccccacgaagttctttttcgtaggatttttcaacacctgttttcccgatgaagtctcccggtaagtagtaggtagaatcttttttaatgtctctttcatttacctcactcgtatatcccaaaagatttccggatgtggaaacttcatactgacgctggggtctcgatacgatattaaatgcgggatacttaaaaataatttcctgaactcttgcaatatcttctctgctgaggtctttaataaaagtcatcggggtcagcttagaataatatttctcctttttgataacattgattctattgataaaatcctgttttgtgattttcattaaactacaaaatgccagggtatcaaaatcaggtttcattaaagcctgcgtaaacgaaatttcataagcaggctggttacctaccatgattttaccatttctgtcaaaaataaccccacgctgtggaattacatattctgttttaatggaagtattggcagcattcagtgcataacggtctgtaaacaactgcaaataagcaagcctcgccacaaaaataagggcgatcgtaacaaggatggaaaaaatttttaaataacgtgtgttcaaactttttgtttgattttaaatattaatgcgtaaataactataaagataaatgaaattacacttgtcaccaacacattaaataatatttcaaaaaacctgctaaacttaaagaattcaatatactgaactaaaagctgatgcaggaaaatacttgaaaataaaaacagcaaaaactgcgcccactggagggactgaaaagagaaaaagtctgttgacgtatctgtggaagtcctgaagatcaacgttctgaagtaagctatcaacgttgttgcaaatgcattgattccccatgaataaagaaaaccgtcgatagacagccctattaaaaagctcaatgccaggaactgaaatttatttctgaaaaacggatagaacataacgaacacgggatataataccggcgtgtatttcccgaaaagtgtaatcctgttgagtacaaaaatctgtaatgcaacaagaaagatcatgatcaatatatctgtaaataaagttctgctaatcattttctttttttattacagcctgcatagtgtcctgaatcttctgcacttctgctttcttaagattcttcactacatacactttattcaacgctcccattttttcactcagctccacggaaatatcccagaagccggttttgttatccacagaatatcctgcaatggtaccgatggttactcctttagggaaaatagcagacttaccatctgtaacaacggtatctcctatctttaatgcaacatatttcggaatatctgccaggtgcatgacccttgagttatctccgttccatgttaaagtaccaaaataccctgaatttttaagcgctgcattaatcctgatcttgtttacgcttaacacggattgaactaatgcataactgtctgtagaattgattacaattcctgcgattcctctcggcgccatcacccccatttgaggaaagactccgtctctgcgtccgcggttgattgtaaaatagttatttcttctgttgatactgttgaaaacaatttctccatcaacaaaagtataaatctgcccaccaccaatggtatcatgaactcttttaaaaacaggattctttgaaccgtcttttccgtagagttcagtcataagggctttattctgagccacaagatcttcattaatctgttttagcttcagataagaaactccttcatcaatatatccggaaacccatgaattgaacgctgccgtttggcccgcaatccaggatctctgcatggcatttcttgagaatatcaaaaccagagcaataatttgcaggaatataaagaagacgaaaagagtattcttcgaaaataatctcagcaaaaatcccattcagatatatagtcgtaaaaaagttaaaattatttaattaagaaattgaacttatccatattcttaagcgcaatacctgttccgcgaactacagctctcaacggatcttcagcaacaaatacaggaagacctgtctttttgtggattctgtccgcaaggcctcttaataatgctcctcctccggcaagataaatacctgttttgtaaatatctgctgccagctccggtggtgtaagagaaagggtttccattaccgcatcttcaattctgatgatagatttgtctaatgcacgtgcaatctctttgtatccaaccataatttctttaggcttccctgtgataaggtctctaccttgtaccgggatgtcttcgatatctacatcaagatcttctactgcagaacctacttcgattttgattctttcagctgttctttctccgatataaagattatggtgagttcttaagtaatatgcaatatcattggtaaacacgtctcctgcaatctttacagacttatcacatacgataccacctaaagctactacagcaatttccgtagtacctccacctatatcgatgatcatatttccttcaggcttttgtacatcaatacctactcctattgccgctgccattggctcataaataagccttacttcttttgcatttactttctgagcagagtctcttaccgctcttttttcaacttcagtgataccagaagggatacagattacaattcgtaatgccggttggatgaatttacctttgatgccaggaatttttttgataaactccttaatcatgtgttcagaagcatggaaatcagcaataaccccatctttcaaaggacggatggttttgatatcctcatgagttttgccctgcatatgtttagcctgctctccgacggcaatcggcttacccgatgaacgttcaattgcaacaattgaaggttgatcaataacaattttattattatggatgattagggtattagcagttccaaggtctatcgcaatttcttgcgtaaacatatcaaataaactcatatttttcttctgattttaagtttacaaagatataaatttaacactactaaagaaatttcccaccaacttaatttggttaaaattttattaaaatttataattctttattaactttcaatttagaggtttacagactttgagttcaactaaaattcatggagtgttaaaagggctgaaaagcgaaatagcaaaagggtaaaaagactaagaaagcacaacaatgaagacagaaataaaactgaaaaacagtaaaaactttttatacaatatcaattgtgccattttacagttttgccttttatggcattcgcttttatagttttttacgataattatcatatacactatctgagataggttaattaaaaaaatcgtaaatttgcgactgcttatgttacagtattccaatattcatcaaacgtcaaatttcgccgtgctttcaataagctacgagaaagccgacgtagaaacaagaggaaagtttgcattctttgatgagaacatcaaaaactttgtttccagggtccaccaggaagatcttggagatgcatttgtggtttctacctgtaacagaactgagatttatactacatctcccaattatcttttggttgctgaagaatattgcaagactatcggagtacagctgactgattttcttcagtttgccaatattcttacaaaagaggaagccctgattcatcttttcagggtagcagccggccttgaaagccagattattggtgattttgaaatcatcggacagattaaaaaagcatacaaccgtttcaaaaaagaaaggcaaaattcgaatccttacctggagagagccatcaatgcggctattcagatttcgaaaagaataaaaaacgaaaccggcatttccaatggagcggcatcggtttcttatgcggcagttcattatattctgaacagccagaaaagaattgctgaaaaaaacattcttcttttgggagtaggtgaaataggacagaatacggttgaaaatctggtaaagcacgtttatcagccgaaaattaaaattgccaacagaactcaggagaaagctgaaaagatttcccagaaatataatattcctcatgttgattattctgattttgaccaggaattaaaaaatactgacattcttattgtagcaacaggagccaagcatcctattgtcaaccagtcacatttcccgaacggaaaagaaacgcttgttattgacctttccatccctcataacgttgaaaagaatgttacagaaaataaaaatgtaaccttaatagatgtagatgagctttcaaaacagatccaggaaaccattcagcaacgcgaaaaagaaattccgaaagctgaaaaaatcataaaggagctgatgaaagattttattgaatgggagaaaaagagaaaactggcacctaatattcatcatttcaaagcggttttaaagaacatggaacgcaatgaaatgcataatttttataaaaagaataaatacataaacatcacggatatggaactttctgacaaaatgatccagaaaatcaccaaccgttttgcaaaatatatcatcgataaccctttaaaagccgaagaaattagtaaattaatgcacgaaatattagttgaacaaccaaacaacgaattcaatgaaaagcattagaatcggaacgagaaattccgcacttgcactttggcaggctagagaggttgcgaggcaccttcagaacaataattatttaacggaaattgttcctatcgtttcttccggcgataagaatcttaatcaaccactttattctttaggaattaccggggttttcacaagagaccttgatattgccttattgaatgatgagattgacattgcggtacattccttaaaagacgttccaacccaattgcctcagaatattgagatgattgcttacctggaaagggattatccgcaggatattctgatcagaaaagaatcttcgagaaataaagagtttcatgaacttaaactggcaaccagcagtttgagaagaagagctttctggctgagaaattatcctactgctgaattttcggatatccgtggaaatattcagaccaggcttcaaaaactggaggaaggagattttgatgcaacaattctgtctcttgcaggaattaaaagaatgaaaatggaaatcgattatgagatgcttccattaatgatttctgctccgtcacaaggggttatttccgtagccggacatactgacaaaccggagatcaatgaaattgtacgccagatcaatcaccaggagactcagatctgcgtagaaattgaaagaaactttctaagcactttagaaggaggttgtactgcacctatcggagcttttgcagaaatcattggcgatcagatccgattcaaagctgcactttgctctctggatggaaaaaactgcattgctgtagatgaaaactttgtctatactccagctgagaatttcggagaaaagtatgcaaaagtagttcttgaaaacggaggaaaagaattaatggccgaaatcaaaagccagatctgatatttcagattatagattcttacctgttctttttcatcttcttaattttacagacatgaaaatcttatttaccaaaaatatagacccatctattatatccaaagaattaggagaggatattttggttgactgtgttgaggtgattaagaccaatcctatcatgatcagtccttttgatctgaaaaattactctctgatttttaccagcgtcaatggtgttacagctttttttaaaaacaggtttagacccaatgaggattttactgcaaaaaactacaataagatctattgtgtaggcgaaaagacaaagagagagttaagaaaacacggctttggtacatttaaggtattgaaaaatgctgaaacgctttccagatttattataggaaaatgccagcatgagcagtttcttcatttctgcggtaatcttgccatcaatgtcctggataaagatcttccgcttcaaaacattaaatacaaaaaagttacgatttataataccgaggaaatcaatcctgtaataactgaaaaatatcatgctgcggtattttttagtccgagtggagttcgtagttttgcaaagcgaaattcactggaaggaatgaaacttttttcaattggcgaaaccacttccggtgagctgagaaagtatacacaggaagaaatttttacttctgaagaaaatacgctgagctccatctttgcattgatcagaaaagagatcagaagcaggatttagaatacctgttaccgacatatgagatattgccggtactattatttaaaaagattatgattaaaaacgacctatatttaaaagcacttcgcggagaaaccgttgaaagacctcctgtctggatgatgaggcaggctggaagatatctgccggaattcattgctttaagagatcagtatgatttctttacaagatgtcagacccctgagcttgccgctgaaattacgctacagcctatccgcagatttcctttggatgctgcgattctgttttctgatatcctggtagttccacaggcaatgggaattgatttcaaaatgaaagaatccgttggaccatggttagatactcctatcagaactatggaacaggttcagaatattgaaactcccgacgtgaatgacactttaggttacgtttttgatactattgagcttactcttcagaaattagacaatgaaattccattaatcggttttgcgggttctccttggactattctttgttactgtgtagaaggaaaaggaagtaaagcgtttgatattgcaaaatctttctgtttccagcagcctgaagcagctcatttattattgcaaaaaatcactgatactacgattgcttatctaaaaagaaaagtagaaaaaggagtttctgcagtacaggtttttgattcgtggggaggcatgctttctcctacggattatcaggagttctcatggcagtatattaaccagattgttgaggcattaagtccgcttacccatgtcgtagtatttgggaaaggatgctggtttgctttggaagatatgacgatgtccaaagcttctgcacttggtgtagactggactattaagccggaattcgcaagaacgcttactaatcatacaatgacgcttcaggggaattttgatcctgcaaggcttcattcgactcctgaaaccatcaaaaaaatggtgaatgaaatgattaaccgcttcggaaaagacagatatattgcaaacctaggacacggaattcttcctaatgttcctgtagaaaatgctgaggcattcatcagagctgtagtagactggaaaccgaatctgtaagattgattcttttaaaaataaaaaaccttatagtacagtctataaggtttttttgatattaggtttattattttcaggcctattcctttataattttcttcctgattacttctccgcgattgttcgtgatgatcatgatataaactccctttctcaagtccgacaagtcatatgtgtccgatgttgtatcaaaggtttttacaagcttccctgacatatcaataatgtcaactttttctgccttgttttggaggccagattttatataaacctgatccttcaccggattaggatatacatttgtattatctgaataagaagtttccgaagttgccaggactccgctcgtaatcatcacattatctaccacgacgccataagaataatctccggcatcatcataaacaaatctcagtttaaaagcagcattggcatagggtgtcagatctatattggcggcagtatcataactcgttactataaatgtaaatgtattaaaatcgagatcccagactcctgcatcacctgaaaaggtaaaaacctgaacccacgaagttccgttaaaaacttcaacttttaaagtggaatcaaaatcataaatcatattagcataattaaacgaaagctttgggtttgcaactccggtaaggttaattaccggagaaatcagtcgggcatttgtattaactccagtcgggcctgcatcatcgtcatcaaaaaaagcagctccatcgggaaaacccgcaaaaccattctgtgtacctacactccagttataagatgtatccggattttctaccgtccatccggttggcaaagcgttgccattaaagttttcagaaaaaatttgtgcattacaaattccacaaacggataagaaaagaataaatagttttttcataataatggatttgatgtttatataaatttaagaaattatattttacaaaaatacattatgcataaaatcaatactttacattttttaataaaagaattaaaccttctctattattttataactttatatctaacctttaaatcacatcctatgaaaaaattaaacaaagacaaaatgaaaagtattatggcaggaggagaaatctgccttgagtgtgctattggatattaccaggttattattgatggccattgttactgtgttccgatagactaataaaaaaagcagcttaacagctgctttaatttatataagtaatattgtattggttagctcaacattctctgagcttttttaactccttcaactaaaatatcaatttcttcgaaagtattgtaaacagcaaaactcgctcttaccgtccccgcaatattaaagaaatccataataggctgtgtacagtgatgtcctgttcttacagcaattcccattttatcaaggatcattcctacatcagaggcaatccccactccctcaagattaaaggaaacaaccccggttctctttgctttttcaccatagatcttaataccctctaattccaaaagctgtctttgggcatattccaataaagcgttttcatgattctgaatattggtatgacctattctgtttataaagtcaacagcggctcctaaagcaatatttccacctacgttcggtgttcctgcttcatatttaaatggaagacctgcataagtggttccttcgaaagaacatgttgcaatcatctcacctcctccatggaatggcggcaaagcttccaggatttcacgctttccatataaaacacctgtccccataggagcatacattttatgacctgagaatacaaagaaatcacaatccaacttctgaacatcaatattgaaatgcggagcagactgtgccccgtcaataacgatataggcatcagtattttttcttgtctttgcaataatctcctcaacagggtttacaattcccaatgcattggaaacctgattgacagaaacaatcttcgttttttcacttaaaaactgatcaaaatgatccatctgaaggattccgttttcatcaataggaatcacacgaagttttgccccggttctttcgcaaagcatctgccatgggacaatattggaatggtgctccagatatgaaatgatgatctcatcatctttcttcagtttctgggttaaaatataagcgatgaggtttaatccttccgtggttccttttgtaaagattacttcaaaatcatgttcagcattaatgaatttctggattttccttcttgaaagctccatttcttctgttgccagctggctcagggtatgaattcctctgtgaacattagcattaagttctgtataatatgcgtgacaaacttccaaaactgaatttggcttttgagatgtagctgcattatccagataaaccagcggcttaccgttcacttctctgtccagtatagaaaactggcttcttatttcctgaatgtcaaacatttatttattttttaaattaaaacgttcttatttagaactcttcaaatttacggctttttttccgaaaggaagcatgaggttgacagctgatagttgtcagttgatagaaatattcaatgagttataatgaagaaagtatattaaataaaaatagtaaagatgattcatctgaactttataagatttattccaaacaaaaaaacccgtcaaaaattgacgggtttctatattgtttaaataagcaattcttattctgctgctgcttctgctgcttcaggagctgctccttcttcagttgcaacttcttcttcatcttcatcatccattgcagctgcacctcctttcattgcatttctagacatcttaacagcaactactactgcgttgtccgggtgcatgaaagaatatccttctgttttgataccaccgatgtaaagtttgttaccaattcttaatggagtaacatctacaacgatttcgtcaggtaggttagcagggatagcttttacttttagttttctgaaagactgacgtaaaacaccaccagcaacaacacctttagaacgtcctgtaattcttaccggaacttccatgataactggcttatcgtctgataactgatagaaatcagcgtgaagaattttgtctgtaattgggtgaaactggatgtcctgaagaacagctggaattgtttttccgtcaacttcaatagataccgtgtgtgcttcaggagtgtatactagacctttgaaagctttctcttcagcagagaagttcaaaggagctccacctccataaacaacacaaggaactaattcagcatcacgtaaagcttttgtagactttttgcccacgctttctctttttgtaccttgaattgtaatagatttcatttataaaaaatttaaaaaattgttctcattttaatttacaaaccgcttaaaatcaattaaataacaaatttactgctaattgatttatgctcatgaaccatagtcataacgtctgcaaataatggggcgcaagatagcacttttattttagatgacaaattatttttaacaggaattgagtcagttacaataacttccagaatttttgaattctcaatattctcgtaagcctttcctgaaagcactccgtgagttgccatagctcttactgtttttgctcctttttcaattaagatatctgctgctttacaaagtgtacctgcagtatcaatcatatcatcaataaggattacgttcttacctgtaacatcaccgataaggaacatttcttctacaacatttgccttttttctttctttataagcaattaccacttctgcacctaagtgacccgcatagttcttagctctttttgcacctcccatatccggagaagcaatggtaagattatcaaggttcagagatctgatatagtctacgaagatagtagaagcataaagatgatccaccggaatttcgaagaatccctgaatctgatctgcgtgaagatccatagtcatgattcttgttgctcctgctgcagtaagaaggttggcaactaattttgcaccgatcggcgcccttggtttgtcttttctgtcctgtctggcaagtccgaagtaagggattactacggtaatgctctttgcagaagctctttttgctgcatcaatcattagaagaagttccaaaagattgtctgcaggagggaatgtagatccaatcaggaaaactcttcctcctcttacagattcatccaaaacaggttcaaattccccgtcgctgaactcctgaaagttgatttttcctaattctttcccataattctgggcaattttctctgccaagtccctgctggttcttgtacaaaatagataacttaactgatcggccatttttactttttaaaagattttgcaaatttaaaaaaaaaccacaagatttactcctgtggtttctaagtttttattttatcaattattaagggaatttaactcctgaatatttgtttggatctacctgcggaagtgtagagttgtatttggcattgatagatttaataaattcattagccacaattccgtatccacgtcctgtaaggtgaactccatctaaagagaaagctcctcctgttacaaatgttgccgtatattttactccatcccagataattcctgatttagaattcaattccatcattttagcatccatatccacaaaggcaagacctttgtctgttgcggctttttttatcgccgtattataccctgcagtagcagcaataacttttgctgtctcagcttcagtaaggacaagcttatcttctaatggcacggaagtacctccacctgcctgtggagtaagaactttgctggctggtaaaagaattaaatccttggctgttgtttgtctgtattttggaagtcccggaacagttgacagatctttatctacaattacagctccgttaaccgccgctccagcagtaaatttaattaaccttttctgatactccgcatcgttaatagctcctaaggttttagcctgaagcaaacctgcgttatactgagcatatcctgtattcagctgagtcacctgagcatctgttaaacccgtaagaggcatagcaggaattctcgtaaagtaagggacattggtaactgttggaatattagcaataacaccttttctttttgtaccggccggaaatagtttatctactaaataagcataggtattactgaaccctacccctaccgcaccatctactggcgtaatcggaacatttggatcagctcctcctgaagttgcatataataaaacatcattatttcctatccataaagaaatgaaggttgggtcttgttttagtgcatcttctactactgaagttgttgttgatgacgcaaaccttacgaaatatggatttgcagtagcaggcgtggagattaatccggctggatttccatatcccggagccagtaaatgcgctactcttgctcccggaactcccatattctggtaaggaccaccagcagaaacattatccaatgctgctcctggagctgttgggccgggagttaatgctccgttcacaacacttaacacatatttacctgcaaaatctcctgttgctgggttaaataaattggtaaaccctcctgtgtcattaggcatcattggctgtttaaaagctcctccacctgctaattgcatttgtgcagcaatcatgcttggataagattcattttgtccactgctgtaaagtgctccatctctataaccagcagttaatgagtttcctaatgatatatattttgaaaagtctgcgtctccttttgttaccgggatatctctcacatccgtatcgaaatccgtattacagcttgttaccgtaaaaagaagtgcagaaactgcaattgtcgatattataatttttttcatagtcttctaaaattaaaatggattatatgagaaacctaagcccaggtagaaagctgttgctttagactgtccgttaagtccaatattagcgttgtttacctttctgtactgaggcattgcatatcctcctgctatatcaattccgaattgtttcagtttgaaacctaccccgcctgtaaccacataagtatcgtatgaaggtgtctccggaataaagttatccgtagtataaggtgcttcatcataataagctcccaaacgtccgtagatcatatttgtgaacgcatattgagttcccagtctgaatgttttggagtttttgaaattcttaggattggtaagaattgttgggtctgacggattgtttccaataggtgcattatcaaaatccaatgtcagcttactatatctctcccatccatgatagttaaagtctgcagaaacctgccactttggtgttactttataagttaaaccaatagtatattcttcaaccagtggaagtgttgctgaaaaaccatcttgtccggccgcattcagtcttagctgattataaacagattgtgacgggaactggaaggaagcagttccgtttttagctttcatatctaccggtgaacggtaagcaatacttacatctaatttaggatcaggtctgaaatagaaaccgaatccatatccatgtccgcttgcttttttatcattgatgttaactttcccatcaaattgagtaacagctttatcccaatctaccactcctcgtgcatagatatagcttgccccgaaagcaagccatggagccagcttcacagaaaccataggctggaagtaaaaactcttaagctccagcttctgtaccaattctttaccttcccagttatcaggccatttgattgtacttccaaaaggtgtggtaacactaagacctacggtaagtttttctatgggtctataagtaatcgctgcgtaaaaaggagttcctacagggttatctgtttctgcactttgtaaagtgttgaaattctgaaaagtaaccttgttacttgcagcaaaccctcctgccactacactcagtttggaagggataaatgacatacccgccgggttaaagaatgtcacactcgcatcttcagcatgagcactagtatgcgccattgccaattgttttaccccttgcagggaaactctgaagcctcctgcgtaagatagaacgcccgccaataaagcagttgatactaatatttttttcatagactattattatataagccaaatataaaattattttgaatacatctgttaatatttgccaatattttaaacaatatcccaaaagaaaactatgtttgaaataatatattacagaaaacaaactataaaaggcttattattaaacatttaaaacaatataaaatctacagcattcacattgtttaattttaaacaaatgtttaaccctaaagctataatgctctaaaaacccttatgcaaaaacaaaatgataataaatgttaaattaaacagtaattgaaaagtaatgaatttagcacatctgttttattctgcataaaggctttgtccggcctttagcattcatttttacttaaaatacagaaatgttttaacctgaattcaggttatttgagtattttagaatttcataaagataaaaatacataaatttgcagattataaataaacaatagtactatgagttgtggatgtaaaacatccggcgattctgcacattcttgcggccctaagaaaaccgcaaatggctgtgaaaatgtaaatacctgcgggaatagttataaattaagtgtttttgactggctttctaacatcaacaatccggcaccaaacaggtgtgattttgtagaagttagatttaaaaatgacagaaaatcgttttataagaatgtaaataatattcctttacatatcggtagtgtagttacagtagaatcaagtccgggacacgatgtaggcgtggtaagccttacgggagaattagtaaagattcagatgaaaaagaaaaagttttctgaagaatcagcacttaaaatatacagacaggccaaccaaaaagatctcgaggtatggcaggaagcaagaaaaaaagaagacagcgtaaagctcgaagcaagaaaaattgcccagagattaggccttgaaatgaaagttactgatgtggaatatcagggtgatgcttcgaaaatcaccttttattacaccgctgataaccgagtggacttcagacagttaattaaagattatgccggagctttccgtactaaaatcgacatgaaacaaatcggtttcagacaggaggcagccaaagtgggcggaatcggatcttgcggacgtgaactttgctgttctacatggcttacagatttcagatctgtaaacaccaatgtggcaagatatcagcaattaagtatcaatccccagaaactggcaggacagtgtggtaagcttaaatgctgcctgaactatgaactggacagctacctggatgcactcagcaacttcccttcttcttcaacaacgttggaaactgaaaaaggaaaagcattctgtattaaaatcgatgttttcaaaaagaaaatgtggtttgcttatgtagacagttctatcgcatggtatgatttcgatattgaccttgttaaaaaactgatttcaaaaaataaaagaggagagaaaacacttccccttgaagatctgaaacaacctgaaacttctatccataccattgatctgatccaggaaaacaatgtggatcgttttgaaaagaaaaacagaggaaacaggaacagaaacaaccagaataagcagaataacaaccaacagggccaggggcagggacaaaaaagaaacagacctgagaaacaggaaagaccggaaaggactcagaaaaccgagaacccaaatgctcattcagccaatcagcctaaaccccagaagcagcaaccacagcaaaaagcacctgtggaaaaagcagtgagtaatgctgatactgataaaaagccgcagggcaataacccaaacaagaagaaattcaaaaagaaatatcctccaaaaaaagataataatgcataaaattttaggattactttcacttatccttttctttagctgtaactcttcctcaggagaagatgttatgatgaattccgttgataacaaatggaataagaaaagtgagcaaaaatttaatcttgaaatttcagatcctcagaatcctaaaaatattatatttgttgtaagaaataacaacagttatccttacagtaatataaggtttatagtgaatttcaccaatcttcagaacaaaaaaaaggagacagataccctgaattacgtactggcaaaaccaaacggagaatggcttggtacagggtttggtgatacgaaggaaactttatttcagtataaattaaattataaatttccgggaaaaggaaagtatgaaatcggtttaattcaggcgatgagaaacgacaaccttcctggaattgaggacattggtgtaaaaatagaaacggctaaaccgtaaccataaatggaagagaacaaaaaaaatgcaggaaataaggggaaaacatttcctctgcctcccaagaaaaagaaagatacctcctggaaaaaatgggtttcatttatctggatcggactcattgcagtagttctgggaatttcaggacttttcttttcagtttctcaaggattccttggggaaatgcctgatgtaaaagaacttgaaaaccccgatatctttgttgcttctgagatcatttcttcagacggagtaaccctgggtaaattcgaaaaggaaaaaacccagccaattgtttataaagaccttcctccttatcttatttatgccctacaggctaaagaagatgagcgtttcaaagaacattcaggaatcgatttatattctgttgccagagccgtagcttatggtggcggacgtggtggaggttctacgattacacagcagcttgccaagcttctttttacaggaaatgcttcccagaataaaatccagagagcatttcagaaactgaaagaatgggttgtagcagtaagtcttgagaaaagatatactaaggaagaaattatcactctttatttcaataagtttgatttccttttcaatgccaatggtattgaaatggcttccagagtttactttaacaagaagacttcggaacttacattacctgaagcggcaacgtttgtagccatgcttgaaaatccaagaaaaaacaatccttacagatatcctgaaaaggcgaaagaaagaagaaatgtagtattggatcagatgcagaaaaccggatatattgatgctgcaacttatgaaaaggctgctaatactccaatcgaagtggactttcatccaatcaagagcatcactgacggatactctgcttattataaattttacctgagaaaagagattgataaatatcttgaaactcatgaaaaagaaaccggaaagaagcttaacctttacaaggacggtttaaagatatacgtgacccttgactctaaaatgcagaaatacgcagaggaagctatcaaggaacacttaacagatcttcaaaagagatttgacgcagaacaacgaggaagaaaaaacagacctttctactatcttactgacaagcagatcaatgatgtaatggttcaggcgatgaaaagaaccggccgttataagcttttgaaagcagacggaatgcctgaagattctattatgatggaattcaagaagcctatcaagacttcacgattcacctggaacggagaagaagaagtggaaatgtctccatgggattctatcagatatcacaaacaaattgcgcaggcaggtctgatgtctatggttccgggaaccggagaaatcaaagcctgggtaggtggtatcgactggcagcacttccaatatgaccacatcaagcaaggtaagagacaggtaggatctacctttaagcctttcgtatatgcaactgctattatgaagctgggaatgacaccttgttcgactgtttctaacggaacttatgatcacaacggatggcatgtaccgggaagaggaggaatgcttactttaaaagatgcattggcacattctcaaaaccctgttgcagcaagacttattgaaatgacaggagtagatgctgtaatccagactgcaagagatctgggagtaacagaagatattccaagaaacaatacaatcgctttaggttcatcagacattacgatttacgaaatgcttggtgcttacagtacttttgccaactacggtaactacaacaagccggaaatgatctggagaattgaagatgccaacggtagagtcatcaaagaagtaaacgtagaacctaaggaagtaatgaacccaatgtacgcctacaccatgattgaactaatgaaaggtgttgcacaatacggaaccgcttctggagagcttggtagaagaggcatctcaaaagcagtagaaattgctgctaaaacaggtaccactcagaacaactccgatggatggtttatgggaatcactccaaaactggcaaccggagcatgggttggatgggaagacagggcaactcacttctttggaacaggagaaggtcagggtgcaagaatggcattaccaatctgggcaattttcatgaagaaagtatgggcagacaagagtttaggagttactcctgatgataagtttgttaaaccttcagactggaaagacggctgttcaaaccttaaaggccttggcggaggatatggagacgatggaagtcttcagactatcgatgagattaaaaatccaagaccggtagatcctactcctaaaaaaactacagagaagaaagaggataatatcaatgaaaatcttcatactaatgatgaagtagatttcaataaataaattctcttttagaaatacataagacctttcaataatttggaaggtcttttcttttataattaatacctttgaaatatgaatatcgaacgtatcagacagccatttattgagaattttcccggtgatttctccaacaatcctatgcaaagaaatacgccaaaggttttatttgccaccattcggcctgccggctttaacaagcctgaactgatcgcttttaacgaagccttatcagaagaaatcggtttgggaaaatatgaagataaagatctggactttctggttggaaataatcttcccgaaaatgttcaaacctatgctacagcttatgcaggccatcagttcggaaactgggcaggacagcttggtgatggaagagctattctggcaggtgagataactaatgagaaaggaaaaaagacagaaatccagtggaaaggtgcaggagccacaccttactccagacatgccgatggaagagccgtattaagatcttctgtccgtgaatacctgatgagtgaggccatgtatcatctgggcgttcctactacaagagcactcagtctcgcttttaccggtgaagatgtaatgcgtgacatcatgtataacggaaatccggagctggaaaaaggcgcagtagtaatcagaaccgctgaaagttttttacgcttcggccattttgaactgatgtctgcccaaagagaatacaacagccttcaggagcttgctgactttaccattgaaaattattacccggaaattacatccactgacagtaagaagtacaaagacttttttgaaaggatctgcacccgaactgctgatttaatggttgaatggttcagggtaggttttgtgcacggggttatgaatacagataatatgtcagtgctgggattaactattgattacgggccttattccatgatggatgaatatgatttgaattttacacccaatacaaccgaccttcctggaagaagatatgcatttggaaagcagggacagattgctcagtggaatctttggcagctggccaacgcccttcatcctttgattaaagatgaaaaatttttagaagatactttaaataatttcggcacctatttctgggaagctcatgacaggatgctttgtaaaaaattcggttttgatcagcttcagaaagaggacgaagaatttttcaccaactggcaggggttgatgcaggaactccggttggattatactttatttttcaatcaactgaaaaaaataaaccaaaacacaagtattacagaacattttaaagatatctcttatattaatctgaatgaagaaaagatagcgaaacttgaacacttcatccgtaattatgagaccagaatagcattaaactccatttcaaaagaatcctctttggcaatgatggaaaaatcaaatccaaaatttattctacggaattatcttctttatcaatgtattgaagagattagcaacggtaaaagagatatgctggaaaaacttaccaaagctcttgaaaatccctaccgggaattatatcctgaattctctgccaaaaggccatccgactatgatgacatcgcaggatgctctacactttcgtgcagttcgtaatttataatattcataaaatattaaataattagtaattattttcatttttttattacatttactgtcaactttaaacgtaaaccaaatgaaaacaaaattactattcattttcttagtctcttctatattgggaaatgcacagattctcacagagacttttcagggcacgacattccctccgacaggatggacaacaggaacaaatgtagcatcaagaccttggggttttacaacaacaatattcaatgcaaccggtcaggctacatttaacattacaggtggaaaatccgcaggtatcggatggattgctcaggcacaggatgctcatttaacaagtccttccttcagtttggtaggaacaacaaatccggtgttaaagtttaacgccaaaataggatatgaatacatggttgaccctaatcctaacggagacttaaaagtagaagtatctacagatgggggaactacatggaaccaggtatgggttgaagaaaactatggagtttatacagattacgaaacattggctattacggttagtttagctcaatacgctggacaggctaatgtaaaattcagattccattacgtagctaatgatgcagacagcctttcaatagatgatgttcaggttttggcaaatggcacattgtctactcaggaaacaaatgccaaagtaaaagacgctactaatatctatcctaatccaacaaaaggagaaataaacatcaaaacagataaaaaaatcaaatctgctacagtatttgatgtaagcggaaaatctctgttcaacaattcttcggagagactggatatttcttcacttccaaaaggaacatacttactaaaagtagacttctcagacggaacttccaaaacggaaaaagtaatgaaacaataacatcatttatataaacttatacaaccaccagctttggtggtttttttatttacttttgcaaaaaatttgacagtgtcttttatcaaaacaaaaatcatcggtttttccaaactgatctttccttcctcttatacagaagtgacagtatttctgttcttcattacctgttatgggattctgggatcttatattgcccttcattacaggatcattttcgacagcagaattccctgggatgcatatttcagttttgataataaatcgatcctgatgaccggaggaagctttgagagacatcccctgtcctactattttttcaactgggtaagagaattttcattattcatttcaggagggaaaatggatgctaatttcaggcttactctggcatggctgagcaatattatcatctcattgaatattattcaggttttcaaatatttaaagaatattattcaccttccattggggttaagcatcttgattattctcttctttggagctttttcaaccaacattgttctctcttttactccggagaatttcacatatactttatttttgctttctctatacaatcactacgcagccattaaattaagaaaagaagaaaagacacctgctgtcgcgttatcactcgcgggtattacgatcggaggacttactattactaattttataaaggtttttatccctctcctttttgaaagagatcttttcagaagctggaaaaaattcgcgaatgctgcgcttagggttgttgttgctgtgatctgttttgtacttctttacctgaacagaattgattttaaataccagaatatcttttcaaaaaccaatcagcaatatgaaaagttctcaaatgtagaatcgatgccgacatgggatatgattttgtccttcttttttggaggaaatattcttttcccgggatttattatgtcagacaaacataatatgaagggattcaattttaaagggctttatatggatctttattcatcagctctgccttacttttttatagcaatattattgattctgataagttggagttattttaaaaatttcaggaataaatgggtccagatcatcactatttcatttgcagttgatatcatcatccattgtgtgatgaggttcggacttcatacttcctatatctatgggggacatttcgttttcgtctatccgatactgttagggtggctgttttacgcttatagaccctcacctaaaatcatgtcatttttaacattgacactggtaatattattcacttacctgttggtcaataatatctttagaatgacagaatttttctggtttatggaaaattattatcaataaaaaaagctgagaaaatttctcagcttttgtttttttatgttgaaataaattgctcttattttgcttcagcacagaaaattctatactgtaccgctactgcagatttaaaatattctctgattctggaaaggtcacttgctgcactttgttttgtgaaataacttcctgctaaaattttataattaggtcttaaagaagcatccgtttccactttcaggttaggaaatctctttctaaaataagattttacctcattagcttcttcattacttttcactgttgtaatctggattttgaaccctaaaattctaggattttttctacaaatttcagcattggtaagctctctgctcggcacaaagattttaggaggttttgtatttattccggtagaaattccactatcattattgctgaaatccttagtggaatttgttgggacagctttagcacatttcccttcaactccctccaaagcagcattaattttggaatccatcgtcatgacaagctccgttcccgacagggtatcttttttaacaacctgctgtgcctcaatattataaaatccaaataatgataatatcgaaaatattttgattagatttctcatttaaacttgtttccgcaaatttatacaaattaaaaaactataccaaacaggttatttagaatcaatacaaattaaccttaaatgacattttcccctttttatatgccgttaaatttctgttaaaaatattatttttgccgaattgattgaatgttcaataatttactaacataagataatttaaatgattagttggagaaagcattataaaaaaacgttgatcgcgataggcttattgctatcaaccagtgcttcattttacgggcaagacggcgatcctaaaaacggagagaaacttttcaaagcgaattgtactgcatgtcacgcgctggacaaacaggttgtaggaccaccattaaaaggggttgtagaacgtgtaaagacagaaggtggtgtagacaaagactggcttcacaagtggatcaaagacaacaaagctcttagagcttctggggataaatacgccaatgagatttttgaaaagtttaataagactgaaatgcaggtctttccgaatcttacagacaaggatattgacgacattttagctttcacaactaaccctcctgctccggaggagaaaaaaccggaagcaactcctgcaactgacgccactgcggcagctcctgcagacaaaactactacaaacgttgtaatcatttcacttttagcgatcgcagctttactggtttggatcttggtaaaactaagacaattggtaaaattgggtcaatctgaagatttagcaggacttaacgaaacaagagttcgttcgttcagtgaaatgtatgagaagttccactacattggtaaaggtttattagcaattcttgctattctggccgcttacggagtatggaactggttgatgtggattggggtttacaaagggtacaaacctgaacagcctatctacttctctcacaaaatccatgctggggaacagaaaattgactgtcaattatgccactccagtgctaaatatggaaaagtatctgagatcccttctatgaacgtttgtatgaactgtcacagaacaatctctgaatacaacaaagatcactacatggagccaggaaaagacaaggcattctatgacggtgaaatccagaagatctacgctgcaacaggttgggatcctgcaaaacaacagtacacaggaaaaacacaaccggttgaatggacaagaatccacaacatgccagacttcgtttacttcaaccactctcagcacgtcattgctggagaacaggcaatcatcaattctttcaacaaaaagaatcctaacaacaaaattgatgttgtatgtaaagcttgtcacggtaaaattgatacaatgaatgttgttcagatggctaacgactttactatgggatggtgtatcgagtgccacagaactactgaagttgatatgaacaacggttataataaagagtacttcaagaatctacatgacaagttgaaaaaacaatatccacaagatggaggtaaaatcactgtagatgcaattggaggtcttgagtgtggtaaatgtcattattaataactaaaaaattagaagtataaatggcttcaaacaaaatacaattcagaagtattcatgaacttaaagatccggctttgaataataagctggctcagaaagagtttcaggaagaaattccggtagaagatttccttggagatgctgagaaaaacggatcaagtacttcaagaagagatttccttaaattactaggattctctacagcagcagtaacattagctgcctgcgaagctccggtaatcaaaacgattccttatgtggtaaagccgcatgatattattccgggaatccctaactattacgcttcaacttattttgacggtttcgattttgctagtgttttagtaaaaacccgtgaaggaagacctatcaaaattgaaccaaacccggctggtggcgatttaggtaaaactaatgcaagagctcaggcaagtgtactttctctttatgataacgataaagtaaaacagcctaaactggacggaaaagatgaaactttcgataaagtagacagttttgttattaaaggtttggaagaagctaaagcgtcaggcaaaaagattgtggttttatcacactcttttgcttcaccaactttcaaaaagttattcgctgaattcaaagctaaatatcctacagcagaattagtaacttatgatgcattcccttattctgcacaattagatgcagctcaggaggtattcggacaaagagcattacctgtttatgaccttagaggttctgagctggtagtttctttccaggctgatttcttaggagattataacgcttcaagcttagagacttcttatgcagcagcaagaaagccaggaccaaacatgttaagacacatccaggtggagtctaacatgtcattaaccggtgctaacgctgactcaagatacagattaaaaccaagtgctgtaaacaagactttagttgaagtttacaatgcaatcgtaggtggtggtacttctgataagactgctactgaaattgctaacgaattgaaagcaaaaggaagcaaagctgttgtttttgctgacggttctaaaggagcacaggttttagcacacttaatcaaccagaaattaggttcagtagctttcacaggtaaagccaacttactgaaagaattcgacggtgcaagataccaggaattccttggatgggtaaacggtggacaggttggcgttttagttaccaacaatgtagatcctatctactctcatccaaaaggagaagatttcaaaaaatctttatctaaagttccttacgtaattgctgtagcagataagaaaaatgaaatgtacaaagcagcgaaagctgtaattccacttgctaactggttagagtcttggggagatatcgaaccacagacaggagtatattcattaatgcagcctaccatccagaaaatctacaaatcaagacagattgaagaatctctattggtttggaagaacggaaaaaacaatgcggcaaacaactactacgattatttaaaagcaagctctgcttcttttttaggtggtacttctttcaacaaagcattgtataacggtatcaacgcatctactaattcaacaacattatcttacgcaggcggaaacgctgctcaggctgttgctgaactaggaaactttaaaccttctgaattagaattagtattatacactaagacttcaatgggagacggtactcaggcaaacaacccttggttacaagaattacctgatccaatcacaagaatgtcttgggataactatttgacaatttctccaaaagacgcagaaaagttcggaattgataacgatcttaacgcaagaatgcagttagatggttctatcgtaaaccttactgtaaacggagtaacaataaaagatgttcctgtattcgtacaaccaggacaagctgaaggatctgtaggtcttgcacttggttatggtaagaaaaactcaggagcaactgctgatactggtgtaaatgcttatccattatttgacggttctaatcttgttctttcaggtgttaaaatcgagaaaacaggagaagatcacgaatttgcagggatccagcttcaaaatacattgatgggtcgttatgagatcgcaaaagaagttcctttagcagatttcatcaatgtagctttcgatgatgagcacaaaggatggaataagcctttggaataccacacgatcagcggagctcttccagcaagaaaaatcgacctttgggatgctttcgatgatacagacggtcctcacttcaacttatctattgacctgaactcttgtacaggttgtggagcttgtatcattgcttgtcaggcagaaaacaacgttcctgtagtaggtaaagaagaggtaagaatgtcaagagatatgtactggttaagaattgaccgttactattcttcaagacaaacggtagaagtatatgaaggattaaaagatggaatggctgtaccagaattatacggtactgcattcaacaaagagggaggtgcattgaaccacccagctgataatccggatgtaatcttccagccagtaatgtgtcagcactgtaaccacgctccatgtgaaacggtatgtccggtagcggctacttcacacggtaagcaaggtcaaaaccatatggcttacaacagatgtatcggtacaagatattgtgcaaacaactgtccgtacaaagtaagacgtttcaactggtttacttataacctaaatgacaagttcgatttcaacatgaacaatgatttaggaagaatggtacttaacccggatgtagttgtaagaactagaggggtaatggagaaatgttcaatgtgtatccaaatgactcagaatacaattcttgaggctaagaaagaaggaagaagagtgaaggatggagaattccagactgcttgttctaaagcttgttctaccggagcaatgacatttggagatatgaatgataaagattctgaaattagaaaggtatatgcctctaacagaagatattatttactagaggagatcggaacaaaaccaaacgtgttctatcatactaaagtaagaaacagagtagaaaaataaagtttaaataataaataggtaaaaaatgtcaggacattacgaagctccgataagggaacctctaattattggtcacaaaacttatcacgatattacagaagatatcgcacgacctatcgaagaaagagcaggtaaattatggtggatctcattatatgctgcgctagttctattcctctatggattcggctgtatcgcttacactatcgggacaggtattggagcatgggggcttaacagaactattaactggggttgggatattaccaacttcgtatggtgggtaggtatcggtcacgccgggaccctaatctccgcagtattattattatttagacagagatggagaatgtctgtaaacagatctgcagaggcgatgacgatctttgcggttgtacaggcggcaatcttccctgtaatccacatgggtagagtttgggttggatactgggtattccctttaccaaaccaattcggttctctttgggggaacttcaactctcctctactttgggacgtatttgcgatctctacgtatttctcagtatcaactgtattctggttcatgggtctaatccctgactttgcaatgatcagagatagagctaaaactccttggactaagaaaatttatacattccttgcattcggttggggtggtaaagcaaaacactggcaaagattcgaagaactttctttggttcttgcaggtttggcaactccacttgtattctcagtacacacaaccgtatccttcgacttcgcgacttcagtaattaaaggatggcactcaactatctaccctccttacttcgttgctggtgcgatcttctcaggatttgcaatggtacagaccctattgttggttgcaagaaaagtttgtcacttagaagagtatattacaatgtatcatatcgaaattatgaacatcgtaattatcttaactggtggtatggtaacggtagcttacgccactgaatatttcatcggatggtactcaggttcaagattcgaagatttcacatatctttctccgggtgctgccgtaggaccttactggtgggcattctggtcattgatcatctgtaaccttgttgttcctgcttctttctggttcaagagactaagaacgaacattatctggacattcattgttgcattaatcattaacatcggtatgtggttcgagcgttttgatatcatcgttatcaacctttcaagagactacttaccaggatcatggaccatgtttaagccaacgatcattgatgtaggtgtatacttaggaacaatcggattcttctctgtattattcttattatacgcaagaacgttccctgtaattgcacaggctgaattaaaatcgattttgaaaatctcaggtgaaacttataaagcaaaagaaggagatgagcaccactaaaattgtatacggactttatgctgacgacgacgatttaatgaacggcgttaaagcattcaacgataaaggaatcgcaatcaacgaagtttatactccgtttccggttcacggactagacaaagctttaggtttaaagaaaaccagaatttctgatgctgctttcatctacgcttgttatggtgtaactatcggtgctactttaacctggtatgtgatgaatcacgactggcctcagaatatcggtggtaagccagcttttgactggggacacaacatgcctgcattcgtagttccaatgttcgaattaatggtattctgtgcagctcacatgatgtctttaactttcttggttagaaacaaaatgtatccgggggctccggctcagaacccagaccctagaactactgatgataaattcatgatggaattcgtaactgaagatgtagaatctgtaaagcagttgcttattgaaactggagttgaagaaataactgttaaagacgcttaaaatgaaaaagaatgtattaaagattacagcagttttaggtttaacaacagttttacttaactcttgcggaccaaaggagaacactccgttggtatatttcccggacatgtattttccggtagcttatgatccattgatgaaggctcaggatgcgtattcagatcatgaaaatgaaattcctgcttttgttaaaaataatggagcaacaggtctttctcctgtagaaggatcagttcctcagaataaagacggagtttttgaagaaagcttattacctaaaaatgttgacgagtacaacgcagggtatgaagcttctaaaaaacttacagtatctcctttgaacccagctaacacagcgaaggaccttgaaagaggtaaaatattgtttgatcacacttgtgctgcatgccacggaacaggaggtgatggacaaggacctatcgtacaaagtggagcattctccggagtaccgaactatgctgacagagaaattactgtaggatctgttcattatgtattaacaaacggtagaaatgccatgggatcttatgcgggacaactgaacgcaggagacagatggagagtagcaatgtatgtgatgagtgctttcaaaaaaggagcagcagcaccggcagcagctacagcggcggcaccagcaacaactgaaacgactaccgaaactaaaaaataagaaaagaaatgtatagtttttcaccaaaattaaaatcaacttctataatacttcttgttgtaggtttagttcttttcggtattggtttctttttgaacaaaggaatttctactgagaaaatagaacaaatgatggaagctgttcatgcttcaggtcatacggctcctacacattcaagtgaaatggttggacctcaggatcacgcggctcatcttgagcacgctacattgcaggtacacaaccagcctttagcagcaatacattttgtagctgtatttttctttggagtaagctgctgcgtattattcttctattctattcagcacgctgcccatgcaggatggcctatcatcattacaagagtaatggaagctattgcttcttatatcccttacggtggtgcaatcctggtaatcctgatgatcttaaacatcactcataatggtcacctattccactggatggaccctgaattgacaaacccggattctccgcattttgatgtgatcttattcgaaaagaaaaaattcttaaatattcctttctacgcagtaagaactttaatctatgtgattggcgcttctttcttcgcatggaaattaaaagctcagtctaagaaagtagatgaaacgaagtctaaagtagagtaccagatgctttacagatggtcagtaggatacatcgcattcttcggatttgcttctgcagcatgggcttgggactggttgatgtctattgaccctcactggtattctacaatgtatatctggtattcaatggttagctgcctttcaagtggtattgccgtaatcattttattaagtgtttaccttaagaaaaatggtttcttaccacagttcaatgataaccacttacacgatttaggagtattccttttcgctacaagtatgctttggacatatacatggtttgctcagttcatgctttactggtatgccaacgttccggaagaggttaactacttcttcggtagattccagcactactctcctactttcttaccaatgttgatcatcaacttcttgttaccactattggtattagtaagcagcagcatcaagagaaattacaaagtagttactacaatggcagtagttgtgatcttaggacacatcttagattacttcaacatggtaatgcctggaacagtaggaccatactggaacactcctgaagtattccttttaatccttggagccatcctgttcgtagttggattatttatgtttactgtactttcagctttatctaaactgaagttgatccctacaggaaacccattcttacacgaatctgaaatttatgagtatcctttctaaggacttgtaacaaaataaaatgataaaagactgattgttaaaacgatcagtctttttttatgcatattggtcaacagctaaaacaaatcttattatgaaaacaaaacttttcctctattcacttttcttttttttagtcagctttatccaggctcagaccattactttcgtttctgaaaaaaataatattccccttcccagagtttcagtatttggaaaagacggaaccatcttagcctattcagatattgaaggtaagattgataaacagtcattgtctccttcccaggaaaagtttcagcttgtttataataattttccggtagctactttatcatattcggactttgaccaatcggttataaaaattaatgatcaggtaaaagaaattgaaacagtagttatcaagaacagtaagcctgccaagtatatttttatcaaaggaaattttaatgcctatgttacggtaaataataagctgaacagttatgcagacggaattgtaagctatatttttgacaacaaaacaaaaaaactgaaaagtacccatgtagagcagtaccgagtattcagaatggcagaatctaaaaacgaaaagaaagaaacttcgtcatgggattatggcaactcactgaatcttccaaagcttaaaaatgtggggaatcccgaagaatataaaaactcaaaaaatacgatcagagaattgaaaggagatcgcagagatcagattgaagtaacaggaggaattcttcaggaaaaagaattttcatttttcggatacagattttatgatataagaactattttaaatatgtcgtttgaaaaaggatctgaaaaaacattaaaagattttctggaatataacgaacttgtttttgttaagctaaaacacaaaagtgaacctgaatacaatcagatttcagtttataataatttctatcctacggaattaagcttcaacaatgacaacgatgtagaaaaagtaaaatttgataaagacaacagcaattataaaaccccttactggcaggatgcatcatttcccaatatgcagacgatcttcagtaactttttcaaaggagatctgaaagaacagcctaacaaaaagtaaaaatttaggattatgcctactttgaacaggaatataacagtctaaaaaacataaagtgaaaataaaaatccagtattaataaaggttttattaaatttgcaacaaaccaaataaaaatgaaaaagttttcttttctacttgttttcagtctgttgctttttacagcatgcaagaaagatcatgtagatgctacgaatactaaaacactgcagtcaagtatcaacgatatgacttccagtttacctaccattaaacagattaagtttaatgaagctctttacatccttaaaacttttggagtagaagctgatggtgatatcaatgagctgaaggccctgggaaaactgatcaatgggaaaaaagtacctgagatcatggctatggctgacgaagttgcacagaaaaacggaattgaatgggcaagtactgctcctccatcactgggagaaatgaatatcttcggagatgataaagctaaagaaagcgatccaaatgatgtaaaagcaggatcattaagccttgtgacaagacctacaggagatgacggaaccggagcgcctacagctattcagattgttccgagacttgtagacgcagcaggaaacccggtatcatttacaggagccggcctcgaagctactcttgaagtattcagtaacggtgtaagactggcaacagccaaaaacctgatgcaggataacaacttcaaaggtttcaatctgaaattctcctctatccctgcttctaaagtagtggacaataaaatagacattacggtttctgtaaagacaacagctaaaactttcaaaatgtcaaaaatcgggcttgatgtgaatgcagcagccctgaaagtgcctgttgttccaaaaaccgattctacagctgtatcggaacagccaagcgcagtggtagatccaaataacccaacagctccttccggaactactactgatcctgcagcggctactcctgcagcaccagctgcaccaaaacagccgaccacagatcctaaaaatacagtaagtaaatttttgaatagcgtaagctctcagaatttaaaagcagcctatgaaacatccagcaatcctagctggggtagctacgaatctttctcaaaccctacttcaggtttcgggtctgtgaaaaatgtgagcataaagaatattacgacaagcggtgctacagccaacagcgccagcgtaaatgctacttatgatgtaacggataaaagcggaaagactacttccctaaaagtaactttcgggcttaaaaatgtaaacggagactggaaaatttccagttataaaatcaattaataaatggcttcagcagaactgatcaacaaattagaagaaacaattgaaaacatccctgattttccgattccgggaatacagtttaaggatatttcacctatctttttaaacccaaaactttatgaagaggtaattgcagatcttgcagtcttcagtaaaggaaaaatagatgcagtctgcggaatagaaagccgtggttacctttttggaattgctattgctgtggcattggaagttccgtttatcctgatcagaaaagccggaaaacttccccctcccatcatttcggaagaatatgatctcgaatatggaagcgccattatcgaaacccgtgaaggacagttaaaaccaggacaaagagtcttaattcacgacgatcttttagcaacaggaggaaccacagaggcggctgccaaactggtagaaaaacaaggagccaccgtttcacaattcagctttctgatcggcctaaaaggattgggaggtgatgagaagttaaaaaaattcggtgctgaagtctaccatattttagaatattaagatttaatatatatgcttcgacatgctcagcatgacaaccctaataaattactgtgagatttgaacaggtcatattagaagtgtcatcctgagcatgtcgaagcatctttttttaattaattcatcattcacaactacaattcataaaatttcattaataatactcataaagtattttgtaaatcattcagaaacaattaaatttgcatttcaatttttaaaaacttatggcaaaattgggaaagagtgctcagaatgagcaagaaggtaaagaaacggttgagttctttaaagaccttgacagagaagcattaaacactgaaagatttgttgaaaaatattcaaaaccgttgggattaatatttggagcactgcttttaggggttttaggattctttgcttataagcaatttgtaattgctccaaagaacgctgaagctgtaaaaagtttccttgctgctcagaaaaaccttacagaaggtaaagataaagatgctttaggcggaaaatttgcggctaatccgggttttatcggtactgctaatgaatattcttctactgaaattggtaaactttctgcttacaatgccggtttattaaaattcaaagaaggaaaattccaggaagcgtatgatcttctggataaattctcttccaaaaacaaaactctgatggcaatgaagtatggagccatggctgatgctaaatcaggtcttaacaaaaatgacgaagctctttctttattagaccaggcagcatctgcatcagatgatccttatactacttattatttcacaagaaaagcaggtatcgttgcattaggattaaagaaaaatgcagaagctaaaaaatacttcgctacaattgacgaaaaatatcaggactacgacaacggaatgtctgattcttatattgaaatgactaaatattattaaaaaatggcaacagttaatctttccgattacaagccacttcatataactaatgccgaagatttttctatcggcattgttttttctgagtggaatgattttgtaacatacaatcttcgtgatgcagctttggaaattcttgaaaaagaaggcgtaaaacctgaaaacatcaagcttttcccggttccgggcgcttttgaattaagctatgcaagtatgcagctttgcaaagaaaggaagtatgatgcagtaatctctatcggatgtgtaatccgtggagaaacaccgcattttgattacgtatgttctgcagtagcgcagggaattaaggattgtaatattatgactgatactcctactattttctgtgtattgacagatgataccaaagaacaatctattgcaagaagcggtggagatcttggaaacaaaggtgtggaagcagccgtaacagctcttagaatgattgatttcaaaaagaaattatctgataaaaaagggaatatcggtttcggacactcttaaccgggattcactttcaaaatatcatggactattttttaatagtccttttttattggaatattaataaatcataaatctcattaataaaaaggatgtttttgtttttttccatcaaaagttctctacaaaaactatctttgtgaaaactaataaaaacagacaatacatgtttttaaaaaaaataaaacccttcctttatttaggaattttctatcttgttatttcattgataataagaacaatattcttttttcatcctattacaacggctagttttggatttttcgaagtcgtaaaggttctgctcataggtctggtaaatgacgtttttgtcttcatcctggccagctccattctcgccctttatttcctcttcctttccaattcgaaatataaaaaaccttacggctacattattttgggagcattggttctgttcttcctttatatatggcttgtgccgaacaatatttttaagcaatacggcggctctgtaatggaaatcgctcttgctttcgtaggaataaaaactcttttctttggattgatgcttttccttcctgcacaaagaattaaaatccgtaatacactgtatttcataacgttattactatacgttcttttgattattttcaacggcgtaagtgaatatttcttctacaatgaattcggggtacgttataattttattgcagtagattatcttatttataccaatgaggtgatcggaaatatcatggaaagttatcctgttattccattgttttccgcaattatgatcgttacacttgccattacatggtttatttataagaaaacgaaagatgaacttctggaccttcctgattttaaacaaaaaatggtgcttctcggtagttttatggtactttgtgctctcagtgcattggctataccttctttaatgcagatcagatcagacaatgtttttgctgatgaaattgaagcgaacggacttcctaagttctattgggcatttactcataatgagctggattatttccagttttattcacagattaaccagcagcaggctgaaaagaatttcctgagccagtacccgcagcataccttatcaagagcagttgttgctgaacagccggaaatgaagaagaatgtagtattgatttctatcgaaagcctttctgcagatttcatggagcattatggaaatacacagaaaattacccctttcctggatagtcttgcagaaaggtctctgatgtttaccaatctttatgctaccggaaacagaaccgtacgcggactggaagctttaacattgtgtattcctccaactgcgggagaaagtatcatcaaaagagatgacaataagaataaattcacaaccggaaatgtttttaaatccaagggatatgacgtcaaatttttatacggaggttacagctatttcgacaatatgcaggatttcttcggaggaaacggatatggtattgtagacagaaacagcttcaaacctgaagaaattacttttgccaatgtttggggtgttgctgatgaagatatggccagaaaagccattcaggtaatgaatgctgaagcgaaatcaggaaagccatttttcaatcactggatgactgtttccaatcacagaccgtttacttatcctgacggaagaatcgatatccctggaacagcaaaatcccgtgaaggcggtgtaaaatatacagactactcacttaaactgttctttgagatggctaaaaagcaggattggtataaaaacacggtttttgtgatcattgctgaccactgcgcatcgagtgccgggaaaacagagctaccgatggataaatacagaattcctgcgatggtattctcagaaggatttatccagccgcagaaattcaatgggctgatgtctcagattgatgtgatgcctacccttttcggattgctgaatttcagctatcagtctaaattcctgggccaggatgtgttcaaaccggaattccagcctaaagcttatgtagcaacctatcaggatctgggccttataaaagacggacatctgactattatttctccggtaaaaaaggtaaaacaatattctctggaactggaaaaaagtgatctggcacctgagtttaagctgtattacgatgaaaaactattaaaaaatccggatcagaaacttgtagatgacgctgtatcagcatatcagtctacttcttactggttaaaaacgaaacaacttaacagataaatatctaaatattttcgcttataatctggtgtaaaatatttaaattaaccgataaatttattagtatgaaatggacagacgacagaggcggaaacgttgatgaccgccgtggttcaggaggcggaagtggcggcatgattgtaggaggcgggctcggaaccttaattatagcagccatcgtgttctttttaggaggtgacccgtccggtattttgaattccggaagcatgcagccttcaggcaatacaggagaacaaagagaactgactgccggtgaaaagcagattggagaaatggtaaaaatgatggatgcatggaatagtcagacctggactcagatttttaaagaaaacggcatgacgtataccgatccgggtattgttcttttcgaaaatacaacttcttcagcatgtggtacggctcaatctgccatgggaccattctattgtccggccgatcagaaagtctatatggatatgagtttttttggtgaacttcagcaaaaattcggagctaaagtaacagaatttacggtagcttatgttcttgcgcatgaagtaggacaccatgttcagactcttttgggaactacacagaaagtagatgcattaagaagaagcggaagatattctgaagagcaaatgaacagagtttccgttgctacagaattacaggcagatttctatgcaggagtgtgggcgaaaagaaccaatgacagcaaacatattctggagcccggagatattgaatctgcaatagatgctgcagaagctgttggagatgataatatccagagaagagcacagggatatgtaaatcaggaaagctttactcacggatcttctgcacagcgtaaagaatggtttatgaaaggatacaataccggagatatcagacagggtgatactttcaaccagctgttgaaataatttataaaactttaaataaaaaaatgcggcctcagtgtgaggccgcatttttttattattgtaattcgatcggattagaatttctctttgcttcttcttttatccgctcctccattctctttctcatatcggcaggattctgatttcctcccccgccagggcctccaattctcatgggtgcagctacaccaccaccctgattcataaatgacattggatctgttttaaacttttgctgctgttttacaaaatcggctcttttcacttttaaagtattcccaaactggttcaaagtcggaaactcggcaattttgtaattcttcatgagatcaaaagaataatctcctttgtcatcttctatttttacaattaatcccggaagtccaccaaacttatagggaccgtcctgataaggaagatctgtggtaaaccatgcagtccattttctgcctccaaaatcggtttctgctttctgaactttgtattcgccaatttttcttgtttctgactctattttccagttcagcggtctgtcttcttcgtacgaataaatatcacggccgattctgtctttgaagtaggttttttggtttgtcttatccttttctacagaatagttgatattggacctcagactttccatctgatctctgttgatacttcctcttcctcctccaccttgaaatgccttttgcatgatagaatcccttttgattctgttttcagaataaaaaaccgatttttccggagaaatatccagataagcattttctgtcttgacatctgttttattttctgcatccggcttcatagtcacatgatacacaaacctgtttgtctgtgcagaaacattctgtatgaagagtgccaatgcgataatacctaattttttcatttatatttttatttattttaattcaattggattctgggctgtatgggtcaaagaaggaatttctccagacgaatctgttgagacaggaattccttgattttcaccacccattcctctgtgcattccgccaccgcctctcattcctccgccactcattccgcccatgccaccatgttttcctcctccaaaattcatatttccagccattgcttttctgcttttaccaaactccagctccaacgctgctttatcgccatggaaatttatccttgtactttgtttggcatccggctgaatctgttcttcaaaagcatttttaatattaatctttttaacaagatcaaatttataatctcctttgtcatcttccagctttacaataagtcctggcagtcctgagaatttataaggtccatcagaaaaaggaatctctttggtaaaccatgccgtccaggttcttcctccaaattcagtgactgctttttgagcagaatacccattctgtttctcaattacattgatcacctcccattttacaggtctgtcttcctgatagtaaatttgttttccggcagccttttcatagtaatacactttctgttccggaatagctttggtaataaaatattcaaaaaaagtaggctcaaaatgttttctcccttccatttttgaaaaatctttttcttgttttctcgtttctttcgcttctgattttacagaagtaaaaagagagtctctttttagtttattttcactgataaataaggaatgcccttctttaatatccagaaaagttctctcacttttcatgcttaccagattgattgaatccgggtttaccagcgtttcataaacgaatcttgtggtttgcccataagatattgcagtaaaaaacaacacaaaaaaagttataattttttgtcccattaccaattttctttatagatcggaaatacctcagaaggttaaaattacaaatgaaatcttcacataaagagaagaaatttatctgtttttaacataaatctttgctttaaaaatccctattaatatcagaatcattaaaatagatatcttcgatttgagattgcggaaattagttcgtatttttgcatcattaaatcattctaaataaatacaatgataaaagtatcagatcatgcaaaggaaaaagccatccagttgatgacggaagatggttttaaccctgctgaagattatataagagtaggggtaaaaagcggcggatgctctggtttagagtatgttttaaagtttgacaacgaaaaaacagacgcagatcagatttttgaagataataacattaaaattattatagataaaaaatccatcctttatttagcaggaacaactcttgaatattcaggaggattgaacggaaaagggtttgtttttaacaacccgaatgcatccagaacatgtggatgcggggaatcatttagtctttagagaaaagacattagatcctagatttcagacctcagagctattctgaattctgaaatctaacatctgaaatctaaaaaattataatgagtaaatatacagaagacgatttaagagtcgatctagaaaataaaaaatacgaattcggttgggaaaccaaaatagattatgaagatttcccgattggtttaaacgaggatatcatccgtgccatctccgctaagaaagaggagccggaatggatgactgaatggcgactggaatctttcaaaatctggcagaaaatggtagagcctacatgggctaatatcaaatatgaaaaaccagattttcaggcaatccgttactacgctgctcctaaagtaaagcctgagttggcaagtcttgatgaagtagatcctgaattattgaaaacattcgaaaagctagggattaatatcgaagagcaaaaaagactttcgggcgttgccgtagatatcgtaatggactcagtttctgtgaaaaccactttccaggatacattggcagaaaaaggaattattttctgttcaatttctgaggctattaaaaaccatcctgatttagtaagaaaatatcttggaaaagtagttccgagaggagataacttttatgcagcattgaattccgcagtattctctgacggaagtttctgttatattcccaaaggagtaaaatgcccaatggagctttccacttatttccgtatcaatcaggcaggaacaggacagtttgagagaacccttgtgattgcagatgaaggaagttatgtttcttatcttgaagggtgtacagctccgtcaagagatgaaaaccagcttcatgcagcagtggttgagcttattgctttagacaatgctgaaattaaatattcaacggtacagaactggtaccctggtaatgaagaaggaaaaggtggggtatttaactttgtaaccaaaagagggctttgcgaaagaaatgcaaaaatctcatggactcaggtagaaacaggttctgcagtgacatggaaatatccgtcttgcatccttaaaggagacaatgcaatcggagaattctactctatcgcagtaacgaacaatcaccaatatgcagatacaggaacaaaaatgatccacattggtaaaaacaccaaatcaacaatcatttccaaaggtatttctgcaggaaaatcacagaactcatacagaggactggtgaaagtaatgccttctgcaaaaggggccagaaacttctcccagtgtgattctctgttgatgggtaatgaatgtggtgctcatactttcccttatattgaaattaaagatccttccgcacaactggagcacgaggcaacgacttcaaaaatcggagaagatcagattttctactgtaaccagagaggtattgatactgaaagagctattgccttaatcgtaaatggtttcagtaaagaggttttaaataaacttccaatggagtttgctattgaagcacagaaactacttgaaatttcattagaaggatcagtaggataaagatatgttagctacagaaagattaattttaagaaaaccaacaaaagaagattttgaaaaattctttgaaattaatcatgaccctgaaaccaatgttcataatccagccggacccatgagttttcaaaaagcagaaagtacatttaccagaatgcttgaacactgggaaaggtatcatttcggaagctgggcaattgctgaaaaggaaagccctgaaaatataataggttttggaggtctgagctataaactctacggagaagaagaaaaattgaatttaggctatcgttttgcttcccaggcatgggggaaaggatatgccacagaattcaccaggaaagctatagattttgggcttaatgagggcaacaatgaagaaatttttgctattgtccgccccagcaatatagcttctgttaaagttttggaaaaggcaggtatgatcaacatcggaacccttaatgacgttcctggtcaacctgaaagtttagtatatagaattcaaaaataatttgtttaagcaaataaaatgttagaaattaaaaaccttcacgccaaaattgaagatggcgcagaaatattaaaagggatcaatcttgaaataaagccaggcgaagttcacgctatcatggggccaaacggagccggtaaatctaccctttcttctgtaatcgcaggaaaagaagattacgaagtgactggtggaaagattcttttcgaaggacaagacatcagtgaagatgctcctgaagatagagcccacaaaggaattttcctttctttccagtatccggtggaaattccgggagtttccgtaacgaactttatcaaagctgctttgaacgaaacaagaaaagcaaacggactggaagaaatgcctgcaaaagaaatgcttgccttaatccgtgagaaatctgaaaaactgggcatcaaaaaagattttctttcaagatctctgaacgaaggattttcaggaggtgagaagaaaagaaacgaaatcttccagatgatgatgcttaatcctaaattagctattcttgatgaaaccgattcaggacttgatatcgatgctttaagaattgtagcagacggagtaaattattttaaaaacgaaggaaacgccgttcttttgattacgcactatcaaagattgcttaattatattcagcctgacttcgttcacgtgttagcagacgggaaaatcatcaaaacaggtgataagtctttagccttagaacttgaagaaaaaggttacgactggcttttaaattaatttgaaatttactatttgagatttgaaattatgccaaccattcatgaagtgcagcaaatatgaatctctaaagtaaaaattggattcctattcctcggaataacaatattttagttcaaaaaaaagaaaaaaatggtgcaaaccacagatataccagtaatggcattaaaagaacaaattatagagaaccataatgagtttttggagagtcttcgtcacagatttctggatgatgaaagaaaaacggcgcttcaaagatttaacaatattggttttcccactaaaaaagacgaagaatataaatataccaatctaaaggagatcacggaaaaaagctacaacttcttcccgaaagagaaccataatatcactaaagagcagtttgatgagttgcatcttggagaagaaaattttgattggatcgtttttgtaaacggcaaacttcacaaagaactttcaaaagtttctattgaaaacgtagagttcctttctttcaactacgcattgaatgatgagaagcacaaagaggtttttgaaaaatactttaataccattgcttctaaagaacaggcctttacaaacttaaaccttgcttactgcaaatatggtttctttttgaaagtacctaaaaatgtagtcattgaaaagccaattcacgttttttacatttcccagaaccaggaggaaaatacattctacaataccagaaatcttttgatcgtagaagaaggtgcaaaagtagaagtgattgaaagccatcataattttgacagctcttatgtattgaccaactctgttacggagatctttacttatcctaatgcaaaagctgactggcacaaacttcagaacgataacaacacaacttaccttatcgataatacttttgcaaaacaggagaaagacagtttaaccactgtaaacacattctctttcggaggtaaactggtaagaaataaccttgattttattcataacggatcgaatatcaattcatttatgaacggaatcaccatcatcggaaaagaccagctggtagaccaccatacagcggttcaccacaacttcccgaactgtgaaagctaccagaattataaaggaatcttcgatggcaatgcccatggagttttcaacggaaaagtttttgttgataaaatcgctcagaaaacaaacgcttaccagcagaacaacaacgttttgctaagtgaaggagcaagtattgatacaaaacctcagttagaaatctttgctgatgatgtaaaatgttctcatggctgtaccgtaggccaattgaatgaggatgcattattctacctgagagcaagagggatctctaaaaaagaggctcaggcattacttctatatgcattcgcaaatgatgcaatgcagaacattgacatagaacctctgaaagaaaaaatttcaaagctgctggctgagaaactagaagttgatatagaattttaagacttatatatattgatacacaaaagcacttcaaatgaagtgctttttatttttgtgataagtcgttttatttttttaaccagctttgattgtccttattatctgaacgctttttgccattatctatattataggcaagacctacccctaatgtctgtttcaactgtgttttccatatctggttatggtcatacaacagatcaagggtaacattggtggaaatgtatttattgatcttcatgcttaaaactccgctatatccgagaacaagcctgtccgggtgatcaaggtagtttgagaagacagatgctgtatttaacagggtaatgttctccataattttcagcttatacatggcagtacccaaaaaaccgaactggaaaagggaagaatctccatcatttttaagaccataagttcctgctttctgaagatctttgtctaaaacaaatgtccatcttgcattggccggacgtaaggttattgtaagattatcattgggacggtacgtaactcctgctcccacgctcagatatccgggagccataaaattggaaatctttttagcatcaggattatttccatcttcataacccggagcaaactgagtctgaagaccgactcctgcagataaataccaatgtttggcgaattctctaccgtagttggtagaaagattaatgacatcctgtgtttttcttactcctgttccctgagtattattttgtccataccccagaataataatattctcccaaagatcctttcctttttcgtaagtaagattgtaattaacaccggcaagccatcctacgttgttggctccgcctcctacccagttggaaaaggctgcctgattaagcattaatgtattttgtccctgaatagaccaggctttcacagtgtctgatgccggcgcatctgttttagtctcctgagcaagcgctaaagccccgaaagagatagagctgatcaataaaagttttttcataatgtttatttattacaaatgtataaataataatctacgtctttataaaattcactttaaaatgaatttaacaccaccggatttacccctataacattatgaaaataaattatttaactacaaacacagtatacctcaaacttaagtcaacttaaagttacagtcttttaaaaacaaaaaatacctcatttctgaagtacttttcttagaatgtataattaattctttgttactttttgatccaccattggctgtctttccggtcagaacgttttacaccgttgtccagcgtataagcgaaccctattcccaaggtttgtttcagctgtgtcttttctatctgattgtgatcgtacagcaaatctaaggtcacattagaggaaatatatttgtttactttcaggttcagcaaggccccgtaagccagaaccaatctgtccggatggtcaaggtaattcgagaagacagacgctgtattggtaagataaatatcttccatgatttttaatttgtatattgccgttcccagaaaaccgaattgcagtaatgaagtatcgccatcattctttaaaccgtagcttcctgccgtctgaaggtctttgtccaatacaaacgtccatctggcgttggttggacgtaaggtaaccgtaagatcatcattgggcctgtacgtgatccccatcccgacattcaggtaacctggtgccataaaattggatattttttttgcttcaggattatttccatcctcatatcctgcagcaaactgtgattgaaatcctgctcccatagagaaataccagctttttgagaattttcgcccataattggtagaaacgttaatgatgtcctgtgtttttctgattccctggccttttgtatcattctgtccatatccaagaatgatgatattttcccaaaggtctttatccttttcataggtcagattgtaattgacaccggcaagccaccctacattgttggctccccctcctacccagtttgaaaacgctgcctggttaatcatcaatgtgttttttcctattactgaccagtattttacggtgtctgtcaccacggaatctttctttaattcttcttgagcacttgcatacattcctacaaaaaaggaaagaatcaataaaaacttcttcattactctaaataattttcaatacaaaagtattaatataattttttttaacgatatattcagctttaaagaattccatttcaataaagtttaattaactaacaacaaggtatttcagtaaaatcaatgccaaataataagtttaaaaattaaatttgataccttttgtcttaaaatcaaataagtagaagcccattcatcgacaaattttccgaaatttatcattggcttttgatttgacgtaaaatccccatgtttaagaatgtaatttccaaaagagcaattatatacccgctgctgatgctttcggcaatgtggttcgggtattttttacaaatgctgggcttctttcaaagctgttttggagccattattcctcttttgcctgagggattgcttggaatcattacctctcctcttttacatggaaatattgaccatatcataggaaactccattccgattgcagcactgatgtttctgctgtatcagttctatccattggtcgccaacaaggtttttattatcggatggctggcaacagggcttttggtttggcttcttcctcccattgacattctcaccggagaatatatgtatacctgtaccatcggagccagtggtgtggtatatgtgcttgcttttttcctttttttcagcggggtattcaagtggaatacgaaacttctgaccatttcgatgcttgttgtgctgtattatggaagtttggtatggggaatgcttccagaagagcttttctacaatatggaggagcccagtaagatttcatggcaggcacacctttccggagcggtagtgggaagtatcatcgcctttgcttttaaaaatgttggcgaaaaaaagaaaaaattcatctgggagttcccgaattactatagtgaaaaggatgataagttgtggcaggaatacaaggaaaatcatcctgaagattttatggagcttccgtacaagaaaaaagatgatatctgggatcatttggatgaattgaggaagagataaaacttaatttcactacatttgaaaaaaaacacagatgatctccgaagaatacttatatgctatcgccctccgcgagtgcagccagattggcgatattcaatttcataaacttgtccgtactttcggaagtgcccgggaagcatggaaaagggcaaaaaaagagtataagaagctcgaaggaataggacaaaaaaccgtttccgatattggaaatgcagctcatttgaaattcgcagaagaagaattaaatttttgcgaaaaaaataatatcagaatcaggctgaaacatcatagcgaactccctttcctgcttaacgaatgtaatgatgcacctgctattctttatcaaaaaggagaacttaataacatactgccaaaagtaagtattgtaggcacccggaatatgacagaatatggccggcagtttattgaaaatttctttgaagcaacccaattttcaaaatacgtctctgtgagcggtctcgctttaggcgttgacaaagaagttcatgaacagtctcttcattaccggaaaccaactatagcagttcttgcgcatggttttcaatatttatatcctgcaaaaaacagaaggctttctgagaaaattttatatgaaggaggtgcactcataacggagttcagttcttcaagaaaaccagaccgggagaacttcattcagagaaacagaattgttgccggattatctccttctacaatcgtagtggaaaccggttttggaggcggttccgtaagtacagcagcctttgccaatgattacaaccgcgatgtttttgcgctgcctggaaaaattacagaagtgtctagtcagggatgtaatcagttgattttccataataaagcaacagcaatttctaccatcaaagatcttgtccgtctattgggatttaatgatcctaaagaaaaaacagaagagttatttccttatagcgagaccattatgcaactatctgaaaatcaaaatacaatatatcaatccattaaagaacacccacatatttctttggatgatcttgtacaaaagattgatatttctactcacaaaatcttaccgataattttggaattggagcttttagggaaagtaaaatcgttttccgggaggcaattcatagcgatttgatatttaacgatttcttaatattgcattatttcacacataacatttcatttttaataaaatttaaagacaaattatcaatttaataatattacgaaacattattatttaatttttaataatgttaaaatatagtgttgtgaatcttgaaaaaaaaattaaatttgttgacaataatattcaaccttaatatatggaacaatataatattgaccagaaaatccaagagtttattgcaaaaattgaagcaaaaaatcctaacgaaccggagtttttacaggctgtaaaagaagttgccgtaacagtaattccattcattgctacgaaaaaagaatataccggaatgaagctgcttgaaagaatggctgaagctgaaagaattattattttcagagttccatgggttgatgacaaaggagaaattcaggttaacagaggtttcagaattcagatgaactctgctattggaccatataaaggaggaatccgtttccaccctactgtaaacttatccgttcttaagttcttagctttcgagcaggtatttaaaaactctttaacaacgcttccaatgggaggtggtaaaggaggttcagattttgatccgcaaggaaaatctgatatggaggtaatgcgtttctgccaggccttcatgacagaattatgtaagcacgttggtcctgaaacagacgttcctgcaggagatatcggagttggagcaagagaaatcggatatttattcggacaatataagaaaatcagaaatgaatttaccggagttcttacaggaaaaggtcttgcttacggaggttcactgatccgtcctgaagctactggatacggtgtagtatacttcgctgagcagatgcttaaaacaatcggacaagatttccaggggaaaactgtgacggtatccggtttcggaaacgttgcatggggagttatcaaaaaagcaactgaactgggtgctaaagttgtaacaatctctggtcctgacggatatatctatgataaagatggtatcagcggagaaaagattgattatttattagaacttagatcttcaggaaacaacagagctgaggattatgctaaaaaatatccatctgctgaattccacgccggaaaacgtccttgggaagtaaaatgtgatgttgcattcccttctgcaacccaaaacgaattagatttagatgatgcaagaaaattagttgaaaacggatgtatctgtgttactgaagcggctaatatgccttctacattagatgccatcaactatttcttagataataaagtattattctctcctggtaaagcttccaatgccggaggtgttgcaacatcaggattagaaatgactcagaactctatccgtcttaactggacttctgaagaagttgatgcaagattaaaggaaatcatgatcggtatccataaggcttgcagagactacggaaaagacgaagacggttatgtaaactacgtaaaaggtgcaaatattgccggcttcgtaaaagtagcagaagcaatgttggctcaaggagtggtgtaacaaaaaatacaaaggttgggagaaattcccgaccttttttgatatagcctgttcccgggataatgggaaaaaagtaaaaagtgaaaggagaaagcgttgctatatgcagcgctttttttattgtgcaatgaaagacactgatccatattttcatctttaaaatgcgcccagttgataaaataaaataaataaaaaatcctgaaatacaagatttcaggattccgactagtgtttgctaaagtgcttttactttttctttttcttatctttcttttcctctttaggagtatctgcaggcttggttgcatcagtaggtgttgtacttactgacggatctgttgcaggtgctgtctccgttgtagttgcaggtgatttttcctgagttttcggatccgaaggacttgtagtctgggtattcggttgttgagtttgagttgtcgtagtgttattagtagaagtatcggccggcttctgagtggttgattgtgctgatactgcgattactccgactaaggtaaacgctgccgttaaaaataactttttcataatgataatatttaaatgattgtttaacttaaacgaagcatcatttataaaattatgcgtaagtagcttatttaacggactttatgattatttaagaggaatttgcaaatataaatttgtttggtttggctggaagagtgacgctggaagctggaagctttttagattagaaataataacttaacagaagattcattaagtttaaaatcaaaaaaacacagtttttattatcaacaatgattacctcccatcttccttctcacaaagctatttcgcaatattcttcatcatcttttctacaaattcaaatgctgccgggcagatcactgtatttttcagcattaaattattaatctgatagatttttttccggtctgtatgcggatattcacgacaggcttttggtcttacttcgtaaatagagcaggtattatcactattcaggaaaaaacaaggaagattctgcagtactttatcattgtcctcatccactcttaaaaattttgcttcaaagtctgcagatttcattcgcagatgtttggcaatgcgttcaatatctttctctgtataaagagggccggttgtcttacagcaattagcacactgcagacaatctatctcttcaaaaacttcatcatgggtttcctgcactatataatcgagatttttgggcggttttttctttaatccgtccagaaattttttgtgttctttctgcttttgtatagcctgttttttataaaaatctaagttcatctattctttatttcttacgaaatccgggagctcttctttcctgtactcattaattttatccagatccagtatcgttgaaagattttctttatttggataatacatcgggacaaattttgcaccgtatacaatttcccctgtagtatacgaagacctttgtactacagtatttgaaaacacttcatcaaatgcacgcacctgcacaataagttcaatatccgtatttttaaaatcctcttcggaaaaaccgtaaaacggagaattctcatcaattttatgcactacagtccagttgagtgctaaggtattaatcttacttaattgggtttcaagcctgtaaaaattgcttttggcaactccgttttctataacttcaatagctgccgacaggataacatcagcatccgttaatgcattatttttatagggggcaagcctgaacattaatgcggaagattcctgaaaaggagcaataagcgcaatatcggagaatctaagataggccctaggccttgaaaaccttccgtaaaaaagaccggttgcaatggcaaaggtaagtaatcccagaaaagcttcaaaggtcgccacaaggctcgccaaaaagcctaccggtgctattcttccgtacccgactgtggtaaaggtctgggaactgaagaaaaaaacatcaataaactcgtttagcggatcacttttgtcgatgccggtaagatgttccactccgattagataatagatcatggcgaaagccaggtttaccagaatataagcaataaccagataggaaatgaaacggaatgaagaaagattcagcatggtgtgataccagcttaacctgttaaagacattcacacctctcctctggacattcgggagaccgtccttattgatgaatcttccggatgcattggttccgaaaccactattctccgcatttttctgacggatcttttttctgaatcctcctgtcatttttatagcattttcttaccgtttgtggtgcaaagataaaatattgttttgatgaattttatcaattgattcatttgagttttaaatcgattttggagtacatttgaagtatgaaaaaactggaatcaagagaggacattgaacgccttgtcaactcattttatgcaaaggtagttaaagatgaagccatcggattcttttttaatgatattgctaaagtagattgggataaacatcttcctaaaatgtattctttctgggaatctattctttttggacagatgacttataaaggaaatccgatgggagttcacttcccgattaatgagatacaggccatggagcagaaacattttgacaaatggctcgaactctggagaactacgattgaagaaaactttgtgggagagaatgctgacatggcgatttacaaatcagaaaatatagcaaagctaatggctttcaaaatggatctggccagaagactgtaagggaaatgtattcgggatgcgggatgcgggatactaaataaacagattcacttaacttttctgcgatttgtccttttgccttttctcttttaaggaacgattactgtaaagatataagcagccagattcactaataatacggtcccatacagaatgttggtttttccgcgactaagggaaagcattacgataaacacggataaagagagcaaaataacgtcttttttgtccagaccaagcaccaatggtatatcatacataatacacaccactgaaactgcaggaatcgttaatccgatacttgccaacgcagatcctaatgccaggtttaagctggactgaatctgatttgcacgtgccgcccggatagcagccacaccttcaggaaggagaacaacagctgcaataattacccctacaagagatttgggtgcccccagacttcttaccatactctcaatcgtatctgataatccttttgccataagcactacaattgccagacaaacaagcaggaaaacaaagcttatcagtgttttggccaaggtaggaatataatgctcttccggatgttcatcgggaacaataaagtagcttctgtgacgcaccgtctgaaccatcaggaagatcccataaatgataagacaggcgatggatataaaaataagctgagcttcgttatagaaaggtccgttaacacttgaagtaaaattgggaaggaccagtgtaagcaccagaatggaaacaatacttaccagataagtagtggctgaggttctcgcaaaaaactgctcatggtatttaacgcccccaacaagaatacatatccccagaattccgttaagaataagcattacggcagcaaaaactgtatctctggccagcgtgattgcctgatctccgccggcaaccatcagcgagatgatcaacgctacttcaataatggtgatacaaagagcaaggataatagtcccaaaaggctcccctactttatgggctacaacttcagcatgatgtactgctgataaaacacttccgattaacaaaataccggcaataatatcataaaaaactcccgttcccatcaatccggaaaagtagtaccctaccgcaaggagaggaaaaatataagtgtaatgtaagaattctttaagtctcataaagtgactacaaaatacaaaaaatctataatattttcaatatcaaaagaaattattaatgttattttaatgaggccagaagttaaagtcctgataatctgttaacatatgaaacaaaagaccaattcctataattctgatattgcctctgaaaaacaacatcaaaaaatacaccgcaatggcataataggaatgtaaaaaatggaaaccaatactttcccttgacgggtcaaaaacaggattggcaaaaagatggtccagatctaccagcattgtagccaataaaatgagatacacttttttccagtgtttaggataaaaaatcaatgctataaataccggaaatacaaaatgtaaaaaataatgtatacacgttttaagcagagcaatttcagatggagccattaatgctatattttcagtttagattaccaccgtaaaattaggggtaaatctcctttctttgcttttatttttacccaataattctgtgctttatttccatacaggatataatcaatatctgaaatgatctttttctcactgtcagtcaatgattttaaagatgaatacagcaaggcattattcctgatcagtaaataattttcgtttaactgaggtgataactttactggtttcctggtcgattgtatgacaattttattattatttgagctgatcttattgggctggaaaggaatagccgtgaattggttttctctattgatccatttcttagattgaaaatactcccacatttttacggaattatcactttcaatattaataacataattaggctgcgtaatcttctgaaaggtctttttttccacttcattaaagttgtcatcatattcataactgataatggtatcgttgacctgctccagatcagcgatagctttcagggaatttgcctgtaaggaatccgcaatgccttttttgaaaaaacgggtaaaatttctgatgttttctttgtcaagttccagttcaagaaaatgattttctttctgaagttttgaaaatattgcatcaaatatttcagtatctggattatttctgatctcaatttcatcatcatccagttcaatagaaaaattttgaattttctgcccggaaatgaaggaaatacttcccaatgtattgtgaataaactgatctgcatcccaaatatgatttgcagaaggttgaagaacctgtttctgaatggttttaaaagcagaatcagaagttcctgcaatacaaatgttattttctatcctaaagaaaatctggcccttctgaaagcagttatttcctttatcagtaaacttttgcttctttaaactggcaatgaatttctgtgaatctttaagttctaaaatggtataccattcggagaatctggtatctttaatgtggaaaatctgtaaaaaatcaggaattctgattcctgagtctatggcctggccggaactttttctttttgctttacttccggaccatactgagggatgtgtaagccagctgaagagatattgtcccgttaatttcttagtgtcaattaaaacaactgcatctgcattctgaggaatatatcttagtcttttatccttatgaaaaactataaaatatactgcaacagccagcaataaaagtaacgggacaataatcttctttttcttcatctataaaatttgtggcttcttttctgtttcttttgttttaaaaacctgatcgaatatatcaaagaaatacattaaactgttttctgaagaatctttgatattataatccatttcggtctggatgctttctccttttacttctgttttataatacaactctcctacattttttctgacagcatccaatgctcttctttctttcgcgctcttgaattctttatctaatcccgtcaaaagcttcctgatatccagtcttcctgacaaaggatatttcgccgagtcttttgcccattttctggaaatatcagactggtttacagataaaatattgtcggcagaactcatcaggtatactacaccatcttttaccgtaaaaaacagctggtcgatatatcctccgtctttttcttctttgaaagtgtacagatttccttttttagagaatcttttggaaaatttcttgttggtcgccagcacatcaaaaatacggttccagtatccttcattttccgttgcaaaggcgaaagtgaagttaggaacagcgatctctttggttttctttacttctttttcattgaagtcagcatcatattcgtaatctgtatattctactgttttggatttcagttcattcaaaacgaatattccgtttccgggagctattttcgtaatggcttcttcatccagaacaatcttcatggtttccatgatcagctccatttcttttttgtattcattttctccggaactctgaagaaggctgtacatcatatcaaagcattttgccccattgacgttcatggcatagtaaccaacacttttttcattgatcagctccagcagctttttgtttttcttacctttataaacagcctctatattcttttgaatatcagcatttttatgttgataattattaaccagccttactttatctttgtcgaaatacagattgtaagaatagttggaatcatacatattcctgaaaaacttatcatagctatagaactttgtcatcttgccatagatgccttcattcacaattcttccgtagtccgtgtacacaaaaacatcagaattggagtcccggaatttcagcatttctttaggaacttcaatttctaaattggaactgaagtatagatcaaacctttcttcagcattctttttaacgaccatgaagttttctctacggatagaatcctgctctttttgataggctttttcttcttcctcgttataagcggtatcaggcatttcttctccattttcaggactttcagtgttttccttttcttcaggatatttatgatgcttttgcagatatttgatatccttctgaattcttgcgatttcgttgttgttatctttaatgctttctttcagatacttaatatcctctttcaggtttttgatttcctccttataatcaaatggtttttccggttcatccgtataagctgtatccccggcatctacagcaacgctgtctgcaacggccaccgaagtactgtctgcaacggcttctgtagcccagatatctttatatggtctggtataactgatcatgctgagaaccgcacggcttccgttccatgccacaaaaacatcatcattgatatcaacgtaagaatagttttttctgctggagacttcctgtccttttttcttcactgaattaatgaattcccggaacttttctttattatcaatgataaagtgggtattataggtcttaatagaatcattaaaacttgcataatggtactgaacagcgtcatatttgattcctgttttggagtagtccgtccatgaaaggttttctttgctttttttgctgagctcatgcagcaaaggattcagtttattccagttgattttattattcagctgctttccgttgacctccatataaaatacggcatcagacggtattttcatgctgttctgggctaaacacaacgtaaagccaaaaagtacgaaaataattttttgtatttttaataagatagatttcatgactatagtttagaaatttattgaaaaagaattgtgttttggatttgttttttctgaaggatcagatccaggatatcagcatccagtttgacagcttttttattcggtgaaagtatataattattattgctttgggatttcaccggagtttcaaattggatgatggaagtatatttcgcatcattaaaaacttctttgtctgccttactcagtttgtcgtaatcggctttgaaagtattcactttatttctggtgaatgtctttttttcaagattctgaccataaacttgtgtagggaccattttacctaaaattttctgagctttaagtttttccagaccggcattgatgttttcaatttttttgaaattacagcttagtctgatgatataattatcaaaatccatggatgttttcacattgctgattccgggagttgctttaaaaatttttgcggcttcattgatcttgttttcaatttccgcctttttgggaaccttttttccgttgatggtttccattttggagattgatgcgagtcttgttttgcttttgctggcgttaagaattatggtatattctcccgtaccgtctgcttttaagtttactttatcaagaatatcgaaacagcttgtcagaaataataaaggtacaaatagaagaaataatctgagaaaatttttcatgattgggtttaaaagcacaaaattactcaattccggccttacatccttacaatctttgattttttgggcataaaatagctgtttcccggtactttttcaggggaaatacggtattgcttccgtatattatttttaaacacgtcctttgagatagtccagacgaagatcttcgtccagtttttcaatagcataccgaaggcaggtcctcggcatttctttgtaatatgaattcagatagctgatcagttctccttcattcttatttcccatttctctaagcagccatccgtttgccttatgcatcaggtcatgaggatgcttcatatttctggttacgaattcttttgtaaggtcaaatgaacctttttttatataatgcatcgtccccactacagcgattctcttatgccacatttcttcagattctgaaagttccctaaggaggttttctttctgattttcaaaagcatacctgcctaaaattttgtaacaggtagaatctaccagatcccagttattgacataagtaagatgatcaagataaaaagcgaccacttcttcttttacagctttatcttttgttttttcaaattttgaaatcagcataaaaagagctgttaatctatgctcatggtattctgaagaaagtaagatgctgagttcctgcaggcttattttatgataatattcctttgccactgagcgctggtccggaacttttacgcccaaaaacaaatccccttcgccatattctccttttccggttttaaaaaatctcggaaagaatgctgccttttcagggatggaaagaacagctaatgcttcctgtatatcttttacaatactcatattccgaatagctgttatgtttaagctttctcttctacagcaatattctcctgctctttttcctctttggcaatcttattaggattggccactttagcaatggtaagcccctgaacaatgattgagaagaccacgacacagtaggtaatacttaagataatctggctgtattcacttttaggaatagacatcgccaatgcaatagacactcctccacggattcctccccaaaccagtacttttacggcctgcggactgaaacttctcctcagagaagtaaattttgaaggtccccagatagaaataaatcttgccaataaaacgaccacaatagcaaccagaccaggaatcatgaaatgtctgaggtctttaatcatcagaagctcaaaaccgatgaacaggaataatacggcattcaggatttcatctatcagttcccagaatttgatcaggtagtcctgagtaatggatttcattttaaatctcacattaaaattccccataaataatccggcggcaaccatcgtcagtggcccggagatatgcatttgtcttgcaataagatagcctcccatcacaacggaaagtgttaccagtacggaaataatataatcatccacttcacgcatcagcctggaagtcacccatccaagcaatcctcccagtaaaatccctcctccggcttctctcagcagcagcaaaccaatgttttcaactccaagatccacttcatttccaatggcaagctgcaggacaacagtgaaaaccactacggccataccatcattgaaaagggattctccggcaacctttgtctccaatgatttggaaacatttgcctgtttcaggacactcagaaccgcaacgggatctgtaggcgagatcagcgctccaaaaacgagacagtagatgaaaggaagattaatccctacataaggtaataaataaaacatcccgaagcctactacaaaagtggaaataacaacacctaccgtagaaaatatcaataccggccggaactgctctttcagatcgttaatgttaatatggattcctcctgcaaaaagaagaaaattaagcatagctcccattaaaacctctgtaaaatcgatgctgttcatcaggttgtgaaggtgtccgaaagttctcggaagtactgtttccccgaacattaccagaaaaatggaaaccacgatagcgatcaccataattccgatagtactcggaagttttaaaaacctgtagttaagataggcaaatattgatgctaatacgattaatgctgaaaatgaataatataattccactaagtgtttttttattttgagattaattggttagttccaaataaagtattttaatataaatctgcttcccatctttttcccagatgtcaaacataccatctttggccggctttgagcttcttttataatcctgtcctacattcaggatgttgagcaggatatattcgtcccctacagaattgacaatataagctgtcttttcagatttcccgtctcctgaaccttttatgccttcagtaagtgcacggaactgattcaggtgatggataaagttatttccatcctttaaagaatcatatgctctgagtaggataagcaaaatgtccaggttggtaggatctttgtcatacaatgcttttccctgcttgatgcagtctgcaaagttattctgcttaaaagcatccacaagatttttaaagctgtcctctgatgtgcttatcttatcatttctgaagtttcttccgtagtacagatactgtgattctatactgtctaaagacttcggatatcctttaaatttaaaaattagtttctcgtaattgtatggagaatcaggatttttgagacttttctcaatagcttttaaatcaatttttgatttctggctgaacccaaaaaccgaaaacaggagaaataaaaggaaaaagtgatatttcattaattgttgctttcttcttcctcatcatcgaaatattcgaaaaggaaatcgttgtacgggaatctggaaatatgaatcttcatgacctcatcgtagatcattttcttcatttccgggaaattttccttcgttaaggcagaaatgaaaaccgttgggtattttgattttgccatccatgtttttttccattcttccagtgaaatatttttacgggttgaaggtgtaagatcatcttcatcctttttctcatagctgaaatcatcaattttattgaaaaccataatcattggtttctgatgtgcgttgatttccatcaggatatgatttacagattcaatatgatcttcaaaactttcatgagaaatgtctaccacatgaatcagaagatctgcttcacgaacctcatccaaagtagatttaaacgattccaccagctgggtaggtaattttctgatgaatcccaccgtatctgtaagcagaaacggcagatttccgatcactacttttcttactgtggtatccagtgttgcaaataatttattttctgcaaaaacttcagattttgaaattgaattcatcaaagtagattttcctacattggtatatcctaccaaggcggcacgaactacctttccacggttgttacgctgggtagccatctgcttgtcaatcgtcttaagtttatctttcagtaaggtaattctatcacggataatacgacggtcagtctcaatttcggtctcaccgggacctctcatcccaatcccccccttctgacgctcaaggtgggtccacattcttgttaatcgtggtaaaagatattgatactgggctaattctacctgagttcttgcgtaagaagtctgtgctctctgggcaaaaatgtcaagaataaggttggtacgatcaaggattttaacttccatttctctttcaaggtttttaagctgtgaaggtgaaagttcatcatcgaaaatgactgttcctatctcgttttcttttacatattcttttatctcaatggcttttccgcttccgataaaggttttggagtcaggctgagtcagtttttgggtaaaacgtttttgtacggttgctcctgctgtgaaagctaaaaactcaagttcatctaaatactccgtcagtttttcttcgtcctgattctgggtaataacacccaccaggaccgctttctcatagttatgttctttcttttctagcattaagttctgtctatgtttatgatttttacaagttaatatttttcagaaaaaaaacaaaatcaatttttatttaataacatattttaatataaatttaagttagctgatggaagatgtataaaaattcaataactttatataataaatttctgatttttaattatttaaatcaaaaactaatctccggaatatcatgattacgcatatcagatgtatgattattgatgatgatgaactggacaggctggttcttcagcattatatcaggcaatatcagaatattgaaattgttgcctcttttgactctgcagaaaaggcgattccttatcttgacctccctattgattttctgattaccgaaaccaatttaggcggtatgaacggactagaattcagaaaactggctcacaagatccccgcgtgtattttcgtaagctcacatcctgaactggctgcgggcgcctttgaaatcaatactttagattttattaccaaaccccttacggcagaacgctttcattattctatgaagaaactttttgatttttttgaagtaaaggaaaaatgcgaatgctatgatgccatgacaggtgaaaattgtctcaagataaaagaaggcgggcatatttttcagattaaaatgaaagatatcctgtacctggaagccctgaaagattatacgaggatcattactctggaaaaaaaacactgtatcttaaattctctgggaaaccttctgcaaaaaaactgttttgattcctttgtcagaatccacagaagctatgccgtcccccgccatcttatccggggtaaaagctgtcatgaaatagaacttacccatcaaataaaactacccatcggccgaacctacaaggataatctctcttttttcaatccttaaaaatttatacaaaaatccagcgttcattcataaaaatgccattggtcgattatttctgccgttggtctattttcctgtcatatgattgagattggtggtaatttagtcttcccaaattcccctcagaaaacacattaatcaccaaaaactgttatccatggaaagaatatctatttactgtattattctgtctgtcttttccatccccatactgcacgctcaatctgcagtgctggcaaccggattggatgcatcagcagctaatggttttgtttcttacagcgtaggccagacggcttatctggaaaaaggaacagggcaagtactggaaggcgttcaacagccttacgaaatcatcacccttaccactattgaaaattcttctgaattgtctggcattttgctatatcctaatcctttcagggattatctgtatctggatttcaccacaaataattttaaaggatcagaatatcagctcttcgatggccaaggaaaactggtaaaaaaagacaagatttcacaatcaaaatctgagcttaatttctcctcacttccttccgctatgtacatcatcaggattacgcaaaatggagaaaatattaaaactttcaaaatcataaaaaaataaaacgccatgaaaaaaatattatcaatgttctggatcctgaccggtttcttcatgggactgtctcaggctccggaaaaaatgagctaccaggctgtcatgagaaatggttccggacaacttttagccaaccaagctgttgctgtgaaagtaagcattttacagggatcacctgccggagccgcagtttactctgaaagacttaccgggaacactaatgccaacgggcttatcagtcttgaaataggaacgggaactgtacttaccggaacattctctactattgactggcctgcgggaagctattatttaaaaacagaaacagatcctgccggaggaaccaattatactatatcaggaaccagccagttactgagtgttccttatgccatgtacgccaaatctgccggtggcggaggaggaagcttcacaatcccctataccaataccgttaataatgcctcaactttattttcattaaccaatgatggtgacggaacatctctggaaggcaataatagtactacgacttccaatattgcagcagtaagaggagtcgttaccaatacagcacctgggggtttttcttcagctgttcgtggaatcaataacggtaccggaggattaggcataggagtatatggaagccaggccggaagcggctggggtgtatacggtgttactccaaatggtttaggagtatatggtaatgccagcgccaacggaaccggtgtttatgccaacagtaatacaggaaccggtcttactgctaccagtaataacggaattcctgcaagcatttcaattttcaacaatgcaaataataatgttgccctcagtgcatccagtgtagggaatggtacggttataaatgttaccacttcaggaaacggagccggagtaagaagctctacaggagcaggatttggacttcacggaataacttctgcacagacttctgccggtgtcgtgggtgataacaacggaggaggtgaagcaatagtgggtagaactaccagtgacattgccggagccgttgtgggaagaaatgacggaggcggatatggtgtgagaggttttgttgccaccagcacatccggaaccggtatcggtgtttacggacaggtaggaataaacaacagtaccggacgtgccggaagatttgaaaatttcaacaatacaaatattgatgccaatacttttgaagtgacatctaacggaaatggaaacatccctgataataccaaaggtaatgcttcttcttttatactcaataataccaatagtgtgggagcagctgtaagaggggaagtcaatactattttcgggaattttggggcggccgctatttttggcgtttcttcaggtaccggaggacgtgcaggtttattttatgcatcaaaccctgctggaaacggagcttcattaattgcgcttacagacggaaacggaaatgcgatcacggccaatgctggtaaagacggaaatggagtcgagaccaatattgatggagccggaaatgccctttatgcctgggttccttctttttctacaggacgtgccggaagatttgaaattttcaacgacgctaatacaagcgatgtcataacagtgaagacagtgggaaacggtatagcagggaactttaaggtagataaagtgaccggaacttcggctgcggtaagaggtgaagtcaattcacagtttgccaatttcggtacagcagggatttatggagtatcttccggaaccggaggatatgcagggttattccacgcttccaatcctgccggaaatggccctgcactgattgccattgcagaaggaaacggtaatggcatcactgccaatgcggcaaattccggagacggtgtggaagctacagtagacggcacaggaaacgcaatttatggttgggttcccaatttcggtaccggaaaggcaggtagattttccaatttcaataccggtaacacccagcctgtattgtatgtaaccaattcaggcactggatctgccctgtctgttaatcatactggctcttcaggagatcttgctattttacagaacgccggagtcaatgttgccagaatcaataaaacaggaaaaggattttttaacggaggcacacaaaacagtggtgccgacgttgctgaagcatttgatgtaaacggaaacatttctcagtatgaacctggagatattcttgtaatctcaaccagcgcagacagaaccgttgaaaagtcttcaactccctattcaaatcttgttgccggagtgtatgccacaaaacccggtgtacttcttacagaagaaaatatagaaactgatatttccaataaagctcccatgggtgtcattggtgtaattcctaccaaagtatgtcttgaaaacggaaagataaaaagaggtgacttattggtaacttcatctatgccaggtgttgcaatgaaagccagtattaaaaaggtaaaaatagggcaagtcatcggaaaagcgcttcaggattatgaccagaaagagatcggaaaaattcaagtattagtcaacataaaataaaccgtcatgaaaatagcatatattatcccgttattatttttaagcaccattatctatgctcaggaaaataaaaaggtcgctcctaaagaagaagatcagacactggttgtaaagcaggcacaggaacagcaggctaaactcatgcaggaagctaaagaaaataatgaaaaaactactgtaaataccggactgccttctgatcatgggctagctgttaaaaaacaggattccaaacccaaagcttcttccggtaattcgggaaatcttcttcccaatacggcaagtcttgaagacatcaaaaaaacaattcccaacagacaggcatatcacaatataaattctaggaacacaaaagcgactgttaccgggctgcccaacacagcaactctggaagaaataaagaaaactatccctaaaaactaataactctcaaagctaataaccgcaaaaaagctgataaccaaactagatttttcaaacaaagaagtccgccaaagagcggactttttatattaatgcccggctattaatcccaatcagtagctacaaatttcattgtatgaccgtgatcatcggacagagtaaggaaatgtccttcgactgaatatctggtcatggtttcaatttttttctgaaaagatgtttcaagatccatatcctgacaggctttcatcgtactgactccttttgaaatctttacctttcctccttttttaaattcagatataaaagacatttgattacatcccatataagcactcccctgaattttaccatcaacaatagcagccgtaagattcatttctgctttttgggcaataagctgatcttttgaaaaaccatctaaagaaattaacatccactgcctttggagagatgggtttttatccggtattgcagagcaattcaaaacaactcctaaaattaaaactgcaaaaagtggtaatagtatctttttcatgcggactatcatcccattttcgtaccattccgggacagaatctcgtaaaaattagtaaattagcgacacaaaaattattttataaaatgaaaagactatttctactattcactttcttactgggctttgctcagatgagggcggatgaggggatgtggctgctaatgctcatcaaaagacttaacggtgttgatatgcaaaaagagggtctgcatcttacgcctgaagaaatttattcagtgaacaattcaagcttaaaagatgcgatcgtaagtttcggtggtttctgtacaggagagattgtttctgataaaggacttatattcaccaaccaccactgtggctacggtgctgttgctgcggcttctacaccggaaaaagattatctgaagaacggtttctgggcaatgaaacagaaagacgaattcaatgcaaaggatctttatgtaagatttttagtaagaatggatgatgctaccaaaagaatcacatccaagctaaacaacaatatgaccggagcagagagaaaagctgttattgatgctgagactaaagccatccagacagaaaactctgaaaacggaaaatatactgtagtagtaaaagatttcttcaacggaaatgaattctactatttcgtgtaccaggattataaagatatcagattggtaggtgctccaccttcatcattaggaaaattcggaggagatacagacaactgggaatggccaagacatactgcggactttacggttttcagagtgtacgctgatgctgcaggaaaccctgctgaatattctccaagcaatactccactgaagcctaagcatttccttccggtttctcttaaaggaattaagcctggtgatttctcaatgatcttaggatatcctggaagaacaaaccgttaccttacttcttatggaattcagcaaatggttactaaagattatccggcttgggttgaagcttctaaattggctatggatgtcatgaaaaagtacatggataaggataaggcaactcaacttaactatgcttctcaatatgcttcagtagctaactattggaaaaacagacagggaactattgacgctgtagagaaaaacggaactatttctgacaagcaaaaaattgaggaaacgtacaacagatgggctgcaatgccaggaaatgatgagtataacggagttttagaagatatcgctatctactacaaacaagtatctgacagaaatgttgaaagaaactatatctctcagttttcaagaaatgccaaatatattacccttgctgctcaggtaggatctgttcttaaagcgtatgctgctcaggatatgcagggaagattagcaatgaaagctaaaactgaagcggcaataaaagcggcttatgaaaacttcaatccagctttggaaggagaaatgcttgctgctatgaccagcctttaccaggcaagagttaaaaacccggacgttgcttctgctactattttaggattggatgccaagactgtttctaatttggcatattcttcaatcttcgctaataaaacttctgctacaaacttcttattgaatccggatgcattgaagcttgatgctgatccgctttggaaggcagctaacggaattgttgctgatcaaaagataagtacagaaagatttgttaaaatagatgacaactttgcaaaaaacaaccgtctgttcttagctggtttaatgaaagctatgcctgagaaaaagttctatccggatgccaactctacaatgagattaacttacggtacagtagataagttacctatcagaaatgacagaaactatttcggtattactgataactactatacagatatgactggtcttgttggaaaatacaagaaaggtgatgaagagtttgatcttcctcaaagagtgatcgatctttacaaccttaaagatttcggacagtatgctgatgctgcagggtatatgcctgtaaacttcctttctaacaacgatattacaggtggaaactccggttccccggtaattgatggtgacggaaaccttatcggtatcgctttcgacggaaacagtgaagcattaagcggtgatatcgttttcgaacctgaatggcagaaaacaatcaacgtagacgttcgtttcgttctttggacaattgataagtttgcaggagcaagaagattaattgatgagttgaaacttgtaagaggagaaaacactcctgctgatacaaaaactaaaaactcagggacaacaacaatgcctaagaaaactaaaaaataatcttatctgatatatttttaaaaaccgtgaaattactttcacggtttttttatttttgactattaaaatatttcatcatgaatcctaaacctattgaattcacagctattattcagcaaaacggagaaatgaatgctgcgtttgtagaatttccgttttctacagaagagctttttaataaaaaaggacaggtaaaaattaaagccctgtttgatgataaagttgaataccgtggaagcctggccaaaatgaaatccgattgccatattttaggtctgacgcaggaagtcagaaaacagcttggtaaaacgttcggagatgaggtttctgttgctcttatggaagataaagaagaaagagtggttgaaattgcagatgatattgcctctgtttttaatgaaaaccctgaagcaaaggctttatttgataagatgagctacacccacaaaaaagaatatatccgctggatagaagaagccaggaagcctgaaaccagggaaaaccggaaggtaaaaatggttcagatgattctggatgggaaaaaggggatataaaccattctgcttccactcccgaaagctgtacactaaaaaaattgaataaataaaatattttttgtcaggttctcaaaaagtagccgactatagttacaaatatcatttataactataaaaaattacttttatgaacaagtttattttcagaacatcggttttagcggcagctactctagctgcatttactctttcttcgtgcagtgattcggataatgacacgatgacagaaatgccttttcaaaaaactatcacttttgaaaatgtggtaactcctaaagattttgtagaaagcggaagttttcagggaacaggaacccctcctattattctgcccggacagtctgtttctgttacattcagtgcaggaaaaacacaggctttaatgtttgccaccatgtacggggcttcaaaagactggttttttgcttcccagcagccaggtatcaaactgtttgatgccaacggaaatgctatcaccggagatgtttcttcaagtgtgcgattatgggataacggaacgaaagatgatacaacaggacaggcagaaagcaagcctattatgcaggttcctaacgtaaatgcttcacagcttatgaagcttaatcttgcttacaatgacgtaacctcagaatttacgctcaccattaccaatacatctggcggaacggctaatgaaactcctttttctcccggagtatgggcagtttccaactacaatggctcccagttgcttaacaacgctcctttttttactcctaatgctttatcaaatccggaaatcacagatattgcccagatggggaatatcagtaaaatgatggcgaaactgaatgccaacacaggaattatgaccggcctctctcctgctttggtagttgtttaccgtggtgacaaaaaccctatttatgaattaggtcaaacggacagcggaatgggattgaaagatattgcacagtttggaaatgtaagcaagcttcaaaacagccttaaatctctctctgccgtaagaggtgtatatgttgccgggaacgctcctgtagcaccgggaagcaaagcaacaacaagctttaatgctgaaccaggggacaaaatagcttatgtaaccatgttcgggttttccaatgactggttttatgccaatgaacagagcattgatgccaacaccaagggagacatcagttcaaaaacttcattattcgattccggaacaggtattgaccaatatccgggagccggaaatcatcaggcattattcggcggcactccgcatagtgaaaataagattatttcaaaagtaggaacccactatcctgttcccgctgttcagaatgtgattaaagtaaccgtcaattaactttcaggcttaaaagatcatacaattaaaaattccaggcagctctgcctggaattttaatatcagtaatgttattcaaccggaattcccaggtattttaaataggaatccagtattttcttatcaaataccggctcctgaattccggaaccttccagaaattgaatcacattggaacaatcccatatataggtattctgataaagctctactgttgataagccttcatgcatattgtccctgaaaaggcttgttagtgggtacaaacggtttttactgtcatcctcccattgttttcgccattctttgtaaggaagacctttcagtgtaaagggataatactgtttcatcaaaccgaaaaaattttccagcgtaagatttgtttccgggcgggcaattaggttgaattttttgcctatcgcttctttattctttgtgatgtgagccattgctttggtcatataatctactgtgatgagtccttctctaagctctgttaaagcaggataagatttgaattctatacaatttttcactaatcctgaccaccattgataggacgcacttgctcctgtttcactgtggcacattgcatatcccaaacgataggtgattaacggaagcccttctttagccgctaaatcagctacggcttccattacccatttgcttcgtacatatcctatatctttacttacagacatcaggttctgctcaatatcatcagattcgagcattactgtttttcctgtaaatatatgtccccagctatatactgagattgtggataacaaagcaagacatgacgttctttctgctcctgccagctttatgatttctcttaatccttctacattcggggctttcatataggaataaggttcaatgaagtttactgaactaccggaatggtagatcaaatcaacctgttttgccagcctgctgaatatttcttctgataatcctaaagatggtaatgtcagatctcctatcacaggaataattctgggtctctgttcttctttatgaggaatgttgtattgtttaaaacatcttccaatcttttccattgcggaaaattcatcctgggctctcacaagacagtaaatatctgcttctgtagtatccagaagctcctgcaaaagatggattcctacaaatcctgtaactccggttaaaaatattgttccggggttttctatctgccccggatcaaatcctcccgcaaagacagttccgggagccagataaacatcgttctgtaattcaacataaggctctacatcttctgccggaacggtgtctctcatttctctggatctggctataagaacttctgacagctgctgtaataccggatactgatagatatcccgcagataaacctttacatcaagtttcctttgtaaagtaacagcaacggctgctaccaacagggagttccctccgatgtcaaaaaagttatctgtaatattgataacagggcgttccaatgcagaagaccagacatctacaataatcctttcagtttcattggttggcggttcagatgaaattacgtcttttgcttcctgatcagccagttcctttaatgcattggtatctgtttttccattggctgttaacggaatggcatctataaaaataatctgggcaggaatcatataacctggaagctcttccttcaatgcattgcggactgaagaaatatctgttgttgcttctggttttaatacaacaaaagcaatcaggtatttggtgcttccttctgtttcctttccaatgaccacagcttccttgatctctttctggcggatcagtgaacgttctatttctcccaattcaatcctgaatccgcgaattttcacctgattatcaatccttcccagaaattcaatctcaccatccggtttccatctggccagatctcctgtacgataaagcttttctgtttccctgaacgggttggtaataaacttggaatgagtaagctcttcattattaaggtagccttctgctaaaagggttccgccaatacataattctccgacagctcctaccggcagcaattccatattttctcccagaatatatgcttttgcattggcaatgggcctgccaatagaggaaacatatttcccgttgatatccttcacttttttgaaggtagcatatacggtacattctgtaggaccgtaataatctattagttcatagctcaattccgtagtaagcaccggcttcagcttttctcctgctgtaaagagatattttaatttgaggtcattataattccgggtaaaatctactacagaaggagcaagaaccgtaggtacaaaaccatgggtaatatgattttttctataataatctaccaatgcctgagcctctgttctatcctcattgtctgcaataaaaacagttgctcctgaagtaagcgccgaccagacttcccatactgagatatcaaatgccaatcctgcaacaagagttagccttgaactgtgatccacatgaaaatgatggttatgccatgttaccagatgctgtatagcctggtgacttatcattactcctttaggatttccggttgatcctgatgtataaattgtataggcaaggtctttctgttgaattttaatctcaggataatgtgaaggtaaatgatcgaggttttccatgctggtcagatcaaatactttttcttttccggattcagataagagatctttaaagctttgattggtaataataagatctgaagaagtgtcggaaagaatatattctactcttttcgccgggtaagatggatcaataggaacatacgcagcacccgttttaataacaccaagaactgcaacaatccattctaaagaacggtcgagccagacaggaacatattgtccttctttaacacccttttttaataagaagttagctacctggttacttttctggtccagatctctgtaggtaattttctgctcctgatatacagcagctgttttttctgcatgaaggattgcctgtttccggaaaagggattccaatgtttcttcatgatgataatcccagccggttttattgaatccgtttaaaagtttttctctgtcttctgatgacagtaatacagccgaacctattgattgggcttctgatgagggaattgtgtttgacatggtaataaattttgattggcttaaaaattaataatcaatagctttcatcctctgtaaagtaattttaaatgaaaatgaaataaggacacaaccgggtataaggtataaccacagtttatgtactaaatgtgttttcattatagctgtaataaatgatacagagtcttaagcgatctactcagtgagcagaacgtaaacagcgttcaaacgttatttatgacattcggaaaaaagaaagaatatattgtggatattcttcggcaattcaatgcaaatttctattcggtatttaaaaatttgattttcataatgtaatatttttgataatatggcaatcaaacttaacataataatttaatctatgcgttacataattattatcatataccacattccggaattgatattctaaaagaaacaaaatcaaacatctgaatttcaacaaattaaatatttgcaaaataaaattattccttacttcctctctagtgagttcaataatctctacatttgtgaaaagcaaaacacaattcattttaatatggatcaaaaactgaagaacgaccatggattcatacatattccatgcaatgaactggatatttttatactttctgacggatattttggtattggataccatcagcctatcttagcacccgacatccctcaacatcttgtaaaaaccgaactgcggaatctttatttatcggaatcttattatgaggctcctattaatgtaatgctcatcaaaaaagaagaccggactatcttagtagatacaggagaaggattttatgatgatgaaaatgcaggaaagttattatacagccttaatgctgcagggttcacaccggaagctgtcactgatattctgattacgcatgctcacagagaccatatcggaggaatcctttctaaaaatggggattttgtatttccgaatgcccgttattatatttccagtcaggaatttgatttctggacaagtgatgagccagattttcagaaaagcaaaaacccggaaggcggaaagctgagcattcctttggttagaaaaatcctttcggcgatagacagccggcttacgaaatttgaaatgggagatcagttgttctcatgtattcagacagaagcagctccaggacatacccctggccatattatatatacagtgagtaatggaggactgtcaattaccaacgtggtagatctctttcactctccccttcttattgcaaaacctgactggggtacacaatgggatattgactttgaaacaggagttgaaacccgaaaaaaagtactggaagcctgttatgaaaacagaacacttatctgttccgcccatcttccgtggccgggaataggatacataaataaggtaaataaccggtttcaatgggttcctaaagtatataacaaccctttttccatcaatttagaaaaaaatccggaaccgggtacaatataaaattttctcaaaacaagaagtccggaccggttatccattccagaattcacggtccaggcttctgtattgtatggcttcggaaatatgatgagacaaaatattctcggattcttcaaggtcggcaattgttctggcgactttcagaattctgtcatacgctcttgccgaaagatttagtttttccattgctaatttgataaggccgaatgaggtttcatccagctcacagaatgcttcaatttcctttggtcctatctgggcattactgctgatactaagattctgataccgcttattctgaatctcccgggctttcagtacgcgttctctgatgtctttgcttttctccccttttcttttttcggaaagctgttcaaattctactttctgaacttcaatatgaatatcaattctatccagaagtggtccggaaagcttattcatgtaacgctgcatttcataaaccgatgaggtattattaggatcatcaggaaagaaaccacttgggctgggattcatagaagctaccagcataaaacttgcaggatagtttacggtaaaacgtgctcttgaaatggttacctcacggtcttccagaggctgtctcattacttccagcactgttcttttaaattcgggcatttcgtccagaaataagactccgttatgggcaagggaaatctccccgggctgcggataacttccgcctcccaccagagcaacatcagaaatggtatgatggggtgatctgaaagggcgtacagtcatcagtgaagcttctgttcctattttccctgccacagaatggatttttgttgtttccagagcctctttcaatgtcaaaggaggtaaaatactgggaactcttttggcgagcattgtttttccgcttccaggtggacctatcaggatgatgttgtggccacctgctgcagcaacctccatcgctcttttagctgtttcctgtcctttaacttcagagaaatcgaaaggaaaattattaatcttttcgtgaaattcttttctggtatccaaagtcattttttcaagaggttttccttcattaaaaaaatcaatcacctctctgatattttctaccccatatacttcgagatcattaacaatagcagcttctcttgcattttgtttgggaagaataatccccttaaatccttcttccctggactgaattgcaataggaagtacaccttttatcggctgcaggcttccgtccagagaaagctcacccataatgatatagtcattaacttcttctgccagtatctgatctgaagcggttaaaatcccaatggcaatactaaggtcataagcagaaccttcttttctgagatctgcaggagccatattaatcgtgattttctttccgggaatcttatatcctacgtttttcagtgcggccgatattctgtagctgctttctttgatggcgttatcgggaagtcctaccagatggtatcccactccgccggtatccacatttacttcaatggtaatggtctgtgcagccactccatgaatggcacttccgtaaattttgatcagcatggtgtgtttttgaggtaaaaataatcaatatagtattttaaaattctgggatttacgttaatagcattctaatcaggcggatatatttaaaaagaaattcagaaatttcggaataaaaaaaccggtacaaatttctttgtaccgacccaaccattattaaaaactaacgaatagattatttcatctgagttacagaaaaattaaatgtaagtcaggaagccggatgccggaaagagagaactccttttggggtaattatgacgtcattagattaacaaggatgaaaattttatctattgagcgtaaagtattaaaataaattactctagttcttcttcaatacaaggaaaatctctcctctgacatccattcttcctgccacaatcaatattttagcatcatcagattacgtaatcctatttttttataaatctatttttgtattcaattcccgctgcacttttagaaacaataatataatttcccggtaccagctgacttacatcaatgggctgattgtagctgtgatctgtttttttcagaaccagctttccggacatatctataatgctaacttctttataaatcttgtctgattcttttcctatataaagatgctgtgctgtaggattaggatagattttcagattattatctttaatttttgtctctcccgttcccagattgctgcagaattcccagttcccgaaatttacctcaacaaaggcaaacggatctaacatctggcattggtccggacagtattcagtacaggcatagaatccatattttccggaagttgtcgctacataagtatctcctactacacctggaatgatacaaggatctcctgccaccggaggattactgcttgggacacatttgaaccacgtatgtttgccataaaccacagggaatatatcgtcaaactgtacagaagctccgttgcagacatttactgttcccatattttcttcataggttcccggagtataagtagtcatcattgccggaagcccgtaaacaaagccatctgcaaatactgtcgggctttctgctgtacagtctccatcggtaacaaccactttaaaataattcagctgctcgttgccgctgatggtcagctgctgtgaagtagctcccggaatagcaacccatggattgttattaggggtctgccaggtccactcctgcttataccactggtaagttgtataagtctgtgtggtagaaagtacttcatcttctgtatcacagaacagaacggttccgggatatttctgaccaagtctgggactggtaactgtaggggtacactgtgcttttagattcaaaatgctgaataataaaaacactaaaaagattagttttgttttcatatataaataattaagcttggtttttgtattaaatctccggcattaatccaacagcactcgtacaccgaacttcatattaaaatgaagtggtttttctttataaattgtattgggagcatcttcttttttaaaatgatatcctattcccggttctgcataaattccgactttatcaataatcttcagctgaagacctgctgctgcgttgacagagaattgtaaaggtttgggctccagcttttcatttgaggattcctttatttcatcattcacaacataggttgttgtgatacttcctgccacaggcttttccacaagtgctcctcctgtaacatatcctgtaaatttgcccttctgaatgacattgtaattgacctgcacaggaattcctatataatgaacggtctgatctcccttaataaaattgttatcacttccggaatgcagctcagaagacagtttggtataatttactcccgttcctattccccatcttttccccagattatagtaaacagaaagcccgaaagtaacaggaaccttatgcctgattctcgcttctaccggctggctttgattcgccagcaatatggcggtcagaggatcatcatgaaactctgaagtagtccatacctgctcaacattcatggctttcccggtaattgaagcatacccgggaaattgctgttctgcggagttggaggccatatttcctgtcagcattcccagcatccaggattttttatttccggatttcctggcagaatgttttgtattttctgcgtatacctccttcaatttttcctgtttaaaaagaaccttatctgattctttttcttccaccgtttctttcacagtatcatcaacaggtgaaattttctgagcaattttactttcctgctgaaaagcctctgaagcagtaggaatctttatgatatcctgattttttccagcgttattttttattccgttatcagaatttctttgagttaagattttctttggagtttctgtattgaatgtattttcagctaagaaggcatttgttcctgattttacctcactgcttacaatatgttcagtttttccggaatttaaagcgctcttttccttttcttttttcacatctgccggtttctgagacagaagtttttccttatcattatgaggcagtatttttgtcagtaaaaacaacaatgcaatggcagcagcaatacctccgatacgatagaataaggatttttttcccgcaccttcaattctttctttcttttccgcaccaccttcatgaatttcaggaataaacccgggaatgctgttgttttcttctcccgagaataattcatctctgatgtcatcccacaacccttccgggacgtcctcttcatagtcatccattctgcttcgcaggttatttagccattcattattcatattgtgctttttttgacattttaaattcttttattttctgaacaagcaatcctttggcgcggtgaaactgagatgcagaagagttttctgcaattcccagcagcccggcaatttctttatggctttttttctcaaatacaaacaggttaaaaacagttctgtatccttcaggaagagatctgatcatcttcattatatcatctcgtggaatttcttcaaaatctggttcttcttcattgggaatatccggaagatcatctacttcaaccgctgatctgaaatctcctttctgttttatatgtttcaaagattcattaactgtgatacgcgtcatccaggcttttaaagaaccgctacctctatactcaaaggattctatcgaacggaacattttgataaaactgttttgaagcacatcatgaacatcttccttttctgtcacatagcgggaacatacatagctcagatttccggaataagctccaaaaagctctttccaggctgcttcctccttcttcagaaggtgctttaccaaaatctgttctttactttcttccatatatgcttctgctgccgtacccgtcaggatattataaactgtcaagcaaaaatagattgcatcttattaaagcgcaatccatttatgatattatctattcattaattttttatacagaacgggaaattataatcgatcacttcataaggagtaaccactgtcccatctactgtaattttttctgctgtaagagcatatctaagtgttctatccatacctacataatatcctttctgcttagaaacgaattccacaacggtctttttattaacgccatctaccggaatctgaagttccattgtcttaggagtcaaagtcaattctatcacattatttgctgtattgatcactgctgcatatttaagatcatactttacttttccaagagcttttatagctgtttctgcttttgcagggtctttcactactgttttcacaatttcggtaaccggaaattctgcaaatgagatggtatctttttttactttgaattcttttattccttctcttttactatttccctggatgataatcagcttacctttatagtttcctggtaattcttccatttttacaggtggaatatcctgttcatcactatcattacatgagtataaggccaatcctgccaaaaccattaaaactgtcataaaaaaccggggtactgtcaattttttcattgcattacattttcgttaaacattaattattttcgagtactcatctatataaatcctgttttatgaaaatcttgcatatttttttagaaaaaagaacaaaaaaatttataacgaattgattttgtgcgggtaaaatttcatcacttcattgcaaattccgtacctgttgtaaaaattgagtggtattgatgcgtccaaaacagcaaaaaggaaactacatcatatagtttcctttattatttttaaggtatgttctactgtactccaccgccaagtgctctgtaaagatcaacctcagcatttaatttttccagtgtaacattaatagcttccagatcattctgcagtttgttattctgggctgtgatcacttccagataggttgccataccgcttttatacagcttcagtgcatcattgattcctttatccagaatggctgttcgctgttctaaaagctgcaacctttctgaagaacctttagactttgccattgcatcggaaacctctcccacagcagtcatcactgattgtttaaaattgatagctgctttttcctgttcaattaaagctgtttcgtaagctgttttcagttcttttttctgaaaaaccggagcagcaagattagcagcaatcgctttggtaatagatcccggaatatcaaaccatgagctgaatttattggaatttactccgatctgcggactaaggctgatactcgggtacattgcggcttttgccaatcctgttttggaatttaagctgattacgttaaactctgccatcttaagatccggccttcggctgagcagttgtgccggtaatccttcagacaatctgttttcaggaatcattgctttcaggtttccttctctttctacttttgcaggatagtctccacaaagaatactcaatgcattttcctgaatggaaatattctgttttgccaaggggatcagcagttcagcagttttcttctgtgcttccgattgctgaaccgccaatgaattgatctgacctgctttaaactgaagattcatcattttaagagtattgtcactcagttcaatattctgttcagctattttcaactgttcgtccagactgatcagattataataagcctgtgctacctgaacaacgattctgctttttatcgcatttaagttctctttctgtccaaaatattctgctgctgcggattctttttgcattttagctttcccccagatatctacctcccaggaaagtctcagtgcagcagtgaaatcatccaggtattttgtcccaacaaactgttcattcagggaaccgttaagcgtatttttggacgcccagcttctgttggctccagcactgaaatccagtgttggcatgaggctcagcctggcctgtttataagcaagatccagctgttctatgtttttcagagcaacgtttacttcattgtttctggaaagggctttatctattaaaccgatcagtttaggatctttgaaaaaagttttccaaggtaataccacagtatcgcctgttacctgtagagattctttgtaggtttcaggcatctgaaggtctgttcttgtatatttctttcctacggcacaagacatcagcagtgatgccattgcacctgaaataaggaaattctttatattaaatagtctcatttgtcaattgattttctgttgtatgatgtttctttttggcagagaatttctcatccagatactgaaagaacatgtagaggacaggaattacaaaaacacctaaaaccactccgctcaacattcccatggcagcacttgtactgatagatttgttcccggaagccattcctcctgaagaaagcattagcggaaccattcctacaataaaggctaacgacgtcataataatcgggcgtaatctcgcctttgctccttccagcgcagaatccagaatagaaagacctgcttttcttctttggatggcaaactccacaataaggatggcgtttttggccaagagaccgattagcatgatcagtcctacctgtacatagatattattatccagcccgatggcttttattcccaggaatgcccctacaattcctgttgggatggaaagcataactgccagaggaaggatataactttcatattgagctgccaacaaaagatatacgaaaagtaaacacagtccgaagatcgcaatggtttgatttcctgccgacttttcttccagactcaatcctgtccattcgtagctgtaatcagacggtaatttacttagggtctgttccagcttacccatcaattctccattacttactcctggctttggagaaacattgatgtttaatgagttataaaggttataacgctgaacggattccggaccgtagacttttttcaaagtgattagtgtatttaccggaaccatatctcctttttcattcttcacgaaaatatcattgaaggcctgctcatccattctgaaaacaccgtctgctttaatattcactctatagaactttccaaatcttgagaaattctgggactggtctccggagaaatacgtctgaacagttcccaaaagatttgaaatgcttactcccagctgcttcgctttatcttcattcacttcaagctccatctgaggataatctgccctgaacatcgtgtaggcaaatgccacttccggaacctgcatcagctggccgatcagttcgtctgctttagctttaagtacctgaggatctctacccatgcggtcctgaagaacgatttcggcatcatttgtcattccgtatccttctacaggaggcattctgaaagtcattacacttccttctttaatcactcccaattttgcagcagccctatctaccacctcctgaatatcctggacttcgcctctttcttttttaggtttcagcttaacaaatcccatagcataagccggtcctgcactgttactaagcaggttgtagcctgtaatggaagtattttcctgtaccgcttccaccccttttaagatttcattaattttattggagacttctgtcgtctttgtcaatgcagttcccggaggcatacttaaggtgtacatgaagaacccgtcatcttccataggcacaaagctttttggtgtgcttgacatcagccatcctgcaactccgataacggctacgattaatcctcctgcaatccattttctccctattaaaaatcttactccttttgcataacggttggtcatattattaaaaccagcgttgaatgccacggcaaacctttgcccgaatccttttggtttcactccttctcctgcaaggttgttttttaaaaatacagcacataaagcaggggttaaagtcaaggcattaaccgctgaaatgataatggcaatggccagtgtatacgcaaactgcttatagaacagccctgctgaaccggacataaatccgatcgggataaataccgccgacattaccaacgtaatagaaataactgctcctgtgatctcgctcatcgctttatgagtggcctctcttcctgaaaggtctgtcccttccatattactgtgaacggcttctactacaacaatagcatcatccactacaataccgatcgccagtacaagggcaaaaagcgtcagtacattgatggtaaatcctaaaaccagaaggaaaaagaaagtaccaataattgctaccggaactgccactgcaggaataatcgtagatctgaaatcctgcaagaagataaatactacaataaatacaaggataaatgcttctatcaatgtagacttcacctgtcctgttgcctcatccagcctttctttggtactcattacctttgtatatttaataccaggaggaaatgattttgataaccgatccagggcttggtttacccctatttcaatctgattcgcgttggaccctgtagtctgcatgatcgctacagtaaccgcatttttcccattggacaggttatctccggtattagaaatcgctccaaattccacacgggctacatctttaagcctgatgacctggcttcccgtgtttttaacaatgatgttttcatattgttccggcctgttcttttttcctttatatcggattacatattctaaggcagcgtctgattcctccccaagtttacccggagcggattccaagctatgatctgcaatcgcactggaaacatctgccggttcaagtccgtaggaagacattttctgagggttaagccatattctcatagaataatctttaatcccgaaaaccatggcctgcccaaccccttttactcttttaacctgtggaataaggttaatatttgcatagttctgaagaaaggtttcatcatattgcttattgtcttcagtatagatattgaagatcaacaccatactgttctgctgtttggaggtagtcaatcccattctcactacctcctgtggaagaattggtgtagcctgctgtaccctgttttgaacatttacggcggcctgatcggcattcactccctgcttgaatataatggaaatagaaaacgtaccgtcattgctggccgtagacttcatatattccatgtcttccactccattgatctgctcttccagcggcgttactacagaacggatcaccgtctcactgttccctcccggataagaccctgaaacggtaatcgtaggcggagaaatatccggaaatctggtcaccgccagctggtttaatcctatgatccctaatatgacaatgataagggatattaccgtcgccagtaccggacggtctattattttttttaacatttttgaattttctgatagtggttatacaactatttcaaaggaacggtatgtgcgacaacctgtgctccgtctgtaagggcatcaattcggttgatggcaattttatctcccgcatgtactccttctttgataaagtaatcctgagacgtacttcctgaaacggtaatctgagtcatttttactttgtctttaccattcagtttatagacaaagaatctgtcctgaatatcttttaccgatgttttcggaagtttgattactccattcagagcattgtgaatcatcactctggctgttcctccggctcttaataatttatcaggattctgaaaaacagctttcatctggatacttccggtatttctgtcgaagtttccactggcattttcaagcttccctttaagagcataggtggagccatctgcaagaattagctctacattttctgtagtatttcctgatgctgaagctctgctgtgcgcaatgaaatccgcttcattcattgagaaatacacattcacagtgtttatattggaaagtgtcgtcaacggtgaggcatcagacggactgatgagatttcctactctgttcggaattcttcctatgtatccgctaacgggtgctttgatataggtaaaattagcattgatttttgaagatcccaatgatgactgtgcttgtgctacctgtgctgatgcagctttataacttgcctgcgctgttttcagctgcatatcggaaaccacttttccttctacaaggggtttcagtttttccacttcaagccttgctgtttcctgggctgccaaagctgatttcaaagcagcttcattggtatttacctgttcgttgtagactgatgggtttattctgaaaagggtctgtcctttactgacgtactgtccttcttttacatatactgcctccagatatcctgttacctgtgctttgatgtctacattatcctgcccttctatgcttcccggataaccggttgatacatccgcatctcccgatttcacctctataaaatctgtaggcaacgcttgctgcatctgcccggcattttcctggccgttcccggagccgcacgaataaagcaccgcagcagcaagtgaaagtaccagatatccttttttgtaattcataacattggttttaaattttacagcagcaaaataacttcatataataagggtattcgcacagaaattgagtgaagcgtcgttaattgaaggtgaagcgtacgaaaggaaaaatgaaaggaaaacagctgtttacctctataaacaggacaaaaaggattttatccggaagaaataagagaaactgttagatcaatgacggctaacaagtaagataaaaaaagactgctttttcagagaagcagtcttatctattttcaggaataaatattaataatccatccaggatttgaaaatggaagctttctcgcggcttacaatcacttccatctccgggtgttttcttaattccagctttagttttccgttaaaatggttaaaaatctgttttacagaatcaatatgaatgataaattgtctgttggcccggaaaaagaatttcggatccagctgtttttcaagttcttccagagtttggggaacgttctcaacaactccggtattcagcatcgctttactgattcccaattcggtataaaagtacaggatatcctctgccagaactgttttatatccatctctgtgagcgataagaaaacgttttctgtaatcttttggctggatataattcaataatccttcaatagcggttcctaccaccggaacagcttccataaaggtttcatagcgtttcagggcagcatccagttcttcttcttctataggtttcagaagataatccacactgttgtatttgaatgcctgtactgcatattcatcataagctgtggtgaatatgacagcacttttaacttcatgcttgttaaatatttcaaagctgagcccatctgcaaggcgtacatccatcatgatgacatcaggaacaacattattttccagccagtgcaccgttgaagtgatggagtcttctacagacaggatttcgatatggggtcttaatttcagcaatagtcttttgagtctatctgcattgggtctttcgtcttcaactattaaaatcttattaattttcatatcaatggaagttttacaataaatttatcttcagttttttcaatcacaggtttaggatatcctaaaatttcgtatcgtgcaatgatattggtaagccccactcccgaggaatccggcttgttgattaaaggcaggaatgtattggaaaccaccagctctcccacggaattggtatagacatgaatctccagaggttttacctttgaagtctgattgtgtttaatcgcattttcaaccaataattgcagggacagtggcagagtatgcatagatctgtattcttctttaatatctattttaaacacaaccccttccccgattcttttttcaatcagaaaaatgtaagattctaaaaacttcagttcctcttctaccgcaatgatatcttttttggaattgactaacaggtatcggtaaactcttgcaaacttctccgaatattcatagcctagctgctgatcttccagaatgagttctgacaatacactcagattattaaaaataaaatgaggatctatctgaagcttcagtgcctgaagttctgctgccatggcagcttgtttatgttttgatgcccggagtttatgctgggcagcttctaccgctgttttcttccagttttcaagcaggtaatccaccgtattaaatgcactgataatcaaagagattacaatattggttgcaatccattgcccaagtaatgtatattctttccgtgaatccatttcaggtaatgttactgaggtacagtctacaatagcattaataataatcacaatcataacacttcccacaatctgcagcaaacactgaatgagcagccgctttacagttctgtttcgccagggaagcagtttattaagagttctgtcaataaatatactgacctctgaaatgattacagaaaataaaataatccaagaggcatcttccaggatcatttgcagcggcgtgttcaggtatcctttccagaccggatcaaacggatctatcagataggagaaaacacagaaagtaaccactgctacggcccagatcacgagccttcttttcatagtggaaagaatctttttatttcggactatatttttcctgatggcggaaatcctattcatgggcgaactttgtgattgtaaatatagaaatagattttatatgggtcttgtccgaaatagacgagaccgccaaaacgggagctgaaacgtaaaatagcagcgttcaaatgaatctgacggttcatcacctgaaaaagacatttcatcatcattttatgcaacatcgcattatttttatcattagctcatgatggtctgtcctagttttgcagtactaaatccggtacaatgaaaacaataattgtctgcacagatttttctcatgaagctgaaaatgccactcattatgcagcatctatggctaaggaaaatatttataagattatactgtttaatcttcaaaccgtttccatacatgctttgaatgcacaggcttcggctgattttttctatgcacaaacacttaaaaatcaaaaaaaactggaggataaagcaactgaacttacaagattgtatggtattgaagcagagcatcatctggcatccggcaatttcattgaagaacttgaaaactgtatacaggtacacagctgcgatttcctggtcatgggaatggcagagaaaactttggaacaaaagcttttaggtaatactgtaacaagggcaattcacagaataaaaaagccaatattaattgtcccttctcatatagaatatacaggaatcagaaaaatactttttgcttatgacacccacaaaaacatgacctggtctgccctgaacgatatttattatttcattaatgaatttaatgctgaggttgaagtctttaatgtaagtgaaaggctggaggattttgctgaagttattcaggatattgacctgaattccggttacgacatggatgatattaaatacagttttaaaatgattcagtccatcgaagtaattaaggctatagaggaggaaataaaacttaccaaccccgatcttctgaccatggttccttataaatataaccttgtagaatcacttttccaccgaagcaaaacagccataatggcctataagaataaaataccattactgtcaattcccctaaacatagattaagatcaataaaaatctgttcacatttgaattatcctttttgcctttaaaggctaaattttacacttaatcttgtttaacaggcccgggaaagtttcccgggcctgtttttatttcagagatttacaatcacttttcctgcaacgcggttagtctcaacttccagatgtgccattgcaaggtcttcaaacggaaatgttttataaacaaagggcttcagcactccttccttcaatagaccggcaattgcctccgtggtttcttttttagattctaccatcataaattcaatatttacatctctctctctggctttgtctgcaatatcctcaggaatctcaggggacggaagcgttacaataattccgttttcttttacaatatctaccgaatcagataaggtttttcactgaagagtatcaatcacgatatctacatcctgcactttttcatgaaagttttccgttgtataatcaatatgttcatccgctcccagcgacaatacaaattctttatttttaccggatgatacggcgataacgtacgccccgaaatacttcgccatctgaacagcaaaatggccgacaccgcctgaagctgcatgaaccaaaactttattcccttttttaattttcgcaacatctaccagcgcctgatatgctgttgaggccgccattgatgctgcagccgcctgctgatggttaatattctgaggctttaaagccagatgagccaccggggcagccacatattctgcataggcatttccttttccaaaaaaattgaccattccgaagacttcatctcccggtttaaaatcacttacatttctcccggtttccactacttctcccgagatatcccatcctaaaataacgggtcttttttcttcaaaaatccagttgaggacgccttcatacgccctggattttacatctactggattaatgcttatcgataccacttttaccaatacttcatcatttcctattacaggcgtgtctatttctgcaaattgaagattttcaacacttcctgcttcttttaaaataacagctttcattttttttgattttaattaccggacaaatgtagtctcatcatatctttgcagcaagtatatacttttttgtaatctacataccaaaaatatactaatgctgattatcaaattattgaaaaaatgttaaaaataaaaaaagtcaccaatgagccatcctgtcctgttgactacgcttttaaacggattggaggaaagtacaaaggccgtattttatggtatctccatctgaatacgattatgcgttatggcgaacttcgtaaaactctttccgatattaccccgaaaatgcttacccagactgtacgggagctggaagatgacggacttatccatagagaagtttatcatgaagttcctccgaaggtagaatattctttaacggaaaccggtgcagagctcattccttttattgattatctgcggctttggggtgaaaatcagattgaaaaagagagaataaaaaattaaaatcccttcaaaaccatgaatgatcatcatggttttaattttatatataaaggaatatcattggatatttttaactaaaagaacaaacacagcaattcatattcatctgaatatcaaaaagtcgtaaatttagtataggataaaaacagtgttttcacccttttttatagttgtgccgttcgctaattttgttccataaaattaaaaaccataaaaatgaaaacttccttttttactaagattttaagtacgctctgcacagcatttattcttagtttctgcttgctaagctgcaatgaacctcctaaagaacctgtaagtaacagttataaaaagaaactgatcagctaccgtgaagggcgcgttctttttgatgaatacaccagaaccaatcatgaaattctcatgaagtacagaaacggagaacctgattcccgatggtactggttttcgcttgaagatatggaaggatatattaaatatgtaaaagaaaacgccagaaaacaaaaattaaaaaatccgggaatcagaatttatatgggaaaatatccgatgaatcatcctaaaaacaaaatggcaaaacctgaatatgcaggttaccaaactatatttttagtacctactgcccaaaaaagagaaagagagaaggccatggccagatcagccaccaccgaagaaaacacagacgttacttcaatagagtctatgaacatgaccaatctggcacccccaccaaaaacgttatcagaaacaatgccttaaaaacatagcattatgaactggaatattgaaacagggaaacagatatcgatggccatatccattgtcgtgatgattctgatggtcataaaatatagaaaaaccggaaaggaaaatttatttttcatcataggatatctgttgttttccctgattgatatctcctgttatttctatttcaagctgacaaatctgcctacggacatcttctatgtaattggttttttaatggttgtattttttctatacttattttactattaccaattattgtatgttccgctgctcaaaaatatacaggctatcatcctggctctttttgtcctcaatattgccgtgatgttttatacagaaaaagacctgcttcatcatttctctttcaatatgctgtacgcagatattcttctgttgctattttcaattattttgttcctgtaccaaacctttaattctgataagatactggaaatcaaaaattatttaccattctggatatcagtggctttactgatcctttttatcggaagcattccgatactttttttcagaactactgtttcggagacaatttatttcttcatcttatttatgctgaatctgatcagtaacagcatactcatactgggtttaatctggaacaaacaggaaagaataagataaatgctttgcagatatggaagagaataatctggtcatcatctttacgattactttattcatcattgttttaacaatggtcttcatctatgcggtttttatcaggaaaaaaacaagcctattgattgaacagaaagaaaaagatttacggtttgaaaaagagctggccacttcacaggtggaaatgaaggagcaaaccctgaattatatcgggcaggaactgcatgatgatctgggacagaaactttcggtagtccgcttacgtcataaccaattgattaccaaattaaaaaactcagaaaaagaagacctgattgaactgaatgaattattgggagaatgcatacaggatataaggaacctttccaaaacattaatcaccgaacagatcattcacttcgggttggcagaatccattgaaagagaagtccagagaatccaaaaactgaaattattaaaaatcgaattcatcacccaaaaacaggatattgatatttcgcctaaacatggtcttattcttttcaggattatccaggaaagcatcaacaatattctgaaacactccaaagccaaaaacgtttctatccaactgaaagatgactgtgaaaaattacatatcagtatttctgataacggaaaaggctttgatacaagcatcattcaggacggctcgggattaaaaaacatggagttgagagccaaactgattcatgccgaactgtctatacaatcacaactgaataaaggaacacaaactctgataacctatcacaaaaatttattatgaaaactattcccatagcgatcgttgatgatcatactttaatctccaaggctttggaaaatatgatcactgagaatactcaatacagggtcattatgaatcatcccaacggagaagaatttattgcaggcgtggaaaaagcttctgaactgcctgccgtagtcctgatggatgtcaatatgccttataaaaacggtatagaaaccacagaatggcttacggaacattatcctgatattaaagttattgccctgacaatggatgatgatgaaagaatattgattaaaatgctgaaggcaggtgctaaaggctatctgctgaaagacatgcagccttctatccttttccaggccattgaaacggtatttgagaaaggcagtttttacactgattttgtagcccaaaagctgttgaaagtaaagacagaagaagcaaaaaatgcatccctactttcagagctgagagacagagagaaagaatttatcaaatgggcctgcagtgagctcacttataaggaaatagcagacaaaatgtgcctcagtcctaaaactattgatggctacagagattcggtttttgtaaaactggatataaaaaacagagcgggactggtactttttgccctgaaacatgatctgtgctgacttaaaaccttaatttctaaccttaattattacctaaaaataaacatctttacattctgtttatcaattcggcggcttttcaagccgccgaattctatttataacaccctcatatacaaacaaaaaggtgtttttcctttttcaaaatacggttttctcctctgttttcgtcatgcggaatgatagaattttgtcatagaaaaaaacacaaaaaggcagcccccgaaaagccggaacagagtagggaaaatttttaaaactaatacaatgaaaaaagcacttatcgtaggtattaatgattatgcgcctatcggatacggaggtccggatcttaacggctgtgtaaatgacgcaagagacatggccaatacattggtaatctgtggttttagtcctgcaaagattaaaatcctgaccaatcagaatgccacaagagcgaatatattgaactatctgaaatccatgatcagcacaagcgtgaaaggagattctcttgttttttattattcaggacatggaaccagagtggccaatatcggatcggatcttgaactggatggtttggacgaagctatttgcccacacgattatgcgaatgctggtgtcattcgtgatgatgattttaaagcggttcttgataaattaaaggctggagtgaatatggaagtggtcttcgactgctgttactcaggaaccggaaccagaaaaatggatctgggtctggaagctgatcttctcaatgaaactgcccgttatattcctccaatgcttgaggatgaattttacctgacctatgccagtgaaatcggaactaaaaatgtaaaaaaatcaaccgttcttaccaaagcacttgttccggttacaggaatgaatcatacattatgggctgcagcaaaagacaatcaggtatccatggaaggaaatatcagcggacagatacggggttattttacctatcatttctgtaaaatattgcgtgctaccaatggaaatattgtccgaaaaacacttgataagcaggtcgctattgcattggcagctatgggagcggcccagatcaaccagacagaaagcatgactgcagaattttcacaaaaaatattcacttaaccaataaccattaccggcggaatccgaaaagccataaaagagtaggaattaccagattaaaaataataatcatgtcaaaaattgaaaacaacaacccgatgaccactgaagaagtgtcaagactcagaacggttaaagcgaaatcaactgaaaaaccggaagttattcagaaattattcagccaggctcctgccatggaaacgattaacggaagaacttttcctaaagggatgaaaacaataggaatgcctatggatgaaaaaacagcagaaaaccgggcactggaaaccgatcatttctatcctacccatgctgattttgaatacagcccaaaactggaaccgaaaagagaccgtaaacctaaatttatcgacagagattctttccttactccggagaatgcaagaaccatttttggagttgatcagagaaaagtatacaattctacagcctatccgtggagatgtgtcggcagagtagaaagttctctgggttcagggagcggtgtaatgatagggccaagacatcttcttacctgctctcatattgtagactggcagcctaataatacaacaggatggctgaaattcactccgatgtattacaacggaagcgctccttacggaactgcctggggtacattgacgtattacaagtataaagttgcaggaccttctattgattcaacagagatacaatatgattatgtggtaattgtattggacagacctatcggaaacagcacaggctggttaggctcaaaatcctattccgactcgtgggatggaggagcttactggactcatgccggatatccgggagaccttaccggaacgcaaagacctacctatcagacaggtatagcccttgatggagatttctggagtgctgatgacaacgaaagcatgagccataaagcagatatttggcctggacaaagcggaggtcctttttggggatattgggatggctctccgtatgctgtagcgactcaaagcgcgcataatccaagtgataattttgcaagtggcggctcagatttagtcaatctggtcatcagagcgagaaatgaacatccttaatttatttttttagtttaaatcaaagtctgcctttcggggtggacttttttatgcagattaaaatatcggactgatttagccagtattctcaatattttaatacatttgtttaaaacatacttcagatgaatttcgaacagatcaacttacaccttgaggcttacaaagaacataatcagattctggatgcagcaaaatacctgatccattcttttaatctggaacatgaaaactttgcgggattcgggttcagggaggaactttctcccacctcaatgcttcttacggcagaaggcgatctgggaggaccgcaaactgtaatgatcccaagaaatttatttgattttgatctgaaccttgtcctgaatatggttgcccacgaaatgcttcatgtaagacagaaagcgcccggacaggtgatcgaagacaaaaatgaaagagaatttcaggcgtattatgaaatgctttttcacaaagtgtttccacagattcctgaggtttcggattttcataaaaaattctttggggggaaagccctggaatactacagaagaatgggtgaaggttcagtattacagcaaaaatatgcagaacagaaaacagaagttgaacatttaattaacaaattgccatgacagtaaaaccagacatcacctgggcagattttgaaaaaatagacatcagatgcggaaccatcatctcagtgaatgattttgaaaaagctaggaacccatcatatcagctggagattgatttcggagatttaggaatcagaaagtcgtccgcacagattacttctctttacacaaaagatgagttgattggtaaacagattttagcagtggtgaatttcccgaagaaacagattgccaacttcttcagtgaatgtcttgtgttaggattatacggggaagataaaaaagacgtcactcttttaacaccatcattacctacaaaaaacggaatgcaggtaggataaccgcctgttaaatataaaaaaaaccttataaatatttataaggtttttatgttaattattgatggagagtctttactccaagattcgtaacctggccgaagctaactgatacattaggagtattctcatccatatatccagtactatttcctgcatcataagaaacagtatagtttccctgtggcaacccggaaaacatgaaaaatccatcggggttaggtattgctgtagaaatcgtatctgaagccataatggcgtgaacaactgcctgcgccgcctgaggctgtacgtatcctttaatctggccgttggtaagctcagagaacgcccgtatcaccggttttaagatataagatccgttccctgtagtgacaatagatcttcccgcatcgaaatcaatccatactgtataggctccgtttgctgataatgtctgattccagttaaatttcagtccgctttgttgggccgacggagtttgcagaggataagtaattccattgacaactacactgttgttaggtcccagcaccattctcatctgagaaacatttccctcggggagtgtggcctgccctaaaactacatctgttccgtttttaaagttaagaagattataaacgcctggatttggaaagtttaatgctgtccattctccattactgttaatttcgattcgttgaatatcaatattaacagcattatatgctgcagggccgtcagtaagccttacattcactgtagcagtaccgttttcactggaatcgttacatgatgccagaaataataagcagatactgcttcccataatgaataacttcttcataagctaagttttaggtataataaaaacgttttggataattggtttattatgtcatatattcggttataaaaaacaaaaaatgatccaaagtatacctttagaaagagtcttatttcttgatatcgaaacagttccacaggcaggatcctgggacgacttatccgaaacagaacagtatctgtgggataaaaaaacaaaattccagagaaaggaagatgtgacggcagaagaattttatgacagagccggcattatggccgagtttggaaaaatcatctgcatcaccatcggaatggtcgaaaaaaatgaaacgttaaaaataaaaagcttttccggacatgatgaaaagaaaatgctccaggaattcggagaaatcttcaacagtccaagactttacaatgtgattctctgtgcccataacggaaaagaatttgattttccatggattgccaggcgttatcttataaatggtatgcagccgccggctccttttcagatgttcgggaaaaagccctgggaaattcctcatatagatacaatggaattatggaaattcggggattacaagagctttgtatcgcttgaactgctggctcatgtctttggaattcctactccgaaagatgatatagacggctcaatggtttcatcaatttactacatagagaaagacttgcagagaattgttgactattgtgaaaaagatgtcttaactttggcaaatgttttccggcgcatgcgccaggaagatttgttgaaaaggaatatcaatctagattaaaaaatgaaatttacagacgatcaaattgctgacattggtgaggaaatcattggtgtgctgaaaaccgtatatgaccccgaaattccggtagatatttacgaattaggacttatttatgatgtccagatctccgatgatgctgatgtaaaaattatcatgacacttactactcccaactgccctgttgcagagacgcttccacaggaggtaaaggataaagtgtctgaagtagagcatgtaaaaagtgtagatttagagcttactttcgaaccgagctggaataaggatatgatgagtgaagaggcgaagtttgagctgggaatgctttaatcacccttaacaatataaaaccccgaaagaagtatttttcggggtttttgttttttaaatatcttttgctatttcctttccttctctcctgctccattcactccatgaacccacatacagatccggaaccggaaatcctgcatagtccaacgctaaaattgtatggcaggctgtaacacctgatccgcagtgaataataaggtgttcaggtttatcttttaataattggctgtatttttcttttaaaacttccggactcaggaaatttccgttttcatcaaggttctcagaaaaaggaatattgatcgctcccggaatgtgtcctgcaaccagatcaatgggttcagattctcctttatagcgataagcatctcttacatcaataactgtagaagaatcgtttttcaattcattttcaacaacttccagacttgaaaccggaagaagccattgctttttttgaattaaaggcgctttatcaaatttctcttctcctgaagaaaactctaagcctgctttttctgcagcctgcattccgccatcaagaacctgaacattttctaatccgaaagatctcagcatccaccatgctcttgctgctgcattggaagcatttttgtcatcatagacaacaatatgagcatcttctgatattccaagatttgagagagttacagcaaacttgtctaccgaaggaagaggatgccttccaccaaaagctgcattttctccaatctctgccagatctctgtccagatctatgaaccgggctcccttaatgtgtttatcaaggtagttttgctttgcatcttttcctgttcttgcatcaagaatgataagattttccgccggaatattttttagttcgtatgaagagattattggagacattttgttgattttcaggttaaattttaaatttaattcgggtacaaccattattaaacaggtcgttcagccttattttgtcattccgtagaatctcaatttattattaaaaaatagtcctgattcctacggaatgacaaatctggctatggatatcaaagatccatgtaagtttttaaacaggtaaaacttataattcattcatcttaaaaatgaaaaatatccttcgctttattgtatgagctttcaaaattcagcagattcagcttatgttctactttttccaagctcataaaattgatgacctgttcagtaggcatatttcctacaaggtcatctttagccataggacagcctccgattccttttatcgcactgtcaaatcttctgcagcctttatcataagctgctttcaatttggaataggaatcttcatagcggttatgaaaatgtcctccgaagttaatttcaggatattttgaaggtattttttcaaataaaagtgcaatcgtttccggagttgcgacgcctgtagtatctgacagtaaaatatctttcactccgatatctgagaaccgctgagcccattggtcaacatcttcccatttccacatttcaccgtatgggtttccgaaagccatcgagaaataaatattaagctgttttccttcactctttaccagatcaagcattttaatgatctcatcaaaagcttcctcctggcttttattggtatttctgtgctgaaaagtttcagaaatagaaaacggaaagcccagaatatctacagactgatgtttcaatgctttttcggcgcctctgtaattaccgatgattgcagaaactttcgttttggaacgggacttatcgatattctccgctacttcattggaatctgccatctgcggaattgcttttggagaaacaaaactcagacaatccaatacatcaaaaccaacatccatcaaggagttgatataatcaatttttttatcagtagggataaattctccccatccctgcatagcatctctaggacattcggtaagaaacattgttactttttgattttctcaaatataataaaactaaactatttggtatactgtaaatacaaagctagcactattttgattttcaaagttttatatgtgattaataatttcgataaccgatattaaatcgcaaataatgtattctcagcatcaaatttgctaactttgttaaaattttgatatctgatgagtacaatagaattcaacccgttgtggaaagaaaaattactgaaccgttttcttagttatgtaaaaatatattcaaccagcgatgcagaaagtgaaacaacaccttctactgaacgccagtgggatattgccaattatatcactgaagaactgaagactattggtctggaagacgtttctatagacggcaacggttatattatgggctatattccttctaacctggaaaatgatgacagacctaccatcggatttatttcacactatgatacttcaccggacttcagcggagaaaatgtaagacctcaggtttggaaaaactatgatggaaatgatcttcttttaaatcaggcaacaggattcacattatctccttcaagatttgaaagtttaaaaaaatatatcggccagacgttaattactactgacggaaatacgcttcttggtgctgatgataaagcaggctgtgcagaaattgtaacagcggccgaatatcttattgcacatcctgaaatcaaacatggaagaattgctgtaggatttactccggatgaggagattggaagaggagcgcataaattcgatgttgctaaatttggcgcagaatgggcttatacgatggatggaggagaagtcggagaacttgaatatgagaactttaatgctgccggagcggtggtaaaaatccatggattaagtgttcacccgggttatgcttacggaaaaatgatcaacgcagctcttttagccgctgaatttgctcaaatgcttcctgctaacgaaactccagccactacaaaaggttttgatgggttctatcacttaatggatattacggcggatatttctgaggccaaactacaatacatcatccgtgatcatgatgcagataaatttgaggccagaaagaaattcatggaagaaaaagtagctgaattcaatcaaaagcacggtgaaggaactgctgaagtggaaatcaaagagcagtacagaaacatgaagcagcagtttgaaggcaaaatgcacattgtagaccttgcagcaaaagcaatgactgaagccggtattgaacctaagatcaaagcgatcagaggtggtacagacggtgcacagctttcttatatgggacttccatgcccgaatatctttgcaggaggaatcaacttccacggaccttatgagtatgtagctttggaaagtatggaaaaagcaactgaagtcattattaatattgtaaaagcttaataatcatgaaaaaggtcttagcatcagcattcattttcgcttttattttcagcagtgcccaggtttctgaatttcagagggcagactcacgctatgaaagaaagaaaacggctctgtataataaatatcctaagcctaatgatttaagaacaaagaaagaatggcttctgacagaggataaaataacagcatataagacggctttggagaaagcttctcttgaggatcagaaaatgattgctgccgaccctcctgtaaaaacaaaagtctctaaagaagctgaatatgataaaggtaaggcaggttttcaaaagcttttatatgaagccgtagatcttgactttctcaacttttcgtcggattcttacaaagctacaatcagttttgtggtagactccaaaggaaatgcccttaaccccaaagtaaaaggcaataatgaagatgtaaatgcatttattgaagctgctttttacaggattaaagataaaggcaaatggaaaccggcagcagacaaaggaaaaccagtctcttccaatgtttcagtccctttaacattaaattttaaaaaataatatactaaacccgctgttatgacagcgggtttttatttttcatataataaaaatataattaaagatcattatgttgttgatattaatttaatataattcttttgtaagttttaaataattcacctaattttgattaaaacttaaaatcactgtatatgaaaatgaaatccaaccccttcaaaatcaacagaaatttttacttttctttccttctatctattttctgtttgtttcttttaacgtcttgttctcaggatgatcctgcagatctccctgctgaaaaacctgcagagtctgttcaaatgaagactttgggcaatctgactttacagaagaatgttattattctgaatgatgaatcagtcaatgcaatttctacccatactgatggaaaaattacgttcagccgtatgactcctcaaactgatagtatttcggtaggaactgttattgtagggactaaggttgaaggtgatcaggtaagcaccattctttcaaaagtaaatactgtttcaaaactgaataaccaatttacagtacagacttccagtgccaagcttgaagaatttatctatagcggaacactgagcggagtgtatgatccatcaggaaaagctcccgtcaatattgatggaaaaatggttaattatgttcctgtggaaggcatggtttctgaacaaatcaatcagagaatactttctattgaagctaaaaatcttcagaatcagaaactaattactttcaaccgttataattttaataaaaccttttcgtttcctttatcttctgcaggaacatccagtgttaacgtacagggaggatttactccaaagattgattataatattacattctcatgggggcatttgtccaatttctatgttaacctcatcatggacgacatcaagcttcagagctccgcaactattgtaggaagcctgggctatacagccagcaccacagattacctgaatattcctattgttcctatcgtcttaggccccacaggactgatcttaagccctaccctatctgcaggccctttcctgggagtacaggctacaggaaaagtacaggcccggcttttggatcttgaaggaaatgccaactttttggtaagcaaaactccggaaattaatatcaaccttcagaaaaaatctgagcctgccattacaagcgcagaaggaaatttatctgctgaagctggtttagaagcaaaaggagctgtaggactcatgttccttaccattcctattgctaattcaggattgaaaggaagagcttctgccctttcctctttaggattaacacttattccttcaagaaaaggagtgattactgtaaaaggtaaaatccaggcagatatgttctatggttttggaatcgctcctttacgatatgagggaactattcctcttttcagaaaagaacgtctgctctatcagaaggagttcagcttctaagacaacatattccattgattataacaagccacttttgcagtggcttttctttattaaagcgccacataaaattcatttacagcacattaagtcatttttattatatttacaaggaagtacaattttaaacaataacatttaataccaaattatcatgaaaacaatgaaaaaacttttgagaaaagacttatctgccattcttggcagcggaggaaatgaatgccatatgggcggtgattcctataactgccagagtgactgtgagtgtgcctggggaaaagcctgtgaaatgtatgaagacgggacacccggacaatgcatcgctgtgggcggaggcggaaatcctggcggtggaggcactggcggatgcattcgaccttccatttgtgaagaacaaccttattaatgaacagaaaaccggaagcattactgctttcggtttatttttttcatcgggaaacaggtccttgtcaaagtatccctgccgttcatcaaataaaatttcatcccatctatcataattgttgttttgcaacagatttttaacaataataaaattatgaagcagcaatttttcgctttaagtgcattgttattatgcatttttggcggtgtggaagctaaggcacaacagaccccggcttttcacattggggtaaagggaggggcaaactttacaaaaacctccacggaatcttctctggaagggaaatatggattcggttatcaggcaggagtaatgacaagagtggatctcggaaaactgtatgtgcagggagaagctctgttcaacaaaagaaaaacatcgttccagtctcaagacggaggctcttccaaactttcctggaacgctattgatattcctgtggtagtaggatacaaattcattaaaaccgaagattttaatgtaagagctttcgccggcggagtctacagctacgcctttaataataaattatctgcttctcaggctcttcaggagggctttaaaaagtttgacaaatccaatatcggaattacgggaggtataggagtagattataagaacttcacgatagatctgagatatgagaccggtcttacaagcattagtaaagaatttaagtccaaaccccacagtttttcccttgggataggttatttcctgttctgaaaaacttaaattatctttaccattagaaactgttttccctgcagtttctaattttttttatcaacctatttcctgttccatgacaaaatcttttgttttaaaagaatacatatttacctttattttctggcttgtactggccattgtattgtggtttaatttccagagtacaacagaaaaatatcttgcaatgacgcaggctgcgattattgcagcattctcatttacatttactcattttttaaccaatagattactcccgaaagctcttcgggaaaagaaaatgaaactgttccttgtacagttggtaatggttattttcatgctcagcctggttttctccgttatattcacgtatcttgaagtggaacccaaagatcagcttccggaaagcttcagagatcagctgccttttctttggaagggcttttatatgtctctgcctgcctcattcctcatcaacggagcagcatgcggtataaaattttataatgaacatggaagaatagagcgcgatcatattctccttcagcaggctcatctggaaaatcagcttaagcttttacaggatcagattaatccacatgtagtcttcaatattctgaatcatattcatattctgatgaaaacggatatacaacttgctgattttttattgttgaaattctcagacattctgcgataccagctatatcattgtaatcagccactggttcctttggataaagagattgagtatctccaaaatcttgttgaggtagaaaaactaaggtggggaaacgaactggatgtaaaagcccaatggcaaatcaataatagaaaagcttctatcgctccgttacttttggttccttttgtagaaaatgcatttaaatatgtttgcaggcttccggggcataaaggttatgtgaaaatctcctgtaaagaaaagaatcacagtctttatttttatgttgaaaattcatattcggatatggcaacctataaaaaaaaggatggaaccggcggaattggtcttcaaaatgtaaaaaaacggttgaaattacaatatccggactcccatgatctgaatatagaatcggataatcacgtctttagaataacattaatactaacactatctgacagttatgagctttaatattcctaaaatgaaatgtcttattattgatgatgagcctctggcaagatttcatcttaaagaactggctgatcagattgattttttatccgttgaaggaacctgcgcaacagcactggaagctgacgcaaaggtaaaggaaagcgaaacagaccttcttttcctggatatcaatatgccctatcttaccggcctggagtttctggagcagcttgaaaatcctcctttatgtattcttaccactgcttattccgaatatgctttggaaggattccggctgcaagtggtagattatcttttaaaacctattgccttcaaccggttttatcaggcggtaaataaggctcagcagcaatttatcatcaatgaaaaatttaaaaagaacacttccctggatgatcccttcctttatgtaaggcagtctgatactttcattaaagtttcatgggttgatattctgtacattgaaagcatgcagaattataccaagcttcattttaaagataaatccctggtcattcaccaaacgatgaaagcgattgaagaatcacttccttcggatcattttttcaggattcataaatcatacctcatcaatattacccatattgatatgatctccggcgggcgtctttttattaataaaactgaattacctatttcgcgtaaccgaaaagaagaattacttaatcaggtggtgtataaaaaactaatcagtaaatagaaaattgataatattaaagggaaggcagtaaaaaattattactccttccctttattttttatggcagattccaacgtaatgatactgctgcgtaaaatgtactggaaaatcttggatcagctatttttttatctctgaaaatgctgctgattttccgatcattttcactaaagctcctcaatatcgccgttcctcccgtaagacgtaatgtgagcttatcattgatttttaattccggtctgagcccagcggtgatctgctgataacccagcaacatcgattttccgtttatatttctctctgctgtcattccgttcagttctacaacggcttttaaggcaaatttatcagagaaaagatatccggcttccattccttccgggaaattgatattgaatttaattttcccgtttgttttccagtcaaaataaatccacggtaaaatcataggaacaccaaaagccgtggtaagtaccggcccggcgcccagggaaagattaggattaaaatgcctgataaacaaaatacctccctgcccaagcacatcgtcaaagtctaccttttcaagatctgtatatacccccacagacgctgtcatcatcatgctccactttttgcccaaaggtctcatatgctgtattccgacctgtgcattcagcatctcatccggaaaaagccgagtttcgtaatttttgtgcgtcatctttgcgtaagatccgctcaacagcatagaccatgctcttactttgccatcggtatctttttttacagacagcggaatgctgagattcagatctactcttttaaaatcacttttagagttggtttttgtactgtcttcaggacggatataattagatgccggaatatactcggttttaagctctgcggagagcccggactgtgcattcacccaacatcctaatggcaatatacagcatagagctgccgaaagggttcttttcatattttaaattttatgcaaagagaaccctttgactattttttacaaaaattacttgattaagtgtccggatcgtgtgacaacaggatcaaatagcaggattagtttctgtggaagattgtgtatgtacgctttcctttttctgggtcttaaaaatacgatatccaaaccacactgcgatcaatgccattgcagaacgggttaccaccatcgggattatagaatctgcttctaaaaagcccagcaatgctgacattaaaaatgtaaccataagctgcataaagcccagtagtgcagcggccgtgcctcttccttctttaaacggagatagtgcatgggcggatgtaatcggaaacaaaataccaatagcaagcaatgacagatagagcatagcaatttccagtgctacggataaattttctgccgcaatcaggatatgaagcgtacataccaccagtaaaataactgtagctacaaataaaagcgttgaattgcttattcttttaatcagtttaggtgtaatataagctgcagtaatcaaagccagtgaattaaaggcaaatataaagctgaatacactgcttgagaaaccatgaatttccatgaatagaaacggagcatttgagatataaatgatcagagaagcaaaagcaacacttcctaccatggtactgctgataaaatctctgttggaaataatcattttcagctgatcttttaactttttttcatccgttgcttcatcatcaggaagattgattctggtattggtttcgggtacatatttatacaccataaaaaaggttataagccccataatgcataaaaaagcaaaagaactgttccaaccccagaatttaaggaatacactccccagtaacggcgcaacaataggagcgataccgctgatctgcgactgctgggaaaagatagtgacggctttgtgcttatcatacagatcaataatgatcgcccttcctacaacaattccggcgctgcctccaaacgcctgcaaaaagcgcatggcccataatacataaatatctgaggtaaaatagatggccgtccctcctgtaataaaaagtaaaagtccagagtacaggacaggcttacgccctttcttatcagataaaggtccccataacagctgtccgaaagcaaatccggcaaagaatacagaaatggatatctggatatgtccgatatcggtattaaaaatcttcgccatattgggaaaagcaggaagataaagatctatacttagagactccagcgtgttgagcagtgcaagaataaacactacaatattcaaattcttcttcataaataacggtaagccttcacaggcattttttcagctgcaaagttgctgtaaaaagccatgcttttcaataaaagaactgaaggaagtataggacaaaatgaagatttaagtagaccaacaaacggaaaatatcagtttaaaacatttattatagtaaatactgaagattatcttttttcattattcttaaaataatctggtgtctggccggtatgtttcttgaaaaatcttgaaaaatatgaagcatcgttaaaacctagtttaaaagcaatttccttcactgtaagcgctccaaagctaagctctcttttggcttccagaatgagacgctgggaaatcatcttttttacagttgtccctctcaaaagacgtacaatatcattaagatggtggctgcttattttgagctggtctgcatagaaatctgtttctttatgggctatataattccgctcaataagtcccaccagttcctgaatacgctgacggtcattttgtagaggttcctgaggaatgatctgttccccgatgatgatacagaatgctttcaggtaagcttttaagagttccgttcttgctgtagtcttatattcctgttccatcagagagataatggtgatgcaggtcttttcattttttggattcaaaagaaagggtagttctcctccgttgagtactgaccctatatcacatgcttcgttgaaaatttccctgcttattgccattgcatatccttcctcgcctgccagtttcatattgaaggcctgtcctggtgcaatgatacagatttgattgttttcaagtctgtagctttcaaaatccagttccaaacgactgctttcaaagacttccgtgaaccagataatctcaaaaaaattatgccggtgcacatcatgaaaattttcaggacctgccgcactcagggtactcatctgaaacttttcagaggtcagatggtgaaccgggatttctttttctggtatactcattactttaaactataaacaaaaaccacagcaaaaaaagtgctgcggttttcttacaatatttaaaattaaatataattttttgattattggtttaggaaagcgtcccatccttgtgccgtcaaagctaccaattgattagaccctcttgccaccataaagttcccttcttctttttctacagcgtgtcctataatggtaaagtccggatgatttttaatcttatcaaaatcgttaggagaaatcgtgaacaaaagctcgtaatcttcaccaccgcttaatgcagtcattaccggattcagattcatttcatccgcagtagaaattgtaagactgtccagcggaattttttcttcgtataatctaaaacctacttttgactggtctgaaaggtgaagaatttcggaagctaagccatcagaaatatcaatcatggaagttggtttaatatccagttcttccagaatctttttgacatctgttcttgcttcaggtttcagctgtctttccagaatatagtcatatccctccatttcaggctgcatattcggatcagcaaggaaaacagcgtgttctctttcaagaatctgtaatcccatgtacgctccacccagatctccggttactacaagaaggttatttggttttgctccgtttctttttactatattttcttcgttttctattcctacagcggtaatactcattaccaaccctgaattggaacttgtggtatcccctcctatcagatccactttgtatcttgcacaagcagcctgaattcctgaatagatctcctccaaagcttccaccggaaaacggttggatacagcaagagaaaccagaatctgcgtaggagtggcattcatagcagcgatatcgcttaggtttaccaccactgctttatatcccaaatgttttaaaggaacatagcccagattaaaatgtacgccttctgccagtacatctgtcgtaagaactacttttttgttgtccggattaacgactgccgcatcatctcctaccccaagctccgaagattcattggatagcggaaaatgctctgtcaaatgtttaataagaccgaattctcctaattttgagatgggtgtaagttcctgtgatttatcttcaaacatgattttttgtattaatgtccaatgtaaaaagtatgaatgattttaaaattgctcctccaatattgaaccttgaattttaaactttgaattattgagtaagttctgccggatcgatattatgtggatggaaaggcagctttttaaagtcttctttcgacagcaccacagtttccgggctcttgtatttattcattgcttccactacgtcatccggcggagtggtcatttttctaagcatcatatcgatccatacccctgtagcttctgatgtcgcacaatgtaccccatccggagtatagaacttatgcaggaaacggtagatagaagaatcttctgaacatccgtctatttccacacttacgattaccgtctggtctgcataaatctctttgaagaaagaatatctctcatgcaggattaccgggccaatcccccatctgctgagctgggtaactcccattttttcttttgtcatgaaagccattctggcttgcgcacaatattgtacataggatgaattggctaagtgcttgttggcgtcaaggtcgctccatcgcacttcaaatttatggtagaaaatcatttgaaaatcgtttttggtctcactaaaattataatcttcaaaaatactcaaataagatggtttataaaaattgtacttttgaaaaaataatcttccgcataggattacatatacatgaaacagatcattattatcggaggcggtgctgcaggctttttctgtgcatccaaccttgacgaaaagaaatatacaattacaattttagaacagaattctgatgtccttcagaaggttaaaatttccggaggtgggcgctgcaatgtaactcatgcctgtttcgatccaaaagagcttgttcagttttatccccgtggaaataaagaattgctgagtgtttttactaaattccagcccggcgatacgatggaatggtttgaccagcgcaatgttccgttaaaaattgaaaatgataacagaacttttccgaaaagcaattcttctcagaccatcatcaatacttttctgaatgaaactcaaaagaaaaatatttatgtaaaaacaaaatgtacggtaaaagagattgaaaagcagggcgaaaaatatatcgtaaaaaccaattccggagattttgaggcggattatattgtgtatgctaccggaagttctccaaaatcactgaaaatcgttgaaaatcttggccataagattgtggatcttgtcccttccctttttacatttaatattaaagatgaactgctgaaagagcttccgggaacaagctttgaaaatgcaggaatttcaattccgaagctgaaaacagaagaaagcgggcctttacttattacgcactgggggctttccggacctgctgttttgaaaatttctgcctgggaagcgataagtcttgccaggcttaaatataactttgaaattgaagttaattttatttcgaaagaaatggatgaagcagaagaaatcttccaggaattcaagcaaacccatcctaaaaaaacaatcggacaatctaagatttttgatattaccaacagattctggcataagattttagagatttcaaaagttgacctcaacaaacaggtggctaatatttccggaaaggaaatacacaaaatactggaaaatctttgcaggagaaaatttcaggtgaccggaaagtccacttttaaggatgaattcgtaacagccggaggcgttgatttaaaggaaattaacttcaaaaacatgtcttcaaaactacttcccaacttctatattgccggagaggttttgaatatcgatgccgtgaccggtgggttcaatttccaggcgtgctggagtgaaggatggctcattgcccaggatctcaacagcttataaaaaagtattatttttacgaaaactataaaacatgaaaaaaaatttcgtcttctttcttttactctggatctttttaggatatagccaggaaagaacaattgtttctgactggacttcacttacccaggccgtcaatatagagaataaacccaactggaacttccgcgttacagctaaaatcaggaaagaaaatgaggataatggttccaattgcgggctgtggtgcagaatagacaataaagataagtcaacaggcttttttgaaaatcaatattacggaatcaaagtaacccatgaatggaaaacatacgaaataaaaggaaccatcaatccctccgcagaaaccatgaatatcggtgcttttgcacagaacaacggagatttttattttgacgattttaagctggaagtcaatgatggaaaatcaaaaaaatggatcgaaatccctttggtaaattctggttttgagaaagatattatagcatccggtggctggtttgaaggaatccattctcagaaagtaacacatgtaaaacactttacaatcggagcttcagattataagccattcagtggtagcaaatcattgctgatgaaagggcatgatattatcggtacaatgccgcatggaaagtttatggatgtaaacggcatcaaattatattatgaggtttatggagaaggtgatcctgtacttttacttcatggtaacggacaatcaatcagtgcttttatgaaccagaaggatgagtttgctaaaaaatataaagtcattatcgttgattgccgtgaacgcggaaaatctacttacgataaaacaaaagaacttacttttgatattcagacagaggatcttaagctgtttttagagaaactcaacatcaaaaaaacaaagatcctgggctggagtgacggcggaattcttgcgctgtccatggcaatgaaatatcctcagatggtagataaaatagcatgttccggagccaatatttatccggaaggagttaaagatgatgagttaaaatctatgaaggaaatgcttgccagccttattaaagagaataaagatcataaaaatgatattcttattgatcttttgaacctggaccttaagtatccgaaatggaagtatgaagacctgaataaaatacagtgtccatcattgattattgcgggggataaagacattataaaaacagaacataccgtaaaaatagcagaatcaatcccgcatgggcaattggcgattattcctaattcaagccattttgttcctgaagaaaaaccggaattattcaatgagttagtcattgatttctttgaaaataaataactaaaaaccaaacatgaaaaaaacaataacattctttgtatttctaggatttggactcacattttctcaggtaaaggaaactgaaactctatcagctaaagatcagtctgaagagtctgttttgtcgaaagacgaaaaatctgcagaatatcccagaggatggatggcacttcgaaaagatattgctgacagaataaggacgaaaaaaataaatatgagaggaattgagggaacaatcacggcgagggcaaagtttatagttaatatcaaaggtaaaatagaagacatcacagtaactggtgataatgccgacttcaataaagaaatagaaagagctataaaatctctgaaagcccaatggaaaccagcagaatccaagggtcgtattgtccgcagctattatacttttcctcttacgataaaacttgattaacagccaatgctttctgtcaaaagaaatatctcttctttctttaaaatccttcttattgcagcgtttgggtatttcttttggctgatgctgaagatcacactagaatatatcccttttaaccgagaagtgagttttctgatgatcaaacaaactgaagttacagaaagaccggaatatcttacattgttctatacgcatgtttatacaagtatttttgtacttctttcaggttttctggccattctcagaaaagattttggactgaaaaactttcaccggaataccggaaaagtatatattcttcttattctgatctttgctgcaccctcgggaatttatatggggctctttgccaatggaggctttttatcaaagatttcttttgtcatattaggctttttatggtggttttcaacatataaggcctatcagctggcaaaacaaaaaaagtttaaagagcaccaacaatggatgtggcggagttttgcctttacattatctgccattaccctgagaatgtggaaagtaattattgtctatttatttcatcccacccccatggatgtttatcagatcattgcatggctgggctggattcccaacatccttattattgaatatttaatcacaaaaaaacatatatgaaaattgtaaagtacactcttatttctctactggcagttgctttggtaagctgcaaaaaagaagcaaaaaccactggttccggaaaggattccctgactgcaaaaaaagactctgttattgttcctgaagttcacaaagaatattacggaatttacaccggtgagtttgccggaatggaaaagatggtagatgaaacagacggctcggaatatgatgtcgataattacaaaagaatttctttaaaaatcaacaggattaccagggacagtgtttacggacaaagtatcgtgaatggtaatcagcgcccgttcagaggagttttcaatgaagcgacggcatcttttgtgcttgatgagccgggaaatgataaaacagacggaagatttgaagtaaaactgaaaggagacagcttaaccggaaaatggaatgcatttgataaaacatccgtcaaagcccctttaaaaaccctgaaactgattaaaaaagagtttgtttacaatcccaactttatgctggataaggattccgatctggtagactggacaaattcaaaagagttcaccgaaaaatatacagatgaggaaaccggtaaaacagaaagctataaaacaacaaaaaatcgtttcgcttccgaagccatattcaaactaaatgcatcaaagcagaaattaacagaaaaagatcttaaaaatttaagaaagctggatcttgaaatcatcaaaaattctgtatttgcaagacatggatactctttcaaaaaagaaacctacagaaatttctttgagcagacagattggtatatcccggtttctaataatgtagacaatgatctttctcctctggaaaaggaaaatgtggcattactgaaccgctttaccaaatatgctgaggataagtatgacagctttggtcgataggtaataagtgactggctttaaggattagggaccgaggttacaccaccattgtttgccatccttacatacatatagagaatcaggcagcctatggcatagcacagattatcaatccatgaaaaagaatttccgatcacaatatacatcaggcttccaggacggaagcctagtttttctgccatatggaaatactgtgcaaattctactaaaaatgaaaaaatcaaaattccaaaaatcagtttctgatcgtttacttttacaaaactcctgacaaaagtataaagaagcatcaccacaatgacatctccaagataagctctgacaaagaaaatatggcttagtttggcagcaatcaatacctccaccagaaaaataaagattgtcataaggaaatatttcagactgaattgtaatttcattttaaactggttttaagtcataaaaaattgatattcccggaaatctctgtctgttgcatcttatttatcagactaatcatttataaaatacaaaatattatcattcaacaatttacaaaaacaaaaattaccgctcgaaaaaatattttacaaataaaggatttatttttatcatcaattcatttttttgatatttttacagccttaaaaattaaaccatgaaaaaaacttatttacttctgccaatcttctttttggcttcatgttcaagcagcaatgatgaaacagatttatccaacaataatgggaataacaatggcaacaataatcccggcactcctgtcttaatctcgaaacttactgtagatggagatacatccgtattcacctataatggttcaaaaatttctcaggttaaaaatattaatactggagaagtttccacttatacatataccggagatttaataacggaagaattaaccacgggaggaagctcaacctttaaagtaaattatacttatgatggaagcggaagattaattaaaaaagtgagtgtacaacatatgcttgttaatggatacaccgcaacagatgaatataattatgcctacacttccaatactaccttaaaaataacttataccaagactgttgcaggaaatttcacaggatctccttcgataacaacaggaactaaaaatgcgacattaaatgcagatggttcattaaatagttggacagaaacagcctcaatccctattcctggtacttctggctttaattctgctaccggtattttgaagcctattgtatatgatacaaagaattctccacataaaaatataacaggatatctaaagattattgatactgaagatgaaaatggatcttctcacaatattttaagttatagtgataaactggatcttaataatggttctggaggtgctatgtggggaatatttaaatctacttatgaatataatacaagtaactatcctaccaaaaatgtcagagtttattatgacaagacatccactaatgtaacaagcagtgaggttattacttacgaatacaatcacctataacacagaagagcgctcaggcgctctttttatttttctttaattcatatatttaatttttcacaacccatagaattatgaagatcattttgtatatttgagttgaatcaaaactaaaatatcatgaaaaaattaaacattcagaaaagaaaattaacaaaaagtgaattgaaacagattaacggaggcagcggaccactttgtcccgggacttgtttctgtaatattgatggagagatgaccattggggcatgcactcctaaaggacaatgttgttaatacattacaacttgtcatataaagaataaggattgaggcaacccctcaatctttttttataaaactatatttcaaacaaacataacattttgactcacaatattttgaacataataaaataacttgtaaattagcttttaccaaattaaaattattatgaaaaattcaaaaaaacagaaaagaaagcttagtaaaaatgagctgaaagagatcagcggaggagccaacagaccgatctgcccaagagtgataagctgtacagatccgaataccggagaagagagatatggagttccgggcatgcaggacggattctgctgctaatagaaatatgattaaaaaaatgattggattaccctccaatcattttttttatggcgttgagcttcattaaagcttcaatcggtgttaaagtattgatatctattttcgtcagttcttcacgaatattctccagaacagggtcatccaactggaagaatgaaagctgcatattttcctcggtcacccttttgatgctttccgaagtagctccattaccctgagttctgctggcttcaagtgttttaagaatttcattcgctctgttaaccactttcgcaggcatacccgccagttttgctacatgaataccaaagctgtgctcacttcctcccggaaccagctttctcaggaaaatgatatttcctttgttttcctggatagaaacgtggaaatttttcactctttcgaaattcacagtcatttcattcagctcatggtaatgtgttgcaaataaagtctttgcctgtgttggatgctgatgaagatattctgcaatcgcccatgcaatggaaaccccgtcataagtggaagttccacgcccgatttcatccaataaaataaggcttcgctcggagatattattcagaatatttgcagcttcattcatttccaccataaaagtagattcacccgcagaaatattatcggtagctcctactcttgtaaaaatcttatccagcatcccgatttcagcatattttgccggtacaaaacttccgatctgtgccagaaggcatacaatcgctgtctggcgtagaattgccgacttaccggccatgtttggtcccgttaccataatgatctgctgggaatccttatccaggaagatatcattcggaatgtatttttcacctagaggaagcgcattttcaatgatcggatgtctggcttcttttaaatcgatcgcatagccatcattcagcacaggctttgtatagctttcagaaacagccagttcagacaatcctgcggctacatcgagctgggcgattatgttggagttcccctgaatctgatcaatataaaccatagtttctccacatacatttctgtagagcgaagtttccagaacgcctattttttcttcagcaccaagaatctggttttcgtattccttcaattcttcagtgatatatctttcagcattcaccagggtttgttttcttacccaatcatcaggaactttatctttatgtgtattccgaacttcaatatagtatccgaaaacgttattaaaatcaattttaaggctggtaattcccgtcctttcaatttccctctggcacatttcatccaggaagccacgtcctttattctgaagatttctcaatctgtccagctcttcagacacgccttctttgatgatatttcctttcgctatacttaccggaagctcttcattaagatgattctgcaggaatttaatcaattcttcaaggtcaaacaggggctctaaccatgccagcacatctgcatgagggtgcaataaagcttttattttatgaatattaatcaaactttggcgcaaatacccaagttctttcggagaaattttttctgccgccagttttcccatcagcctgtcaagatcagaaattgatttcagaagctggcagatctcatatttcagatgatcattttcatttaagaaatcaatcagggaaagccttctcatgatctcatccacagattttaaagggagaataattcttcttctcaaaagccttccgcccattggcgtagacgttttatcaataatatccaataatgatttcccctgcggattgcttggatacacaatctccaggtttctcagggtaaaattatccatcatcaggtaatcttcctgaggaatgatctgaagcttagtaatatgggaaagcagattgtgatgggtatcttccacgagataagcaaaaatggctcctgctgcagtaatagccaacggaagattttctactccaaaaccttttaaggaattggttctaaagtgattcgttaatttttcgtaggcaaaattatactggaaggcccagtcctcaagcttaaaagcatttttatttttgatctgttccggaatctgtgtgcttctctggaagataatctcactcggatcaaaagtattaacgatatgcaatagcttttccaggtttccttcacttaccagaaactctcctgtagagatgtctactaaagcaattccgtatttctctttttctttatgtaatgaaagaagaaaattattcttttttgaatttagtacctggtcattgaaagtaacgccgggagtaaccagctccgtaacccctctttttacaattcctttcaccattttaggatcctccagctgatcgcagatcgccacacgcattcctgccctcaccagtttaggtaggtaagaatctatggaatgatgcgggaaaccagccagttccacacttccttcaccgttatttcttttggtaagaacaatgcccaggatctgagatgttttcactgcatcctgcccgaaggtttcataaaagtccccaaccctgaaaagcaaaagcgcatccggatatttacccttgatggtattgtactgcgtcattagcggggtttctttctttgattttgccatagtaaaaaatgagccccaaatttaaaaaaataaattcagggtaagagaattgtttcggggttaatcttccctgtttttctttatcattaattaatcgtattttcactgtcaaatcacattattttatggaatttcctgttttaaagacagaaagacttatcttgcgccagcttacgttcaatgatatccaggaccttttcgaatatttttctctggatgaagtcatggaacattatgatctggacactttcaaaacgcctgatgattcacgccgcattattgaacattttaacagtgaatttgaaaaaggaaaaggattcaggtgggctctggagctgaaatccagtggaaaagtcattggtacatgtggctaccacaactggcacagagaacatttcagggcagaggttggctatgaacttaatccaaaattctggcagcaatcctatatgaaagaagctcttcttcccattctgacctatggatttgaaacaatgagacttcaccgtgtggacgcattcattgatccttccaatatttcttctgaaagactgttgtcttctttaaatttcagcaaagaaggaacgctgaaagattatttttttgagaaagggaaatttgtagacgcaacaatctttggacttatcaataaataaattgatttaaatctaacgctaagaagcaaagaaaattgatattgattcttcttattttcgttcgcaaaggcatttcatttagcaattgaagtgctttactcgctgagtgaaacgcctttgcgaacctttataatagattagctttaaacttgcgttcaatgcgttaaaatggtcaaaagtataatatttatttttctgaaaggtgcttttccaaagcctcagaacttttcttataggcccatttttgcttgtagttcacccatttggctttaaaaagttttcgcatcagcttatctgtatacctcataatgaaaacatgatacagcatattggcaaagacattgggtttattcggaagtgctcttaaagaaagagaaaaaccaggctcaagatatctgttgaaatgccagaacgctccgggaataaaaagagcatcaccatgttccatgaaaatctcgtagccttttgcatatctcaatgcgggaaacttctcataatccggattttcataatccagttcgtaaatggtatgaacagataaaggaactttatataaaaacggggactgtttctgatcaaaaagcaggattcttttctttccttcaaagtgaatatgcataaaatcacccagatccacatcataatgcattaaaacatgggcttcacttcctccgaaaaataaagtcggaagtctcttaaaaaacttcattccaagatccggataggtgaaatttttcagcagttcgggaagcctgtctgtgatgatatagaaaaaaatacgaaggtctgaaggcctactttttatggtatcaatatattccttcattttcatatgggtcaccggagcatcagaacttttagaggcatcggccggtttattatcatacaaaggaacttcctgatcacctgccttttctctgatatatgccagattccatttatcgaaggcatcccagcggctggcaaaatttttaatcaaaagaggcttctgctttttgaaataattcttctgaaaatcttctttactgatatcagttacaatatctacattttcgaggatcatgtattttgtatttaatgcgaaataaaaatagtgtttttttgaaacctgagaaaattaagattaaaagagctggaagaaggaagatggatgctgggagttcatatttgtctgcaaacgactatacatcattccataaaaagattttatggaaaaacatagacctccttcggcttcaataacatctcttttccaacttcagacttccttactttattggcagagctcggatgaaaaatttatatttgtagtaataagtgaatttatgagagtctacaacaccaaacatttccttaaaatcctgttcagtctccacaaaagcgataccctgaaaattcttttcccaagtatgattcttgtaggattatactcatggggaattcagtatctggaggtagaatatctccatcttacttcaaaatcaggaatcagcaatgtggggatgattcactctctgctgggctttgttctttctcttttgctggttttcagaaccaataccgcttatgacagatggtgggaaggcagaaaactttggggcaaactggtcaatgacacccgaaattttgccataaaaatcaataccattcttggcgataatcgtcaggatgctgagcagattgcaagatatctgaaattctttcctcactttttagccaaacatctttccaaagaatctacaagactggctctggatgaagattattctgaaattgaaagctccttaaaaaatcatggcccaagtgaaatgattattctgttaagccataaattaaatcaattaaaaaaagaaggaaaaatatctgaagttgaaatgttgtatctggatacccagctttccgggtttctggatgtatgtggaggctgtgagcgaatcaaaaacactccgattccttattcctactcttctttcatcaagaaatttattatcctgtacgtttttgccttgcccattgcttacgtgatcaccattggtcttttcatgattccgcttaccgttttcgtatattatgtactgatgagtcttgagctcattgcagaagagattgaagatcctttcaataatgatgaaaatgatattcctatggaaacattggctcagaatattgagaagaatgtgcatcagattatgatcagaaaataaaaaatcaagcttttaaagcttgatttctttgagttcgccgtcctgttttatctctacaaatttgctttccctgttggcagcagaatatccgtagaaaaatgtactgtatatcggggttgaatacagatacgctccatagccgttataggcatcagaagtcccggtctgttgctgataacttgccgtagctgtaaaattgacgatggtttcaagataatatttccccggcttcagcttttcgaatttaaaccttccgtgatcatctgttaaggcttctactctgtatttgaaagcttcttcagacatatataccgtcgtctttttattttcatacttccttctcatgtcgtaaaactcctgaaaataaggcgttacaggaaaaagcatgacaacagttcctttgggtgcgtaatgcttttctccaagcaatggcttaataccccagttgtttttttgttttgtggaagccacaccttcaatggtagaattcccgaacccaagcatttctcttgccagttttttatcgaaaaaagcctgaggataataggtattttgtgcttccaggtaaataaatccccacattaatatgaataaggtgaataattttttcatagtatatttttgagtcaaatataagtattttactatttttgaaataaaaatagctatgaagtacatctttttattatttttttccgcttctgctctcattatggcgcagaaaccctgcggatataaagacggtttacaggagggagcctgcaaagagttttatgaaaacggacaggttaaaaatgtggtggaatggaaaaaaggaaaactggacggcgatgctgttttttattatgataatggaaaaatacagtccaaaggcgaatataaaaaaggatacaaggtaaaagaatggtcctattttgacaaaaatggcgttcttacgtctaaggaagctttcaggaacggagaaaagaatatttatgacaacagccttaccgctactttttattctcctgccggtaaaataactgaaatttcgaattataaattcaataaattacagggagaaagcaaaaccttccatgaagacggaaaatcggtaaaagacattggccagtatgacaacggtcttgctaccggaaaatggaaagtgttctatccatcaggaaaattacagcgtgaaaccgaatttgccaatgataaaagaaacggcacccgggttcattaccgtgaagatggaagtatagaaaagacagaggtctacaaagacggaaaattaatctcaacaaaataatacaattggtacagaaactaaaactggaagaacttaacagaatagatgtagaaacatttaagaaggttgaaaaaattccgttggtcatcattttagataatatcagaagtatgcacaatgtaggtgcagccttcagaacagcagatgcatttttaattgaaaaaataatcctctgtggaattacgccccaaccacctcatcgagagatccataaagcggcgttgggagctacagaaagtgtagactggtctcatgaagcagataccaatactgctgttgccgatctgaaaagcaatggttatgaaatcatcggaattgaacagactacggacagccagatgattacagattttacgattgataaatcgaaaaaatacgccctgattttaggaaatgaagtagagggaatcagtgatgaagttcttcctaatattgatgtatttttagaaattccacaacttggaaccaaacattctcttaacgtaagtgtatgtggcggaattgtaatgtgggaatttgcaaaagctttaaaataaaaaaactgcatatgtccttagtagacagtgcagtttgaaataaatctaataaaaagtaaaaatgaaaggcgacaaaggtactttatttttttttacaaacaaattttgacggcactttttttgttccatcttaaaaaaagtactgttttcagaaaaagtttcatttaattttttataaattagcacaatgtttatcaaggactatatctcaaaagactttccgtgttttagcctgtctgactccatagagtcggccagaaatatattggaagattttggatattcccatgttttcatcaaaaaatcccaccacttctatggtgctattgccatggactttctgtatgaggaagagggaggaacactgaaagatctggaacatcagatagagcgttttgccattctggaagatagtaatattatggacagtattcgtctgttctatacattcagttccaatataattccggtgatcaataaaaatgaaaaatatcttggctatattacctgtgaagatgtttttcaggacctttcccgctatcctctgttttcagagacaggagctattcttactgtagaaactcctgccagaaagtattctatgacggaaatcaccaatattgtagaaagcaacaactcgaagttttacggcgggtttataagctttatgtctgatgaagtggtccagatcaccataaagatcagtaatgaaaaccttgcctcgatagacgctacttttgaccggtacgactacagaattgttgaaaaatactattctgatgagaaatccgatctgtttaaagaccgattcggttttttacaaaaattcatagaaatataacatgaaggcagccatatattctcagaaaaaagatcttgatacttttttatatttaagcaagtttatctctgaacttgaagcaagaggtgtaaaatctgttctgtatgatgaaatggctgaggctcttcagttttcaaaaatattcgaaactttcaactgcaaacaggatcttctggataaagaggtagatctgttcttcactttcggtggtgacggaactattgtaaattctttaaccttcattgaagatcttgaaatcccggtagtaggagtaaatacagggcgtcttggatttttagcctttttcactaaggaacaggtgtttaaagaactggattctatcttaaaaggagatgtaaaaacaagccgacgttcagtaatagaagtggtttcgcccaagcttgaagggtcttttccttatgcgttgaacgatgttaccgtgtccagaaaagaaaccacatccatgatcaccgttgattcttatattaacgatgaatttctgaatgtattctggggcgatggcgtgatcatttcaacgccaacaggctctaccgcatactctctgagctgcggaggaccaattatctctcccaacaatgaaaattttgtcattactccaattgcacctcacaacctgaacgtaaggcctctggttgtaaatgataaggtagaaataaaattcagggtggaaagccgtgtacctcaatactccctttccttagactcccggctgatccatatagaaacagataaagaaatcattatcaaaaaagcaaaattccagcttcttctggtacagcccaacagtttaagtttctacgaaaccatccgtcagaagctactttggggaagagataaaagaaattagcaatttcttaaaaatgattacctttacacgaaattaaaaacacctaataaatttataacaaaaagtaaaacatgagcagaatttttccggcaggagttgccacaggtcagttggttactgatatctttcagtatgctaaagaaaacaaatttgcattacctgcagtaaacgtaattggatcaagcaacgtaaacgctacgatggaaactgcagcgaaattaaacgctcctgtaattattcagttttcaaatggaggagctgcgttcaacgcagggaaaggattaagcaatgacgggcaaaagtctgcaatcttaggagctatcgcgggagcaaaacatattcacacgcttgcagaagcttacggagcaacggtaattttacacacagaccactgtgcaaagaaattacttccctggattgatggtttgatggatgctaacgaagaattcttcaagcagacaggaaaatctctttactcttctcacatgttagacctttctgaagaatctttagaagaaaaccttgagatttcagctaaatatttcgaaagaatggctaagcttcagatgacccttgaggtagaaatcggggttaccggtggtgaagaagacggtgttgacaactcagacgttgataactctaaattatatacacagcctgaagatgtagcttatacttatgaaaaattaaaagctatttctgataacttcacaatcgctgctgctttcggtaacgtacacggagtttacaagccaggaaacgtggttcttactccgaaaattcttgacaattcacagaaatatgttcaggagaaattcggaacggctgctaaaccgatcaactttgtattccacggaggttcaggatctactttagaagagatcagagaagcgatcgattacggagtaatcaaaatgaacattgatactgaccttcagtttgcatacacagaaggaatcagagattatatgatcaacaatattgaatatttaagagctcagatcggaaaccctgaaggagaagaaaaacctaacaaaaaattctatgatccaagagtttgggtaagaaaaggtgaagatacattctctgcaagattggtgaaagcatttgaagatttaaataacgtaaatactttaaaataagaactgtacaattgtatcaatgtaaaagtattcataagaaatagatttacattgatacattttacatttatacattaatacaaacaaaaatggcattcgactggtttaaaagaaaagcaaaaaacattaccacttctactgatgagaaaaaggacgttcccaaaggcctgtggcatcagactccttccggaaaagtagtggaacatgatgaactaaagagaaataactacgtttctcctgaagacggatttcatgtgagaataggaagtgcagaattttttgacatcctttttgacggtggtaaatttaccgaactggatgccaatgttgagagtattgatatcttaaacttcaaagatacaaagccttacaaagaccgtctgaaggaagtaaaagctaaaacaaagcttacagattctatcagaaacgcagtaggaactgtaaaaggaactgaaatggtagtttcctgtatggattttgctttcatcggtggatctttgggttctgtaatgggagaaaagatcagaagagctgtagactactgtatcgcacataagcttccgtatatgattatctgtcagtccggaggagcaagaatgcaggaagccacatattctctgatgcaattggcaaaagttcaggctaaattagctcagctttccgaagcaggacttttatatatcgcttacctttgtgaccctacattcggaggaatcacagcttctttcgctatgactgccgatatcatcatggcagagccgggagcgctgatcggttttgcaggaccaagagtaatccgtgaaacgattggtagagacttaccggaaggattccagacatcagaattcttacaggaaaaaggatttgtagatttcatcgtaaaaagaactgaaattcaggatacggttgccaaaacagttaatttattggctgtaaaagcatagtatctgtaacaaaaacaatacaatctctctctaattagggagagatttttatttatgaggacttttaagatatttttcaatgccatcagaagtatgagttttaaaaagattatgcgtcttttatcactcatccttccccatcctcttttcgctttactaagtttttatgctacagtaaaggcattcaccattgcacagaaaaaattccctgaaacagcctccaataatgggattggaaatgctttcaggcatgctctctggtgctgcttcattatgatgtactgctgtaagatttcctctcctaaaaaagcgcttgatttttgcaaaagaattacagacatgcatgaagagctgttcccaaatgagcatctggaaaccaaaatggatcttcataacaacaaaatcggaatggattatttcatggaacttttaccgggaattcaccgtcagttttttgaaaaaagcttctttgtagatgcattaatcaaaaaaatggatgatgccaaagttcttaaaagcctggatgacaattttgaggggtatcttgtttatctggaagagtaaatcgttttaagttttaaccgccagggagcgcagggaaaatctaaaaacttaacgtatattttttgttcgcaagagcatttcattcagcaatgttccctaacttaaattctctttgcttagtgctaacgcctttgcgaacgaaaaaatcaaacgtcatcattaaaaacctttgcctacattgcgttaacaatatactttaagattagaagccatcattagttctctttaacaccagaataacaaaagactttagttatttttgtggtttaaagtattttcgataagtttaaacaattaaatcaatcagatggttctcagcagaatttggtcggctttcattatcattgccattgccattgccagtataaaatacgtttcatcaggtaattacaaaaccattttcaatgatatggtggtaggaaaaggtggtgatacagtgaagattgcttcccagcctatgaacagcctctcccctgttgtaagagacagcctgatgaaaaaaaatgattttgcagacagcagaatccactataaaacagattctttaaaacagaatgtaaatgtttaccgcgttcaggaatcagacggagtaatcgggacttcagaaaccgcagttaaaatctgccttggccttatcggaattatgaccctgtttatgggattcatgagtattgctgaaaaagcaggaggcatcaaccttttaagccgtctgatacaaccctttttctctaaattatttcctgatatccctaagaatcatcctgcattcgggcacatgctgatgaatttcagcgccaatctattagggttagataatgctgcgactccttttggtttaaaagcaatggaaagtctccagactttaaaccctaataaagatacagctagcaattcacagattatgtttctgtgccttcatgccggtggtatgactttgatcccggtctccattattgcgatcagagcctcgatgggttccaaaacgcctacagatattttcctgccttgtatgattgccacttttgccgctacactggcagcaatgattatcgtttcattatatcagaaaatcaatcttcttcgccctgtagtgattgcctatgtaggaggaatttcagccgttatcgctttattggtgttgtacctggttcaattgagcaaagatgagctggatgatttcagcaaagtattgagcaatggactgattctcttcattttcctggctattgtattgggtgccgtttataaaaaaatcaacgtttttgatgcctttattgaaggggcaaaagaaggttttacaacctgtgttaagattatcccttaccttgtcggaatgctgattgccatttcattattaagaacctccggtgtttttgatgtgattatcgacggaatgaagtgggtagccaacgttgccaatatggatcctagatttgtggatgggcttccaacggctttaatcaaacctttatccggttccggagccagaggaatgatggtagacacaatgacaacatttggagctgatagttttcagggtaaattggcagcagttcttcagggaagctcagatacgacgttttacgtgatcgcagtatatttcggggctgtggctgttaaaaatacaagatatacggtaattgccatgcttctggccgatctggtgggcattatcacttctatcgcactggcttatttatttttcgcataatgaaaaggtgcaggttgaacaaagctattaacttaaaacattaaacttaaaactttacatccattatgattacagataaagaatttacactaagactcatccgccaattaacccaggcgttggaaaaactgattctggacaaacccgaagaaagtttaatgcagaaagagctggattttgatacgctaatgagagatattttcaagatgaatttcaccgaagtttcctcaatgactaaagaagaaatgattgccctggtcaatgagaggcaggaaagagatcataaagattattatgaaatgcttgggaaccttttctactttaaaagcagagaaggccagaataaagattttcaggataaagcaaaaacattctatgagctgtatcttcagaccagcggtatttttgccctgcctgttatcaacagaataaatgaattgaaaaaagcacttgaataaagtgcttttgtatttttagaaagtaattttataagtaccggttgaagaagtattggctttctccgccttcacatacttcttaacccaggctacggatgtagatgacacgcagggatccgaaatacctcctgatcttcttgctgacactacatttcctgctttatctacggtgtaggaaatcgtaatcgatccgcttgctgtacagctgtgagagggctgcgctcctcctcttcccattgttccgggaatataaccgactaatttcctgtcgattccaaccttgctgtcgccatttccgtcaccccctaaaggatctccagcatttccgataccatcacctgttccctggcttccagctttcgttcctcttcctttgatcaggtttcctatggctgctgttccttttccgtccccatttcctgtttttgaattggctgtggcagcgcccgattttttggtatttttagaagcacttgtactggttgcttcttttttctcagctttttttgattcttcttttttagggactgttgtttttgagttattcccagtgattaccttttccttcacttctgttttcttaggttcaggagtaggtaaaggctctggtttcacaacagtttttgtctccggaacaggtgtttctgcagggtcaggtgttacttcttctgtggctgcggcaaggcttcctggctgctcagcaggctcttcgatcccttttccgtttctgttgtctccaaagttcaccagcattgtggtaaccacttcagggtctttatccagttcgggttttaatttatataaaaaaacaaaaagcaggatagcagcccagatcagaatagaaagcagtgcgctttttaccctgtctttattttcttcgtttctgtttgctgtatagcttctcatcttaaaaagtaaatctttccggaaatccggctatgttatttatctttaacggttgcaatcgcaatgttaaatttatgtttttcagcaatttccattacaaaaacaacatctttatgtaatgtgttttcatcagctctgatcgtaaacgatttattggtctgacctgctaatttatctacaataatcttctcaagttctcctttattgacaggattatcatccacaaagaatgaaccgtcaggcttaatactaacagttaaaggattaggaatattatcgtcaactgctccggctttcggcagattcacatcaatagcactctggttggctgctgaagaggtgatcataaagaaaatcagcatcaacaggataacgtctgtcatcgctgctaaactgaattccggattcgctttatttcttctttgaattttcatcgtaagaaaattataaaggtttattgataaggtctaaaaattctccagacatgttctgagccttcagtacaaatttatcaatccttgtcaaaaggatattgtaacagaagttggcaggaattgctactgccaaacctacagcggtttgccctaaagcggtataaataccttctgaaagtgttttcggagagaaagaccccgtggcatgagataaattaaagaaagcaataatcatcccgattaccgtacctaaaagtcccagcattggtgcaatacttggtactacagccaaaaggttcaggtttttttccatattggcaacctctacctgtgcctgtgcttccatggcacttacaatatctgaaactggacgccccaatcttgaaattcccttttctaaaattcttccttccggagaattctgggttttgcagtaatctgttgctgcctctatttttccagctttgatgaagtcctcaatattgttcatgaagtttgaatctgtttttgaagccagtcttttaataaagaaaaatctttcaaaaaacagataaagagaaaacactcccaacagtaatacggtgaccatcactattttagcgaaagctcctccatggaacataattttccagaatgagaactctaagttgtctgcagcaactgcaggtgtagcgatttgtgcaaataaaatctgagaaagttccgttaacagcattaaatgtgaattttattaaagtttcaacgacaaatgtagtagaatattatgaattgaactcttaaaaattgcttaaaaacaacttaaaatttgttacagttctacaaacagcaaatttctttccaaaaataattctgaaaagaaatccggtattaaaaaatgaagttttcggttagtcttcgtctacttcaatatcatcctgcttgaattcgcattttaatctaaaaggaatcggggtatctgaacccgtatagaaatcatcaatagttcctttccagataacctgaagttccccttcttcatttttttcaaaaagaagctcattatcataaatataggcatcttcgtcatcgaatagatctacttctgtataggtctcttcatcagagtcattgatggtgatggtttttccttctatttccgcagagtcgatagggaaatcgaaaatttcaagtgaaagctgcggaaagttgtactgtagtgaatcatcatctacgtgatccaaactgtcatccgtaatcacttcaacctctaaaaagtgttgctggttgctgtaaactgctttacaataagtatttctgatattgtattttagcgtttcttccggatggtaaatttttaaaatccctttcattttttcttaaaaaagaactgtaataatatgattgttaaacgttttagacaaagatagaaaattgattcaaagttgaaaggattttgaaaataattttttaaaatcaatgcataccataagcctgaatatcccaataatacttacttttgttttcataaagattctgaaaatgaaaaacattttatcaaaaggtattctggcactgggattgatgataggtcttgcttcctgcaaaaaatcggactctccccttacaaaagtgaccccaagtaatctggattctattgcttccaactattatgagcaatatcttaagctatatccaatggacgctacagcacagggagatacaagatataatgaccagcttcctattaatattgataaagactttatctcaggagaaatagcattctacacttctgtacagaaacaactggaaaatgtagattataagaccctttctgatgaggataaagtggtatatgatgttttggattacactttaaaagataaaattgaggcttatgcctatcatccggaatatattccgtttacccagtttggcggtcttccgcttacttttcctttatatggaagcggacagggtaaccagccttttaaaacggaaaaagattacagcgactggctgaaaagaatggaaaaattcccggaatggatggatgctgctgcagacaatttccgtgaagggatgactaataaaatggtccttcctaaaaagcttgttgttaaaatgattcctcagatgaaagccgaggaaatcacaacttctgatatggaaaagaatattttctacggcccgatcagaaattttcctaaaaatttctcccaggctcagaaagataaattttcgacactttacaaagaagccattgcgaaaaagattatcccggcctatattaaaatgggaacgttccttgaaaaagaatatcttcccaaagcaagagataccgatggatacaacagtcttcccaacggtaatgaaatttacggctattatgtaaaaagctggaccactaccaaaaaatctcctgaagagatcaataagatcgggttgcagcaggtagctatgcttcgtgcggaaatggaaaaagtaaaacagcaggtagggtttaccggaactctggaagaattcatcacatttgtaaaaacggatccaaaggcgatgccttataagacttccaaggaggttttaaatgcatttaacggcattttaacaaaaatcactccgaagctgaaaacgatgtttaatgtaacgccaaaaacaaagtttgagatcagacagacagagaagttcagagaagcaagtgccagcgcagaatatatgcctggaactccggatggtaaaagaccgggtatattctatgttccgctgccggatccttccaaattcaatgttacttcaggaatggagtctcttttccttcatgaggccatcccagggcatcattatcagatgtctcttcaacaggaaaatacaaagcttcctaaattcatgagattcggatggttcggagcttatggtgaaggatgggcgcactattgtgaaacattaggacctgaattcgggttgtatacagatccttaccagaaaatgggctacttaagcgatcagatgctgagagcggtaagacttgttgtagatacaggacttcataccggaaaaatgtcaagagaagaggcgatcaaatatttcttaagcaacatttcctatgacgaaggatctgctactgcagaagttgaaagatacatggcaatgcctgggcaggctttaggctacaaaataggctctttaagaatccgtgagctgagagaaaaatatcagaaagagcttggaaacaaattcaatctggcaagcttccatgatgaggtattaagtcagggatgtcttcctctggatgttctgaacaggaaaatggagctttgggctcaaaagcaaaaatagtttcaatgaaactatttttatttttttccggtattttattgatgactttgagttgtcaaaaggaactaaattttgaaaattttattattgacacaaacttacctgataatgatactattctacttctctctaaatatccggaactgaagctttacaatagtgaaattgttgaaagtaaatcaagaacagcacatattgttcaggctgctagttattcagatggttttcgtaaaggaatatttctattcgacgattacaaatgcaaagctatcactcaggctgatacgcttaatattaaattgaataattacaatggatattttggcaacgggattttgattaaggtatttaacaatcagttttatataaaagatattgatcctaaaacattaaaaggtgaagaaaaattcaaaaaggtccgtgttttaagtcagaaactgattctaaatagtaacaaattcaataaaaatgacagcatttatggcttcatagattataaatgcagtattgacagcttagtttataagcgctttagaggatattttaaaactataatactataaaaatcaatatgatcacagaaagcctcagatctctttacagcagagatttaaataaattaaaagcagaaatagaagcttatcagaatgaagaaaatctttggaaaactgataaaaacatagccaactctacaggtaatctaacacttcatcttgtcggaaatctcaatcattttctgggaacacaccttggaaacacaggatacgtaagacagcgtgacctggaattttccttaaaagatattccgaaggaggaacttattgaaaaggttacagccactgcaacaatgatagattcagtactttcccaattgtccgatgaagacctgaaaaaagaatatccattggttgtttttgaaaatgcaatgacaactgattactttctgatccatctgcttgcccatcttgactatcacttgggacagatcaattatcacagaaggttattggacatttaatccatccataaaaaactcaaataacgcaacgatcacaaagtaattgttgcgttttctattagttggcaagggcatttcacttagctaagaaaatattgcctttgctcaacgaagtgcccttgcgaaccttttcaatctaaattatcataagtacttgcgatcttagcgttaaaaacaaggcaagttatttctcaaataacattttcgtaataaaatccttttctccttttcctcttgccggagaatattctcttccatagaaaatgatctgaaggtgaagcttattccatacttcttcagggaataatttcttggcgtcacgttctgtctctacaacattttttcctgatgtaagcttccactgtgtcatcagacgatgaatatgggtatctaccggaaaagcaggaaatccaaaaccctggctcatcactaccgaagcggttttatgtcctacgcccggaagagcttccaattcttcataagtctgcggaacgataccattatgacgctccagcagaagttctgccattcttttaaggtttttggctttggtattggacagtcctatttctttaattaattccttgatctcaaactcttccagcttggccattctctgcggagttcctgctacggcaaaaagatcaggagtcacctggtttacttttttatctgtggtctgcgcggaaagcgctacggctaccattaaggtatatggatcggtatgatccagcggaataggcgttgtgggatataatttgtccaattctctctgaacgatctcagctctttgtttttttgtcatgtaacccttaaatttgaacaaaattaaatcattatgctgaaagttggagataaattacctgaatttgaaggaatcaatcaagacggagaaaccgtaacctcatcacaattaattggaaaaaaactggtagttttcttctatccgcaagcgaatacacccacctgtacggtagaagcctgcaatctgagtgacaattattcaaagcttaaaaaagcgggatttcagttattgggagtaagcggtgattctgtaaaaaaacagaaaaatttccatagcaaattcgctttcccttatgatcttattgcggatgaaaaccgtgatatcattgaaaaattcggggtatggcaggagaaaaagacgtttggaaaaacgtatatgggaattgtaagaactacttttatttttgacgaaaatggcgtttgcacaagagtgattgaaaaagtgacgtcaaaaactgctgctgagcagattctggaaggataatttttttgaacacagatatcacaaatattttcacaaatagcacagatacataattgtattatttgtgaaaatatttttatgattgatcttattcggtttcgtaatagttgagctcttcggtttctccgggcagtatgacgtgctttttaaacctcaatcccagcttttcaatgagcttctgtgaagaaatattatccttggaaataatggcggatatttttgttaatccaaagtcatccatcccaatagatttaaccttcttagcggcttcaaaagcatagcctttgccttcaaattcttccaataaagagtatcctatatccacgatatcaagcccctctctttcgaagattcctacggctcctactttttcatttccttctttggtcactaaaagatagtttccaaatcccagtctttcaatctgtggagcaaatctgttcagaatataattttcagcatcttcaatagaattaacattgcggttaccgatgtactgaataaatttaggcctgttgtaaagctcaaagataaaatctttatcttcacgggacattggacgaagaattaatcgctcagtctcataagtattatctgcgcttggatgttttttggggctcatctttctttggttcttcttttttttcgatttttaaaagtctcgggttattagcacatttcttattgtaaagctcaatataggttccattatcttttacattgcttacagtacctgtagatttacttactgttacagtataatgtgttttctgataaggacattcctttgaggttagctttccaagatcaagatagtaattcgactgatcttcatggtaattaccagcaagatccttgaactcttcatctaccatgtatccgtctgcagctaatataattgctgcctcttgggcattatcaattctgtctacaaacttttttagtccgtcggcatcagttacatagtttactttaccgccttctgaataggcaatgtaataaaaactgtcttcgctgggaaaaagattgaatcctgagaactgaggagtataatttaccttacccgaagtctttatttcctctcctttcccatagctgttgtataccagcacccaggaatctaccctgctgcccgggatgatctgctgtaaaatagcaggaatgctcgaaaatttctttttctcctgagcatatgctgagattcccaaaagcaggaatgtaagaattgtaaatcgggttgcagttttaatcataatttaaaaatcaccagaaatataccaaatattacatgaacttctcgcctttcttaaagttttttaaatcaagaacataatctttaataagctggtcattgtctctcgggcagataagaagtgctttatctgtatcaacaacaatgtaattttcaagcccgtcaataattacggctttgttattattctttaagcggatgatattcccttttgaattataagagagtaagtgcttcagctttacagcgtttccgtctttatctttttccgtattttcatatacagatgtccatgtacctaggtcactccaacctaaatctgatggaataacgtatacattttttgctttttccaggatcccgttatcaatagaaattttctgaacttttggataaatggtttcaatacagctgttttctttctctgaattatactcacatgccataaaatgctgcatcatttcaggaagataaagatcaaaggcatggtgaatacttttcacattccatacaaaaattcctgcattccaaaggaaatcaccactttccagaaagctttgggcaatttcaaggataggtttttctgtgaatgtttttaccttaaagtattctgaaccttttttttctacaaactgaatgtaaccatagccagtatcaggtcttgtcggggtaatacccaatgttaccagataatcattttttgatgccagctcgaacgccagctccactttctccaaaaacacatcttctttaaggatcaaatgatccgccggcaatacaatcatcgttgcatccggattgatttcagcaattttattagccatatacaggttgcaggccgctgtattcttcataagcggctcacccacaatattttcttcaggaatttccggaagctgctgatgggaaacagaaacatactctttattcgtaattacgaatatctgttctttaggaattaccttgctgattctgtcataagtctgctgaatcattgtgcgtccggttcctaaaatatcctgaaactgttttggaaatttttgcgtactcatcggccagaaccggctcccgattcctcctgccattatcacgcaatatctatctgaatttaacattcttagctacatttttctaccctcgctaaaggcttgaaagaatacttccttccagtagccaggttcttacaaagatagttttttttaaccagaccttccaataaatacttttcgttgcgatagataaaaaattctccctttttaagttcctcgataaactgaagggtatcatcttgtttttcagtatgaaaatatcttaccagatcggggctggccatgaaatttgctttgggcgattttgaaaattttatgataatgggttttagttcttcatcataaatttcaaggctttccaggagcatatttctgaatgtttccttccactcatttccgtgaggagagattcttctgccgtatttttcgaacgcaataagatgggccagctcatgagtcagcacaaagaaaaaaagttgtggagtaagtgtagagtttaccgtaatttcatgtgaattgtccggaagttttctgtaatctcccagtttcgaattcctgtttcttgtaacttttatatgtatataataatctgaaaaccagatttttaaatatttaagtgtattttgaggtaagtatttttctaaagattgaattggcattttacaaacttaatggaattcctgcatagaaattcaatagtttaagactaaaaaggtaattgtattttgcctgcgctactgatccctgtgcatttgcataattatttctcgccacgtttacgtcatagatggttgttcttccggcagcatagcttttatcggcaaaatcaagagccagtttggagcttttttcagcttctaccgccgccagataggtttcataattggcatcagcatcaaactgagctttctgtacattctgtcttactgtctgcttctgctgctccaacgcatttttggctatactttcgtttattttagattgttctacctgtaattttgtttttcctttattaaagattggaatattaagcgacaaccccacattttgtccgaactgatctttatattgttcaaaaaaagttccctgtattgtacctgggataggatcaaattgtctgttatagaaagtattaagaccggcgctggctgttaatgtaggccagaatgctgttttggttacctcagtttgtgcctcggcagatcttattctgctttctgctgctttaatctgaggttgtatctcatatgctgttgtaagtacttcatccacggaattaagctgtaaatcaagcttatccggaacatttacatcttccacatcaaaacccttataatctgacagttgtaaaagctgaacgatagcaaacaaggcacgtccaacgtttacttctgctgttttaagattttgcttttctctagccagcgctgcttcagcctctgctaaaaccgtctgtgcagtggttccaacctgagttgtgattttagctctgtcaaactgtttctgagcattgtccacagcactctgagagattttaacgatctctttattcagcaaggcggtcagatattgttgagcaatctgaagggaaatatcatttttaatggtttcaatatcatactgacttgcttctacatcaaactgggcttttctgatattcttctctaatcttccgttattatagagcaaaatatcggcacccagaccaacactgttattgaatctatcgtttctaaaacttccggcacctaaggatccttgtccgaaactcaccccattcgtcatacttgccgatacagaaggcaaatattctttttgggcagctttaagattatattcctgattttgtttgttatactgattttggataacctgaagattatgctccactgcatagcttacacattcttttaaggaccatttcttctgagcgcttacccccagataacctaatccaaaaacgatgatccaaacttttttcatatgtatatgtttatttgttttttaatggcatatgcaatcgtgtcatgttcattcagtactgtaacctataaatcacagcgatttcatattaagatttttcaatattagacgaattaaatataaaaaagttacagattgaaaaattatattttattttaaaaaaacttttgggaattttgcaccatgacaaatgaacaatatcaggaagctatcgactggcttttcgtacagatgcccaactatcagatagatgggcagaaggcttataaacccggacttgataatattacaaagctttgtgctttctttggaaatcctcaggagaaaataaagtgtattcatatcggaggcactaatggtaagggttcttcaagcaatatgctggcatctgtccttcaggaagccggttacaaaacaggattatacaattctccccacctgatcgattttacagagcgtattaaagtcaacggaaaaaattgtgataaagaatttgtctttgattttattcagaaactaaaacaacttcctgaagatattcgtccttctttttttgagttcactactatcatggcttttgaatatttttacaggcagcaggtagattttgccattattgaagtcggattgggaggaagactggattctaccaatattattacccccttgatttcggctattaccaatgtacagctggatcatcagaatatcctcggagataccattgaagaaattgcaatggagaaagccgggattatcaaacataatattcccattatttcaggagacgagaatgaaactgttcaaaatatcatcaaagagaaagcagcgaaggaaagtgccccattgatagatgctactcttataaatacagatctggaatctgacctgaaaggagattatcagaaaaaaaacatcagagtagtgatagccgctgtagaagaattaagaaaacttggagtacatatttctgatgaagatcttgaaaatggtctactgaatgttcatcagaatacaggatttatcggccgctggtttgagttctcaaaacacccgcttaccatttgcgacacaggtcacaatcaggcaggtctggagtatgttttttcacaattaaattcgattgaccgtcacaagcatgtcattttggggtttgtaaatgacaaaaaaatagatgacgtgatgaaattacttcctgaaaattctgaattctatttcgcaaaaccatccatcaacaggggaagacaccccgaagattatgaaaacctgcttcaggaggcgaaaattttttataaaatttttgattctgtacaggaggcgtatctgtctgcaaaagaacgatgtacaaatgaagaaatgatttttatcggcggaagtaactttgtagtgggagattttttagaaaaaaatttggagattaaagaataagtcgtatatttgcaccactctaaacaagagaacaagtctagagggttcttagctcagttggttcagagcatctggtttacacccagagggtcgggggttcgaatccctcaggacccacagaaaaggaaacgaaacctttcaaaaaaattcgggttcttagctcagttggttcagagcatctggtttacacccagagggtcgggggttcgaatccctcaggacccacaaaaaatctctcagatttctgggagatttttttatttttaacctgattaaaccttcctttctacttttcctgatatttatttacctttgtctgcatcggattaattaaacgtgaaggaactccatattatatcattcaattatccctaccctccttcttatggtggaatcattgatgtatattataaaatcaaggctttatctgatctgggaataaaaatccacctgcactgttttacagaccaggttccttcaataattgatacagaaattaaagatattacggaaaatgtatttttttaccggaagaaaaagaatcctttgctttatttctcgccagttccttttgctgcagccataagaaactctgatatccttcttaaaaatttagaaaagaataaagctccgatcttgttcgaaggcttgcagacaacgcatattataaggtttttgagagatagtgaacacaaactctatctccgttatcataacaatgaatctgagtattataaaggcctctcattatctgaaaaaaacatttttaaaaagatcatttataaaattgagtccttaaagtattacggatatcagaaaaaacttttaaagcaatttgaaaccgtattctgtctttcggagaaagaatatcaggaagtaaaagcctgttcggagaatgcgcagcttgttcacatttttcacggtaatacatcagtaaaggtattggatacaaaaggaaagtattttctttttcacggcgatcttactaccgctgataataaaagagcattgaatgagaccattgacttatttaaaacgctgcctcaatataaactgattgtagcctcagatcgtgccactgaagatattaaaagaaaaatttcggcagttgggaatatcactctcactcctatccaaacgacagagaatctccaccagcttctggaaaatgctcatgccaacattctgatttcttaccagaactcaggaactaaagtaaagcttttcaatacactttacaacagtcgttttgtcattatatctgaaaacattacagatgatcctgttttgaagagtttatgtttttttggatccgatatgaaggaaatccgccagcagattatcacctcagcagaaaaagagtatcatgataccgaaaatagaaagaaaacattagaaagaacccactccgatatagctaaagccgaagcgatggtgaagattatttttaaaaattaaccctatccacgaccttctggatattaaactcctcaagacaagcccaatctcccctgtaacattccttatctccaaatacagaacatggcctgcagctaagatctttcacctgaacaacatcttcttcactctgcccgaaccctaaaaatccggcataaggatgagtggctccccagatagaaacacatctcgttcctacaagactcgcaagatgcatattcgcggaatccatagaaatcataagctcaagttgagaaatctgatgaagttcttcagtaagatttaattttccggagagatttttggtatttgggatctcactttcccatttttcaagagtttctgtttcttttttaccacctccaaagaaatacacagtatgttttctagcgagaatcctggccagctcatatgatttttccagaggaagcattttccctttatgctgggcaaaaggtgcaaaaccgatccctgatttattcattgaaacaggtctgagttgatgtgaaagctctactttgaatcccatatctcgaaaaacatccgcataacgttccaccgtttttttcagctgtaccttttccagattccagacatccgtaagatgctctttctcttccttacctttatcaattttgaagaccttaaatccttttctcctgtatattctgtctaaaaccttggtccggattacatcatgaaggttagcaatacagtccggattaaactcacggatcagttcattactgagttttctcaatccaaaaaaacctttgtaatcatccagatcaattcctttaaaagttacattaggaattcctgcaaacaaagcctcaaaatttttcctggaaaccataataatttccacacctggattctgctccagaaattctctgaaaacaggcacagtcattgccacatctccgaatgcggaaaaacgatatgctaaaattctggtcaccgttatgatttcagttggtaagcaactgcataaaacttaatctgcttcgtcatcgccatcagtccgttggctctggaaggagaaagaaattcctgtaatcctatttctgcaataaaatcaaaatcagaatccaggatttcctgagtggaatgcccactgtaaatgcttactaaaagcgaaacaattccttttggtaaaataccatcagaatctgcattaaagaaaagtttcccatctttgaattcggcatcaatccaaactttgctctgacagcccttaatcaggttttcctccgtttttctgtcttccggtaagcctttcagttcttttccaagatcaatgatgtactcatacttttgctcccagtcttcaagaaaagcgaattcgtcgattatttcctgctgtttttctttaatggtcattttaaatcaatttcttgtgcaaagataaccaattttgtaaaatttattgccgggatgctttttcaaaaagctgcaggatttttgcctcttcattctcccagcaaaagacgtctgcggccttattcagctcactctgataatgtagtcttcctctctgaaggactagatttatcgctttttcaatggtctcaggctggtgatcaggaacaatttctcctacatcaaactgattttttatcctttgcatctccgggaaattaatcatcacaagcggtactctcgactggatataatcacaaaccttattgggaagtgaataatagtagcttactccgttattctcttcgaggctaaaccccacatcagcagttttggttatctctctgagattttccggcttcagtttgccaagaaaaaatactttatcctgaagtttttccctgatgacaagttcttcataatctttctttttcggaccatcacccgctattttcagaacagcatctttaatgtgatgcatcgccacaatcattttttctattcctctggattgattaatcgctccctggtacaaaataattttaggatgattttcagaaatttcaggagcagaaagaatttttctcgggatatttcttaccactaccggattgacattatattgttcgtgaaaccattcagcatagctttcactttctgtcatcataagattcatgtgaggaaccagctttctttcaagtactctccagaatttctgcgaaaaccggttctgaaccgatggcatttccgtgaaaatttcatgactgtcaaagactaaaggaatattcatttttctggaaatgagataatttggcagaagtgcatcaatgtcattggcatgaagaatagtatctttgtccgcttttttcttcagttctttatataatttccagttgaattcaaaataagcagtcttcagacttttagatttcagagcaatccttgaaaatggatatggacgctccattttttcattcccttgccagtcattccctatcagatctatggaatatccgttatcaaaaagggttttgcacaccttttcgatcctctggtccgtatacagattactaaaagccgaagtaattatttttttcctcatgaactcttcttacctagtattaaatgatagatctgaatgaagcagattaatccgtttggaatgataaccggccagagcggtccgctgaagaagccataaatgacaaaacaaatgcagccaatcatattgacaattctgatttttcttacatctttcagtatgaaactcaatacgataaaaagagaagcagaatagccgatgtaagtcgtaagttcaggattcatggggaaaatttaaggatacaaacttaatcattttcaataagataataaatttttttctgccataaagtcattaattgatttttggtaaaatatttgtaatttagataatgaataaaaggtaatgttgcctttgttctaatgagatatattatggattataagttttcacaaggtttgagccaggtgttcaaacaaagcaaaagcgaagctaaaaggctgaaaagtgaatttcttaatacagaacatctacttttaggtattataaaaacggaaaactctgcaaaagaaatccttcaaaaccttaatgcggatttaacacaaatcagaagaaaaattgaaactttaaatacagcaagtcttaatcctatttctgaagaggttaccaatatttctttcaccaagatggcagatcatgctattaaacgtgcagagttagaatgccgacaatataaaagcaatgaaattaataccgttcacctgcttttaggtattctatataaatatgaggaccctacttcaaatattctgggagcttatgacatcgactatgagggagtttcaagagagtaccagactatgcttaaaaattcaggtcaatctccacagatgagcgcttacgatgatgatgacgagagagaagaatttgagcaaatgagaaagcctacaggaaatctaggttctgcaaaaagtaaaacacctacattggataactttggtagagaccttacttctttggcaagagacggaaagctggacccagtgatcgggcgtgagaaagaaattgagagagtttctcagatcttatcccgcagaaagaaaaacaaccctcttcttatcggagagccgggggttggtaaatctgctatcgctgaagggttggcattaagaattcaacagaaaaaagtgtccagagttctttacggaaaacgtgtgatcactttggatctggcaagtttggttgccggaactaaataccgtggtcagtttgaggaaagaatgaaggcgattatgacggaactggaaaaaaacagagatgtcatcttatttattgatgagcttcacaccattgtgggagctggaagttctaccggaagtttagatgcttccaatatgttcaagcctgctttggcaagaggtgaaattcaatgcatcggggcaaccactctggatgaataccgtcagtatattgaaaaagacggagctctggaaagaagattccagaaagtaatggtggaacctacttccattgatgaaaccattcagattctgaaccagatcaaagataaatatgaagagcatcataatgtaatttacactccggaagccattgctgcgtgtgtcaatctgacatcgagatatattacggaccgtttcttaccggataaagcgattgatgcgatggacgaagcaggatcccgtgtttatatcaaaaacatgaaagttcctactgaaatcattgattttgaaaagaaaatcgaagagatcaaagaactgaagcagaaagcggtaaaagctcaggattacctggaagcaagaaagctgaaagatgaagaagaacgtcttcagatggaactcaattctgctcaggaaaaatgggacaaagatgtaaaagagaaaaaagaaaccgtaacggaagaaaatgtagcagaagtggtttctatgatgagtggagttcctgtaacaaaagttggtaagaacgagcttgacaaattagcacagatggatgataaactgaacggtaaagtaatcgggcaggaagacgctgtgaaaaaggttgtaaaagcaatccagagaaacagagccgggcttaaagatccgaaccgtcctatcggtacctttattttccttggtacaaccggggttggtaagaccgagctggctaaagtaatggcaagagaattatttgattctgatgaagccttgatcagaattgacatgagtgaatacatggaaaaattcgcggtgtcaagactggtaggtgctcctccgggatatgtaggatacgaagaaggcggccagttaaccgaggctgtcagaagaaaaccttatgctgtagttcttttggatgagattgaaaaagctcacccggatgtattcaatatcctgttacagatccttgatgaaggtcacgttacagatagtttaggaagaaaaatcgatttcagaaatacgattatcatccttacatccaatatcggaaccagagatcttaaagatttcggagatggtgtaggattcggaacatctgctaaaaagtcaacttcagatacaagagcgagaagcaccattgaaaatgcccttaaaaaggcgtttgctcctgagttcttaaacagaattgatgatatcattatcttcaactctcttgtacaggatgacatcaagaaaatcattgatattgaactgaacaaattgtacggcagacttgaaaaattaggatataaagtagagcttacagacgaagcgaaagactttatttctgaaaaaggttgggataaggatttcggtgcaagaccattgaaacgtgcgatccagaaatatattgaagacttattggcagaaatgctggtaaacaagcaattatctgaaggagaaaccgtagttcttgaccttaacgaggctaaagacggactgattggaaagacgcagaaagcaaagaaatcagccgctgagaaatcttctcagtcttaatgaaaaataaataatttaattcaatagaaaagcatcgggaatattttccgatgctttttgtttttatcagttttggctaaagccaatggtattttgaatattgtactgaacgggctgaagcccgtccctattgatgcatcaggttttaaagccccaccacaaaaccgatagtcggaaccaggccacttgaaaacacactggaattctgcttccagagcacattatacattaatcccagctgcataaaagaattatttccgatccgctgcatatatcctccacccagatataatgcattttcttccgtattatatttgtaatcgtaatatttgtcattataatcaatgaaataatgttgatagttggctcctaggtaaaatgatctcgcaaaataataattgacaaaaggacctaccccgaacattgttgatttataataatcggaagtctgccaggaaacggttcccactactcctccttccagatcatcagtgagcctgtaacctactctgggtgaagcagaaaggttaaaagcactgttgcttccaaatcctaccccgatgcctcctccgaaggtccatttgctgttttcctgtaccggtgcacctacagaaacctgggaaaatactgatcctgaacctatcagcatcacagaaataataaactttttcatatttagatatatattttgtttgatgatattttattcatccggcatacattataagccggttagataataattctgattactatcgtttttatcaatgtttaaaattatggtttttttacgactttattagttgtatttttgccgcatcaaactaagaactcccgttaagagtttcgtaaaattgaaatacaatgaaaatagtagtaggcctctccggaggtgtagattctagtgttacagcttatttgctgcagcagcagggccatgaagtagtggctttattcatgagaaactggaacgatgcttccgtaacattagaagatgaatgtccctggattgaggacagtaatgatgccctgatggtggcacaaaagcttggaattcctttccaggtgatagacatgagtgaactttacaaagaacgtatcgttgattatatgtttgccgagtacgaaaaaggcagaactcccaaccctgatgtattgtgtaacagagaagtaaaattcgatgtttttatgaagaccgcaatgtctttgggtgcagataaggttgcaacaggacattacgcaagggtaacttccacttttgatgaaaacggtaaagaaatttttcatcttcttgcagggaaagacaataataaggatcagtcttatttcctttgccagctgagccaggatcagctttcaaaagcactcttccctatcggagagcttacaaagccacaggtaagagaaattgcgaaagaaatagggctggtaacagcagataaaaaagattctcagggattatgctttattggaaaagtaagtcttccacagtttttgcagcagcaattgaaacctaatgaaggcgaaattgtagaaattttcaaagattctcctcttttttcagaagaaaaacctgaattttcctctaaagaagaagagctggaatatttatcgagaaaaatcaattataaaaaatccgacggaaaagttatcggaaaacatcagggagcccagtttttcacgatcggacaaagcaaggggcttggcataggcggacacaaagaaagctgttttatcatctccagagacatggaaaacaatatccttttcgtaggagaaggaagccatttcccgggccttcataaaaaagcattgaaaattgataattcagagctgcactgggtacgtgaggatatgaaacttcagaatggagaatctatgaaagtaatggccagattccgctacagacagcctttgcagaaagcaactttataccagtttgaaaatgccttttacattgagtttgatgaactccagtctgctattgcagaaggtcagtttgcatcatggtacattgatgaagagcttatcggcagcggggtgatttcatgagggtttttgagtttcgggggcgcaagttccttaatgaagaggttttaagtattttaaaagaaaatgatttttaaaatttttctgtaacgttttttaagttatcgtacttactcagtaaataacaataaaaaatactactatgaaaacatcttcaaaaaatcagtatgcttatgcaaacaatatcctgattactcttgtatctgcggtttttggttataatctttatcaggccattgtacatccggaaaaatcaaacatcatactggccttaatgctggtaattctgacttccgttatggtcaggaaatatggacaccaaccgaccaatgaaaagaaagatatttaatatcaaccctacataataaagcccggaacattagtttcgggtttgtttttataaatttttatttaatctttttattaaaatgaattaacataaaaaccaatgtaacaatgcattctgctattaaaatcataaccagaaatcctacaggtttttccaatacaattcctcttatcagctttatgattaaagccgttaaaataaaatgtcacttctgaaatcttttctctaaaagaattgagtataaaagtcgagatatagaaaccaagaatcagtaaaatgtagaacttcaggaaatcgggtcctttaagcgcgacaggattaaatgtctgataggttgtccaaagccatatgaggctgatcgcaacaggaactgagtgtatgatgatctttttcataatcattagttttatccgccacagcctccacatccaccgcagcctcctccacatccacctcctccgctgcagcttgatccgccacagcttcctccatcattatctgccttcttttttccatcggggtctgatgcttcatgatctccaatggcagatacaaccactcccaaaatgaaaataactgcaaatacaactcctgttatgagcaagcctgtaaatccattgccttcagtacatgagaacagcatcaataaaatgaaagccggagcaaaggaagtaatcttttttacccaggtctgcactttagatttcttctccggcattttccagatttcttcgggagcttcctgctgaaatactttcctgtaggctgccaaggtatcttcaaaccaatttttatgtttttctctttctgcaattcctccgttggatgggtgatgatgaagtggttttttcagaatattccggcaaaattcttcccaatagttcttggtatagatcagatgcatatgccataccttatctacaattttactgggagaagccccgttgggaagaatacaacagaggtaaacaaactttttatattcttctattgcctttcttacaaaaccagggctccagttttcctcttttgccagcttttttgaaaagggaaaatcaacgccgggagcatccagagaaaactcctgtattcgtttccaaagagattcgtcttttactatcatttttgtttccattgttttactatttgttttctattcaaatatcaatggattacaaaatataaaagtctttcataaatcttttttggtttgataaaaatcttaaattagtcttataaaattaaccaatgaaaaaggaagatattctgcatctcgaaaagcttatgaatttcctaagcaggcagtttttaaagaaaaaccattgggaagatgttaccaaaactgaatggtcttatataagtgctgagctgaacgatctgattgtaagtgatcattctgaaaagaagataaaaaaagaacctgatcttctgggaacaaattatctgtatgagcatctgattatcaataagctgaaaaaattcagacagaatgaaaatgctgttctgagcagaccaaatcttgccaaactcagccttatcgtcaaagtgctgggttattctaattatatagatttcattaattctaatacggaatcattcaattttaatgacctgagaattgaaatgaacaatgtcaatctgaatacagcactattagaccgtttggtgggctgctggtattcttataaccgaaatctgcctgataatcctttgatggcgaaagaagaccgtatatggcgttctgcgatggaaatttataagtctgaaactacgggagaatattttattgagagaagcggcggtgatcaccataaatattttggaaaagtgaccgcctactcagattatgttttcatcatcatgaacagcaatacttttatccgccagaggcattttatttcaaggataaaagatattaaagagaaacttaaaaacccggactataaactccacgaaatccactttataagcacttgtataagcttcaaccaggagccgattgcattatttgaaattttcagaaaagcagacaggaaaaattttatttccgactccatcagttttccgattgatagtgatgagattccggaatctattgtaaaacaacttgaagatacagaatccaacaggattgattacagatagttaagacatacagatctaccaaatggtgctatatgttggcttacattatatttctcttatgcctggaatacatttaatcattcaaaaccaacagattgctgcaataattctttaacttgatagttcataaattacgaacccctcaatggcaccgttatggaatattgtgaattgtatgaagtattgaagagtcattttgattcaggaaaaagcacgattgaaataaaggagctgaatgtaaccattgaatcagttccttttgagtctaaagtttctgaccttctgtacggttcggaacatcagcattgcaataaacatcagcagtctctggaaatcaatgaaaaaggatatcttctttatcatcatcctacggtagacatcaaagattttgagattgaatgcaacaaaaggtttgaatattacattctgaagagcgcagatattgaaaaagctgatggatgcatttttttctttcatggcctgaatgagaagaaatgggacaagtatcttccgtgggcttatgaactggctcaaaggacgaaaaaagccattatacttttccctatcgcttttcatatgaaccgtgcagagcctatctggagcgatcgccatcacatgatggaagtagtacgtttcaggaagaaaaagtatcctgaaaatatgaattattcttatgtaaatgctgccataagttcccgcctggaggctcatcctcaaaggatgttctggtccggccttcaaacctattctgatattaccgaagtggtaaaagatatcaaaaacggtcacttaaaaagtatttcccgggatgcaaaattagatttattcgggtattctataggatctttcctttccatgatcatcaaaatggctgatcctgatcattacttttcagaatcgaaagttttctgcttttgcggtggaatgacgatcgaccggatgtttcccatatccaaatacattatggatacccaggcaaccgtcaaaatgcagtctgtttttacggagcttctaagctcggattttaaatcagattccaggcttaaacattatcagaccgaggcattacatccacaggaaagctggtttaaaaagatgctacgttataattattttcagaaagaaagggaagaaagaattcaggaaatccaggcacaaatcaaagcttatgtactggagaaagatagtgttgctcctccaatggaagccctaaatacgctgcagggaggttacaggaatatcaatgttgatattgaaatcaaagattttccgtacgaatattcccatatggttccttttcctcttagccataagcacaagaaggaagttacagatgcctttcaccattttataaaatctgccagcgatttctatggcagttgatcattctctttttttagggataaaaaatagaaagaaacagtttaaaaatcaataatacaagatccatggtgtttgttttttatgttaatttttatcagctgaccagccaatccttgaagtctttcacccggtctctgctaactgtaatttcatcttccggctgaaaatccagatccactttataatatggtgaagtgtgaatgtttttgatataatccgaactgataataaactgcctgttgacacggaaaaactttttttcatccagtacgtcttccagctcatcaagtgtaaaatctgatggataagtacggtcttccgtctgaaggtaaacgattttgttctcactgaaaaaacagcttatttcgtgagtctgtataattttaaggttataacctattttaaccagaactctggaaagcgttgatttttccttcctgatcagctgtttgatatcctgagaagcattggtatcactggcaggaatgaatgatttgaacttctctacagcgccctcaagatcttcatcaaggatgggctttaatagataatcaatgctgttcagtttaaatgctttcagcgtgtactggtcaaaagctgtcgtataaatgatgaaacctttggtaggtaccttttcaaagatatcaaaagagagaccgtctcctaaaacaatatcggagaaaatcagctggggatgttcgttttcagaaaaccaggcaactccttcttctactgattctattttagcaactatttcaatttcaggaaagttacccagcattctttctaatttccttgaagccggtttttcgtcttctataatgacagttttgatcattgagctttacttttggttttcagattttgggaaataaaggtagataaaagcgcagatattttaatagcctatcggctttttctcttttctgagttctttttcaatcatttccctttcccattcggaatcaaaaagaaacagctttaaggcttttacaagaaggataagtccccatattccaagtatggcatatctgtcgaataattggattctgatcgttttttcatcaaaaatatcgtctggagcaataaggaccgcaacgaccgcaaatataaaaatgcttctgtagaattttttaatgttttgagttcttgtgtacgcagtttgataatccatgattgtataatttttttagttattataggttaaaatgtttttatttttggcttttcttctttatccatcagttcttttattttcctttcttcccattctttaccaattccatatacgttaacggcatgaaatgcaagtccgattccccagcccaatgcaggccataaaaaccataaatatcctggagcggtaagaatattcagtacagctaaaaagggaattacaagacagtaagaagtaagatttccataaaactctttcaattcttttactcttcttgttgcttttctgtaagcaattgtttctttatcaggtaaaatttccataatgttttgttttaaaggttaatttgtttttttcttaagtcaaaggtagttcagaaaaaagcctcccatcaattttatattaccgaacggtagaaaatgatacctgaatggtaagaacttcaacttaatagataaaagggatcagctttttagtactttttctgtaagcgatatattcttctccaaactgctccaccaaagcctgctcttcaattttaatcctgtaggcaaaagctaaaaaaggaggtacaaaagcaaagagtaatgaaagccagttattgagatacaagccaagtccaagtgatgttagcagggaaaaagcataggaaggatgcctcacatatttataaaaaccctcttttttgattttatgatcctgtctgatggtaacatccaccgtaaagtattttcccaaagacctgataataatgtacctgaaaataatcccggcaagaatgaaaaactcaccaaggtaaagaatccagttatctttaatgatcggcaaacgggtattataggataggattactgaactcatgatggaaaagggaatggccagccataagatattaagagtagatctgtccttatcttttttatcttctttaccggatttcagcatatttttatacaatatctctgtaagaaaccaggctgccattgaaatataaaatagaatggataaagtattcatttccgttaggtttttaaggttaattttcaaatgaatcacatagtgttctgtttttttaatgatcctttttcttatcaattatttcacggaatttatcttcctcccacttttttacagcaccgatttttggcaagaaaacggaaagtgcatgaaccagaagtccgattccccaaaaaatggcagtgaagaaatttttaaactgaaaataactttcacccggttccagatgtgaaatattataaaaggcaataatgatgtttactgccacataaacgaataaatgtccataaaacccggtaagttgttccacctgcttttttgcctgctgatagtgaatatcattttcatcaaatttttccattgcttctgttcttttgttgattcataatttctctgatcttcttttcctgccaggactccccgattccgaaaatcttgaaagctctgaaagccaaaaccattccccacactaatgccggataccaaaaccaatactcccctttacttgtaaaaagattgacaaagaataaaaaaggaataataatacagtacgtaatcagactggaataaaactttttcatttccctaaccctcttttgagcccttttataagcagcagcttcttcttcaggttcttcattggaaacttgtggcttaactaaaagcatcggaagctttactttaaaatgatcctcagacttttctataaagacattccgttctgtaagcagagaataacgctgtacaatattggcaagaccaatcccggaactttctttgatctgctctcttacctgcagattgttttcaatgcaaagagtatttccatctgaaaaaattctgatagtaagtggttttgatgatgtcgcaaaattatgtttgatacagttttccagcagcagctgtagagaaagcggaaccacatatttctgataatcttccctgggaacatcaaaactaaaatccacactgtcttcaaatctggtttttaaaagttcacaataggtttttgcaaactctatttcatcttctaccgtcaccatctctttatctttctgttcaagtacataccggtaaatctttgacattgaagcagtaaatttctgtgcctgtcgtggattttcatcaatcagggaacttaaaacattcaatgaattaaaaagaaaatgaggatccagctgattctttaaactctcaaactgtgcattggcagatttggcaataagcttctgttccaccacttcttttctggaagtcttcttcagctcctccataaaactttttgcatgcagaaaagcagagatcagcaaagcaatattgatcataaaccaattggtaactccatattttgatgagaaaaactcttctgcagtggctgttttctgaatgacaacatagttcatataattacagaaatagaccagaataaagtttccgatgataatagaaacaatacttaagacagcccttgtgcgggtagcttccgaccagggaaattttttattgagaaattcattgataaatccgtttccaaatcccaggacaaaagaatacattgttgataggagcagcgtaatcaaaaaggtccggaatgtcttttcatcattaaaaaataaaaagaaaaacaatgtggttcctaacgaagtccaaagtaatgtggtaaggtatttacgcttcatgatctgttttcttgactcaaaattagtttttattaaaggtatcaaaaattaattcttaccgaagggctgattttcttttctgaatggtataaaaaaaccttcacgaatgaaggttgattttttacgtaaaaaaaagaaaactattttgctttttctgcaggcagactcaggaaataatctgcttcagcttttccccagttaggatctaaagctgttttgggtttgtaggctttaaattttgcctgagcatctttaaacatttccaatcctttcgttttgcttcccccgtactgttcaggagtaaaataagtatcttctgccttgatcagcgcaattctcggattggaaggatctaatttttctgcaacattaagctcttcagcagctcttgctccgtctgtcatataacgctgtgcaggatttaccatcattctcagggaataagacatttttctcagcagatgaatttctgcattatcagttccggcaagattctgagccattgaaaggtgtttctccgcctgatcagcgataacatcaagctcctgcattttaccctctctcatcaggactcttcctttctgaattaaagaaaaagctgcatagtatgccggaagccatttcgtgctttctttgcttcctattctctggaagtcgttagacagagcctggaaatcttccggtgttttacaggtttcaattctggcgattttgtcagacattattttgtcataatctgcctgtgcaaaagcagttaagctcataaaagctaaagcaaagcttaaaaggtattttttcatgattcaaattttaaaagttagtgatgtttgtgggttctaagttatgtttttataaattattattgatagcatcgtccgttttgtctactccgaagcttatgaatgctcctatgaatacaaaagtattgaccggcggcacaattgcagagcttctggagccatttgctgaaaagttatagccatatacattttttgatcctaaaatattactgatactcagtacaaatacaggaaaagatttcgcatcctttttaccaatattcggaagataattgatactgaaattcaatgcgttgtaatcttttaatctgccttcatttcggataaaatttacggcttctccatttttaaatgtagaggcaatatcgtaataaggacgacctttcgcataagtataagacaggtttacccctaatttccattccggaataaatctttttgccactgctgaaagtgtatgttctgcggcaaaacctggctgcaggctcacaggataattcaggaaatctctttttgaatccagatacgagtaactgatccagtaatcaatattttcaaatgttttcttattatctctccagaaaaactccagtccttttgcatatccgtatccattattgttcaatgcagtctggatctgctgattctgctctttatcctgggtaatattgaaggttttgatcaactgatcatattttttgtaaaacgcttcaaatcgtaatgttctgccttctgatgctctctggacctgaaagatataatgctgagatttctggaaaccaagatttgcagggccattgatgtatttactttccggattctgataaaaaagtccgtaagctaacgaagtggtccaatcttttgccagacggtatgcaattgcaaaacgtggtgcaatattgctttttcctaaaaatgatgaatgttctgttcttactccaattttcgctgacaaagcattgctgaaaccaagatctgtttcaacaaatgctgatgagatcaaatctttataatgcttatttacggcttcaaaattcagattttcatcggtattattaagctcaaaacctcccctcaccgcactgattctgttgatttttctttcaagaactgctttaaaattcaggtaatttccatcagtcagaagctggctcctgttggactcgatatcattggtttctgtagaaaaatgaagatccgatctgttataagagtaagaaccacctacattcagcagatattttccaaatttttgtttaaaagacagattatgaaaagtgtttttgccattaagctttaccaggctgaaatcggatccgggttcaagactttccgactttacacccattctattggaattgaacattccgtaatatttaaaaaatcctcctgactttgttttaaatctgaaattcaggtctccgttaaaaccttgtggcgcttcaacaaaatctgtattaaaattaaaaactttctgcataaggcttaaaagggaataccctgctgtagctccgtaggaatagtttttattatctgataacttctgaaatccggcattcaggaaaataggtgaaatcccaacattataagaagtttcatccggaagatctacactttccagcatcaatgctcctgaaagggcttggccatacagcgcagaatagccaccacttgaaaatatatttcctttaaaaagagaggtattgaactgatctcttcctgcaattcccggaaccgagttggaaaaataattgttgataagacttccgtccataaaaattttagactccgttcctgtacctcctctgatgaaaagaccttccgttcctcccactttttgtaccccgggaagataagtcaatgctgaagaaatctgtccatccgcccctgctgtggtataaatatcaatgggagtaagcaatgctgttgctcttttcttatcgctggcttcaatagatccggcagaaacgacaactgcatcaatttcgctgatctgttctttaaggtctacattcaaagagacatcctgattttcaatagagactggtctttctacattttcatatttcggatgggtaaaagtaatgatatgagctcctttttctgaagtttcaaatgtaaaattaccttgtgcatcagtggttgtaccgtcgtaagtgtctttaagtgttacatttacttcggcgatccctttgtttttgaaggaaactttccccgatattttcacctgagaatatcccatgatggaagcgatcaggaaaaaaagaaccagtatgttttgtccttgtgttttcatttttattgttttctggatcaaaaatagcacagtaaatgccttcctgtaaaaaaattgttaccgaaaggcattcttttgctaccgaatggtaattaatgaaccgggatacaaaaatccacaatcatttttccttccggatgttctttaaagtttgagtgataaatttcgtaaggaaaggttctcctgaacatataattatgctcattcatccataaaaacaaagagacccagcattgctcaaagtcatccaaagtaacttcaccgcttcctacaatgtattttccggcttgtagagtttccgcaaaaacttctccttcctgctgctttaatttttcatccagaagcatacaggcgtgaatcctgactttatcaagaggtgttattttgcagctgtcatgataaacggaaatcattttcacattctcttcaggaaaaagattcttctttaccgcccagtctgctaatacattgaaagaaggttctacattggctattccaaggctcattacagatgccaggtgcatttccggcatttcttttacttcgatttttaaattcattttcgtccagtttaacaggttttcaatgttgcaaatgtattggctgaaaaccgtatcaacttgtccgttcttgctctgcttctgtaaaatcctgtgaaatttttccggtgccgacctcctgaattccgtaggtgctaatccgtaatattttttgaatgttttgcagaaagcagaatggctggaaaatccgagatcccagtagatatcccttatttccatagttttatacaaggcaagatagagagcactcttttctgttttcttcctgatgatatagttctgaagagtttctcctgtaaccagcttaaatattctatgaaaatgaaacggagaataggcacttacctctgaaactttctccagagacaaatctgcatcaagatggttatcaatatattgaagtgtttttacaatccgctttttatattcttccaattcaaaggtatatgtgcacaaagatattttttcaggctggaatttgtttgtctgttattgctattctcagaaatttctgcatcatcagttataaaacagcttcttcccaatgtttaaagagaggaacagctcttttaatttccggatctgaagaggcgatatatccatggtagtcttcatgaataaaaatctctctggtaaagaacctttccccttcaataacacattcgttactggctatttcgaaagattccaggggaatcatcattccggctccatgcgctttgattacagcttcctttcttgtccaataggtgaaaaatccttttattttatcttcagtattttgaatttcaagaagttctcttgctgtcatctgaaatataaaatccagataactgatcttcggatcattgaattccacatctattcccaaaggatattctgcaatagcacaggcaaccagatctttggaatgcgatatattaaaatgaagttgccggcccttcagataaggttttttgttgggaagaataccaacttctatatcggagatattataataagttttcactccgtattgtaaaagaacttttcccaataaagaaagctgagcatcctgccatcttctgtatttcaggatagcctgttgagtttccgaagaaaaaccggacagatatctgtccagaagagcctgatgcttttcttcgctgataaaggtgtacagaatgaccatttttatgcctataataattcaacgttaaaaataagctttttccgggctgtttttaaagccgttaacaatctgatcataagttgtatgaaccgggattgaaagagaaggaataaagctgtaatacgcagcatcttttgaaaaaagaccggaatcataaagcgcattggaaaatcttttttatttttatagtaaaatcactttaaatcatttaaaaatgaaagtacaaacattagcattactggcagggtgtgcatttttagctgcatcatgcggaactacaaaaacgtactctataaatgccaaaagcggaacacagacaggaggaacagcaaagtttacccaaaacggaaatgaggtaacgatgaagttggatgttaccaaccttactcccggaattcatgcagtacacattcacgaaaaaggagactgctctgcagcagacggaacctctgcgggcggacactggaatccttccaagaatgatcatggtaaatggggagctgaacatttccatatgggagatataggaaacctggttgctgatcagaacgggactgcaacattgactttcaaaacagataaatggtgcttaggctgtacagatgagtctaaaaacattatcgggaaaggccttattgtacacgcagcagcagatgacttccatactcagcctacaggaaatgcaggaggaagagtgggatgtgtagaaattaaataatttactttattcaataaaaaaccgctaatctttttgattagcggttttttatgtttaggatttagctcccatatctgatacaatattcattgcttcctgcaggtaaagatcttttttcagattcttgatccacatttcagattttttcttgaatgcttcatcttttttctctctttcaatctcacttggatacatgataaactgaagtccgttctcaaattttgtcaaagccttgaacttttcgatctgagattttctgtttttcatcagttcgttgaacttcgttatattcagcgtaatgttctcttctttatccagtttttctctccattgagcagattctaataacaactgataattgctgtttttagccattctgtcagcacttgctttttccaaagcctgaatattgaaatagttcagtttctggaattttgtaggggaaattttatcccatgccaatgcataatcatcatatcgctctccaacctcagcgtaagtaaagaaatctttcatctgaatatcagatacaattccttttctctgggtagattctcctgtaattctgtagaatttctggatggtcagttttaaggacccgaaatcatcctctgtattcaggaatctgttcaggtctacaaaagtctgaacggttccttttccgaaagactgaggagacccgatgatcattgctcttccataatcctgcattactcccgcaagaatttctgaagcggatgcggaaagttcgttttgcatgataaccaacggaccagtccagataggtgtttcatttttatttttaagcgtctgtatttttccgtttccgtcttttacctgaacataaggaccagcttccatgaaaagccccataatatctcctacttcagttaaagatcctccaccattatttctaaggtcaagaatgattccttcaatattctgcgccttaagcttaacaatctcattcttaatatcatcagaagcatttcttccttttgcattttcaaaatccgcattaaagcttggaagattgatgaaaccatatttcttaccgttcggcgcattaacaacaatacttcttgcaaaagtatcctcaatagcaacctcctcacggatcatggttacatctttaatggtaccgtcttttttctgaaccgttaaggttaccggtgttcctttttctcctctgatcagccttactgcctcatcagaaagcattcctacaacatttaccgcatcttccttcggtttggatcttactttcaggattttatcaccttctgaaagctgcttagacttccatgccggtgcaccaatagtaagagctcccaggtaaaggtttccttttttctcctgaatcaatgccccgataccgattacttttccggtaaactgggtatcaaagtcttctttatcttttggagaatagtagttcgtatgtggatcaaatacttctgtatatgcattcatatacaccgtaaaccaatccattttctttctctttttgaatctggtaaaggtatcttttacaagatcttttacttcatctgtagcttttttgatcttttcgtcctgagtaagcaccttcagtttgatggtatctttcagtttgaatttctgaacagaatctttcttttccttctgcgcttcttccttactgttcatcgattcaacttcctgaagaatattgtatttgatgaattttttccactcgttatactgttcctgtttgttggcaggtacttttttcagttttggctcaagggtaagggtttcatcttcctgaagattgatcggtttactgaagatatcctgtgtgattttatcgatttcatctactctctggtataatctgtcgatagtaagtttgtaaaatgtcagatcaccttgtcctatataatcatcaagctttgtttcatgcttgctgaattcgtccatatcagattgcaggaaatatctttttgccgggtctaccaattcgaaataatgcttataaacgtccttcgaataggcatcattgatcgttttcgggctgtaatgcagataagaaagtgtgttttttacgctcaccattattgtctgcatcttttcatcgtcattctttggcgagttgaaacaaaacattagactggttaatggaatcaggagtaaaaatttattcagtttgaaatttttccacataaattgtctttatttattaatttttttaaaataagtatagtaattagtagcagtaagtttggtactgttacaaatgatcaaatttaataccttatttacaaatatcgacagttttgatcatttttatttaaagagatttgcaaataattaaaacagtgttagccatttcctgatgtcaggcagtttcaatccaaaaccagatgataatatttctttttacaatgtttttccaatttttttcactaaaaatcacaaaacaggtaccacaaaaatctgttttcaaccataaaggcataaaatatgatggtattgatgtatacaaattcaaaatattacgttatgaaaagtttactatggttagtcgcagttatctgcatcgttgtttggcttttaggaatgttaggaatagttccgggtatgagtaccggctatttaattcatgtcttactggttattgccattgttgttattctttataacattatctccggcagaaaaccacttgattaattctttttcaaatcacttaacaaaacatctttacaggtgcttttccacagaattcaaaacagactcctgctggaaatgcatctgtaaatttttaagatcaacttaaaaaattctgtctttttcaaagtaattacttattttattactttttctgaacattgtatttcaccaataatattcgtttcccatctccttttgtattcaaaaaaaatgaaactcaattttggttgtaaagaaatcaatacttcatctgctgttttatcgcgtcttatttttacctacatttgatgtgttgaaaatctatctgttccattctgaaaatgaacagactcacaatactatttgaataaaaaaattaaagataatttatggaaagaccacttattctggtgactaatgatgatggaattacagctcccggtatcagaaatctagtaagttttatgaacgaaatcggagaagtagttgttgtagcacccaactctcctcaaagtggaaaaggccacgctattaccattaattctaccctaagctacgaagaagttaatctggaaggtcctcaaactgatttttcatgcagcggaactcctgtagactgtgtaaaaatggctcttgataaaattctgaaaagaagacctgatattgttgtttcaggaatcaatcatggtgcaaactcttctatcaatgtgatctattcaggaaccatgtctgctgcagtagaagctggtgtggaagggattcctgcgatcggattttcattacttgatttcagctgggaagcagattttacccaggctaaagaatttattcagaatatcgtaagaagaactctggaaaacccaatgccaaaaggaattgtactgaatgtcaatattccgaaactcccggcagaagaaataaaaggtgtaaaagtctgtaaacaggcgcatgcaaaatgggaagaaagctttgatgagagaatcaatcctcatggtaaaaaatattactggctaaccggatatttcaacaatatggatgattctgaggatgctgacgaaacagcattggctaacggatatatttcgattgttccggtaaagtttgaccttacagcatacgaatacatgaaaacgctggaagaggtgatgacttttgaaaatgtaaaagaggtaaaataaccaaagaaatagtaaaagcgtgaaatcagatttcacgctttgtttttatactgttaaaataatactttatcatcttttctgagctcttccagataagcctttttctcatccctgtaaaaaaggttcatcgtttcaaaagggattaacttcagatctttattgacaatatgtacgcatgacttcttaacagctcttacatcaaaatcatgagcatccataaagttcatgataattattctgaacaggttatcatagtcaagatccggagcacagacttcaggcagacagcacagtaactgattgactttaggctgaactttatctacggaaattccggtactgaatatatccagcagctgcatatgcaatcccttatcctgttcgtaaacaatggtattccttgattcattattcagaagatcggcaggattgatgtatcgggttaaaggaattgtttcgccctgaagttttaagatatatcccatagcaagagcatccgggttacaaggaacaggaataatatcatcagaatttaataatggaaactgattgataatttcctgtcttacctccgttaaggtaattttttcatgggcagaatcttcccggtttcttccggcaatttcaacaggctggaaggtaattcctcttacacatttctgtttcagggcaaattctataatttttcctatttcatcgatatttttccctttttgaaggacaatcaccagtgtggtagaaagattaagttcattgagtttttccagtgccttcattctgactgcagtaagatccttccctctgaaatcttccagaacttcaggtttaaatgaatcaaactgaaggtatatttcaaactcaggagcatatgttgccaattgttcagcaaatcccggatcattggctattctgattccgttggtattcagcataagatgtttgatcggttttgacttggcaatatccataattttgaaaaattccggatgaatggtaggttcccctccactgatctgtacgacgtccggttccccttcattttttacaataacatcaaacatagcctcaatttcttccaggcttctgtgacttccataatgtggtgaggacattgcatagcatgtaggacaagtcagattacaacggtctgtaacttctacaatagaaagacagctatgctgttcatggtcaacacataatccacaatcataaggacagccatattccacatcagtcccgaaatgaagaggcatttccgaggccttattatagtttcttatatttttataataatgtacatcagaagctatttttgttttgaaaaatccatgatccggacatcttttggccataaaaacagtttcatcctcaataatgattttagctcctacccttttaagacattgcgggcaaagactgatggtataatcgtaataggtataatttcttactggcatagcaaattttttaaagtcctccgcaaatataaccgctgatcagtccacagatcagaagggatataagcatggtctggataaattgttttctggtaaatttccgatctccctttctttcgtaaataagttttgtaataactgtgacaatgagggaaagaaacagtgcagccaaaataattgcgccaacaatcactaccactactccagccagattgatattgccttctaaaatagttaatgttttcatcttgaatattttaaatataaagatccggtatttttaattttataaatgtagtaaataattacacagatacagacccattgaatagtccccatatttcccaggatttctatccttggttttataaaatccaaaaagaatctgaatgtaaaatagctaatcataaacagctgaaatataaagccggaagggtatttcttacgattctgaatatacttcaatcctatccaaagaaagattaaaaaagctatttcatacaaagcaacaggatgcctgagatattggtcccccaaatgcataccaaaaacagaatcagtaggaataccatatgtttcttcaccaataccggtaagaaagcaccctattctgcctataatcatggccagcatcagtggaaaaacaataagatctcccgtactttctttatgatgtactatcttttttgccagctctacacccaataagccaaaagccagccctccgacgatggtattgtttgaccagaactttctgatagaaaaattttcaaataatgtataagggttttcaagattaccgatcagcttggaacctattaaagctccggcagtagcacctattaaaaccgcagcagaagtattgaaagaaagtttttccttggacttacgtttcagataaaaataatatctcatgcccaaaaacattccggcagcctcaaaaagcggatgcgcaaggattgttttgccgaaaatatgaaaggttacaggaaaatccattatttcaaaaatacactatttcatattattcactacctttattctgacaaataattacaaaatgcgtatagaatatgacataaaactggggtttaaggatgtaatgttccgccctaagcgttctactttaaaatcccgttcggaagttgatctccaaagagaatttacctttaagcatacgaagaaaaaatggacgggagttccggtaattgccgctaacatggatacggtagggacttttgaaatggcagtagaactggccaaagaaaaaattattactgctgttcacaaacattatactcccgatgaatggagccggtttctcaatagccagcctgaaagtattcaccagtatattgccttaagtacgggaacaggaaaggcagatgaagaaaaaataagacagatcctcgaaaagcatccaaaaattgagtttctctgtatagatgtagccaatggatattctgagcatttcgtcgaatttgtgaagaaagcaagggcaaattttccggataaaattattatcgcaggaaatgtggttaccggagaaatggtcgaagagcttcttctggtaggagcagatatcataaaagtaggtattggcccgggatccgtatgtactaccagagtaaaaaccggagtgggatatcctcagctttctgcaattattgaatgtgctgatgccgcacacggcttaggaggacatatcattgccgacggaggctgcaaagttcctggtgatgttgcaaaagcattcggtggcggtgcagatttcgtaatgctgggaggaatgtttgccggacatgatgaaagcggtggagaaatgattgaagaaaacggtaaaaaataccgtcttttctatggaatgagctctaaaacagcaatggacaagcattccggaggtgttgcagaataccgtgcttctgaaggaaaaacagtgaaagttgcctataaaggtccggtttctgaaacggtaaaggatattttaggaggtgtccggtctacatgtacttacgtaggggcttcgaaactgaaagagctttccaagagaactacttttataagggttcaggaacaggaaaatcaggttttcaaagattaaaaaaacaaaggctttagaattatgatctaaagcctttgtttattctttcgttctgatgtattttttattgaaatatttctgaagctgatcatttacgtaagtctcctgttcttttacagaagccatttcatccatatataaaatcctcggaacctcctttatcttatccaccacaactgagtctttaggagagctactgatggtatctattctttggttcatttctctttcatattctttcagatctgtattcagaacttccattattatattttcattattaaaatcaatattaaagtaagaatattttttggggaaaattttgagctccggaaggaatacaatgagtagggaaagccaccagagctttttgatcttttcccatttgaaacataatagcagtgaaaaactaagcagaaaataaaaaaggatactttcaaactgtcttgcaacagaggtgagaatatagcttgtaaataataaaggaaggaaggaaactgaccagaataaaacagcttgcctatatgtaaccttgccagcaatctttttgagttcttcttcaaaaacctttataaataatggcagtataagaataaccttaaatactacatatacactatctgccccaaaaagagcagctcttttcaaccatttaacaattccgctttccacttcgcccattctgttgaaatttccgggtgcaagaaaacaaacaagcagaaatacggttcccagcagtgccagaatcaggctttctttattgcttttctggtaacaggctactaataaaagtccttcaagaatcaatgccagaatctcattagatcccatcagaataatgatcagcaaggctgaaagataaaaccatatcttcctgtctgcatcttcatattttttgaaaaaataaagtaaaatccctgataaaacaacaggaacaaaataaatattggaccccgtaatccagaagtaatgctccggtaagcttaccagaaggactgtataaaagaaaaacaaaagaaatccttttttaacggattccttcagagaatagttgaaatactccttaaagtttaatgctgaaactccaataaaggaaaggattaacaagacaggatatattttcgggacaatattattgctgtcataaaagacaggattaaacatattgatggaatatccgaaataccttccgccccattgtgtataggtatctgtaaagctttgcagcaatccaaactttctggtagtataggaccagaaataatcatcggtctgatatacattaaaaaaactaatgtacgtcagaccgatgaatagtaaaactgacaagaatactattatattctgtacttttttcattttctaggttaacattccaccgtcaacgtttaaggtctgtccggtaatatatgctgacatttcgctgcctaagaatacacatgcattggcgatatctgcaggctgccctcctctcttcatcggaatttcttctctccatccctgaactgttttttcatccagaatagccgtcatttccgtttcaataaatccaggcgcaatagcattacatctgatatttcttgatcctaattccagcgccacagattttgtaaacccgataacccctgctttagaggctgcataattggcttgtccggcattccctttcactcctactacagaagtcatattgatgatagatcctgatcttgctttcatcatcggcttgataaccgctttcgtaaggttgaaaactgaatctaaatttactttgataactttatcccaatcttctttggacattctcaataacaggttatcttttgtaatccctgcattgtttaccaaaatatcaatctgcccgaactctgccattacttcctccaccaatttttgagcagcatcataatctgatgcgtcagactgatatcctttaatttgggttacagaacttaaagctgcttctaattcttttgctttgtctacagagccggcgtaggtaaatgctacttttgctccctgctgagcaaacatttcagcaatccctttaccgattcctcttgtagctccggtaattagtgctacttttccttctaatattttcatatctattgacaattattttcttttataactcattcagcttgtgacagctgactcttgtagtctctacaattcctttccggaattaaacggtttgcaaagatattataaaatgttattcaacccattcaaattgtcaaaatactcatctttttttgatgattatttgatattttactaaagttgagtggaattatttttaaacctggtgaaatagataaaatcagtttttttattttggtccagcttcaacacctctttctgccagaaatatttatcgtacacaatttctttcagaggctcattctggaaattggaaactccgaattttccttcttttttcactacaatctcattttcagcattcccgaacgttataatatcttcgtaaacaaagggtacaatttctgttcctttcccatccagaataccataaagattatcattattcctgcaaaccaaaggtttggaatactggttaagaggattaaaatattcaacatcctcattctttatttcagttacattttttagtgcgatcaatgactgatccgtcactgaaaatctgtaatacttaccttcttttccaataataaggttatcaggatagaaaccaaaaatatgaactccatctcctacaatattcttaagatctttatcaagaaatttctcttcacttccttttttaaggtaaataaagtctttcccggaaatggtaaaacttctggtgaaatcatattcctgagggaaaataacccttcccccgaggtctatgacaccatatttctttgtcttatcattgtaagcactgaaataatgatccggtaaaggagtcagatattgataaggcagaggatacagcttcctgtctttcttactgaaaacagttgttttaccatttttactgaagtatatatattcccttcgtccgaaatattcaggagtgatatcattaaaaatttcttcagcaatggtatttccgtctgtatcgatcaaaccatatttacctgtgtttttattttttgtaatcagatagggataagcgctgatgctgatcacctgttgagaaaatgtatgtaaggtttggccattacttccaatgatttcgctttcaccatcctcattaatgatgagtgctttatcctcttcaaaattgtaatcttctttaaattccctggtgctgagctgctttccgttgagatcatacaggaaccacttattatcttttaaaacaaagaacctgttctttcctgaaaaacggatcttttccgaataaggaatgatttgttttccgttaaaatcaaaaacagcttctgcgttctgttttgatgaaataatccgctccctgctccaccacggtgtattaaattcctgattgtctagtggaataatctcatttcctttttcgtcaataactgctgattttcggctgtttccttcttcagaattcaggataaagcggtttttgaaaatgtgaaaaacatttcccctgaaaggagattcaaatgtaatattgcccaaagaatcaataatgccctgttttttagatctgggatcgtaggctgttccgtatccttcagaataagaacttacctcttttcctgtttttttcgacaggatgactttcatatattgattggtctgtgctgtacagactacagaacataatacaaaaactaattttttcaaggaaaattaaatagaattattgacaataagaacaatctctccttttaaagttttactcttggaaaactcaattaattcattgattgtcccacgtttggtttcttcaaatttcttggaaatctcacggcttaagcttactttggtttcttctccaaagaactctttaatctgctccagagtagtgttgatcttatggggactttcgtaaagaacaatagtctttttttcctcagctagctgcttcagcttggtctgtcttccttttttctgaggcagaaaacctgcgaatagaaattcattattaggcagtcctgaaactacaagagcaggaatcaaagctgttgctccgggaaggcagatcatttcaatattgttgtctgcacccgcttttgccagcagatatccgggatccgaaataccgggagttcccgcatcggtaacaatagcaatattctggccgtttttaaggtcagcaatcactttttccgttgcctggtgctcattatgcaaatgataagattttaaaggcttggagatctcaaaatgttttaaaagaacaccggaagttctggtgtcttcacataaaatataatcaacttctttcaggacgtttattgccctgaaggtcatatcttcaaggttcccgacgggtgtgggaacaaaatataggattccgctcaaaattataagaatttattttccaccaatatccaaagcctctgagcatattcatccactttattccattttctttcatagtacagatcgctcagatattctttggcttcatccagtgttctgaactgattcagctggtatacggtatcattaagatctgcctggcttccttcaaaaagcatcttcgtgaaggcaagcctgtcattaagatccagcttaaattcaggtttcagtttgtctgcttccatgaagttggttggaatattggatttcagaatacttcccgtgtcttctttcacagccggagccggtttttcttctttaggaaggtctctttccaggtggtcgtcatcaaaaagcgactgaacagccttcattcctttgatattggctaattttatttttttctcccgatggtattcttctaaattttcgaagctctcatcagaaggatttttatctgtttcttcgcgaacaggtttgtcaatttcaacaatttttctccggtcatacacttcggcaaggatgctttcttcttttgtttcttctgctgaatgatcattttttatctcactcagaatattttccacattggaagtttctgaagccatctctccctgctctatcgaaacatttgaagctacaaattgttcttcattttcttcgatcagtatttcatcttcaagtgtttcactttcaaaaatacttggaattgtttccgttatttgtggtttggtatcatttacaattgcagaatcaatctctttttttgattcctgttcagaaatttcctcttcgtcttcaatctcattaagctgattattgaaaatcgcttcttcctctgttacttcatggtaatacaggtcttcattaagatcttcatccgaatccggtgtggaatgtgcgagaattttatcttcatctacaaagttcagaacagctctttcttctgctgatatttctgcttcatcaatttcattaaactgatcatcagacaccgtttcttcttcctttatttcatgatcaaaagtctgttcctcagtattttcagtataactttcttctacaaagctcacaatattttcatggaattcgttttcaacaatttcattcagctgactattgaaaacggcttcttcctcagatgcatctgggaagatttcattctcgtcaatttcgttgagttcattattgaaaatagcttcctcttccgtcacttcatttgtatcatgatgttctgcttcccctgaagcaaaagagacgtattgactgtccgggttctgcaccggattgtctgctacgaagtattcaatatttttttccagcagtttcaaaaaagaaatcctgttagcaagctcatccacaagatcttgcttagaaagtaattcgtctatgtgacttattttgtccagattatcaatgatattcatggattcaaaaaaaatcttttcctttaaatcttggatattctgcataataagattcttattaaaattgcttacttttgatgttaaaaatatacggctaatttaacaaatgtttttagaaaatacaattaatcattccaaacaaagcggttggatggaagtgatttgcggctctatgttttccggtaaaacagaggaacttatccgcaggttgcgaagagcagaaatggcaggacagaatgtggaaatttttaaaccgaagctggatgtacggtattctgaagaggatgtagtttcccataaccagaacaaaatccgcagcactgcagtagaaaatccaaatgaaattcttctgctggcatccaattgtgatgttgtaggaattgatgaagctcagtttttcgatgaaagcattgttgatatcgccaatcagctggcgaatagcggtatcagagtagttattgcaggtctggatatggattttctgggccgtccgttcgggcctatgcctaatctgatggctactgccgaatatgttacaaaagtgcatgctatttgtaagagaacgggtaatctcgccaactattccatgagaatttcccagggagataatctggtagaattgggagaaacagaaagctatgaagcagtaagccgccgtgtttttattgacgaagtactttcaaaaagaaaataactggaaaggcaaagctgctgcattatcaatcagctgttgctaaagccataagaatatatttaacttaatataaaatgaaaagcgaaaaagctctgtaaaatatttaaaaaggaaaaaaaccggatgatgttataaatcttagcccttttactattttacctttttgcgatttcgctcaaaataaagcagaaagggtaccaatgaactatacagtacaacacattgcagagatcaccaatgcacagatcattggagacggaaatttattgatcaaaaatatagcgtatgacagcaggataatttattctatcaagaatacagcttttatcgcaatcaatactcataagaattccggggaaaaatttattgaatctgcaatggacaggggtattaaggtcattatttctgagcatcattatccggagtttgaaaatataacctggatcattgttgaaaattccgtagcgtttcttcagaaattagcaaaatatcatttcgaaaattctcatttacaatctatcggaattacaggaagtaatggaaaaaccattttaaaagaatggttgtatcaatgtctgtggaatgaatttcgtacagtcaaaagtccaaagagtttcaattcccagatcgggttgccattatctctacttcagatcaatgattctcatcagttgggtatttttgaagtaggaatctcaaaaccgcacgaaatggaaaagcttgaaaatattttccatcctcaggtcggattgcttacccatattggaactgcccatgctgccaacttttcttccgaggaagaattgattgatgaaaaaatcagactttttaaaaattctgaggtgatcatttacaatggcgacaatgatttggttgatcaaaaaatcaaaaattcctattctgataaaaaattaattgcttacggtttcaaaaaagagaatcaggttttcatcaaaagcaatatttccaaagatgaaaatatcattgttgaatattttggcgaagaaatcagttttccggcccaccagagagacgaagcgacgataaccaatgctatggcgcttatcactgtcctcaaggaactaaatatcggaaataaaaagatcgtcgaaaaaatcaaccttttaaaggccgtcgaaatgaggcttgaagccattgaaggaaataaaggcaatattgtcatcaatgattctttcaaccttgacctcgattctttgaagactgcccttcagtttttgaatgaatataataaagcaaaaaaatctctggttctgacagacatcgtaggagtaagcaccaatgccaaagaattgtatgaagaagtagcagaattggtgaatgatcagaattttgattctgtattcctgatcggtaatgaaatttcaaattttagtgaattatttaaagctaaaacctatacttttattgatactaaagagctcattgaaagtaaacatcttactgaaatagaaaatcagatcattctgctgaaaggtgccagaaaattcgagatcgaaaaacttaaagatatcctcgaactcagaaagcatgatacggtcctggaagtaaatcttaatgctatacttcataacatcaattatcataaatcactgctgaaaccaggaactaaaatgatggcaatggtaaaagcgaatgcgtacggattgggtagttttgaagtatcagaatttctccagcaccatcatatagattatctaggtgttgcttatgccgatgaaggtgtagagctgagaaagaaaggaattaccactcctattattgtaatgaatcctgaacagcatagttatcagactatcatagagtataatcttgagcctgaaatttacagcttcagggtattggaattattttatgaagccgttcagaaatcaggatatgataaaaaatatcctatccatattaaactggaaacaggaatgcaccgtcttggttttaaagattttgaactggatcagttaagcgaaactctaagccacaaaaatgtaaaggtccaaagtatgttcagccatttatcttcttctgatatgcctgaagaaaaagaatttactttgaaacaactggaggtttttgataaaaattcaagttgccttattgaaaaactgggttacacacctatccgccacatcctgaattcagcaggaattaccagctataaagatcatcaacatgatatggtgagaattggtattggtatgctgggagaatcagcagatcctgaaattcagaagcaattgcggtccgtcgtaagctttaaaaccgtaatttcacagatatcaactgtggaaaacggagaatctgtaggttacagcagaagatataagacagatcatcctaccagaatcgcaaccattcccgtaggatatgcagacggaattccaaggctgataggaaatcaggtaggaaatgttggtgttaacaaaacactggcacctatcgttggaaatatctgtatggatatgatgatgattaatgtagatcatattccgaatgtaaaagaaggtgatacggtaactgtttttaatgcacacccaagtttaaaagaattcgcaggatactgcaaaacgataacctatgaagtattaacctccatttcaccccgggtgaaacggatctatataaaagactaacttatgagaaaactcctgattctgcttttcatattcccgctgttattgatccattctcaggtaaaaaaagatctggtaattcctaagaatccaaggatcgggctttcccttgccggtggcggagccaaaggtttttcacatgtcggagttctcaaagtattggattcgttgggagtgaaagtggattatatagcaggaacaagtatgggcgccattgtaggaggattgtatgccgcaggatactccggaaaagaaatagaaaaaattgtcatggatacagatttctattctttgattatggacccgaaatcacggcaggaagccagctttttcaacaaatcagtagataaatatcttttatccattccgcttaaaaacgggaaaatcaccctcccttcttccatcagcaccggccagagaaatgtttaccttcttaaagaactttttaaaaatgtttccaatatcgaagatttttctaaaatgcccattccttttttatgtgttgccaccaatcttgaaagcgggaatatgcagatctttgaaaaaggagatcttgtacagtctatcatggcaagttcggcctttccttctttaatggatcctgtaaagattggcgacagtatttatattgacggagctatgaccgtaaactatccttcaaagcctttaaaggacaaaggaattgatatcgtcattggtgtggaccttaatcaggatctttcaaaaagagaggatttaaacaacattatagccattctgaatcaggttatcgatttcggaataaaaaaagataccagaagacagtataaatatacagacatcaatatcaagcccaatctgaaaggaatgtctgccacaagctatgatgataaaaagaaaattctggacagcggctatgtggaagggctgaaatatacccagatacttgaccaacttccaaagcggccttttgaccgtctcagacagcgtgtaaacccaatttattccaacgtatataagatagacagcatttctattgaaggaagtaaaatctatggaaaaaactatacacttggtaaaatgggattgcgcctcccctctctgcagacctatggaagcatcaataaaatgatagataagcttgttgctacaaacaactaccgttttattaactatgatatcgttcaggaaaatgatgccaattatctgaagctttatgttactgaagatgaagcccgccattttttaaaattcggtctgcattatgatgaagttttcaagaccggacttttattaaattactctgcaaaaagacttttatttaaaaattcaaatctttccctggacgttgttgtaggagaccgcttgaggtactacctgaattattttatagataacggatatatccccggatttgggctctattcatccggaatgagctttgatattaagaatgtggataattacaatatagaccgctgggaatggctcagaaatgaagcttatatacagtctgtatggaaagataaattcgcgatcggtggcggtattagccacgactactttaaagcagaaaacccaaatggtgaaaaccaacgctacagtcgttttttaaacccttatatttttatcaaaaccgacactcaggatgataaagaatttccaacgaaaggggtttattttgctgccgaaggaaaagtagtagatcttttaaagtccgaggtagacaaacgaatcattcagattaaagctgatctaagacttaatattccgcttggcaaacacttcagttaccgtctgaatttatttggaggagttaccattggtgaaaatcttcccgtttattatcaatacagattaggtggaatttttgaacagaacctgattaatttcaaaagcttcggaggattttatttcgcccagctttatacaaataatgttatactggcctctaatgatatccagtttaaattcaataaaaactattttatcagtggaaatttcagctttgctaacttatcaaacgatatcaagtttgaagatgcagttaaagtaaattatagctcactgggaataacggcgggttacaaatctcctttcgggcagataaaagtcaacttcagccactcacttaaaaacaaccaaaaaggtatattcagtgtcattttagggcactggttttaaaaaaatgatacagttcttttacgaaaacttaccggagtcagtaagtacagattacaaaaaatggctggaagaccttattctttcagaaggaaaaaaactaggagaaatcaattacattttctgtgatgatgaatatcttcttaagatcaatcaggattatttacaacatgattattatacagacatcatcacttttgattatgtaaaagggaagacaataagcgctgagattttcgtatctttgcagcgcatttctgataacgcctctaccctttcccgagattatgaagaagaattaagaagggttttagcccacggaattttacatctggcaggctacaaagacaagacggaagaggaagaaaaagagatgcggagaatggaagatctgtacctggataaatacaggaatttaaagttttaaaattgaacaatcacttaaagtcctatatctaaagtattctattctagcaacaatatacatttacctagagtgcattctccaaaaatgtttcacgtgaaacattggttataaagataaggtttaaagcttaaaacaagcgagataaaaatgatttcagaaatatatgatgtaatagtagtaggtgccggacacgcaggttgtgaagcagcagcagcagcagccaacctcggttcaaaaactttacttattacaatgaatatgcagaccatcggacagatgagctgcaacccggcaatgggcggaatcgcaaaaggacagatcgtaagagagattgatgcaatgggaggatattccggaattgtggcagataaatctgctatccaattcaagatgctgaatctttcaaaaggtcctgcgatgtggtctccgagaacccagaatgatagaatgcttttcgccgaagaatggagactggcattagagaatactcctaatcttgatttctttcaggatatggtgaaacaactgattgttgaaaataataaagtaaccggagtggttacctctttaggaattgaaatcaaaggaagatctgtagttcttaccaacggaacttttcttaacggtttaattcacgttggagataaacaattaggcggaggaagaatgggtgaaccaagagcttttggaattacagaacaattggtcactttaggtttcgaagcaggaagaatgaaaaccggtactccaccgagagtggacggaagaagtctggattattcaaaaatggaagaacagaaaggagatcaaaatcctcaaaagttcagctatctcgatacaccgaaactgacaaaacaattaagctgtcatattgtatatactaacgaaacagtacacgacattttaagagaaggcttcgacagaagtccaatgttcaatggtacaatccaaagtttaggtccaagatattgcccaagtatcgaagataaaattaaccgttttgcagagagaaacagacaccagcttttcgtagagccggaaggatggaaaactgtggaaatctacgtcaatggattcagctcttctcttccggaggatgtacagatcaaagcaatgaaacacattccgggatttgaaaacgtaaaagttttccgccctggttatgctattgaatatgattacttccctcctacccaattaaagcacacacttgagacgaaaataatcgataatttatatttcgcaggtcagatcaacggaacaaccggatatgaagaagcagccggtcaaggtttaattgcaggaattaatgctcacaataaagttcacgaaaaagatgaatttatcctgaaccgggatgaagcgtatatcggagttttgattgacgatttgattacaaaaggaactgaagaaccttacagaatgtttacttcacgcgccgaatacagacttctactcagacaggataacgcagatatccgtttaacagaaaaagcgttcaatctgggattggcaaaagaagacagattaagacgcgtagaaactaaagtatctgaaagccaatcacttgaagaatttcttcgagaaacttctttaaaaccaggtattatcaacccagttctggaatctatcgaaagcagtcctgtggaccaggcttacagagcggctcaaatccttaccagacctaatatgacattagaaaaactggatgaaattgatttcattaaagaagtttctgagcaatatagcgatgaagttagagagcaggcagagatcaatatcaaatataaaggatatattgagaaagaaaaagaaaatgttgctaaattaaatcgtttggaaaatattaaaattcctgaagactttgattatagcaaactttcaagcctttctgcagaagctaaacagaagatgtctaatgtacgtccaaaaacaattgcacaagctggaagaataagtggagtttctccagcagatatcaatgttttattagtatatctgggacgttaaaaaaatgtttcacgtgaaacatcaaaaaataaaaacaaaaattaaggtatttacaagcataaaaaacttatgaatatcttaatttttttatcatataaaagatatttacttcaatgaaaataaaagatcattttctttcacaggaaatatttgaaattaaagaaacagaaacaaaaggagtcttcaaaacctcccctattccatctgacatttcaagatattatgaaagcgaagattacatttctcatcaccaggattccggaagtttaaaagaaaaactctacaagtttcttcagtcattcaatcttcagtacaaaaaaaacatactggtagacagaatcaaaaaaggttcaaaagttcttgattacggatgcggagccggagaatttgtaaaatatattgaaaatgattttgagactttcggttttgaaccggatgcggatgcaagaaaagctgcacaaggaaaaataacaaaagcttccattgtggatgatattaataagattgaagaaaacagcctggatgctattacactctggcatgtatttgagcatatagagaaccaggacgagatgctgaatatttttcataccaaattaaaagaaaaaggacttcttgttatcgctgttcccaaccctacttcatatgatgcaaaacattataaagaatactgggctgcttatgatgtgccgagacacatctatcatttctcaaaaaatggaatggaaaatttaatttctaaaaaccgcgactggaaattaagaaaaataaaacctttagttcttgactcctattacatctccatgctgagcgaaaaatacaaaaaatcacccctattttggctaaaagcagtgatctacggaacgatttctaacttaaaggcattattttcgaacgaattttcaagtttgatatatattatcgaaaaaagatagaaaatcgatttttgacccatttatgaaggtcaattttcagcgtttttgattaaaaaataaaactcaggggaaaaatctctgagtttttaatttttatgtaagctcatttttttggttcttgaagtcttaactaaaataattttggttcattcaactctccattgaaatttagtaaggctcccctactccattttaaaaattcaaaaaacaattcttttgtaaacgtattcaaatttgactttactacctgtaaatttaatacagtctaaaaaagtcaaaaaaaaacaaaaaaaatggttttacaatttgaattcttacaaaaacaaagataatttccaataaaaatataataacataagataactcattaaaatatagaaagtcgattttaggtatatttacgaaggtcgatttttaagtatatcttatcaaaattgtaagacagacaactattctctatcctttatatctatgcccattagaaaagaaccggagatataagacaaataaaatataaaactcccctactcccttaactgaatttttaagcagcctaacatcttataccggattcataataaatgtaaagtaaaatgatagtactggaaatctttcaaaataaaattgcagatcaaaacctaaaaatcagtagaagcaatttgaaagtactatcaaaataaaaagtcaatactaaaatatctcaacatttgttttagaattcattattactgcaaattagataaataactttataacctattcattttaaattacttaatactatataaaaattaaaataaactaaataaaaataactttattaattgataatcaatataatacaaaatactcacacatatatgaaataaaataaatataaattacttataagaaatacatttaaattatttccagaaacaaataaagaattgctctgtttaaggttatggattataaaatcaggaatcaaagttgatcctttacaataattgatcaggctaatctcaccctagagcatataccagaaaaaaaatcgcaatgaaagcataataaatgtttctaaaaaatggatctttcattgacaacactctggtgaaaatcgagccatatattttcaaaaaaaaccaggaaagaacaggaagagatttttaaaattacagaattacagagaaaaatacagacaaagaaatttcaatagaacacaagtaattgataaagaaataaacattactctatataaccataagttatatctaaaatacattggaattaccgatgaataaaggattttctttacgttacggagataaaaaaagcctgctaatataattagcaggctttaaaatatttatttatttgtattaattgttgattgcagctacacctggtaactcaagtccttcaagactttcaagcattgctccacctccggtagaaacataacttactttatcagcatacccgaattgcttaacgaatgcaacactgtccccacctccaactaaagagaaggcaccaagcttagttgcctcagcaatactatcacctaaggcaacagttccacccgcaaagtttgacatctcgaaaactccaattggtccgttccaaagaatagttcttgaatttaacaatacgtcattgaactgatctctagacttgtgacctgcatcaagtcccatccatccttcagggattgtatagatatcagcttcttttctttccgcatcattactaaaactttcagcaataattgtatcagacggaagataaactttcactttatgctccttagctttacccaaaatctctagagctaaaggaagcttgtcttcttcaacaagagaatttccgatctttcctccaagagccttaataaaagtaaacgccatacctcctccaatgatcagattgtctactgcaggaagtatattttctataatggtaattttagttgaaaccttggatcctcctaaaatagctgtaaccggtctttcaccgctttttaatactttatcaattgcctgaagctccttagccatcagtaaaccgaaatatttagttgatggaaaatactgagcaattactgctgtggaagcatgagccctgtgtgcagtaccaaatgcatcatttacataagcatctccaagcttagcaagtttctctgcaaaagcagcatcacctttctcttcttcattatgaaaacgtacattttccagcaacaagatctctcctggtttcagttcagctgcagcctgctctgctttttcaccgatacattcatcaacaaactttacttcacgtcctaagacattggaaacttcgcctactatatgtttaagagaaaattcatctttaacctcaccctttggtcttcccaggtgggtaattaagatgacagaaccaccatcattaaggatcttatccactgtaggttttacagcaacaattcttgtattgtctgtcactttcagttgatcatcctgcggaacattgaagtccactcttaccagagccttcttatctttaaaattaagatcattgattgttttcataaatagatttatttttttctaagccttatgaaaccgccgtgctcaaaatccgttctagcttccggtaaaatctcgcaagagcaatttcataaatttcactgaatttttgtttcacaaatgtaaggttttaaactttttcaacactttgattaaaataaaagttttcaaaaactttccccgaacccaatcacccattaatcaacaattttttctcttttaaaaaaaagaataatgtagttgttgttgagtattgttagtttcggggataagtttcaggctaaaagttggtaacactcaacttttattcaattcatatttaactcacaatataaatccttgtaaacccgctgtttcacacacttattaacaaatgttgataactttgaaatgatgccattcttagttattttattatggaaaagactggggatagctgaagaaaacatctggaaagttgtggttaaattttgcggaaacgttttctattacgaaataaattgatctttaaaaatagaaagttgataaaagttttccacagttattcacagaccttttcacaattaactcccggtttactaacacgaattgttattattcttacctttgtaaggaaatagaatctaaaaaagcttaataagagtattatgaaaagaaaaattgctgttgcagcggaccatgcaggctatgaatataaggagattgttaaaaactacctttcagaacattttgaagttcaggattttggaacgttttccacaaacagtgtggattatccggactttgtacaccctgccgcaacttctgtggaaaacggagaaaatgaactgggaattttgttctgtggaagtggaaacggagttcagatcactgccaacaaacatcagaaaattagatgcgcactttgctggatgccggagattgcaacgctggcaagacagcataatgatgccaacatgatttcgataccggcgagatttatatcaaaggaactggccattgagattgtagataaatttctttctacagactttgaaggcggaagacaccagaacagagttgataaaattgcattttgctaatatataataaggcttgtaaatcatttacaagccttatttattttttattcgtacatttgcagtgtccaatagaaataacactctattattctctaaagccttttttatattggaaacatatttaacagaaggtttttctcttttcttctccagaattgtattaaatttatacaaaactaaagctcccgttgttagcaaaccgaaagataatttctgatgatatacggaaagaatctatgatgaaattgaataaccttatattaaggaataaaggaagatttagaaaaaggttttatttgaattgagataaaaccaaacatttaaaaaagaaaattaacatgccaaaaaaaagaaaatatataagtcataaaaatgatttaaaactgatggagatcggaaggctgatcctccgttttatgaatgcaaattcatccaaaatttataattacaaacaaatcgctgatggtatagattacaaaaatccgagacaaagggaacttgttatccaggcattgcataaacttcaggcatctgaaaagatcaaagaagtggagcgcgggaaatatattgttaacctgaaaatagcaggaacattaaccggaattattgacttcaaccaaagcggaaatgcctacgtaaatgtggaaggaatggaagatgatatcttcattcatgccaaaaatgtgaaggatgcactgcagggagataaggttcttattataacttatcattataaaggaaagaaacttgaaggctcagttctggaagttttggaacgtaacagaacagaatttgtagggacatttcagaaggtggctcacaaagatttcgggtttgttgtttgtgataagaaatcaatcaatacggatatttttattccgaagaccaaattcaataatgcggaagacggagataaggtgatcgtaaaaatgacagagtggaaaccgggggataaaaatcctgaaggtgaaattatccaggtactgggtgctccgggtgaacatgaaacagagatccactctatccttgcagaatatggtttaccgtatgaatttccacaggaagtagaagctgatgcagataaaattgaaagaagcattactgacgaagaggtggcgaagcgttgggatatgcgtaaaatatgcacttttacaattgacccgaaggatgccaaggattttgatgatgccttatccataagaaaactggaaaacggaaactgggaaatcggggtgcatattgcagatgtatctcattatgtggttcccggaactattcttgatgatgaagcctatcagagagctacttcggtatatcttgttgacagggtggtaccgatgcttcccgaagtattgagcaacgatgtctgttccctgcgtccgaacgaagacaaatatactttttcagcagtctttgaactgaatgatcaggcggaaatccagaaacagtggtttggaagaacagtgatccattctgacagaagatttacctatgaagaagctcaggaacgtatcgaaaccggaaagggagatctggcggaagagattaatacgcttgataagctggcaaaaatcatgcgtaatgaacgtatcagaaaaggggctattactttcgacagaagtgaagtaagatttaacctggatgaaaataatgaaccggttggggtttattttaaaataagtaaagattccaatcacttgatcgaagaattcatgcttttagctaacaaaaaagtatcggaattcgtatcgctgacaaggaaaggtgaaatcaccaacaatacatttatttacagggttcacgacgatccggatcctgcaaaactggaatcactgagagactttgtagctactttcggatataaaatgaatcttgccaataccaaaaaagtggctgaatctctgaataagcttcttcatgatgtaaaaggtaaaggtgaagaaaatatgatcgaaacactggccatgagaagtatgagtaaagcggtatattctacagaacctatcgggcactacggattaggatttgaatactacagccacttcacctctcctatccgtcgttatccggatttattggcccatcgtcttctccagcattatctggatggtggaaaatctccaaacagaggtgagcttgaagaaaaggcaaaacactgcagtgccatggaaagattggctgcagatgcggaaagggattctatcaaatacatgcaggtgaaattcatggaaaaacatttgggagaaactttcaaaggtgtgatttccggtgtggcagaattcggattctgggttgaaatcccggaaaacggagccgaaggtctgatcaaactgagagatcttgttgatgattcgtacatgtttgacgctaaaacacatgctgtatatggagtaagacatggtaataagtaccagttgggagacgaagttcagattaaagtggtgaaagccaatctgattcagaagcagctggatttccagattgtgaagtaatgacgagaatagataaatacattgtatttagtattttaaacgtaatattattgataacagttatttttaacactgttatcaatttttttctgtttgtacttgttataatcattcttgtagtcacatgtaatattttgatcaaaaggaatattattaatattgataaacaagggaagaattacttttttggagttacatttccacagataattaatggtttttttttgataaactatcttacaggaatgaatcctaccaaagaaacatactgttttaaaaacatgatttcagaggttggaagtgtacgcagccatgagaaaggaaagacaacttacatctatttaagcggaaatgcatatgaatattcttatatgacaaggagttttctcattgattataaaagaatgttgtttaaaaatcagatcacttacacctttgaacgaggaatttttggacttaaaatcagaaaagactttgagtttgtttttaatgaaaattgcctggaaaaataagtgtgataaatcatcagaaaaatataatgcaaaaagattattccaataaggaacaatctttttcttttttaaggaggtaaaggatgggctaaaattattttgggatctgttcgtattttggactttgtattcttgctcctctcctatttcttaaaatttttatattaaactctgattaaaatccacttgatatatcacaactttattgaataattaaatcataaagtctaactttgtattaaacgaaatgaatttttattcattttaaaacaccacttaatgctagaacttgtactatctgccatcatattaggatttatgctgagcctggttttcataggacctatttttttcctgttaattgaaaccagcttttcccgagggcccagacatgccctatccttagaccttggcgttattacggcagatttattatgcattgttgcggcttactatgccagtacagatattgtaactctgatagataagcatcccggattttacaggattacttccattcttattttcatctacggaattgtgatgctggttaccaagaccaaaatgcatatgcctggtgaagaaaagatcattggccagaattatatcaagacatttttcaatggttttttctttaatcttctcaatgttggagttatccttttctggctggtaacggtaatttccgtaaggaatcaatatccggacaccagcagttttattttatacatcagcatagtgctggccacttacctatctatagaccttgccaagatatttcttgccaagcagtttcacgataaattaacacaaaaactggccaaccagatcagaagagtggttggctgtattcttattatcttcagtttctttattttcctgcagagtttcaaaaagttcaaccaatttgacagacagctggaggaagcagaaaaaaaagaagtaaaatatcagaaaacaaaatgaaaaagatgatctttcctaagtctcttaaaaaaggagacaaaatagctgttatttcccctgcaggagccgtagatgccacacaattggaaaaagggattgaaatgattaaaagtagaggttttgaacccgttccgggagaacatctttacagtaaattttcaaacggatacaattatgccggaacagaaaaggaaagaattaaagatatcaactgggctttaaatgacaaagaaataaaagctgtatgggcttccagaggaggttatggatgccagcacctgattcagcatctgaaactgaaaaactttacagaaaacccgaaatggtatatcggttattcagataatactgtaattcaaagttaccttttgaaaaaaggtttcgcttctatccatggacaaaccatcaaaacatcaagttttggagttacggatgaaagctatgatcttattttcggtatcttaaaaggagaaatgcctaaatacagccttaaatcccatcaatttaataaagaagggaatatcaaaggtgaattggttggaggtaatttagccctgatctatgcccttctagggaccagatattcttttgattttaaagacaaaatcctgtttattgaagatattggtgaaaatttttatgctctggaccgtatgattatgagtctggaactggcaggagtttttaacaaaattaaaggactcattgttggcggtatgaccaatatgggagatgaaaaagaaaacacaagctatgaaaaaagctttgatgagctggcgtacaaactgatttctgacagaatttcaaaatataaattccctgtggtatttgccttcccgaatggacatattaaggacaaccggccattaattatcggaagcgaggttaagctaaaggttgatgataaagtaagaatagatttttaagtggtatcactctcctatctccagactcttaaatactgaatatggcaaaccataatgattttggaaaaatggcagaggatttcgctgttgaacatctcaagaagtgtggctataaaatcctggtcagaaattttcgttttcagaaagctgagattgatgttattgctgaaaaagataatcagattatcgttgtggaagtgaaagcaagatctacagatgcctttatgctccctcaggaagctgtcaccaaaacaaagataaagtctattgtttctgcagccaatcattatatggaggaatttaataaagataatgaagtaaggtttgatattatttccgttcttcctgacggaaacaaaaatttaataattgaacatattgaagacgcttttgaggcgtttgatgccaattagatatgtattatctttgagtataaaataattaaaatttactacatgccctttgtaagaattagcctgcctaaaacgctgaaacaagaagagaaagatcagatttctatttctgtacatcaggctcttatggacgaatttaatatcccggctgatgattattttcatgttatagaagaattggaatcacaccaggttaaatttcctcaaagctatcttgacatcccgcatacaaaggaaatcatctttatacagataaccgcaggaaaagggagagatttcgaaaagaaaaaaagattatatgcttctattgcagaaaaaatagcagcatcaactacaattacaaaaaataatatcattattgtgttaactgagaataacggacaggaagactggtcgtttggaaacggtggaatacagggagcaaagcatatcatttaagaagataaaaatatgaagacaatattgatcaccggagctacttccggtataggaaaagccactgccgaacttcttgcaaaacaaggaaacagaatcattatttgcggaaggagaagtgaagtgctggaatctgtaaaaactgaactttctcaatttaccgaaatatttagtttaaaatttgatgtaagaaatcttaacgaagtggaatcagccatcaattctctcccggagaactggaaagatattgatgttctgatcaataatgcagggaatgcccacggattagatccgctatcggccggtaaaacggatgactgggattctatgatagacggaaatgtaaagggattactctatgtttccaaaatgatcattccaacaatgaaaactaaaaatttaggtcatattataaacatcagttccgtagcagcaagacaaacctatgcgaatggagtagtgtactgtgcgacgaagaaagcagtagatgttatttcggaagggatgagactggagcttactgaatttggtattaaagtaaccaacattcagccgggcgctgtagaaacggatttttctttggtaagattcaagggagacagtgagagagcttcaacagtgtatgccggctatgaggctctgaaagcggaagatattgcagacgcaattgcctactgtgtgaatgctccgaagcatgttaccatttcagacatgacgatctatccaagtgcacagtcagaacccagaacgatttatagaaaatagtccaaaataatggagtaaatttgcagaagattaaaagcggtttgccttttgtaattttgcaatttagtttaaaagaaaaaaatgaaaattctatatctggaaacatcatccaaaaactgttcagtagcagtttcagataatgagaagctgttatgcctttgtgaagaagtttccgaaaattataaacagtccgaaagtttacacacctatgttgaatgggcattgcaaggagcaggtatttctcttaaagagattgaagcggtttctttaggaaaaggtccgggatcctacactggtttaagaataggtgctgcttcggcaaaaggattttgttacggactgagagtccctcttgtagctgttaattctcttgaaagcatgatagagccgtttttaggcgataactacgatctcgtagtgcctttagtcgatgcaaggagaatggaggtttatacggccgtttatgacggtaaaacagggaaggagttatcggagacagaagctaagattttagatgaagcttcatttgaagaattcaaagataaaaaagttctgtttgtaggggatggggctaaaaaagcaaaagatatcctggatcttccggatgctgtttttaaagacgatgtttatccttctgcacaatatctgatcagaaagacactggaaaagatagatcaaaaagaatttgaagacatggcttactttgagcctttttatctcaaagatttccatggagtaaagaaaaagaaaagcgaagaataaatcttcgcttttttattttattgaggtcttggtggtattttcgaccctgattttgtttcgtttgatttctttggattttgctgcccgggacttgattgcggagccgtattattcatattaggattctgagcactgtccagcttctggattttcccgctattcatttgcggaatacctgtattctgggcattaggctgtacaggaactcctgatggctgctgaggaatagcatttcctttattatccgttgcctggaaactcaggtcgcttttcaggtaattcagcatttcttttgctcttacaccttccggtgttttggaatagttcaacgcaatctgttcaagctgaagaatcattacttccttaccactggatttcccggcattgaaggcattcaaaaggtaaagtttaggaaccagtgcatccttcgggaacttctggatggcctgatcaatgacatctttactttccgtaaacttttccgactcaaacagggcatatgcctttttatattcgttttcaacttcctcagttgattttacaaacgacttatttttaggatttcttgcaaactcggcataagaagtataaggataatccgctaacagaatttgttttgctctttcagaagcctgaggatttttttcataattcatggcaaaaatctcatacaatgcctgtaacattaccttttcttccggctttacatctacaaggtcataaagcgttttagtcgccaggggagtattggtaaaatagttctgatacataataccaagtcccagtgaagcggtatccctgtccttttttaactgggacaatttgccctgatcagtaggaatctgttcgatataataagcaggctcaaaacgtcttggattaggtgctgaagtaactcccaaagcttcattcttcatatcttcaatagacgccatcttcttagaagaacgccagttgtcagcaagagcacggtctccccagatctgcttaaatgaagaagttcctttgcttacagttcctgtattgctgaagtagaaaccttttgttgttaccccaaaatcttcaaaagaattaccactgttggcaaaaacagaattggcgctgtaatctcctgtatcaaaacctttacttctttcagcacgtcttctttcctgttccgccttttcttctttgatctttaattttgcaatatattttgtgaaataatcggtcttctgagcatcatccattcttgccagagaaagaatactgtcattctttttgatcagatagtagtttttggaaatctttttaatgtattcggactggtctttcaataagatttttgaaggctcataagtcattactgccaatgcagaatcgtaataacttcctgccccgatataatcattcttatccaggtagtttttccctatttcataataagtcagtccacggatctggggatcagaaactttctcaaacagtgattttctgaagaattgctgagcttcatctttttttccagccttattagccatgagacctaaggcatagtaaaattcattctttctggaaccataagttcctttcttactgattccttccagataattcttcgcgccggcatagtctcctttaccgttaaaagttttggcgattgcaatctgtgattttacttcaaattcgaaatcattggcatatttgtatgcggcagcgtagctttctcttgccttatcattctggttcagattttcataaacctggcctctcagataagcaattctgcttttcagttttctgttgttattcagttcaaaagcattgtcaagttccctggcagcctcttctttttttcctgcatcaagcaaagattcagaatagtaaatactcaggagctttgcgtagcttttattaatatcgtctcccttcagttttgcaaaagtttcatgcgctctgtggtaatccttgatcttatcataagcaagcccctgataaattcttgccagtgcaatccttttatcatctttcatgtgcgtgaagacataattaagcgcatccagtgcttccagggatttaccacggtaaattcttgcctgggcaagaatcatataggcatcaaaaatctgcttgtttttctcttcaccatttctggttaccgaatatttattaatagcttttaaagcttttgcttctgcaatttcaagggtagtagcgcctttgctctcctcaccgtcaggtcttgatggtccgcctcccggaggcccgccaggaatattaggaactcccgaattgcctcttcccgaaggtctgttggctacttcagccatcttcatagaattttctgcaaaagcttcagtctgtccaaggtcacttcccaaaggctgttcttcataagtcagaataggaatataaggtgcatagaaattatccttatgtcctttgtctctggttgtaaattcactgtttaatgcatctttcgcattaaaaagagtattataatatgtggaaaatcctttcaatactcttgaacgctgctccggcttttttgttttggtagcacaggaagcaacaagacatatgactaaaaggaataatatattctttttcattattcaatataactcgctaatctgctttttattatcagcagtttgatgattttgtaaaaataataaaattttataatgaataatatttatatttccgcaggaaatattttatttcttctttaacagatatccggaatcctaaaaatcgtttaaatcaaagcggtttctttcaaaattttgtaaacgagatgagtaggaagccccataatcgtataaaaacttcctgtaagacttgtgatctttgccattccaagccattcctgaataccatagcttcccgctttatcgaaaggcttgtaattttgaatataatagttaatttcttcatctgtaagcacatccagtgtcacatccgctacatcagtttttgtaaaagattgattggcagttttgatggtaattcctgtatacacctgatgcgttcttcccgaaaggctctggagcattttaaaggcatccgcttcatctttaggcttaccaagaatctgatgatcaatagctactacggtatcggcagtaagaagaacttcatctgcttccagacttctgaatgcatcagattttaaatcagaaagataagatgcagcttcttctattttaatgtgctgaggaagtatttcttcacaatctattttgacaacttcaaattcaaaaccaaggctggaaagaagctcttttcttcttggtgattgtgatgctaaaagtaatttcatgccgttaattatacagattgggtattatcatcatgccagttaccctgaactttcatcacctgttctatcacgtcacgaaccgctccggttcctccttttttaggagaaatataatcagagattccttttacctcaggaactgcattttcagggcatgcagcaatagctgaactttccataatatgaatatccggaagatcatcacccatggtcagaatttcttcatttttgagattatattttttcttaaaatcttcaaaatcatctattttattgtgggatttcggatagtaatcctgaattccaaggtaattgattctgtgttttaccatttcatcatttcctcctgtaataacaccaatcagataattgttttttaatgccttcactacagcataaccatccagtacattcattaccctgcacatatttcctccgggaagcagataaacgcttccgtctgtgaaaactccgtcaacatcaaatacaaatgccttaatatcttttaatttctctttatagctcatacattttctgaatagaatgattcattgttttataaatcttaaggctctcgtcctttaataactgttcatgcagctgtaaaatcctgacatcatttcttacggcaggtccggtttgtgcttctttaggctcaattgtatggattttctgaaccgtttcatcaatcagcggtaagaaatagtcaaacgggatttcctgagagtctgaaatttccttggcccttgaaaaaaggtgattcacaaaattgcaggcaaaaacagccgtcaggtggatatattttcttttttcatgagtactttccattaccctttccgaaatttttgaagcaagatccaacaacagtttttggtcttcatcattttcagcctctacaaaaaacggaattttttcatattcaagttctttggattttgaaaaggtctgtaaaggatagaaactggatttccggtattcgccggtaagaatttctttaggaagagatcctgaagtatgggcaaccaaaaagtcttttccgggtatgatctttgaaacttcttctacagagtgatcacttacacagatgatgtaaagatctgccttttccagacgatctgtggaataaggaatatttaattcttcggaaattttacttaattctttttcgttcctcccaaatagctgggccacgggaatacctttcaaagtgaaagcttttgccagatgataggcaacatttccggaaccgataattacaatttgcatataacaaatataagattttaagccgagccgggaaaggaagatcactttgaaaatcctgtacttcaatacaggcacgtttattgcgtaagtgtctcataatatttttaatatttaaattgaaaattgaataattaatttaactttcagttatttttgtaatccaaaacaatgtaaggcatcttatgaagattaaggacgcggaaattatttcgttgatgcagaatccacggacccaggataaaggtgtccgtgccttgatggatgcctatcaaagcagattgtactggcacataagaagaattattgtggacggagatcttgcacaggatactttgcaggaaacttttattaaagcttatcagaattttcatcagttcaaaaatgatagccagctgtatacctggttgtacagaattgctaccaacgaggcactacagcaggtcaataaaatgaaaaagatgcagaaaactgatgaagacccggattatcacatgcagaatcttgtagctgataatacagatgatgatgctgaagaaatacagattttactgcagaacgctatacagagcctgcctgagaagcagaaactggtatttatgatgcggtattatgatgatttgccctatgaagaaatatcaaagattgtagatatgtcggtagggactttgaaaacgaattatcattatgccaaacagaaaatagaagattatattaaagaaaattacgaaaaataatttttgatccaacaaagatgaaagagttcgacatagaaaaattagaacgtaaaaacatttacacagttcctgaaaatttattcgaaaatattcaggagagcgttatgaatgacataaagacaagtaaaaaaggacctgtctttaagctgaactggatgtatgcagcggcggcatcactggctttgatctttggagcaacttttgtttttaattcagataacgattctacggaacaaatactgaactccaaaacaacgtatgtggccaataacggagaacccaaaacagaaagtgaactggcctatgaaactttaaaatctgatttaacttctgttgaaaataatgatcaaacagttgaaaatcaaaaaaataacaattcatacgcttcaaaaagcgttcacgaaactgaaaaaacaacagagacaccaaaaccggtgaaaactgtaaataaaaaagaagaaacacgaatgaatgactatctggattcgttttctaattctgaaattgcagaattagcaagtaattcgacccaggacgtttatttggatatttataattaaaagaagatgaaaaagatattattgacgtttttgattatttacggctttggattaaatgcccaaagaacagattatgattggaaaaagatggatcctaaacaaagaaaggaagtcatcaataatctttctcctgaagagagaaaagaacttctgaaaaaattcagaaacaatatgatcatggataatctgaatgtcgatccggaagataaagccgaatttacacaattgtataatgaatatctggatagccagaagcagataaaaagtcagtttaattcaaactttgatccggaaaccttaacggatgaggaagctaaggccaaactacagcaaagctttgaagtgggacagaagctgctggataacagaaaaaaatatgcagacaaaatgcagcaggtgataccctgccaaaaagttctgaagctgtttcaatcagaaaaaatgatgaaggataaaatggatgaaagaagacctcatggaaacaataataatgcttcaggaccaaaacaaaacccataatagtttatttttttaatgttggacggctcttacagatatttctgtgagagccgtttaattttgcttcaaattcctatttttgctgtagttaaaacatgaattatgagaaacttttttttccttttacttatgtcagtttttgcatcagcgcagaaaatagaaaccattgatctttcaaaatctattaaggatggcaaaaattctatcaagagtcttacggtaatagatcaaagggaaaatcaggaaattggaatggttatgcaccataaggatgaggtgaaaattattttcgaaaacggtgccagcaaagacatacaggattggttttataaatacaatccggtaagaggaaatagtgatatggtcattctgttggagaagttaaatatttcagaagataaaaaagaaaagtattctatcggaaagctagaattaaaggcaagtacatttattaaaaaagaggacggatatcattttgttgacagaaaagataccgtagcaacagtttcatcgcgtataacaccttatctggcacaaagtctggcaagaaaagtaactttaattcttactgatctttttaaagaatcttataaagcaacaccttgggaacttagtatttcagaaaacgagctttcagactatgttcctatattaaaagaaaaacttagtattctgaaagcagatgaattaaaagaaggagtttataaagactattacagtttttttacacacaatcctgaacccggatttactttgcagattaatgataaaggaatcgttacaaaggccgtaaaaggggaagaaaaaacggcaataaggcatttttatggttttgtgtataaaggcattgcatacaaaaatatccccgtgggttacactgagattttcaaagatgatattggtgtttttattgaggtgacaaaagcagaattatttcctgaaacggcaacaacgggggttacaattggtgctgctgcaggaggtctgattggtggtgttattggtgcagtgatagatgtcagtttatcaggcaaaagaaagaatactgtaggacctaaagtttatcttgatccttttaccggaaattatgtgttaccggaagactttggcaaaacaaaataatatttgaaaagggggaaagttttgcctctcttcttattgttatctgtgtttcagttaaaagaaagaattaagaatgaaaaattctcctgcattttcttatctttgcaaactacaagattcttaaatgaaaaacatacgaaatttttgcataatcgcccatatcgaccacggtaaaagtaccctggcagaccgtctgttggagtataccaatacagttacccaaagagaattacagtctcagacgcttgatgatatggatctggaaaaagaacgtgggattacgattaagtcgcacgctatccagatggattatgaatataaaggagaaaaatatattttaaaccttattgatacaccgggacacgttgacttttcctatgaagtttcccgttctattgctgcctgtgaaggagcgcttctgattgtagatgctgcacagagtattcaggcacaaaccatcagtaacctctatctggcattggaaaatgatctgacaatcattccgattctcaataaaattgaccttccgtctgccaatcctgaagaagtaactgatgagattatgaatctgatcgggtgcgactatgaagatgtactgagagtttctggaaaaacaggagaaggggttcataaccttttggagcagattgttgaaagaattcctgcaccggaaggagatcctgacggtccgcttcaggctttgatcttcgactctgtttataaccctttcagaggtattgaagcgtatttcaaagtagtgaacggaagcattactaaaaatgaaaagatcaaattcttcgctacaggaaaagaatatggagctgatgaagttggaacattaaaacttaagcaggttcctaagaaaacaatccattgtggagatgtaggttacctggtgtcggggatcaaagatgcccgtgaagtaaaagtaggagataccatcacttcttttgacagacctgcagcggctcctattgatggatttgaggaagtaaagccaatggtatttgccgggatttatccgattgattctgaggactttgaagaactgagattctctcttgagaaattaagactgaatgatgcttcccttgttttcgaaccggaaagttctgccgctcttggttttggtttccgttgcggattccttggaatgcttcacatggaaatcgtacaggaacgtcttgacagagagtttaatatgaacgtgatcactacggtaccgaacgtatcttattttggatactccaaaaaagaacctgaagttccgattctgatcaacaacccttctgaaatgatggatccgtctataatggacagagtggaagaaccgtttatcaaggcttctatcattaccaaatctgatttcgtggggcctgtaatgactttatgtattgaaaaaagaggagaaattgttaaccaaagctatttaacttctgaaagagtggaattggttttcaatatgccgcttgctgaggtagtatttgatttctatgacaggttaaaatcaatctctaaaggatatgcttcgttcgattatcatccaatcggattcagagcttccaagcttgtaaaaatggacatcctgatcaatggtgatatggtagatgcactttcatctttgattcatgacagtaatgcctatcacattggtaaaaaaatgtgtgaaaaacttcgtgagctgatcccgagacaacagtttgatattgctgttcaggctgccttgggtacgaaagtaattgcaagagaaaccattaaagccttaagaaaagacgttaccgcaaaatgttatggtggagatatctccagaaagcgtaagctattggaaaagcagaaagaaggtaaaaagaaaatgaagcagattggtagagtagaagtaccgcaatcagcgttcatggctgtattaaagctgaatgactaattcattataaaataaaaaccgcttctgataatgaagcggtttttttgttgattttatttcttacgggtatattttatttccatggttttgtactcttttcctgttttggagtccgggccgtacatttccagcttttgggtattgtcatccacaaaggtgaaaacttccctgaaatcacaatcttttccaggtcttgaaggatctgtcatttttcctttaaattcaacagattttgttgaaggattccattctccttcaccatgcatgattccggttcccatattgtcaatccatgtactgataaatttctttttggaattgtcatatcccacaatgctcattccttcgaaaggcattcccataaagttgcctttatggttactgatctgataacgtccgtcatacatcattttattggtagtctcagatttactcatcataggctttcctccgttttccatccacatggtggtttctcctgtccatattccatcagattttgccagcattttatgcatttctcccggagtagagtactccatccacgctttcatagctgttgcagaatctacaggcttccatttggattttgcggctgtagaatcggctttatcagcactgttggctgctgttgtttttcccttctcacaagccgttaataaaaaagctgcgacaagaattgataataaatttttcataatggtttagttttaagatggttagaatgataacttaaagataggaacttttattatatccctgattatttttttactttgcacataaatcgtaactttgtgtattcataacgcaaatcaatttatggagtctccaaaaaaattacaggatataaaagtggctgtagatgccgtcatcttcggatattttgataaaaaagaccttcagatccttctgattaaaagaaatattgaaccttttaaaggaggttgggcattgcctggaggacttgttcttgatgatgaaagtgtggatgacgcagtaaaaagagaactgtatgaagaagcaggtataagacccgattttctggaacaactgtatacatttggtaatctgggtcgcgatcctagaaacagagttgtttctgtagcctatcttgggcttgtgaatccatcttatcatgaactttttgcagactctgatgctgaagatgcacaatggttcagtattaataaactcccttctttggctttcgaccacaaaacaatcattgatacagctttaaaaagacttcgtacaaaaattcagtatcagccaatcggcttcaatcttctcaacgaagaattccccttttctgatcttgaaaacctttataaaaccattgttggacaggaaatcgacagaagaaactttcgtaaaaaaattatgagctacgggctgctaaacgaaaccaataacgttaaaaaagaaggcagcggcagacccggaaaactttttactttcaataaggaaaaatataaagagcttgaagagcaaggcttttatttcgaaattaaatagatttctaaacacaaacttcacaaatgttttgacaaatattcactaatatttatgacattcttgaagccacagtataaaatatcaattgaaaacattcaataggaacgggctttagcccgtttttttatatcatctcattcaactggcttcaacctaaatgcatcaaatttgtgtcatttgtgatcaaagtctgtgttatctgtgttgattgaaattaaatttttatccttgaaaatcaattaattataattattagcgtaaaaataacgcaaaaaaatttggttactaaaatgatattcttttaaatttgtgtcaaaataacgcaatcatgaaatacaccttacaaaatattacggaacgttttcagaagaaagaaaagttaaaatttctgtttttctggggtcacacggcgaaagataccattaccaaatcatgtttcagccagtggttccccggaaagtttgaagaaaatggtaccatttacaaaacagcagaacattatatgatggcgggaaaggccagattgtttaatgatcctgaaatagaagaggaaattttaaaagcaaatacacccaatcaggcaaaagctctgggtagaaaagtaagaaactttgatccgaaacggtgggacgaacataaatttgaaattgttacccggggaaatcttttgaaattctctcaaaatcagaaatttaaagactttcttttgtcaaccggagacaaagttctggtagaagcgagtccttatgacagaatttggggtatcggaatgctggaaacggacagcagagcagaaaatcctttgctatggaacggagaaaacctgttaggatttgctttgatggaaataagggatgaattaagaaggtaaaaacacaaccagacacaaaatattaattatggaaaaaatagaattacacccacagatatttctgattgaagattttctgaccgaagcagaatgtgatcattatatcagtctttcacaggagaaagtttttgaagaagcaaagatcaatgtattcggccgccagcagatgaataaaggaatcagaaataatgaccgattgatgatttttgatacaacaattgctgaagagctttttaacaaggctgtagagtttctgcctcaggaacaggatgaataccaggtccttaactttaatgaaatgctcagaatttataaatatgcgcccggacagcagtttaaaatgcacagagatggaagttatatacggaatgaaaatgaaaaaagcttttacacctttatgatttatctgaatgaggattttgaaggcggagaaacagaatttgagaacttatttactgtagctccaaagaaaggaacagctcttattttttatcatcccctgagacatgaaggaaagactttgatcagcggacagaaatatgtgttgagaacagatgtaatgtattcaaaagtataaatcagccataagagagaaggcattactatgtcttgtttgattagcgtaatattaacacaaataaaaatatttgatcatggaagatgaattaaaacccagatttatcgaatcattacaaagaaataatgatcagatcagagaagaccgggcaaggatcatcggagcagattccgaattgatctatagacgaagagttgaagatattgaattaaaaatcaaaagactcgagcatgaacaggaagggcttattgatatcagtcctttggacaggaacagtctgacttttgtggatttcaatcccgaagcattcgttcagaaagacatggaattatcattaacaatcagaaatctgaatattcagcttgaagtaacccaaaagagatttgaatatttatttggaaaaacattatagtcatgggaagtacaagatatgatttagacgctcgttatgacagagctagaaaagcaggttacggaacaaaatccgcaggagaaattttcacccagaatgccaaaagaatggctcatgaatcgatgaatccacatggaatatctttcagggaatccagagactcggaagttcatccgaattcggttccgattattttagggctggatgttaccggaagtatgggccatattccttacgagctgatcagggatggattgcctaaactgatgggcggaattatccagggaggtgttcccgatccggccttattgttccttggaatcggagatcatgaatgtgatggctacccacttcaggtagggcagtttgaatccggagatgcagaactggatatgtggcttacgcgcacttatattgagtcaggcggtggcggaaatgctggtgaaagctatctgttagcatggtattttgctgcatttcatacgagaacagatgcttttgaaaaaagaggtcagaaaggattactgtttactgtaggtgatgaaccttgtttaaaaacactttccgcatctgctatcagggaaattatgggaaaagggcagcaaacctacacccattctgagctgctggaagaggcaaagaaaaaatatgaagtataccacatcagtgttttgcattccgatcaggcattgagagcggacaggggctggaaagaattattaggacaaaactgtgtatctataacagatcacagagaaattccgaatgttattaaaaacattatctgtgataagtttaaaaatcaaagtttcggaacaatgggaacaggagggttagatcagtttcaaatgctttaaaaatctgtcaatgtcatgagcaaataggaatgacagagacaaaagattaaaaaaaataaaagtcatgaaaaaggcacaaatagtaataggacttggttttggtgatgaaggaaaaggaattactacagatttcctggcttctcagaatccggagaccattgtgatcaggttttccggaggccagcaggcagcacatactgtgatgattgatgatagaaaacatgtacattccagttttgcgagtggtgcacttcgtggtctgccttcttatttcacggagcattgtaccatccatccggtttttctgctcaatgaaagagaagaattaaaagcaaagaatggaaatattgaggtccatattcatccactggcgaaagttacgactccttttgatgtatggcagaacagaacgaatgcaagaaacctcgaacacggaacctgcgggaaaggaataggagccacgatgaaaagacacgaaagcccttataaactatttgctgcagacctgatttcacccggagaaatgctgatggaaaagctgaaaggaatagcctattattatggctttacagatgaaaacgaaattagtgaacttttacagccttttttagaagctattgatagtattgattggagaataaatgattatacctggttggcttcattcaatcaccttatttttgaaggaagccagggtattttactcgatatggatcacggtgtttttcccaatgtgacctatgctcataccacttcaaaaaatgcctacgaaatctgtaagcttttaaaaattgaagacattgaaatgtattatgtcaccagaacctatgcaacccgacacggaaacggctggatgagcaatgaaaaagaaatgaacctgagacacaatgaagaagaaacctgtacatttaatgagtatcagaaagaattcagaaccggggaaatagattacaaactgcttaattatgccttaaagctggatggagcatatgtatttccgactaaaaagaatttagttgttacctgtctggatcagattgatgagcaatttaaattagaaaatttgagtgttgaatttaatgctgtttacggatcctattctccgtattcaaaagattttaaacagattttttaatttcaaaagggaatcaggaataagataaaaaagcattagttttatatcgaatgataggatagagaatgattaatgattgagaaataataaccatgaaaataatacaatatataaaaggagatgctacccgtcccaatgccgaaggaaatataataattgctcatatctgcaatgatataggaggctggggaaagggatttgtcactgccatttccagaagatggaaacaaccggaaaaagaatacagagagtggtttagaaacaataaaaattttaatcttggagaaatccagatcgttcagacagaggatgatatctgggtatgcaatatgattgctcagcataaaattatcactcattcagaagttccacctatcagatatgatgctgtagaagagtgtttattaaagctcgcgcatgaagctatccaacaaaaagcttcggtgcatatgccgagaatcggatgtggactggcaggagggaaatgggaggagatagaacctattattgaaagagcactgcttgcaaagaatgtggaggtgtatgtatatgactttgaataaattaacaagcaatgaaagaatttgaaataagagcagactataaaaatgatactctcatcgtttaccaggcttataataaagccattgcacaatcagctgtggagcatcagaaatttactgctccgttttcgttcaacaggatgacctggataaagccttcttttctctggatgatggaacggagcaactatggacagaaatccaatcaggaatgtactctggcaatacatattaaaagagaagcctgggaaaaggctttgggcaaagcgattcttacttcaccagaaaaaagagtctatcccgatccccgaaattgggaaaaagattttgaaaatgcagagatttatgtgcagtgggatcctgaaaggaatattaaagggacaaaactgaattaccgttccattcaggtcgggattagccggtcgctgattgaggaattcaatgaagaatggattgtaaaaatagaggattatactcctttggttaagaaaatcctgaatcttaccaaatcgggagaatttgacaaggcaaagaaactgctgcctgtagaaaaaaactatcctctgtcagaagaactggctcacagaattggagcttcagtgtaaaaaaagaaaaaatcatgaaaacaacaacattatacagaccggtaggagaaaaggaaatgatattgattatggaaagcggatttaaaagtttccccccaagattagaatggcagcctattttttatcctgttcttaacgaagaatatgcttcagaaattgctgaaaaatggaataccagagatgaagccggaaactatcttggttttgtaacccaatttgaagtgttggaagaagtcgcagatcaatatccgatacagaatgtcggggccagaaaccataatgagttatgggtcccttctgaagaattaaatagctttaataaagcaattataggagacattaaagcaaccaaagtatttataggtgataattttgaaaaaacagaaaatactgatttggaagaattgatgttaaacattaaaaaactaactatgaccaataaaggaatggcaaaagataccttggatatccttgccagaaaatattatatcaacaaacataacgaaaaaataaatatagaaaacgaactggaaatcagtaagaaagaaaccattcttttcactccggaacacctttccgagatgatagaacttccaatgccggaaactgattttgaaacaaaaattgaaacctggaactgcagttctttaaaagctattttacaattggcaaaagaagaagatcagcacaaactcatgtgtctgaacttcgcttcagcaaaaaatcctggaggaggatttattaacggggcagaagcgcaggaagaaagcctggtaagaacttccggactgcatgaaagtctgcttcaagcctgggattattacaaaattcaccgtgcgatggaatcctgtttttatactgacaccatgatttacagcccgaaagttccggtgttccgaaaagacaaaggagaattactggataagcccgttctgtgcaattttattacttctcctgcagtcaatgcaggtgtggtaaagcgccaggaaccggaaaaagctcatgaaatacttgatgcaatggatctcaggatggataaaatgctttcccttgctttgcatgaaggaaatgaggtattaattttaggagcctggggctgtggcgtgtttaaaaatgatccaaaagaaattgcaggattatttaaaaagcatcttcagggtaaatataaagataaatttaaaagagtggtttttgcggtacttacgaaaaaagaagaaatgctgaaaccgtttgaagaaatacaatgaaaattgaattaataaaaggggacatcacaaaaattcagtcggatgccattgtcaatgctgccaattcatcattacttggtggaggtggagttgatggagctattcatagagcgggtggtcctcagattttggaagaatgcagagagataagaaacagacaaggcaaatgcaaaacaggtgaagctgtagttacaaatgcagggaatttgccggcaaagtatgttattcatacagtaggctctgtttggaacggaaatgaagaaaaggaatctaagcttcttgctaactgttactatacttccttgaaattggcagaaagtcttggtgtgaaaatcattgcttttcctaatatcagtacaggagtttatagatttccgaaagaactggcaggaaaaattgctgtagatgaggtcagaaattttaagtcagatatcattgagaaagttatttttgtttgctttgatgatgaaaatgaaatgatctataaaaagctattagattaaacctatgaaaaagctaaccatattaagcggtgccggaatcagtgccgaaagcggaataaaaaccttcagagacggagacggtctttgggaaaatcataatgtaacggatgtggcaagtccggaaggatggagaaaagacagagcgttggttttggaattttacaatcagagaagacgccagcttcatgaggtaaagcctaacgaagcacatcaattactggcaaaactggaaaaatattttgaggttcagattattacccagaatattgacgaccttcatgaaagagcaggatcttccaatattcttcatctccatggagaactgttcaaatcatgctcatgcaacaataaaaacctgatttatgaacaaaaagatgatattaaaattggagataaggccgaagatggggcacagttaagacctttcatcgtttggttcggagaagatgttcctttgtatcatactgcacggaaaattgtcaaagaatcggatgttttactcgtaataggaacttctttgcaggtatatccggcagccggactgattcatgatatcaaagacgattgtcttctaattgtgatcaatcctaatgaaacaggatttggttacggacagagagctgttataatgaaagaaaccgcaacacagggaatgaaactgttgtttgataaactggtaaaccttgcctgatggaaaatatattaaaagcaggaattatgggtgtttgcatcggagacgctcttggggttccggtggaatttagaagtagagaacagcttaaacgatctcctgttactaaaatgcttgctttgggaactcatcatcaacctgcaggaacgtggagtgatgacggctctttaacgttatgtcttgcagatagtttgtgtaatggatatgatcttgaaaatatagcattgaaatttttgcaatggtataatgcagagatatggactccgcatggtcgtgtttttgacataggtattgcaacttcacaagcaatttacagaattggaagaggtgtttctcctattttatgtggaggaaattcggagtttgataatggaaacggatctttaatgaggatgatgccattattattttacattaagaatttgcctattgagaagcgctttgatattataaaagacgtttcctctattacacacagacatatccgttcaattgtagcctgttttatttatttggaatttgctttggaaattctaaaaggaaaagacaaatgggatgcatacaggacaatgcagaaaacagttcgggaatttctggaccataatccaatttgttcacaaaatgaaatggataaatttcaccggattttagaattaaaagtaggtgaatatgatttagctcctttgtataccttgcaggaggaggaaataagttctggcggctatgttctccacagtctggaagcttctttatggtgttttttaaactcagaaagctatgctgaagctgttttaaaagcagtcaacctgggagaagatacagatactaccggagccatcaccggaggaattgccggaatttactacggatatgaaaatattcctgaggagtggattgcagagctggtgagaaaggatgatattgagaagttatgtgagaaattacaccaaaaattaatgaattaaaatgcaccaaccatgaacgaaatagaaaagaaaaaaataagtaaatttttaagcctgatcttacggcatcagccggaaagtataggacttacactggatgaaaacggctgggcagatgtagaagaactgagagaaaaatctgcgaaaagaagaatacattttactcccgaagaactggatgaggtagtagataccaataataaaaagcgtttcgcttttaatgaagataaaaccatgatcagagccagtcagggacattctattgatattgacctggctttggaagccttacagcctcctgactttttgtaccacggaacagcagaaaccaatattgcttcgattctggaaaaaggaattgagaaaagaaccaggcagcatgtacacttaagtgctgataaagaaacggctgcaaaggtcgggatgagacacggcaagcctgtgattcttaccatcagaaccggaacaatgcatcaggatggactagctttctttcagtctgcaaacggagtttggctgacagattttgtagatgcaaaatatatttcaaagtaaaaatgagcagaacattagtagttggcgacattcacggaggatttaaagccttacaacaggttctcgaaagagccggagtcacggaaaatgatcaggtgatttttctaggagattatgtagatggctggagtgaatcttccgaaattataaagttcttaacagaactgtcagaaaaacaggaatgtattttcatcaaaggaaatcatgatgcctggtgcgaagattggctggcatcaggcaaaagtcctgatgtatggctttttaacggaggaagaagtactgttgatagttacaaagattatctcccggaaaatctggatcttcatcttgagttctttcaaagaatgaaaaactatcatattgatgatgagaaccggttgtttattcatgcgggttatgcatccatgcatggtcctgaaagagaggtctattccagtaattatcgttgggacagaaccctttgggaaaccgctgttgcaatggataaaaagctacagagaaactcagcattatatcccaaaaggctgctgttgtacaaagaaatattcattgggcatacgcctactcttgatattggaattacggttcctgccaataaagctaatgtctggaatatggataccggagcggcttataccggagctttatccatcatggatattaatactaaagaattctggcaaagtgatccgctcccttctttatatcctaaagaaaagggcagaaattaatactattgagaacaaacctaacaggttttcaaaacctgttaggtttctgttttaaaataattttgcattttcaatctttcacaattttgcctgccaacaggttcctgtttctcacaaaagataactacatttaaagtctgaaaatatgacttcaatgaaactgaaatatcttttattcaccctgagttccaccttattttttgcacagaaatcatttcagactccttttgaaaaagaaaatggtaatcagacggttacctacgatgaaatgaacagctactatcagaacctggctaaaaatttcaataccattcaataccttaaaaaaggagaagatgacaatggaaaacccatttatgtagtggtttataatcccttttctgaaaaagatcttgaaaaattaagaaaagaaaaagcgattctctttgtcaacaatggtattcacccgggagaaccggatggtatagatgctaccatgatgctgatgagagatcttgccacccaaaagatcaaaactccacagaactttattattgctgctatttctgcttacaatgtcagtggaatgcttaacaggggttcttactccagagccaaccagaatggtccggagcaatacggtttcagaggaaatgcaaggaattatgatctgaacagggatttcattaaagcagattccaaaaatgccagaagctttcaggaaatctatcagtggctgaaaccggatgtctttattgataatcacgtcagcaacggagcggattatcagtatacatttacctatatttctacctttaaggagcgtctgggaaatactctcggaaactatttctacaatgagtatcaggctaaaaatcttgaagatatgaaaaaactgggctatgaaagtactccttatgtaaacattcacggagatatccctgaagttggattcgcctcatttgaagactctcccagatattccacaggatatacttcccttttcaattctttaggaacggttcctgaaacccatatgctgaagccttacgacaaaagggttgatgctacctacaaatatatgctggtgaatctgcagaatttagataaggactaccaaaaaataaaacagcttcgcattgaaaacttaaaacagtatcaggctggaaaacaatacggaatccgctggaaaattgattctacaaaattctctacgatggattttaaaggctacgaaggaaaatacaagccaagtgaaatttcaggtatgccaagactgtattatgacagaaacaagccttttacaaaaaatataaagctctttactaccgcggtcccaacgggatatattaccattcctaaatattatgtgatccctcaatcacaatacagggtactggaagagtttaaaagaaaccatattcagatgaagccgattcagaaggacagtactttaacggttgaatcttataaaatcaaagatttcaaaaccgttaaaaatccttacgaagggcattatctgcattttgaaactactgtgaatgcttcagctaaaaatatgacattttctgcaggtgattatctggtttctactaatcaacctggtgtaaaatatattatagaaacacttgaacctgaggcattagactctttttttaactggaatttctttgatggaatattggcacaaaaagaatattattccgcttatattttcgaagatacagccgcagaacttctgaaaaaagataaaaagctgaaagaggctttcgatacagccaaggcatcagataaaaaattgtccgaggacggaacagcacaactggattggatttacagacactctccttattttgaggaaaaaacattcaggcaatatcctgtttatagagtgttgtaaatatttgccaatcagtaaataagctaaaaaaagacgtttcaagtgaaacgtctttttttttattttggtaaacctcttttcaaggctagctcagctcttttaatggccattttctctttccagtccatgtatttctttttgaaattggacttcataatgtcgtcaaatttacgctgtacagtaaggttccacagagagtgtgcctttactgcccatgatttgtcccatgctcgtaaagaaatagagaaacttccgtccagatatttcatccagtgccaccatcctgtaggcatgaataaagtatcaccatgctcaagatagcactcaataccttctacaccgtccagtgccgggaatttggtgaaatccgggttttcaatatcataatcttccagtgcataggttgcatacggaatctggtaaagcctttctttccacttatagtcaaaaagaagaatatgctttcttccgttgaagtgagtatggaaaatatgagccatatcaatatcaaagtgaaggaacgttaccgatcccttaccgccaaagaacatattgggatacttatccagaaaacctcccattaattctttgggagaaatataatcttccagaagtttaggggcatattttatcgggtcaaaaaggaagattctgagatcagtgggctctctttgtataaggtcaatataatctccaaacttcatttttgctgcagatgcattgatgggagcagagggatctgcctttgagctgtcatatagcgggacctccacatctcctacaacctccttcatgtattccatcgtccatttttgataagcaggccatttttttgccatatttttgatgacaacgggccttcttggcttcagatatttttcgtagaaatcttctttcgaaatatcatctacaacatctataggctttaaaataattcccattttataaattttatgttacaaaattattaaatatatattgatgtaccagtttttaatttttttttaatctatgattcaaatcagattttactatttggaacagataaaaatatcaaaatttctattattgctaagaatgttcctttactgatttaataagacaaaatacataaagattttgttacaggatttaaaaaataatcagcctgccatttttataaaattgatatgccaaatatactttttcaggaaaatcatcagtagtgtatacatctgtaaagtgatgatgagtcgattttaaatgtatattttattaaaaaaatcaaaactttaataaatataactaaatttgtagtgataatgatttaacctttatccataaaattcatctttataaaaagtgtaacaaaaaccaataaccattaactaattgagcaaataataagtatgaaaaaaaatatttccttatttctgatgcttttctttacggtgcttacttttgcacaaaaaacagtttcaggaaagatcactgatgatgacggggtggcaataccaagtgccagtgtgacgatagaagaacctggaaaagatgctattctggcctatggaattacgaattccaaaggagaatataaagtgacctttacttcggcagaatccaatgtagatctcaaagtgaaggcctttaaccagaaacctcttataaaacagatcagcaacagcgatcagaccctgaacttcaaaatgcagtctgaagcaacagaaattaaagaagtacagctgaaaaccaaaatgatcactgcaagaggagacaccatttcttacgatcttaaagcgttcaatagcaaaaacgacagaacactggcggatgtaatgaaaaaaattcctgggattgaagtcaacaatgacggaacaatcctgtatcaggggaatgccatcaataagttctatgtcaacggaaaagaccttatggaaggaggttatggaactatcaacaactctcttccaaaagatgcggtacagaaagtagaagttctggaaaatcaccagccggtaaaaatccttcaggataaagtgccttcagatcaggcagctatcaatatcaagcttaaaaactctgtaactatgaccggaagaggggaagtaggaaccggtttcggagatccgtggctttggaatgtaaaactgaccccaatgtttttcgggcagaaaagccagtgggtagttaactataaaaccaacaacatgggtgagcaggtggaaaatgaagggaatattctggcttttgggaacaggtttgaagggaaaagaattaatgcttctcaaaatgattggttaaatgtagaaaatgcagatacaccaaatcttcctgtgaaaagatatctaatgaataatgttcattatttatcagccaattatcttaccaatattgataagaaaaaggagtgggaacttaaagctaatgcaaactatactaataatgctgtaaatagagaatcttatagccaaaaagattattttggtggaacctctaatattgtaaaaatcttaaacaatttttatacagataaagcaaaaggtgaattaatattcactaagaacgctaaaaaagggttttttaaaaataccacaagtttctctcaatattggaacgcagatagaggaattgttgacagaacagatgcaaaaacaggaattcagagaagcgctaatgaaggacttgaatctcctacaacatcattccagaattcattaagtacaattattccttggaaggaaaaaatggtaaatctattgtcctatgtaagttatcaaacagatagacagactttggaagtttctccatcatcttatttggatatcccggggtttaagccagtacctaacacagaatttgccacacaaagtttaagacttaagacttttgaagctaatcattctgccaatattggcttttctgccaaaggatggacttttactcctgaagttggatttaatttcaaaagtacaggtatgatgtccgatttgtcaaatgtgaaagcgattccatctaacaatcctaacgttcaagaccccaaacctgaggcatatagtaatgatttaaactacaccacagctacaccatacggaagtttagggataaattataaaagtgaatcatggatgatctatgctaatcttccggtaaattcaaacaatattaaagcagaagatccattaagacttgtttcaaaatcggtaaataaagtaacgtttgaacctaatatttttgcacaatattcatttgcttcattttggaaagcatctgtaaatgctaatattaataataattttggggaaataaatactgcatattcaggattcttaatgacatcacctggaggaattatcgcaatggatgttaacaacccaattcctcagaataacaacaaatctgctggaacaagattagaatatagaaatccattgaataatttattcttcaatgtcaattacagatattctgatgcaaagagaaacttaatttcaaatccggagatcaatggggctggatataccataatgaaatataaagaacaggataatcacgtattaaataatggatatagtgtagaagtcgggaaatattttccaaaatttaaaacgaacgcatctcttagctatagcaacaatacgacaaaatctgatgcatttttgaatgataaatcttataccaataaaaacaatggccagtcatttggaattaaattcaataacacctatttcagttggatgagtgttgattataatgcaagtcttaccagaacaaaacaaacaagtgttggagaattaaactctaatgccaccagaacagggtttactcataatctaggagttttcttctatcctatggaaaatcatacagttgggttcaattgggatcaggtaaatacaaatgcggcaggtcaaaaatatcataatgggttctatgatatatcctatcagtttacttgggctaaaaagaaaattgattttgaattgaaatggatgaatatcgcaaacaaaaaagttttcgaaacgtatgaaattaatactacaaatattgcatatacaaggtatcaacttcgcccaagccaggttatgctaaccgtaaaattcaactttaaataaaataaaaccaatccatacggattggttttttgttgagatatacttagatattaattaaaaactttgctggtctgctgaaggcccatagcttcccggcaaaggaatattgttcagtctgtaatatacgcccagctgagccctgtgatgggtaatctggtttaaagcatgacgtatggccccgtatttactccagcttgccagttcatggccgtcattttttatggtccagcttgggtttaggtcttcttcagtactgttttccaatgctgtttttgctgactgatagtcttcctccagctttttcataagatcatctctggtggaaagaactgtaggtttgtattctcctttggcaaaatccagttcggaggttttcaaaatagtattcggccattcaaaaacttctacaagatgggtggcaagaggcatcattttcatgcttttttcatgaggagcataatcgttttttccttcagggaatcgttcaataaatttttttgtggtttggaattctccctccagttcggattttaattgagataaggtgtccataatattttgttttttagaaacttaaaggtaagcgttttaaaaatgaaaatgttttaagagaatcataattttttgtaaccgacctggtatcaaaagacactgctcaatctttaaaaataaatttcaaaaaaatgtaacaaaagaagaaataggattactaattatataaacttgctacaatgaaaaagttattctctatatttcttattgcactttttgcttttgcaggagctcaggaatctaaagaaacagccaatcgtttcttttatgaactgacttttaaacctaagaaagattcagcgaaactggataagattattaccattcttgatatcacacccaaaaaatcaatttatcaggattatactatgccggctcaggattctatcattaaagtacagatagaagaaatggaaaaaaccaaatcttttaaagacatgactaagctgattaaatggccgaaattttcttataagattattaaaagctatccggatatgaaggttcaatatgttgacagaatcagcagaaaccttttctcatatgaggatgatccaaaattacaatggagcattttgccagacaaacaaaaagtaggagaatacaatgctcagaaagcaactactgaatttggaggcagaaaatggacagcgtggtttagtacagatattccttttcaggatggaccgtataaatttaaaggacttccaggtcttatcgtaaaaatagaagatgctgataaaaactattcctggcaactgagtggaaataagaagattgaaaactacgatgaattgtcatacgcagataaaatcaatgctaaaatgggaatggtgagcaatacaataacacctacttctaaagaaaagtttctgaaatcttatgaaggatacaaggcagatcctttcgcagagtctcgtccatacatgaccgcagagaatatgagcagaccaatgcctggaacagatggaaccgtaggagactttatgaaaagacttgaaaagcaggtgaaagatttcttcggatctaacgacaatccaatagaaaaagaacagccttcagacaagaagaaaaaataagacttcatatcaactaaattatattttgaatcaccccagatacagcaatgtgtttggggtgatttctttctgtggaacggattctatgcttgactgatagaaaattttaaaatttttctgaaaaagtttgattttattttttattctcatatgtttgtgaaaactaatttaaaaattataccatgaaaaaaatccttgtcacagttctattgacaacatctgcactattatttgctaaaaatgaatctccaaataaaaatccggagcttccaaaagtaaaagaaactgttttagtcgctaagaaaactattgaaaaaacagatcaattacaaaaacctattacattatccgcagctgcagaagagaaagaattaactacagaagaaaaatgcattattgaaattgcattaggtcctgtaattgcgggacctccttaccattgtacacaaatttaatccttaaaagaaaattcttgataaaattaaatttaatcaccccagatacagtaatgtatttggggtgatttcttttatgacaaaacgttatttagattaaatttaaatagcgtatatttgcaggactaaaaattaggctttgaaagagaacggattacataaattaagtggattccctaaaaataaaatggggaagatattgggatatgataacgaccatcttaaaatgcccaataaaattattgaaatgggacttcttccggaaaccactttcagaattttgtatcaggctccgttcagtgggcctatgtatgtagagtttggaacagagaaaagccggattgctcttcgtgaggaagaaggagattacatcattgttgaagaattgaattaatgcaggaaaacaagaaaaaacagatacttttagtcggaaatcctaatgtaggaaagtcgacggttttcaatacgctttgcaataaaaagcagaaaaccggaaactacgccggcgttaccgttgccagtcactcagggaactatgtttataagaacgaagaagtggaggtgatagatcttccaggttcgtacagcgtctacccgagttcagaagacgaagctattttttccaaataccttattgacgagcaggaaaactatgcaggggttgtttacattcttgaagcattaagtttaaaaagaggactgcttctgtttcagcagattcaggaccttggaattcccatgattctgattgtcaatcagattgatcaggcagaaagaagaggcattactatagatatccaaaaattttcacaagcattaggcattaaaattattcagaccaatgctaaagagcagatcggaattgatgcagtaagagaagccgtttacaacaatgaatttgtaaaaacggataaagtttcttttgaaaccccgaatgaacatagagattttattcagaagctggcagcccataaaggttttgacaatgaatataaagcctggatgagcctctcattggggacagatctcggaagaataggctctgtcatggaacagcttaatgagcctgattctaaaagtttggttcctaaaagattacaggttcaggaaactgttaggagatatcagaatgtagacaaaatcctggctgatgttatttcaaaaaaagctcagttcaaagaattacttaccgaaaagctggataaagttttagttcataaattctggggatacgtcgtctttttagcgattcttcttattatttttcaaagcgttttcttccttgcagaatatccgatgagctggattgaagatactttctcatggctggccgcatttacaagcgaacaccttcctgaaggtccagttaattcattgatttcaaatggaatcgttcccggaataggaggaatcgtagtttttgcaccacagatcggaatcctgctgtatttcctttatctgctggaagattccggatatatggcaagagtcgtatttctgatggacagattgcttcgtcctttcgggctaaacggtaaaagtatcgttccgctggtatccggtaccgcctgtgctatcccggcagtgatttctaccagaaatattgagaatgtaaaagaaagattgctgacgatattggtaacgccatttatgacatgctcggcaagacttcccgtatacagtattatcatcgggctgattatttcagaaggaacgttcttaggaataaaatataaagcgctggtcttgatgggaatgtaccttcttggcttcctggtagcattattttcagcagcaattcttaaaagatttatcaaaagcaaaggtaaaacttatctggtaatggacctgccggcctataaaaaaccacttttcggctatgactttaaaatggttttagggaaagtatgggacttcattaccggagccggaaaaataattttcattgtaagtatcatcatctggttcctgagttattttggaccaagccagaaagcagatcagtttgtagctacagatgttcatcttgaccattcttatcttgcgaaaatgggcaaaggaatagagcctgtaattgctccgctcggatacgactggaaaatgggtgtaggaatccttacaagctttgtagcaagagaagttttcgtagggacaatgtctacactttacagtcttgaagatgacgctcctgaagtaaaagtaattgataaaatgagaagagatgtaaagcctaacggagaaaaagtcttcagctttgcaacaggaatctcggttcttcttttctacgcatttgcaatgcagtgtgtttctacactggcagtagtctacagagaaaccaaaagctggaaatggaccggctttcaggtggtcatgatgacaggtttggcatattttgtgtcgatgatagtatatcagattttaaagtaatggactcatcattaatttttcaatacgtacttatcttattaattgtagcattcgcatgctactctctgtttaaagtacttaaaaagaactttgctcctaagaaattcagttccaaaagaaccaactgtgataaagattgcggctgttcttaatattgggttcatcggataattgaaaaaaatgtagtaatttcatttttctaatgtaaattattaatttgaatttcttaaaggcaggattaccggtattattttctttatttgcccttcaggtaaaggcacagtcagatactgtcaatactaagtcttatgcagaccaggtaatgattcgtgctaatcttgatactaacattgaaagctatgttttttcggcaggagaaggtaagaacgcattcaatatggacctgtcaatcaacaataaaacaaaaacatccctttccatcgattatagaatcataagtgcaacagtatcgtttgcgcccaggtttttagacggaaataatgatgatgaaatgaaagggaaaagttcttataccgatctaagcttcaggttttttcccggaagatttatccagaatgtttattataaaaatgtaaaaggtttttatgtagaaaatatgaaagacctttcccccggatggcaggaaggaagagatccgtacattcagtttccggatttaagagttcaaacctttggcggttcaacatcctatattctcaagaaaaatttttcagcaagaagtatctacacccagggagaatggcagaagaaaagcagtggcagctggattccgtttgtggattatgatcttaccattttcaggaatacaattgacgacgtcaaaagcaaggaaatacagtataatatcgggggaaatatcgggtatttctataattgggtgattgggaaaaaagtaaatatttcaccctatctgaccgtcgggatcggaggaaagttttcaagctacacagatattgagaacggaagtgctaaaaaaaatacgcagtatgcaaccataagaatgcagggaggtcttcatataggttataataccgaccggtttttattcggaggtaaaatgaattttaagagctatgcctacgaccagaaagataaccagactgtggaaaataataacctttacggactgttgtacataggctatcgttttgcaccaccgaaagttgtaaaaaatacctacgataaaattcaaaaaaagattcccgttctataagttcaaaggtcttttaagtatctttgcgatggaaaatttagaaaaaacaaaataaaaaaacatcatgtcattaataaaaagtatttccggaattcgcggaaccattggaggaagagtaaatgataacctgacaccgctggatgtggtaaaattcgcatccgcattcggaacatggcttcagaataataaaaacaaaaaagaccttacccttatcattggaagagacgccagaatttctggacagatggtttcttccctggttactgccactttgcaggggctgggaattaatgtgatagatcttggcctttctacaacaccaactgttgaagtaatggttcctgaactgaatgcagacggaggaatcatccttaccgcttcccataatccaaaacaatggaatgcccttaaattattaaacgaaaaaggagaattcatcagcggtgaaaatggagcagaagtactggctttggcagaaagtgaagacttcaactatgcagaagtagatgatcttgggaaatatgaaacaagagatgatgcttttgatattcatattcagcagattctggatttaccaatggtagatgtggaagcaatcaaagcaaagaaatttaaagtggttctggatgctgtaaactctacaggaggaatcgccattcctatgcttttagataaactgggttgtgaaaccattaaattatactgtgaacctacaggacacttcccgcataatcctgaaccattgaaagaacatttaggagatatctgcgaattggtgaaaaatgaaaatgcagacttgggagtggtggtagatccggatgtggacagactggctttaattgatgaaaaaggagaaatgtttggagaagaatatacactggtagccgttgctgattacttattgaaacataaaaacggagtggctgtttctaacctttcttcaagccgtgctttgagagatgtagcacatgcgcacaactcagaatactttgcaagcgctgtaggagaagtaaatgtagttaccttgatgaaagagaaaaatgcggtgatcggaggagaaggaaacggaggaattatctatcctgacttacactacggaagagattctttagtaggagttgcgctattcctgactcatttagccaaagaaaacaaaaccgtttctgaactaagagcaggctatccaagctattttatgggtaaaaagaaaatagaacttacgccggagattgatgtagatgctatcttaagcaaaatggaacaggaatatcagaatgaagaagtttctaccgtggatggtgttaaaatagactttgaaaacaactgggttcacctcagaaaatccaatacagagccgatcatcagaatctacactgaagctaaatctcaggaagaagcagatcagttgggagatgatatcattgctaaaatcaagagtttaatctaaaaatacacgaagaacggacacattgtccgttcttttttatatcagtaatgtttgaacatatcaaagacaggtttcctttccccaaagaaaagtggagaaaatttataagcagcttccaacgtatggaagttcctgcgaaaactttgcttttacaggaaggagagatttcctgtaatgcctattacatagaaaaaggaatggcaagagcctggtacaataacgatggtaaagacgtaacattccagttttttcttgaaaacacaatgttttcttcccttgaaagctttaaaaaaggcttgccaagtatggtgtcgttcgagaccatagaaccttgtattttatataaaatcaacagatctgatgtagaggccttcttggaagaagtttatgaaaattctgaactcagaaatctctttatggatgctctttttgaaagaatattcgactatatgaaacatttcttttcattcataaaagatacaccacagcagcggtatttgaatctggtcaggcaaaagccggagattatcaaaagagttccgcagcattatattgcttcctatctaggtattaccacagtacatctcagcagaatcaaaagtaaaatattgaaagagagactggagtaggctggaagatggaagccagaaacaggaagtttaaaaacatgctgtataactccgagatcattttaaccgcgacgtccacaaagaataatatgtattgttgaaaacgctcgcgaaggtgttccactcagcaatgatcattccttgctaaacgatgcccttgcgaacaaaaataatatacaatatcctgtttcctagcgccctccgcgtttcagactttaaaattcatatattttaaccgcgacgtccgcaaagaataatatgtattgttgaaaacgctcgcaaaggcgttccactcagcaatgatcattctttgctaaacgaagtgcccttgcgaacaaataataatcacaatatcatatttcttagcgttctccgcgttttaatctattatcagggttataaccttccaacctccctcttccagctcccctttccaaaactgataacaaatgttatcgctccagaacattcttccctcataattttgtataaaaattaaaagaatgaaagcagcagtagtatttgaaaaaggaaatattcctcaatacacagattttcctgaacctgaagcacaggaaaatgaaattatagttacagtgaaagccgcgtctattaaaaaccttgacagagccagagcaggaggaaatcattattcaacagataatcaggagcatcagccaacgattatagggacagacggagccggatatctggaaaatggaaataaagtctattttttcagtaaaaaaggaactgtagcagaaaaagcatcagcagataaaaaaatgatcattccgattccggaaaaactggatttctctatagcagctgcattgcccaatgcggtgatgggttctgcaatggcattaaaattcaaggcaggattacaacagggtaatactgttctgatcaatggggcaacaggaattacaggtaaaattgcggttcagattgccagactatacggagcgggtaagattatcgttaccggaagaaatgaagaatcgcttttagctttacatgaattaggcgccgatgaggtgatttctctcaaactggacgaacatgatttcaaacaaaaaataaaagaaattcacagggcaagtcctatagatgttattctggattatatctggggacattccgtagaaatgatattatctgcccttaaaggagacggcaacttttcccataaaacaaggctggtcaatgtaggaggaatgagtggagataccattcagttatcttcacagattctgcgggggactgatattcagatttccggatcaggattgggaagctggaccagggaagaaacaatgcttttgttttcggaaattattcccggaatgtttcaggcagccgtagaaggaaaaataaaaatggaaacacaggacatcgatattaaaaatatcgaaactgtatggaatgctgagatacaaagcagaaaacgcctggtcataagaatttaacctcaatttccgtttttttatccacaatccttttatcggttttctttttttactatttttataatagaaatttatgaaatggaaaattcaaaaaaaagttgcaactttgcataaatatttgaatatcagtttcagatgtattattaactaatcgtttgccgaggtttgtaagcaaattcagacatcaggccgacaaagaggacactattggaagagtattttggaaatgaacttgtaaaaaagttcgaggaaatgatggaaaacaatgacgaattctacttcgataccgaagaactggaagacattattgtttattatttggagcttggtgattttaattacgcagatatggcggttaattatgggctaaagcttcaccctaattcgttggatattaagatcaaaagacttgagatccttctggagtgggaagagtataatacggcgaaagaacttattgacgaactaaaaggcgcttctatggagaatacagactttttggtttgctacgccaagtattattcgaacttaggaaatcccagaaaatccattgaaatctgcaaaaaagctttgacattagaggaagaagaaaactttctccacaactttattgcggatgaatatgtgaatctcggagatccttttaacgctcttaagcattacaggaaagcattgaaagaagatcctgcggatgaatatgcgctggaaaactgtatggtatgcttcagtgacctgaataagagtgaggaggcaattgcctttcttaatgaatatttagatgaattcccttattctgaaaccgcatggtttgaatacggacaattctacttcaacagaaaaaattatgatgaagcgataagaggttatgattatttattggcaatcaactccaattcagtgggagtatatgccaataaagcagcctgttatgaagctttgggacaataccagaaggcaatcgaaacgtatgaagaaatgctggagcttgaatatacgaaagcatttaccttctataagatcggattatgcaacaaggctttaaaacagcctattctggctttgaatgcattccagaaatcattgagagaagatcctcagttttatctagccatgatggaacagtcttatctttatgaagaaatgggaggaatgtccgaagcattgcattttgccaaagaagctacccagctgaatgaaaacaacctcgattatcagaaaagacttgcgtttttattcatcgattccgggaagtttgaagaaagcctttcatgtcttaaaaagctggtagatgcagaaccttcaaggttttacaactggtatgcttattcagaagttttgatgttggtaggagaatatgaagatgcagtgacagttttgaataaagctattaaaaggcatcacagagctgagctgttttatcagttaagcaactgttatttcaatctgaaagaacaggataaaggaatggaatcacttcagaaagcactggatcttgatccgtctttggttaaggatatgcagaaaaaatatcctttcattaaagatgaggtaaaaaaagttaaggccggtaaagtgaagaaaaagaactagatttatctgaaaaataacaaaaaacctgcaaaactgcaggtttttttattgataattatattcgtaaaaaaacttatccggaacactgctgttcgggtttccgtttgcatcaaatgattgcctgctttcttcagatggataaccggcagtattaaaagttgttgtatacttatgctgagttgttccggttgctgttcctcctccggctgtggtgctggtaaactcacccttataagtacttaagctgttttttatatttgaaaataacatgctgacgccgtcactgctttcatttccattgaatatgatcttatcaaaacctttcacatttttaaaaggataatttttatccgtgtaagtataggtttctttttcggtataattaactgcatttccatttacggttcctgtgcctgaacctacgctgcttaccatatttccgttgctgtaggtaaacacactgttgatggtcgaagaaccggcagttcctgaattcgtcttcctttttacattgatttctgtagtactggtgtaggtgtatgtaaatgaaacagtgttttctactgttcctgtagtagaatattccttaatgaccgctgacgacatgcgcccactggaatagccatactcaacagtactttccagaacgttattttcgtaatttttgatgccagtaatgtaatcatcggtatacgaaaattctactctctgcccatggttaatgttgttgatcatgctgatgatcttcgttccgttgtagttgatcttcatgacaataccatcaattgtcattttagtaggaagtatcacattctgagcggaagggtcgctgttgtcaaaaggaatatcgtctgaatcagaacaggatagggtaaacaaggctatagagccataaagtaaaagttttttcatagttataagttaaatccgcccaaatataatttaatttataatatgatgttactttttaggatttgttcttaaaaatatcagtccgcctatgatgattcctgctcctataaattgcaaataagtcagcttttcaccatctataattccccagataatggccacaatgggcattaccaaagttactgttgaagcaaaaagagggctggaaactttcaataaacgataattcatcatcatcgccagtccggttccgaaaatagataaaagactaacaaacatcagtcccaacaggttatctttcgaaaaactgaattcagaaaaaaatcctgtacacgtcaatgcaataatagaaggaaatatcaaaacaaacgagaaaacaaaagcagacaaaacagtagaggagacctccataagttttgattttacagttgttgtgctcagagcatagcataaagtagccaataagagcagaagaatcggaatcattttaaactctccgctgtcaccgcctccaaatgccaggatacagactcctgtgaagcttattagcgttccgatgatctgttttttagtcgtttcaaacttccataccagcgcaccgacaatgatcacgaaaataggcatcatggaattgataatccctgcaatgctgctgctaatctcagtttcagcaatcggaaacaggaacattggaatgaaatttccggtaaaagctgccagaatcaaccatttcagatgttttttagggaaaagcttataattggaaattgcaaccggaagtaaaatgatcccggcaataagcactcgcaaagaccctacctgaaaaggattgaaatgttccagtgattttttaatcaaaataaatgatgatccccagataatactcaggacaatcagaagaacccatttttctttatctgcgttcattattttcgtgtaagatttttagaaattcttttttaggaatcatttttgcccctaagctctcaaggtgctctgtatgggattgacaatcaatcaattcaattgtatttttatggctttctacaaaatggataaatccggctttggaagcattactcaccttggcaaacatactttctccacagaacacattcccgatctgcaatccgtaaaaacctcctacaagttccccatcctgccatacttcaacacttttggcaaggccatactcatgaagctgtataaaagaatccatcagttcatcggaaagccatgtgcctgactgccctttccgggttgccttctggcagtttctgatcacttctctgaaattcttattctcagaaaaagtaaaaacattcctgttcaggatttttctcatggattttgaaaccctcagttctgcaggaataagcacgaatctcggatccgggcaccaccaaagaatctcctctccgggattgtaccagggaaaaatccccaattgataggcaaaccaaatacgttctacagagagatcacctccaaaagcaaccactccctcatgaccgtcatacagttcagggtctggaaatgaaatctcgttttcgtctaatcggaccatttttagaaaaaaaatcccacttcaaaaagcaggatttatattgatctttattctttaattaaaaaggcaaatcatcatcgtcatcaccagcaaacggattctcatttgaaactggagaagcagattgctgaggcattgcctgagtaggttctgaagcattatcaaatactttctctactctccatcctgtaatagagttgaaatatttagtctcgccctgaggagaaacccattctctacctctgatgttgattcctacttttacgttttctccttccttaaggttatctaataaactgattttatcagataaaaattctatgtttatcggctgtggatactgttcctgggtcaaaataaccatttctcttttttgaaacccgctcgcaaatgtttgagcatcaaaaagtttctttaccgttccttgtaattccatatcgtaaatattaacgttgtaaaagtaagaaaatgaaatgtaataaaaggtgccgtgaaaaaaaaatgtggaaattttaattttttttcctgaaaagtttggtactaaaggaaattgtcctatatttgcactcacaaaaacgaagcaagctctttaaaacttacaatataaaaaaaccagcggatgtggtgtaattggtagccacgccagacttaggatctggtgccgtgaggcgtgggggttcgagtcccttcatccgcactatgcgaaaatagctcagctggtagagcacaaccttgccaaggttggggtcgcgggttcgaatcccgtttttcgctccacaccatgccctggtggtggaactggtagacacgcaggacttaaaatcctgtgtccgcaaggacgtacgggttcaagtcccgtctggggtacaagaccctctgtaatatcttacggagggttttttgttttaatagagagtgttctttaaataaaatttttatatttgtaagaaatatagctagaatctgtaaattcagatcagcaaaccagcggatgtggtgtaattggtagccacgccagacttaggatctggtgccgtgaggcgtgggggttcgagtcccttcatccgcactatgcgaaaaaactctttggagttaccgggaagattggaacttttgttcgaatctttttttttcgcccttcaccatgccctggtggtggaactggtagacacgcaggacttaaaatcctgtgtccgcaaggacgtacgggttcaagtcccgtctggggtacaaaagccctccgtatgaaagtacggagggcttttctgttttataatcttcaacctttttgcaaagtccataaactgatgctttctcagttgttgagcagatccgttttcttttccagtttttccagtctttcaaaaatgcttgtgaagatatttttctcagcagttgaaacataccctacaatcttataatattccttattgtttatagactgatggtcagttgcatactgaaggtttttgttggtgtacaccagcaaattgttaatggagtccgttttcggatctgttttattcagaaataaaatatcaccggattgatattgaggaagtggagatttttcagaagtaaattcataaaccagatcaacagatgctaatattttttgcaatattgctgagttgggattattttcttccgtttttagctgtgtttctttactgttttgaatggccagctcaggaaaaagcattaactggtcaatgtcggaaacgcttgcgagctggtttaccggcaggatttcagtcagcaattgatcaagattaaggttaaaatggctggcgacctttaatatggtttcaatcttaggctcggcgcgtccttcctcataagagcttattactcctctgtttaaatcaaataaatcggcaaaagccttttggctaagtcctttcacctgtcttattttcttaatattagttccaaagaagctcattttgtctaatcttttttgcaaagatagagaatctgaaataaataattgctaataatatttgcattttgaaaattttattttatatttgtgtagagaaaataaaacactaaaccagccattatgagaaatcaaatattcagaacggtcaaagagtggttgttagattatgagtttaacatcacgctggaagatgaagctcagagaatcttaatcattgaaaaagaatccaacgggatcaaaaacatgatcctgatcatatcagactctattctgatcatggaacagttcctttttgaaatcaaaaacccatccgagaaaatattcctgagactgcttcagaaaaacagagacattgttcacggagcatttgtattggacggaaccggaagaagagtgattttcagagatacgcttccaactgataatatggcacaaaacgaagtgatggcttccatcaattctttagggatccttgtgggggaatttacaacagaaatgctagaaatgagtaagtaattcacaaaagatatttaaaatgaacattttcaaaagattgctaacaataggaaaagcagagatccattctgtgatcgaaagctttgaagacccaatcaatttaacggaagagggtatccgtgaaatgaaagaacagctggcaaaaagcatagaagcgcttgctcagttaaaagctcttgctattcggaaaaagaatgaagcggaaacagaagagcaaacggcaaaagattattataataaggccgtcgtgattgtgcagaaagccgaaaaaggagaagtggaaactgcagaggcagaccgtcttgccaaagaagccctgaaaagacagactgcttctctggaaaacgcaaaaaatctacagaaagaacacgaaaaacaatacaatgaatgcgaaaagatgcaggccaatatcaatcatctgaaatctggtattgccaagtgggaaaacgagctcaaaacacttaaagcaagggttcaggtaagtgaagctaccaaagatatcaatcagaagatgacccaaatggataccggaagcacagtaagcatgctggaaaaactgaaagatcgggtggtacagcaggaagctcttgcggaagtttattcagatatttcaaaggcaggaaaaagtattgatgaggaaataaatgccctggtcaataataacgatacaaaagctgaagaagatttgaacagattaaaagaaacactaaaaaaaggctaaaatgacctttcaggaatttttaaatatagcattttctccggtgaatacggtgctgacggttctgctcgggctttcagtgatctattggctctttaccattcttacagggctggatatagatgtgggaattcattccgacgtagatgcggatgcagatatagacgttccggatggccatgttcatacccctgatcatgacccttcagcatggatgcacttcctgaaatttctgaatctggatattgttcctataacgtattttctcaccctttcactgctgattacctggctggggtcattttatctgaattattttataccactgcccacatgggtaggtattcttatcatatttccattattaattggaggaatgctgttaaccaaaataattctgaaaccgctgaatcccttttttaaggaaattaatcataaaggtgaattatcgtatgcttttttaggacgggaaggccgtttgaaatcaagcattcaggatgataaaataggaatgatggaagtctttatcggaagtgatcctatgacgctgatggtgagaagccaggacggcagcaggctggaacacggaagccgcgtcatgattgtagatgaagagcccgaaaaaaggattttctatgtacagcagtctataagatattaaaaataagaactaataaccatgataactatttttttgattctgatgaactatatcctggatctcatctgtcattttttataaaacaaaaaacacaatctatatataaactacaaacttataaaactatgaacttacctttaattgctggaattattgttgctgttgtagcaacagtcggattgattttctggattttatcgatgtataaaaaaaccgttcagggaatcgttattttaagaactggttatggaggtacaaaagtcttctttaatgccggtatcgtgattcccattatccaccgtatggaatctatggacatctccgtaaaaaaactggagatttcaagagagggaagagcaggcttgatctgtaaagacaatatgagagcagatattcaggtggcattttttatccgggtcaacaaatcagtagatgatattgtgaatgtaggtcaaactattggctgtcagcgtgcttcagatgcccagacattaagagaactgttcgaagcaaaattttcagaagcccttaaaacagtaggaaagaaatttgatttcaccgaattatacgaagcaagaagtgaattccgtcaggaaatccttgatatcattggaacagaccttaacggatatgtgctggatgactgtgcgatagactaccttgagcagacctcaattgataaattagataaagataatatccttgattctgaagggattaaaaagattacagaacttacagcaactcaaaatattaaagccaaccaggttcgccgtgatgaagaaaaaaccattacaaaacagaacgtagaagcccgtgaagcaattcttgagcttgaaaaacagctggcagaaaaagaagaatctcaaaaaagagaggttgccaatatcaaagcccgtgaaaatgctgaaattctgaaagtagaagaagaagaacgtctgagatatgaaaccgttcggattgcaacagaagaaaaactgcagattgcagaagaaaataaacttcgtcaggtcgtgatcgctgctaaaaataaagaacgtgcagatctggtagaaaccgaaagagtattaaaagataaggcccttgaagctacagaaagagaaagaattgtctctcttgcccaaattgaaaaggaaaaagcaatagagctagagaagaaaagtattcaggatgcaatccgcgagcgtttaaccatggagaaaaccgtagtggaagagcagcagggaatcaaagacctggaagccttcaaaacagcagaaagaaacaagcaggtagaaattaccgttgccactcaggaagcagagaaaaagctgatcgaggaaacaagagccgcagaagcccgcagattggccgcagaaaaagatgcgcagaaatacgtcattgaagcacaggcgaagagagatgcagcagaaaaagaagcagaagcccgtaagatcattgcagatgcgaaagcaaaagaagaagctacaataggactatcagaagctcaggtaatgcatgcgaaggcagatgctgcagaaagacaaggggttgcagaagcaacagtgattgagaaaaaagcagatgccaacaaaaaagaaggaattgcccaggcagaagtgatcaaggaaaaagcattggcagaggcagcaggaattacagagaaggcagaagcgatgaagaaactgaacgatgccggaaaagaccacgaagaattccgtcttcagcttgccaaagaaaaagacgtggagctggctcagattgctattcagaaagatattgcagaagcacagtcaatggtactggcagaagccttcaaatctgcaaaaattgatatcgtaggaggtgacaatacatttttcgacaatgttatcagacaggtttctgcaggaaaaggattggataagttcatcagccacagcgaaaatgcacagattgtaaaagaaaaccttctgggtgatggaaaaaatatcattggaaaagtaatgggaatggtggataaatataaaatctcttctgacgacatcaaaaatatgagcatagcgtccctgatctttaaactgaatggcgtagccaatcaacaggaaaaagttattctggaaagagctctggacatggctaaacacctgggagtagagcacaaaccggtgaataacaaccatgtttaatgcaagagtgctttaaaggcttctaaaattcaaaccttataggtttccaaaacctgtaaggtttagactaaaaaattttcaaagtaccacaagttatacaaaaacctgctgtcctgcagcagccatgacaacctaaataaaaacgatgtcagaacaacttaattccggaacttacgaaattattcagaaccgtttaaatgagcagaagaatgatctgattcagcgacttcagcagcttaatgaaaaccgtaaaaatatatttggcggagtagatttttcgcttgtagccaatgaaagaatttctacggatcacagctgtattgccaaagatatctattcactgggcgaccacctgattttcgggtctaatgcacatctgggacttcagacggaaatcaatatttcggacgttttttcaatatataccatcaataatgaccgatttgaacctcaggattataccctgatcaatgatgaggttttcattgacgagtttaaaaacctttacaaatattacagaaatactttctttgccagatttaccttcacggaaaactatctttatatggtttttcagctgtcagaaagtactacagatatcaaagcctttaaatggctgatcaaagataatcagctgatctatgttgattccagaagtgcttccgagacctcataccctcagcagcatggttttgcatggacaaaggcaacgagagatatgcagagatccgggaaacatcctcatatttctcttgcagataaagtttttgtagaaagcattggcggcgatatcaccatcaaagtagaagacaatacggatatcggaaaaggaatttattccgaagatgtcattcacaaagatcagaatctggatgatgcagagattcatttctgtgatctggataatcttgttttgtttaaaataaagccttatcaggaaacagaacgctattttatttataatcacaaagaaaaaaccgtttcaagagcagatgctcttaaatattcgggacttttgcttcccgaaaatcagggcgtattattttcaaacggatatgcgcttcagaccggaggattaaaagtgatttctcaggatcagaacaggctttactatctgaaaaccgttacggaaccgaacggagagaactttttatatgttttttatgatgataaaacgaataattatcagctgatctcctataacattatcacccagaccattgagacacccatccgatgcagtggcttcacatttcttaatgatggaaagctgatctatcttcgggaaagcgtagaaaccacgaagcatcatctgtcccagatctggcagactcctttttcaaaagaactgttgcccaatatagaaaaggcagacagtttactgtacaaaataggaaataaagatattgtacgcgtcatggcagaaagccaggagctgatcacccttctgaacaaaaaagactcttatagtggcttgtatgatgatatcgtaaagctctctacttttattctggatacttactattttcttggtgaagatgaggttcagaagcttgatgtaccattgaaggagatcagagcgattgcgcattcggccatcaatgaatacgaaaaagtagtagaacagagaaaaaatactgaagaagctttagaaaagataaaacagacctgtgataaaattcttgatgataccaaaaggcttcactattcccagcttacagaatatattgatgctctttctcaaatcagagccttaagaggagaagtgacaggagcaagagagcttaaatatgcagacacagctttgctggatagattggaaaaatcccttgcagaccgttatacagaactgtcaaatgcctgcgtggaatttctgcttcaggaaggtgcattattgccatacgaagaaagagcacagcaaatttctgaagatatcattggattacagaaagccattgatgccagaacaattgaagaaaatatcaataccctttccgggcagctggaattattggtggatattgttaataatcttaaaattgaagacacctcccagtctacccagattattgaaaacatctctctgatttttgccaggctgaatcaggaaagacttgagctcagcaaaagaaaaagggaaatttcgggaaaagagcttgcttcagattttcaggcccagattacgttgtttgaccagtctgtgatcaactttcttgaactttcacaaactccggaaaaatgtgacgaatatctgaccaaactttctatccagctggaagaaatggaaacgaaatttattgatttcgaagaatttatcctgcagataggaaccaaaagagaagaggtttacggacatttccagaataaaagagtacagcttaccgaagcaagaaataaaaggactcagaatctttttgatgctgcacaaagaatactgaaatcggtacagaccaaagcagaatcttttgactcagaaaatgagatcaatggctattttgcagcagatcttatggtggagaaagtgagggatctttccaggcagcttgcagaattggaggattcagcaaagtcggaggagattcagaccttgttaaaaacccagcagcaggaagcagtaagaaagctgaaagacaaaaaagaaatttatgcagacggacagaatattattgcgttaggagactataaatttgcggtaaatcagcagaaactggatctaactctggtgctgagaaatgcacaatactattatcatcttaccggaacaagcttttatgaaccactgaattttaccgcagatgaattcagagaggtatggaatcaggaatttgtatcagaaaacaacaaggtaaaaaggtttgaatatcttgcctggaacgtgttttccgctcatcaggagataacctccgaagcagagaatgaaaaggctgtacgggattttacctcagagcattttggggaaggactggtaaagggggttcatgataaagatgccgaaaaaattgttctcaaactgcagcagatacacaatgagctgggactgatgaggtttacagcacaggaaagaacactagcccagctgttctggtttttccttggaaccgaaagaaaggaatattataccaaacagtttgcggctgcatctattattgcccagtcattcattgtaaaacaggaatttgaatatctgagcagagagctttcggaagaaatgaaatcatttgcatcagccaatagtatttttaaagagacagattgtatcaatgctgccatctacctgaaaaaagaagacaaagagaatttcctgatctcggaaaaagccgccactctgtacgagcttttcatgaaagagctcaaagaaaagggtaaagatctggagtttatggctcagttacaggctatgtatcaatatccttcagcgtgttattatattgctgaaggtgcattacaggcatttgactctgatgctgatcaaaatacggtacaggaagcagcaggatttttgatcacccagaagtttgatccgaaaaatatcagacatattgcgtatgaagtcgccataaaagagctgaagtctcttgaaaaagacacggaatatcatcttaactactttgaatttgtatcccgactgaattactttaatacggttacagttccgaaatacaaacgcctccaggaattgaaacacagttgggtagatgaaaagaaaaaagcactgaaactggatacttttaaacctcagatattaagctcatttgtaagaaataaactgatcaatgatgtctattttcctctcatcggagcgaaccttgccaagcaattgggaacagcaggttcagacaaaagaacagacaggatgggaatgcttcttctggtatctccaccaggatatggaaagacaaccctgatggagtatatggcagaacgtatgggattggttttcatgaaaataaacggtccgtcactaggctacgatattgtatcaacggatccttctgaagccagaaatgcaggcgcaagacaggagcttgaaaaactgaaccttgcgctggaaatgggagataatgtcatgctttatctggatgatattcagcactgtaatcctgaatttttacagaaattcatctctcttgcagacggacagagaaagattgaaggaatctacaatggagaaagtaaaacttatgaccttcgatccaaaagattctgccttgtcatggctggaaatccatacacagagagtggagaaaagtttaaaattccggacatgctggctaaccgttcagatacctacaatctgggagaaatatccggatcgaaaacagatctttttgatctgagccttattgaaaatgctttaatgtcaaatgaatacctgaccagattaacaaatccgggaatggaaaacctgtatgaactctatgattgtgtacttacagataatcctgccgataacctgaaaggaaacttcagctctaatgaaatatcagatttcagagcagtcctgaaaaatacggtcagggtaagaaacatggtgttaaaagtgaacagggaatatatcgcatccgcagccatgtcagacgattaccgaaatgaaccgccattcaagctgcagggatcttaccgtaatatgaataagctgattgcacaaatacagcctattcttaaagataatgaagttactcagcttgtcttgaatcactatcaaaatgaatcccagacgctgaccacaggagcagaagccaatatgttgaaaattaaagaactgataggaattctttcagaagaagaaaccgaacgctggaatgagataaagaaaacatttgttaaaaataaaaccctgaaaggattgggtgagaatgatagaatgtcacagattgtagcactgcttgctcagtttggagacggactggaaggaatcaaagaagcccttaaaaaagcagaacaataaccacgaaactttaaatagtttacaggctgtttcagatagaaacagcctgtttttatatatatttacgttttagagctagcattgattagaaatgggcttcacttaatctacaaagcatccatataatgacacataaaaatctgtacccataatattctatagttctgtatctgtgtccaaaattaaatactccataattttgtttagctaaagaagaaaatatggaaacaatcactcaacatcagaaacagtttcgatatgctgaggcttatatatcagacatgctggtgctgaaaaatatttttctggaaacacagaatctcaaattagcagatcaaagtttcggacttccttttcttttggctaaaaacggaagggaagtagttgcttttgccagtcttattgtaaatgaaaaggatgaaatttgctttaaaatatatgataaaaacaaaatgactgaacccgaggagagaaacttcttttctcatgttgaaagatattttaaaaataataatagccccaattttaaaaatcctgctcaattaaaaagcagtataaatagtatggttaactggcttaatccttaaacataggaaaaattgtacatttacttaaaacccggattctatgtctaaagatgttctgtaccttaaaatagccaattctgtcacagagcagattaaaagtgaaaccctgcagtttggagacaggctgccttcattgcgaagtgcccagaaattatacaatgtaagcctgaataccataaaacaggcgtatatggaactcgaaagccgttcgctggtagagtcacgtccgaaatatggatattatgtaagccagacttcccagcgaaaactggcgctgccttctgtgacacagatgaaggtttcagagggaaaaaatacccctcaggatttgattgacaaggtattcgggagtatcggagggacagatgtcacacaattcgcgcttggaattcccgggaaaagtcttcttccggtagccaagatgaaaaaatgcatgattgatgtgatgaaaaggaaaagcgacagcggaaccaactacgaacccgtgcagggaagcgaagtactgcgccgggaaatcgccaaatggtcaatggttatggaagggaaaataacagaagatgatctggtgattacttccggagcgatgaatgccgtttataattgcttaatggccgtgacgcaaccgggagattcggtggcggtagaaagtcctgtatatttcggaattcttcaggccattcaattattgggattgaaagcagtagaaattcctacgcatccgattacaggagtagatctggatgctctaaagaaagtgcttcccaagctctctgcatgttgttttgtggtaaattataataatccattgggatttcagatgccggatgagaacaaaaaagaactggttaaaatgcttaccgagcataatgttcctttggtggaagatgatgtctacggaaacatctatttcggagcaggaagaccgaaaccgtgtaaattttatgatgaagcaggcattgtgatgtgggtaggctcggtgtccaagacattagctcccggatttagagtaggatgggtagcacctggaaaatttaaagaaaaaattatccgccaaaaactggttcagacggtgagcggaccttctttattctcggatgtgattgctgatttccttgctcatggaaggtatgatcatcacctgaggatgttcagaaagaaattgtacgccaactaccttcagatccagaaatcggtgattgaatattttccggataatacaaaaatctcagagcccaaaggaggttttatgctctggctggaactggataagagaatatgcacagaagatctttatgatttggcggtcagtcagaaagtaaactttgccccgggaagaatcttttcacaatataatcagtatcagaactgtatgcgtttaaactatgcattagaatggacagacagagtggaaagtgatctggaaaagctgggaaaaatgataaaaaacagaatttaataaaccttatagcgatgaatgatagtaaaaatgaagtaaacattatagcctatgaacctcagtataaagaagctttcaaagctttgaatgaggaatggatcaaaaaattttttgtaatggaagcgggagattataaactgctggatcatccggaagaagagattttaaataaaggaggacatattgcctttgccttattggatggagaagttgtgggaacttgcgcattggtaaaaacagaagatcatcctcttacttttgaactgtcaaaaatggcggtaagtcctaaagcgcaaggaaaaaaactaggctatctgctgggaaatgctttagtggaaaaagcaaaagaattaaaggctgaaaaagtctttctagtcaccaactctatccttgttccggctatcaaattgtacgaaaaactgggctttatccatacccctatcggtcatgctgagtacgaccgtgcagatgtcagaatggaattggtttttcatagataaacccattgtttctcgatagtttaaaaacaattaatcgtaaggagttctcattttatgagaaaaatttccgtttttacctttttgcctatccccaggaaaatttccctatttttgtaaaactccttatttcatttatgaaaaaaattattcttatcgaagacgagaccagtgtggtatcctttattaaaaagggacttcaggaaaacggatatgaaatttctgtagcatttgacggccgtacaggagtgcagctggtgcaggctaatgatttcgatctggtcattttagacattatgcttccggaaatgaatggtctggacgtgtgtaaagagataagaaaaacaaatcagagtgttcctattctgtttctgaccgccttgggaacttctgaaaatatagttctgggactggaaagtggcggagacgattatctggtaaagcctttcaaatttattgagctggtggctcgtgttaaatctttgctgagaagaagcaacaacaatgggccacaggaaatcgctgaaccggagccggataatgaacatgtatttcagttttcggatctgatcgtgaatgattataccaagaaagtaacacgcggaggagaagagatttcactcacttccacagaatataaattactgctgtattttttgaataaccctgaaaaagtaatttccagagctgaaattcttgatgcggtgtggggagtaaattatgaactgggaaccaatgtagtggatgtgtacgttaactatttaaggaaaaagctggataaccaggaagaaaataaactgattcataccgtgataggaatgggctatgtattgaaaaaaacataatgaatgtttaataaagtcattacaaatcaaaccaaaacgatggtgcttttaatgttggtttttacagccatcattttgctgttcagtggtttggtgtacttttctatcgttaatttttcgcatcagagattttatgagctgctgaaaatcagaacggcaacaattgttcagatcgaaaaaagcaaggataatctcgatcttccggaaaactatattctcagcaacctgaatgatgaggagcttccgatggaaaaagactatgtttttgccgttcccaccgattccaatttcaaaaaaatatcccaggaagttcatattccggactatttctttaaaaatatcattaaagaaggtgaatctaactataatgacaaagaattctattatatcggccaaagcttcaggtatgatgataaggattatatagcgatagcttctgcaaaaaaccattatgttgtctactatcttggatttttaaaaagaacgctgattacgtgtattgtactttccctgttcttcagtatgatcttttctttttatctgtctaaaaccttattcagacccatcttaaaaatcacaggaaaagtaaaggaaataagttctgaaaatcttcatttaaggctagaatcacagcctgataataaagagcttaatgagttggtggacacttttaacgatatgctcaaccgtattgaaacttcctttgaaacccagaatcatctgatcggaaatgtttcccacgaactgagaacacctcttacttctattatgggagaagcagatgttgcactatcgatcagcagaacagccgctgaatacaaagaaaccctcggaattattctggacgaagccgaaaagcttgataaaaagatcaaagctttgctaatgattgctcaaaccggattcgacggaaagatccagaaaatggataaggtgaggattgaccagctgctttgggatgtcattgaaaccctgcgaagaattgattcccgaaataatattttcctggatatcagcatgcttcctgataatccaaaaaaacttaaagtgcagggaaacgaacagctcctgcatctggcagtggccaatatcatcagtaatggctgtaaatactctgattttcagcaggtcaaagtttctttgggagctaccaatacagatgtctacatcattgtaaaagacaacggtatcggaattcctgaagaggaaatgaataaaatctatgatccgttcttcagggcgtccaatacaaacaactatgaaggatacggcattgggcttccgttggccagaaacattgtgagaatgcaccatggcgagctgatcgtcagttcacacgaaaatcagggaacaacggtacagatgcgttttccgaatttctatactatgcagaaagaagaagaagttaaagggtaagccggaaacaataggtaaaatcgcaaaacggcaaatttgcgaaaggctctttcaccttttattctttcactttttcgctatattaactcctcttaacaattttctaatctcattttaatctctttaatcacattttaattccgttccaaaggtcttctaataccgtcgttctaattttgtattatcaaaaaagataaaaacacaaatacaaaataataaagaacatggctaaaacaattttaattgcaacagattattctcttgagtcattaaatatattgaagaaggtacttaaagagaaggatgcggcagaagatcagaaccaatataatattcttctgacttcaggatatgattccggagattctataagagatcttttattcagcaccaaaacatcggtcttcaataaaatcaggccgaaagagttttgtgacgccttaggcattatcagtaataaatatcctcatctcattaataaaatcatctgcgacatttttactggtagcttccagagaacttttaatcaatatgtaaaggcagaaaatattgaagaagcttattattctccttctatcataagcaaaggaaaaggaaaattcgatctgattccttatatcagaaaatgcaaagaacttcagtcttatgaaattaccattgaagcaagagaaagacttccggaaaaaggcagactggcagagatctttgtagaagtttaaaagtatacacaatttaaaaagataaaaaatgttaagaaattatagtaacagcaggacactgggagacaatatcaggttggggacgctgactgccttcaccgcaggtactataaatattgcttccctgttgatatttctctcttttacatcgaacgtaacaggacactatgctattctggcagcagaaatcagtaaaggaaactggacgcaggtagctgtagtgggagcatggattttcctcttcttctttggaagttttgtatccaacttcattgtcatcaattttaataagaaaagtaaatattttgcccatgccatgccgattgtgctggaaatcatatgtcttctttttgtaggagtatacgggcagttttattatcagaaaacattagaagaaacagaataccttgtagccctgatgctatttgctacgggactgcaaaacggattgacagcaagtatctctaatttctctgtgaaaaccacccaccttaccggaacaaccaccgacttaggaattctggtatctatgtttacccagaaaaaatacagaaaaaacggagaactgatcggcagagctaaacttctgacgagtattatggtagcctatgtgatgggagctgtattttcaggacttacttattactatctggaattcagggtgttttatgtgatcagtatatgtctgctgattgtcatcggatatgatgcctataaaattcacgtccgtcactttaatacaaaatacagatacaacagaatctacagaaaacctaatatttttgcttacctgtatgagaaaattcatggagctcctaaaaaagagaagaaaagaaaacttgtctttgaggaataaaaataaaacacaagcgattaattttttgtataaactagctgtaagtgcccttattttatcataaaataggggccttttttttaaaaataacttcaatatttaaatgtgattgttttatatcctttttttcgtgagggttgaaataaaaatttacggatcaaatcaataaacttgctaacgcccttcattacaaacattaaaaaaatcagttggggataaatagggaaaaatgttgataattaaatattaaatcacggtttttgtattttaattcccgttttcattgactatttttgtaagttgatttacgtttttatgtcagatattattcagcttttaccggatcatgtagccaaccagattgcagcaggagaggtggtgcagaggcctgcatccatcgtgaaggaacttttggaaaatgctattgatgcagatgcaacgaaaattgaactgatcatcagagatgccgggaaaaaccttattcaggtagtggatgacggaaaaggaatgtccgagacagatgcccgtatggcttttgaaagacatgcaacctccaaaatcaaagggacggaagatatcttcagaattgccacaaaaggattccggggtgaagcgctggcctctattgcagcggtttcacaggtggagctgagaacgaagcagaaagatacttccattggaacaaacatttatattgaaggtggagtttttcagtttcaggatcctgttcagacagcagacggatcaaattttttagtaaaaaatcttttctataacgttcctgcaagaaggaagtttttaaaaaataataatattgaattcagacacgttattgatgaatttcagcgtgttgcattagctcatgagaacctggaattttccctgttccatgatgatgaagctgttttcaggctcagaaaaggcagtcagatgcagcgtattgtggatgttttcggaagaaagctgcagccgcttctgatccctattaaagaagatattatatggtgtaaactgcatggttttgttgccaagcctgaaggtgcgaagaaagcaaggggcgagcaattcctttttgtgaatggaaggtatttcagaagtccatacttcaataaagcagtgcaggaggcttttgaagggctgctgcaaccgggatatgtaccttcatttttccttttcctggagttggatccggaaaaaattgatgtcaatatccatccgcagaaaacagaagtgaagtttgaggatgagcatcttatctttgccttgcttcgttcaaccatcaaaagatctctggggatttacaacgtgtctccaagtcttgatttcgacagagatccggaactggatgaaatgatgaataaaccaattcccagcaaaagtaacagcggtggaagcggaagcgttattaaaatgcctgaaattattgtagacaaagattataatccgttcctggaagaaaaaaatgtagtgcatccggaagaaatccagaaccttacggaaatgtatcatcagaatattacagcagaaccttcaaaaatcaatttatttgaagatgaagattttgatgaagatcttatgaggcttccaaacggctattggctttttaacaaaggagatgtgacgcttatgttggatcttggaagaatgcacaggcttttgatatctgaaagcaacaaatctgtcagaaaatcaagtacaaacagccacgctcttctcttttctctggagtatcacatgaatgagattgagaagacaaaatacaatgcgattaaaaaatatcttccggaattagggtttgacatgaaaattgctcatgaaagtgtacttcgcatagattcacttccggaagggttaaaagaaacccaggcgatgaagttcctggaaaacctttttgagatcctggattacaagacggaagaagaattcatgcagtattaccataaccaatggaataaaatgcagtctaagtcaagatttgattttatttataaaaaagatgcggaacagcttatcaaagattttacagcattaggcttcccggaatttttaccggatggcaaaagatgcttttatgaagttccgtttaatgactttaaaaacaaattttaaaaattatgtttaacaatataccgcccattacaaggaatattattatcatcaatgttgtagtatttattttgacttacttcatgggaaaccagatgattggctatcttgcgggcttttatcctttctcaccatttttccattcatggcagattattactcatatgttcatgcatggaagtattatgcatattttattcaatatgatgacactctttagttttggaccaattctggaacaaaccttaggagacaaaaaatatttgcttttatattttgcaagtggcttaggtgcattttttctttttaatgcatggaattttgttgaggttcaacaactttcccgtgaactggagcagctagggttcaatgtaaatgcttatttgtccggagcaagtgttgaatttgcaggaaatacgagctctgttcttaaacagaaagaattactggaaagtttaaaagctattgttgctaccccaatggtaggtgcttccggcgctattttcggagtagtcgccgcatttgcaacattatatccggatgcaaaaattgggattatgtttatccctgttcctatgaaagtaaagtacctgttacctgttattgttgtgatttcaatatatcttggggtttcaggaaacggcggaggcattgcccatctggctcacgtaggtggtgctttggtaggatggctcctggcactaaactggaaaaaacacctgtacaggttcaattaaaataatgttgtgaagattttccgactcatagtattgattatccatctgggaattttatttctattgttgggtaccttgttaaatgcctatgtcccaccaaagatttttccgtggtttaatctgctttctttagggtttccggtacttattatcttgtatcttattctgaccatattctggatattcagctggaaaaaaagagcatttgtatttatgtttgccggattggcttttataaatcctgtaaaaagatgggttaattattctgatcagaaaggaaactctgacataaaggttgtttctttcaatacaagggcaggcggcagaggaaacaaagagattgcaccatacctgaaatctcagaatgcagatgttttttttctacaggaggatgcgggcaatgaatatcagtttgaaggctatcagaaagcaaatccgggaggaggcttaaccattctcaccaaacataaaatcattaaacaacagattttagatccacaggatgaagacgtaagaattcccggtgtgctggccgatattgaaattaaaggcaggacctacaggctcattgatgtctatctcaatccttttcggtttgaaaaagagatggtgaaacttaatggaaataccgataccaacgaacaaaaaataaaagatgttattaaaagactgattcccacctttaaaaaacatcaggatcaggtagcgcttattcgtgaagccattgaaaattcaccttaccctgttattcttgcaggtgatttcaattctgtaccgaattcttatgaatattaccatttatcagacggacttgaagatacatttttaacagccggaaagggaagtgcaacgagttttcatgattataaatttccaatcaggatcgactatgttttttcttcaaaatctttaaagacaatatcttacaaagttgaccgttctgtaagtatttcagatcattatcctgtcattgtaaaattttcttcagaaagtaaataatcataaaaatagttaaaatttttatgcttggtaggatttttgttgaaagaaaacagtaccaagaacgttttttcatgaagtcgaatcagatattactatttatacatatcgttgttgccgttttgctcttatgcacattggggaatgcatggattccacccaacattctgggcaacctgaatcttctgtctcttggatttccttatctgatccttgcccatatcatccttacactgatttggatctttaaaaaagaaaaaattgcaatagcttttgctttaggtacacttattttctataatcctatcagacgatggattaacttttccccgaaaacagagaatttaaaaacaatacgggatatcaaggtattgacttttaatgtgaaatacggcgaatacggctgggataaagtaaaagactatatcaaggcccaggatgccgatatcattcttgtgcaggaaaaagatacaaaccgtgttataaaacgtgatcttataaagtatccgtcagttattcttaaaacgaaacataaaattgtaagacaggcagaattaattgatgagaaagcacggggaaattcattctatgctgatatagacattaacgggaaagtggttaggattattaacgtttatcttgagcccttcagacttaataaatcgatgtttacaaaactggatgcattaggcctgggaaatgtttcaacattactttctcatatgactcctacgtttcaggctcatgaagatcaggtgaaaagaatcagaaaaatggttgacttgtcaccatatcctgttattctggcgggagattttaattctgttcccaattcatatgaatattataaccttggaaaagaccttcaggacgcattcttagtagccggaaagggtagtgccagcagtttccatgattataaggtgcctttaagaattgattatattttcagttcgaaatcaatcattccgctaagctataaagtagaccagtctgtgaaattatcggatcattatcctgtaattgcagaatttctgttaaattagttccatgaaaaatttactggctgcaatttttatttctactcttttttttaccgcttgttccaagaaagaatctccgggattcggggctgaacaggaagttaaaataagttatgataccactgctgttgactccttttctacaggggcggtttcagtggatattgcacgcaaaataagaatgtcttccccacagtatattgattcagtaaaacaggctaaaaagcttcaggatgaagaaaataaaattaaagccgagctggaaaaagaaaataaagcaaagctggaggaggaaaagaaaaaggcagaggcagaaaagaaacagaaagcaactgaaaaaccagctgcccaggagactaaatcagaataaattcaaaaaacattaaacaaataaataatatgaaaaaacaaattttcgctgcaatagtgatttcagtattcacagtagcatgtacaaaatcaacaaagaaaacagaacaggtagaaaaccctgacggttcagttacaaccacaaccactacggttaccgaaacccctaatggtgtggatacagcaaagatcaacaatgctaaagaagatgtaaagactaaagtagatgcagcagggaataagatcgacgaagctgctcaaaaggcaaaagataaaattgatgctactgcagataaaacaaaacaggatcttaacaaagcaggtcaggacattaaagcagaagctgataaagtaggaaaggatgctaaagaagcagcaaaaaaaggagcttcaaaagtagaggaagccgcgaagaaagtaaaagaagatttaagcaaataaaaaatgaaagccgtcagtttgtgacggcttttttatttttattatacgcgaatgaaataacattcctttatttattcatttccagcagcggatcaatgtattctctgtcattgctcagtcgcggcaccttattctgtccgccaagctttcctttagcctccagccactgatagaaaaggttttctttagcgatatgtacaataggcctttttaaagtcatgttattgtacctttttgcctcataatctgaattgatagctttcaggtgcttgtcaaaagcatctataaagttgtccaggttgtccggatgctggctgaattcaaaaatccactcatgggcgccgccttcatttcctttcataaatacaggtgctccagtgaaatcggtgatgtgtgcacccgttacttcgcaggcctttgaaagagcagattctacattggtaatcattagttcctctccaaaagcattgatgtagtgctttgttcttcctgttatttttattctgaaaggattggttgaggtaaagaccacagtatcaccaatcaggtatctccaaagccctccgttggtggtaatgaccatagcgtaattttttccgacttccacatcttccaggcttacgaccttcggatttgaaaaatggaactggtccatcggaataaattcataaaatataccataatccagcatcagaagcatctcatcactgtctgatctgtcctggatcccgaagaagccttcagaagcattatagatttcgtagtaattgatgttttttccgatgatctgtctgtattgctccctgtagggcttaaagctgattccaccgtgaaaaaacacctccagattgggccatagctcacaaatacttcctacattggtttccttcaatactctttgtagaagaaccatcatccagcttggtacaccaaggatacttcccacgtcttcatttttaacttcggaagtaatcgctttcagcttactttcccattctcccatcagagaaactttcttactgggcgttgtggtgatttctacccagaacggaaggttatcaattaaaatagcagataagtctccaaatttggtgttgaaatctgcatacagctcagagctgccgcctaaacgtaggtttttatagttaaaaagctggttttccggatggttgttggcataaatggaaaccatatcctttcctgctttcatgtggcagtactcaagactttcagcagagatagggatgaatttgcttctggcattggtagtaccggatgatttggcaaaatgcttgatgaggcccggccagcttacgtccttatgtccttgcctagctttttcaatatagggctccatttcctcataggtgacaataggaactttatttttaaaatcctgatagcttgatattgaattgaatccgtataattttccatattccgtgtcctctgcatgaaacagctgtgaaaagagtatccctttttgtgtttcaatgggatggtccatgaaattctgtatctgatcaatcctttgacggataaaccagttgactacggtattgaaaagtgctttggttgccattccaacaaatataatgatatttgaattttcagaaaattttttaggtgattaaataaaaaaaccgttacaaattttgtaacggtttgatatctagtttattgtctgttagcaatactcatcgtatgcagcctgaagatttgctgcaatagcacccgcagggtttccttcaatatggtgtctttccagcatgtgaaccaattcaccatctttgaaaagcgccacacatggagaacttggagggaatggagcaaggtgttttcttgcttctactaccgcctcagtatcatatcctgcgaatacggttgttaaatgatcaggctttttatcgcctgttaaagagtatactactcctggtcttgccgcacctgctgcacatccacatacggagttgattaccaataatgtggttccggactgcttcaaagcttcttctacctgagcaggagttgttaaatcctggaaacctttatctgtaagctctgccttcataggcattactaaatctgttggatacatatattttgttttttatctctacaaagttaagcaattctttgcgtttgttcaatatataaaaactatcaatggattagtcatacaaaattaatagaatattaataatgtaataatattcaaaaaaaagtgaattaagactaggaataatgaaatattattattaaatttgaaatgattctgaaaaacaaacgaccgtgaaaaaacatttaaaagctttccctcaagcaatcaaccacttaaacactgtctgaaatatggtagtattttaacacttttttcagtttagaatcaaactgactgacaaactttaatatccaaagaaatgaagccctgaaccgaacagttcagggcttctttaatcaaatcgatatgcaaaggttgtatatcctatagttatggtgtgaagtgtgctgtttgggcttcagaatggctctgaatcaaacgcacatcacattaagaaaggagttttttagccatctcggaaatactttttccgtcagattttccggctaatgcttttgatgccactcccattaccttccctaaatctttgacagattcagctccggtttcagaaataatgtttttaatttctgtttccagttcttcggcagaaagctgtttcggtaaaaactgctcaataactttcatttgagcatcttctacttcagcaaggtcatttcttccctgtgccgtaaactggtcgtaagaatccttacgctgctttaccattctctgaagaatggcaatttcctgttctgctgttacttcagcccctacagcctcagttttaagcagtaatatctgagattttacagcacgcagagaatctaaagccactttgtctttagctctcatggctgtttttatagcttcgtttattgtattttctaaactcatgtttatatgcttttggcttctggcagttggctaatagctttcatagggcccgagagccatttgctaatagccaattgccaatagcatttaatctacgtctttatttaaaaacctgttttctctgatctgcatggaaccgttgttatcagacaggtatgtattgatattctggtctgatgcattgtttccgtcgatcgaaatattttttcttttgaaggcaggaatagattcaaattcactggtgctgtcaaagctttgatagcgggagttgaattcttttaatttatttcttctttcaatcactctttcctgatcgatcgttttattcacgaaagtgaattctgattcttcagttttcggagtttcagttttgttttcaaaagccggttttatttcagctttaggttcttcctgtttctgatagaatgtttcaatcttttgagctggttcagctacagcagcatttgttggggtattaaattctgcttttggctgtccgaaatccgtattcggctcgtttctgacaggctcgtttacaaagaagctgaattcaacaggtttttcctctgaaaaagagcttgtaaacggagttccggattgtggctcatcttttttattttcaaaatcaaatgagaaagactggatctcaagatcgttaggatcatcatgctcttcatcaatggaaaataagctgtattcttcttctccgccttcttcatttctccagttctgttcaggagtatttaccgtatcttcttctttatcaaagaattttatttcagttcttggctgttcttcctcaatgatcatttttttttcagtagacttcacattgaaagagatgtcgtggtcttcgtcatccagcctgaaaagattctttcctccaaaatcatgtgtagtttctgttgcagattctctttcttctctagttttgaaaggagaatttttcggagcttcaaagctgtcattaagactgattctgattttctctgtaggaccagcaaatttcttgttatcgttagagaatcctgttgcgataacaaggacgcttacagcatctcccaattcttcatcagcacctaccccgaaaataatatcggctgtgtttccggcttctttctggatgtggtccatgatcacaccgatttcatccatggtaacttcttcagcaccacttctgatcaataaaagaacgtttttcgctcctgtgatcttgttgtcgttcagcaatggagagtctaatgcctttcttactgcttcttccgctttattttcacctgaagcaattcctgtagacatcaatgctgtaccggagttctgaagtacagatttagcatctctgaagtcaatgtttacatcaaagtaacccgtaataacttctgccatccctttcgcagcattggttaacacctcatcggcctttgagaatccctgtttaaatccaagatttccgaactgttgtctcagtttgtcattgttgatcacgatcagtgaatctacattgtttcttaatttatcaagcccgttttcagcctgctccagtcttctttttccttcaaagctgaaaggaacggtaacaatacctacggtcagaattcccatgtcttttgctactttagcaatgacaggtgcagctccggtacctgtaccaccacccattccggcagtgatgaacaccattttggtgttctgtcccatagcggctttgatgtcttcaatactttcgatagctgatttctcaccaacttcaggatcggcacctgctccaagaccttctgtgatagaagttcccaattgaactttattcgctaccgggttattatctaaagtctgggcatctgtattacagatcacgaaatcaacaccgtgaatacctttctcgtacatgtgtttcagagcgttgtttccaccgccccctacaccgattacttttataatggatgaatttccttttggtaaatcaaatgaaaatccttgtgaacctatattttccataactatactttttacaattataattggtcattgattaatgataatggataaggaaaagatcgtttatcgcttatcactcatcatttataatttactctacttcttcaaagaatttttttactttttccataagcgactgcccgaaggttaatttcgcttttctgttgtcctgtctttcattttcaacagaatgctgctccatgaccggggctgtctgctgaacaggttgaacagtttctgtctgtgctgcagcaacttccggttttggctgttcagtgacaacttctgttacttcatcaatattctgccttttgtctctgatctttaagctttccatcagcaatccgatagatgtagcaaattcagggcctttcagatactgatttttatcgttggcgatatattcattcgcaaaaccgattctgctgtcaaaacctgtggtataattggccagctgacgaaggtgctttaaatttgaacctcctccggtaagcacgattcccgcaataagctttttcttttgctcaaaagcgccatatgctttcagctcggtatttaccatttcaagaacttcttctactctcgcattgatgatctgagccagagtttttaaagaaatttctttgtccggtcttccgtgaagtcccggaattgttacaaaagtactgtctttttccaattcgggaacagccgaaccaaattttactttcagttgttctgcatgtttctctatgatggagcagccttctttgatatcttcggtaataattccgcctccgtatggaatcacacaggtatgacggatgatattatctttgaagatagcaatatcggttgtaccaccaccaatgtcaacaattgccacaccggcttctttttcttcttttgtaaggacagcttctgaagaggccaatggttctaaagtaagggcttccatttctaatccggcttcgcgaacgcatcttgcaatgtttctgatgcttcccatctggcccactacaacgtggaagttggcttctaaacgcttaccatgcattccgacaggttcctgaatttccccctcggaatccactttatattcttgaggaagtacgtggataatttcttctccaggaagcataaccagcttttttacctgatcttttaatgcttcgatgtcatcgtctgtaataaatttatcaggatgttcacgcataatataatcggaatgctgcagagaacggatgtgttttcctgcaatacctaccgtgactttgcggataggaactccggcactggattgtgcttcggatactgcagccttgattgaattaatggtctgtgaaatattattcacaatacctttatgaacaccaagacttttagcttttcctacaccgagaacttctattttcccgtgtgcattccttcttccgacaatcgcgactatcttcgttgtcccgatgtccagacctactgaatactcttgattttccattttatatcgatttgattttttctacttttccctttttttctataaggatattctcctatttgtgtataaatgtcctttcggatttattctatttttactttttgcttagatttaggctgtaccttgacgggtggctttttttctgctttttttgtttcttttgtatgtgttttcggttttgtactctcttgcggctttaccgtgtttgagctggtcttttttgcttccgctgttttgggcttcacctccgtctttttgactgcagctacggaaggagcttttgccagttccatttttcctgcttttaaaatactgtcattttctttaaaatacgggtttaaagtggtgacaatctgattctggtatttcacagaaaccatgctgtatttctgaggatcctgatataccaggtatttctccacaaaggttttgaatccctttactttaaaatcaatattatctagatctccgatttctactctatagttgccttcactggtaagcaggctgtagctgtctttattttttgagattccgataaaatattttttactgaaatcatctttgtcaatcttttctaccagttccgccagcttttcatattcatccggctgtacatttcctgtgaccagcatgcaagggtgcgaataggttcttgaaatcgggaattcaactcctttttcatctacataaaagtcttttccgtctttattcaatctgaaaaccgggactctctgtttgatgtcaagattcagtttcccattcaggttcagataaacattggcactgtctactgccggtaaggaattgatctttttttctaaagcaggaatattaagatctccaacttttcctgacggattttctttttttacaatctccctgatgtctttttcatccacaaaatataccggtgttctctcactcatttttacagaaatcttattgtccgtaatctgctcacggctgaatctcctcaatgagaagctcagtaaaaatcctaagataattacagtgacaacaatttttaatattctgtatttatttttcatacatcttttgtattcatgtatttatccattcacaaataggatcatacagggtgtctatatttcctgcccctacagtaagaaggatatcaaaatctttttcttttattttttcaaaagcatcggataaagaggatacttcttttttatctaattttactttttccaacagccagtttgaagtaattccttcaaaattttcctgaagttctcttgcaggataaatatcaagaagaatgagttcatctgctttacttaagctttccgcaaagccgtctgcgaaatctcttgttctgctgaaaaggtgtggctggaaggctaccagaagttttttatcagggtaaaatgttctgattgagctcattacagcattgatttctgtaggatggtgagcataatcgtcaatataaattttaccattttgataaatatgtttggtatatcttcttttaattcccttaaaattggcaattgcttttttcagcgtatcaaaatctgcgcctaaattatgcagaatagccagtgctgcagtagcattttccacattatggataccaggaatttcccagacaaaatcttttactgtttcagttggggtatggaaatcaaaataaatcttatcatgttccatacgcaggttgtctgaataataatccgcgggctcattgactgcataagtttgatgtcctctgccaatttccagaccttttcttacaaaaagttgtttgtcttgaggaactaaagctgcaaactgtctgaaaccttcttcgatatggctcttatctccgtaaatatcaagatggtccgcatctgtagaggtcaccactgcccagtccggagacaggttcaggaagcttctgtcatattcgtcagcttcaactactgagtacgtggaaccattgtacaggaagttggatttaaagttttcagaaattcctcccaaaaagcaagagaaaggaagatctgcttctttgcataaatgagcaacaagggtagacgttgttgtctttccgtgggttccggcaatagcaatacagtctgtattttctgtaattaatccaagaactctggctctttttaaaacttcaaactgattttggttgaagtaatccaatattccaagcgttttgatagccggagtatagatgaccaatgtatcttctttctgaagggaagttatcctttcatcaataagatcttcaaaaacgatatcaatcccctcattcatcaggttctgggtaagtttggtattggttttatcatatcccaatactttttttccggatgcgttgaaatagcgtgctaatgcactcattccgatacctccgattccgacgaagtaaaaagtctgatatgtttgtaaaatgttcatttatattttaatctttaaactcttgaaccaattcagagttttattactatattttatattataaggctttaatcagctaacatcaatgactcgttaattaattaagttttaacggtgtcaggctgtgcttgtcgaagcctcctaatctttcatcctattttttgataacaagggtaataaatcccagttattatttattattgcttccttctttttcctactccagcctttaacttgtttttcaaatcttatagcttgattaacattattaaactcatggtagaaaacaagttccacaggttttcttgtatacgtgtaactttcaggatttaatccgtcattatgttcgttaattcttctttccaaatcattggtaaagcctgtatagtaagaattatcggaacattttacaatgtatacataatatattttcattcattagtgtttgcttactggcccttcgacaagctcagggagacaactctaatactagctgttttattttactaatgtcaggctgagcttgtcgaagcctctctattttatcacattaaatatttcatctacaatctctttcgctgcattgggcttggcaaaatatttcagattgtcagacatttcttttcttatattttcattttcgcagatttctgataatgtattccagaacttttcctgcatctcagagtcttttaccattctggctgcgttcttttctaccagattcatggcatttttggtttgatggttttccgctgcaaaagggaaaggcaccaaaagcaccggtttctgtgctacagccagctctgaaatggcaatagctccggctctggaaacaatgatatcagcggcagaataggccagttccatgtctttaataaattctttcagatgaattgaagccggaagctgaaggctggatgataattcgttgtaatccagttttcctgtttgccagattaactgataccctttttctttcagattttcaaggttttctttccatgcattattcaatgttctggaacctaatgaacctcctacagaaaggattgtaagtttgtctttatccaatcccattttctcttttgcctgagcagtatcctgcattcctgaaataatattttcacgaatcggatttcccagaaattttattttctctgccggaaagccgtctactttcggataagccgtgaagactgctttagctttcttgctgaggattttattcgttacccctgcatgagcattctgttcctgaatgaaaatcggaattcccattttactggcttcataaagtgcgggtccgcttgcaaatcctcctgttcctacagcaaagtcaggcgcgaagtttttgataatctttttagattttgatagacttttcagaatcttgaaagggagacctaaattagataacaagttacctctgtcaattccggcaatatcaattccttcaattttatagcctgcctggggaactttttccatttccattttcccgttggcaccaatgaacaaaaattctgcatcaggaaatctttttcggatctcatctgcaatagcgatggcaggaaagatatgtcctcccgttcctccgcctgataatagtatttttaattttttgtccattttaagcgatatcgtttatttctgctatactttgttttttgcccattccttcttcatcataaatctgaatccttgagcttatatttaaaataatacctaactgtaaataggttaccagcattgaggttcctccgtaactgatcaaaggcagtggctgcccagttaccgggatcagattcactgctacagcaatgtttactgaaagctgaataaagatcattaccccgagactgagcacgagcaacgatccgaaaaatgccggcatcttgctggcgatcataacaatccttatgatcatgatgaggtataagctaatcagaaaagcagcgcctatcactccatattcctctacaataactgcgaaaataaagtcggaggcagattgcggaagcatttgtttcaatgcactttttcctggtcccattccggtaattccaccatgtacaatggctgctttggcctgcattacctggtaattttttgcttttacactttcatcatccacatcggctgttttggctttgctggatgtaaatgtttcaatacggctcatccatgtatgaacgcggtttcctccaataagattggtatttaaagcaatcaataagaagaatacgatggccacaaatgatgcggaaataaatcctgcaatgtatttccagtgaagctgtcctatcacaagaacaatcacagaaaccattaaaatcattaacgcagtggaaccgttatctttggctaccaacacaaaaacaagcaggataggtccgaagatatacatgatattctctatcggaagtctttctcttgtaatttttttggttagatatctgcacagatagatgattaacattaaaaaggcaaatgatgaaggctggaaggagatcggtgttccgggaattttcagccatcttgaagcactggctccgtcaatggtctgtcctgtaaacatcgtaaccaccaataggataatcataaggccaagcagaatactgctgagctttccgatgtattcatattttacggttccaaccagtctcataatacccaaacctaagactacaaagaacatatgtttgataacgtgacctgttgtggtcccgttattgacaatgtattcaagatttgaactcgcagagtagacagggaaaatagagaagatggagatcacaaggatgaccatccaaagtactttatcgccctttagaaattcaaatctgctttctgtgttctgttcgtccatatttaatgctattggcttctggctaatggccattggcttttaatacctgctctttaaactgtcgtcctctgtcttcgtagcttttgaataagtcaaagcttgcacagcaaggagacaataaaacggtatcaccgtttttagccagtgattttgaaattctcacggcttcttccatacttgaagtgtcataaataaattcttttttatctttaaagaaatctatgatcttcttattgtcaattccaagacaaacaattgcctttacttttcttttaactaaatcctcaatttcggtatagtcgtttcctttatctaatccaccaacaatccaaacggttggtgttttcatgctttccagggcatagtaagtagcatttacgttggttgctttgctgtcgttgatgtattttacgccatcaatttcagtaacaaactccagtctgtgttcaactgcctgaaaggtcatcaatgaatgtctgatactttcattgttgatttctaatattttaccggcaattgatgcggctaagctattcgctacattatgatttcccaacaaagacaattcatcaactttcattgagaattcgtctttcatttttaccacaatttcatcttcattcacaaaacctccttccggtaatttctcttttgttgagaaaggaatcattttagcttttatctcaagcttttcaaggagatttttgctcatttcatcatctttgttgtagatgaagaaattatcattctcctgattttcagcaattctgaattttgccaaagcatactcttcataattgtagttgtactgatccaggtgatcctgagacagattcagcaataaagagatataaggcctgaaattctgaatatcatctagctggaaagaacttacttccaatacataatattcatgattttcatctgcaacctgcttcgcaaagctgtagccgatatttcctcccaagcctacatttaatccgtcatttttcaggatataatagatcagggaagtagtagttgtttttccgttgcttccggtaatagcgataatttttgcatctgtaaattcagaagcaaattcaatttcagaggaaagtctgattcctttttcatgaattttactaataatatctgccttttttggaattcctggactttttacgatccagtcagcatttaaaattctttcttcgttgtgatttccttcttcaaattcaatttcattatcggtaaggaactgcttatagttatccttaatggctcctttatctgaaagaaatacttccagacctttctttttagccaaataagcagcgccacatccgctttctccacctcctaaaacaactattttcatatttattcttttgtaaaatgtaaaatgtaaaacgtacaatgtatctggtgtctttttacattaatactttttacttttcacaaaatttatctcatttttaatgtgatcagacatacaatagccaatattaccccgatgatgatcattcggttcacgattttactttcgtggaatccttctttctgataatgatggtgtaatggtgacatcttgaatagtctattgttttgggcatattccagcccgtattttctttttctgtatttgaaaacaactacctgaagcattacagacaggttttcaattaagaagattccgcataatacaggaatcagcaattcttttcttaaaataatggccaaaacggcaatgactcctcccaacatcaaacttccggtatctcccatgaaaacctgtgcaggataggtattgtaccagaagaagccaattacagcccctaccattgctacagcaaagatggtggtttctcccatgttcggaaggaacatgatgttgagataatctgcaaagatgatatttccggaaaggtaagcgaaaagggccagcgtaagcagtataatggtacttgttcctgcggccagaccgtcaatcccgtctgtgatattggctccgtttgaaacggctgttacaatgaaaattacgataggaataaagacaacccatgcccactcatgggcatctttgtcattcatccaaaataaaattccactgtaatcgaattcattattttttgcaaaaggaacggtggaaacggtaattttttctgtaggcataaagttttgctctacgttgtttctgttgaccaccttagcatccgcatattttcttttaacggtaatgtccgggtggaaatacattgtaattccgacaattagccctaatccgacctggcctacaattttaaatttaccacttaatccgtctttattttttttaatcttctttaaataatcatcaaggaaaccaattgctcccatccataacattgaaaccagcagcaggacaatataaacattggtaatccttgtaaacagcaataccggaataatggttgccagaataatgataagccctcccatggtaggggttccttctttctgtttctggccatccaatccaagatcacgtaccaattcacccatttgttttgttctcaggtaattaatgactctttttccgtagacaagagcaataatcagagagaataatacagccattccggcacggaaggaaatgtatttcagcattcctaatcccggaacgtgaattccatggttggttagatattcgtatagatagtatagcatagtttcaattgttaataaatgatcattgataattgatgaatgattgaacaattattctttcagttatcatttgtaatttatttgctcattaatttccagagctcattaattacttctttgtcatcaaaatgatgtttcacaccattaatctcctgataggtttcgtggccttttccggcaaccaaaacgatatctttaggctcagcaaattttatcgccatttttatggcttcttttctgtccggaattgaagtgtatttgctgaagttctgtggctcaacacccgcttcaatttctttaatgatctgcgcaggatcttctgttcttgggttgtctgaagtgatgattgccagagtagattttttagtggcaatatttcccatttcaggtcttttggagtggtctctgtctcctccgcagccgaacacggtgattaatctttcgtttttggttctgatatcgttgatgctgtccaggatgttttccaatgcatccggagtatgtgcataatctacgataaagaaaattcctccatcagatttgagggtttcaaatcttccggaaactctttttaacttactgatagcctgaagaatttcatcctgttcaaaacccagttcagcagcaattccaaagacaagaagcaagttgtatacattgaattttccggtcagtgtcgtccagaattcttttccattgaagttcagcagcattccgttgaaatccacttctaaaagttttccgtgataatctgccatggttttcagtgcgtaagacttctttttagcctttgtattctgaagcatgacattgccattcttatcatccacattggtgatggcaatagctgtatcttctaattcgtcaaagaatctttttttcgtttttaaatattcttcgaatgttttatgatagtctaaatgatcatgggtaagattggtgaaacccgctattttgaaatgtagcccttcaatcctgttctgggcaattccgtgtgagcttacttccatgaaagcaaattcgcatcctttttctatggcttcagctaaaatcctgttgatggtaatcacgtcaggcgtagtgtgggtagccggtataatttcttcaccaattctgatttcaacagtagaaagtaacgcagcaggataacccaggtttttgaaaacatcaaaaagaagggtggaaacagaagtttttccattggttcctgtaactcctatcagtttcagcttctgagaagggtttccatagtaattggaagcgagatgtcctaaggctttagacgaatcttttaccaggatgtatgttacattttctgccaatgtttgagggagttcttcgcaaacaactgctgcagctcctttttcaatagcagatgtgatgaatgagtgcccatccactactgttcctctcattgcaacatatagagagccttctgtaacttttctgctatcgatcaccaattcagtaatttcacggctgttatctccgtgaatttccagtactgggattctgtttactaattctgttataatcatctttatcaataaggctttgccttattttgttttaaattgcccttccggacttgtttcttaattctgcagagataaataaattctctggtttttactgatcgttgtgccttccagcgggaattgttctttaattcttcctactcctttatagtcgacacgatagcctaagttttccaattgcgggatcacgtttttcccgattaatcctacgacattaggcatctgtttatcatttactgctatttttacattaggctcaaccattttgctcaggtttacctttttgtctaccagcatttctttttcaatattctgtggagtcttcaggaatgtctttcctgcaatttccttaaacaccggtgctgaaacggaacctccataaaaaccttttgctgtattcggctcactgatcattacataacaggtgtattttggagcgtctgccggatagaagcctgcgaatgaggcacggtacttcatagggccgggcagccagtattcaaatcttgcagttcctgttttccctgccattttcaggttaggcgtaaaaatgcttcgtcctgttcctttttctacagctttggttaaagcactcgtcatcattttaatagctttttcagaggccattctgttgaccattacttccggttttgcctgatacatcacttttccgtctttcatgattttatcaatgaataaaggcttaagcattttccccccgttagctaccccattataaaatgttgttaattgaagcaggttgatattggaagaatacccgtatgatatagaggcaagtgttgctgcattccatcttttattttccggagtaacaatttttggttttgtaatacccggaagctcgatgtccattttgtcgaataatttccaacgtttcaggtgatcaaggaaaatctgtggtttttcagcataatactttgtgatcagtttggcagtacccacattactggacttcgccagtacatcactgatatcgtatgttccacctccgtggccatcggaaattctctgttttgcatatacccaaacgccgtttccaacatttaccgttgtgttttcatcaataaatccgtcatccattgctgctaaaagcgaaatggttttaaaagtagatccgggctcgatattgtcttttagtgcatagttgtaagaatcttcataatcgccggattctgtccttcttaaattaacaagagcacgtacttttccggtttcaacctccatgacgattacggtgccatgttttgcttcaaaattaattaactgcttctcaagagctgagtgcgcaatgtcctgaattctaaggtctaaagtggtataaacatcttcaccatctacaggttcctgaactttccagaaatcaatcggtttccactgggaagaattaattctttgttccagcctttttccgtcagtacctgtcagatattttgaaaaagcgccttccagtccggatttaagctcgccgttatccataccgatggtaccggctccgatttctgaggtagccaattctcttttatagtttcggtcaacgataaatcctcctttatttttacctcttttgaagatcgggaactttctgattctgtcatactggtcaaaatcaagcccttttaccaaagtgtagtactgatttttcttttttttctgctcatcaaacttctgtctgaattcacttctcggtttcccgaacattttacttagggaatcagtcaatgctccgatgttgttggagtacaccgtatctttcatcgttttgaagtcaagatagatgtcataacgcattacagttgtggcgagaatagaaccgtcggaagcaaaaagattaccgcgggcagcctttaaagtggcttcacggtagtttttattaatgtaatcatctttaatttcctggacattggtattctgaaggatcacaatccttgccagaaacataacaaacacgcacaaagctaccactgcaaagaggtagccccatcgtaacgtttttttacgtttattgtcgtattcattttgcttttgcatctgtactgtccagttttattagcaatttgtgagggtggttttccagggtcatcaatgaatcccgtgctacctctttccccagctctgattccatttttactttgatcagcttactttgagcgtaagcatttctcgatttatattcttctgtttcttcctttaaggcgtttacaattttaatttttttattgacgagatggttggtataaatcatggccatcatcagaacaaacagcaggagaaaatacttgtaatgtattttgatctcatcacggttcagaaagtttccttttataatgtctataaaagtgagtcttttctgggggcgatttgttgttctttttgccaatttattatgtcaatttgctttgcagtgaatttacttcgtgtcaatagtcaattttactttgcttaatgattcactattgacgattcactcattcacattttatactttaattcctgttctcatcttggcacttcttgctcgcgagttttcttcgatctctttgtcatcagggatgattgctttactcttgaccaattcgaatgcctttttataatttccgtagatatctctttccggttctccctcgaacattccgtttttcaggaatctctttactaaacggtcttccagagagtgataggaaataacgactaatcttccttcaggtttcaaaacattgtaagcctgaaccagcatttctttcaatacttcaagttcctgattcacttcaattcttatcgcctgaaaaagctgtgcatagaatttattgaccttgtgaggcggaatgtagctgaacaattttttcagatcttccgtagtttctatactttttgtttttctgtgatgtacaatttctctcgccagctttcttgcttctcttaattctccatagtgataaaaaagatcggcaagctcttcttcttcatattcgttgattactcttttggcatcaagattctgcatcacattcattctcatatccaaaggagcattgcttcttgttgaaaaacctctgtctgcctcatcaaactgatgagaagacacccctaagtctgccaaaacgccgtctacctgtgaaatgccgtacatcagcaatgagttttcaaggaatctgaaattctgattaaccaatgtaaaacgtggatcatcaattgtatttttaagtgcatccaggtcctgatcaaaactgaacaatcttcctttatcggaaagccggctcaggatttcttttgaatggcctcctcctccaaaggtgcagtccacgtatattccgtcaggattcgtcaccaaatcatcaacactctgcttcaacaaaacggggttatgatacatgcttaattgtgttttttatttaatactatcaattaataatctactgcagttattcttcgtcgaaagaacccatcacatcttcagcaaggcttgcaaaatcagcttcgttggttgcaatcaccttttcataggcgtctttatcccaaatctcaaagagttctcctgggctggtaatcacaatatctttctgaagatttgcaaaaaccgtaaggtcttttgagatctgtagtcttcctgcattatccagttctactgtttttactcctgccgtaaacattcgtatgaaatcagcattcttttttatgaacctgttcagtttattaattttacccatcagtttgtcccatgcattcataggataaacttccagacaaggttggaacacagatcttttgactacaaacgccttatcgtcgaagttttccatctgtttgattaaagatgaaggaacttttaagcggcctttgtcgtcaattttacactcatatgttccaatgaaatttttcatttgggacaaatttatataataatttccaaaatttcccactttttcccactttttgactcaatgttaataagttttattaaagattgaatttcaataatgtaaaatactgatatgaagagacttgttgaaagtgttatttaggccataataaagcggttctgaaaaaaaaagttaaaaaggagaatattatattatttttatcttaaattaggataatcaaaatttttttgaggtttaatttgtatttttgcagggctttattaaggcgttttatgatatttagtacaaaaaaagaaaagaaatattcctatatagaagcaggagaaggacatccattagtgctgttgcacggtttaatgggtggtttgagtaatttcgataaaatggtagattttttttcggaaaaagggtttaaggtctatgtgcctcagttgcccatctatgatctgccggtactcaatacgaatcttaccactatcgcaaaatatattatcaagtttatagaaagtcatatttcaggacctgtaaccattgtaggaaactcaatgggaggtcatgtagggcttattcttactctggcaagacctgatctggtaaaaaacctggttcttaccggaagttccggattgtatgaaagaactttcggggacagctttccaaggaaaaatgaccggtcttatatcagaaagaaaaccgaagaagttttctatgatccaaagattgcaacagaagaccttgtagatgaagtttttggagtggtgaatgacagaatgaagggaataaaaacagtaatgctggccagaagtgccatcaaacataacatgctgaatgatcttccgaaaattttgacaccaacctgtctgatatggggtaaacaggataatgtaactcctccggaagtagcagaagatatgcacaagtttattcctaattcagacttgttctggatagataaatgcggtcatgctgccatgatggaaaagccagatgaattcaatgagatcctgtacaactggataaaagataaagtttaaaaacatataaatgaccattaagagcttttcttaatggtttatttttctaaaatacattcaaaaatgattatcaagacagcagagtttgtaaagagtagcggaaaatggcaggaatgtcctgaacctaatattcccgagtatgcttttatcggaaggtctaatgtaggaaagtcatcactcatcaatgcgatgatgaatcataaagatcttgccaaaacatcacagacacccggaaaaacccagctgatcaatcattttttagtgaatgaaaactggtatcttaccgatttacccggatatggatatgcgaaggtttcaaaggtacagcgaaaggattttgaaaaactgatcaccaattatattctgaacagaaggaatctggtgaatctttttgttctggtagatgtaagacatactccacaaaaaattgatctggaatttatccagtggtgtggcgaaagcggaataccattctcaattgtctttacaaaagctgacaagctgaaaccgaatgccgtaattaaaaatgttgaggattataaggcagaacttcacaaaacgtgggaagatctccctgagttgtatattacctcagcagaaaagaaggaaggaggagataagattcttgattttattcaaaaaaccaatgagtttttaacccataataatataagctttgatgagtaatattgtctggaaaatcaaaacatttgatgagtttactgttccggagctgtatgccatactgaaagcacgtattgatgttttcgttattgaacagaactgtccttatcccgatctggataattatgatcagaaagcagtccatatctgggcagaagaagacgggcaggttttagcctactgccgtatttttgataaaggtataaagtatgatgaaacttctattggcagagttcttaccactgagctggcaaggggaaaaagccttggaaaacaactgatacaatatgctgtagaaactatagaaaaccgttttcatacttctgaaatcagaatttcagcacaggattatctgttaaaattttacagcggtttcgggtttgaagacaccggaaagaaatatctggaagatgatattccgcatacggaaatgataagaaaataaaaggtatcccaaacgagataccttttttcgaactgtgtataaaattatattggcgttattagttttttctcatcatttcttacatcaaaagtaagataactgagaaaattaaccttacgggaaaccgtaattggttaaattattcctaaatctttacaaaaagcaacaagctgttcgttacttgttatctgtaaatcttccttcatactgttcagttttttctctatactgcttaagctgttcggcttaataccgttgttttgaaggtatacaggtatattcttttgtaaaactccctgtgacaaaagagaaactaaagtgatgtcataattggaaaactcataattgttgagtttccttacttcctgtttaaggtcgagggaaagataattttcattcacataagttgaagcaattgctttttttaattctttggaatcatttctagccttacgaacaaaaccattgattttgtattcattaaaaagattatctataactccggatctgtgctctgcggaaaatacaatgattttcaaagaaggctgtaattctctaacggtttttatcagttcctttccgtctttaagattttgtatattgtggtcttcttcaaaagaaagatctgtaattaacaaatcataaagattattttcacgaatggatttttgaattttagctaatgcatcatcacaataatacacataatctgtgttggaaatactcaggtcttccagtgttttctgcacagagatactgctgctttcgtgatcttcagctattaaaatttttttgaacattcttttttcttttttaagaagcaggaaatgaaatatagattttcaatcccttttcggtttctgtgtcaaaaataatttctccacggatagcttcaatacgggaacccgtatttgtcaaaccatttttaaaagttattccttgcgagataccaattccattgtctgtatactgaatttgtatgatattattttttctttcaaatttaaaagcaaccagagtagcctggctatgttttttcatattaaccagaagctcccgtattacctgataaatttcttcccgggtaaattctttcatggctagccatatattttcatcatttccggcaagataagttctgacattttcattattaaaagaggcaataagagcagaaactcttttgctgaattcgggtttatcttccggggttgttttctcataagaaatatctctggacttttcatagacaaactccagttcatcaagtactttttctttgtcaaaatattcctgattttcgatctttgtcatgacctggtaaatgccgttggcaacgacgtcatgaattttcttggagactttcagctgttgttcctttaatttattatcagattctaaaagcatggtctgcttgcgttttttgtaccaaaacatagcagtaattataaggatgagggttcccaaacttatacttataattaaaatattttttttggtaatctgatattctttctgagcaatacccttctgcagcaaaagattttcagctttctttttttctacatcaaattctatcagggcaaatctgttttttgctttatcccttgataattgaatgctgtcatttagctgctgatattctgtaaaatagttctgtaagtgatttccggtatcgttttttaccagaaattcaagtgcttccagtcggtcattaggatttttaattgcttttgccagccggtatttttcattgttatgatacaacgctttagccttatccgagtataagtaatattcagcaagatgggaatggctggatataagaccagatttatcatttattttctgtcttaaagtgaaagctcttaataaaccatcttctgccttatagctattattttgaagccatctgatataattataattatctaaaattctggcataatcaatctcccgctgttgtaagttttcatctttaagcagtgtctgatagatgttgatggcttgcgaatagcttttctgttttccgtaagtatccgcaatattatttttgataacaattttttgtgtgttatctgaacttacctgtagagctttatgataccagctgagagcatccgtataatgtttgagatttttttcagatatcgcaaggttgttataaatggaaggcagataagcagagtcttcaggtaattttaagaatgaaagtgcttcaacagctctttcattgctgctgagataatctccgatatcatttagtataatagctttggttattaagcatgaggctatatttgctgaatcattctttagtttatagatactttcagcttttgaaagaagtgtaaatgccttttcattatcattattatagagagctgttgcttcattgtacattttatctgcttccgctgaagtagtttttaccggaggattattgttttcggaaaaattgcagcttatgaataaaagaaaaactcctaaaaatttaaaccgggcatgcatgataatagttgataacaactaaaggtattaaaaaaaggacaattttcattgccctttactgaattatttttttggtggtaaaatctgtcctgtttcgccgcttgtatcttccggtgctattcctcctgttccggaagaaaagcaagctgtaggagatacattattatcagttgctgaaatattggcattgttatctgaaaatgctaagcctaatagcattaaaataatctggatcatttcctttaaaattttcgaagttgaaactgtatttcttcctctcacgaaatggttatcgcaagctgtacactgttaaaatttcgaagcgcttcttatttttggggaagtgaacctttaaaaacggaggcgaaacatctgcttcccgatccggagtttaatctctgttttctctggttttgaaatcagttttttatgtttttcttgatttctgagacaaatttgcagcaaaacagtaaaggtatgttagacaaaatacagacaccaaaggacaataccaaagagtggagttatttacggaaatccgtaatgtgatatgactgaaaattatctactttgtaatgcccgaaaacactgtatatgtccaagaaaaaactactgattaatgaagtatttcagcaggcaagaagagagtcagagaaaaccacgaaaagtggattagcttgctatctgcatctttattttattgataatctgaaattttatgatatttccgaaaaaacatttatccgatattatgaagactttgttgaaggcaatagtaccagaaatattgagttggaaagattgaataaaatgagtcaatatatcggttataaagatttcacggatttttcacggacttttatcagaaatgatgaaaaaaaaaatatgacaacagtaaaaataagtgtggatcaggatgaggagattatatcagaaaggctgtctaatattaatattaatatcatcaatgagcagcatattaaaatgcctgaatttgtaaaacaaaatagttttggtctggtaggcatattgatgctcgggggatttttgattggaagtttttattgctcaaccggaaataaaagtgcttatgaatcatttaattttttgaatctgccggtaattgagaaaaactgtatgtattgggatcagtatgaatataaagcaacagcttgtaaagaagaaaatcttatattaaatattgttcctaaggatgatattcagattaaatattttaaacgtattacacggaaagatacgcttacagtagagaatgctctgggaaaaacatggtactccaaagtaaatgggaaagttgaattttttacaatggatggaattgatcctgaaaataaaaaagagctaaaaaagtcaactgaatatatcatcaggaaatattccggaaagaaagctgagatgattcccacagaatgaaacttccttcacaattatttaaaattcaattataaggaaatccttaccaatttatgataaacaaaaaagcgaaaagaaaatctcctcgcctctgagttttattgatctgtaagtatcctgtttacattttggtaaattaattaaatatcaataggaacggactttagtccgtttaatcgaaacttcagcctttcttcggctttagccaaaacctaaaactgtaaggtttactctgcattcagcattcccagttctccgaaatgttttttaaacttctgaattttaggccccactacagcgctgcaataaggctgtgtcgggttttcattgtaatatccctgatgatattgttctgccggccagaatttatcgaatttcgttaattcggttacataaataccagcccatcttcctgattcctgagatactttgatggcttcttctgcttttgccttctctgcatcatctttataatagataacagaacggtattgggttccgatatcatttccctgtctgttcagctgggtgggatcatgaaggaagaaaaatacatccattagctgttcgtaagaaataacagtcggatcataagtaatctgtaccacttccgcatgtcctgtttctcctgtacaaacttcctgataagtcggattgtctttatgcccgcctgaatatcctgaaatagcagattgtacccctttcagcatattgaaacagctttccacacaccagaaacatccgcccccgaaagtaatctgttctaaattattgttgtccattgttggtaattatattgttttatgatctcttcctttatccggaaaagctgatcaaaaataggaaaaactttttcatttgaacacggttttaagtcttaaacttaaattgtaatgatagatatgacaaatgatttctaaacacaaataacacaaatgttttttacgaatagccacaagaaaatatagcataatcatctgtgaaaacctgtgtaatctgcgagaaaaacaaaaagcaccctaaaaaggatgctcttaattatttaaaatagcgttcagttatttttcccaaaccaaagcacttgctccaagaatggcagcatctgcttcgtcaagctcactgaataccagttttactttatttctgaagataggaagaagatttctttccatatgaagcttagctggttttaaaataaaatctcctgctttaatcactcctccaaataaaagaatagcttcaggtgaagagaacatcacaaaattggctaatgcttctcccagcttctgacccgtatatcggaaaacctcaatagcgatagggtcttctttgatggcacattcgtataccgttttagaattgatggcatcttcaggatattgattcagcatagattccgggaactctgccctcattttctttgcggtgatggtgattcctgttgcagaagcataagcctccagacttccttcagaacctgtgctccagtgctttctaccgccgggtttcactattgtatgtcctaattctccggcaaacccgtcatgtccatagattaaacttccgttggcaatgattccgctgcctactcctgtacccagtgtaatcatgataaaatccttcattcctctggctgctccgaaaagcatttctccaagggctgctgcattggcatcattggtaaccgtacaaggaagaccgaattttgctttcatcagttccgcaaaaggaatcactcctttccagggaaggttaggagccagttcaatggttcctttatagtagttggcattgggtgctcctaccccgattccgtcaaaatgcttttcagcaccatgtttttccatcatgggatgaacatgttcatacaaagcatcgatgaaatcctcaactttgtcataagcatcggttctcagatttcctttatccagaacttctccacggtggtttacgattccgaatttagtattggttccgccgatgtcaactccaagggcaacttgttttgataaatctattaatgacatttctatgattaaattctaagggctaaaattataaaaaagattgtattaatggattattaactgagttttatttaatgccttaagctgtttttattgattttttcttttttcttccccgccagatcataaatcctgtaaccggaagagaagcgcatataaggcttacgataaaagcaataatcttggtaggaagtcctaaaattgcccctacgtgaatgtcgtaattggcatttaccactttctcaccaaagtttttgtccttcggatcatgagtatggagaagttctcctgaattttcatcaaagattaagctgctgcttttatgataagaataagacaaatgcttcacatacacttcaaagttaggatgctcgtgatcatccatgtgaggatggcccagatctatagcaaaaccataagcatcgggatattttgtctgtacagtattaataattttatcaagcgttccttctgttctcaactcaatgggagcttttgtcttgatatgggagaagtcaggatactttgtttctccaccggaaaagatcacataaatcatcgcttgaacgacaaagaatgcatagaaaagtcctgtgatggaaaagatcaaagcaaagatagatgcataaaatcctaatacgttatgaaggtcatagttctttcgtttccagcttttgatatttttccatttgaaagagaaacgctgttttcttgctgctttgttcttgggccaccaaagaatgattccggaaatcaacatgatgataaagataataactggaattcccaccacatacgttccccagtcctgtttcagaagatagctccagtggatcatttttacaatattgaagaatccgtttttctcatcataaactctcagtacctttccggtgtatgggtttacataagcctgtttgtaaataggaaattcatcaaaataattccaggcatctgtattatgttcgtaccaaaaaaacatgtaggacatttttttatcgataggaacactgacccagtggatcggatatttttcttttacctgttccgcgacagccttttccattacccggataggaagtacctgcttctgttcaatattctgctcatgatggtagatgacatcttttcgggtgatattttctacttcatccttaaaaacgtataatgctccggtaatagaaataataaaaatcaggaaacctatgcccaatccgaaccagagatgcagctttgcagaccattttttaatgaatcccggtttctttttatgatgatgctttttcttcatatcgcagtaaaagtaaagcaaatataagcttactctttattcagtttaattaaaatctatattcgaccatgaatgttcctctaaatcccagagcattggtaaaatcactgtctcttgcggtccaccatgaaatagcaggctggtagagtttattgaaaaggttttcaattcctaatgatactctccagttctcattaacctcataacttgatttgaaattgaaaacagtatactcaggtacatatccttcaccataagcatataatcccgtcttggcattaggttcaaatctattttgctggaaagagtggagcatatcaaatccaatggagagagcagggatcggtctggcctgcacatatgctaaaaccttaggcgcagaaattctgctgttgttgatttttgtggaatagtctccgtcatcttttacagaagtaattccttccatccagctgtagcttccgccaaactggatccatttcactggggtaaagtgtaaaaatccttcgactccatacacgatttcaggagatcgctgaatcattaatgctctgtccgggctctgtacgaatgatgctccaagtttggatgtacttacataagaagttaattcataattcaaccagctggaaagctgccctgttgcccccaattcgtaattattaacgatgatgggttttgtttccagatttttgatcgtttcagaagttgaggttcttaaaattcttcctaactcattaatggagtaggcctgagaaaagcttccgaaaagattgatataaggttcaatattgtaacggacaccgatatttcctaccagcgcattatagttcagctttccgccggctacaggaatgcttttggtgaaagtaccgtcacttttaagagtagaaagggtattgaaatcatcaacatttactctgatgttttcgtagcgaagccctcctttaatcgtaaactttttaaacagatcaatttttgccagcacaaaaggtgcaatattggtcatgttcatgttaggagtccagaaacgtccgtcttccagcttttgtacagtttcatcattcagaatatcagctccatagataatttctccctgagagttggccgaattccaaagctgggtatcaaaattaaatctggctcctgcttttttggagattacattagattgtccgccattgaagaacgtatcgctgtagccgtaaacggttttaaaatcctgataatagagactgatatttaacgaagttccggcaaaaagattcttattgtcatagctcactctgatgttgtggttcttcggagttccctgaggggttgtttccaatccctttccgattccttcaccaatggttggtgttatgccgtactttcccgtttttaatcctacattcagatctgatcttgaagaataaccaatgtaagaaacctcaattctctgattttcgttgatatcatagcctattttcagcaatccgttgtaattgtccatcttggcaatgctgtaagtcgggcttatcaaaacgccatctccgtctttcgtatatccggttctttcataagctaatgaaagggtatagtcaaatttgttgatctttcccgatacaagctggctggctcttactcccaaagtgccaccataaggctgtccggtaagaccaatctgtgaaattcctgagatttttttatctgttttgtttcttttcgtaatataattgatgatccctccgtcggctccgtttccatagatagaggaagctcctttgatcacctctattctttcaatcgctgaaggatctatcgtccttaaatctctggccccattacgaagtggtgtagactgaggaatgccatcaatcaaaaccagaacctggcgtcctcttaacgtctgtcctgtattggaagtctgtcctgaattggttcccaaactcggaacggtgtactgcaggatgcttgtaatatctgagttaacagtcagctgagactgaatctgcttttcaccgacaattgtgatagaacttggaacttctttgatgttttccttttttctggaagcagtcattaccacctcatctacatttttagtttgtaaactgtcttttacctgggcaaaaagggtagtagttcctaagcaggcagctgataaaagcacttttttcattatattttctttccttttttctttctttttccccaccaaaccaggaatccggttacagggagtgacgtacacgtaaggccggccataaaccagatgatttttccaataattccgaagtaggaaccggtatggatatcataattggcgttggaatatttctcggcagtattgagattgtgatgaggtttgttggcaagtagtttacctgaatatttgtcgaaggtcaggatgtttctttcactgtatcttccatccattccgtaaaccgttacaggaaggtttttcagctcttttccttttttattctttccgtttaaagtaattctgaagctggatgattttgaatacaggttttcagcctgtgctgcagccagatcaaaaacagcttcattctttgccatcagagagtccggagattttctttctttttcctttggaagttcccatgagccggataatgcaaaagtaaaagtgttttttacaaagggataggcaaaataaaggccggtaagactcataagcaaagcaataaatgaggcataaaatccaagtacattatgaagatcataatttttacgcttccagttttttacattttcccaattgaaccagaaacgtccttttcttgcatttttgtttttgggccaccataaaatgattcctgtaatcagcataatcacaaaaataacggttgggattcccaccgtgtacggcccccattctgagttaagcaataatccccaatggatatatttcagaatattgaatacatcgtatttttcatcataaaccgcaaggatttgaccggtatattgattgacatagacctgtttgctgatgagcacctgctgaaaataattccatccttttttacttttttcataatactggaactgataagatttgcttttatccaaaggaatttctacggcacttacaggatatttttcattgagttccagtgatactttttcacgaagcagattgataggtaaaggttttgtccctacatcttcttttttaagatatatggcttcttttcttaagctatcctgtatttcatccttaaaaacatataaagtccctgaaagagagactataaatacaatgaatccaacagacaaacccagccacaaatgcagctttgcggaccatttttttgttgaagaaatctcctttttatgatgatgcttttttctcatagcaaaaagttaaccccatgaggggctaacctttgaatttttaaaatttataagtaacagatccaagtacgttgattagtttttgtggattcgctgttgtatatccaatccagtaatgctgactggtaaagttgtcaacttttactccaactctgaattttcttgcgtcgtaaaatgcattggcattcattacaaagtactttggaagtgtaaaagtagatactctgctggttgcaggatctaattgattaaatatcttgttggcattggcaaaatttcctcctactccaaaaccaagtccctttaagtttccatccagaaactggtagcttgcattgaaattagccagccatggagaacccgccgtagctggtcttaagcctgtagccatatccgtagtatcattataggaaagaccacctattaaagaaaatcctttgattaagtatgcatttacttctaattcaacacccttactttggatttcacctgcctgagtctgtactgatttacctgcaccggtatattgtccggtagctaccagcatatttttaactctgatatcataataacttacagaagcattaatttttccattgatcagattggccttgaaacctccttcaaactgattcgctctttccggatctgaaagggctatacttcctgcaagatcggtagtaaaatacccgttgcttttaaaactgttctgataatttccaaaaatcgaaaatttatctttaataatctggtaaactacacccgccttgggagaccatgcagattgattataagggtctaccgtagacataaaatatttgccctcctttgcattattgttttcatatctaagccccaatacaatgtttaatccggaaattggagtgaaaacgttggaaatatatccgctgtaagtattaagatcaccatcactatcaaaatgcccaatctttgtgggatcattatataaatcacctaaagtagtcccgttgaagccagaataatcaccaccagtagccggtacgctatcaaaattaccgcttgctaaataaatatatcttgatctgtcctttgttttcagataatcaaaaccagctacggttctgtttctcattccatttccgaaagtgaagtcaaagttgaaattttgctgtatctggaaatatgactttctgctatctctggttgcctgatcatttctgtccacaagaagattgttgctggtatctactcttgcagcgaaataaggtccgaaaccatctgagtaactgcttgatgaattgatattggtagatgatttaatatgctcgttgatcttataatttatctgaccaaagatattatttactcttgccgtggtataaaggtcatttccaagataagattctctgtaattaagtcccttcttttcaaggtctttcatattatcaattcctccaaggttatctggtgtaagataaaagaagaatggttcaccaactgctcttgtattgaacatttcatattcaacattgaactgaagtttatcatttacattataagttaaagatggagcaaaggcaaaataggtatttttagcatccgttttctgaaatgttccttcattcgtataagctgtattgattctgaaaagcagtttgttgtcctttgtaagtggagtatttatgtcggcttgtgctctgtatgtattgtaacttcctccaaaaagacttacctgtccttcgaatttttcgtatggttttttagtaattctgttaattaaacctccataagaagcaacgttgcttccgtataatgttcctgaaggtccttttaagacctccagtctttcaatattaatggcgtcaatggtagttgtaaccggtgatactaagccgtttctcattgaattgttggaaggaaagccccttaaaacaataaacgaacctccatctccagctctgcttgttgccgtccacattttttgaattcccgtaacatttctgtaggcatcatccactgtaaaaattgtctggttttctagaactgatctgttaatggaggaaaaaacctgcggatcttcaatcgcctttaagggcattttgttagaatagtcactatcctttttgacataggtattaataattacttcatcaatattgttagtgttggcagaatcctttttctgagcaaaagttagcatagagcctaacattgaggcacagatcagtacatttttcatgaaagcaaaattttctgcaaatatattatttttaactgttctaaataaataataagattgatatttatcataaatttgttatatactgaataataaaaaaccgctatggtcaatgccatagcggtttttaagtgttattattaaatttttcctaagaaggaatttctcctttatataagaatgaaataatttctttgtttaatttatcgatcatttcactgaataagtggaaggattcctgcttatagattacaagtggatctttctgctcgtaaacagctccctgtgatgatcttcttaggtcatccatctcacgaaggtgaagcttccagttttcatcaataattgataaagtgatgttcttttcgaaatcgtttacaagactttcacaatgcgtttcgtaagcttctttaagatcagctacaatcgtcattgttttgtgtccgtctgtgaaaggaacctggatcattttgaacattgaaccctgattctggtatacattctcaataatcgggaatgatttttctttcaacaggttcagtttcattttataatcttcctgagctgctttgaataggatgtttgtaagatcctgaacattcttgttattaaaatcactttgagaaaccggagattccatcgtaaatgtcttaatgatttcgtattcaaaatctttataatttcctgaagcttttcctttcgcaacgatagaattagctacatcgaaaatcatattcgtgatatcatatttcaggtggtctccgaacaaagcattctttcttctcttgtagattacgtcacgttgcttgttcattacgtcatcatactcaagaagtctttttctggttccaaagttattttcttccaccttcttctgagctctttcaatagacttgctgatcatagagtgctgaattacttctccctctttatgacccattctgtccatcattttcgcaattctttcagaaccgaacaaacgcatcaagttatcttcaagagatacatagaactgagaacttcccggatctccctgacgtcccgctctacctcttaactgtctgtcaacacgtcttgaatcgtgtctttctgtaccgatgatggctaaacctcctgcatcttttacttctttggtaagcttaatatcggtaccacgtcctgccatgttcgttgcaatggttacaactcccggacgtcctgcttccgcaacgatctctgcttcttttttgtgaagcttcgcgttcaatacctgatgcggaatttttcttaactgaagcgctttcgaaagcaactgtgaaatttcaacagaagtggttcccaccaatacaggtcttcctgctgctgttaatttttctacctcttcaattacggcgttatatttttctctgttagttttataaactaaatcctgcttgtcatgtctcagaataggacggttggtaggaatgaccacaacgtctaatttgtagatctcccaaagctctccggcttctgtttcagcagtaccggtcatccccgcaagcttgttgtacatacggaaatagttctgaagtgtgatggttgcaaaagtttgggttgctgcctcaatttttacattctctttcgcttcaattgcctggtgaagaccatcagaataacgacgtccctccatgatacgacctgtctgctcatcaacgatttttacttcaccatcaattaccacatactcatcatccttctcaaataatgtgtaagctttcaatagctggctcatcgtgtgaacacgttcggatttttcagcaaattcagcgaaaagtttttcttttgcttcaaattcttcttctttagataagtttttagcttctacttcagcaatctcagttccgatatccggaagtacgaagaagttcggatcagagtttccttgagacatgtattcaacacctttgtctgtaaggtctacctgattgtttttctcctcgataacgaagtaaagatctttatctacgatcggcatatcacggttgttgtcctgcatatactgtgcttccactttctgaagcaatgctcggtttccgctttccgataagaatttgataagttgtctgttttttggaagacctctgtaagcctgaagcaatttgaatccaccttcctttgtatttccggcagcaattaattttttcgcttcgttgaaaatagcagaaactgttttcttttgtacttcaacaattctgtcgatagaaggtttaagaacgtcaaactcctgtctgtctccctgaggaaccggaccggaaatgatcaacggcgttctggcatcatctaccaatacagagtccacctcatccacgatagcaaagttaagttctctttgtaccagttctgaaggagaggtcaccatgttgtctctcaggtaatcgaaaccgaattcattgttggttccgtaagtaatatctgagttgtatgcttttcttcttccgtctgagttcggctggtggttatcgatacaatcgatagacattccatggaactgataaagagggcccatccatgcggagtctcttttcgcaagataatcgttcacggttacaacgtgtactcctcttcccggaagtgaatttaaataaataggtaatgttcctaccaaagtcttaccttcaccggtagccatctcggcaattttaccgctgtgaagaataacccctccgataaactgaacatcatagtggaccatatcccaaactacaggagttccggcagcgtcccatgagtttttccaaacagctgtgtctccctgaatgctgatgaaatcttttcctgcagcagctaactctctgtcccagtcagttgctgttacacggatttctccattctgagcccatcttcttgctgtttcttttaccaatgcaaaagcttcaggaaggatctgagtcagaactttctcttcaatttcatatgattctttctttagagactcaatttttgagaaaagagcttctttctcatcaacatttgttgaattttttatctgctcttttatctgttctatttgagctgtgatcttgctggttgcagattttatattctctttaaactcagccgtcttttgtctcaacccatcatccgtcagttgttggatgttaggttctacagccttgatttttgttacaactttttttacttcttttaggtcctgcgcttttttgtctcccaaaaaccctttaagaactttgtttaaaaaactcataaattttttgctttatgcttaatgcaaatgctttaagcgttttaaataacacttatcgtgtaaattatatataaaaagggcaaaaaagctctaagcacgcagcctaaagcttatcgctttattaatattcgtcttcgttccaaaggaaatcctcgtcagtaggataatcactccatacctcttcgatagattcataaatttctccttcgtcttcaattgcctgaaggttttctactacttccataggtgcaccagttctgattgcgtagtcgataagctctgcttttgtcattggccaaggtgcgtcacttaaatatgaagctaattctaatgtccagtacataattttctaattttttgcaaaagtataaaaataggttgtataataaacttttttatacttgattttcaattctttttataattttttcttataaatggctgtcacaaactggctgtcagctatgtcagcaatttacttaatgtcgttttctcaaaaaccattccacaaatttttttatgccattttggaagtctgtggcaggtttataccctattaattcctttgcttttgtgatatctgcattggtttttgtgacatctcccggctgcattggcagaaattttttagtggcagatttttcaagcgccatttctatagtagctaccatttccgataaagtcacaacctgattttctccgagattaagaatctcatatacctctgtattattttcaaggtaaaggattgatttggtaattccatcaatgatgtcatctatataggtatagtctcttgctgtatttccatctccatagaagggaatttcctgattttccgaaataagctttgtaaacttgtggattgcaagatcgggcctctgtcttggtccatataccgtgaagaacctgagctggatcatatctatatggtataggttatgataaacatggcctataacttcgccactttttttagtcgctgcataaggagagatagggttgtctacattatccgtttctgcaaaaggaattttttcattatttccgtaaacacttgaagaggacgcacaaatgaattttttaatctgatgttctttgcacaattcccaaaggttcatagtgcctcttacatttacttcttcatattccaaaggacgttcaatagaagggcgcaccccggcaagtgctgccagatgaatcaccatgtcaatatgatgatttttaaagatagcttcaatacccttataatcccgtatatcctgccaatagagggaatattgatcagaatgggagagggaaaccaaacgacggatgtcagtctctttatccgagaactcaaaatccgaaattttaccaattgactctaaagtgtttttaatttttacctgatagtcgtaaaaatcatcaaaattgtcaatgtttatgacagaatgtccatttcttaataatcgctcagttaaatgagagccaatgaacccgctgccgcctgttacaagataaaccatttgtattttttatggatacaaaaatataaattttactatttgaaaaatataatcattaaatttacttaaaaaagtaatataaatataatatgcagtttcaagggcaaattttaaagatgacaagctacgatgccaaacctatccagtactacctcaatctttcaggagatctgattcatatgaatgagctgtttggaaaggagttaagcataaaacatattggatttcaatgtgtaaattgtggtgagaataaaccgatttacagaatgggattctgcaaaaactgtttttttgaaagcccttatgcaagtgataccattatccgtccggaactttccacggcccatcttgatatcgcagaacgtgatctcgaaattgaaaaacaaattcagctgcagccccatacagtttatctggcctatacaggagatgtgaaagtaggagtgacaagaaatacacagattccaacaagatggatagatcagggtgcaacttttgctttacctattgcaagaacagaaaaccgctacgaagcaggaatgatagaagttgctttaaaagaacacttaccggacaaaacgaactggaggaaaatgctgcaggatgattttgaaggagaagtggatcttgcagatttcaggcagaagattaaagaatatttccctgaggatttccagaagttctatagtgatggagaagaattgtggatgctggattatccgtttgaaaaaccggaaaaagtgacttcattcacattagacaaaaaacctgaatttgcaggaaggcttaccggaatcaaagggcaatatcttgggtttgaaggaggaaatttcatcaatgtaagaggccatgaaggatatgtgatcgatctggaaatcaggaattgatcggaataaaaatataatcaaatcacaaaatatgaaaaaatgggttaaaagactattgataagtttcgggattctggcaggtatccttcttgccgcaaatttcggagttaacatatggcttaaaacccagcttccggattatataaaaaagaatacggattataaagtatcttataaaactcttgatgtggatttagcatcaggcaatatattcgcagcaggaatttccgtcaacagtaaagatccgcaaaatactgatgtcattggcctgcagggaacaattgataccttgaaaataagccgtttcgggatttatgatgctgttttcaataaaagaatcagctcttcggaccttttgctggctaagcccagcttaaatgttattcttgcaaaaccggttgatcgtaaaactggcaaaaagagaaatcctgtgctttttgaaaatatcaggatcagtgatggaaaaattgctgttttcagacataccaaacaaaagtttttatctgtagagaagttggatctgtttgttgaaaatttacagatgacggaagaatctgtagaggataaattaccggtcgtttttgacagatacagcattaaaggagaaaggttcttcttccgtccggataatatctatgccattaccatcagtaaaatcaatacggagaacggacaaatgtcggtggataacttcaggctgattccactgctttctttgggccgctttaaaaagttttatcccgagaaggtccagctctttgaattttccattcctaaaatggaatttaaagatgttgttttaaataagaacaaagtatcacttgctaatgcggattttaaaaaccctgttttggccgtgtacaatacaggggtaaaagggaaaaaaaatgaaaaaaaatcaaattttgaggttgatttaaaaaatataaaactcaataatgccattgtcaggatcagtaaaccggatggcaataaacttttatctgtcgggaatcttaatttgaatatcaatcagctgatgtttaataaagaaacttcagaacagatcattcctgtaggatataaagactttaccgttgccggaagagatattgaatattcaaaccatcagaatattacactaagaagccttgcgcttaagcctaccagcggtgagatccgggatgtggtattatcgggaggaaattcggaaacaggaaaactaatagaaggattaagaaccgaccatattgcttttaacatcaataaactggaatttgcagataaaaaactggatcttgaccttaaagatcttcttatagaaaatgtgaacgggacttttacggcaggtgaaaaaaagcagaacaacgctggcggacctgatattgtaaaatccattatcataagaaaagcttccttaaaaaattcaaatattatttatgacaagggaaaacagcctttagctttccgtgatctgaatgctacctttaatggcattgagctgtctcctaaacctgatcacaaaggtctttcttttaaagtgaaagattactatctgaccaccagaaattttgcctacaaaacgcagttttataatatgagcctcgggcttcttaagcttaataagaacagaatccaggtcaataactttgccatgaagcctctcgtttcaagagctcagtttatcaaaatgatacctgttgagagagatctgtatgacctgaaagcaggacagataactgcagaaggggcctgggagctattttctcaaaataaaatggtaaatgcttcccatgtcgttattcagtcagctgatgccaatattttcagaagtaaaattccaaaagacgatccgaaaataaaagctttatactccaaaatgctgagatccattaaaattccggtgacggttaataaccttgatgtgaaaaattctgtattagtgtatgaagaagatacaccagaaagtatgggaccgggaaaactgactttcagcaattttaatatgaatataaagaatctgaattcagctaaaataaaaggaaaaccaacaagggtagatattaaaatcaattgctcctttatgaatctgtcgccactctccgtaaactggaacttcgatgtagccgatcagagtgataagtttgcaatttccgggaaaacatccaatcttccggctagtggaatcaatccgtttatcagaccttatcttcatgtaacggctaccgcagggactattcaggaaatgctctttaattttaaaggaaatcccgccggattacacggaacctttaatcttaaacataaagatctgaaaattgctgtcttaaataaaaacaaccatgagaaaaaaggttttctgactgctgttgccaatgtttttctgaaatcagactcaggaagctttcctgaggcagttactgtggaagatgtggagcgtgatcctacgaagtctttctttaaccttttctggagaggaattgaacaaggattaaagaaaaccctgattggtaaaaacgttgaaaaaacagagaagaaagtaaaagatgcggtttcttcggtgaaagacatgaagcagtctgtaaaagaaataaaacaggaaataaaaaataaaaaagaaacttctgcaccaaaagaagaagagaaaaaagaaaagaaaggttttcttaaaggaatcttcaggaaaaaagagaaccctcaggaataattcttaaaccattaagatagaactatcactatttaataaaaaccttaatggtttaagaattaatataagaaagattcagttaaaaattgaattcatcactttcctgaatgggaatatctcttaaaaacttatcaaactcttcacccggataattactgtctgctccgtaagaatctatgatcattccgcggtttccgctattgtcttttaccacataaagaactgcattatcatcgggattgctgtctccttcaaagcggtatgttttcaaaatgaccagatccgaaggctgataaattttgtcggaattttcaaacttcatttcacatttttcattcattctgaactctctgtgtattcctctttcagaaagcgttttcatgacttggctcaaggtcgtcattctgtcgatgttttccggattttccataataatatttttgttgataagtacaataattaaaccattgcaatttctaaatataagaaaaataacagattataattttcttaaaaataaagttgaatgttaacaaaatttataatccggaaaaataaaatgggtatactttttgcaatggtatcaataataaatcagagaaaatatgaaaaaagaagttggagttttactggcagggggagttggtcttttggcagtattaagtttaataagcataaaaaaaatattgactaaaaaagataaaaaatatagtgatacttactcagattatcacagacactttgatgaaaagaaccatgaagatgaatatcatggtgtcgaattttacgcagtgaagtagtaaaaaaatatatttaattatgtttaaatccaacgcttttgaaagtgttggattttttttgtggaaaactttaatgttaaaactcattattttataaaaattccattctaattttacactggcatgcaaaacgaaaatttcataaaaggtcagggagctcagcgaaacgttatcaatcgtttcgacaggtatacctatgaacctgaagatgaagatttcgaacccttaaaaacctcttttaccgaagtctttcccaaaacaattgtcaatcaggtgaaaagcgaggatcttcccatggagtattcaatgaatccttatcagggatgtgaacacggctgctcctactgctttgcgagacccactcatgaatattggggttatagcgccggaattgattttgaaagaaaaatcatggtgaagaaaaacgctccggaactattggaaaagttttttcagaaaagaggttacaaagcagcacctattctgttgtccggaaatacagactgctatcagccggcagaaagacaatttgaaatcacaagaaaattactgcagatttgtctagactacagacatcctgtcaatattctgacaaaaaatgcattggttttaagggatctggatattttaaagccaatggcagaacagcatcttgtttccgtttccctaagtattccgacaatcaacgaagaactcagaagaaagatggaaccgagaaccagttccgcaagaaataagttaaaagcagtagaaatcctttccggaaacaacattcccgtacatgtaatggtcgctcctatcattcccggactcaatagtgatgagccgctgaatatattgaaggccatttcggatgccggcgcttccggcttcggatacacgcttgtaaggttaaatgataccgttgaacctgtttttgtaaattggatagaagcacattttcccgatagggcccagaaagtcttaaaccttatccggtctatgagaggaggaaagcttggagataaaagatattttgaacgacaaaggggagaaggcaacattgcagaaatgattcacactacctttaaagtcggaagaaagaagttttttgaaggtaaagaattcccgaaactttcaaccgcaaacttcaccggaacccgcgatcagcaattgagactatttgattagccaaaacttcgaagaaatcatatcatatatatagtataggataattttacaataggtttcgcaatattgtacatcattataatatagtaatagattttcaggagctatttcctgctattcattcatactcctcgcgcctgcaccctcccacgcccaaaccctctcgccctccaactcttgctgcggggtaaccatttctatcagggctagggaaggagggatgtaataagtaataagtaataagtaataagtaataagtaataagtaataagttggcacaataaaaatagtttatatgctataaaatagacattatgctccgtgtaaatccgcaccatttgtggttaaaaagaaaaaaaacattcaatagaaacgggttttaacccgtttacgaaaatacattctccgctggctttagcataaacttatctttttattatatatagtatattaccatcatcctaaaccccacaccccgcacccccgcatcccgtatcaccattctctcaccctcaaaccctcccacgctcaaactctcaaactctcatacactcccacccaataccccaaacaaatgtttgaaatttttctctctgcaatccagcgctttaagagtaaatattacgaaacggtaaaatttatgttaaataaacttgttttgcgttgttagaagttgctatctttgccccactgaaaacgagagtagatcagtaagcgcagaagagcttttaggtaagcaggaacattatttacttcacaagagacagacgaaaaaaactttaaaactttttgcaaaaagagttgtgagataaaaaagagtttgtatctttgcagtccgaataaatcggagcgcaggagtagagagattgagggtttgagaaggattaaggttacttaaaaaactttaaaattttcttcaaaaacatttggtcattaaaaaataaagttttacttttgcactcgcaaatacggagcactactgacagagagcgtgcttcgggaaaagcggaagatataaagatcattgacatacaatataacaaccaagtaaggaaaaactaaagcgttaaaaactttgagtgagtcagacaaacatacaatggagagtttgatcctggctcaggatgaacgtataagcaataagcaataagcaatgagtaataagtaataagtaataattgatgaatggtaaacgatacatcaatcaattatcatttatcaaccatcacttatcacttgacattcatcacataccccattgtcactccgcaggagtctaaacaaagtattagaaaataacacaagtattacttttacccttttaaattgtttaaaactctaataatggaggttggattcctgcggaatgacacagtagaaagaagcagcacaaatgaaaagaaagatgctattgacaagaaaagttttatctgtttagtctgttattcgtaggatagaaatcattttcctctttttaagctcataaattgcttattgcaaacaaaacctgggcttatcattataaataggtctgagtggctgaaatctactttattttaatccaaaagaaataaaaaaccacctctgtgaaagaagtggctccatttatggcattttgattttcaatcttacatgtcactgtttgtatccgggcatttgaaatcatcactgcaggttgcacaaacaatggttccattacaatagtacatacaaaaatctgtttcaggaagattagttcctccggaaatgtgttttaattggcctttttttagtttttttagatttttcatattgttttaattaaaaatttgtagttaaagtaaaaataagcaaaatatttttaactaaacaaggcttgttgtgtaaaaacaaaaatttaatggtaaaatgattctaacatttataaatctttatttaattattatgaaataaatactgattttaagcttgcgtaatccgaaaagcttacaaagtaggaaacaattaaacgataactataaaaaatttaaagaaattgaaagaaaagaattgaaaactatttgataaatgctatgatcttagagaatctccagatgatccttgtcaggaacttaataatcaaaataatgtttgttacagaatgaatagctgtacaatgttatgtacgcttgttccatgtttctaacggaattattatagtaaaatggctgcctatagggcagccattattttttattttttaatcaatcctaattcgatcaatctttcatgcaggaattctccggcagtagtatcttcgtataattttggattgttttcatctacacagttctcaagtgcatttaaagacattgcactgataggatgcataaagaaagggattgaatatcttgaagtactccacaattctcttggtggatttaccactctgtggatggtagatttcaatttgttgttggtatgtcttgacagcatatctccgacattgatcatcagttcgtccggctctgcaatagcatcgatccattctccattatggttctgaacctgaagacctttaccttgtgctcccattaaaagggtaataaggttaatatcaccatgtgcagctgctcttactgcatcatccggttcttcagtgattggcggatagtgaatgggtcttaaaatagaatttccttctgcgattttgtcatcaaaataaaattcatctaaaccaagatgtaatgctaaagctctcagcacgtactgtcctgttttctcaagcatttggaatgcctctttacctacttcattgaattttggaagttcatcaacgattacattgtcaggatactcagttctgtacttggaatcatcagacaggtactgtccgaagtgccagaattcttttaagtcgccttttttgaaaccttttgcagtttctttaccgaatcctacataacctctctggcctccaattcctggaatctcatacttttgtttcgtttccacaggcaggtcaaaaaagttttttacctctccatacaaatcatctaccaggttgtcatcaagaaagtggccttttagggctacaaaaccaatttcttcataagcttttccgatttcatttacaaatttctgtttgcgttccgggttgtccgaaaggaaatcacgcaggtctacactaggtattttatccatttttagaaatttacgaacagcaaaattacattttttttaatttaaatgattttaaaatcattatttataagttaaatttgctgtatgaaaaaatattcttctaaaagaagtatccaaatacttgcacatcttcttcagcagtatggaattgcagatatcgtcatctctccggggtcaagaaatgctcctttggctattcatttttcagaggtagatagttttaactgctacagcattgtagacgaaagaagtgctgctttcgtggcaatgggaatggcgaaaagtgagaaaaagccggtagcaattacgtgtaccagcggatcagcagtagtcaattattatccagccattacagaagcattttatcagaatgttcctcttttggtgttaacagctgacaggccgacggattttgttgatatttttgatgggcagacgatcaggcagaaggatgtttttcatcagcactcttacggtgattttcaattgctggaagacagtaaggagaatgcggaagatattaatttcgacacgataaaaaaggcgatcgagctttgttttgaaaaacaagggccggtacatattaatattcctttggaagaaccattgtacgaattggtttctgaacttccaactttcccgacagttgaaaaaacaatcaagcatagagattatgaaatcccatccaatctgattgcagaatggcatacttcacagagaattatgctgttggtgggaacaagagattacagcccggaacttgaaaatcaattgacgcaactggtaaaaaaccattctgttgtggtattgagtgaagcaaactccaacttatatcatgaaaagtttttcagacatatagaccgttatatttttaattttacggaagaagattataaaacatatgctcctgatctgttgattacagtaggacagaatgtggtttccaaaaaagtaaagcaattcctgagaagtgcccgtccgaaacagcactggcacctggatgaagtatggcagcctgatacttatttttcactgaccgaaaaaatagaagtaaagcctgaagttttcttctcaaaactgctgaaatttatcaatctggagccaagaccttactttaatctctgggatgttttaagggacaaaaaagatgctaagcatgagcagttcttaaatacaattgaattctctgatttttattttttcaataaggcttcacaaacggttcctgaaaattataatattcatttcagtaactcatcagggatcagatatgcacagctgtttgatttcgggaagagaaagatatactgcaacaggggaacgagcggtattgatggatctacttcaacagcaatgggatttgccatcaaaaatgaaaatccaaccttgctgatcactggagatctgagtttcttttatgatatcaacgggctttggaatcagtatattccaccatttgtaagaattatgatcttcaataatggcgaagggaatatttttaaaatcattccgggaccaggaaacgccaatccaaatacgctggatgagtttattgctacaaaacaccgtaaaaatgcagaatctttggccaagcatttcggtttttcctacatcagagtggaagatgaacttactctggacagagttctggagaacttcttcaagccagatgcacagccgaaaatccttgaagtgaacactcacgggaagaacagtgcagacgtactgaagtcgtattttgaatttatgaaatagatttaaagatcaagatattcttcattgcccggcagattgataattctgtcgatggagtagatgaacatgtcatcaaaatcattcaacgcattaatgatctggaaatgggagaattgctttatattctgtaaagtgatttccgtttctttgatctttttatgctttaaaagatgctgtctctgtactccgttcagcagataggtagaaggagtaaaccagtcttttccctttaaaaataaaaggttggaaaaagaagtatccgtgatatgattatttttgacgatgataatttcttctgtcttggctttcatcttcattttatccagctccttacgatcttcaaacttgaaagaataatcgaaactgttgttttctaccagctgaaaatcctgaatttcaggaatggcatagggaatcatctgtgtcctgatctttttatcaaggtcataggcaattcttagtttaaaaagaccatcttcatcgtgctgcagattcttatagattttggccagatcgatagagtcttcctttccgaaatgggaaaacgtctgattgacacgtttctgatgcagatccaataaaaaaacctcctgatcttctactttaatactttcaatgaattgggacatagattttatttttcatttcctgatactcgtcttctaatttactcatatgcgttataccgcctccgcttttgaaataaagttgatctccttctttttcaataaagcgtatcatgacacagctgtcaacattctgaccgtcaaaccatccgcagactcctgtataatatcctctgtcatatccttctgcgtccagaataatttccagtgttttaggtttcggagctcccaaaatagagcccgcaggaagcagttttttcataatacttccaattctgccgctaaactcaggttttactgtacctgaaatttcggagctcattgcgtacagatctttctgctgtgttttgataaagtcaatatgctgaaactgatctacctttacctcatcagccaccatgctcagatcattccgaagcaggtctacaacagtgtaatgttctgctttttcctttttatcattcttcaggatttctgctgcattttcaatggaagcatcaatagttcctttcatcggatacgtcaaaattttaccatcaatgatctttacaaaagtttcaggagaaaaaaatacaaaaaaatctttataaaatactttatacttagcatttgagtgataaaaaatttcttctaaggttaaattggtctctatctttgtttttctggtataatttaccagataagagtttcccagacgaatatttttctgaactttatcaaatccgattttaaagctttcctttgtttccggaaatgatttccataccacttttttgttaagattgcgtactgttttaacgttggaaaactcttgaaaatcaattattaaacctgatttttcaatctctttttcctggtatatttcaacattctccgaaagaaagtcgatcacgaaaaaatagggaaccttctgaagagaaagttcgtccatttccataaatttttgatgattcactgaaaacattccgcaaaaataattattgatgtttacttttgcataaattttttatgatgcagaacaaatatcctcagaaaccgggaatagattttatattgaagcaggcatttttctactggaataaaacactcgtttttcagttgatgttttcaatcatcttttttggaatatttcttaccgcaattatgcttttcggacagaagtatgacgttttttcatataataaagaattacaggaagcctttatggaaggaacccaggcttatctgaaaaaaatggaagaaataacggctactgaaaattatcagatgttcacactggcaatctggggaaccacagcatttttatatccattgaatcttgggatgtttcagatcttccgtaagcttgatctcagggaaaatattgtaataggtgatttgtttgtaggatataacggacttaacttttttaaatatgtaggatatttccttttctggttcttcatttacagatttacgattcctacaattatactggcagtaatttgggttgcggtgactctgtttgtcgctccactgatgttttttaccaataaaaggattttcgaagctatctctctgaattttaaagcatttaaaatgtattttgttgaaataatggtctgtgtgattgtggcttttctgtttaaatatttaggtttcgccttatttctgataggtggacttttcactttccccttttggaatgccatgatttactcactttataaaaccatcttttcagagaaaatttaaatttcgtacctgtttaatatgattttttactaaaaaaaactaaatttggtaaaatcattaaatatttaaactatgtctgaatttaacgaatttgaccagcaaggctctgtgcctaacagagatacggggtctattatttctcatgcttttgaaatgtataaaggagtcttcggttatggaatcgtagcgatggttatttacctgatcggaggatctgttattcaaatgcttacggggtttgactctgcttccatggttgaagaaatgaaatcaggaggagaatttaattactggagtgctccgggacttcctttatatatgggagtttccagtcttttcggtcttttattatcccctctgtatgtagggttgatctatatggtgaataaatataacaccaaaaatccgattgaattttctgatcttttcattggataccgtcagaattttgttaatatcctaatctacagtcttctttccggaatcatttcatctgtggcactggcattgtgtgtgctgccgatcatttttgtatatcccttccttttaatagggtatcctattcttttatttgaaaatgcttcagcaacagaggctttggggaaatcgttcaatattgctaaagaaaattatggaacatttctgttaacaggtttcctcggtttcctgatttctattgcaggagttgttctttgcggaataggagttattttgacggcaccatttattatgattgtcatgtactctacttattgcgctttcttaggaaaaccaagacaaattatgtacagcaagtaaaatagaaaagcatgatgaataaggacaagcaaataagcagtgttgcaataaagcaggtgtcattgctggcaatcattcttgtattgacggggttgatctgttttaatctggcattgtttattccctcggttctgggagcaattaccatatatgtagtctgcagaaaatacaatttttatctgcaggaagaaaagaaatggaaaccttccctggccgcctttgcattaatgtttgcaagccttattgttcttattcttcccatctattttattgctgatctgattattgataaactgggaaatgcacaggcatatatggccaaattcaatatttttctggacaagatacatacttatatttttgataaagtaggatttgatattctcagcaaggaaaatatgacaaagctgaaggattctgtaggaaagatttctacttctgcactcagtgggacattcaatacccttacggtggttatgtccatgtattttattctttattttatgctggaaaaacccaggttatttgaaaggattttaagtaatgctgcacctcttaagagagccaacatttccctgattggcgataaaatgaggaaactgattatggccaatgctatcgggattcctgttgtagcagtaggacagggaatagtttctctgataggatatataatctttggtgctccggggccggtattattatttgcccttacagctgcatcttcggtaattcctgtagtaggaactgccattgtttatgttccggtatgtatctttatgattgctgaaggaaatacaggtccgggactaggattagccgcatactgtgtagtagtggttggccttacggacaatcttctccgttttacccttttaaagaagctggaaaatattcaccctttaaatacggtattcggaattatcatgggaatgaatctgtttggctttatggggcttattttcgggcctattctgatctctctgacccttttgctgattcaggtgtacagaaatgaattttcggatgaagaaacgcctccggatctcgaattaccgaatcagaatgatcttcaggaaaaattaatttaagtataaaaagtggaaggtataaattctgaaatattaaaagaaatctgcgttgctaaaatgccttttggtaagtacgaaggaacagtccttgcagatcttccgatcagttatctggaatggttcaacagaagcggaatgcccaaaggaaaactgggaatgcagcttgcaaccgtctatgaaatcaaactgaatgggctgatggaccttttaattcctattagggcagcagtaaaaaatggattctaaaaattaaaatatatcaaccggttaaaaagtttcggcggcatcgaagatgccgccgaaacttttttataatcaattatttaagccttcaaagcttcaatttcatctctcagttttgctgccttaataaagtcaagattttttgctgcagcttccatttctttctgcttctgggcaatcattttatcaatatcttcgcttgcatagctggcttttgtttccgccaccttctgaagaatttctttctgagtatatttttcatccgggaagtctttgcttcttccgacaagattttcagaaatctttttattcaaagcttttggttgaagtccatgttcttcattatatttcatttgcttggcacgacgatattctgtttcatccagggtcgcctgcatagatttggtgattttatcggcatacatgatcgcttttccgttcacattccttgcagcacggcctaccgtctggatcatagatcttctgcttctcagcatcccttctttatctgcatctaaaatagccactaaagaaacttcaggtaagtctaaaccttctcttaagaggtttactccaataagtacgtcgaaaagtcccaatcgcaagtcctgcatgatctgaatacgttccagggtctcaacatcagagtggatatatcttgttctgattccgaatttggtgaagtatttggtaagctcctctgccattttcttcgttaaggtagtcaccaggaccctttcatcggcatcagctctcttctggatttcttccatcaggtcatcaatctgatttaaagtaggccttacctcaataataggatcaagaagtcccgtaggacggataatttgttctatataagctcctccggttttctccagttcgtaatcggcaggtgttgcagaaacataaattacctggttctgcatggcttcgaattcctcaaactttaaaggcctgttgtccatcgcagcaggaagtctgaatccgtattctaccaatgcttccttacggctacggtcaccaccgtacatggcatgaacctgtggaaccgttacgtggctttcatcaatcaccatcagaaaatctttagggaaataatcaatcagacagaaaggtctgcttcccggaagacgcccatccagatacctggaatagttttcaattccggaacagtagccaagctctttaatcatctcaagatccagttcggttctttcctgaagtcttttggcttccaaaggtttttcgatagagttaaagaaatcaacctgcttcaccatatcatcctgaatctctctgatagcgccgtttaaggtttcttttgaagtgacaaaaagattggctggataaatctgaatctggtcaaaattagattccacatttcccgttaaaggatcaaaactttgaatcttttcaatttcatctccaaaaaactggattctgatcgcattgtctgcatacgccggaaaaacatcaatgacatccccttttacacggaatgtccctctttggaattcatttaatgttctggcatataaagcattaacgagtgaatgaagcagagcggttcttgttactttctcgccgatggcaatagaaatcagggatttgtgaaactctgttggatttccgataccatatatacatgaaactgaagcaacaatcaaaacatccctccttcctgaaagaaggctggccgtagcggaaagacgtaatttctcaacctcttcattgatgctcaggtctttttcaatatacgttccggtagtggcaatatatgcttcaggctggtaataatcatagtagctcacaaagtattccaccgcattttccggaaagaattctttaaactccatgaagagctgtgctgccagtgttttattgtgtgccagaactagtgtaggacgctgaacgttttgtataacattcgcaacagtaaaggtttttccggaacctgttactcccagtagcgtctggtatttctcaccgatctctattccttcggtaagcttttcaatagcttggggctggtccccggtaggtttatattctgattgaagtttaaaatccatataacaaaaatacaaaagaaatgataagactgtataatgttttgaaggtgaatattttgattataaaattttaacagattatccttgtagttttgattttttgaagctaaacaaaacaattgaaaaaataaaaagtgctaattattagcactttgttgttatggacgtgtaaaggtcattgttgcagggatctttaatactgaagcaatggctttgccatccttcattgcaggcttccagttggtttcattacttatttcagtgaccgtttttagaagctccctgtttaggatttcgttttcccccgaagtcgttacctctgtcgtttttcccatcccattgatatgaatataagcggtagatgttatagttccgctatagcctcccaaattacttacatccacatttttgcttattttgatttttaagtctctatccccaccaggatattgcgccggaatttcattagaactctgttgagtattgataactgtatttgtttttttaccttcatctattcttggaactattgtatccgaaactttttttaattcctcttttttgaaacctgttatagcggatgtctgcgcttcttttgtttttttatggtatgaaggagtaactaaattggtttgatatggtctttgatctccaatttgggttggcatttctgttattttttcagaaaaaagaaaatgatttggattctcagcatatgttctttcggagaataagactactgcagaaattaaaacagtgatgctgactgttttttttaacagactaaattttgttttttttgttttcatcataataaatctttttttggtgttattaaaattaaatgaatgagtcaaaggtgggttttgatgattaagaatttcttcaagaataagattctgatattctttgatgtcgcaattgtttttcataacagcttcatccgccaggaattcatgattggtgataatagctttgttatagagtaaaagaatggggttgaaccaactaaaaattcttaaaacattcaaaatcaatatgtctatactgtgcttttgttcaatatgggtcttctcgtgaatgaaaattcttggatctatcacgttattattcatatagctttcccccatataaattgttttccaaaaactgaagggagaaagattttcttttgtcaataatatagtatgtttgtggtaaaagtgtttccttccggatattcttgtgattttaagtaaggaaataaggtttctcaacaacagaaatgaagtgatcaatatataaattccccacatcatatttgtcaagttcaagcttccctgatcctgcgggatgacaacgagttgttgtgccgtttcttcaataactaattgaggtgtttttccgctgttatgagttggcaaagtaatggtaacaaacggaattgcatatgaaagcaataatgagcttagcaaatacacacggttaaatctaaggattctttctttttccaaaaacagaaaatagacagtaatgaaaatagaagagcagaggattatttttaaaacaatagcaatcatctttattcttttatctgtttgtcaataatatcacgaagctctttcagttccttctggctaagttttgaattggaagtaaaaaaagaggcaaactgtgttacagagctgttgaaaaaacggtcaatcatggaagtcatttcttccttgaaatattcccctttctctacttttggataatattcgcgggaatttccatacaatttatagccaaccagttctttattctgcattcttttaagtaatgtagcaatagttgatggtgcaggtttgggttctggtgaggcttccagaatatccttcatgaaaacggttttcttttcccaaagaatttccataaggactttttcagaatctgtcagtttaatctctttcattctacaattttataatttgttctacaaatgtagaataaaaattaatatatacaaactttatggcattatttttccattcatttttttacacctaatcataatgctatgaaaatcaatcaattttatgtcccggcaataagcctttttcttattttatcttcatgtaaggaaaatcatgcaaatgcccagaaaaccggaaatgatgggagtgtagaaacggaaaatcctaattccgactacaggccggcatttcaaggacagacaagaattaaggctgtgaagacaacaacagaatataatgtagaagtattgaataaagatttgggaagaccctggggaattatcaatttgcctgacggaaggtttcttattactgacaagaacggacatatgaatgttgtttcaacagacggaaaacaaatttcaaaaatagaaggctttccaaaagttgattctaaaggacagggaggaatgctggatgtggctcttgatcctgattttaaaaccaataatataatttacttcagcttttctgaaccgttcggaaaaggaaacttaacttctgtagccaaaggaaagctgtctgcagatcttaaaaatatttctgacgtaaaagttattttccgtgcagaaccttcctacgatggagataaacattatggaagccgtctggcttttgataaagacggaaatttatttgtcagtacaggagaaagatcggataaagtaaccagggcatatgctcagaaaacggataattatcttggaaaaattttgaagattacaaaagacggtaagcctgctcccggaaatccttttatcggaaaacaaggctataagcccgaaatatatgcttatggagtccgtaatccgcaagggttggcaattgatcctgctggaaatttatgggatgtagaaatgggaccaagaggaggagatgagatcaatctcattaagccgggcaaaaactacggttggggagatgtgacgtatggaattgaatattcaggtgataaggtaggccagggcattacacagaaagcaggaacagaacagccggtttattattgggatccggtgatctctccgagcggggtcactttttataccggaaatattgatgaatggaaaggaaacctctttatcggatgtttaagtggagaacatatcgacagaattgtcatgaaaaataataaagtagtaggagaagaacgtcttctggcagatcagaaagagcgtttccgggatgtattgaatggaatggatggaaatctgtatgccgtaacagacagtggtaagctctataaaatttcaaaaaaatagaaaaaaagcctacagatattttctgtaggcttttgtaaggaagttggaggctggaagttatagtagcttaatatgaatttttccctgatgtactttccattttcaatcatttgccatctcttatttttcttaaaacttaaagttaagtctggcaaaaacctgccttccggcaaatcccatctgtacaggatcaaaaatacctccggattctgtatttccggtagttacctgagttgtctgtaaagtagggtaacggttgaataggtttttacttcccaacgtcagattcagatttttagaaaactcacaaccaaaagacagatccgttgttacctttggattatataactgttttgcgccgtcatatccaattaaggttactttatcaaatcttaccatctgcagatttacattgaatttgttgattttatagttaagatttaagttaacttttgttttcggtgcggaagccaggataaatgccttttctctttcgctcagataaatatcttctttccctgccagctgttcggatgtatttaccttggtaatttccatatcgttgtagtttccggctaaagtggcagtcagttttccggatcctatattttcgctatagcttaaaataaggtcaacccctttcgtacgggtatcaattgcattggaaaagaactgcacctggtcaataaatggattctccgcctgaacttctgccggcaagtcttcttgtgcaaaatatccggtaaggacgatcctgtctttcacttgaatataataaccatctattgttgctgtaaattttcctgtattgaaagtaaatccggcacttccatttacagaagtttcctgtttcaattggggaattccgacgctgcttgccagtttgctgtcattggaagccagttgaatagtaactaacttgccaccttgaaaattggtgaattgctggctgtaatacttctgcgccagagaaggtgctctaaatcccgttgaagctgatcctcggaaggcgaattgtggagtaaaagcatatcttattgcaaattttccgttcagggtgcttccaaaatcattataattttcaaatcttccggcaaggcttatcatcaggtttttggtaatgtccaactcagtatccacataggctgcaaaattgttcctgcttttgccgatatctgtagaatatcccgggaatccctgtgaaccgcctggtcttacgctattgtcatttaaaggattggtaaccagtaaactttcaggggtgtcaggtgtcacaggatttccattcttatcgtacatggtgtaagaagcctcctcacccttgatgatgttaaatttttcatacctgaattctgatccgaaagcaatattcagtccttccaataccttaaattgtttcacagcattaaagccagtcgtattctggagcaatgaatgccctccggcattaaagcttgttggtgatttaactcccaaagtagcattgatggtattgtcaatctgataggtaaacctgttattgccaaaagcattgtaaaaatccacatcccagtctaagaccttaaattttaaaccattgtcaaaagtaaaatctgaaatgctggtattttcaatcgggttaaatcctgaaggatatatttcagggatatttccatctgcatccgctgttctggtccacgcataggctttggtgtttctatgcgaaaagccctgacgggaataaaattttaatccgtctgatagaggaagttcaacattgccgaaaaaataaatattttgagccttggcgtctccgaaacgctgtctgggtgccggatccggatcattgtagatgttgggattggcatttcgtattgcataatctttgttgataaactctgctgtaaaatttccaaaaccgccttttgatcctattttagttccgaaattcccgctgaaatcaaaagtagttccatccactttgtgatcggatacaacgtcattatttccgggacttttgaaaagattcattccatagaatgcatttccttcaaaacctttgtcacgatcattaaggatcacgttaattacccctgcaatagcatccgatccgtattgggcagaggctccgtcacgaagaacttccactcttttgatggcgccaatgggaatggtattcatgtcatatccggtatttcctcttcctttggttccgaaaagattgatcagtgaagattgatggtatcttttcccattcaaaagaagcaacgtctgatcagggccaagacctcttaaagtggcgggatctaccgcatcagcaccgtcggatcctgattgtttgttggaattgaaagagggggcggaaaactgtaagagctggttgacttccacctggccggttgactggcttacctgtttaatatcgatgatatcaatagggacaggagtattaacaactgttctttttttattccggcttccggtaatggctacttcgtctatctttgattcttttaaagtatcctttatttgctgggcataggaaagggtagaagctccaaggaaaataatgctgatgtattttattttcatattgataatttttagtgatgattcaatcaaaattatcaatatttatttttaaatcaatatcaaaatttaatatttagtatgaaagtcttaatttgatgttgatttgtggtaaattcggtaaaataataacttaatattcggttttaatgaaaaatttcaacattaaaagcttgtaatcattctgttaattccttcttctaaaatttctcttgaagtggagaagcaaatcctgacatgtccttccgctccttttccaaaccatctttccgaaccgggtactattgcaacttttccctgctgcagaacatgttgtgcaaatgcatcgctggtcattccgtttttgatctttggaaacaggacaaaggtagcctcaggcaaattaggcgttacaatttcggattggcttaataagctaaatgcaagatctctgttgctttgtaaatgtgctaaaaattctctgtaccagggttttgctttctccagggctacacttgctgcaatttgtgataaagtggaaaccccttctattgtagaattgaaattggatttttcggtaaaatcttcaagaatgtcctggtcattacataatacagctccaattctcaagccggcaatcccaaacgattttgaaaatccatataccgtaaaactttttttcttcgctttttctgaaacagaggagtatgtataaaaatctttattgtcataaatgatatcactccagatttcatcactcatcacccaaagatcatgagcggaagcaacctcagctatttttatcaggatttctttagaataaacctttccgagtggattgtgcggattgcatatactgatcagtctggttttaggactgataagagaagccagtttttcaaaatcaatttcaccagatgttgtatccacagggcaaagcgtgacctttccgccagcaatttccactgattttttgaaaagaaaatctaccggatcgagaataatggcttcatccccgggtttaagaacatacgatgcaataagaaacattccctgagcagcactgttaactgccagaatattttcaggagtaaaacttccgtgtttttcctgattgaaatgatcggctacgctttttctgaattccggcagtccggaaaatggtccgtagcttaaatagccatctttaagatattcaataattccctgttctatttcaggcgctgttctgaagtccggatcagcagctgtaagagggataataccatcttccacggtagcccatcttccgttgtaggcttttcttttcagggcttcaaaattgatatcgttattggtaaacatatttatttataagatatgggtaaaatattttctgattgttggtgaagaggaagcaggaactgttctaacaaggttcttccgttactgatgtgagtttcaatttcgggttttctttctgcttcatactttttgaaagcttcttcggtatttttttcttcgactaaatatttagtgagagtgaaagagtcttttaatgcggaagtaacaccctgactggtaaaaggaattaatggatgtgctgcatccccgatgaatacaatattgtctttataaaacggatgtaatttttccaattcataaacacaccataaatgcacgtttttatagtctgatttctgtataatggaaggaattaaagggtgccagtcttcaaacacttcaagcatatatttcttcaggttctctggcgaacattcgttgatcatgtattttttattatcaaactgtgaataccacagaatagtgtcgcccgaaagcttgaggattccaaaagtcagtccgccttcctcgtgatgaaattttatgaaatcgttctcaatggaatctgcgatctctttgtcttgtatgatgttgaccacttcactttctcttaccacgctcattttttcatctttaaaaagatcccttctgatacggcttttagaaccatcagaaacgaccgtaatatcagcatcaataccggttccgtcagaaagctttagttttccggtctgttgattatcagggattacactctcttcataggtaatcttttcgggagaaatattttgtgccaggagatttattaaagagtgtcttgaaatggcaaaaacatggtccagtttcttttctgtcagaatcttccctgtatgggaatactggatgtattttttcagaaaatttccgtgtttgaggagagtttcaggatcaattatctcataaagatagtccatcccttcctttggaatgagaaagccatggcctgacagatcttccttttttcttctttcataaatatgatagtcaatcttgtgtttttctaaataatttgccatggttaagccggagatgccagcgcccacgacagcaattttcttcattcggaataacggattttttcaggtttgttttttaagtattgttagtctgtgttaatagacaatacaaaattaacttaaaaacagtcactatttcaaaaaatgaatcaatttactttcgttttctttaaaaataaattgaaaaagaggttatgatgatgaattataaaaatatatgattgatttatctctattttttaactgtatttatttctgatatttgaatggttttgaggctgttaaaaggtgaattaattccataaaaacaaaaaaaccggaaaaattccggttttatgattaggctttttcaagctgaacagtaaaatgtcttaaaatttcaggttcccaggtgatcttatacccttttgcaatctcttcacgtctttcataaacgttctttatagcagcagcaatataatccatatgattattggtgtaagttcttcttggaattgcgagacgtaccagttctaatttcgggtaacggttttcccttgttgcaggatctctgtctgctaataaagtcccgatttctacagttctgattcctgcttctttataaatttcaagaccaagtgtctgcgctggatattcttcacgggaaacattcggaagaaaatttaaagaatcaataaatacggcgtgtcccccgattggtttctgaacaggaattccatattctatcagtttattcccaagatactcaacctgggagattctgctttcaagataagcaaattcagtagcttcgtccagacctacagccaatgctgccatatctcttcctgccattccaccataagtaataaagccttcgtagataatggtaaagttagatgcctttctgaacacttcttcattattcaaagcgatgaatccaccaatgtttaccagcccgtcttttttggaactcattgtcattccgtctccgtaagagaaaatttccttacagatgtctttaatgcttctgtttttctgtcctgcctctctttttttgatgaaataggcgttctctgcaaatctcgctgaatcaaagaatacaggaattccatattgatcagaaagggctttcacagctttcatattttccaaagaaacaggctgtcctcctgatgagttacaggtaatagtaatcaggcagaaaggaatactttctttaggatgacttttataaacttcttcaagtttttcaaggttgatattccctttgaaaggatgaaggtcattgatatcaaaagcttcatcaatcgtacagtctattgcgtgtgcctttctgaactcgatatgaccttttgttgtgtcaaagtgtgagtttcccggaactacatcaccttcttttaccaatacggaaaaaagcacgttttcagcggctcttccctggtgggttggtaataaatatttgaatcctgtaattctttcaacggttttctgtaattgttcgaatgaacgtgagcctgcgtagctttcatctcctgtcattaaagctgcccattgtttatcggacattgctccggttccggaatcagtaagcaggtcaatataaacctgagaagatcttaaattgaaaaggttataattagcttctttaagccactgctctctttcttctctggtagactggtagatttcttccaccattttgatgcggaaaggttccgcgtacggtaaattcatgagttaatatgttttaaattgtttgtaaagaaaatgtgtttgaaaataattttcaaatttcatcaaagtatatataagtcgggaaagtgattattccggagccttaaatatattttcatcagaatggaatccggctacaccgccgcttactgcaaacttcatggcagaagctgctgtcattcccactacaggtttgatgtttttttcttcagtaacaattacccagcccgagatggcatacgagtggggaagatataccgcaacgtaattatgcttgtcaacgtccgacatttctttttgggtcaaaaaaccgattctccagatttcgggattttcattggtttttacccatacaggatcgttgaattttttcttgtcccctacaaatgaagacatgacgtcttttgtaggagtataaatgtgttttactccgggagttttctccagcaggctgtccattgtgtcgaaaaaaaatctcccgaccacaaatttatttcctaaatatcccagaatagcagtaaacagtataatagatacgaaaacaagccctggcacctgcttggcaagtgaaggaataagattgtcaatggcacttacaatataccagatgacaaaaatggtaagcccgataggaccaataattactaatccctgaaaaaaattcttcaggaaaagattggcaatattttcaaagcttggcttcttcaatggatactctttactgtttgtatttaaccgtgaatggtttctttgtttccgtaggacttaataatgctggcttcatactccagccattcttcccagcgatggtttactttttcaggattaccaagctgccttgcaaatcctataaaagtagtgtaatgattggcctcagaaatcatcagttctctgtaaaaaactttaagctcttcgtctttgatattttctgtaagaactttgaatctttcacagcttctggcttcaatcatagcggcaaacagcattttatctacgatgaggtcttctctgcttccctgaacgataaatttcgccagttcattcacataatcatcttttctggctcttccaaaagtatagcctctctttttgatgatctcgtgtacctgattgaaatgatccagctcttcctgtgcaatggcaagaagttctgttacaatgtcaggatattcaggaagcatcgtgatcagtccgatagcattggtggctgctttttgctcgcaccaggcatgatctgttaaaatttctccaatgtttccttctgcaatatttgcccaccttgggtcggtaggtagtttcaacttaaacatgttgtaaattttttgtaaatttaaacaaattgaggtaagaaatgtgactttatttcaatttgatcactaaagtcttaagaggctgtcttccttcttaggaattccaaaatattccagcctaaggtatcaacctttttcagccctgcagaaattacaaaagctaaaatgatattaatgatataaataatgatcatcaaaatccaccagggtatattttcttttaatggaaccaccaggaaatagaccagcgaagagctgattccctgtgcaaaatagaagaatatagcattcctgccgatataagtgatgaaattttcttttgtgatctttagcctgttatagagaacaaataatgtcaccagagagaataatgcccagatgatatacgggattttcggcgggaatttgtttttattgattttatagaaaatatctcctccataataccaaaacatccatagaagagcagctcctacaagtgcatatgatagaggaattgctttaacaggaattttttttccacgcattttgttcccgattaaaaatacagcaagataaaaagcaacataacccacctgtccggttggataatattccgggaaaatattaaataataaagttaaagcaatgcaaagtccgataaaccagttgatatgtttcgggaaaaatcttaagatcaggactccgaaaacggttaaaataaaataaaccttaaggtaccagaagcttcccatgacaaccggaaaagtatcggcattggtgtattgatgaagataccagtttcccagattttcccattgaggaactgctgaaatgctggtagtggaatatttggagccaaatgttgaataaaaactctggagccattccatagaaaagaaacttaatccgaaaactttaaaaaagtaatctaaaaagaacaggaaagtcacaaatatcatataggtgatctgcagtttcaacaaccggtaaaatgttttttcaatattagctccggaagtaatgccactcagtgcataaaaaagagcgacgtcaaaaacaagggagaatactcttacttctgcaggaatataaaactgtccggaccagaaagcggtatggataaatatgatggaaagtgttgccattcctttggcgaaatcaatatagagatctctgttcattttagatgggttggaagttttttgttgtggttcaaaaatacaaacaaattgactgtcgaaaacataaaagattttttaaaacaaaaaaggggcggaacatactgcccgcctcctttcttaaatatgctaaaaatgaatgttctcgtttattgaagatgtttaaattcttctgcagaaatttctcctgactgaatttttctcagctcatctatatattgactcatataagcgtcaatttcaggatttactgtgtttttagccatcttatacgtaccgttcaaaactccctgatagtaataaaagaagttgtaatcgaaattggaagcgttaagatcgtattggcctagaaggaatcctaaacgaactgctgatcttctttgcgccggtgttccgtgatggttgacattggtcgtctgatagtctccaatgctctgagcaaactcataagctgcggcgatttcagggaagctggttttattgtaaccattaggtcttctcagataatatcctgcgaaaccatctgcttcaagctcgttcggtctgtatgttgattctgatacagaaggaagattgaagatgtactgaagctgatgtccgtattcgtgggcaaggatcattgcgtttacaatatcgccgccttttgattttgcatcataatagatagcatatccgtaatagatctttccggtagaataagaaatagcattgtacgtagagttgaaattggaagggtcattcacaaatcgcagtgtaggagcggttcttccccacatgcctgcaattttagtcatctgaccgttcatgaaattggtgtctgtggagttttgaaggcctgtcagcaaaacagaactggagctccagttgttgtctacgtaagagcatcctttttcagtatttcccggctgatcaatttttgcactaagtgcttcttgctgaggttgagcattgctgtccatttggtcatcactacatgctgtcaatgaagtgacagcaatggcgcctgctaataagcagagattaaagtttcttttcatatataaatttcaatttggtaaaacgaaggtaataaattatctcttaattgtgagtactttatttcaaaaaattattcaaaacatagtgaataggattttatttaaaaaaacattgctttgattgtaagctatttagaaatttatatgtatatttgcacctcgaaataactaaaaatttataaacaatgtttgcaattgtagaaatagcagggcttcaatacaaagttgagcaagaccagaagttgtttgtaaaccgtttaaaaggagataaaggaggaaaagtttctttcgataaagttcttcttactgtaaacggtgcaatcactgtaggcgccccagctgtaaacggaatcactgttgaagcagagatccttgaccacgtaaaagctgataaagtaatcgttttcaaaaagaaaagaagaaaaggttacaaagtgaaaaacggtcacagacaatctttaactcaaatcgtaatcactggtattacaggatttgaaggtggagctaaaaaagctgctgctaaaaaagaaactgtgaaaggtgaagttctttctgacaacgcaactgttaactttggtgaagatcacgagctgaactatcacttaaagaaaaacaacttgtctcagtctaaagagaacagagaaactttaattactttaggtaaagcagttaaagttgaattagaaaagaatgttcttactcatgaagaagtagatgctgctatcattaagaacattgatcaatttaaagcacttaataaataatccagtaataaaatggcacacaagaaaggagtcggtagttccaagaacggtagagagtctcactctaaaagattaggtgtgaagattttcggaggacaagaagctattgccggaaatattattgttagacaaagaggtactcagcaccacccaggtgataacgtgggaatcggtaaagatcacactttgtttgcattagtagatggtaaagtagttttcagaaagaaagcaaacaacagatctttcgtatctgtagagccaaacgcataattttgtaagcgttttataaaaattaaaacctcagtttttactgaggttttttttacggattgttatagtattcatttgttcgtgaaatattttatatttgttcactgccacatttgtggaacagttgcgatagccgaaaagcatcaagagtaggcagcattaaaacaaatatctatgaaaaatgtaagaaaactagccagaaaagatttaaaagaaattaccggtggggctgcagcttattgtccttccatgtttcagtcatgcgaagaatggtgcagctggactccatggcagaaatcacactgtattttgtctgaaccatgtacagaatgcttttaatgatagaagaaaaatgccctttgagattttatagagctgaatcgtgaaggttcagcttttatttagttaaaaatatttaaataatatcttcaataagtgaaatattaatatatttaaccgactttaaaataaaagaattacgcggaagccgaaaagcaaaaagagtaggcgataaataaaactaaacaatcatgaaaaatttaagaaaattgaccaagaagagtcttaaggaaatcaatgggggaggaacactggcactatgtccgccaaaaccaatcagatcatgcgatatctggtgtgggatgactccagagcagaaaatgcgctgtttgcttgatgtagaggagccgtgtgagtgtttttaataacctctcattatatagaataaggaaaggtaaataaagtttcggcggcttcaaagaagccgccgaaactttattatattattagaatcctacctggaatcctgctttaacaccgaattttgagatatccggtttgtcaagataatttcctctccagttgaaatccactctgaaaattctgagatttccgattcctatattttcaatcccgaagccgtattcataataaatatgttcgcttggtgcagaatatttaaacccttccacgttgatggctttggatgcatcacttaatgttccgtatgcacctctgataaatgcaacttctctaagtttcagttttttaatcaaaggaatataagaaaggatcttaccgttaaaatggtgttctaattgaagggtagtataagcatcagttacaaattcataataattaagctgcgagaatgtattgggtaccaaaccatatgaaaggttggcagggattatattctgtaatgccaaaggaacagtgctgaaattctttcctgcttcgaaattaacaaccagttttcccatgcttccaatcaaaaacggcttatagagcatgaactgcagcttgtcataattaaagtcagcattgaataaaccttcaatacctctggtatatcttaaaacaatcgttggagccaggtttctggcctgataacggtcaattccggtctgagaaaacttagcgccgggctttgcgattaagctgatggtaacatgtgagtcattaacggtctttctcagctggccgtctttataatacatgagattgaatttctcaggaattgcagatttaatgctctgcatcactccatctattcttatctgaaagtttttccacggttcaatagctgcaaaaacacttgttttattgacagaacttaaagaaatgttttcccctcttgcaaaaaaagtgctggtagatgaggattgaggtgtaacgccatcaccggatgtaagctgtcctccaagctgaacaatatccctgctggttcctgccccaatcataaaacggttcagcttattgaacatataccttgcctcaactccatatttgatctgttggtctttgaacccgtaggctgtataaaactgggctctccaggtatcattcaatccgaaataggttcttgctcccaatcgtattctgtctccttctacttcatttcttccataaattgaaaatatgggaccaatatctattcctttgaaggcattataataacgtgaaccaagggtttcaaacagttttaccattcgattgaatttcggggtctgctgaagctggtcaagcatgttgtaaacgccctgctctgctttggataaagtgtcgggtctgacctttgtccagtaagcttcatctttattggtaaactggtcttcgtattcttcttcagtacgtttgaaaacctttgggtctagaggcttattaaactgataatcggaataatctacagatcttttggcgataatacttttggctcctttcttttttgaaaaaggactcatttcaaattcggtaaccagttttttaggaagaaacgtggcatcatcaggattgtcgtattccacctgagtatagacactattgacaaaattgacattgatcttctgggttgacttcaatgttgctcctaatacagcataagtatctgtatcaatataaagatttccctggaatgcaaggatatcttttctttttggctggtatcttatctggaatgctttttccccacggatcgtaatggtgtccataaggctgtaatcgtaggtgctgaaaccatctgttcctacggggctctggaatccaatatcgaaataattcagggtattatcgtaaatattaatatcacggtaaaggtttttagctgaaacggtaatcacctgattgtcctggaaacctgaagttttctgagcaaccagagttcttttactgtccttatccggcttgtttttaccataattttcataaaccgcttcattcaggaagataggaagtccaagccttccacttgctgtagaatctgcatagctgaaaatgaaatcaagtttattgaagatctttttcttcataaacgcactgtccagattgttcagatcaaactgcgttttttcatattctttgtaggaatacgtatcgaacttttctagtccgttatttcttttttgtgcccagaccttctgcataatagcataagcagggttttcttttttatttttgtatttagtcttaccgctttgaagaacaatctcctggatgtcacttactttagcttgagaaagctgtacgaaaatattttctgcattttctggagtaatatcaagggtttccgttacatagttttttctggaaaatcttaactgatggataatgctgtctgactgtacggtgaagctacctgaagttgtcgtcagggaaggggttgtattattgttgatgaaaatatcaactttattcagttctttattgttcttttcgtcaaccaccttaccactggccttgttttgagcgcatacggaaccggagagaatcagtaaaaaaaataaaagatagtgtttttgggagttattgtttaacatcattcgtttcttcaggcaattagcataaacaaaaagcatgcagtttatttaaaaaaaggtaaaaaaataaaatatttttattctaccttataaaacgacaaaagtaacgaaaataatataagtgttgttgaaaaaataattgaaaattttaacgcttaagagataataatcagaggattaatggaatggataaagtggtcaactttataagttgactctgatacttttaagaatataaaataaaaaagacctacatttctgtaagtctttttgctcctcctgctgggctcgaaccagcgaccctctgattaacagtcagatgctctaaccaactgagctaaggaggaatgtcctttgttttaagtggtgcaaatataatatgaatattggtaccaagcaagttttatcccttattcttgaagatttttaactaaatgtattgaatttcaataagaaatattttatctttttttagttaatccccgaaatattctgtcagctaaaggaattaactatgtcacttgagatgtttatgatattgttaatttaatccggtcctgaaaaaccgttatttcaggaccggatataattaaaaagactacatttatttctttaaatctttaagaatttcctgaacagctctttccaattgagggtcattgttctgaaggcggtccatgaaagtattttttacataaatatcaggtttcacaccggttttttcaaggttttgtccgtccagagtataagttccccacgcaggcagcctgtaagaagagccatcaaccaagccttttgctgaagtaaaaataatccagcgataagtatcctgaccgataattttacccagtttaagcgctttgaatccggctgctgtcatttcagcatcgcttaaggaagcttcattgatcaaaagaacgatcggttttcctgaaggggcaaaattaggttgagttgttattttcccttcgcggtatttccattggagataaggtctttgagaaaggaaattcaatactttatcatgaacatttccgcctgtattataacgtaaatcaagaataacggcgtctttcctgttttcctgctctaccatatccagaaggaaacggtccagctcatcagtagacatatttttcatgcatgaataagcaatacggttattgctaagcttgtctacacgctgatggttattgtagatccaatcgtcgtaaagcaatgattttaattccccatttgaaataggatgtactttggatgttatatttttaccaccgcggctgaatgtaagaacgagttcctcctgctttttaggggtggtaaaataagtttcgcggttttcatcaggatcaaccttttttccgttgactgcaatcagttggtctcctggtttaatatcaacaccagtgcggaaggcaggagattttcttaggatactttctaccatataaggctggtcttttttgaagataatccccgtttcgttggtaaaatagttcaggaacattgcctcttcttttccggatgaagaaaatcctgtatgcgaagaattaagttcacctaaaagatcattgagtaaaattcgcagatcatttctgttgtgtacatacggaagatatttcgcgtactgttctttttttgctttccagtcaattccatgaaatttttcatcgtagaagttttcctcaacacccgtccatgcttcagcatacatctgggtaaattcggaagctaaatctttatcaaaactatattggatgtttattttttcaggttttagagctgatacggttgttttataaatatttccttcaatcagggcaaatagatttttatcatttttggtcaggtagtaagctgctttatcaaagactttttcagatttggcaggttcaaaatcagtaaacacttttttgaaaagctgcctttttccgttatcctggttggagttaaatagcagaatctcttttttgtcatctgcaaaaacagcagggtcgtcctgatatccataacggtcggtaaccagttcaattctgtccagtgtatcttcaggattaactttcaattcttttattaccggctctttttctttctcttccttcttttctttgtccttgtcttcctcttttttattttttttgtctttggtgtctttggctgtgtcggaaggttttgtttcctttttttcttcaatgaaaaggttgtcaaatttttctgacttaaaaggctcgtcaaaccaatccaaagccattctgtaaatattagacttttgcattcctaaagggtaggacggattggttctgtcactggcgaaataaatgtatttgccattaggcgaccacacaggatcttcttctgagacaccggtattggtaaggttgagagtctgtccttttttgatgttatagatgaagatatcaagctcaaaatttcgttttgctgaaaacaaaacatattcattattgggcgaaaaagaaggtcttgagttttggaatgcccagatttcgtcctttacaatagtcgttgagttaaaatctttcaaatccagcaatcttacttcatcacgaccgcttaagtaaaccgcttttgaaagatcattgttaagtgtaatacttcgattgtttcttaaatcctgagtgagttgcttaggctgacctttcccatctgcagaaacagtaaaccagttctgatatccgttataggtctgattataaagtaaagtacggttgtctttcagccattttacttccatagcacgttctttcccatcagtaacctgttgtgcgaattttccttcaatatcagaaacaaataaaataccgcggcttataaaagccattttcttaccatccggggatacatcataataggaaatattattttccacattgaagttctgttctttctccagtgttttattggtattcagattaacgttaagaagtctcgttttttttgaggctacatcgtaagtgtaaagttgataatctttttcaaaaataactttagtgccgtctgctgatacaaaaggttttttaatagaagtatcaaattgggttaaagctgttttttttccaccttcaattttataaagattatattctccgttattctcatccgaaataaaataaataataccgtttttatctacacttggattaaaatcctttccttcatagttggtgtactgcttaaacgtattattttttgggttgtatcctaagatgtcgggattgttttctcctttataacgcttacgctgtacctgatgggcgctttcagatgaacttgtgaaaagatattcacctgcaggagtttctgcgagactattcgtattgttaaaataattgttgaaaagcttctgtggggttttcccttcaatcgtggttttaaaacttccgaaattattatttctgttggaagtaaagtaaattgttttgctgtcccaggaccagttttccatttcatcttttccggtatggaacgtcagctgtttgattgttccgccttctgaaggcattacataaagatcataatttccgtattgattggaactgaatgcaagccattttccatcaggagaaacgcggggattgatttcttcgccgtccagagcggtaatccttgaggcgtttcctccgttggaatctaccctccagatgtcgccgtcataagaaaaataagcagtcttgccatcagggctcaacgaaggacttgataagaaataagatttttcctgtgctgaaatcccgatcatagaaaatgctgtgaataacgaaataatagttttcttcatggtataactaaatatgatgcagtattataatattgattttatgtttttggttttaaagtattattggatataagtctctcagatccgtctacttcttaaaagaatagtcggattattgaaggaatcgttacatacaaaatgtctcagtaggaaaataatattcaataaaacagataaatacttcataagggttgagataaattacaggtatctgtcttttttaaattaaagtaaagatataaaaacaaaaaaaagacctacatttctgtaagtctttttgctcctcctgctgggctcgaaccagcgaccctctgattaacagtcagatgctctaaccaactgagctaaggaggaatgtcctttgttttaagtggtgcaaatataggacgaatatttataccctacaaatattttttagaaaaatttttaaaaaaaattataaagttcctgaaagccatttgaaaatatcgctaccgaaaatcagtaacatcaatcctaacaggaagataaccccgatcatctgtgcgttttccaaaactttctgaggaaccggtttgcctacaataatttcatataatgtaaataaaacgtgtccgccatcaagccccgggataggaatcaggtttaggaatgccagccatacggagaacatggcagtaaagctccagaaagctacccagttgattttaaagcttccgtcagcatctttatctacaggcatattctttacaatcgcaataggacctcctacatttttatacccctgaactttagagttgaacatgattttgaactgcttaacctgagtagttaaagcctcaatagttctcgtgaatcctcttggaatagcttctccaaaagaatattttttattggttacgatagattttgcaatactttttgtatcaattgcgatacccagttttccatttttgtcaacagaaactgacggtaatgtctgtaaagctccgtttctttcaacatcaacagaaactgtttttcctttattttcactgagaagagtgcttacttcatcaaaaaatacggcttttttaccgttgattcctacaattttatctccttttgccaatcctgaagcttgagaagaaggagttgccaatgaatcaactaccatagaaactcttggggtgatgtatagttttgcctctctttgtttaagaacatcagctacaccatcagcatttaccgggaatgtaacttcctgaccgtttctcagtaccgtaacatgatctcccaaaagaatattgattgacgtgttttcaagcctttctgccggttttccatctacgctgatgattttgtcaccattctggaagcccattttctttcctgctgcagtagcctcaattccgttgctgaattttgtgatatctgtatacatttcaccattgaagaatgaaagacagctgtagattaaccatgcaaggaaaaagttaacagtaactccacctaacataataataagcctctgccatgccggttttgatctgaattcccaaggttctgccggttttttcatttgggcagtatccatactttcatccaccattcccgcaatttttacgtatcctccgaaaggaagccatccgataccgtacttggtttgctcagggtattttctccagtcactgtccggaagtttagatatatcgataggaacttcttccttctttccgttaacctctattacttcagaatccggcagattctttgataagaatttatactgccattttccgttgattttcttcatggagaatatggagaagtaaggatcaaaaaacaggaaaaacttctctgctctggtcttgaaccatattgccggtaaaaaatgcccaagctcatgaagaagcacaagtatagagatgctcagaatgaactgaaaaagtttgattgctatttccattaataaattttagattttaatttgcaaaggtaacaattatcaaaactatgccaaataaaaaagctccccgaaacgagaagctttgtcatatttaaagacgatttgttataaattgaaagaaaccccaaggctgccgttattacctacttcggcaaacactcctattttatccgtgaagaagtatctggctccgatgtgggcgcctactccgaaatcttttccaacaactccaaggtccacacccgggtaaatatcccattttgatggtagattcaacgcttcctgcaaatgaaagttcaatcttccgaaaacaaaaacgcggttatccttatcgttgtttttataattgtcaaagtagccattgatcccggctcccactgaaataagttgattgagaccatagtcataagttcccgttattccggttccgtatccccaggcgctcagccccagttgtatcttctgatcccctttacctgtccatgcctgggcattagccattgcaccaaaaaagaagatcattaccataaaaaacaatttcttcataaattttaaatttttaaggattttaataaaaatatctctatcaaaaatgaaaccgaaagaatgggagtattctaaaaaaggctgactttaataaattattaagaaatatagttctgttttcacgggagaacctcttttttcagcagtttaattcttcttttgtaatgataaaagctgtatttttatacatcagattcggaataacttaaaaagaataaaagatgaaagttgcagggcttaatttagatatcatctggaaaaataaaactgaaaattttaaactcatagaaaacgagattcagcaggttgaagctgatctgtttcttctgcctgaaatgttttcgacgggtttctgcatggatgctgctgaagtatcagacagaaatgaagagtcatttcaattcctgaaaaagatctcaaaagaaaaaaatgctgcattctgtggaagcgctcctgtagagcaggatgggaaattttataacaggatgtattttgtaaagcctgacggtgaaatgtcttattacgataaaagacatttgttttccttctcgggagaagataaagtgtataccccgggaaaagaaagggtaattgttgaatatcaggggattcggtttttgcttcaggtttgctatgatctgcgctttcctgtttttgcaagaaataatgatgattatgatgctgttttgtatgttgccaactggcccgaaaaaagggtaggagcatgggaacatctgttgaaagcgagagcaattgaaaatttgtcctttgtatttggcttaaacaggatcggaacagatggaaataatctgttttatcaggaaagctcgcattacttctttgctgacggaaaagaaatttcccggaagcaaggcaaccttgtgtctgcagaattaaatatggatgaattgaaagatttcagaacgcatttccagtttctgaatgaccgggattctttttctattaaattttaggttttcccacagatttcgcagatgttaaaagcataagctcaactatggaaatttgggtgatctgtgggtattataaaaacaaaaaactgtgaaaaatcacagttttaagcatattcttgtaaaagtttggtgagtgtattcacgtcatgtacaccactttccttccataataattctccttttttgaaaatcgccagtgtaggtactccacgtactccatattgagcggctaaggcaggatactgatctacatctacttttatgattctggcaccttcgccgatattttcttttacagtatttaataccgaagactgcactttacaaggctggcaccatgtggcgaaaaaatcgataagtacgggtctttcggaatcaatgatttcctgaaatttttgtgacataggtttagttttttttgatcttaaaaagttttggactggcatacaaaatccgaagtagggaatttttccgtttttttgatcccgttgaaacctccttctatttcagtaaaatttctgataccatgtgagttaaggatgcttgctgcaatcatgcttctgtatccgcctgcacagtgaaggaagaaatgttcagaatcatcaatagtgcgtgcccagtcactgatggcatccaatggcttattgtatgcgttgtcaatgtgttctgctgagtattcagtcagttttcttacatcaattacggtagcatcttcagtaaactgttctgcaaattcggcaggggaaattcttctgatctcatcggtttccttccctgcatttttccagctttcaaatcctcctttcaggtaacctactacattatcaaatcctaccctgcttagtctggtaataacttcttcttcagttccttcatctgttaccagtaacagagggtgtttcacgtcaacaataagagttcctacccatggagcgaagtctcctttcagccctatattgatggaattgggaacaaagcctttatgaaagtctgcaggtcctctcgtatctaaaattaatgctcctgtctcttctgctacggcttcaaaatcttccggttcaacaggatgcagtcctttgttcattacaacatcaaggctttcataacctcccttgtttaatgcgacattcattccgaaatatttcggtggtgctgttaaaccatcaagaacctctctgatgaaagacgctttgtccggttgattaagggcgtaattggttttcttttggtttcctaaaatatctactgtttccttctgcatattctttccacaggcagaaccagctccatgagccggataaactgtgatgctgtcatccaatggcatgattttgctttgaagactgtcataaagaatacctgcaagatcttcctgcgtaaggttggttgccttctgcgcaagatccggtcttccgacatcacctaaaaacaaggtgtcacctgtaaagattgccgtttcaacaccattttcatctattaaaaggtaagtactgctttccatggtgtgacccggagtgtgcaaaacctttatttttactttcccaatttcaaaaatctgattatcatctgcaataatagcttcaaattcaggagccgctgtaggtccataaacaatcggagcaccagttttcttgcttaaatccagatgtcctgatacaaagtctgcatggaagtgggtttcaaaaatatattttaaagtgacattgtctttttccagacgatccaggtaaggtttaacctctcttaaaggatcaataatggcagcttcattctctgatacaatataataggcaccctgagccagacagcccgtatatatttgttcaattttcattgggtctttttttaatgagttaaagatacgaagtattagataaattctaaatgaaatgttaaattccattgatagtttctttcaatacttgttaaaatttacattacttttttagcaaaaagaatgccttatataaagtgaatttacgaatgctgttttatatcatattctttaccccaaaactgtctttatgttcgtggtttaaaatttgcttgtgcagggataaattattttcagaaggacttaaaagaagttcatccgaaaatacctttacattttccaaaaaattttatatttataagttaaaaacaatcagatggcagacaaagcaaaatttattgaagagttaaatgctagatatactccgaaaggagaacacattatattaggaaaaggaatgcttgacggacaagtggttcctgaggtgaatgtaacaatccctttgaaaacaattaaccgccatggtcttattgccggagcaacaggaactggtaagacaaagacgctacaggtatttgcagaacagctttcccatgcaggaattccttcattggtccttgatatcaaaggtgacttctccggaattgcagaagcaggacaaatgaatcctgttattgaagaaagatacgctaaaacacagcttccatacaatccgcagggatttccggtagagctgatgagtatttccggagggaaaggcgtaaaattaagagctactgttacagaatttggtcctgttttattaagtaaaatccttgagcttaatgatactcagcaaagcattatgtctattgtctttaaatactgtgatgataaaggccttcctttgattgatcttaatgatttgaagaaagtattgcagtatgtaacggataatgcacagggaaaagctgagcttgcagccaattatggatctatcgcaccggcttctctcggagcgatcttaaggtcaattgtagccctggaacaacagggtgcagccggattctttggcgaattaagttttgatgttcaggatttactggaaacaagagacggaaaaggagttgtcaatattttaagagtatcagatattcagaataagcctcagcttttttcaacatttatgctttcgctttttgccgaaatttatatgactttcccggaagaaggagacagcggaaaaccgaaacttgtattattcattgatgaagcgcaccttatttttgatgaagcttcaaaagcccttctttcacaaattgaaacgatggtaaagctgatccgttccaaaggagtggggatctacttcattactcagattccaggagatgtgcctgaaaatgtgctttctcagttaggactgaaaatacagcatgcactgagaggctttacagcaaaagataaaaaagaaatcaccaaagctgttgaaaattatcctacaacagaatattatgacgcttccagtcttatccagaatttagggattggagaggcatttgtaacggctttggatgaaaaaggaatacctacaccattggttcatacctatctgatctctcccgagtcaagaatggatgttttgagcgaggcagaaatctctgaacttacatctcagtcagcacttgttgccaaatacgagcaggctattgacagagaatctgcttatgaaatgcttacgaacagaatggagcaggctgcacaaaacccatcaccaacacaaaaaacaagaccggtaaaagaagaaccgggaatgtttgaacaggtattgcagagtaaagcaggccgtacctttaccaatacattaatgcgagaaggagcaaaagcgatcctcggaatgtttggtctgggaggcagaagaagataattttgaaggataacctgctctgttttgatatattttttgttattttagcaggttatctttataatattaatagtaaagccaggtttattggggaataatacatcgggtttaaatacgaacgacaaacagcagttaacacacattcaatgtattcaattatagatatagaaagtaatggtgcaggttatagaaatgaatgcattatagatatcgccatttacagatatgacggtcagaaaattaccgaccagttcatctctctggtaaatcctgaaggcgatattactccttttgtacagaaactgaccagcattaccccaaaaatggtcaaaacggctccgaaatttcatgaaattgccaaaagagtcatcgaaataactcaaaatacaaccttggtagggcataatattgattttgattacagaatgcttcgccaatcattcaaaaggcttggttatgattttaaaatcaatactttagataccattccgttagcaaaaaaactgatacctgatgaggtaagctattcgctgggaaaactggtgaagtcgctgggaattcctttgaccaatcatcacagggcagaaggtgatgcaagagccaccttggaactctttaaattgctgatttccaaggatactgaaaatgaaattattcagaagcagcatgaagagtctaatgccaagacctatatcaataaaattaaggaacttacccaagatcttcctaatgataaaggatttgtatactttcaggatgaggcaggacgtatcatgttctcggattatgttcaggatatcaacaaattttcaaaaaaggttttcaattccaaatcaaaaaaatgggagcagattcagaaagatgttgagcagattaattttgagcttaccggaacagatattattgcaaaactgattctgaattcaaagaatatcaaaaagaaagaaattttaccattcggactttatttcagaaacaataaatatgttgttgaaaaaaacaagctcaataaaacggaaaaaccggtattaaaattcagatcgtttacccagggaacaaaagcggttcagtttattggttctcaggaagagtttaatgatttctccgcattgaaacagaaaattgaattcagaaaaaggaatgagctctggctggggccgggaagaaagcttggtgaaaaattatttctaatcatagaaaacggaaaagtagtttcttttggtttctatgagctgtttacgcagattcagactttgagtaagctggcgaagctgaaaattgatcttcagctgtcctccacagatctgaataatgaattacagctggctttgcttcgtggtgattttgaaaccttaccgctgccaaaataatatagaaattagcactttaccgttttattcagaagaagagctgttcaaatcattttcttagaataaaaaaataaatagtatttttgcaaaaaaataaatagaagcaatgcaaaatcttaaacaaaataaaactggaaaaaagggagctgtaaggttctctaaggtttggaatatttaaaagagttgtcttgcataaaaaataattaatgtggcaggctcttttacgaagaatctgcctttttttatgttaaaatgaaattatgaattcaaaagaattattaaagattgccaatgagtttggcaccccggtgtatgtttacgatgctgagtccatcaaaattcaatacgaaaaacttacctcttcatttttaaaacatactaagttcttctacgcagcgaaggctttgacaaatatcaatatccttaagtacgtcaagaacctgggagcatctttggattgtgtatctattaacgaagttaaacttgggttaaaagcaggatttccgaaagaaaagatattgtttactcccaattgtgttgacctggctgaaatagaagaagcaatgacttttggagttcatatcaacattgataacatttctattcttgagcagttcgggaataaatacggaaattcataccctattttggtaagaataaacccgcatatttttgccggaggtaactataaaatttcaacagggcatattgacagtaaatttggtatttccattcaccaggttcgtcatatcgaaagagtgatgaaaagtacgaatctgaatgtggaaggacttcatatgcacacaggaagtgaaattaaagatccggatgtattcctgcaggctctggatattatgctggaactttctgagcatttccctaacctgaaatacctggatatgggaagtggtttcaaaattccttaccaggacagtgaggaagaaacggatgtaaaaacattaggtaaaaaagtagaaaaagtaatttctgagttttcaaaatctaccggtaaaaaatttgaattatggtttgagccaggaaaattcctggtaggaaaaagtggttatttattagtgaaagctaatgtaatcaagcagacgacagcaactgttttcgttggcgtgaattccggatttaatcacctgatccgcccaatgttctatgattcttaccatatgattgaaaacctgtccaatccaaaaggagcagaaagaatctatacggtagtaggaaatatctgcgaaacagatacattcgcgtgggacagaaaactgaatgaggtaagagaaggtgatattcttgccttccataatgcaggagcttacggttttgaaatgagttcaaacttcaattcgagattaaaaccagctgaagtattattcttagatggaaaagctcatttgatccgtaaaagagatgagtttgaagacctgctgagaaatcagattgaaatagtgatgtaaaatctgaaacatacgatataaacagccgccttttgggtggcttttttgttttacaggggaattaaacctcacgggttttcaaaacccgtgaggtttcaatagaaaaggaattcaaaattaaattacaattttttaacatcgagttagggatagagtctcaactttattagctaaatttgatagaaataggaagattttcttcttctcaagtgctattttcaccaaaaacaaccaccaaaacagaataattatggccaaaaacatagcagagcagattgttgaaatgctcgaaaatgccaatgtgaaaagaatttatgcagtaaccggcgacagtcttaaccatctgaatattgccgttaaaaaaagcagcatccaatggattcatgtgcgtcacgaagaggtaggtgcttatgcggcagcggcagaagctgagctggatggccttgctgtatgtgcaggaagctgcggaccaggacacgttcatctgatcaatggggtttatgaggcacatcgttctcatgttccgatgctggttattgcttctacaattcccagtgatgaaatgggaatggattattttcaggagaccaatacgataaaattgtttgatgactgtagttattataatcaaatgattacaaggccggaacaggtacagagaaccgttcagacagctattcagcatgctatttccaaaaaaggagttgctgtgataggtcttccgggagatgtgtcggaactggaagcagaagaagccactacttcagcccagatctttaaaaccaatccggtcataagaccttcggacagcgaattaaaaagcttgtcatcccttatcaacagcagtaaaaaagtaacattatattgcggaatcggtgctgctgaagcaagtgaggaagtcattaccttatcaaagcttttaaaagcacctgtaggatattcattccgtgggaaaatggctattcagccaaataatccgaatgaagttgggcttacgggattgctgggctttccttctgcctatcatgccatgcatgaagctgacctggtgattcttctgggtacagatttcccatatcagaaattcatgcctgtaaaaaataaaataatacagattgatgaaagccctgaaagattaggaagaagggcaaaactggaattgggacttaccggcgatgtcaaagaaaccattaaagcattacttcctctgcttgaagaaaaaacagatgaccattttctgaatgagcagcttgcattttatgataaagtaaaagaaagccagctggagtatgtaaaagattcaggaaaagaaaatgcaatccagccggagtatgttgcccatactttagataagctggctaagcatgatgctatttttacggtagatacaggaatgtgctgtgtttggggagcgagatttattacaggaaccggtgaaaggaaaatgctggggtcatttaatcatggctcaatggcgaatgcaatgccaatggctatcggggcggctttggctcatcctgagaaacaggttatcgcgatgtgtggtgatggcggactatctatgttattaggagatatggcgacaatttttcaatataaattacccgtaaaactgattgttttcaacaacagaaccctgggaatggtaaagctggaaatggaagttggcggaatgcccgataatgaaacagatatgattaatcctgactttgcgatggtagcacatgcgatgggctatcctggtaaaaacgttcatttgccggaagatgtagaaagtgctatcaaagaatgcctggattataacggaccttatcttctgaatatttttacgaatcctaatgctctggcccttcctccgaagattgaatttgaccagatcatgggaatgaccaaatctatggcacagctgatgctgggaggcaaaatggatgaggtttttgaaacggtaaaaacgaattataaacatattaaaggtctgctgtaagattaagaatattcatattatagaacttcatgcattgtgtgaagtttttcttttttataactgggctaaatatttacctttgtttattattagtaaattatgagaacaatacttttatttttgaccttatgtgtaatgaatttttcttttgcacaggatcaggaagaacgggatgactcttttatccgggaaagcaataaaaatcttttaaaaatagatattcgggaaccttttatgcaggttgccgtgaaatgtaatgattttaaacctgcagccttcgaagggggtgttgcggcctataaagatatcctgaacaaatatatgtacgcatatctgaattctgacttctatgcccttacaggtgattttacatttacgctggtgcttgatgataaaggaaaagtagtggatgtgaagggaatgcctaaagtggccaacagcgaagttttctttgatgacatgcagtatgttgtaagaaggatcaaaaaaaactggactccggcttcttgtaacggacagcctgtggcttcacagattaaagttaaaatgaatttttcttcaatttcaacggacattgactaataccaataaatgaaaaaatatctctttattctatctttatattttaagggttaaaggtttatcacaaaagctgtagagcagattacagaaaaatgggacccggaatcttctcgggaatgccatcagtctctattttccggatatctgtaactttatgattttgttaaaataataccgctgacattctgtcacaatattttgtatctttgcaaacttatctgttcgtaatttactattacgggccttaaattgattatcgtgcaggaaaaatatatagacgaaacaaagcagggcgaagcttttgctattgccgaaagaccggaaaattctaaaaagctgtttttagaaagctatggttgtcagatgaacttctctgactctgagattgttgcatccattctcaacgaacagggatacaacacaacgatgaaagtggaagaagctgatctgatcctattaaacacatgctctatccgtgaaaaagcagaacaaacggtaagaatgcgcctctcccagttcaaaaatctcaaaaaagaaagaccgaatatgacggtaggagttttgggatgtatggcggaaagattgaaaactaaattcctggaagaagaacaattggttgaccttgtagttgggccagatgcttacagagacttacccaatcttttaaaagaaacagatgacgggagagatgccatcaatgtaattctttccaaagaagagacctatgcagacatcaatcctgttcgtttaggaggaaacggagtgactgcttttgttactattacaagaggttgtgacaatatgtgtacattctgtgtggttccttttaccagaggaagagaaagaagccgtgatccgcactctattattgaagaatgtaaagatcttgccaataacggttataaagaaattacccttttaggacaaaacgtagactcttacctttggtatggtggcggtcctaaaaaagattttgccaaagcatctgaaatgcagaaagcaacggccgtaaattttgctcagcttcttgatttagtggctaaagctgttcccgaattaagaatcagattctctacttcaaatcctcaggatatgagtcttgatgtgttcagaatgatggcaaaacacgataacatctgcaaatatgtccaccttcctgtacaaagcggaagcaataatatgctggcagcgatgaacagacaacatacccgtgaagaataccttgatctgatcagaaaagcaaaggaaattgttccggaagtagcattttcacaggatatgatcgtaggattctgtaatgaaacagaagaagatcaccaggataccttaagcctgatgagagaagtggaatatgactacggttatatgtttgcttactcagaaagaccgggaacccctgcccataaaaaaatggaagacaatattcctgctgatgtaaaacagagacgtctcgcagaagtaattgcacttcagggtgagctctccaaaaagagaatgaaatcctatgtgggaagagagcaccagattctgatagaaggaatttctaagaagaataaaaaccaatggaagggaagaaactctcagaatgccgtatgtgtctttgataagcttgaaggacagaaaataggtgacattgtgaacgtttttgtgtatgataatacgcagggcacgcttttagggagaacagcggaataaatataagttttgatcaaggcggtttattttagaaagaatcccgatcactgaaaaacttaaaaaagaaacaagatcaacggtatattaccgtaagatttttagtaaattgtgaaggaaagacaggcctgttcagattacagcatatgagtccggatctgaaagattctgtactggatgaagaattggaaaaaaaattgctgcagtttacaaaatcactcgacggctggatgccgaaagagatacaaggtttaaaagtagattattatcagtatttaacctataaaattgaaaatggaaaagtttcagaggtattaccttagctttttgctacttatagtttacaccaatactattgcacaggttaactgtaatgcagtagagggtgagaactgcaaaaaagcgtgcgggttatacaactgggcttcagatttacaaggtttcgcagaatcccaggaaggctttgataaagctattgaactttgtcctgatttctcccatgcttatatggaaaaagcagttccatatcttaaaaacggagatttcgtaacctggaagattctgattgataaagccgttaccttagatccaaaaacgtaccttggttacagaggctggacgaagtttcagtttttaagagactataaaggagcaatccaggatttagaaagcttaaaaaaatatgagcccggagacttaggaagatctcaaaacggagattataatctggatgtggtaagagccatgtcttacagtgcgttagggcagaaagaaaaagtcgcaggcattatagaaaggcttctggctgccagaggttatgtgaaaggaatgtttgatcattatcagctgggagttacctgtttcgagctgggaagatatgacagagttcttgaaaattttgaaaaacaaagcaaagagtacgactttgctgagaatatatactttaagagtaaagtttctaagatcagaaacaaagattatttggatttaaaaaagttagcattacgaacgtatgatgaaggaaagaccatgaaagaggtctacactcatcactttaacaaaatctacagacagcagattgaagcggtgtagaagattaacattaaatcaataatcaaaaatttacttatgagcaacgagctacaaaacataaaaaaccgtttcggaattatcggaaactttcctgcactcaaccgtgccctggaaaaatctatccaggttgcccctacagacatttctgtactggtgattggagaaagtggagtgggaaaagagtttattccgaaaatcattcattcagaatccagaagaaaacatcagccctatatcgtggtaaactgcggggcaattccggaaggaaccatagattccgagcttttcggacatgaaaaaggagcctttacgggggctacagctacaagaaaagggtattttgaagtggcagatggcggaaccatttttctggatgaggtgggagagcttcctctgcagacccaggttcgtcttttaagagtactggaaagcggtgaatttatgaaggtgggttcttcacaggttcagaaaaccaatgtaagaattgtggcagctaccaacgttaatatgatgaaggccatccatgacggaagattccgtgaggatttgtattaccgtctgaatactgttcagattgatatgccgcctttaagagaaaggaaaggggatattcatttgttattcagaaagtttgcaatagactttgcggaaaaatacaggatgcctgagcttgagttggagcaaagtgcagttcattatatagaaagctattcttttcccggaaatgtccgtcagctaagaaatttagtggaacagatgaccgttgtggaaagaaacaggaatatcactgcagaaaaacttgctgaatatattccaatggaaacccaccttcccatggtggtaaataatcagagtgctccaaagcagaatgatttcggaagcgaaagagaaatcatgtataaaattctgtttgatatgaggaatgatattaatgatttaaaatccttaacttcggaactgatcaagaacagaggaactgcagatctgagtaaccatgagaaaaacctgatcaacagaatttatacttctgatagtcagccacaagtgaattccggatcgatgttatattttgaaaataataatgatacaccggccgttcagactcctacgattatttcaaaccctgatgacagctatgaagatattgaagatatcgaaattgaagaaaacagaccggaatctctttcgcttcagaataatgaaaaagatttgattatcaaggctttggagaagcataagggacgtagaaacagagcggcagatgagctgggaatctcacaaagaactttatacagaaaaataaaacaatataatctggaagattaaaatcaaaaataaagatttaagattttaaataacagaaaataccacaaaaatgaatatcaggattaaaaatatcagcctgaaacagtcgctgctaacagtaatgctttttgcgttactgggagttttaaattcatgctacagttttacgggatcatcccttacggacgagaaaacagttcagatcaatgaatttcccaataatgcacctctcgtaaaccctgcattatcacagcagttttctacggcaatacaaaacagattccttcagagaacaactttaaaaggaacaaaagaaaatcctgatatcctgattgaaggagaaattacggactattccattacccctaccacaatcagttccaatacccagacaaacccttcgggtggagtggttcagcaggcacagaataaacttacgattacagtaaaggtacattatgaaaataaaattcatccggatgcaagttttgacagaacgtattctgatgaagctgcattcaacagtgatgtatctctaagccagatcgaagaccagcaggtaaagctggtgacagatagaattattaataagatatttaacgacattgtagcgaattggtaagatgaatccgagagttttagaattaataaaaaatccgaaaaatattcagttggaagaccttggtcttttgaaagaagagattcacacttttccttatatccagaatatcagggcgcttcacctgtacggagtacacctgtacgaaaaagagaactatcagaaagaactctctacaacagcggcctacactacagataaaaaaattctatatcagctgatcaatggaaagatcagacaagaaccaaaagctgaaattgctgaagaaaagaagccatctaaaaccgttgaaaggcctgcacaattagccctgaaaactaaatctttccctattaaaagagaagaagaagctgcggtggagaaattggcagaggagaaggaaaaaacatctgttttaccaattgcacatgaggttaaacctatttatgtaaatggtgagcgaaacagaattttgtttgaaggagaagaaaatttcctgaatgaaaagaattctgaaacaatagatattgaatctactctggaatcaggaactcttgtaacgcaaaaggcagagcctgcagcagaacaacctgttcaggaatcaaaagaagaagcacaggctgaaacagaggaaaaagcaggagaaaactttacgccggaaatcattattgatgaagatcagatttctgatgaaaaagaagtaaatggtaatgaagaaacgcactccgcagatgtatctgatgctgaagtaagcttccatggtaccgattcatttatgccggacgttaagatccaggcaaacaatgaagaaactgttgagaccgttgaaatttcccagcctaatgtcaataaacatgaagaggaaatgagacgtctgatcgaagaggttgagaaaaagatgaaggaaactaagtctgtttcgcaagaagaaaaaacagagcctgaatccattgaagatcatgaaattagctttgcagagacccagagttttcatttttggtcaacaagtgacgagaaaccagcgcaaatcgaagaagagccggtacaggaagaaattattgaaaacccattacctgtagaagaaaatactgacgataaagctgcagtagaaaaagaagaaaaaatgcctgaagttcattcagcatggaaaccaatgagtgtagaatctaatgtaccggattccttaatcaataaatctgaaaaagtatcagctcctgaaataaaagctccggcagaagaagtaactcctgttgcagaacctgaagcagttatagaagaggcacagcattctgaggcagctgaagatgttaagacagctgctcaggacgaagttctgcaggcagaagaaactcaggaagaatctgtatcaactgaagtcattgaagaagaaaaagctgaatcagaaactttaaaagaagatgttcctgtaatgaatgtttcgttcttcggaaccgatatttctacacttaaagttgaagaaaagcaggaggaaaagaaagaagagcctgtagaaaaagtacaggaggtaactatgaagaatacaactcagtcaccagtagacagcaatgttcccggttttatcaatacatggcaaagctggctgaagatagacagaaaacaggaaatcgaaaaggaaaagtcggtcattaaagaaaaggctattgaaacctttattgagaacaatcctaggatcagtcagttaaaagaagaaagtacttatgttgtaaaagaaaagaacgacgatatctcgcatctgatgacggagaccctggctaacctttattttgaacagaaattatatacaaaagcaataaaagcgtttgaaatattaatcaaaaagactcctgagaaaaaagaatattttgaatccagaattcaggatattaaggatttcagaagcaagaattaaaaataaaaaaggtactgattagaacagtaccttttttattttatcaactctgggaatcgtttttacttcctctcagctttctccaggccttccgtccaaatacaataacaagaattaatgtaattacggcgaagattgcggcaataacaggagcggccattgcaagaacagacataagcccggcgcctgcagtttccgttgttcctaccacagaattccccaatcctccggttgtggctgtggaggcggcccgtattcccgcaaacccggaactgatggtggctgctgtacctccaccggctattaaagccaatgcccattgtggaaaagttccaagttcagtaaactggctggcaaataatatagagccggcaaccgttgccataggaatagatacggtgtccagcaaatgatcaataaaagggatataataagcaaggatctcgacaatggtggctattccggttgtaataagcgtaggcagccccgcaagccattcaaagtgctcattcatagggatccagtggaagtaagaggcaatacttacaataaacatagggagaaacacccggaagcccgtagctgcagccagtccaatgccgataaatgcactgatgatatatgaaaaatagggaacattgtctaacatattaattttcagatttattgttttccctaaattacaaaaactatatgatattaagtgttgctaattttaagtacaggttctgtgatgctggatctgaactttactgctcttgaataaaaagcaaagaatctacgcaaccatctgtgttgatctttgccatccatggaaaaataaacttcagcaacactttattaatatcagatcattgaaagcagattactttttctgcgcttcacaaagtttgataaactgagcctccacatcctggaattttgccggcatctcagaagaaacccaaaacagcatagccattgttttctctccgaaagattgtttaaacagctctttattcagcctgtagcattctctcagcaatctcttgatacggttcctgtgaacagcccgcttaaaatatcttttagacacagaaacaccaaactttcctgtgtctataggaatactgggtttgtctttcagaatgataattctcagatttccgctggttctccatttgcctttctcaaaaagcaaactgatctccgtattttttttgagcttctccgctctgggatatttggaattctgcattaatcttttttcttcactaaatgattaatcacttcagctgcagcatacaacccaaaaatagcaggaataaaactgatagtgccgtagaatgactttttgaagttacttccatcagtcattttaagactttcctccttctggatttcattggagaatacgcatctgatccctttattgattttttctttttttagcctttttctgacctgtttggcaaggaagcaattgtgggtcttgctgatgtcccttaccattaccatacttggatctgttttcccaccggcacccattgagcttacaatcttgatttttcttcttctggcagcttttattaaacagattttcggcgttacactatcgatacagtcaagaacataatcgaactttccggaatcaagcacttcatccattctttccggattcagaaactcattgattttggttaaatgaagctgtgggttgatgtccagcaatctttcagctaccacttctactttatgctttccaaccgttgagtgtagtgcaggaagctgtctgttgatgttggtaatatctaccgtgtcaccatctacaatggtcatattgcctacaccggctcttgccaggaattctgcggcaaaagaacctactccccctaagcctacaacgagtacgttggctttggtcagcttatccaatccatcttcctttatcaaaagttcagttctttccagccagtatttatccattttttatcgtgtgtaaattttctaaaatttgttcattgagttgttccaaagaaattccttttatttccgaaaccttacgatacaattcttcgatgttaaaatcttcgttgtcagtttctaaaaagattttgtctgatggagtgtttttcaaaatatcctgcaaagataaattatacaaaacagcttttccaaaactcaggtaaaaattattggcaagaagatcctccgcaatttggtgttttttattaaaaccatggataatcataggttgttcagccctcttcttaaatgaaatgacctcataaaattttcttacacaatgaataatcagaggtttttttacttcgttggcgatctttatctgtcttaaaaaaactttctcctgaattttctgatcaacagaaaccaaagaatccaaaccgcattcaccaatggcaaaacagttttggaatatcatgtttttcatcctggaaaactgctcttccatattgttgatgtcaatatcctgggggtgaattcctatagaataagggaaatcaggaggtatctggccaatatccagattataaattccatttctgatatatttcttatgatggtgaaaatcaaaaaaatccatattcaaaaataagtaatttcagatttaatctaaaattattaaacgatcgtttataaatgtgttaaaaatttcttaactttactcaaagtacacttcatgaaaaaaaaatttacagaaaaacagattcacatactggatattgcagaagagctgattgcaaaaaagggatacgagggaacttctgtaagggatatttgttctaaagcaaatataaacgtcgccatgatctcttattatttcggttctaaggagaaaatgatgtcttatctctatcagtacagggtactgaagaccagagagaatttttcagaatttgcagataccatcaaagatggtaaaccggaaatgcagttgcgtgagatgattaagtatattgttgctcagcttttcaagtataattatttccatgggtttgtgacccaggagctccgccatacagaaaatctgaaagatgagctgcttgatttctatcagctgtttgtgaaaaaactggatgatgtcattaagaaaggagttgcgtcaggcgtttttacatttactcccaagcctgaggatattcttaccatgatcatcgggtcaaccttatttgtaatcagaaataaaaacttttacgagctgtatgttcccagtaaaaatgaagaaacttacgcaaaagaagctgagaaaaaggtgagaatgaatcttttattaagtgtttttgcaattttgggatacgctgcagactaaaattacgttaaatattcataaaaaaaaatctattgacaaaaaagttatatttttgcaaattagtaaatcggctgtataatccgaaaactgttgaattttttatatgaaaaaatatattttaggtctttttgctgtagcggtggttacttcttgtgtaagccagcaggaaagagcaatgaggagtgctgataaagattttatcttgaaagctgctaatgaaaacttcgccaagaaaaagtggaagaacgcattggctctttatgacagacttgctaatcttgtggcgggaacagatgatttccctaacgtaggtttcaatacagcgtacgccaactattatgacaaaagttataagctggcagggcatcagtttaaaaatttcgcagtaagttttccaaaagatccgagagcagaagaggcagcatatatgtctgcgttgtgctattatgaaggatctatggattacaatctggatcagtcaagtacagaattggcgatcaatgagcttcaggactttctgaacaattatcctaactctgaaagatctaagaatatcagtcagttaattgatgaattgtcttataagctggaatttaaggcttatgaaaatgcaagacaatactacaaaatgggcgaatataaagccgcaaatgtagcatttgataatgttctggaagattttccaagtacaaaacttcgttcaaaaatttatgattatatcatgaagtcccgttacgagctggcaatgaaatccgtgtataatcttaaagaagaacgtattgagagtgctttaacctatacaaaactggtagaaaaagaacttccggatacggaatattctaaaactgctgtagatctgagaggaaaactggaaaaggaaaaacagaattttgccgttgttaaaaaacagactgaagcaagaatggctgctttaacagcaagacagaaaaaagaagctgaaaaacttgcagataaagataaaaccgagcagcagattaaagatcagatcagcaatgaaaagaaagcaatgcagttacagagggacagtgcggcacttaagacccctcctccggcagcgactttcaaaattcaaagataattcgtaaatttgccatcttaaaataaaaataattttctcaaaatgagtgtaaaagatacaaaagcagaagtaaatacaattacttacgataaagataagattgaagataaagtaggttcaatctatgaagctattgttatcatgggaaagagagcagagcagattaatgcggagatccgtacggaacttcacaataaactggatgaatttgctgttcacaattctacattagaagaggttttcgaaaacagagaacaaattgagatctctaaacattacgaaaagcttccaaagcctacttcaattgctattgaagaatggttaaacggagatgtctatttcagaaaaacagaagaaagaaaataatcaatcatctgtgttttaataaatcagggtcataaaggaattcacttcttttatgacctttgttgttttgaagcctgattgtgtgggaaaaaataagtactttagtatttcaaaaaattagaactaaatgagtgtttccggtaaaaaaatacttatcgctgtctccggaggaattgcggcttataaaattcatttcctgatcagggattttgtgaaaaaaggcgcagaagtacaggttattatgactcctgacgcagaaaactttgtgacaaaattaagcctgtctacattatccagaaaaccggtgtattcagatttttatggagataacggaacatggaacagccatgtggaaatggctttgtgggcagatgtcatgattgttgctccctgtacagccaatacattagctaaaatagtccacggaatgtgtgataatctggttatagcgacttatatgtctgcaaaatgcccggtgtttattgctcctgctatggatcttgatatgtatgcgcatccttccactaaaaagaatctggagctggcagaaagcttcggacatatgattataccagcagagagcggagagctggcgagcggattaatcggacagggaagaatggctgaaccggctacgatctttaatacggttgaacattattttacttctcatagccactccggcagtcttgaggggaaaactgttttaattacggctggacctacctatgaagctattgatccggtaagattcatcggaaaccattcatcgggaaagatggggttttctcttgcagaggaagcttcgaaaagaggagcaaaagtgattctgatttccgggccaagttcccaaaccataaacgaaccaaatgttgagcttcataaagtgacttcagcaaaagaaatgctggcaaaagtttttgagttttacgacagaatagacattggaattgcaagtgccgccgtagcagactatgcacccaaagaggtggctaaggaaaaaatcaaaaagaatgatgaaaatcttacaatagaactggttaaaaatccggatatccttaaaacgatgggagaaaagaaaacccatcagtttctggtagggtttgcgcttgaaacccaaaatgaagaggaaaatgcaaaaggaaagcttgaaaagaaaaatctggatatgattgttctgaattctcttcgtgatgaaggagccggttttaaaaatgataccaataaaatcaagatatttaccaaaacagaaaagaaggagttcaacctgaaatccaaagatgatgttgcaaaagatattctcaattttgttgagtctcaacttttaaaataattttaataaatttccgttctcaatttttaatagacaatgaaaaaaattataagtttattttttctgttttttctatacacccaaagtttttcccaggagctgctggcaacggtgcaggtaaactccaagcagttgggaggaagtaaccagcaggcgtataaggcattggagaagagtctcagggactttatcaataataccagctggacaggcaaaaaacttcagaattttgaaaaaataaaatgtgctttttccattgttatttcggaaagagatgttaataaattcaaaggaactattgttattcaggcggtaagacctgtttataatactacgtatgaatctcctttgctgaaccttcaggatcagagatttgcttttgaatatattgaaaatgagagtcttatttttaatgaaagacaattttctggaaaaaaccttacagatgtaatcagtttctatatttatgtgattctggggatggatgcagacagctttcagtctatgggaggatcacaatggtatgcaaaagcacagcagattgcccagaattcccaaaacagaaactatgagggctggaataccattaacgagcccagaagccgttctattttgattaacgaaatcatgaaccctaactggagtcagctacgttctaccatttatacctatcacagagcaggactggataaccttttcaatcaggaccagacgcctggtaaaaaagtgatttttgatgccctgatgcaattgaaaatgtatgagaacagttttcagcaggcatttttctttaacctgtttatggataccaaaagtgatgaaattttcaatattttcaattctggaaataacggaggtctgattctcaatgatcttaaacaaacaatgatcatcctttcgccaaagaatatagacaataaatggaataagtggaaagtctagagatttccggataagttaaatactcagtattatggatgagagtagtgaaaaaacattttctcaattcattaaaaaaaaacttatttttacatttcaaactgaaattggattataacccggattatcaatgctttcgagaatttacattaaaaactttgccctgattgatacccttgaagtatcattgaaaaatggtttacaggttattaccggagaaacaggagctggaaaatctattattttaggtgctctccggcttattctaggagagagggcagatgtaaaatctatcgctaaaactgaagaaaaaagtgtggtggaaactgagttttcactcaacaatcagtttaaaaaattctttatagaaaacgatctggactacgagcttcagaccataatccgaagagagattcttccttcagggaaatcacgtgcattcattaatgatgtgccggtaacattggatatccttaaagagctttcctctcaattgatcgatatccattcccagtttgaaacttccaatctttttaccgctgaatatcagtttaaaattattgacggattatctgagaataaaaaggttattgaagaatatcagcaggaattttccgattttcaaaatcttaaattgcagctgaaaaagctgaaaacccagtttgcagaagccaataaggaaagtgattacaaagaatttttactgaacgaattggaagagctgaagctggatgatgtggattatgaagatatccaaaatcaactttctgttcaggaaaatgccggtatgatctccgaaaatctcgggcagatcctgtccaggtttcatcaggaagaaataggaattctgtccttctttaatgaggcaaccaataagctttcaaaaatttcaggtatttctgccagtttcgcagaattggatgaaaggctggaaacttcatttgttgagcttaaagacatcatttctgaattggaacatgcagcagaaagagtagaaattaatcccgaaaatctcgtataccttaccgatctgaacaataaaatcaatgctttgtttcttaaacataatgtttcagaactgaatgagctgatagaaatccgaaaccagctggcaggagaccagaaaggagcttcagatcttgagttacaaattgaagaaacagaagaaaatatttttcagaaagaaaaaacacttctgagccttgcttcaaaactttcaaagaacagacataagaacatttctgttttcatcaaaaaagcagaaaatcttctcaagaaattagggcttgaaaaagcgaaggtcgatattgaactgcaggatgctgatgaattcaatcagtttggaaaggaaaatatccagctgttgtttcaggccaattccggtttccctttaaagccaatccaaacagcgatttcaggaggagaaagatcaagagtgatgcttgctgtaaagaagattattgcagaaagcgacgaacttccaactttgattctggacgaaattgacaccggagtgtcaggaaaagtggcagaagaaattggaaatcttatgcgtgaaatgtctgaagatatgcagctgattgttatttcccaccttgcacaggttgcggccaaaggaaacgacaactataaagtcataaaacaggatatttccggcagaacacagtctacaattattcctttgagcagtgaagaaaaactgaacgagattgcccagcttctttccggaagtaaaattacggaagctgctttagctcaggcgaaagagcttatcggataataataaaatcacacttttcctgaaaaaattgtaacatattttacattatatttactaatgtaaaaaactaacatatgtttctaaagttccttaggcttgaaatcaaaagcttctttcgtggtacttctttagggatcaatctgactatgaaaatactccggtttatcggaatactttatttcatgggctgtctggtaggaggagcttttattgcttttttctacgtgcaggaggaaatgcaccagaatcctttaaaagtggtttcaaaatttctgattgttggctggatcattgatcttgccctcaaatacctctggcaggaaattcctacacagaatattaagccgttcctcaccctgaatattcggaagaatacactggtcaattatatgctggctaaaacttttctttcggcattcagctggttgagttccttgttcttcattacattttcactgattgctatattcaacggatataatgttcccgggatattactctggcttataggggtgatttcattactctatctgaataatttcattaatattttcttcaacggtaaggagacccttgcagtgatcattggtgtatgcttcctgattgtgggagcgttggcatattacaatattattccggttttgtcttattctgagtctgtattcttcagcttttatgaaaagccttactttgctttgatccctgttgtattgtttataatattgtggtggatatgtttccgttaccttcgtaacgaattttatcttgaccaggggcttgaagcgaagaaaaccgttggaaaaacagaaaatatagctttcttaaataaatatggagttaccggtacatttatcaataatgatataaaaatgctgagacgtaataaagtgaccaaaggcattttgctgggcagctttatgtttctgttctacggattactgatgtttacctcttcactttacaaaacacctgcaatgatgatgtttatggggctttttgtaacaggaggcttccagtttctgttcgggcagagagtaccggcttttgacagttcatattatccgttgatgatgaccctgaatgttccttacaaagaatatctgaaagcaaaatggtggctgatgaatattgtaacagcagcttctgtgattatagccctgtgttatgcgtattttggctgggaagtttatattaccttttttgcagccggattatacaatattggagtgaactcccagtttaccttatggtcaggtgcctttaataaaacccagattgatctgaattcaaaagaaaaaagaatggggcaaaaaggaagtttcaatctcgtggcaatgcttctgctgattccaaaaatgcttcttccaatgagtgtatttgcggtggcaaaatatttctcgggaattacaggaggcgtaataagtattgccgtcataggaattatcgggtttttcctgagagaaaaaatcttcgatatcattgtaaaacattataagaaagaaaaatacagcacccttgatgcatttaaaaataaaagttaagccatgatcaatatccataatttatccaaaacatacgggacagcaaccgttcttaatatcgaacatcttgaaattccaaacggagaaacatttggtcttgtaggaaataacggggcgggaaaaacaacacttttcagcctgatgctggatttgattcaggcttctacaggatatgtaagtatcgatggtattaaagttaatgaatccgaagcgtggaagaataaagtttcagcctttgtggatgatacattcctcatcggttaccttactcctgaagaatatttttacttcatcggagagctgagagaccagaacaaggcatctgtagatgaattcctgaaaccttttcatgattttttcaatggggagattcttaaatccggcaaatatatccgtgacctttcaaaagggaatcagaaaaaagtaggaattgtgggggcaatcattggaaatcctgagattattattcttgatgaaccgtttgccaacctggatccatctacgcagatcaagctcaaaaaccttatcaaggaattgtctaagcaggatggagttactttcctgatatcgagtcacgatctttctcacaccacagaagtctgcaacagaattgttgttgtgaataaaggtcttttggtcaaagatattcagaccaatccggaaaccttgaaagatcttgagcaatattttgcagatcaggtttcagtttcggatatttaataccacaaaaaagaggtatgaatacgatagaatcacagaacgtaacagattatccgaatagcaatactattttcatggtctggaaacttaatgacagtccacagctgaaggatgtttttcaaaggctgtgcgctttggttttaaatcttaataattcggttttcaaccgttttccggacagcagggcaagctgtgtgatgggaattggggccgaagcatggagaaaactggaacttccaacacctcctcccaaggaattagtgagttttgaagaaataaagggaataaaacataccgctgtttccactcccggagatcttcatttccacctgagagcagataacaaaagtctgatctttgatatggctgtggaaatatccaaactgctgagctcggtaggtgaaagtattctggagattcatggattcaaatactgggatgcacgctccattcttggttttgtagacggaacggaaaatccgcatggggacgaccgggattactttgccaaaatcggagatgaagaccttcagtataaaggcgggagctatcttttcgtacaaaaataccttcataatatggatgcatggaaaggattatccacagaagagcaggaaaaagtaatcggaaggtcaaaagagaatgatattgagatgtctgataatgtaaaaccttcaaactctcatattgccttagccaacattgaagatgaaaatggagaagaactgaaaatcgtcagggacaatatgcctttcggaagtccttctaccaatgactttgggacctattttatttcttatgcaagcacgtttacgactagcagaaagatgctgaccaatatgtttataggtaacccaccgggaaattatgacagaattttagacttcagcacagcagttaccggaacgcttttctttgttcctaccagaaatatgcttgatgaattctcaggataaaatgcaaggctgtctctttcaggacagtctttcttatttaattaagtacagcaaataaaatttttttaaaaacgtgtaacctttttttgttttcattgtctttagtatagaaacagcataagcatgaaactcttgttcggaaataaaaagaatgatttgttgagcctcctgaaaaaacaggacccggctgcacagaagattttctatgaacagaatgtaaagaaatttctgagtgtaagcaaaagctatgtaagcgatttgtaccaggcggaagattgcctcattaaagcattctgtaaaatttttaagcatatagaaagcttcagaggagagtcgaacctggaaagctgggcaagaagaattgtggtcaatgaatgccttaattttatcaaaagtcataaaacagttttctatctggatgagatcaaccaatcttttcatgaagatatccacgaaacggagattgactgtgactttaatgcacaagagcttctggatcagctgcctgatgcttacagaatggtttttaacctgtacgtactggaaggatattcccatcaggaaattgctgatactttgcagatttcaattgctgtgagtaaaacacaactgttcagggcaaaagaaaaattaagaaagatctactttcaacaacaaaaaaaagtgaaaaatgaaaacgtttaaagataatattgaatttcagatcaaaaagcagattgaggaaagagagatcgctccgtcccgtgatctttggtctgaaatagagtttcataataacagtaatcgttcaccaaggttacaagtgaagtggggtttaatagctgcatgtttactattaacctttggtttgggtgctgttctgttttttcttaatcagcctgcggaaattcatcctgaaattgtaaaggaaacagaaaaaactcctgttgacaatattataaaagatccggttcagaacagcattccgctggcagctgagaataatgataaaaaagatataaaaaaaatacctgctcaggataaagagcaaatagtttctgctgtggcaataggatcggagaaactgattcctaaagaaacagtccctgcaaagaaactggaaattctccagatttccactcctaagctcatggcaaaagccgattctttaaaaactccggttaaaaagaagaaatatgtagacccatccacgctactattttcagtagagcataaagacgttatcgaaaaaacgaaggatggaagcaatgttgctactactattgacctgaatgcccggtaatttatacgaaaattaaaaattaataatatgatcaagaaattaatcgtaatgggattgctatgctttgtttcagcatctttccatgcacaaaagacctttaatattaacctgtcttccaaaaaagatactgaggtaagcccgattgtcaaagaaaaagtggaagaatatgccgctaagatcaatgccattatccaggaagaaaaaaagctgatggaagaagaacttaaggttttgcaggcaagaaacctggataaggctgaattcgacagagaaaaagcccaaattgcagatcgctattctgagaaaatggataaaagaattgaagagctgggatttgatctggatgatgtgattcagaagcaggtaagatattcccttctgaatactgatgtgacttccaatgaagagcttaaagaaaagctgttgaaaaaattccgtcctaccagaagctttacaggatatttctcttacggaatcatgacactgacaaacagttctcaggataacgagcttgataagaacatcggatatacaaataatctggaatttggactgaaactgaattatcagcttagcagaacaagcccgtgggcgattacttcaggattagggttttcctggagaaccgtcagaacagataataatatgtactttgcaaaaagtgcagaccagggagtagcttttgttcaggctaatcaaaatctggacaaaagtaagctgagaacgggatatattatcgttccccttggagtacagtataatttctccaaacttaaaaatgctggtatggatatccagtaccgtagttactatactggatttaaaataggagcgaatgtatatggaggggtgaaaatgtctacgaataacattgtgaaagacggtgacggagaaagaagagaccgtggaaattatcaggtgaatccttttgtgtatggggcacagcttactctttcttataatagtttcagcatatttgtaaaaaaagatttcagcaatttctttaaggacggctattttaaaaatgataaagcgctgatattcggcttagccattggcttggattaaatatattttgattgcaaaacaaaaactccggaagacttgctcccggagttttacatagtatcagttatataatcattattttaagcttcctaccatgtcttcaggttttacccattcatcaaactgttcagcagttaacagaccaagattgatggcttcctcttttaatgtcgtaccatttttatgggctgttttagcaatcttagcggcgttttcatatccgatgtgggtatttaaagccgtaacaagcatcaaagatttgtctacaagctctttaatcctctcatgatttggctcaatacctacggcacaatggtcgttgaaagaaatacatgcatcagcaatcaattgggcagactgtaagaaattaaaagccattaccggtttgaaaacattcagctcataattcccctgagttccggcaaacgagatggtagtatcatttcctaaaacctgtgcgcaaaccatggtcattgcttcattctgggtgggatttacttttcctggcataatagaagatcccggctcattttcaggtatatgaatttccccgattcctgagcgcggtcccgaagccatgagtctgatatcctgagcaattttaaacagagatacagccaactgttttaatgcgccgtggctttcaacaatggcatcgtgagcagcaagagcttcaaatttattttcagctgtaacaaaaggatgttttgtaaactgagcaatatattcagctacttttacatcatagccgttaggggtattcagacccgttcctacagcagttcctcctaatgccagctcagaaagatgaggtaatgtattttttaaagctctcaatccgaattcaagctgagccacatatccggaaaattcctgtccgagagtaagtggagtagcatccatcaggtgggttcttccgattttgacaatatctttgaaagctttcgatttttcagccagcgtattctttaatttttccactgcaggaatcgttacttccatcacttttgtataagcagcgatgtgcatggctgtaggataagtatcattcgaagactgggatttgtttacatcatcattcgggtgaatttcagacttttcgcccaaagttcctccattattaacatgggctctgttggagattacctcattcacattcatatttgattgtgttcccgagcctgtctgccagatcactaaaggaaactggtcattcaattttccttccagtatttcatcacatactttcgctatcatatcccttttttcggcaggaagtacccccagatcagtattggcataggctgctgcttttttaagataagcaaaagcttcaatgatttcgtgtggcattgaaccttcaggtcctattttaaaattgtttctggaacgttctgtctgtgcaccccagaatttatcggcaggtacctgcacttctcccatggtgtctttttctattctgtaattcatagtggttgaaatttgtatgatctttatttttgagccaaaaaattgttgacattactcatgtttaatgaaataaataatgttttggctttgtttatttatcttttataaaggtacttataaactcagaaacctacaatttataatcattataaatatcaatttaagtgactgattttactcatattttttttaaggaggcgtatttttgtacaaacaaaaattgaatggattttagatatcaggatccgtatcctattcagaaagatgatacggtgtacaagaagcttacatcagattatgtaagggttgaaaaactgggtgacagagaaattttaacagtagatccgaaaggactggaattattggcagaagaggccatggcagatgtgtctttcatgcttcgttcctcacacctggaaagccttagaagaattattgatgatcctgaagctacagataatgatagattcgttgcttacaatcttttacagaacgctgcagtagcggttgagggagctcttccttcatgccaggatacaggtacagcgattgtaatgggaaagaaaggtgaaaatgtatatacaggagtagatgatggcgaatacctgagcaaaggaatcttcaatacttaccagaaaagaaacttaagatattctcaggtcgttcctttaacgatgtttgatgaaaagaattccggatccaaccttccggctcagattgatatctatgctaaaaaaggagattactacgaatttttatttttgacaaaaggtggaggttcagccaataaaacattcttataccagaaaacaaaatctttactgaacgagaaatctcttgaagaattcatcaaagaaaagatttcagaccttggaacggctgcctgcccgccataccacttagcattggtaatcggaggtacctcagcagaagccaaccttgcggctgttaaaaaagcgtcagcaaaatattacgataatcttccgacagaaggaaacgaggccggacaggcgttcagagaccttgaatgggaagccagagttcagaaaatctgccaggaaagtgccatcggagcacagtttggaggaaaataccttactcacgacgtaagagtgatcagacttccgagacacgctgcatcttgtcctgtaggaatgggagtttcctgttctgcagacagaaatatcaaaggaaaaataacaaaagaaggaatcttccttgagcaattggagcaggatccgaaaagattcttgcctgatacacctccgcatctggaagaagctgttgagatcaatctgaataagccaatgccggaaattcttgcagagctttccaaatacccgatcaaaacgagactgaaactgaacggaacattgatcgtggccagagatatcgctcacgcaaaaatcaaagaaattattgacagtggtaagccaatgcctgattatttcaaaaatcacccgatctattatgcaggacctgcaaaaactccggaaggaatggcttcaggaagcttcggacctacaactgcaggaagaatggatgtttatgtagatgagttccagagccatggcggaagtatgattatgctggcaaaaggaaacagaagtaaagatgttaccaatgcatgtaacaaatacggaggtttctatcttggatctatcggaggaccggctgccatccttgccaaagacaatattgtatctgtagatgttgtagacttccctgaattaggaatggaagccgtaagaaaaatcgaagtaaaagacttccctgcattcatcattaccgatgataaaggcaacgatttcttcgcagatcttgctcactaattagtttaaaattaaaataaataacaaaatagaacgctgatcttttgtgtaaaaaggaaaaaagttctatttttgcctaaaatctttaagagaatgataacgattttatcagcattttggccgttctaccagttcctatggactgttttcttcattactatgttcttagtaggattctggtgtatttttatgttcttcggattagtaatcccaatgtggctaactgaaggtttgaaagagtatttcggaaaagtaaaacctttcgatcctgaagacatcagaagaaagcttattactgagcaggaaggtgtagaggttatctataacgagcctaaaggaaacggacctttcattcacgatcacggacatcatcattaattgattgtcattgctttttcacctgaattctgaaaaagtaatatcaaagcaaaacaacatatatgaaccgcttaatttttttaagcggtttttctatttgatatttctcaggcttctcatgaatttttctggattatttttccccgaaaactgaaatatttaccagtgactgaataaaatagacaatatgaataaaaattaatcctatattcgataaaaaataggacatgagaaaattttattccgttgcttttctgctgattgccatgtgtgtttttggacagatcagttatacaatttcgcccaatccgtttaatgaaacagatgctattacgcttacagttcccggagatcagattgacgaatctgcctggggcgtttccaataatgccatttacatatggacctggtcttttgataccaattatcagaacagccaggattgtcctaccaatggaagctggaacaactccaatgacttaaataagctgaattataatgcaacaaccgacagctattcgcttacctttactccaactgccttctttggtagaacaggaatcggaaggctcgggtttctattaaaagataaaacaggatcacatcagacctcgccggatatttttgtaaatgtggggactttaagcctaaatcttacaaaccccttggtgaatagcctgacttctgttcctgcaggtaattccatcaatattactgctacaaccaatgtcaacgcaacatttcagttaaaagccaacggaacggtcgtaaactctaccacaacaccatctcaatcctattcttacagttataccgttactcaggatgcaagcatggagcttatagcaacacagggatccagttcaaaaagtgtcgcatttattctgcaggttccgagaaatgtggtttcggaagcaataccgaactggataaaacaaggaatcaattatcacccgacagatcagaccaaagtaggacttgccttatatgctccaggaaaaagttttgtccatgttatcggaagtttcaataactgggtagtgaatgatacgtatttaatgaaaagagataccaccaatcctgatctgtactggattgaattgattggtttgacgcctcagcagctctatacctttcaatacagaacaaatgacctgagaaaagtagcagacccttattcaccacaaatcttgtcttcttatgatgatcagtggatttcaactgccacttacccgaacttacctgcatttccggccggacagggttttgaagtttcaacatttaaaaccgggcagacagcttataactggcaggtgaccaactttcaaaggccggcaaaagaaaacctggtagtctatgaattattattaagagactttacacaggaaaagaactggcagtcattgatcaataaaatttcttatctgaagaatttaaaaatcaatgctattgaattgcttcccatcatggaatttgacggaaacctttcatggggatataatacttccttccattatgcattggacaaagcttatggaactcctgaaaaattcaaagaatttgtagacctgtgccatcagaacggaattgctgttattcttgatgtcgcatttaatcatgctacaggacgttcccctttggtaaggctttggaatatagatccggatggcgacggttatggaaatgtagctccggacaatccttactttaatcaggttccgaaacattcatataatgtattcaatgactttaaccatacaagtccttcaacgcaatattacgttgaaagatgccttcagcaatggctgacagaatatcacatagacggattccgctgggatctaaccaaaggattcactcagagctgttctgaaaatgatgaagcttgtaccaatgcctatcagcaggacagagtggatattatgaaacactatgccgacaggcaatgggcaatcgatccgaattcctacatgatttttgaacatttgggaacagatgcggaagagcagcagtgggccaactacagaatagccgaaggaaaaggcgttttgctttggaataaacagacagatccttataatcagaatacgatgggatataaggaaaacagcaattatgaccgtatgaaccacagccttcacggttttaccaacatgagtgctgtaggctacggagaaagccatgatgaggaaagactgatgtttaaaaaccttgcctatggtgcagtaaacggaaattatgatgttaaaaatctgaatactgctcttgacagaatgaaaactttcggtgcaactttctttaccattcccggcccgaaaatgatctggcagtttggagaattaggctatgaattcagtatcaacagatgtgcagacggtagtatcagcagtggctgcagaaccgatgagaaacctgttgcatttacgctgggatatgataccaatgccagcagaaaagcagtatatgatacctgggctaaaatcattaccatcagaaatgcccatcagatttttaaaaccaaaacatacagcatagaatctaataaccttgcgaatgaccctaacgggctgatcaccagaatttacctgtacgatacatctattactacaggaataaaaaatgttgtggtattggccaattatacaatttccgcacaaaacgtggttccttatttcccttatacaggtcaatggcagaacctgatggatgacagtatttcggatgtggcctctacaacggctcccatcactttgcagccgggagaattcagaatctttggaaattatgcaggtgctttgtctgcagcagatataaatgcaggcaacaaattatcgcttcagattgcggataatccggtacaaaacggtacggcaaaattaatttttaataaaatgaaaaacggagaaatttccatttttgatatgaccggtaaaaggttgagttcattcagactggataaagaaaacggcacatatgaggtcaaagtggactatccggccgggacctatctggtacatctgaaatcagacacaggaatagcaactcaaaaaatgattgttaagtaaactaaaaggcagatttgcaggcagcagatctgccttttttgtccatttaaaaaaatagtctacttttgcagtagatttatcaagaaaggtggagggatttggcccggtgaaaccttagcaacctgcacggttccggaagtgcgaaggtgctaattccaacccgaggggaagataagtgaaatgaatactctatatgattcccgtttcttgaagtcttatgtatctgcggaaaagaccgccggataagttatgatcaattgggaagaacaaaatgaaaaaaataagtacagctgtattattgcttggagcaatctgggttgctgctcaggagagcgggaataaagaaaaagaaattgaagatattatcatcgttggaaaccgtaatgttaaaagaacaaagctggagacaccggttccggtagatgtaattaatatcgacaaaattcagaggagtgctccgcaaatgactgctcaggatctgctgaactatgtgattccgtcatttaatgcagtaaggcaatccgcttcagatggcacagagcatattgaccccgttaccttaagaggaatggggccggatcaggttttggtattactgaacggaaaaagaagacatacaacatctttggtcaattatcagaacacagtcgggaatggttctgtgggaactgacctgagtaccatcccggtgattgccattgacagaattgaggttctgagagatggggcagcagcacaatacggatctgatgccattgcaggagtcatcaatattattcttaaaaagaatgccggggcttcagcaagccttacttatggtgtaagtggtagaaatgatggcgatacatatcaggcaggagcaaactacggagcttcattaggaaagaaagacggctacatcaatctttcaatgcagttaagccacagaggaaaaacaacaagaacacaaaatcatgatctggatatttttggggataattttgcctatgaatttgcagataatcctgagatagcaagagcagaagatgatgcagaaattcaaaaaagaggactgacgcgcgacgattttaatcttcagatcggggatgcacagatcaggcagggacagttatttttcaatgcagaatatccttttaatgaccattttaaactgtattctttcggaggcttcagcatcaaggaaggaaaaggttttggtttcagaaggcttccgagtgaaaaatccaatgtagtttcatccatttacccgaacggttttcaggcaacgctggcatcccagatatatgatgtatcttatgctgttggggcaaaatatactatcaatgactggctttttgacctcagtaatacatttggaagcaatactttcaattacaatgtaaacaatacgaataatgcttcattgggagcaaaatctccaacgagtttttacgccggagcacacagcttccttcaaaacaccattaatcttgatgtttccagaaatataaaccgttttaatattgccttcgggggagaattcaggtttgaacagtatcagatcaaagctggtgaagaggcatcttatgcccagtatgatatcaacgggaacattgctaccgaaggttccacagtgcttggtgcaggcggatcccaatcctttatcggattttctccggataatgcactcaggaaagacaggcattccacagccgtatatgcagatgtttcttatgatctggacaaaaagttgaacattgatgctgctgcaagatttgaaaactattcagatttcggaaataccttgaatggaaagcttgctgtacgatatgaatttgtaaaaaattatgcagtaagagcagctgtgggaacaggattcagggctccttcccttcagcagcagtattttaataactcttatgcagatatttctacttccggcgagaagattgttaccaaaggaatctttagtaatgatagcaaagctgcagaaattcttggatttgataagctcaagcaggaaacttcagtcaatgcaagtgccggatttaccctgaaacctttaaacaacctgaccatcactatagatggatactggatcaaagtgaaagatagaattgttattacaggaaatataacagattcaagattatcagaccctgctgtagtaggcaatggaaatgaggttgaaagcggaagattcttcgccaatgccattgatacagaaacaaaaggagtagatgtagtggtcacctatgactggattcttggtaacggaaaattaaatatgaatcttgccggaaattatacggagacaaaaatcacagatttccattttccggaaaatttaggaacgcctcaggaacagttttttggcccggatcagatcaatatcattgaaacgctgtctcccaaaacaaaagcttcattaggattaaattatggaatcggaaagtttaattttctcgtaagaaatacctattttggcaaagtcataagagatggctatccgtttggagaagtgcaggagttctctccaaaagtcgttactgacatcagtgttgggtatgatattacaaaaagtatcaactttacggtaggagccaataatatttttgatgttttcccggatcgccagatttacagaaattcatactatggggtattcaagtatgctccggtgcagatgggaacgctggggaattatttcttcggaagacttaattttaacttttaatcattaaatgagtactacctcacatcagattggctggaaaacagctgccgcaattgttgtttccaatatgatcggaacagggatttttaccactctgggatttcagctatccgatattatcaatacctacagtattttcctgctgtggatcattggaggcatcctggctctgtttggggccttttgctatgcggaattgggatcgcattttaaaggaaacggaggcgactttatttatctgaaagaaacctatcatcctttattcgggtatctcataagctggatttcgctgattatcggattttcttctcctgtagctttggctgcattggctatgtcaaaatatctttctgtattcaattattcttttggaaacggctttgctattgctgctatttttctgattgcagttactctgtcattcagtttgaaaacatccagtcggtttcataactttttcacattcattaagatagcgtttattgttgtactcattatcctgggcgtctggctttcagattcaccacagattggcagcagtttgaatttcagtgacagctggcagaatgagatcatgcttccggcttttgctacatcgctggtatttgtaacctattcttatacaggctggaactctgcttcttatattgcaggagaaattaaagatgtccagaaaaatcttccgaaatcactcattataggaactgttttcgtgacggtaagttatattctggtgaattatattatgctgaaacatgctcccgtgattcagttggcaggaaaagaagacgtcatgggagaggcggctatcaatatgcttggtcctgcttttggaaaaatcgttaatattttcattgctttgcagctgattgcaacaattagcggatatttatgggtgggttcaagattaacccaggcttttgcaaaacatacttatatctggaaaccattatcagctggaaatgcaaaaggaattccggtaagagccatttttgctcatgctgtgattgcggctattattattttaacaggaagtttcaaagagatttttgtttacactgcttttattttacagctttttgcaagtctggcaatttctaccgtattcttcctgaagaaaaaggacaggaaaatctttaaatcaaatgctttttacattttcccggctgtttttcttttgttcagtatgtatattctctattttacatttattcataatcctaaagaaagtcttataggattgggaattatcgttgtaggaattgttttatatcttattgacagaaggctttctaaagaatctcaggctcagtcttaataacaaggaaagacgaattaacaaattggctattcggcctttttgcagttttgtcctcttttcccctaaagctcaaaaatttatggtgattcggaattttaattttgaattaataattcttatctttgcacccacaaaatttctacaatgtctaaatcattaattccaaaattagaagctataaaacaaagatataatgaggttgcagaccttattatacagcctgatgtcatttcagaccaaaaaagatattcttctttgaacaaagaatacagtgatttgggaaaaattgtaagagtttacgatcagtataaaggcgcattggacagtattgcagaatctgaggaaatcattgcggatggttcagacagagacctggtagatttggctaaagaagaaaagctggaagcgcaggctaaaattcctggactggaagaagagctgaaagtattactgatccccaaagatccggctgatgataaaaacgttatcgtggaattacgtgcgggaacaggaggtgatgaagcggctattttcgtagaagatatctacaggatgtacactatgtacttcaaagccaagggatggagacacgaagtaacagattccaacgaagctgcaaaaggatacaaggaactgatcatgaaagtggaaggtgaaggggtttacggaatcatgaaattcgaatcgggagttcaccgtgtacagcgtgtccctgaaacggaatcccagggaagagtacatacttcagcaattacagtagcggttttaccggaagctgaagaggtagacgtagagatcaaccctgctgatatcgaaatgcagacttcacgttcaggaggtgccggaggtcagaacgtaaacaaggttgaaacaaaagttcagcttacccacaagccttcaggacttgtagtagtgtgccagcaggctcgttcccagttggctaaccgtgaattggcaatggaaatgcttcgtgccaagttatacgatatcaaacttcaggaagttcagggagatattgctgctcagagaaaaacgatggtatctacaggagaccgttctgcaaaaattaaaacttacaactatcctcagggaagagtaacagaccacagaatcaacaagtctatgtacaaccttgatgcttatatgaatggtgatatttctgaaatgattgatgcagtaatcatggcagaaaatgcagagaaaatgaaaggggaagaagaaaattattaaaaattataatagataagcaaagcctctgatccttcaggggctttgttttttaataccaaaacataaaatataaactatgaaaaattacaaaattattttgttattgctgcttacgatgatcgggcagaacctatttgctcagactgaagtaaagaaaccgaaagaagcttttgaattgttcttcggaacttttgtcaacaatgatgaaacagctttgaataagcttaatgagtacctgaaacctaccgttgaaggacagaatgcttaccaggtagatttcaaggaaacttccaaggaaatgatgaatggcagtgttgaaaatttccttgctgctttccccaaggctaccgctgcagcttgcaaaaaagaggcagaagattattttactgccatgcttggaaattttaaaaccggaaagctaacggttaaaaatgtaaaagtagtcccgaatgaatatcttaaggacgaaaaaatagcagagataagttattctgtgagtttccttgtcccatcaaaattaacacccggaccaaaaggtgatctcaataaaataaaaccggaagaactgaaaaaatatttgattcaggctgcccaggacttcaaaaatgcggataaaactgtaaccactgaacagaattttaatctttacgaattgaaggaaggagggaaaatatattattggaacggcagcccggatgaaattgttaccaatctcaccgatttctattttgaaagcttcggagcaaatgaatagttggaaaatacacctataaagaatgaaagtccccgtttaaagggactttttttatttcacatactttacgtatttttgagaaaaccgatcagtatgaattttaaacctatattgttaactgctggagtattgttttcagcatctttttattctcagaaaatgaattatcctaaagcattaaaaggaagccagacagatacctatttcggaacagctgtttcggaccctttcagagatctggaaaatgattctgaagccactaaaaaatgggtagatgaagaagttgcttacagtcagaattacctgtctaaaattccgttcagagacaaaattaaaaaccaattgaaagatatctggaattatgaaaagatttcagccccgttcaaagaaggagattatacctattacacaaaaaatgacgggcttcaggcacaggctgtgtactatagaaccaataataaaaccaaggcaacagaagttttcttagatccaaataaattctcagaaaaaggaaccacttctctttccaatctttctttcaataaaaaagggaatcttgcggcatattccatttcagaaggaggcagtgactggaacaagataatcattattgatgcggtgaccaaaaaacagattgatgaaacactgctggatgtgaaattcagtgggatttcatggcagggagatgaagggttctactactcaagttatgacaagccaaaagaaggaaccgtactttccggaatgactgataagcataaagtatactttcataagctgggtacaaaacagtctgaagatcaattaatctttggaggtgataaaacgccaagaagatatctgagcgcaggagtttctgaagatcagagatatcttatcatttctgcggcgaatgctaccaatggtaatgaactgtatatcaaagacctgaaaaaaggaggagattttgtacagattataagcggatttgatatcaatgcaagcattgtagatacacaaggcgatgatctttttatttttaccgataaagatgctccgaatatgcgtctggtaaaaacaacaataagcaatcctgctccctcaacgtggaaagatgtgattccgcagactgaaaatgtattgggaatttcttccggcggaggatatttctttgcaacatacatgattgatgcaatagaccaggtgaagcaatttgataaaaccggaaaactgatcagagaaatttcacttccaggtaaaggaaacgtttcaggattcggaggaaaagaaaaggagaaagatatttattattctttcagcaattatattacaccgggaaccacttataaattcaatgtagattcaggaaagtctgaagtatatcagaagcctaaagtgaaatttaatccggacgattatgtttcagagcaggtattctatacctcaaaggatggcacaaaagttcctatgatgatcaattataagaaaggaactaaacttgatggtaaaaatcctactatcctgtattcttacggaggtttcaatatcagtttacaaccttcattctctgtagtcaatgcgatctggatggaaaatgggggtatctatgccgttccaaacatccgaggaggaggtgagtatggtaagaaatggcatgatgcaggaacgaagcagcagaaaaaaaatgtttttgaagactttatcgctgccggagaataccttcagaataaaggctatacttcaaaacaatatatggccctttcaggaaggtcaaacggaggattactggtaggggcaaccatgacgatgcgtccggatctggcaagagtagccttcccgggagtaggcgttttagatatgttgaggtataataaatttacggctggtgctggctggtcttacgattacggtactgcagaggacagcaaagaaatgttcgaataccttaaatcatattctccggtacacaatgtaaaagcaggaacttgttatccatcaacaatgattatcacgagtgatcatgacgacagggtagtgccggcacattcattcaaattcggagccgagcttcaggaaaaacaggcatgtaaaaaccctattttgctgagaattgaaaagaacgcaggtcacggagcaggaagatcaacagatcaggtaatcagtgaaaatgcagatcttatatcattcgctttgtatgagatgggaataatgaaatagatatttaaaaatatttcaataaaaaggccgggcattgcccggccttttttatttctactaaatgtaagaaaaacaggatgttaacataagtttcatgtttcgttcaaaaaaattaactttacggagacaaaattaattggaatgcgaaagacaatttctgtgaaaaaaccggattttagtgtatcacctcaggaaagagagatttacaactttgaaaaagacggtcttgaactcaaatcatcctatgagagaaaagatataaaagatgaatcattaacacagacttctccgggaattgaaccttacctgagaggaccgtattctacgatgtatgtacagaaaccgtggacaatccgccagtatgcaggattttctactgctgaagaatccaacgctttttacagaagaaatcttgctgcaggtcagaaagggctttcagtggcatttgacctggcaacgcacagaggatatgactctgatcactcaagagtggtaggagacgtaggaaaggcaggagttgccattgattctgtggaagacatgaaaatccttttcaatgaaattccgttagatcagatttcagtatccatgactatgaatggtgctgtacttcctattttgtctttctatatcgttgccgcagaagagcagggtgtaaagcaggaacagctttcaggaaccattcagaatgatattctgaaagaattcatggtaagaaatacctacatctatccgccggcaccttccatgaagatcattgcagatatctttgaatatacttcgcaaaatattccaaaattcaattctatctctatctccgggtaccatatgcaggaagcaggggccactcccgtactggaaatggcatacacgctggcagacggccttgaatatgtaagaacaggaatcaaagcaggaatgaatgttgacgatttcgcaccaaggttatcattcttctgggccatcgggatgaaccattttatggaaattgctaaaatgcgtgccgcaagatacatctgggcaactcttttaaaacagtttaatcctcagaatccgaaatcgctggcactgagaacccattctcaaacttccggatggtctctgacggaacaggaaccttttaataatatcacaagaacagccattgaagctttgtcttcagcattaggaggaacgcagtctctacataccaatgcactggatgaagccattgctcttcctacagattattcagcgaaaattgcgagaaacacacagatcattcttcagcaggaaagcgggatatgtgatgtggtagatccgatgggaggaagcaatcttgtagaaagccttacccagcagatgattgaagaagcgatgaggtacattgatgaagtagaacaggaagggggaatgaccaaagctatcgaagccggaattccaaaaatgagaattgaagaagctgctgccaaaaaacaagctaagattgacagtggtgaagaattcattattggtgtgaactcattcaaatcctcattaaaacaggaccagatagaaatcttagacattgataataccgaagtccgaagaaaacagatcgaaagactgaatacaatcaaagcagaaagaaatactcaagctgttgagcagatcctgaatgagatccgtgaaagcgccaaaacaggaaaaggaaaccttctggcattatgcatcgaagcagcaagaagaagagttacccttggcgaaatgagtgatgccatggaagaaacctttggaagatataaagcaaatattaaaacaatctctggtgtatacgcaatgaatgccggtaaaaacgaatactttgaaaaagcgcttcaactgactcagaaatttgaagaagaagaaggacgtcgcccaagactgatggttgccaaaatgggccaggatggacacgacagaggtgcaaaagtagtagcaacagcatttgcggatatgggatttgacgtagatgtcgctccgctattccagacaccggaagaagtcgctaaacaggccgtggaaaacgatattcacattttgggagtttcttcattggccgcaggacacaaaacattagttccgcaagttgtggaagaattggctaaactgggagcggatgatatcacgatcgttgtaggaggagtaatccctcagcaggattatgaattcctgtatgccaacggtgcagattttattttcggacccggaaccaaccttccgaaatgtgctgtggaaatcttggaaaaatttctaaattaattcttagtaaagaataacttgcatggcttttgtatagtttaatgaaaaaatttcattatggcttatacagtagtttcagtatttccggtgactgtagatacagaggaaattaaaaaaggattaaaacaaaaaggctttgacgaagcgaacatcattatttcaaagtcaagagtagaaagtggaatgtctgctgatcagtatcaggaagataaacagacgcaggatttttttgactatgttttcgctcacgatgcggaaatgttggacgcttaccgcaaacacagcgtaggcagaagcaatgttattgtttataccgatgatcttgaacgggcaaaaactgccaaagaagtattaaatgaatatggagctcttgaagtttatcgcagaccttcagaaaaaagagacagcattccggacggtatgactgagcatgaatataatggaatcattgccaaagcaagacataatatctacttcctcggatcagaaagagtatatcattccaatcaggtaaaaggaatggatgacgaaatggatagtttaggctcaaaagattaatttttacaataaattataaggttgattattttttaatcagccttttttactgaaaaaaaatttgattatcagaaaaatttatatatttgcacctgaaaatcaagtttaaccaataaaaaacaacgaagcaatgttcagaactaagcagaattctacagttggattgccacttatggtggtaaggcttcgcggtttggtacattcttagaataacagtacaatgaaatatcaaaacccgaagtcgtagagatttcgggtttttaattgcgcaatatttcaaacttcacgtttccccgaaatcttttttagtgtcattaaggacaaaataggaggaggtacattcctcagaactattaagtctattattaatccattcaactaatattttagttgattaaaagttgtgtgagataaaaataattaagtttctataatctcacatcatacttctgtcaacaatggaaaatgataaccttctgtatttccgcctgagaagcgtgagaagcagaaaaagaacaattagaaaagatgtagaaaagcagataagaaaaaaatatcgacgtagtaatgaactttgggaaatcagacgaaatatcccatggattcctttgggtaagccttatcaaagaggatttgtaagattctttgtggtaagggaagatgtcatgagatctaaagacggagatttctttgaaggaatattgaagaaaattaatacctacatgtattcggaaagccgccggtttttgaaaaagaaaagaaaatttgggcggagaatatatgtagaaagagtacagaaactccagcatatttcttcatattcctggaatgaccccaagctaggacttacagcaagagaaagacagtattttttgagacaggaagaatattgtccggcccggaagtcttatgttccttattacgaatttattgaaccctggagatttatcctgcgtataagacctaatatgatcacccattataaacctgtagattttgaattggaaaaagaatgcgcagaactagacgattatttatggcagcataaaattgtaggaattatcaacaaaaaaatgtatggtaagtcatcttcatggaaaagaaaaagagaagatatttcacttatcgaaagcaggaaatatgttacctgcacaatgtctgcaacagagattgcagaaagcttacaggacgtataagtccgactgttatttaaaacaaaaaacaatgggaaatttaaaactaaaaggaaaagatatattaaaactgggctatccaaataaccaaagcgtaaacgtagcattggaagtcatgagaagaaattttgcaaccaaaaatattcaccatgtaaaatctcttttaaaggaaatcctgctgaatccggagagctttgaaaaagatctcaccttcgggcaaattgcagaaaccctgctttcgtcaaaaaaaacagaaaagagaatgctgaattcacagcgtgccccgtttcagatttttggaaacaacatttcggaagaggcaaaaaaccagctatacacagctttaaaactgcctgtttctactcagggagcattaatgccggatgcccacagcggatatggtcttccgataggaggggttctggcggtggaaaatgcagtaatcccttacggagtaggaatggacattggctgcagaatgagcctcagtattttggatacaccggtatcatatcttgaaggagcaagggataaatatgaaaaagctcttgctgaacatacaaaattcgggatgtatgaaacgcataaatctcacatagatcatgagattttcgagagggatacatttgatatgattccgatcctaagaagattaaaaggaaaagcggtcaaacagatgggatcctcgggcggcggaaatcactttgtagaattcggggaagtggaaatcactgaagaagacgaacaaattggtctcccaaaaggaaaatatctgggaatactttctcacagtggctcaagaggattgggagcagagattgcccaatattactcaagaatggctgtagaacagtgcccgttgccaaaagaagctcaaaatttcgcctggcttgatctgagtacccatctgggattggaatactggacagccatgaatcttgccggagattatgcttcagcctgtcatgatgatattcacagaaggctcgttaaagctgttggtggaagagtaaaagccagaattgagaaccatcacaattttgcatggaaagaaatccataatggaaaagaagtgattgttcaccgcaaaggagcaacacctgccaatgaagatgaattgggaatgattccgggatccatgacagcgaaaggatttattgtccgtggaaaaggaaatccggaatccctcaattctgcatcacatggagctggaagagcacattcaagaggagagtgcagaagtcttttcacccagcatgacatcaaaaaggaactgaagctgaaaaatgtcaccctgatgggcggaaatgcagaggaagcaccaatggcctacaaagacatcaatgaagtgatgaatgcacaaagcgaactggtagatgtcctgggaaccttccagccgcgaattgtgagaatggacaggtagccaacctgatattttacaaccttacaggtttcgaaaacctgtaaggtttaataaataaaatatttaaaaacaaaaaaatgggagcaccacataacataaaaagatacggtgaagtctggccggaattcagaatccggtttggacttgaaattttagataaattaaaagataaagtcattatatcaggtggctgggcatggcattttatgtctgaaacaggacatacagaatataagcatgctcatgaccataaggatattgatgtttttgtaaaaaaagaaaatgtagcagatgttgttatcatccttcaggaagaaggctttcagaaagtctggacccggtatgatcatctgcccagtgaagagaacttccgcaggtatgaaaaaacggtagagcttgaaaatgataaattccacagaatcaccatagatttttttgaaagaaatgatcttgaaaccataaacgctaatggttttaccattgtgaaacctgatattttactttcattttacagaaatattcactccagtgacaagtgctgggcagtgatggctgcaaaagatttattacaaaagggaataaatcctgttggacaccccttattaagcaaaatgcctatataaaaatggaaaaaattatacagatcacttcaggaagaggtcctttggaatgccagtgggtagccgccaaagttctgaagacctttcttgaagaggccaaacaaaatacaatagaatacgaaatcattcatcgtgaaaacggtgatgaaaacctgacattaaaatctgtgactatccttttgaaaggaagagaaataaatcttttcttaaaaaactggttgggaactgtatgctggacaggaaaaagtacattcagaaaactgcataaaagaagcaattggtttatcggggtctttgaactggaaaatgtaaaaatgattgatttcaatgaaagagatatcaggtttcagacagcgcgaagccagggtagtggagggcaaaatgtaaacaaggtgaataccgctgtgcgggctacccacattcccactaatgaaacggtctttgtacaggattcccgttcacagctggagaataaaaaacgatccgttatcagacttaaagaaaaggtaatggccgtttatatccaacagctggaaagaaagatgaaagatacatggtcccttcagatgcaggtagaacgtggaaatccggtccgtacattttccgggacggattttaaaaagaattatgaagacaggacattcaaaaaacaaaggaatgccttgaaaaacgaacttaaaaactatagaaatgaccttaactaaaagtaaatattattttgaagcattagactactttccattcaacctttctgaatgtattgatgcgctgaactatgcgttatcttatgaaccagaagatgcagacagcctctgtctgatgggaagagtatattccgaagaattaaaagattatgaaacggcaaagaaatatttcgatgaagcgatgcagaataatattggaaatgtcaatactcccaagtattatattgaatgtctcctgaataatgaagattatgaagaagccggaaaattaattgaatttgccctgaaactaaaaggaattgacaaatcagaaattctgaattgccgatcccttatgcaggaaagaaactttgagtataaacaggctttagttactcttaaagaagccaaaaaatttgcttatagcagagcagcgctggatgtacttgaagaaagagaaaaattaatcaaaggaaaagtaacacggtcaagaacagtaaagaaagcagagtaatctgccggacttcatactaaaaaaataagctttctattgaaagcttattttttatttacagaaatcagataatcgtacaccatttgatgttggtcatccgtcagcttggcttttggagccattctgcttaacgtattgatccatcctttgtcatcatgcttcgtaggttccggcagtttatgacattttgcacaggaattttcgaagatcgtttttccttgcgccaattgctcagatgaggtatactttggccctgttacagccacactttttggtccgcatgataccagaaatgctgatgttgcgaaaccggctaagatgatttttttcatactatttttgtttgttgattacttcttcacagaaacaatatagtcataaacccattgatgctgttcatccgtcagtttagcttttggcgccatcgaattcatgattcctacccattgtacagggttatgtgaagcaggatccggtaatttatggcatcttccgcaggaattttcaaaaatggttttcccctgagcaatctgttctgcagtagacgttgcagcgcctgtagtagcagtggatgtagcagctttcggcgtacaggaaaccagcagaatagcagttaacgaagccacagcaataagttttttcatgtttcttttttgatatataacaaatgtaataaattccttaagccgttgatacagggtgttgtagttttaatttagaagaaataaaaattgaactgatgaagaatcgtcagtgtcagatcaggcaattgatgccttttgtcctgtcattatgaggcagctattgatcattcccattttaattattaattttgaaacaatgaaattttctacagaagagctaatagacggaatacagtcaggaaacaaacgcctgattgcaaaagctattacattggttgaaagtaaaaaagcagaacacagagtacaggcagaggagcttctgaagaagattatgccccttaccggaaactctgtgagggtaggagtcaccggagttccgggagctggaaaatccacttttatagaaaatttcggaaggttggctattgcccagggaaaaaaagtagctgttttggctattgatcccagctcggcaatcaacaaaggaagtattctaggggataagaccagaatggaagagcttgccaaagaagaaaatgcctttatacgtccttccccaagttcaggctttttgggcggagtagccaatactacttttgaaaccatgatgatctgtgaggccgcagggtatgattatattttaatagaaaccgttggagtaggacaatcagaagtactggttgccgatattaccgatgttttcttattccttaaaatcattggaggaggagacgagcttcagggcataaagcgtggcatcatggaaatggtagacgttattttcatcaataaggtagaccgggacaatcttcagaaagcaaaaaatacaagacttgaattaaaaagagctttagactttattcctccaaaagaaaaaggatggaaaatccctgttttattaggctcagcccttcacaatgaggggttgcaggaagtttatgataaaatttatgagtttattgatctgaaaaagaagagcggccgttttgatgaaatccgtgttcagcaggctgaaaaacgcttcgagtattgggtgcaggaatatattttgtcactcatgaaaaagagcaatgctgtagaagaagcttaccatatgcacaaaaaaaatgcttcagcgatggtttccaatccaagtaccgaagcaaaattatttgttgaaaaatttttatctaatgaaaacagagactaaggtttgtccttttcctgtttaacctcagttttagagatataaccatcataagaaataggctgcctgtcattacttctcatagaaacaaaagctttaccgtttttaaagatctcaatattgatttcatcaacagttcttacatcttttggcttgaactttaaagtccattttccctttttattctgagttttagttactgtaaaatcttttgaagtaaatcggtagctgttatcacttgtatttccataagttgggttgaacagtcttccgaaataaggcagaactacatcaagcgtatttttactgacatcaatggtataatccccattcagattaagcattctcgttgcagtagcattaggcattgaattcatgacattaataacatcataattcgtaggattggctctttgtgcatagaaggtaaactcctgtgaatcaaccaaagcactcaccattttcggatctgaagccccctgtgacgcgcagctctgaaagagaaacaggaatccaaaaatcatcagtaaagaaatatactttttcataatgagataattattaaatttaaacagcaaaatgtatgcaaatatattctttccggaatattttggaataaaaattgttaaggttgaattattaacactcaaactatgaaagttacacatctatttggaataggagctattgctctgtcggctgttgcctgtactacaaacccgattacaggaaggtcttctttacagctggccaacaattcggaaattttaacaatgtcttcacaggaatacagaacgacattgtctaaaggtaaagtaattaccggtacggcagatgcaaagagagtggtaaatgtaggaaacagaattaaaaatgcagcagaaagatattatcagagtattggaagatcagcagatcttgccaactacagctgggaatttaatctgttgcagagcaacgagctgaacgcctggtgtatgcctggcggtaaagtagcggtttataccggaatattaccgataacaaaagacgataacggccttgcagtagtaatgggacatgaggtctcccatgcactggcaggtcacggaaacgaaagaatttctcaggcaatggtagctcagtacggaggtgctatcctgggaggaactatctccaatgcacaatgggccagcgttttccagaaggtatatcctatcgggtcacaggtggctttgctgaaatatggaagaggacaggaatctgaggcagatgaaatgggactttacctgatgtctatggccggatatgatccgagagcagccattcctttctggaacagaatggaagccgcttcttcaggagcaagacagcctgaattcttatctacccacccaagtccggaaacaagaatttcagatatcaataaagatcttccgaaagctttggaatactataaggctgcgggaggaaaattataattagaattttaatcttgagtaaggccttattaaatttttagtaaatttggtaaggcttttttatataaccactaaacacaatattatgaagagtttatcaattaccggacttatacttctggctgtttctgcattacttttctatttaacaactgattttgccgtagagcagataaaaatttctcacattatgggaatgatggctggtgtcggcattgggcttatcatcggaggaatggttggatatgtaagtaaaggaagcgctatcagagcggaacagaagaaaaaagaattcaagcaactgcagaaagacaaagaagagcttgaaaaaaaggctgcagaaattgcaaagcgtcaggctgaacttgaagaacaaaataaaaaccctcaaatataaaatctgagggtttaaagttgttattttcgatatcaaattaaaatttatatcctaaacctaccataaacaggttaggtctgttatcatatctgatttccgaaccggaaaccttgttgataaaatttctctgatctttactgaaagcgccttcatatttagcatttacaataagctttttgatttcaagctgagcaccaaactggtaccctactgtaaagtcatttttggcattttctttaaaatcgttgtaagtattgtctttatttaagttaaaacttcccacaggacctacaaaaacacccagcatatttcccagaaggttatatcctaaaagaaccggcacatcaatacggttgctttttacatcaaatgtagtattttctgtagtaaactcatttttaaaatgtgtatagtagatttccggcatcacaaacagggatgtaggaaggcccacttttaatgaaagtcccacattgaaccctacattgtttttaccagtcccctggatagcatcattcactgttcctttgatgttagaccaggaaggagagcctgttggaaaaattaagttagctttacccgccagtgaaatctgtgcagaagcccacattgaaaaccctaataacgctatactaagtacctttttcattatcgtctatttttgtatttgtcgtttcaatcgttttgttattctcaagtaaatattctctcagctccttaaacagttctgaagaataaacgaagtcaatcaggtttttattgcctgcagtaatcagaatgtctttgttaccttcccattctttaattcccagtcttaggtatacaattttctcgccaattgtcattacagagttcatatcgtgggtgttgacgatggttgtggtattgtattcttttgtgatttcatacagaagatcatctattaccttcgaggtataaggatcaagtccggaattgggctcatcacaaaacagatatttgggattattcacaatggctcttgcaatggctacccttttctgcattcctcctgaaatttcagaagggtattttttttctgctttatcaagatgtactcttcctattacttcaaaaacccttttctttttctcccggtaggtaagattggtgaacatgtcaagagggaacatgatattttcttccacagttaaagagtcaaataatgcacttccctggaatacagtcccgatttctgagcggagatgctgcttttcatcccttgtcatagtattgatatcttttccgtcaaacaggatttcccctgatgaaggcatatatacattcaataaacttttaagaaaaacagtttttcctgagccactctgtccgatgatcaggtttacctttcctttatcaaatgaagttgaaattcccttaagtacttcaacatctccaaaacttttcttaagatcttttacctcaatcatcagcttaatattaattgggttaaaattaattcggaaatgataatgaataccattgtccacactaccgcctgtgtactggctctacctacttccagcgatcctcctttcacattgtatccgaaataagaaggtacagtagcaatgatgaaggcaaaaacagtcgttttgataaatgcataatagatgaacagattgggcatatacatttgaattcccacaatatagtcgttctctgtccagttaccggtcagaattcctgcaatatatcctccgcctataccaaatacaatactgatggcaataagaagagggttaaagagaacacaggcaacaattttagggaaaatcagaaaatttggtgagttgacccccatgatgtccagggcatcaatctgttcggaaaccctcattgttccaatactggatgcaatataggaacctactttacctgccagaatgagactgataatggttggcgaaaactccagaaccaatactgcttttgtagcatatcctacaaatgaagtaggaataggaaatgatgaagcatcaaagttattgaacatttgaatggctactacagcccccacaaatattgatgtgaagactacaagcccgaaagaatttactcccaaatcattaatttctctcatgaacagcttccagaaaaccctcattttctgaggtttctgcagggattttcctaagaggataatgtactcccctaccgctgtgaaaaacttttttaacatactgctaaattagacttttttatttaattgggctagagtcagggataagactagagcctggttttgtgttaaaatttattctaccgtaacctggtctgttttcttattttgcatttttatctcctccgatgaccaaaaaagtagtttttaaaataatgaccagatcaagtacaaaactccagtttcttacataaaaagcatcggccagaactcttttcttcatctctacttccacatctccgaggtcaccacgcagtccgtttacctgtgccagtcctgtaatgcccggactaaccatacttcttaagctgtatcttccgatttttggtttataataattgtcaaccgacaacatgtgcgggcggggacctaccacagacatttctcctttcagaacattaataaactgaggaagttcatcaaggctggtttttcttaaaaatttccccactctggtgatcctggagtcattcaatgatgtggttttggtggtagattcatcattgacaaccattgttctgaatttgatacaattaaaaacttcttcgtgaaagccatatcttttctgaagaaaaaaaacaggtcctttggaagtagttttgattaaaatggcaataatagggaagagccatgaacagataaaaaccaaaataataacagaaaagacaatgtcaaacgttcttttcatcagataattagaataataatccagcggataccgggcctggttaagtaccggctgagtctgtatatatccaagatcataaaggaagaaatcactttgtgtaatacttggtatgagtgaaatatgaatcttgttatcttctgccagtttaaaaatttcgttttccatgttttcatcatacgagttttccattgataaaaacaaggtatgaatcccgttctttttccagaaagcgattaattcattgaggttaagctcagtatgtccgtattcaaatattctgtatccataatctttacgctcagtaaaaatattcttgagaatttctgtggaatggctgtcccccaaaaacatgacattcctgtaattggctccaagggatcgtatatacttgatggcgaaatagatcaaggatttcaccaaaaagatgaaaataaaaaggtaaagtgaaagccagtaaatatccgaattgaaaaatacatttttactaacctttcctataagcagaacaccaagtataaaaaaaaggaaatgaattaaaagacgttcaagaaacaaggtataggtaaggttcctcggaatattgtatatttttgttctgccgctcagaagcacccagaataaaaacaacagaatcagagaaaaaatattctgataccaggtttctctatggtattttaaattttcgtttctggttataaaaaagaatatgaagatagatgcaataaccatgaggtcaagcaacataatgatcgatttcaggtatctagagtatcgaattctctgcatctatcggtattatagcgaataacaccagctaatttacacttttttacgggatattcagatatttgtgagtctgaacagaagcctgccattcggggtgttccaggatgaaatctgtgatcttcggatacatgtcatttctcttgctccattcgctctgaagataaagcttacagttttcagaaacttttgccgcctgctcctgagcaaacgtaaaatcatgctgattgaaaataattactttaagctcattggccttttgataaatttcttctttcggaagacctgttttcttcggtgaaagagtaatccaatccagatgtccgctcataggataggctcctgaagtctcaatatggatcgtacatcccaattctttcagtttggatgtcaggatgtccagattccacattaaaggctcaccgccggtcaacacgattgttttacagtgtctggcagccgtttctgcaatttcttctgcattcataagagggtgaagctcagggtcccagctttctttcacatcacaccagtgacatcctacatcacaacctcccagcctgataaaataggctgcttttccggtatgtgccccttctccctgtaaagtgtaaaaatgctccatcacagggagcattttaccttcttttaataaaatatcttcttctttattcattttaaaattagtcgttatagaccgaagttttgtaagcaatgatggtatttttcatcaacattgctctcgtcattgggcctacacctccaggtaccggagtgatccagcttgcttttgctgcacagctgtcaaaatccacatcacctgcaaggtaatatccttttggagagtcgttgtctactcttgtaatacccacatcaataattacggctccttccttgatcatgtctccttttaagaagtgaggatctcctaaagcggtaattacgatgtctgctttcttcgtatattcttcgatgtcttttgtatatgagtgtgtaagggtaacggtagagtttccagggaaatcctttcttcccataagaatactcatcggtcttcctacaattttacttcttccgataattacacagtcttttccttttgtttcaatattatatctttccaataatgttaaaatcccgaaaggcgttgccggtaagaaagtatccatctcaagggccattttcccgaaattttcagggtggaaaccatccacatcttttctcggatcaattgcattgatgatcttctcctggtcaatctgatccggtaaaggcagctgaacgataaatccgtctactgctttagacttgttaagctcgtcaatcttttccaatagttcagattcagaaactgtgcttggaaatttgattaagctggattgaaatcctacttcttcacagtctttcactttggagtttacataagccttgcttgctccgttatttcctacaagaatagccaccagatgcggtgctcttcttttgctttccagaatcttttctacttcaaccttgatctccgctttaatttccttggatactttaagtccgtcaagaatttctgccatttttacttttttactttatagatttacttttactttcttttttacttactatttgtttttcttatagtaattgatcaatccgttggtagaactgtcgtgagagcttattgtttcattattctcaagctcaggaaggattttattggctaatacttttcctaattccactccaaactggtcaaagctgaaaatattccagattacaccctgaacaaaaattttatgctcatataaagcaatcagttgtcctagtgaaaaaggagttaattctttgaataatatagagttagttggcgtatttccgtggaagactttaaaattgataagtctgtctatttcctcatcagatttacctgcatttctaagttcttcctccacttcttcttccagttttccgaaggcaagtgcttcagtctgagcgaaaaagttggccaataatttatcctgatgatcagaaacatgattcgggcttttagcataagcaataaaatctgccggaatcaattctgttccctggtgaatcaattgatagaatgcgtgctgtccgtttgttcccggctctccccaaatgataggtcccgtttcatattctacgaattcaccgtttctgtcaacacattttccgttactttccatatctccctgctgaaaatacgctgcaaatctgtcaagatattgggaataaggaagaattgcgtaagtagttgctgcatagaaattacgataccagattcctaaaagacccattaatacaggaatattttcagagaattctgctgtctggaagtgctggtcagtatcataagcacccctcaaaagctgttcaaagttttcgtatcctacagaaagaacaatacttaatccgatagcgctccaaagagaatatcttccgccaacccaatcccagaattcaaaaatattttcttctgcgattccgaatttcttaacttcttcaatattggtagataaagcaacaaaatgcttcgccacatcttcctgttttcccgacttcaggaaccagtctttcgctgaatgcgcattcgtcatcgtttcctgggttgtaaaggtcttggaagcaatgatgaataaagtggtctccggattcagatttttcaccacttctgcaatatgatttccgtccacgttggaaacaaagtgagcgtttagtcttgttttaaaatgctttaacgctgaacaaaccatcacaggacccaaatctgaccctccgataccgatattgactacatctgtgatctctttgccgctgaaacctttatgctctcctgaaataattttttcagaaaaagatttcatatgctcaagcactcttttgatctgtggtttgatgttttctccatccacaaggatttcacggtcagaaaaatctctcaatgctgtgtgcaacaccgctcttccttctgtttcattgatcttatctccggagaacattttggaaatggcatctttcagctggcattcttctgccagttgtaataaaagatcttttgttcttgagtcaattaaatttttggaataatcaaaaaggtagttgtccttttgcagggaaaactcattaaaacggttcgggttatactggaaaagagttctaaggtcaaagtcatttccaccgaagtgctcgtcaagtgctttccagctgttggtttgtgttggatttatttttgatagcatattacagaatttttatcattcagaagatcatgtattggatgaaaattgctaataatccataatgatttatttctgatttgcaaatttacggaaaaataaaacctcagataaatttgaagatgataaataacaattttttaaaaaaacaaaaccccggagatactctgaggtcttatgacaagtcttttatgatgggcgccgggcattattcatccatttcattcagaatattttccaactgtttagcgcttcttccatagatgtattttgtccacagaacaatgcttataatgattgccaaagttccgatcagcactaagatgatcaacccctgctgatgagaagaagtaagctctgccaatgattttccctgtttttccatcgcattataaataatcaggcctgccgttaccagaaaatgagggagcagtaaaaatccgaatgactggtatcgttccatattcaggcgcacctcatgatatattttccagaggctgtttttcgtgtttcctgtataaagctctgtctctctgtaaaatttataaaatccagacagatagtaagacgatatgacaaccattaccgtataggaaacataataaataatgtactgtgaagacggaaactgaaattgaagaggaaacaagccaatgataatgatggcaagaatctgcatgggaaattctcttttcatatttttctgaatcttttctatcgggtgtttactttcctttaattgctttatgctgtcaggaatatggacatcgctgttttctttattccactgttcttttaattcatcaaaattcatagcctgatttttttatgatttgctgtattttttcttttgttctgctaagtttcacgcgggcattgccttcactgagtcccagattgtttccgatttctttatgtgacattccttccatgaaataaaatatgacggctttttccagaggattaagttcctgaacagcgctgtagaaaatttccagctgcctgtctttggcagggttgtaatcttcctgttgtacttcaaagtgatgaggaacttccgtatggctaccggatctctgtttttccttttttaaataagtaatagcggtgttgatggccacccggtacatccaggttgaaaactcactgttccctttgaagttctgataggatttccaaagctggataaggatttcctgctgaaggtcttcccggtcttctacagaatcagcatagatccgtgaggctttgtatacaatgcctttgtgccggttaacaagttttaaaaaagtagtttcagttgggttactcacaatggattcatggttgggttactgttataagtctgatatagggtttacagtgtaatttttggactaatgctgaggcctccaaattattacatttttcatagtattaatttttttgattttctgttcttttaaaaagttggtaaaacaaatgagttaatcgttacagttttttttcaaaaaaataaaaacctccccgaaagggaggctgtaaaatctaaaattatgatgataaccaattggttaggagtgttttgttattcctatattttttaatgttccggttttgaaacttttctttttcttaaaaaatagataatagcagctgcaattaataagatcggccagatgttgataagagcaactatgattctctgaatcagatagaatccgtatacaaaaccatctttagcgtcatagataaaattgtatctgtatttattgtcaatgcttgtagtattggtaacggcaatttcagcaatacgcaactggggttctttgatgtagatatcaatagtgctgtatttcagattgtctgccatattcatacttgccagcttttgggcattcccttcagacatattcccgtcatccatattcactttatctttatttgttttcagcttgctgatattttcagaggtcttttgatttcttttcccttccagttcagaatatttgatgttggcagttacatcttccgcattaatggatcttgaattaaggaataatttgttggcattgatggctgttaaaagctctcccagtttttctgtgggaatacggacctgcattgtattttccgtttggtatttttttaccagcatagcttcatcgtcggaagtattgtaagtattttcagaaaccacattactctgaagattgcttttagtaacaaaaccaccaagttcctgtacggatttttcaatagcaattgttgcattatacacatcttttacttccatattcacatccgcagttttgataaactgtttgtcttttattttcatactggctgcagatgatatactgtctgaaacaacagtgacagctgaatcagcagtggcataagcttcaagatcggaggtggtggcttctctttttttacatgaataaattcctaataaaagaacggctgacagagataatttaatgtaagtggttttcatagcgttgattttaaatgtttgcttgaaccaaagttcagtcaggatcttttgtaacgcttgaaaatcaaaagtaaaaaggttgtaaataatattttcagttttaatgaattgaaatttagtgttttgtaaaatagacttaggcttcagtcattgctttcggagcagtttttgcttatcttttacaaaccaaaactacaatctatcactatgtcaaatactttttctaaaatcagaaacgcaataggattattcacatccatagattttgatcagctgagtgccatttctcagaaagtggatctgccaaaactgatgcataatttttcaaaactggacgataaacagctttccgggttgatgaaaatgcttgatccggataagaaaaagaaagagcttcctcctattgacggggatttttatgatatctaccatacacttagtcccgaacagcgtgaaattcagctgaaagtaagagcattcatggaaaaagaagtcaaacctcttgtcaatcattactggctcagagatgaatttccttttgaactgatcccgaagttccagaaacttgatatctgtggagttacatatcaggggtatggctgcccgggaatgcctttcctgatggaaggtgtcatcgcaatggaaatggccagaattgatgcttcaattgctactttttttggagtacagtcaggtttggcaatgggttctatctatatctgcgggtcagaagaacagaagcaaaaatggcttccgcagatgcagaaatttgaaaaaattggagctttcgggcttacagagccggaagtaggttctggagcggcaggcggacttacggtaacctgcagaaaaacacctgaaggctgggtgcttaacggtcagaaaaaatggattggtaacgccacttttgctgatttggttattatctgggcaagagacctggatagcggagaagtaaaaggatttattgtagaaaaagataatcccggatactctgtggaaaaaatcaaagggaaaatggctttaaggattgtccagaacggattgatcaccttaaaagactgtttggtcactgaagaaaaccgtctgcagaatgccaattccttcaaagatacggggaaagtactgagaatgacgagagccggagtggcatggatggccacgggctgtgcaagaggagcttatgaaagtgcactggattataccaggaaaagagaacagtttggaagacctatcgcctcgtttcagatgattcaggggcatctggtagaaatgctgtctaatcttactgccatgcagaccatggtgttcagattatctgaaatgcaggacgaaggaattttaaaagatgaacatgcatcactggcaaaagtcttctgtacactgagaacaagagatattgtttccagagccagagaagtgatgggcggaaacggaattctgcttgaatatgatgtcgcgagatttgttgctgatgcagaagctatttattcctatgaaggaacaaaagaaatcaattcgctcatcgttggacgatcgattacaggtttcagtgcttttgtataggcaataggtagcagataacagataataggttgtaggcaatgcaacctgtaacctattacctgaaatctattatctgttacttacgaaactaagtgtttgtatttttctttattgtcaataatcatccaaaggttgatcaggaacatcactccggcaatacccattcccatcggagatttgtccaaagtgaaaacgtgagccacaattcctaccataacaggtagaataacaatggcacccagcgctctggtttttgggaaaataaacagtaatccgccaagtacttctacagtacctaccagtggcatcagccagctgatttctccaaaggcagcgaaaagtttcatttgttcaggagtaggtttctccattggcatataattaaagaacttgtttaatccggcattaataaacataagcccgaaaagtaaacataagataaattttattactttcatgattgatgattttacatcaaatgtataataaaaataggattcgttaattatatttttacaaaaaatatgcaattagtgttaatgtaaggttaacgttgtattttggataattttattgtttatatttgaaatgtattctaaactaataatattatgctgaaaaatcttaagaaattaaaccgtacaaatttgagaggaatccatgggggaattgataaatgtgatataggaccaatagactgtccatgtaaaatcccaccagggcattcttgtcttggaggtggaggaggaggtactcctgagccggataaaggatactgcccggatagccaaacttatatcctgtgtacagaaacttgtccaaatggaatgagccctttatgtgctctttcataatgaaataaaaacgactgccgtgaaaaaggtagtcgttttttatttgaagttattaattattactcattgtttattgcccattacccatattctagtccatttccttaagcgtaatattcttggaaatcttataacttttctttttcttatcaggcttctgttcttcaccgagtaatcttccccaaggtttaagatcatctactctttcacagataattttaataatggcaatggccggaatacaaaggaacattcctgcaattccccaaagatgctctcccagaagaataccgataaatgaaaataaagcattgatttttacttttgagcccactacaaatggcagaacaatatttccatctacagcatgaatagcaatataccccaaagcaacataaatacacgttgaaggagtagaagtggcaaacgctataaagcaggaaattaaaagagaaataaaaattccaagatatggaatgacgttcaataaaccggtcaaaactcctaaaagaatggcatattttactcccagaacagtaaggagagtagatgttagaatggaaacgataatcacctgaaggaacagtccgaagatgtatttcttggtcataatacggatctcattcaccgcttcctgcacgcttgctttatgtctttcattaaaaaccgtaacaatgaaattatttaaaagtcttctgtaatttaaaataaagataaaaaacagcgtgaaaaatataataaatccaaatcctgttgaaaaaattccgaaggtaaatcctaaaattacccctgaagaagataacagtttattcaagccctggttgatataatccacctgctcatccacttttacattgaaagttttggaaacccaatgctgaaggctgttaaaaacagtagtaaactgctcctgaagatgaggaagatctttactgaaatcagatagctggttggtaaagaaatagataataccacccaaaatcatcagcataatgaacacggaggtcattgtagacattgaccttggaaatcttaattttctttccataaaagtggctgccggtaaaaacagcatggccataaggaatgccaggaaaaacggagctaaaatactctggcctaatgccagaagatagccaagtccaatgatggaaaccaccacaagtgtaagcttgacaaggaaaggaagtctaagaaaattcataatctataaatgtgcagtgtggaataaaaataagaaaaaacctgcgtgaataaaaatttttattgaattctaaaggattttcttgtattgaagcaaattgtattccacaggctgggaaaattgtactttttacgttcaaacagaaacacgctctgatattcagaacgtgtttcattattgagaagttgatatgttataagttgttttattcttcgatagcgatgtctatgacttcctccattctgttgacgtaatgcactctcagatttttcagataatcctttttgatttcttctacatcttttctgttggcttcacaaagaataacatctttgattcctgctcttgttgctgcaagaagtttttctttgattccgcctacaggaagtacttttcctctcagtgtaatttctcctgtcatggccaggtgaggttttaccttcttatttttaaatgaagaaaccattgaagtcagcatggcaatacctgcagatggcccgtccttaggcgttgcaccttcaggaacgtgtacgtgaatatttttcttatccaggtcttcctgtggaattcccagttcgtcatgcttcgctttaatatattcgagcgcaatagtagctgattctttcattaccgttcccagatttcctgtcattgttaatgctcctttaccattgcttaggatactttcaatataaaggatgtctcctcctacacttgtccacgcaagaccagttacaacaccgggaactccggtgatttcagataagcttttcggtcttggtaccccaagaatttcgtctactttttcaactgaaatttttggatcatattcttttagcagagcggtctgtagtgctacccatcttgcaaccgcagcaattctcttctcgagcgttcttacaccgctttccgaagtatgagcctctataatatgtttaagctctgcatttccgagtttaaatgattttgcatccagaccattttcatcctgttgttttttgatcaaatgtcttttggcaatctcaattttttcctccagcgtataaccggcaatctgaatgatctccgttctgtccagaagaggagtctgtattgttgaaagtgagttggctgtagcaatgaacattacttttgacaaatcataacccatttcgaggaagttgtcgtagaaggatttattctgttcaggatcaagaacttccagtagtgctgagctagggtctccatgaagtccctgtccgatcttatcaatctcatcaagaacaataaccggatttgaagtaccggattttttgatagactgtaaaattctgcccgccatagctccgatataggtctttctgtgtccgcggatttcgctctcatcgtgcagaccgcctaaggataatcttacatattttcttcctaaagcgtctgcaatagatttccctaaagaagtcttaccaacacccggaggacctaccaataacagaataggagacttcatattgtttttcaattttaaaacagccatgtgctccaggattcttttcttaatgtcttccagtccgaaatgcgctttatcaagcactttttcagcttttgcgatgtcaaaaatatcttttgtataggtttcccacggaagatctgtaaagaaatccagataatttctctgtacgttatagtccggtgaattaggattctgacgctgaagtctgctgatttctttctgaaaatgttcttctacttccttgctccattttttggttttagcttttgcaataagatcttcaacatcactttcaggtcctccacccagttcttcctgaatggttctgatctgctgattcagaaaatattctctttgctgcttatccaggtcttttgaagttttctggtgaatctggtttctcagttccagctttctgaaatcttcatgcatcatttcatagcactggttagccctcgtcatcagacttttctcttcaagaagtttttgcttcgctactgaagagaaattagcattggtacagatgaaattcagaagatcatcattattgttaatatttttgatcgcgaagttagctgcattaggaatattaggatccagctcaatgatttttaaagcaaggtccttgatgttctccagcaatgcttcatactcttcctgatctttaggacgggtatcctttaattttgatatttctgctttgaaataaggctggttgtcaacaattttcttgatcttaaaccggtgaaaacccttggtgatagcagtaatattaccttccggaagcttaataatcttaatgatttttgctaatgtcccgacggtataaatatctttttcggaaggctgctccaggtccgaatttttctggcttacaattccaatgaaatctccgttcttctgtgcttcctcaagaagctgtattgatgtctttcttcctgcggtaataggaattaccacgttggggaacattaccatatttcttacaggaaggatagggaatattttttgttcggaatttttatcagtctctgcgaaatctgaaagattgatttcttcagtcacgatatcaaatccgtcactaatcatttcttctaaactaatatcttcaaattctgtcatagtcaatcgaatgacaaattgtcattttcgtttttatcgttaaagggaatttttacaatatacactgaaaacgtgtggcatattataatattctaaaaatgcacaatacttatgccatttgttttttacttaaaaatacggtcaaaatttcctttttcagataatctttgcattaaaaatcaaaataaagcagttctgtttctgtaatttcttaaaaatgtgtattttcgcaaactgataaaaaactataatttataaaatggcaattttaggacagattaggagtaagccttggcttttaatgggagtaatagccttagcgcttttagcgtttttggtgaacccggatagtatcgacaaggtttttggtaagaatcctgatgttttaggaaaagtaaatggtgagaaaatcacccgcgaagagttcaatgatcagcttttcgtgttgcagcagcaggctgaacagcaaggtcgtccaaaaaacggtcttgaagagcaggcatggcagttacttgtacaatctaaacttatcaaacaacagtttgagaagctgggctttgaaatgactgatgattatttctggaaccaaatccagtatgatcagatgtttgctcagaatcagcagttctttgatgagaaaggtaactttaaaactcaagagcttaaaaaagaaattgaaacattacaaaacaccaaccctcagggatatgctcaatggctgaaaaccagaaaaacaattgagtacagactgatggcaagacaggtgtttactaatctttcagcaggtatcactacaggtaagaaagaagctgaggaactgatgaagcagagagatcagcttgcagatatcgactttgtgaaagtggattatgcagcatatcttcaaaaaacaaagatcaatgtgactacacaagatcttgctgattacatcaaacagcatcctgtaatgttcaaagctgagccaagcagaaatataggtattgtatttttcccttccaagcctagtgcagcagatgatgcagcagccttgaaagaaattacaaaattgtattcaggaggtacagatgcaagcggaggtactgaaaacttccagaatactaaaaatgactcaatgtttgtaactgcaaactctgatgcgccattcaatcctcagtatctgaacccagctcaattgcctccaacgatcaaagatcagattacttcagcagcagtaggtcagacttttggtccttataaagaacaagatgtttatgtagtctctaaactggtaggtaaaagaccttcagattctacattatcaagacatatccttattgcattcaaaggaagccctgcaggggaaggggtaacaagaaccaaagaacaggctaagaaattggccgactccatcggtgctattgtaaaagctactcctgctaaatttacagaattccttaagctttccagcgatccgaattctgcagctcaggggggtagccttggatggacaactccggaaacacctttcgttcctgaattccttgcttaccttgccaataatcctaaaggagcaacaggggtagtagaaactcagttcggttatcatatcatcaatattgaggataagaaatcaggatcaatggggtataaagttgccaaccttgtaaaagcaattaaaccttcagatgctactgaggctgaaacagacaaaaaatctagaaaattcattcaacaggttcaggggaaatctttcaacgatttcgtgaatattgccaagaaaaataattaccagttctctaatccaaaagcggctaaaagatttgaaggtcagcttcagggcttaggtactgaaaaagatgcagatatccttacatgggctttcgataagaaaagaacaaaaggagatactgaattatttacagtagacggaacaggtgataaaattgtagtttatctgaacggaaaacaggaggcaggtcttgctgaccctgaatctgtaagagatcagattgaagttatcgttaaaaataaactggcagcaaaacaaatttctgaaaaaattgcagcagcaaaagcttcaaatttagatcagattgctaaattatttgcggctccaaaacaatcagctcaggtgaacttgttgaacccttcagtagctggtgctatggaacctaaagttgccggtgcagcattcggtgttgcaaaaggtaaactttctaacccggttgaaggtggaacaggagtttatgttctgatcaaaaaatcagaaacagtgaacaagcagcctggagatcttaagcagtttacagaatctcttacacagagaagtgcaggaatgttcggacaggcttggatgaaaagccttcaggacaatgcagatattgaagattacagaatcgagatctggaacaagctgggaaatcagcaacaataagaaattcatttcaatgatataaaaagcgacaaatttttttgtcgctttttttgtatttaacgcagaataataaaggaaaagatttatttaaaatgtattatatttgcttattagaaaaaaattagcaagtgaagttcagtaaagaattaaaagctggtgtgatcgcacttctagctatcgtaggctttgtggtattgtttcagtttatgaaagggaaaagcctttttactaccgacaatatattttacgcaaaatatgacaatgtagaaggtctggcgcagtctgcggcagtttctatcaatggtcttaaagtagggcaggtagacaagattattcctgtcacctcaaaagatggaaaaattaattttgttgtaaaagttactgtcgacaataaatttgaattttcaaaaaactcatcactggagatctttgagccgggattaatgtccggtaaagaaatgagagtaaaccttatgtatggaggaccgacagcaaaagacggcgatacattgaaaggagctttcaaactgggaacgctgggaagcctttcttctcaggtaggtcctgtaaaagatcagttacaggtggttcttcatagagtagactccctgatggccaatgcaaatcaggttttcgacgctcagaacagagctgaaattaaagctttgttagcgaaccttaacaaaacggttggtgcattacaggctacagcaggaagtgtaaacaatctggtaggacataatgatccaaaactgcaaaaagtgctggatgatgcaagccttaccatgcagagcggaaaagtaacgttagataaatacggacatcttgcagaaagtattgacactaaacagttgaatgctaccattgcaagtttagatgctacagtaggaaaattgaatcaggtaattggaggtattgataaaggagaaggaagtttaggtaaactgatgaaggatgaccagctttacaacaacctgaattcagcttcttccaatctgaacacattaatcgaagatatgaaagcgaatccgaagagatatatcaacttctcggttttcggtaaaaataacaaagactaatacgccttatgcagtacatcgataacattattttcctgattttattagtagccggatttgggctgtttgccaaaagcctgcagaagatctacagaaatatcaggctgggtcgtgaaatcaatagaagtgacagaaaatctgaacgctggagcaccatggccaatgtggctatgggacagagtaagatggtaaaacgtccagttgcaggaattttacacatttttgtctatgttggttttattatcattaatatagaactcattgaaataattgttgatggactgtttggaactcatcgttttctggcctcggttttggggcacggattctacagcttctttacagctacattagaagtcctggcacttctggttgtaataggtgtcgttatatttttcatcagaagaaacttttacggggttaaaagattaacaatgaaggaacttttcggatggccgaaagaagatgccaactggattcttatcattgaatttgccctgatgatggctttctttaaaatgaatgcttcagattttattttacagtcgagaggtgttttaccagtacatggaagcttcccgatcagtgaaatgacatttgttccgtttttggaaatcttcaattttgataacggatttttgatgttcacagagaaagctgcctggtggttccactttgtagggattcttttcttcatgaactatttgtattattcaaagcatttacacattattcttgcgtttccgagtacatggtatgccaatcttgagaaaaaaggaaaattcaacaatcttgactctgtaacaaaggagatcaaattaatgatggatccaaatgcagatccttacgctgcaccggctgaaggtgcagaagctgatgtcccttcaaaatttggagctgaagatgtttttgatctgaatcaggtacaattgcttaatgcttattcatgtacagaatgcggacgttgtacttcggtgtgcccggctaatattaccggtaaaaaactttctccgagactgatcctgatgaaaaccagagaccgattggaagaagtaggaagaaacatcgataaaaacggaaaatttgtagacgacggtaaaaaactgttaaacgattatattaccaaagaagaactttgggcctgtacaacatgtaatgcatgtacagaagcctgtccggtattgcttgatccgctttccattatttttgaaatgagaagattccttgtgatggaacagtccgctgctccacaggaactgaatctgatgatgaccaacgtggaaaacaatgctgctccatggcagtacaatcaggcagaccgtctgaactgggcatcggaaaactaaataattaatcagtttgaaagtttgaaaattgatgcccgttgatatcattttcaaattctcaaattctcacattttcaaattgaaaaagaaatggatttcaatataaaaacaatggcagaatatgctgccgaaggaaaagcaccggaagttttattttgggttggatgtgcgggaagttttgacgaccgtgcaaagaaaattacaaaagccttctgcaagatattaaataaaataggagttgaatttgccgttctgggacaggaagaaagctgtaccggagatcctgcgaaaagagcaggaaacgaattcgttttccagatgatggcgcttaccaatattgaagtattgaatgcttacgaagtaaaaaaaatcgtcacggcttgtccgcattgttttaatactcttaaaaacgaatatccaagcttaggcgggcactttgaagtggttcaccatacacagttcctgaagagtctgatggaagagggaagactgaaaattgaaggaggtgcattcagagggaaaaagattaccttccatgatccatgctacctgggccgtgccaatgatgaatatgaagctccgagaatgcttcttgaaaagctggatgcagagcttgtagaaatgaaacgctgcaaaaccaatggactttgctgtggagcaggaggtgcacagatgtttaaagaacctgagaagggaaataaagacatcaatattgaaagaacagaagaagctttgtcttttgaacctaaagtaattgctacaggatgtcctttctgtaacaccatgatgacagacggggtaaaacactttaataaaaatactgaagttgccgtaaaagatatcgtagaacttcttgctgaagcagaagacttataattgtaatcctatacaggtttatgaaactgaaatggagactctcctttttgtttatcacttcgatacttgcccttcttacattctggaactatcagaacagagtctatgactgggacatgccggggtacatgggatgtatgtatacctccgagtttccgggttcaccggataaagttcggatcattacgtatgaggaaataaaaaaagaggctcctgcagagcattacacagatattatcggaattaagcaatgggatattccaaggcagtacttcgtaaaagatacacaatcctttacagaacagttaccctattttcagattaaagtagggtatattcttgtcataacccttttttataagctcggattttcatctccaatggcagtgctttttaccagccttatttcttattttttttcaggattattattcttttatattctaaagcttctattcccagagaaatactggctggcaattatattaacgattgccgcaatgcttttgccacccatgacttacatgtcaagagtatctactccggatatgtttatctttcagtttatgctgatctttattattggcttgatcaaacaatggaataaatggggaatgtttgtacttttatttgccattacctttatccgcccggattatattacattcacgctcacttatattatcgctgttttctttttccagtattttcagaaaaagaaaattgatgtttcctatattgcgcagggaacagttcttctggcgatgtatctgataattattaaattttaccattacccgggctggaaagatcttttttatgatactttcattgacagaagacctattatttccacgcatccaattgatgttagcttaaaagattatctgagtattatttacattaaaatcatttattttaaaaaagttactttatcggtagctgttatgattggcgtaatcttctggcgtactaaagatacttgggtgagaatgatttcagttctttttctggtcaatgtatatatcaagtttttcttctttccgcagtcggcagccttaagatttttcttcccgtttatctttccacttttcattatgatgctctatgtgctgagcaagaaatacaatgatcttaaactcaggaaaattgcgtaattttgcctttaagataataaggatttaaaatcaatagtaaaagaatatcttactcagtgatgagcatttgaaattgattttaatattctgataaataaatatttacattatgaaaatcgaagaatctaatattgtagaaaccaacgactacagagtcattatatatccggcttcaagaccttttgaaaccaaagaagcaaaagccattactgagaaattatttgatttccttgcaacatgggcggctcatggaaagccactttcttcttcatttaaaattgaaaaaaatcaatttatcatcgtttgcgtagatgaagaaaaagaaatggcttcaggttgcagcattgatgccttgggaaaagtaatgagagaaattgatgaagaatatcagctgggtcttttcgacagaatgaaagcaagttttgtggagaatggtgaagtaaaaactttaaaattaatggatttcaaaacaaaactgagaaacggagaactttcagacgatattcaggtttttgacttctccaagaacacttatctggattttttaagccacttccttcttcctttagagaaaagctgggcagcctctataaaataaaacgctataagttcaatacagcagaatcatcataaagtggaaaatatatttccacttttttgttttaatgtatctttgtgtagattcgagtagaaactaatgcctaaagtactttttttaacaacatcccataattataatgatgaccgtattttctatcatcaggcgaaggctcttagagatgaggggtttgaagtaaaaatatgtagtttatatacgcgttacaacggtattattgatggcattgacatagaatcttacgatgtgctgatagaaagtattgaaaaaaaaatggaaactttcaggaaggtttgccatacgtttcagcctcaatgcatcatttgctccgaacccctcgcagtggtagcagtaaggaaatttgtaaaacagtataaagcggtttgtatttatgatgttacagaatggtatccttccatgtctatgctcagaaagtaccgttttcctgttaaaatttttcaggctgtaaagttttctcttgtgcagttgtatgcaggttttttaggtactcattttatttttggtgaagcaaccaagaaattccctttagcctattttttcggatttaaaaaacagatgattcttccttattacccggatgctatttacatcagagaaagtgttaaacaacttgaaccgggtagaattaccctttgctataccggtcagatttctaaagataaagggattgataacttttttaaggctgtagataaacttcgtcagaaagcttcttcacttcatatcagaatcctgattatagggtccgctgtagaagaaaatgataagctatatttttcctcattgttgaagaaatatactttcgatgatattgagatcagaaaaccaacggattttgaacagtttacagaagaattggctgatgcagacatttgttttgatcttcgggaaatcaactttgaaaacaaccattctttgccgataaagctgttttattttatgggagcgggaaaaccggtaatgtattcaaatctgaaagggatacggaaacatatgggagagctttcttttggaagtctcgtaaatcctcatgatgctgatgggatttcagatattattattaattatatcatgaatcctgagttatatcacgctcatgcgctcaatgctggaaaagaatttaaagaaaaatataattgggagatgataaaagattccttcgttgattttgtgaaaaaatccattgataaataatcaccatgcagctcactatcattaaaacatttgtctcacgctttcttattctgatcctcagtttcggactggtgatctattctacgaatatgtggggaagtgagggtaagggcaccatttccatcgtaattgccaatgcagctgcagtgagtttcttcagtaatattttttcaggaagcagcgcttcttattttgcttcaagatttaaaatagaaaaagtcttactctatgcctatctctggtcggtcctgacaggacttttaattccttttttattcagtctggcttctattcagggtgaatatcttttctatcttatcgggatttcagtgttttcttcacttttatctacgaatatcagtttatttattggcacacaggatattaaaaagttcaatgtgtatactgttctgcagcaacttgtacatattgtatttattggaatattggtttatctgtttggaaagaaagatgtatctgtatattttctcgcccagatcagttgcctggcacttcttttcctgaccagtttttttcagattattaaaaagtgtaagatttccgaaataacattctgtaaagaggtaggcaagaatatgtttgaatatggctggaaaacccagctgagtgcttttgtacagtttctgaattacaggctctcgttttattttttagaacattttgaaggaattgccagcgtagggattttttccataggagttactttttcagaagctatatggaccattacccgtagtatcgctgtgattttatactcagatgtagtcaatagcaaaagcagggaagaatctataggaaagactaaagaatctttaaaactgactttttttctgatgataggttttgtactgggaatcatggtcataccgtctcaggtttacgaatttattttcgggaaagaattcagagataccaaagaaataatgcttcttttatcaccgggaatttttgccattgcggtaagtgatatggtaggacattacttttcaggaatgagagatctgaaaattcttaatgtgaaatcgattgcaggtctggcggttaccgtcgtactgtctttcataatgatacccagatggggaattttgggagcctgtatagcaactacatcatcctattttgtttcagccttgctgttgttcatgaaattttatagttcaactccgtttattttgaaagactatatgatttcaaaagaggaagtacagcttttaaagcaaaaatttttaaagaaataattacttccggcacatctataaaataaagtcattttcctatttttacaaatctattaactctttactatgtgcggaatcagtggctattattcatttcataaaagcatttcctctacaaatattctggaaatgaatcaggccatcaaacaccgcgggccggatgatgaaggattctggatgtatagtaacggagagggagtttctttttcagggaatgattccacacaaaaaattaaagaacagtttccggttttaaaagaggaatattctgatattgctctaggtttccgtagattatcgattattgatctttctgaaaaaggacatcagccaatgctttcagaaaatgaacagattatcattacgtttaatggtgagatttataattttaaaaagttaaggaaagaacttgaaagttccgggtatgttttccaaagtacttctgatactgaagttattctcaaggcatatgaagagtggggaactacagtttttgaaaagctggatggtatgtttgctgtttgtattgtggatcttatctcgcaaaaacttatcctggcaagagacagggtaggaatgaaacctttattttatcatcagagtgaaaaagggctggtttgggcatcggaaataaaagcattgctcaaaaatgagtttgtaaagcctgaaatcaactggaatggagtatataccaatttcctttttcagaccacgttagctccgcaaacctgttttcagcatattttttctctggaaccggcttcttttatgacggttgatttaaagaatcagaacatcaccaaagagaagttctggaatctgcctctaccttctgagaatatttctgaagaagaagctgtaaaaaagatagataagcttctttccgaaagcatatcagaacaattatatgctgatgttcctgtagccgtaatgataagcggaggaatagattctaccttaattacttcgaaatcaaaagctttcaatgctgatatcaacacctataccatatcatatccgttttcagaagaagaagtgaaaaatgcggctttagctgctcaacactttggtgtttcgcatgaggtgaaagaagtgagtgatgaagaagcgcttgaacatcttaaagaaaatattcagcattttgaagaaccctacagcagttttgaagtgttaatcaatgcggcaaaatatgcacacgataaaaattttaaggtcgtactgagcggaaatggcgccgatgagctttttgcaggctattcccatacactaaagctcaacagatggctttttatgagaaattttaattgtataagtgcttttatcttcacgaaagacaagttttcacagcgcttaaaaaactatttttcgcaggataatatgtttgattttttcaggcagagccagatcagtatgaggcctttggaagctaaaagtgtcataaaacaggaaatttataatacaattgatccggatcttacaaaatatcatctttcggaaacaaaaaactattccggttattttgaatatgatatgaaatactcgctttcatcccatcatgttttccgtgatgacctgagtgccatgaaatacagtgttgaatttcgttatccttatctgagcaacagcctgatagattatgtagcggcactgccggagaacatcagatttaatggagctcagaataaacctttattacgtaaaactgcaaaaaaatatcttccggaatcagttttgaatatgcctaaaaaaggattttcatttcctgtcaattatttcattaaaaacgaaaaaaaagtaagagactttatcgttgaaaatcttgaaagcttaaaaaggagaaatttctttaatgctgcagtgattgacgaatggtggaatcaccaggaacatgaatatgactgggtgaaaatatggcagctggttacttttgagctatggtatcagaaatattttgaaaaataaagaaggtgtctaaagattaatattttacctttgtagctatgatgaaatatttttggagtatacttgttgcggtatttgcactgataagttgcaaaagtgatgatgattctttgcagagaatagatcaggtactgaatatctacatgaggaacagtgccggccaggatttgctgaacagtaaaaaagcagggtcttatacaggattttccgtcaatgatatttttggggccaaagataattctccggtaagcattccattgaaaatgactacagattcactgttttatatggaatatcttgcaggtgccaaaagaagacgtctggactctataagtcctgacaatccgggtacaggtaattcatattattcgagaatgcagattacatttacaaaaagtactaatgcaagtgataatgttgtggacactttggaagttcagtatcgcaatacaccaacggtatttcaggtttcaaaagttttgtataacagggttcaggtattttcaaaagatgcagatgctcctacttcgataaataccgttacgatcacaaaataatttttaaatttgtacaagtgttagctgattgtaagctaaccatctaatatttaacatctaaataaaatgttacaagtcaattttttgcgcgacaataaggaacgcgttttagaaggtcttaagaaaagacaattcaaaaatcttgagttggtagacgaggctatcgctgccgacgacgaaagaaaaagaatccagtttgaactagattcccagctttccgaaatcaacaaaatttcgaaagaaatcggacttttgatgaaagaagggaaaaaagaagaagcggaatcggcaaaatctaaaacagcacaatacaaagagtcgagctcagaattgaaatctcagttggaagtaaaggaaaacgacttactgaatatcctgtaccagcttccaaacattccaaatgaattggtaaaaagcggtgcttcagctgatgacaacgaaatcattttccagtctcatcctgtagaagggcttggtgaaggagcaatccctcactgggaactggcaaaaaaatataaccttatcgattttgaactgggagttaaaattgccggagccggtttccctgtttatttagggaaaggagcaagactacagagagctttggttcagtatttcttagataaaaacgtagaaaaaggatatacagaagtgaatcctcctcacgttgtgaatgaagcttcaggttttggaaccggacaattgccggataaagaaggacagatgtattatatcaacgaagataaattatatttgattcctacggctgaagttcctgtaaccaacctttaccgtgatgttctttttgatgaaaaggatcttccggttaaaaatacagcattctctcaatgctacagaagagaagcgggaagttacggagcccacgtaagaggattgaaccgtcttcaccagttcgaaaaggtagaaattgtaagaattgagaaaccggaaaattcttatgctgtgttggaagaaatggtagaacacatcaaagaaattcttacagatcttgagcttccgttcagagtattaagactttgtggtggtgatacaggttttgcctctgcaatgacgtatgactttgaagtatggagtgcagctcaggaaatgtggctggaagtaagctctgtgtctaactttgaaaccttccaggccaacagactgaagtgccgttacaaagctgatggtaaatctcaattggtacatacattaaacggttctgcaatggcattaccaagaattatggcagcattgctggaaaacaaccagacagcagatggaattaagcttccaaagaagattgctgaatatgcaagatttgatgtgattaactaaactaatcttttgattaagtatataataaaaaaaccaccggattccggtggtttttactttattctgtaacgataataatctttttatcagcgtttttaagttttgtatccttatcataaatggatttcagatcatattctattcttatggaatgatcatcaacctgcttcacccagtcatgctttcctgaaattgattttataggattctcaaattttaaggtagtaccgatctctttgaaaaacatgaccatcatacctgctattttttcagcttcttcctttgagcttttggtcttgatagcttcttcaatactttttagatttaaattctcagtatcaatggtgagggtttttccgtcccagctgttataaatattctgatccagaggaattttttcagttttggtaaagtttttcagggctttatagtcgtccgaagcaaagtgttccattttaaaagaaaatcctgccagtttgttgttttcttttgcagatttcatgaagatttttttcatgatcctgactgaatccggattttcagtttttaattttccttcttttttggcaagatcatacatacttgtccagacagttggaagtttatccacttctccaaattctttttgtttcagcgaatccggcgtcatagccatcatttctgccataaactccctcgtatcgatatcggtaacagaagtagaagcggcatccctatgatagacaatttcagaattcacactgcaggattgcagcataaaaaggcttattaaaaataagacaacagttttcttcatggtttatgtaaatacaaatttaatggcagttaacagctccgttgggatctttaacaattgtcatggcttctgctttcggagaaacgtaagggattcccagttcaagacctctcagaatgaataatcctccaagaataatcataattaccggaacagctttcaaaacttttattctgaaggcctgattcataagatttccggccagaacaatggcaaacatgaagggaagggttcccaatccgaataaagccatgtataacgctccctgccatattcctcctcccgcaaggctggcggtaagggccatatagaccatcccgcacggtaagaatccattaagaagccctgtagtaaatctcgaacggtaatctgccttttgaagaagtcttcccagattcatttttacgctgtacaggaatttagaaagaaaaggaatctttgaagcaaaatcttttcctccaaatgaaaatacagccataatgatcagaagaactccggcagtaatggtcagatatttctgaaagcctgccatttcaaatccttgtccgatgatccccagaagcgcacctaataatgaataggtgaaaattcttccgaactgataggtaagattctgaaggtagaaattagcagcctgttttttggttaatcccatcgataaagcaataggtccgcacattccgatacaatgaaaaccggaagcaaatcctaatgcaatagccgacacaataagtcctatttccatatcacatcataatccattctgtagtctgttttatctttcgtccagctcagtcttaatgtataatttcctactttcaatacctgtgaaggaattgtgaaagactgcgcggcgtcaagctgtacagattttttgatatctaaattctggtcgtcggttctgtttaaaacaaattttaccgtagtattagagttgttataatctttcgggaaagtaattttaattcctttggtatcctggctgtaaacaggtttttcctgtaattcgtcagcttttttcttcgcatcaattacatcctggtattttaattcctcttcataataattatcggttaccatttccgagttcttctgtccgttcgggaacaggaacatcatggataatataaaaactatgaatgcaagtaatgcaattacaacaccgtgtccccaactaaagttcttcatttttttctaaaattaaaattgcagtttgaatggtccttcaaaataagtctgataagaatcaatcagtttacctttcatgtcatacacaccaatcgtgatattctgtttagagagtttcatttcattttccgggaagctgatattaattgttccttttgaaattttatctctgtcaacctgaatcttgctggatgcactgtaagtaatttctccatgcgccggatcgattactttgatggtaactattttcttgtcattcgttttattaaggaacgtataattataggtattggtaattttaccgtctcgtacaaagaatgtgcttccagccggcttaatgaatttagcttccatttcaccacgactgtaaagaagatatcctaagaatcctacaagaaggagtaagaatatggagaaacccttcattcttcctgtaaacttaaactgggtttgtttttcaatttcgttttcagaagcatatctgattaatcctttcggaaggcctactttctccatgacttcatcacaggcatcgatacaagctgtacagttgatacattccagctgctgtccgtctctgatgtcaattccggtaggacaaaccactacacactgatggcaatcaatacaatcaccctttccggcagctttccggtcttctccttttctccatttcgctctgttttctcctcttttgaaatcgtagaaaacattgatggtatctttgtcaatcaatactccctgaagtcttccataaggacataccaatgtacagacctgttctctgaaccatgcaaatacaaagtagaatgccgcagtaagaaggatcattacaatgaaattggtaggatgagcaaatggcccttctccaacaatcttaaatacctcttcatatccaacaatgtacatgaacatgaagtgggtgatgatcaatgatatgatgatatagaccgtccattttaaacttctcttccagatcttctcactgttccactcctgtctgtccagcttcatctgcttatttctgtcaccttcaatcaggtattctattttacggaagatagattccataaaaattgtctgagggcaaatccacccgcagaaaattcttccgaatgcaatcgtaaaaacaataataaagattaaagatgcgatagcacctaaagtaaggataaaaaagtcctgtggatagaaaggctgtccgaagatgaaaaactccctgtctataacattgaacatcaataatgggttaccattgattttgatgaacggtaatgtaaaataaataattaatagtaaatagcttacaatatttctatagttggtatatttccctttaggttttcttggaaatacccatttcctttttccggattgctccattgtccctatagaatctctgtaagtttcagggtccagaacctgtccctgtccgcctcgtacttctatttcttctatgtctgacatatataataggttttaaaaaagaaaaaacataattcgttactattttaatctaataacaaattatgtttttttcatatgtttctaattttttaaattattctttttcccaatgcgcttcagttccttgaggagctgctcctccctgagccggagtcactggcggttgttcctgattgatgtgatatacatatgctgcaatcttttcaatctctgcacctgaaacttctccgtttttaccgaaaggtctcatcgcagggttggtaggagaaccattccagtccatatggaatacgtttttgaataatgttttctcaggctggttgatccagtagttatcagtaaggtttggtccaatacctccactaccgtcttccttgtgacaagatgcacagtttgttttaaataattctttaccttctgcgatattatccgctgaatacttagctgtttcaatggttacaggaggctgagatttctgatattcttcaatacttgccaactgctctttatattctttttcatattcgcttaacgggtgagcgaagtctgtgaaagagtatgctgcaatatatacaatacaaaaagcggtcccaaaatagaataaacctacccaccattttggtaattggttatccagctccataattccgtcgaaaccgtggtcgataaggatatccttttcttcggaagcagattgctttttgaatgcactttgatataatcttttgaagtaaggtactttcttctcagctaaataagctgccttttcttcaggagataatttcttgaatttgttgttctcgataaggtccccgatagctccatgaatgtaagcaaggatcccagcgatcacaacagttccccagaagtaaggtgaagaaaggaacgcgtagctctgtacaaataaataataaaaaactattaaaagtccgattattattaagatgtttataacaacaggtgttctttgtttcataaaaaatagtttaattttttaaattaaaatcgtcatcttcatcatccccaagaggagcctcttcttcttctttgtaatattttttaggtctgctaaaaacatagattaccaaagcgatgaagaacagcataaagaaaatcagagccagtgtctggtagaagccagcattttctgtattggataatatatctttaaagttctgaggaatcatatgaaccttttaatgtttagttattacttgctgttttgatttcagttgttttgatatctgtacctaatctctgaagataagaaataagagctacaatttcttttttctctaattctccctgaggtctcttagcataagcctgtttaaggtcatttgcttcagagaagatatcttttacaatttttgctgattggttgttagcccatttgtctgcagagtcgatttcagcctttgtataaggtacatcaaatacattcttcatcagcttcattttatctaccatcttggttctgtctaagtcagtagcaattaaccaagggtaacgaggcatgatagaacctgcagaagtagatcttgggttatacatgtgcttgtagtgccaagaacttgggtttttaccaccttctctatgtaaatccggtcctgttctcttagaaccccataggaatggtctgtcgtatacgaattctccggctttggagtattgtccgtttttaccgttaaatctaacgatctcatctctgaacggtcttaccatctgagagtgacaagcgttacatccttcacggatatagatatctctaccttctaattccaggggtgaataaggtttcaccgcagaaatggtaggtacacttttcttaagagatagtgtagggataatttcaattgaactaccgatagatattgtgatgaaagatagaattcctaataatacaggagttctttctaaccaaaggtgagtaccttctccttcttttctgttcttactgatgtttgccaacgcaggagcttcagcaggaacatctttctggaatgatccttttcttaccgtagcaactacgtttacgatcattaagatggctcctgaaatatagaatgcacctcctaagaatctcattttgaagtaagggataattgcagttacagtatccagccagtttttccataataatgttccgtccgggttgaattgtttccacattaaaccttgtgtaaatcctgaaatatacattggtactgcatagaagatgattcctaaagtacctaaccagaaatgccagttagctaattttacagaccaaagttttgttctccacataattggtaccaggtaatagataaccccaaatgccatgaaaccattccatccaagtgctcctaagtgtacgtgaccgataacccagtctgtaaagtgaccaattttgttgatgtttttagttgccaaaagcggtccttcaaatgttgccataccataacaagtaacagcaactacaaagaacttaaggataggattttctcttaccttatcccaagcccctcttaatgtaagaagaccatttaacatacctccccatgatggtgcaataagcatgatagagaaacctgttcctaccgcctgagcccaagccggaagagctgtatactgaaggtggtgaggaccagcccagatatatacgaaaattaatgaccagaagtgaataatagacagtttataagagaataccggtctgtctgcagccttcggaaggaagtaatacattaaacctaaaaccggagtcgtcaatacgaatgcaaccgcattgtgtccataccaccactgtacaatagcatcttttacccctgcgtatgctgaataagatttccagcctgtgaaagatagaggtacttcaagattgttgaaaatgtgaagcattgctactgcaatccaggtaccgatatagaaccaaattgctacgtaaaggtgtctcactcttctcttcgaaatagtcaggaacatattgataccgaaaatgatccatgagaatgcgatcaatatgtcgatcggccactcgtgctcagcatattctttagaggtattgatccccataaagaacgtaatgaacgtagcaacgatcataaactgccaagtccagaaatgtagccatgacaatgtatcactgtacattcttgtttttaataatctttgtaatgagtaataaatacccgtgtaaacaatgttacaaacgaatgcaaagattacggtattggtgtgcagcattctgattctaccaaaaccaaatgcaccatgtgtgtttattaacccttgaatattacctgatgccaaacttttaatggtcgtatcatctgtcccgaaaaagaattcaggtaactctgggtagaaaagcattaatgccgccgtaagcccgaatgtgaaacctataagaccaaagacaatggtcgcatataggaacgcacggacaatactgttgtcataactaaacttttgtgtttccatatcaactattcactatttttctcaatttttattattttctcctatttctttctcgtctttacttttgtcgccggtctcatcattttctttgattttttcatcatcaaaaaggattctgacagcaggagattcatcatcctcaaactgtccttttcgggcatacactataaatacgaccaagaaaatcgcagctaaagaaacactgcagaggatcattaaatatagaatatccattggacaacaaaattaacctattttcggggttcaaatttagtgaaaaataatgacattcatcacgaaatgccgatttcagctaatttaaaatcagtctaaataagggcttttacgcctgttttttgaaatattttcgacctaaaatccaggttgaaagtgttgtaaaggtaaccactgtgatcgagctgattggcataatgatagcggcaaaaagcggatgcatatgtcctgtaacagcgtaacttaaaccaacgatattgtataaaaaactgattataaatgtcattttcacaatcgtgatagagcccttacaaacgttcagatagttgtcaagtgtaaccactttttcaccattcataatcacatcagaagatggtgtaaaactgtttgtatcatcagcaatagcaattcctacattactttgttttaaagctcctgcgtcattaagcccgtctccgagcattgctaccttcatgtgctggtcctgaagatttttaatataattcaacttatcttccgggctctgattaaaggccattcctttatagttgggaatgagttctttaagctgattttcttctgaagaattatctccgctgagaataaatattttgtattgggttaatttcgtgaaaagctctttcagtttcgggcggtattcatttttaaagatgaatttaccaaggtattcaccgtttttactgatataaactgcggtctcaagattcttgggttcctgattgttatagcgggcagaaccaattttataaagatttcctcttacgttggcctcatatccttttcctgaaatttcaacgaaattttctacagggaaatattcatcatttacatcaatgaattcatacagtgattttgaaagcgggtggttggagttttttaataatgttttgatattcagagagtcaaattcattaatgtcagctccttcatatttgatgtttgatttttttctgtgcgtaatcgttccggttttatcaaaaacaatcgtatccagcttcgcgattttttcaatcgttaatgtatcttttacataaaacttgtttcgccctaaaatcctcataatgtgtccgaaagtgaacggtgcagacaatgcaagtgcacatggacatgcaatgataagaatggctgaaataacctggaacattttttccaaatcaataaatgaccagtaaatccccgaaattaaagcaatacttaaaataataaacgtgaaatatttactgatgttgtttgtcagggtatcaagacccgtttcgtgttttttgaaagcttctttattccaaagctgagtaagataactctgatctacgtctttgattacttccagttccagagatgacccgatctgtttacctccggcaaaaatcttgtcaccgggttgcttactgatgctttcgctttctccggtaataaaactgttgtcaatatttccttctccgttgatcagtatggcatctaccggaatgatttcctggtttctcactaaaatcctgtctcctacttttacctcagaaagaaggatgttctcctgttttccttcaaagtctactttggtaaccgcaataggatagaatgatttgtaatctctgtcataagaaagagcactgtacgttcttttctggaaaattttccccatcagcatgaagaaaagcagtccgcaaagcgtatcaaaatatccaggaccgtaatccgtgaccacttcatagatgcttctgccaaagagaacaaaaattcccaatacaataggtacatcaatgttgacaatcttattttttaatccgtaccaagcagatttataataatcagaagccgagtaaaagacaaccggacaggccagcaggaacatcagggttctgaaaagccctttgtaatgctccatccagtaatcttcccctcctacatattcaggaaatgccaggaacattccgtttccaaatgcaaaaccggcgatggcaaattttaccagaagtgatttatcaagatgatcaacgtttttttcagcggtttcaagactgataacaggtttgtatcccagattggttaagaaattagctagttcgcttaacttcaaatcattatggttgaatgaaatctgtaaggtcttccttgtaaagttaacctgggaatatttgatgtgctgatttaaagtatggaggctttccaataaccagatacaggaagaacagtgaattacagggattttaaatgtaacaaggctggtgtttccttcagagaaatctgttactttttcaaaaatctcaggagtgtccaaatagtcaaactgggtagaattttcatcactcggacgaattcctgcccctttgttaagctgataaaaattgcttaagttattcgtatttagaatttcataaacagacttgcagccattgcaacagaaagtcttttcatcaaataaaattctctctttttctataccttgaccacaatgaaaacagttctcgctcaccaccataaaatattgaactacaaaattataacaaatttttttgtttatcgcgttaaaaagttctatttttgtgataaatatcatataaaatgccgcaggaacaacagatagcaattgaagagaggttcgccagagtttttaatgataaatcatttaaggaaagactttctagcgcagattttgaaaaatatattaatggcaaaaagaaactgagttttcagaaacatgaaaccattttcgaggatggggaaactccaaaaggagtatatgtcctggaaaaaggtgcggccaaactttcaaaatcaggagcgttcggaaaagatcagattttaagatttatcaaagaaggggatattatcggctatcgttctttgctttgcggggaaaactttcaggctaaagcagaggccatgacagatattgaatgtgtatttttaccagcagatatctttatgtatcttctggaagtagatccacagctttctttcgtaatgcttcagaaaatttcttacgaattgggagaatcatccaataccattactttccttgctcagaaaacggtaagagaaagactggcagaaatcctgctgcttctggagcagaaactgggagtagaccctgaaggtttcatcaagatctcattgacgagagaagaaattgccaacattatcggtactgccacagaaagtgccatccgtctgatctctgaattcaagcaggataatctgattgaagttgacgggagaaatatcaagattctaaatcacgacaaactcatgaaactcggtcacgtagttttataaaaatcataaaaaacttaagtcggctcagggccgactttttaacttttaaaaaatagataaattatgtctgttcactctgaaattaaaaaagttacgactgaaaccttgcgtaaaatgaaattcgacaaggaaaaaataacaatgcttacggcctatgattttactaccgcaaagatggtagatgccggcggagtagatgctattttgattggagactctgcagcgaatgtaatggctggttttgaaactacattgcccattacgctggatcagatgatctaccatgcccaaagtgtggtgagaggaactgacagagctttggtggtagcagatttacctttcggaacttatcagagtaaccctgaaaaagcattggagtctgcggtaagaatgatgaaggaaggcggtgcacatgccgttaaaattgaaggagggaaagaaatttccaaatcaattaaaaaaatcatcaatgccggaattccggtaatgggacatttgggattaacaccacagtctatctataagttcggaacgtataaagtaagagctaaagaagaagccgaagcggaaaaactgatcgctgatgcacagcttttagaagaacttggatgtttttctatcgtattggaaaagattccggcagatttagcgaaaaaagtaacagacagtatttccattccaacgatcggaatcggggccggatcacattgtgacggacaggttttggtataccatgatatggtaggaatgaacaaagggttcagtccgaaattcttaagaagataccttgacctttacacagaaattacaggagctgtttcccaatatgtaaaagatgtgaaaagcgttgagtttcctaacgaaaatgaaagttattaatattcatcaatgcagaatcaacaacaatctatccagggaatattatctatcgcagccttgatttgtcttgctgtaggatggtttaatcttttctctccggaaatcaatcatttgctttcaagaaaagttttttatgttttaatcggagcgagcttttttattcaggctccgttacttacgaataagaattttgtttatgctatgtatgctgctgccgcaatctgtgtattcggagcattcattccggaaggctcaaaactttcagccatcaaaaccgttggacttcttgcaggaattatcttgtcattgtccaatagaagaagatagacttaagatatgaaggagcagattatatatgaggacaatcatcttctggtggtcaataaaaaagtcggacaacttgttcagggtgataagaccggtgatgaatcactattggaatccatcaagaactttataaaaataagagatgctaagccgggaaatgtttttctcggcttggttcatcgtatagatcgtcccacatcaggattagtgatctatgcaaaaacttccaaagcgctttcccgtcttacgcagatggtgaaaaaccgggaagtgaaaaaaacatattgggcagtcgtgggaaaagaaatgattccgcaaagccagagactggtacattatttaaagaaaaacgaaaaaaataataaagccatcgtctttccaaaagctacggaaggagccaaagaagctattctgacgtatcatgtaatcaaaacattagacaattatttgttgctggaaattgatcttgagaccggaaggcatcaccagatcagggctcagctgtctaaaacaggagttccgattaaaggtgacttaaaatatggagcacctcgctctaatccggatggaggtattaatcttcacgccagaaaactggaatttattcatccggttactaaagaaaacataaaaatcatagctcctgttccgcagaatgatgcgatctggagagcttgtgaagaataacatatcataaactataacatgaaactcaaatcacttttattagccacattgctggttatgacatcttgttcagacaatgatgaattgccgcatgataattcacaacagacgattcctgaaaatacaagtaaaatatcatggaattatcctgttttgtcacctgcctttaatggattggaacaaaattatatgttcgaatatgatgctcagggaagaattataaaaagaacaggaggaaaactggaactttccggaagtaccgggtttccttatgcttattcaaaatctgtctatacaatggtaacatatacaggagatacagcgattatgagaaattatagctctgatcctggtttcactgttcagttgaaggaaagaaggtttgaatttgataatcaaggtagagttattaaagcagttattccacaggttaataattcatatatggatatgtatttgacctatacttatgatggttcaggaaagttaactgagattttaactgaatatccaaatattccatatgatccaactgatcctcaagattatattttaacatacgtagaaaagtttatttataatacgtcaggaaatctagaaaaggcaattaaaactgaaaagcataataatattgatgcttacattaccaatgaaattacattggataattttgattctgcacaaaatccatttaagaatctgggtatttttgaagagtatttctacttttcattatcaaaaaataatcctcaaagaaaaatttcaaaagagtttaaaccttatagctccgaattttttctaagccaatcaaattggactaatcaatataattctgatggaagcctgaagcttttttactaaagaactatttaaaataaaagtgaagactatctcaaaattgagatggtctttttctttaaagtcatttaagattttgcttattctgaaaaaatgtctaccttcgttccaaactttaggggtgtctgttgccaacagactgagactttaccctttgaacctgatctggatcataccagcgtagggaaaagtagatgactttgctgtacattctattgtacaataatggccattcctgaagtgtatttaaattatttaggaatggaacttataatcaaccacacccgaaaaacattcgatatacttcctgcaaacctggaagcattactggctattgagctacctggaaaaaagaaaggcattgctgtggctctcaataatcgtattattccgttatccatctgggcggaaaccatcctcaacaacaacgattcaattttaatcattactgccactcagggcggttaattttcatatttaaaaccaatacttatggctcactccattacatgttcgccatttccgaactcaaagaaaatctatgttgaaggaaaactacaccctatcaatgtagccatgcgtgaaatacagcttagcccaaccaaactgaccaatggtggctttgaacataatgctccggtaacgatctatgatacttcagggccttataccgatgaaaatgcagttattgatattcagaaaggacttccgagaatcagagaacaatggattctggacagaaatgatgtgaatatcctggacggaattacgtctgaatacggaaaggcacgtttggcagatccacgtcttgacgaactgaggttttcctatgaccataaacctaaagttgccaaagaaggaaaagaactgacacagctttattatgctaagcagggaatcatcaccccggaaatggagtatgtggctatcagggaaaaccagagaatagagcagcttgattccgtatcgaaagaaatggcttttcagcatccgggacacagttttggagccaatactccaaaaggcaagatcacgccggaatttgtaagagacgaaattgccgccggaagagccattattcccaataacatcaaccaccctgaaagcgaaccaatgattatagggagaaatttcctggtgaaaattaatgccaatatcggaaacagtgccgtttcatccagtattgaagaagaagtggaaaaagccgtatgggcctgccgatggggagcagataccattatggacctttcaacagggaaaaatattcacgaaacaagagaatggatcatcagaaacagtccggttccgattggtaccgttcctatttatcaggcattggaaaaagtaaaaggtgttcctgaagatcttacatgggaaatcttcagagatacgctgattgaacaggcagagcagggagtttcttactttaccatccacgcaggagttttactgagatatattcacctgacagccaacagagtaaccggaattgtttcccgaggtggatcaattatggcaaaatggtgcctgtttcatcataaagaaagcttcctgtacactcattttgaggagatttgcgagatcatgaagaagtatgacgttgctttctctctgggagacggtcttcgtccgggatctattgcagatgccaatgatgcagctcagtttgcagaactggaaactttaggtgaactgaccaaaattgcctggaaacataatgtacaggtaatgatagaaggtcctggccatgtaccgatgcacatgatcaaggaaaatatggataagcagctgaaggaatgccatgaagctccgttttataccttaggccctttaaccacggatattgcaccgggttatgatcatattacttccgggatcggagccgcaatgattggatggtttggctgtgccatgctttgctatgtaacaccgaaggaacatttaggacttccgaataaagaagatgtaaaagttggggtgatcacttataaactggcagctcatgcggcagatttagcaaaaggtcatccgggcgcacaatacagagacaatgccttaagcaaagcaagattcgaattcagatgggaagatcagttcaacctttcgttagatcctgaaacggcaagggcttatcacgatgaaactcttccggcagaaggcgcaaaaattgcccatttctgttctatgtgcggaccgaagttctgctccatgaaaatcactcaggaaatccgtgaatctgcagaaaaaggaatgctggataaatcacaggaatttattgaaaaagggaaagaaatatatatatgatcctcgttatcactcctgaattgattgttccgaacgaaactgatagtattaatcagatgtttcaggaaggacttaacttgcttcatatccgaaagccatggatcagccgtaatgaaatgattgaatttatcacccaaattgatgaaccttttcattcacagctggtacttcatacgcattatgaccttaggaaagaatatcatatttcaagatttcatttcagggagattgatcggcaggaagaaatgtataagtcttttgtgaaagaaaataccatttcaacttcagtacacgatatcacaacctacaatactttgaataaagaatgggaatatgctttcataagcccgttctttccaagtatatccaaaaaaggatatgggacagattctactattaaagaagaaatacaatatcggaacaatccggatgtcaaattaattgcccttggaggcattaatcatgataatattcatgaagtctttgaatcaggagcagacggagcagcgctgttaggtgctgtctgggaaagtgaagaacctttaaaagtattcagaaaatgcaggaacgtccttatgtcataagcattgcgggctttgatccaagtggtggagcaggcttattatcagacagtaaaacctttgagcaatccaaagtaatgggactgggagtatgtactgcattaacactgcaaaccgcttcccaatgtcttagccttgaatggcgtcctttggatgaagtgactgaagccattcagatcttgatggaaaactatcccgtttcagcagtgaaaatcggaattgtgaaagatgccggttttttaagcaaaattgtagaaacggttcaaaaaagtaactctgaagttaaagttgtttgggatcctgtcctgaaaagcacttccgaattcacttttttcgatcttgacacacttcctcaattaaaaaataccattaatgagctcagtttaataactccgaattataatgaatacagtgttttaaaggaaaataatcttctaccggatacccgtcaatgtgcattgctgatcaaaggagggcatagaaaagatctgttgggaacggatattttagttgaaaacggaaaagaatctcttttagttccagccgaaaacgatagagtatattttcccaaacatggttcaggttgtgttttatcctctgccattacagcagaacttgcgaaagggaaaaatatggaaacggcctgccggaacgggaaattatatatcggaaaatttttaaaaagcaatccctctttgctgggaacacattcatagaaaatatggaaaaattacaatacatatcacagggaaataccaggcaggaacaggaacttcatatccgtaaagctctggataacggaatcaaatgggtgcaggtccgatggaaaaatgctcctgaaaatgaattaataaacctttgtgaaatttcaaaaaaactttgttcagaatatcagtcggtttgtatcatcaatgatcatgtagaaatagcaaagaaaatagatgctgacggggtgcatttaggattgagtgatagctctgttgaaaccgcaaaacaggttctgggtgaaaacaaaatcattggcggaacagccaatacgctttcggatgtcattcagagaatcaatgaatcctgcgactatatcggtttgggaccattgaggtttaccacaactaaagaaaaactaagtcctgttcttgggcttgaaggatatcagaaaatcatagatggattaagagagcaatccattgatatacctaaaatatttgctatcggaagtgttgcttttgaagatatcttacccttacaggaaatcggaatttacggtgttgccgtttctgggcttattacaaagcagcctgaaattattaatgaactaaaaaaagtaatgatatgaaccatcagaaattagaaatagcaggaagaacttttgaatccagactgtttttaggaacaggaaaattcggaagtatgagagatatggtacaatctgttatcgcatcagaaaccgatatggtaacaatggccttaaagagaattgatgcacaatccaatgaagatgatctgcttgattcactgaaagaaacccgtgttcatcttctgcctaacacttccggagccagaaccgcaaaagaagctgtactggcagcacaattagccagagaagcgctggaaacgaactgggtaaaactggaaattcatccggatccgaaatatttactgccggatcccattgaaacattatatgccactgaagaattagccaaacttggatttgtggtaatgccttatattcatgctgaccctgttttgtgcaaacgtctcgaagacgccggaacagctgtagtgatgcctttgggtgctcctattggaacgaataaaggtttaaaaacacaggactttcttgaaataatcatcagccagagtaatgttcctgtagtggtagatgctggaatcggagcaccatcagatgcagcaaaagccatggaaatgggagctgacgctgttttggtgaatactgcgattgctgttgcgagaaatccattgaatatggctgttgcttttaaagaaggagttattgccggaagaagagcttttgaatcggggttgggagccatttccagtcatgctgaagcttcaagtccgctgacttcgtttttatttgaataaatgaaggttatgaaaagctttaaagaggtttttgaaaactaccaatgggatgcggtaaaggataagcttgaaaaagtaagcccagctgatgtaaggtacagccttcagaaaaagaataaaaatcttgatgatttcctgaatcttctgtcacctgccgcttctggggaacttgagctgatggcagtgatgacgaggtcacttacccagaaacgattcggaaaaaccattcagctttatgcgccgttgtatctcagcaatgaatgccagaatatctgtacctattgcggtttcagtcttgataatcatctgaaaaggaaaaccctctccgatacggagctattgatagaggcatcagtcctgaaatcaatgggtgtgaatcatgtactgctggtaagcggtgaagccaataaaatagtaggtgtaccttattttcaaaatgctgtccgtaaactaaagcctcatttttccaatatttccattgaagttcagcctttaatggaagaagaatataaactgcttcacgaagaaggagtacattctgttttagtgtatcaggaaacctatcatcaggatgtctacagggaataccatccgaaaggtaaaaaatcaaacttccatttccgcctggaaactcctgacaggataggaagagcaggaattcataaaatagggctgggagtcctgcttgggcttgaagactggagagtagacagctttttcaatgctttgcacattgattatcttcagaaacaatactggaaaagtaagttttcggtttcctttccaaggctcagacccgctgaaggaattattgagcccaattttatcatggaagatagagatcttcttcagttgatttgtgcctatagaatctggaatgaagaccttgaaatttccatatctaccagggaaaatgaagtgttcagaaataatattgtttctctgggggcaacagcaatgagtgcagggtcaaagaccaatccgggaggttatgccgtagataaagaatctctggaacagtttgaaaccagtgatgaacggagtatggaagagattaaaaccatgattagaaaagcaggttacgatcctgtgatgaaagattgggattctgtttatagtggattttaaatttttaaaccattaaggactttgaagagatgaagttgaattaaaagaaatcaaagatttttaagacagctttttcaagcgaagctcaacttaactattcttaaaagcttaaaaaaccttaatggttcaattatcataaagcatgaaaaaagaagattatttttcccggtacagccggcagatctttattgaagaaataggattggaaggacaaaagaaaataagagcttccaaagtgcttgttatcggggcaggaggtttgggaagtcctgttattcaatatctggctgccgctggggtaggaactttaggtgttgcagattttgatgaggtagaacttcataatctgaaccgacagatcattcatgccgaaagcagagtaggattatccaaagttataagtgctgaaacctttgtaaatgaactcaatcatcaggttacattcaaagggattgaagaaaaaatcaatgaagataatgttgaagaaatcattactcagtacgatgttgttattgacggttcagacaatttttcaacaagatatctggtgaatgatacctgtgtgcaattacaaaaaactctggtttacgggagtattttaggtttcgcagggcaagttgctgtatttaatcataacggaagtaaaaacttaagggatattttcccggaaccgccttttgatgaagatgtaccggattgtgacagtttgggagtactgggagcactgcctgggatcataggcagtatgatggctcttcagacactgaaaattataacagatcttccggtaagtgtaaatcagctgacattggttgatacgctgagctggagatttcagacgattgatttttgatgtaaatgtaaacactcatatcacaaatggtttcacaaataacacgaattcaatatcaataggaacgggctttagcccgttctaattttaatatcttccattggctttagccaaaacctaaaaaaacaggtgataatcttttttaccacctgtttttatttctattgttaaaagtattattgtgcctgttgcattacgcctccggtatcctcttttttagtctgatttaagatattcggatcttctttcgctaatttatttctcgtcggaattttataattaatagaaagcccgaaatttcttgtgtcatatttactgtaaatcattaccggatttcctgatggcggattagaacttacctgcattacctgtccgttgaaaatatcattggcaaaaacagaaagggtcagacggttgttcataaactttttcgttaatgtaatatcaaacgagttgttgaacggtttctctgccgtaaagtagaaatatcctgcctttggagtcagataactgtaattcgcggtaagcttgatgtctttaggtaaaataatctgagtcatgatattgaagatccagaaccctttattgttcagattgtcgatttcatgtttctgatagccagcatataagtacatgaaattaattttatcaggattgaaattaaatttcatgatttcgctcaaaggtttactgaaaatcataaaaggaaccggtaatcccacattaaaattatgaattctcatattggaaatattcacctgctcattgaaaagtttccttccgtcttttcgaatgatctgtgctacctgattgcttgctgaacttacactgtatccgataaacgcataatcaaaagctgatattttcaattcataattatcaaaaatagtaggctgaaggttcgggttaccgtttacttccgtacttggtccggagaatgtgacgttattcggattcagggcagaaatgcttggcaaactgattttcctgttgtaattcgcagcaatataaacttggttcatcatgttatactgtacacttgcattcgggaaaaatttaaatttgttgaaaggaatcagatcagcttcaaccagttttttatccttatcaatatatcttgtgatcccagaaatatcatagttttcagcacgggaacccaatgtgaaatcaaactttttcagcttagcctgaaactctaaatacgttgaagcagtctgtctctgatattcaagattggtgaggccaaagctttccgtgttataatcctgcttttcatacaatcctccaaagcttacctttccgccatcaagaagcttgataggctgtgcgtaatctactttaaagttagcaatattcatcacagatttattgttcagaatatcttttaatccattggtagggctatcaagaggttcagtaggatagtttacaaaggtcccatcctggaaataattatcctgtgaaaacttgctgtctgaccttgtatacccaaactggaagtccagtttctgagatttgtcagcaaagcgcttctgatacgttacaacagcttcctgtctaaggttattggtatgcgcaacatcggaagaagtataaaaagcttctctcaaatcctgcagatttcttttgaaaggcaaatcaccatgtccgtcacttaaagtgtagttgtcattattgttgtgataaatatcgtagtttaacaataatcggtcctgtcctaaatcaaaagttaacccggattttgcaaaatatccgcgtccatatctgttggtatgacttgttaaaagctcatcctgctggccattcagcatactttcgcgataattctgcccaacattcagttgccatccgaaatatttatttcttgcatttaaattaacggaattcgtagttctgcttctgtatttgtcataattcgtgaaagaataatttcctgaataagtagccgtcaaatatttatttgcatttttattggtaatgatattcatgatggcacctccggaagttgccggaaattcagcacccggctgtgtgatcacttcaattctttctacagaattggcgggcatcccttccagaaaggaattcaattcattggaggtgatgttcagaggtcttccgttaaggtatacttccagcatttttccctgatacatcattcctgcaatatcggtagatacaagtcccggaagtttttttattccttccagaacgtttccgttattcagctgaggctgttcagaaaagtcaaaaatagtacggtctgctttttgttcaacggcttttttagttttggtaatgactacgccttcaatttgcttttcctgaggtttattatttttttcctgtgaaaaaacaaaaacagagcttagtaaggataaagcgaaaattgtttttttcataatgtttttactgttatccggttagacgcagaaaaagagaatttgttacggtaaatgtttgaaaaccgaaaatttaggctaactatttttttatttccgaaataattatatctttgccaggtaattatcaagaatctctagatgggatagcaacctgcaaaaacaagcaaggtgctgcaatcgataagccggatctcccggaaaaaatgtttatcattctatcattactcccatcttgaatttttgttttaaagttaaaatcaaatgtttaaagacaagggaaatcactcaacatcagtaattttttattcttcaggtcatgaggtaaatcttcattactctgatatgttctcatgccatttctatatgcgcatgtgttgttgtttctagtcttttctatttctaaaaaataatacaaacattttgaattctatggtaaccttacaatttagggttacaggatttgtattgcccaaaaaacaaattttatcaacaaaaagtacacaacaacatgcataatttcaaaaaaagaatctttgttccttctattgcacttatctccacattttactatgcacagacggataccttacaatctaagaaaatagatgatgtagtcatccttggatcaagaggttccggaagatcattaacagaaacacctgttccggtagatattattaacatatcaaaaattttaaaacaaagtccgtctaacagcatcagccaggctttaaattatatcgtaccctcattctcatccacctctcacaccgttaatgacggaactgattttgtagatcctgcgctcctgagaggattaggaccagatcaggttttggttctggtaaatggaaaaagaagatatcagtcttcactggttaacgttacccttacgccgggaagaggttctgtgggaactgaccttaatgctattcctgcctttgcattggaaaaaattgaagttttaagagatggggctgctgcccagtatggttctgacgctattgcaggagtactaaaccttggactgaaaaaaagactgggactttccggacaggtatttttaggaggatacgcttctcctgttaccaataatttctccggcggagtagatgggcagacgatttccgtagacctcaactacggagccaaaataggtaaaaccggattttttaacgttaccggttccgcccaataccgtaatccttattccagagccggagtaagggaaggtgatatcttcaatgcctataatgctattaactaccgggcattacaggatggagtgaatattgacggactctataaaaatattaccaatactcccaatactcagcaaatcatcaataccattaagcaatatacgactaaggtagattattttgggaatgattttcaaactcagatctcaggggcaaacagcatttctgagcttcaaaaaatattaggtaaagattttacttctcaggaacttaactacagaggattggagaggaaagacttcagtctgagagccgggcaatctaaactgcagtcagggcagctctttttcaactctgaaattcctgttaatgatgaatggaaagtttattcatttggaggttacagttatcgtcttggaaatgccggaggattttacaggcttccgaacaatgaaagaaacatcaatgcagttacacccaatggatatcttccacagattgaagccactgtgaatgattattccctagccgccggaatcaaaggaaaatgggatggctggaatatcgatttcagtaatacattcgggaaaaacgtctttggttttggtgttgtcaatacttttaatgcttcgcttacagatgcttctccaaggacttttgatgccggaggatctgagttttcacaaaacacggttaatttggatttctccaaaaaatatgatgttctgaaaggattgaacattgcctttggaggtgaataccgacacgagaattataaagtaaatgctggaaaagaaaactcttatgcttcttatgatatctatggccgtgtagtaacagccaaaactcctgaaaatgaaaaagtaaccgatttctttggaaatgtaagacccgcaggtgcccaggtctttccgggattcagtcctgaaaatgcagtttccggtaacagaaacagtattgcagcttatgccgatgcagaattggaaattacagacagatggctgttggaaggagctgtacgatatgagaattattcagatttcgggtctacattcaattataaggtggcaaccaatgtaaagctggcttccaatctcaactggagaggtgctgtttctacggggttcagagctccttcactggctcaaatctattacagttctacttctacgttgattcagcagggaaaaacaacacaggtaggtactttcagaaataattctgaggctgcacaggcattagggattccaaagctaaaacaggaaacctcacaatcctacagcacaggaattacatggaaggttccggccttgaacctgactttcacagcagatgcttacttaatcaagattaaagacagagtagtactgactgatcttttctaccgtcctgatggtagtttttctcctggctcagatcaggccgttctacaggatgcttttgatctcgcaagagccagcgcagccaatttctttgctaatgctgtagattctcagacgaaaggtctggatattacgatttcccaaaactcaaaaatcttatccggggtttctttggagaataacctgggaatcaattttaatcaaactaaaagaatcggggatatccatgcatctccaaaattggtaagccagattaataattatttttcggaacccaacagaatttattttgaagaagctgtaccccgtgtaaaagctacattgggcaatacagtaagagtttccggctttactttcgtactgcgtaattctttcttcggtaaagtgacggatgcagatgttttggatgccaattttgacggagtaacgggaagtacagagcatttcgttcttaacagccgtttggtaacagatctatctgtaggctatagttttaataaaaatatttcagcaacagtaggaagcaataatatctttaatattttgccttctaaaagccctgccataagctcattaacagcagataaccagtttgtctattccagacaggtttcgcagtatggtataggcggaaggttcttatttgcaagaattgaattcagtttctaatataaagactgacgttttgattaaaaaagacagaggttcaatctctgtctttttatttatttcagtgaagaaaactcagtgaaatcatattccgcggaagaggtaaaaagctgccttaatactgcggcatgtccatttccggcaatcacaagaattctgtcttcagcgttgtgaggaatgttttgaatattacggaacattctcagatttctgctgtaccagtaaagtgctagcatatcggcaccgtcatgttctcttagtttgaaatcaccgcttaaataagctccgtatccatattgatggctttctttggaattcatataagtaaaagtatcaagcagtgatttgaagtttttaggctccgaactcttgtaaaaggtagtgaattgttgggatatcggatcatcacttctgaaatcataatctttactaagatttttaaaaaatgcagaatcagttttcccaaaatgtttttcaagatcatccagaacagattctgcgtcaatgctgaacaattcgtttattgtaagctcactggctagtctcatagctagctgataacgctcatctcttttgtcacggtgtttgccttcgctgtattcctttagcttttgattggcattccagcctggccaggcttcaattgcaatctttgtcggcttaaatcttttaatatactctacaagttcagtgacttcttttgctgttttaggagaaagtacatctacctgatcttccttattggttttatgagcatccagattaggataatcaaaatgaaaggtgcctaccaccaggacttttgtctttggatttttaaaataatctgaaggttttttttgagcaactactgatgtagaaaggcatacaagaaggatataaataaaagttttcatgagtttattttttaaaattactgttaattattattgtgcgcggtttttttcttcgaaattcaccgctctgttattggatttgattttttggtttccaaaattataagtgatgctgagtgtcattcttctggcatcccagtagttgttgaatgactgtgtattatctgtaaaatacatatctcccttatatccggactgtttgaaaatatcgctcaccgaaagatttacctgaagtgctttttccacaaagctcatctttattccggcgtcaaggctggctctgttccttacagcggtgtatccgtcacgggaaggaagattatgccagtagttgacaaatagcatgaacgttttagccttattaagctggaatgtattattgagagaataataaaacgactgtccgtttttaggaaccagattgaatcttgtaatctgagtctcattataactgaacgaagtcgaaatattgctttcccatattttgaagaaagtatctgtataattcagattgatgccgtaattatcctgattatagtaattctcgaatgtgctaacgaggtcaatcccggtcaggaatgtgatctggtcaaagttatttgttgttctctggtagtaaagattggccgaaaatttacttttgaacatatagttgagttctatattatgattgaaagaaggctgcagacttgggttccctgaataatacgtgttcggattggaataccatcggaacggatccaaagcccggaaatacggacggttgattcttctggaataattaatactaaactgattatcctgattggccttataagacagataagctgttgggaagaactttccgtaattattctcagattttgtctgtgtagtaggagagaaaccgctggtttgtgaatattcataacggagtcctgctttcacagaccatttttcaccaaggtctttactggcactcagataggcggcataattcttttcattataatcaaaaagattgcttctcgaaggatctataaggtaatctccattgataaaattaaaatatccgatgtccgaattattagaaaacaggctgtattttgctccggtttccagctgtatttttttgaagtttaaagttaaatctgcctgccctgaatatattttataatccactgttgaaagatttcttaccacctgtgctgaattgttagcaacatttcttgtagtaaaatttacctccgtatccggaagatttccataataattggctcccaggcttagcttatgttccccgaatttctgatcaaaatatacattcagcatctgtgaagtaaaagaagaacgatgcttggaatccgtatctgtttgtaaagtaggagtattgtcggtaaaatagttttgtttagagttgatatccatattggaatgtcccttcgaaatatcatataccaatccgatattggaatttttggaaagagaataatcaacattaacatttagccccaatccgtcattcatatcccgtctttcatccctgctgacggaagaactttggccgattatcttataattttctaccgatcttttatctccgtcatatccctgaagttttattgaggctttcactttttcattctgatagtttactcctgccacactactgaaagctgcataagttttttgcgtataattcgtggtcaggtagccgctccatccaagattctgattctttttaagaacaatattaataatcccgctgtttccctgagcttcgtatttggcaggaggagtggtgattacttcaattttcaatatgttttccgaacgaaggtttctcagataattgatcagttcggcccctgaaagattcagcatccggtcattaaccatcacagaaacgccgttttttccagcaatggaaagcagtcctttattttcatccacctgtaataaaggtgtgccggccaaaacttcagttcccgagcttccttgtgaaagcatggaattctggacattgtaaacaagacggtccactttacgttctacaagaacctttttaccgttcaccataaccgcttctattttgttgacattagcggtgtctttggtttgagctgctgaaaaagaacaaatcagggtagctataattaaaatatgtttttccatattataaatgacagattgaatggtatttatattacatttctctgacaaaagtaccggaagaggttctatgagaaaacagcatttagatgaagaacacaattattcatgtcaaaaaagtttcgtcgggaaaaaacaggtttttatcgaaaacaattgatgaattatgcctttagagatttatatttgaatatgaataaaaaacaaattatctggcttcaaattatttactgggggttcaatttcataggaactgtcattacgcctaatttttttgttccggatacaaatcgtcgggaagtacacattctgagggttacatttttcattgtgaaaattgtcacattttatatatcctatttctttattttcccaaaagtttttaaacttgagaaactgtattctgccgttttcgtttttattctgacccttttatgttttgccggtatgagatatgctcttgaagaattgatactgccttctactcttggctttcgcaattatgatgaaggtacggggcttctctactatctttttgataatatatataatagttcgctgactactttcattgcaggtattctatggatactggaaaaatatggagtggctgaaaatgataaaaagcagcttctgatcgaaaagaaacaggcagaactccaggcattgaagacccagatcaatccacattttatttttaattcattaaataatatctattcgcttgtctatcagaagtcggataaggcgcttcctgctattgaagagcttgggcagctgctgaggtacagcacaaaagatcttgaaaaagataccatttctctggataaggaaattggatatattgatagtctgattgcactggagaaactcaggatcagaaatccggaactgctgatcattgagaaaaatattcagtatcctcacctgaagatttctccgatgctgttggttccttttgtggaaaatgctttcaaacatggtgatttccgtggtaaaggttttgaaatgaaaatctcagatcatgatgaggttttgcatttttatctttttaattataaaacacagaaaatgaaagatgttgtttccggcatcggaattcaaaatgtgaaaaaaaggctggaaatattgtacccaaaacatcagcttgagatcaaagattcggaaacggaatttgttgtagatttaaaaattgatttaaagaatgaataagataaagtgcattatcgttgatgatgagcctctggcaatctcacttctggaacattatgcagaaaagattccttttcttgaacttgttttctccacagagaatccgatacatgccttggaatatctgcagaagaatgattctgatcttatctttctggatatccagatgccggaacttacggggatcaattttatgaagattgtaggggcagatcaaaaatatattttaaccactgcctattcggagtatgcactggaagggtatgagcataatgttgttgattatcttctgaagcctgtttctttcgaaaggtttcagaaaagcgtattaaaagctcaggaacggttttcttttccacaggaagaaaatacctatttctttgtaaagtcttcagggcagagacatcgcataagtttcaatgaaatcctgtacatcgaaagtatcaaagactatgtcaatatccgaacagaaaatgatgagtatatcgttttggatacgcttaaatctatggaaagccagcttactgaaaaatttgtacgggtacataaatcttttattatcaatctggataaaatcaaaagtatcggggcaaaaaaaatcattcttcctgaatatgagattcctattggggaaagctatagagcaggccttcttgatagaatatcataatattcatatgagaaataaactttacaggtttctaaaacctgtaaggtttggagaatatcaaagttcagcagaggaaatgtaaaggcagttaaaataaaaaagacggcttcaactgaagccgtccctttattaattaatctaacaattaatcttatttttcctgttgtttgatcagattcagggcagaaccagccttaaaccagtcaatctgctgatcgttgtaagtatggttagccatgatgatgtctttagttccgtctgtatggatgaattctaaagtcagttgtttacccggagcaaactgatcaagatctaagaagttaacgatatcgtcttcctggattttgtcataatccgcttcgtttgcgaaagtgataccaagcatcccttgtttcttaaggttggtttcgtggattctcgcgaatgattttaccaatacggctttcactcctaaatgtctcggctccatcgcagcatgctctcttgaagaaccttcaccatagttctggtctcccacaacaattgtcgggatcccggcagctttgtaagctctttgtacagccggcacttcaccgtattcaccggttaattcgtttttaactttattggtttccatgttgtaagcattgacagccccgatcaacatgttatttgaaatattatctaagtgacctctgtatttcagccatggtccagccatagaaatgtggtcggtagtacattttccgaaagctttgatcagtactcttgctcctgtaatgtttttaccatcccaagccgggaattcttccaataactgaagcctgtctgaagttgggcttacattaacaacaactttagatccgtcttctgatggcgcctgatatccgttgtcatctactgcaaatccttttgaaggaagttcaaaacctttaggctcatcaagttttacctgctcgccagcttcgttagttaaagtatctgtaattggattgaagtcaagtctgcctgatattgcaactgcagcaaccatttccggagaagctacaaaagcatgggtattcgggttaccatcagctcttttggcaaagtttctgttgaaagagtggataatagagtttttctctcctttttctgctccttctctgtcccattgtccgatacatggtccgcaagcgttggtaaagattcttgcgttttcaaattttctgaaagaatctaagaaaccgtctctttctgcagtgaatttcacctgttcagaaccagggttgattcccaggatagctttaggttttactccttttgaaacggcatcttcaacaattgaagccgctcttgataaatcttcataagaagagttggtacaagaaccgataagagcccattcaacttctaaaggccatccgttagcttcagctttagctctgaattcagcaacaggagtcgctaagtccggagtgaaaggtccgtttaagtgaggagtcagttcagaaaggttgatttctattaattgatcgaaatattgttcaggattggcatatacttcagcatcacctgttaaatgttcagcaattttatctgctgcatctactacatcctgtcttcctgtagccgcaagatatcttctcatagaatcatcatacccgaaagtagaagtggtagccccgatttcagcacccatgttacagatagttcccttaccggttgctgaaagagattctgctccttccccgaaatattctacgatacatcctgtacctccttttaccgttaggatccctgctacttttaagatgacgtcttttgcagaagtccatccgttcattttaccggttaattttactccgataagtttaggcattttaagctcccacggcattcctgccattacatctacggcatcagcacctcctacaccaatggctaccattccaagtcctccggcatttactgtgtgagaatccgtaccgatcatcatacctcccgggaaagcatagttctccaatactacctggtgaatgattcctgctcccggtttccagaacccaattccgtatttatcgcatacggagcttaagaaattaaatacctcggaatttttgttgatcccttcctgtaggtctttatcagcacctacttttgcctggataaggtgatctgcatgcgcagtagaaggaacagctactttagcctttcccgcctgcatgaattgtaaaagtgccatctgtgctgtggcgtcctgcatcgctactctgtctggtgcgaagtctacataagagttccctctttcatgtgcctgtgtagcatttccttcccaaaggtgggtgtaaaggattttttctgaaagggtaagaggttttccaacgatttgtcttgctgctgcaattctttcaggataacgctcgtatacctttttgatcatatcaatatcaaaagtcatatcgtatttaattttgttcttgtctgttaaagtctcgttctttgatgataaaaagaaaaaaactatttctttatacatcaaaaaacgttcctattgtccattaataggaatgattttgactataaaatcaagagattttataactttcaatttaagaaaaaatagatttcgtttttcaggttatattgaaaaaaaatcgtatttaacttaaaatagaaacattctaaacaaaaaattgaaagatcttaaatcctaaaggactaaaatctttcaattatatagttttcaaaagtcttgcgacttatttgttaattctcttagtgagcgcttgtactggtcagttctttaatagatggtacaaacgttgtaagatcaatgccttcaacggctgctttatactcgtcaatgctaggaattctaccgataattgcagataataccacaaccggagtagaagcaagcagggattctcctttcttacgttcagaatcttcaacaactcttccctggaaaagacgggtagaagttgctaaaacagtatctcctttagccgctttttcctggttacccatacaaaggttacatcctgggcgctcaaggtacattacatttttatattctgtacgggcttctccttttggagcattgtcatcgaattcaaatccggaatatttctctaataattcccagtctccttctgcttttaattcatcaatgatattatacgtaggagctgccactacaagtggtgcattaaattctacttttccttgttgtttttcaaggtttctaagcatttgagaaacaatcttaagatcccctttgtgaaccatacaagatccaacgaaaccaaggtctacttttttctcacctccatagtaagaaaggtctctgatggtatcgtgggtatatcttttggaaacatcttcattgtttacatccgggtcagcaatcattggttcaacgatagcatcaagatctaccactacttcagcataatacttagcgtttgcatccggagtcagggcaggtttttctcctgatctgatctcttcaattctcttgttggctttatcaattaatccctgaagaactttattgtggttatccatacccttatcgatcatgatctggattctgttttttgcgatttccagtgattcgattaatgtattatcttcagaaatgttgatagaagcttttgccttcatttcagcagtccagtctgtaaatgtaaatgcctggtccgcaggaagtgttccgatgtgaacctcaatgattcttccctggaatacgttttctcctccaaactgcttcagcatctgagcctgcgttgcgtgtaccacatcacggaaatccatgtgttctttcatgtttcctttgaaggttacttttacagattcagggattggcatagatgcttcaccggtagctaatgcaagcgcaacagttcctgagtcagctccgaaagcgacaccttttgacattcttgtatgagagtcaccaccaataatgatagcccactcgtctacagtgatatcgttaagaactttgtggataacgtcagtcatggcatggtattcacctttcgggtcacgggctgtaataagaccgaactcgttcatgaatttcatcagcttcggaatattagcctgtgcttttttgtcccaaacagaagctgtgtgacatcctgactggtaagctccatctacagtaggggagattacggtcgcagccatagattcaagttcctgagcagtcataagacctgtggtatcctgtgaacctacgatatttacttttacacgaacatctgaacctgcgtgtaatacttttcctggggttactccgacagcatttctgttgaagatcttttctacagcagtaagtccttgtccttcgtgagaaatctcttttgacggagcaaaaacagcaggtgcttcaattcctaaaagctgagctgcaaatgtctgtagtttcttaccgaatacaatggcataagaaccacccgctctgataaattccatcttctgcggagtgaaagactttgtaaggtcgataagttccttatcgccgttgtataattttttttcttttgtattgattgttaaaacagttcctgttgctacagaataagcttcttcaagaacgggttcaccgttttcgttaagaacagggtttccgttctcatctactttctttacccagtttttaaggtcgatcccaatacctccggtaacgtctactgtggtaaggaagatcggagaaataccatttgttcctcctacaattggagcaatgttcacgaaaggtacataagggctggcttgctttcctgtccatagagcaacgttatttactcctgacattcttgatgatcctacacccattgtgcctttttcagcgataagcataacgcttgcatcaggatgttttgcttgtaaagctttaatttcttcttgagcctgaggggtaatcatgcatttaccatgaagttcacggtctgatcttgagtgagcctggttacccggagaaagtaaatctgtagagatatctccttcaccggcgatataggttactactttgatttcttcggcaacttcaggaagttgagtgaagaattcagcttttgcgtagctttcgatgatttcttttgcaatttcgttaccgctgttgaaggcttccttcagacggttggtatcggcttcataaaggaaaacctgtgttttaagaacgtctgctgctgctttagcaatagcaggatcattacctaaagcaaggtccagtagcacttcaatagaaggcccgcctttcatatgtgataataattcaaaagcaaatgccggggaaatttcttctactacggattctcccagaataatttcttttaaaaatttcgcttttactcctgctgcacttgttgttccgggtagtgtgttataaataaaaaatttaagagaatccggtcggtcaggattacctgagtctttaatttgtgtaatgatttcgcttagtaattcagcaccatcaataggctttggatgcagcccctgggtttttctttcttcaatttctttgatgtaatccttataaatactcataatagaaggtctttcaaaattaaaggtagccctgccttttctttaccggtctgtataaatacagtttaatgacattttgagttctcgcatttgacgcaacattaaccgaataaagtcagcataatctacactttttttaaaagttttttaaaattatcaaacatttcaaaatgttcccaaaattacgaaattttagtattttataagagtgaaattatttagattctttataaatatgaattttataatatctatttttggccgtatttttgtaaacaaatggagaatatgaaaaaattcctgaatgttttatgtgtttttatttcgtttttcgttttctcgcagacaaaatctgtgaagaaaacaggtgtgaaaaaaagtgcaaaaactacggccaataaaccgaatcccgatctggtaatcattaataaagacctcccggttttgatccctaaaaagaaaggtgaccagtttggatatgtaaaccaaaacggaaaattcatcattcaaccggaatatcatattgctgtatttttttacgaagactgcaaccttctgaattcacccaacgaaaaagtgagaaaattcgggacaaaaaattatgcaaccgtagaaaaagatatggtttcttacaggatagaccagtcaggaaagagagtatatcaatttaaggaagcagactttggaaaatgtaaattcgaagaatataagcagcagttgttccaagcctacattcttaatggtttttacggaatcatagaaaaatcaaagtttgtgaatgcagccgattacagacaatatcagatctatcctcaatatcagtacctctttatcctggaaggagatgatgtcgctaatcctatgattgtggcttccaataatgataaattcggggttattgatgttaacaataaaatcatcattccctttgaatatgctaatattaaaagaaatttcagctggaaactgggtaagatgtttgaagtgacaaaagacggacagaattactattatattgatgcaaacaataaaacgtactagggaataaatgataattgatgaatgatgattgatacatctgataattcctgtttttccatggtatttttatcccgtagcctaatatcccgtacctcgcacctcgatctcatatattttttgtaattttgcggctgaaataaaggggtgctttaacaggctgagattatacccaatgaacctggaacaggtaatgctgtttagggaaccatttaaataattgatagatgattagcgataaatgaccgataagcatcaattattatttaccatttatcaattatctcgtaatcaccccttttattcattaaatgtcaagatttatagaatgaaaggattattttttttagggcttagtataggctctgtagcttttatccaggctcaggataaagattccctgaaaataagggaaattgaagcggtcaattttactaaaagactgccggtagcgaaggaaatcatcaacgtgcagaaagatctggacgggaaaaacctggggcaggatctccctattcttttgaaaaatcaaacttccattatttctacttcagatgcaggaaacggagtagggtatacaggattcagaatccgtggtgtctcgggaagtgcaatcaatgtaatgatgaatggtgttccgtacaacgattcggaaagccagggaacattttttgtcaacgttccggatttaaccagttctgcatcgcagattgtgattcagagaggagtcggaacttccaataatggagtttctgcctttggggcaagtattaatgttctttctaaagatccggaagagaagttttactttaaaacagatgacagctatggttcattcaatacttacaaatattcagcagaaataggttccggaaaattctggaaaaaccgcctttccgtaatgggaagatatacgcatattcactctgacggctatattgacagggcttcctctaatttacattcctataactttactgctttatttgaagaaggaaatacgaagctgcgcttaatggctttcggaggaaaagagaaaacttatcaggcatggaacggcattgaccgtaaaacgtgggaaactgatccgaaattcaatatttcgggagcaatatatgatgccagctgggaaaatattgtaggattctacgataatgaaaccgataattacagacaaaaccattatcagttactgtgggaacagaaattcagtgaccgttggaatcttgaaaccacatttcattatacaaaaggaaaaggatattacgaaaattacaaacagggagaccctttctcaagatacaatctgccggatattactgaaggaggtgaaactgtaaaatattcagatttcatcagaaaaaaatggctgaataacgacttttacggaattgtttccacattgtatggaaagtttgaaaatctggacctgaactttggtgctgtagccaaccaatattacggaagacattatggaaatgttaccggtgttttctttcctcagattgatgaaagtgaatactacagaaaccgttctgtgaaaaatgaggtctcaggctttgcaaaggcattgttcagactggataattttgaattttttggtgatttacagcttaggaaaatcaactacaataccaaaatcctgacagcaggtgatgatgaaggagcagatttaagcaaaaactggctgttctttaatccaaaagccggagttaattacagaattaacggcggtaaaatatttctttcctatgctcatgctcaccgtgaacccaacagggatgacctgatggcgaacaatgatgtaaaagcagaaaagcttcacgatattgaagccggttttgaaaaacagttcggaatagtgtcgtttactgcgaatgtctattacatgtattatgtcaatcagttggttttgaatggagaattgaataatgtaggagcattcatcagaacaaattcgggaaaaagttacagaagaggaattgaaatcggggctttggcaaaactatccaaacaatgggaaatttccggtaacgtgacattaagccagaacagaaaccaggattttaatattcagaatggtgatgtgcctaaaagtctcgggaatacccagatttctttctcgccgaacgtgatagccaacttgggtttgaaatttaatcctgcaaagaatttccagtttgctttaatgaatcagtatgtcggaaagcaatatcttgacaatacggaagacgcaaatcttcagcttaaagattatttcctgacagatttcaatgcgcagtaccagtttaaaattgccaataatgaaattgccttaaaacttctggtgaataatctgtttaacaaaaaatatgtcaacaacggatctgtttatgagggacagccttattatttttcacaggctggcaccaatttcatgtttggggtaagctggaaaattcaataattgctaaaaggtgaaaggtcttgtaatgatatttaaatttacgaatcagccttttggcctttagtaaatttcccctttttaagcttgaaaaaagaagtttaattaacagtatatctattttaatacataataatcaaaggactgtttcggtagtctttttttataaaggttaaatatcctgaaaagtcatgaaaaagttataaatttgctgccaaatgaatatttcagcatacattttagaatacttaaaacaatttggaactgccacggttccaggctttggggtgttttcactgaaaaattctaaggcaattatcaattccgaaaacgggagcatcttacctccggccagtcagatagaatttaccatagactatgaagtacaggccgaagatcttactgcttttattgcagagcagaaacagatgtccctggaagcttcaagaagtgatcttaaaatccagactgatttctggaagaaaaaacttcaggctgagcagattcttgaaattcaaaaccttggaacagtcttcattgaagaaggacatactcatttcaagggaaaaagaatagaatccggccgcccggacttttacggattggaagagatccgcatatctgatatcaataacggggaaaaggtaaatacttcagttaaccgcgagaaagattttaaattcagaaaaacaattctctggattttccttctgattattccggttcttggaattttatacctggcatttacccagcaggagcttctttttgggaaaaaatctttcaataatgtttccgtacagacctctactcacagaattgtaaaagatacggtgaaagtgatggcacataccccggaaacgcccgtttcagattctttgaaaaaagattcattagtaaaatctgtcggaaaaggcgtaaaacctgctccggctgttccaaacaacactaagactagatggcaaaaataaaaaaagcgtcagaatccctgactattatgaccaatatcgttcttccgaacgaaaccaattctttaagaaaccttttcggtggtgagcttttggcaaaaatggaccgttgtgcgtctatttctgcagcaagacactgcgagagaagagtagtaacagcttctgtaaaccatgtttctttcaatcatccgattccggagggtggagttgtggttttggaatccaaagtttccagagcattttctacttcaatggaagtatatgtggatgtatggttggatgatccgatcaatcagaagaaagtccacactaatgcaggtatttatacttttgttgcggtggatgaattcaaccgtccgattcctattcctgaaatgattcctgaaacagatgaggaaaaagaaagatttgctgctgcattccgtagaaaagaactttcactgattctttccggaagaatgaaacctttggaatctgtagaacttaaaaagttattccaggaaccgcaggagtctaagaaagataaaaagtaaacttaaacacaaataacacgaatgactggcacaaattttcacaaatgatttgtgcctgatcaaatgaaaaaaaataatatggatatttctgaaaatgatatatcaaaaattgtttacgaagcaggatatatagttcataaaaccttagggccaggacttttggaaagtgcttatgaagaatgcctgttttatgaattaaataaacatgatattcttgtagaaagacaaaagccgatgccattaatttatgatgaggtcaaaatggatgtgggttacaggcttgactttatgattgagaaaaaatttgtgctggaaataaaatctgtggaatcactacaggatattcatttagctcaaatacttacctatctccgcctcagtaattgtaaacttggaatgttgattaacttcaatacacttcagtttaaaaacggtgttaaaagagtaattaatgggatattataatttgtgttatttgtgaaataaattagtgacattcgtgtttaaactatgaaaatacttcttttagataaaaaccatcctctcatcactgaacagcttttggctaagaattttatcctggaagaggattttacatcgtcctacgatgaggtttgtaataaaattgaaaactatgacggaattatcatcagaagccgtattccattagatcagaactttctggaaaaaggtaaaaacctgaagtttattgcaagagtaggagccggaatggagaatattgatatacctgtcgccgaaaggctgggaattcaactgatcaattctccggaaggaaacagggattcggtggcggagcacgtggtgggaatgttgcttgttatcatgaacaggctttttattgcctcccaggaagtgaaaaacgggatctggaaacgtgaagaaaacagaggtgatgaattgttgggaaaaacagtcgggttgatcggatatggaaatatgggtaaagcaactgccaaaaggctttccggattcggatgtaaagtgattttccacgatatccttccgggactttcagatgaatttgcaacacaggtttcactggaagaactgaaacagtctgcagaagttgtaagcttacatattcctttgacttcggaaacgcattatcttattgatgaaaccttcatcgcagaaatgaaaaatgatttttactttgtcaatacagcaagaggaaaaaatgtgaaaactaaaagcttagtagaagcgttaaaagccggaaaagtaaaaggtgtatgtctggatgtattggaatatgaaaagtcttctttcgaacatttggaagcagaaaatgaggatttgaaataccttcttgaatcagaaaaagccattgtcaccccacacattgccggctggacccatcagagcaaagaaaagctggcgcagtttattgtagataaaattgtagcctcacattgctaagcaaatattgtgaaataataaaaagtaaaaagacggatttgcaaaagggtgattcgtcttttttatttttgtaactaataattcattttttacttctctattcatttatgttaaataattcataatatccggctcatatttattatttattttgagttttattaaattgccgctcatttttgaatctcatgacgacgcgtaatttactacttatcttaactgtttttttatctctgttttcttgtaaaaaaaagtctgaagctaaagaagtttcagcagaaaataccaccaatcttcctaattacggaagcgtagatctgggaaatgttttcacaaaagctgacggacaactcctgaacagacagtcaacggtaaattacatcgatcagtattataaaaaagtttgggaaggaggagatctcagcgggggaattcttgttgccaaaggggatgagattttatatgaaaactacagaggtttcggaagagaaggaaaccagatgccaatcgataaaaatacacctttgcacgttgcttcagtttcgaagacgttaactgcaatggccatgatgaagcttgtagaggctggaaagataaagatgacggatcatcttacccagttttttccgggatttccctatccgaatgttactgtacaaactttattggatcaaagaagcggtcttccgaagtacgaatattttattaccaaaatacagccggctccggcagaactttccaagccgttcattaccaatcaggatgtattgaatatgatcatcaaatataaacctgatctggcaagagatacggatacaggatttatgtattgtaatacgaactttgctttattagccctgttaattgaaaaagtgaccaaaactccttttcctcaggcgatgaaagaaatggttttcacaccattgaaaatgaataacacttacattttccaggaaaaagatattcctaccgcttcacagtctttctattacggaggaaataagctttatcctttagacagacttgatctgatttacggagataaaaatgtctacactacgccaagagatttatacaacttctcaaaagcaatgttttcaaaaaacttcctgaagccggaactgatgcagatggtattcacgccttacagcaatgagaaggcaggaatgaataactatggattaggtttcagaatgaagatatttgacaatggtgaaaaacttacttatcataatggatggtggcatggtacaaactctgtatttgcccatcttttaaaatctaaagtgaccatcgtggcgattggaaacaaatattcaaacaaagtgtatacagcccttgctttatctggtttgttcgaagatttccctttgcagaaagataagcttcataccgtgatgaatgataataaagattctttgaattccggacaggaagtttttggagaataatgtttacttttgcctaaacattttcatgaaaaggtttcttttattatttgttatctgttttcttgtacactcatgtgcaagggtaggatcacctgttggtggacctaaagatactctggctccgaaatttttaagctcaaacattgataccacaagaattaatgtcaaaagagatatccgtgagctccgtcttgattttgacgaatatgtgacattgaaggatatcaataaaaacctgattatttcacctcccattaaagggataacaagaatacttccttcaaatatagccaacaaatttgtgttgattcaatggacggatactcttcaggctaatactacctataatttcaatttcgggaattccattgttgataataatgagtcgaatgtactgagatatttcaactttgccttttctaccggagataaactggatgatctttatatcagtggagaagtaaaagatgcattggataccaaaaagaaagccggtacaactactgaaaataagctggtagtcggcttgtatcaggtgaaagatacgatggattacaagaaaaagccttactatattacgaaggtagacgaagacggatattatgaattaaactatctgactcccgggaaatataaaatcatagcctttgaagatgagaatggcaattccatgtatgatccgggcaaagaaaaggtaggtttccagaaagatccgatcaatgttgagaaatcaatttcagggttaaacttaaaagtctatccttccagaaaaccggtgaaatatgtagaaatgaaagaaattgccggaggagttttaatgacgtttgaaggaaatcctgatgaagtgaaagtacagtcgctgaacgagaagttaaaggatgtcaaaatcacacacaatccaaaatcagactctgtgagaatctggtttgatgccgtaaaagataatgtaggacaggatgctaatgaaaaactgatcttcacccataacaaaggtccgaaaaaagacagtgtctacagtgtttctttattttacagatacaataagaagaatgctatggatgtcttcagtgataatgacggaacttctatcgctccaaaagcagatttgaaaattgcatctaactatattattgataaaattgatccttcaaaatggactttaagagcgaaaggagacagtttgacaacaataccgtttaatgctaaaatctcggaaacaaacccttaccagatcttggttcaatctgattttgtaatgggaaaaagttatgagcttaccgttcctaaagaaacggtatcttcattctttgcaaaaaatacccagtcaaaacgtttcgattttgatgttgccaaagtagaccagttcggaagtgttgaattttcaatttcgaatgctccggaagccaattattggattcaactgattgattcttccgacaaggtggcatatcagaaatacacaaaaggagataaggtaaagtttgatatcctgagacctggagaatatattgtaagaattcttgtagataacaacggaaacaaatattgggatgaagcagatttcgccaatgacatttttgctgaagatgcttatatcttctataagaaagtgatcgtaagaggattatgggaaacaagagaagattgggacctgaaagataccagaacacttgatagcccgaaatcatcgacatcaacgtctgccacatcgacacctgctccaacttcagcacctgcctctgcttctgcaccagaaacaacggttccagctgaatctacaacaaagcccgctttgaaaaaagaatttaaatccggtaatgctgttttaactccagctaagtaagcaatgaagactgctaagaaaatactattctggacattggttgcatttgcactgattcagtttttccctattgacaggaccaataaacctgttgatgctgctgtcaactttgttgatgcaaggaaatctccggaaaagatcagggcactgcttaaaaatgcctgttatgactgtcattccaatgagacggtttatccgaaatacgcttttattgctcccgtttcatggtctgtaaaaagccacgtgaatgaagggagggagcatcttaatttttctgtctggggaacatacaataaggatctgaaggagaacatgcttactaaatctgttcagacgatccggaacagaacaatgccgatgcctggctacattgtttatcataaagaggccaatctttcagaagcagaaagagcattactgactcagtattttgaagaaatgctgaagaataaaacctattaatttctaccataaaaaaactcccgcagattttacaaactaagcatattgtttaaacagtagtatgcctgatctgtaaaatctacaggagaatttttacaaaaattatttctttacatagctctcgaaaaatctcttctgggaatcaaaagcgatatcctcaagatccagattctgtaaaggaatccagacagcttccgagatctcggagagttcaaggtttacctcaaacttttccggaacattgtattcataaaagagatcaatcgtattataatcaatttctttatattgatatacattaggaaggctggtaaggtatttcaggttggaaatatcaatatcaagctgaagttcttcaaaaagttctcttttacaggcttcctctgcactttctttagggtctacgaatcctcctgcaagatcgagtttaccttttttaggatctctgtttcttcgggtaagataaatttcgtctccatatctgatgacaaccgctacagcgcctgccacattattgtacaaagtaaaaccacattccggacagctccattttttttcgccatcccagtgtaaggactccttgccgcagcttgggcaatatttcaatagtttcattgagtaatattaatatttctcgggtgataactcaaaataacatccctcaattcttcagttttcaggtgcgtatagatctccgttgttgtaatactggaatgtcccagcatttcctggatataacgtaaatctgcgccattctgtaataaatgggttgcaaatgaatgtctgaaagtgtgtggagatatttttttgttaacccctgctttatctgtaagttctttaataataagaaacacgattactctggacatggatgttccacggctgttcagaaacagagtatcttcatatttcttgttgattttacctttggaacgtacttctttgatatagctgtcaagcagatccgcggtatagtcggctaaaggaacaaaacgggttttgtttccctttccgtgtaccttgatgtattgctctttgaagttgatattggaaatcttcagatcaatcagttcagaaacacgaagaccgcagccatagagtacctctatgatgcattggtttctttttccgagatctgtattgacctcaatagcagcaataattttgttgatatcaggaaggcttaaagtatcgggcagatataatcccagtttagggccttcaagcagtgccgcaggattgtcttcacggtattcatcctcaagcagaaatttgaaaaaggctttaatggaggatatccatcttgcctgtgatctctcactgaatttctgtttggaaagattgaaaatgtattcctgcagattttcgtaggcaatagagtccggaccgacgttttccagatcctcttctgcgtaatcttttaattttttaatgtcccgaacataggcgtcgagtgtgttttctgaaaaatttctttcgaaacgaagaaatatttcaaaatctttgatcttttcatcccaagtcatttgtgcttatttttttagttcacagtccgatatttgttctatttcaatattatggtttctcaggaacgatattccatcgtcatctgaatactcattaatatacaccagtctcgtaattcctgcctgtaagatcagtttgctgcattccttacatggagacagcgtcagatataacgtagctccttttgcagattgagtagaagcggccagctttaatatagcgttggcttcagcatgcaatacgtaccagtgtgttttcccttcttcatcttcacagcagttttcgaatcccgaaggagtcccgttgtaaccatctgaaataatcatcctatcttttacgataagagctcccacctgttttctcttacagtaggagagttttgcccattcctgagccatttttagataagctttatcaaacttattcataccacagcattgtttttttttcgaaataatttggattaaagtcttttagaaagattagaagttcggctttctcttctctagaaacgcagtaactccttctttcttatctgccatttcaaaaagttcgccgaaatatttaatttcagtttcaaaacctttctctgtgtcagatagattcacggcatttattgcctttgatattgccattggtgaattgtaggcaatagtgtttgctaattctttagttttggttaataattcttcaatagggtatacttcattcaccagtccgatctcttttgctttttgagcaaggatcattttggcagagaagatcatttcgttggcaatgccttttcctacaagtttaggaagcctctgagttccgccataacccggaattaaaccgagcgttacttcaggaagccctaatctggcgttttcagatgcatatctgatgtggcatgccatggcaagctccaaacctcctcctaatgcaaaaccgttaacggcagcaataacaggctttgacatattttcaattttgttgaacaatgtattttgtccgtttcttgcaagttcttccgctctttcctgtccgaattcgctgaattccttgatgtcagctcccgctacaaaagatttttctccacttccggtaaggataattaccctgcaggaagtatcagcattaagttcatccagtgcggaactgatttcctgaattgtttttgcatttaaagcatttaaactctcaggtctgtttatggtaataatagataatttatcttctttttttaataatatattctcgtaactcatttttccactttaaaatatcattctttgcaaattatgaattttttacaaaaaaaaggaaaaaatattatttttttttccttttttttaatttattattcaatatgattatttggaatgattcatcatatttgcatcaatattgacgtttaactgagaagccactttcatgccaagctcaatgttggcgcggaaaaagtgacataactgacggttgataatttcgtctcttttaggcccgctgataccgttcatactgcccacgatgtttttgatcagatgatctctgtcttccgcattcattgcttttgaatacaaaagtccaggttgggtatagtggtcactgtcattatcatttctgttgtagctggcaacatgggcactgtctaactcatattcgtagtttttataagaagggtcaggcttaatatcatcaaagctgttcgggtgataatttggtttatcctgataatggcttgagtctgccataaagccgtctctctgataattgttgacggcaaaaggacatctgttcacttcaagctgatgagaattgactcctactctgtaacggtgtgcatcaggataagagaataatcttccctgcaacatcttgtccggggaaaaactgattccattgatcaggctgcttggcgaaaaagtagattgttccacatgggcaaaataattgacaggaatttcattaagttccatttcacctacttcaatcagaggaaagtcatcatggaaccatactttggttacgtcaaacggattccatctgaaatcttttgcctgttcttctgtcattacctgaatatacatcgtccattttgggaaatctccgttttcaatggcattgcaaagatcttcctgtgcaaaatcaggattttcaccagccatttttacagcttcttcatctgtgaagttttttacgccctgctttgttttgaaatggaattttacccagactctttcatttttatcattgatcatagaaaaagtatgggatccaaaaccatgcatatgtctgtatccataaggagttcctctgtctgacattaatatgagaacctgatgaagagattcagggtttaaactccagaaatcccacatcatggtggcgctttttaagtttgttttcggcactcttttctgagtatgaataaaatcagggaattttttagcatctttaataaagaatacaggagtgttgtttcctacaaggtcccagtttccgtcttcggtgtaaaattttaaagcaaaacctctcggatctcttgcggtatctgcacttcctttttcacctcctaccgtagaaaatcttgcgaacattctgcatgagtttcctacctttgaaaacagttttgctttcgtatactggctgatatcgtgtgttaccgtgaaagttccgtaagctccgcttcctttggcatgtactatcctttcaggaattctttccctaacgaagtgtgcaagattttcctggagaataaagtcctgcagcaataccgggcctcttggtcctaccgtctgggaatcctgatgctcataataaggcgctccgttacttaacgttaattttttagaatccatataattgatgatttgaataattgtttttcttttctaaatccaagtgtaaaggtaatgaatatcaaatttacttgaatttttaattgctaatagcaaaaacgttatatctttgtaatagataatattaatcaaatgaacattcagcaactggagtatcttatcgctgttgataagtataaacattttggtaaagccgctcaggcgtgttttattacccaacctacgttaagtgccatgatacagaaatttgaggatgaactggatgtaaaggttttcgataggacaactcacccgatccgtacaacggatgttggcctgcagattattgatcaggcaaaggtaatcatcgagtctgtcaatgagctgaagaacaaagcaaacctcttgaataatattctgggtggaaccatcaatctcggaatcattcctaccgtttcttctttcattctgccaacggaaattttcaagttccttgaggacaatccgaaaattcagatgaatgtaaaagaaatgaccactgataatattattaaagctctgaaagcaggagagctggatgcgggaattatctctactccttatgatactgctgacgagttttatcaggatttcctgttcaacgaagagctgatgatctacagttccaatacagaagccaataagaagaattcttacatcattccggaagatctgaatgtagaaaaagtatggctgctggaagaaggaaactgtctgagaaatcagtttgaaaacatctgccacctgaaagaaaatacattaaagcctaagaatttagactttttagcgtccaatattcagactttggtgcatatggtggataaagtaggaggaatcagtattctgccggagcttgcactgagccagctttctgaacagcagaagaaaaatgttttcagattcaaaaaaccttttccatatcgcgagatcagtattatttattataagcctacttttaaacaaaaaatcattgatgaattgtcacattctatcaagagttctttagaacttaaactgaattatcacgaaagtccgaaagaatttgtaagcatcaagcctcagtagcaggaatgtcttaaagtgatagaaatcatcaatttaaataaaattataattaataaacaaaatttttgagtattaggaaaatagtacttaaatttgctgacgtttattacgaggaaaaatttgacctgattgcaacctctataaaaaaatgctaaaacagtattcttttttttgggcaatttcattcatatttttcgcaaacactattttaaatctttaaaaacaaaagaattatatgtcttatttatttacatctgaatccgtttcagaaggacatccggataaaattgccgaccagatttccgatgcattaatcgatcatttcttagcatacgataaaaattcaaaagtagcatgtgaaactcttgtaacgaccggacaggtggtattggcaggagaagtaaaatcagatgcttaccttgatgtacagaccattgccagagaggtaatcaacggaatcggttatacaaagggagaatatatgttcaatggagattcttgcggagtgatctctgcgatccatgagcagtcacctgatatcaatcagggcgttgacagagctgtaaatgatgagtctttcgaagctaaagcaaatgcacagggtgccggggaccagggaatgatgtttgggtatgcaactaatgagacggctaattatatgcctcttgcactggatcttgcccacacaatcctgaaagagctttctgccattagaagagaaaataaggagatcacttatcttcgtcctgatgcaaagagccaggtgacaattgaatattctgatgatcataaacccatcagaattgattctattgtagtttctacacagcatgatgactttggaactgaagaagaaatgctgaacaagatccgcgaggatatcaaaaatattctggttccaagagtggttgcacagcaaactgaagagatcaaagctttatttaacgatcagatcaaatatcatatcaatcctacgggaaaattcgtaatcggaggacctcacggagataccggtcttacaggcagaaaaatcatcgtagatacttacggtggtaaaggagctcacggtggtggtgctttctctggaaaagatccttctaaagtagacagaagtgctgcgtatgcaacaagacatattgctaaaaatttagtggctgcaggagtggctgatgaagttttggtacaggtttcttatgctattggagtagctgagccttgtggtttatatatcaatacttacggaacggcaaaagtagatctgcatgatggagatatcgcgaaaaaagtttctgctatttttgatttaagaccttatgctattgagcagaacttaaaattaagaaaccctatttatcaggaaacagcttcttacggacacatgggtaaagagcattatgtagctgataaaactttcaacaaaggacataaaaatgagcttacattgaaagatcttgaattcttcacctgggagaaacttgacaaagtagaagagattaaaaccgcttttggaatttaatttctctttaaagaataataaatgaactgctttatctttggataaggcagttttttttaattttacaccttataatatagaaagatgatgaattttagaactgtagttgccatcctgtctctgtttttactaagtacagccgtaaaagctcaatataccatgcataaaatgatcagcgtgggctatacctaccagaatcaaagttttggcgaagtaggaggtaaattgcttttccttaaaaatgatgatgtgatctacagattgggagggtctgcaatgatggggtctgtggattccaaatttgccattatgccgaaactgcaggctgatgttcttcttaattttgaaaagaatgtggatttctatcactcatattattttttagcaggcgttgaaggaactaataaatatattgcccctaagattggagttaccttatttggtatgctggatcttacaggcggatatgcttttcccattggagatacccgtctgaacgggaaagaaatgaaagggcttaatgttaattttacattaaatattcctactgtctttattcacgacatgtttaagtgattttttttagatttttctctataaaatttaataataggttaacagttattaaaaaattattatatttacatcataataatttgtaccgcctatagaatagactctactctagaactgttttgttgatacagcaaaggccagatgaaatatctggaggaatgcctgtctgcgaattatttatattgagaagagttatgaaatcaaaatcggatagtttactaatttccctttaccagaaaggagacgagggcgcattatcgaccctcattcaccgacatcagagagagctgtttacattcattttttacaaaattaatgatgaagatttagccaacgatatctttcaggatacattcatgaagattattgtgatgctaaaagaagggcgctacaacgaagaaggtaaatttattctttgggcgaaaagaatttcccacaatttaatcatcgatcatttcaggtcaaaagccaagaatatcaaagtttcagaaactacttttgaaacagatgaatattctatttttgatttaatcagagaaccttcggagaatattgaggatcagctggtgaccaatcagattcaggaggaccttctgaagatgctgcagtttttaccacaaaaccagcaggaggtaataaaactgaggttttttgatggcttgagctttaaagaaattgcagaccatacggagatgagcattaatacaacgttaggcagagtaagatatgctttgataaacctgagaaaaatcatggatgaaaataatataatattgaccaggtaaataatatttcaaataaattcacgttttaaagaaaaacatacttcgcctatgaaaaaaaatgattctttaaaagtgaaaactttgaaacctaagaaacaaacaatcgattttttgctcaacttttctaaaagccttgaaattgtcaaaagcaagagcaagaattaccctgtctcgaaaaattaaaattactaactttgtgctgtatgaaaatgcagcacgttttttttgacctggacaatacgctctgggatcatcgcagaaatgcctatcttaccatcaaagatctttttgaaaagcaggaaatcacttcaaagtatcacattgactttgaagaatttcattctgtttatcatgatatcaacgaagaattatgggaaaagatcagagacggaattattggcaaagagtatttgagagaacaccgtttttatgattcattcaaacattttggaatagataataaggagcttgcctcttattttgaagaaaacttccttgataatattgtgagttataatgaactggtagaaggagcagaggatgttctggaatatctgaaagcgaaaaattatacattacacattatttccaacggatttcaggaggtgacagaaagaaaatgtacattatccggaattgcaccctattttaaaacgattaccagtgcagattctgtaggggtaagaaagcctaatccaaggatttttgaatattctctggggctttctgaagcaagaaaagaagaaagtatcctgattggtgacgattggattgcagatgcaatgggtgccacagatttcggaatgcatgctattttcttcgatgtatataaagaagataaacagaaggaaggattaaaagctattacccatcttcagcagattaaagaatacttataaacataagaacataagttcacaatataaaagccattaagattatcttagtggtttttttgttgtaatattttctaaaaaatcaacgtaaacatctgtggttaaatcttaaattttaccatatttatttttcgccgaatcatttttcccaattctttcccaaattgatcttgaactttgctccagaataacaacagaaaaatgtaatcatatgaaaaatgtaaagaaaatcacaggagtattgatgatcatgtttttattgatgggaagttttatttctgcgcaggatagagcaatctctcccaatcagttgccgaaaacagcaaaaaactttcttgctgtccattttaaaggcatacctgtaaactcagccatagaagacagggaaatctatggagttgatgaatacaaagtatatctgaccaatggaatgaaaatggagttcgacagcagcggaaactggaaagaagtagatggcaagcaccagaaaattccatatggttttattccggtatctatcagaaattacagttcgaaaaactttcctaatacttacatcattaaaatagaaaagaaaagatggtcatataaagctgagctttctaatggactggaacttgaatttgaccgaaacgggaacttcaaaaagatcgacgattaacactaacactaaacactaaattttaatattatggtcaactggaatatcataaacagcaacggaagaaagatttcttctgctcagatcagaaagaatatagtttcatttatgacaaggaatcatcctggcagtatcattgactctattgaaaaaaaatacaacgcttacaaaattcatttaatgaatggcctgtgccttgtttttgatgcagacggccgaaatgtgaaatcaaattagattactaatgaaaaggaacctgagagaagggggcagagtgtatttccattttgtagatatcttatcggtaatttatcatatcactcttatactgatcatattctcgtagactttcagatgggtatctctgcctccggcttccctccttataatttcctatatttgatataagttaaccatgcagcagagtaaatagatccagaaatatgaagattttaataatagaagatgaacccgaactgaaagataccgtacagaattttctggaagcagaacatttcattgttgaatacgcagagaattacagtgccgggctggaaaaaattatttcttacgaatacgactgtattttactcgatataatgctgcctgacggaaatggtatagatctgttgaaggagatcaaaaaaatgcataagaaagatccggtgatcatcctttctgctaaagactctgtggacgataaggttgcaggtttggaaataggagctgatgattatctggcaaagccttttcaccttgccgaacttctggccagaatcaaatctgtgatcagaagaaaaaatcaggatggagagaatatcatccgttacaaaaatataagcattgatccggagagcagaattgtgaaagtagggaatgaagagcttgtcctgaaccgtaaagaatatgatcttttgtattattttgtgattcatcctgaaaagactttgcagaaaacaacattggctgaagctatttggggagattatatcgatcaggcggatagtctcgattttatttattcccagattaagaatcttcgtaaaaaattgaaaaccctccatgcagaagcagattttcaggctgtatacggaataggatataaattgatctgatgaagacttcattaaaatattatacgataaaatatctgataatgatcctgctgctgattatagcagtttgggcagggcttttttatgcctatatcctggatgaagtacatgataatgtagatgatggtttaagggaccggaaaatacagattatcaaagcggtttatcttaatccgcagcttttgaagaataacgagtttggattcaatgaatttaaaatcaatccgattaaagctgaacaatatcaaaacaaaagcaggctttataataaaatgtactacatggagtatgatgataaagaccagccttacagagttctggaagcagactttatcgatcagttcaagggtcatcagcggcttgttataagaacttcaacggtggaggaagatgaattgatatacgatcttaccactgccctgattgtgctttatattcttttggtgataagtatagtggtagtcaacggatatttgttgaataaggcaatgaaacccttctatcagattctggataagcttaaaaaatatcagtttggaattcctttttcccgggaaaagtacaattataaaatcactgagtttgaagaattaaacaaagcaatcaatgaaatgattgaacgtaatgagcttgttttctatcagcagaagcagtttattgaaaatgcgtctcatgaacttcagactcctttggctattgtgattaataaaattgatctgatgatccagaatgatgatctggataaaaagaaccttacttttcttacaggagtgaagaacgacctgagaagaatggtaggtttaaataaatctttattaatgctttccaaaattgaaaacagtcagtttaacaaaacttcaaacgttgattttaatggaatgattatccagttggttcagaattacgaagattttatcgcttttaaaaaagtagaggtcggtattattgagaaaggaaaatttatagccgatttcaatcaggatctggcagatattctgttgtcaaatcttcttaagaatgccgtcaaatacaataatgaggaaggtatcctaaatattatcattgaaaataacagaataacatttcaaaacagcggaacccctgtgtctctggatacggcaaggatatttaacaggttctataagcagggttcagatcatacttctaccggattggggctgtctatcgttaaaactattatcaggcagtatccgggatgggaaattaactatgaatatgcagatcatatgcattactttattctcactaaaaataacagcagctatattaactagaaaagcctttcaaaacgaaaggctttcttatgataaaactaggtattaaaatcctaagcttgttcttactcttttaagagtttcctgagcaataggtctggttttctcagctccctgctgtagctttgcttcaagctcatcaagattgttcatatagtaattgaacgtttctctttccttctcaaaacgtaccagaatcaaatccagcaattcctttttagcatgtccgtatccgaagtttccggcaagatacttagctcttaattcctcggtttgttcaggagtagcaatcagctggtaaatggcaaaaactttatccgtttcgggatctttagggtcttctaaagctttagaatccgtttcaatgctcatcacctgttttttaagttccttttccggtaagaaaatattgataatatttcctctggattttgacattttctgaccatctgttccgggaacatatttggtgtcttcctgaagttcagactgaggcaatacaagaatttcacccatctgattgttgaatcttgacgcgacatctctggcgaactccagatgctgaagctgatcttttccaacaggaacaatctctgcatcatacagcaaaatatctgcagccatcagaatagggtaagtaaacaaacctgcattcacatcctgaagtctgtccgccttatccttaaatgaatgggccaatgttaatctttgataagggaaaaaacatgataaatgccaagaaagttcacaggtttcagcgatatcgctttgtctgtagaaatatgttttttcagtatccagtccacaagcaagccaagccgcagcaatctcgtaggtattttgtcttaaagtctgcgcatccttaatctgtgtaagtgtgtgaagattcgcaataaataaaaatgattcatttccttcctgcttggatagttcgattgcaggaataatggcccctaataaatttccaagatggggtgttccggtggcttgaatgccggtaagaattcttgacatttgttacaatttatatttaaaaattaatgaatagcaaatttacgaggtttgaggggaataacgaaagataaaagataaaagataaaagataaaagataaaagataaaagataaaagataaaagataaaagatgttgttattaaaattcaaaaggggtgggctttagcccatccagcttaaaatgtaacatccatccattggctttagccaaaatctatcaatcccaaataatcaatctatctttgtcaatcatctgtgaccatttgtgtaatacgtggttgaaaaaaattaaggaatcgcaatcttctcccctccgaatttcggttctactccgaaaagaagatcccaatatgccttagctttggctgcatactctctcatattagtctttaaccctgcatacttattcacatcagctgcattgtacccaaaggcttccattccattttttcgggccagaaaaacggctctttcattatggaacttctgagaaatgatgataagttttgtctggctgaaaatatccttggctcttactacagaatccagtgtcctgaatccggcatggtctaaaataattttatcctttggaactccttcctgtatcaatgcaaactgcatatcctcaggttcattataatctttggtactgttgtcgccactgacaataatgtattgtatttttccgcttttgtataaatcagctgcagcttttattctgttgtagaaataagcatttggctgtccgttgttcagaagtttcccggttcccagcaataaacctgttttggcttcaggcagatcagcaatattataagaaacgaaagactcactctcttttttgatgctgtaattcgcccaggtaataaaaataattcctgcaaccagaagaagcaggaaaattttaaaaatatttttgattatttttttcatccgaaatatatcattttaaaactccaggccgttcgggaaagctttttttctgaatatcaataagaatgctgcccctacagtaatcgcagaatccgcaacattgaaaatatatttgaagaactcaatgtgttttccgcctatcaaaggccagctttcaggaacataccagtctaccagcgggaagtgcagcatgtctaccacacatcctttcataaacgaagaatatccatgtccaaaaggaacaagcttagagactccaccgtaatccagccatctgtcaacacttgcatcataaatgcttccgctgtcgaagatcattccgtagaacattccgtcaataaggtttccgatagcccctgcaaaaatgatggccattggaatcaaaagatagttggaggcaccttcttttaaccattttttaaacatatacagcattcctccgatcaggaaaattcttaggataacaagaaaatattttccgataatacctccgaaatgaaacccgtaagccattcccggattctcaacaaaagtaagtttgaaacccggaaaaacaaaaacactgtcgcccagtccaaaatgagttttaatataaatttttgaagcctggtcaattaacaacactaaaaaggttatcgctaaaatctttttcattactgtcctttaggttttgaaggctttgctgccggctttacatttttgttgtcgcttgctttcttgactactttctgtccgttgaacgagcttttaacgtgagctttttcaaatttaatgcccatttccttcagaacacttttcagtgcactcagctccatagaatttttaggatgtactatgatagattccatttcttttgtttaattgttacattttagacagttcatcgagtctctttctgtctttctcagagagatcattcactccgtttttgcccattttgctcagaagtctgtcgatttctttctcccgctcccgtttatcagaattgaatttatcatcaatagtatagtttttctgtggatcaggaaaaaatctgtttttgatccatgctctgttgaaaaacaacaatactcctgcgatgataacgcccaaaattaataattcgctcatgggtatacattaaaaattaggtttataaagtatccgtaaatacgatataaacccaatattattttacaaaccttacggctatttctgcatatttttcgcttcgatgctcagcgtagcgtgaggaacagccagaagtctttccttaggaatcagttttcctgtcactctgcaaacaccatacgttttgttttcgattctgatcaaagcatttttaaggtcacgcacgaatttctcctgtcttcctgccaaaatagaattctgctctttgcttaacgtttctgctccttcttcaaaagctttgaaagtaggagaggtatcatccgtcccgttattctggtcattgatgaaactttctctgataagctgaagatctttttctgctttttctattttttctttaatgatcgctttaaattcctgtaaatcagcatcgctgtatctaactctttcgtctgacatattctttctcttttttaataaaattatgaaatggaatttgaaatacaataactacatgttaatttttttcaatatttatcttaaaattaacctcatctatttcgatttcgttaaaatttgaaagtgaagatacaatttctattttatttgacaagacttcagaagaaatatattcctcatttttcttaatatcattcaagaaaggagagctttcttccaatgcaattgaaattttgtctgtcagttcaaagtctttgtcttttcgcaggttttgaattctgttaatgaactctcttgcgatcccttcagattttaactcatcggttaacgtcaaatctaatgccacagttgtttttccgtcagaagttactgtccaccccggaatatctttagtagaaatctctacatcatcaagggtaatttcatatccctgaacatctgtttttccttctttttctagaccggcaatctgttctgcattaagattagcaatctctgcacctaccatcttcatgtcttttcctaatttaggaccaagcgctttgaagttaggttttatctgctttacaattaagtgggatgcttcttcagcattaattaattgtaattcttttacgtttacctcctgcttgatcaggtctgcaacagcaagaatctgttcttctgttttagaatccaatacaggaaccaatactttctgtaacggctgacgaacttttacattttctttctttctcaaagagaaaaccatacttgtaatgttctgggccaaatgcgttttttcaaccagatcctgatcaattaagctttcatcagctaccgggaaatctgtaaggtgtacagattcacagttttcttttcctgttactttattcaggtcctggtacaattgatccataaagaatggagcaataggagcggaaagcttggctactgtttcaagacaagtgtataaagtctggtaagcagagattttgtcatcagaatattctcctttccagaaacgtcttctgcatagtcttacgtaccagttactcaggttgtcattcacaaaagtgctgatcgctcttgctactcttgtcggttcataatcttcatagaatgcttttacttccttgatcagaagattcagctcagaaaggatccatctgtcgatttcaggacgattttccacttctttttctgaatagttgaaaccatcaacattcgcatacaaagcaaagaatgaatacgtattgtaaagtgttccgaagaactttcttcttacttcatcgattccttcaatgtcaaacttcaggttttcccaagggttggcattggagatcatataccaacgcgttgcatccggaccgtaaacagcaagtgtttcgaacggatccacagcatttcctaaacgttttgacatcttttgtccgttcttatccagaacaagaccgttactcattacatttttgtaagcaactgaatcaaacaccgcagttccgatggcgtgaagcgtatagaaccatccacgggtctggtcaacaccttccgcaatgaaatcagccgggaatgctttgttgttgtcgattaattctttattttcaaaaggataatgcaactgggcataaggcatagatcctgaatcgaaccaaacatcgatcaggtcgctctcacgtttcattgcttttcctgaatcagaaaccaataccactttgtctactacatttttgtgaagatccacaagctcatagttagactctgccatatttccgatgatgaaacctttaaacggattttcagtcatcagtcctgctgcaattgatttctcaatttcgttataaagttcttctacagaacctatgattttttcttctttcagatcgtctgttctccagatcggcaacggaataccccaatatcttgaacgggataaattccagtcgtttacattttccagccagttggcaaaacgtccctctccggtagcttttggcttccagttgatttctttgttcaggttaaccaatctatcttttacagcggtcattttcacaaaccatgaatccagcgggtaatataataccggtttgtctgttctccagcagtgtggataagagtggacatacttctctactttgaaggccttgttctccgttttcaacaggatcgcaagttctacatcccatgatttctcaggagctgttccttcatcataatattcgtttttgatatattttcctgaaaatacctctggaacattttctcctttgatgaatctcccctgtaaatctaccaatgggacaaggttgtcattttcatcttttaccaacataggagggacctcaggctgagccatcttagcaactctcgcatcatccgcaccaaaagtaggtgctgtgtgtacgataccggtaccgtcttctgtcgttacgaaatctcctaagattactctgaatgcattttcaggattatcgtttggtgtaaaccacggaactaattgctcatatcttgtgtcaacaagtttttctccggtaaattcttttaatattctgaaaggaattactttagtctccggagtatagttggcaaaatcttcatctgtaccttctgcatattttttaccgaaaactttaggtaaaagaacacttgataaaactacagttacaggttcaaatgtatactgattgaaggttttaaccaaaacatattcaatatctcttcctacggtaagagccgtattggacggaagtgtccacggagttgtcgtccatgcaaggatatgtacatccccgtcaacatcgttgaacaatgccgaagagtctttcttcactttaaactgagccacaaccgttgtatctgaaacatcacgataggtacctggctggttaagctcatgagaagaaagtcctgttcccgcttttggagagtaaggctggatggtgtagcctttgtacagtaaatttttatcatacaattgcttcaataaccaccaaacggtttccatatattttgacttgtacgtgatgtacggatcatcaaggtctacccaatatccgattttctccgtaaggttattccagacatcggtataacgcattacggcttcacgacaagctttgttatagtcttcaatagagatttttttgccaatatcttctttcgtgattcctaattctttttctacacccagttccacaggaagaccatgcgtatcccagcctgctttacggaaaacctgctttccgttttgcgtctggtaacggcagaaaatatctttcaatgctcttgccattacgtggtgaattccaggcataccgtttgctgaaggcggaccttcataaaaaacaaactcaggatttccctgacgaatctcaacactcttattgaaggttttattttgtttccaaaattccgctacattctctgctacgtcaataaggttgaggtttttgtattctttaaattggctcattgtaaatatctcaatatcgttgattaattaagtctgcaaatttactaaaatttgtcggtttataatatatgttttattttgatatcatctattaaaaagttcaatttcagaaatataaataaaatgtagggtaaaagtgaatggtgaatggtgaataagtgaatttttccgggtgttatttatataaaatttagcgtaatttattcaataagagcgggctttagcccgcttgaacaataaaaggcaaatccaacggctttagccaacctagttaatgattgcgcaaagttcataaagatcttaagaatgggttaacattgttcgcaaaggcgcttcactcagcagatgaatacgggaaaaaaacaaaactggtttgaaaaaggctggtgcagcaaccgcttattggccggaattttgtacatttaagtagacctataaacccaaatgctgtatgaaaatcttctgcaaactgatggttactatctgttttatctatacaatcatcataaacgcccagaataattatcctcaaaactatttccgtaacccgataaacattcccatgcagttggcggctaattttggtgctatcaggacgaaccattttcatatgggactggacttaagaaccaacagtcaggaaaatttaccggttctggctgcagcagaaggctatgtaagcaggataaaagtagaaagatatggttttggtaatgcaatctacattactcatcccaacggttatactacagtatatgcccacctgaataaatatttcaataaacttgatgaatatgtaaaggaaaagcagtacaaagacgaaaagtgggaacaggatattacctttcaacccgggcagtttccagtggaaaaaggacaacagattgcattgggtggaaatacaggaggttcggcgggtccgcacctgcatttcgagataagggataccaaaacagaagaatgtctcaatcctttattgtttggatttaatattccggattctgtagctcccattatcagtggattgtattggtatgaccgtagattcagtacatatgagcccggagcaaacggaattgaagtgaaaaaagtgggaagtgcttacactgcagaggttgtaaaagtcagttcaccgaagataagtttcggaattaaagctgtagataaagctaatcagggatttagtcttggaatttataatgcagaactattgatggatgataaactgatgtacagttttaaaattgataaagtacattatgatgatacccgatatatcaacggttgtatagattatacgaaattcatcagagacaaagtaggaattcagcatctgtctgctttgccagggatgaaactgcaaaattatattttgcctgaactttcaggaattatcaatcttcaggatgaagatgttcacaatatcgaaattgttgtaaaggatgtaaaaggtaataccagcaggctaaccgcgaaagttcagttgagtaattcaggaagcggaatttcatcttcaggtaaaacagttgtacctaatgaaggaaaaacgcttacaacggaaaatgcagaaatcagtttcagtaaaaatgcactctatgatgctgtaaatttcaatgcctatgaaaaaacatccgctaatccggatgcggtttcgaacagtattattttacataatccatatattcctgttcatgacgactatactttgaaaataaaacccaataggaaattatccaatacagaaaaagacaaggctattattattcttgattacggaagtgacaaagattttgtaaaagtaaaatggaatgctgaccgggcagaaggacgatttaacagattgggtacagtgcagttggtgattgataatactctgccatccgtttcgccaggttggaatgatggtgctttggtcagcagcagttctttgagactaaaaggaacaacaaaagtgggggatattgtttcattccgggccgaactggacggaaggtggctaaggtttgcccgtgtaaaagatgattttgtgtatatctttgatgaaaaatgttcaaaaggatcaggctctcatactctaaaagtaaccacgatcaataccgcaggaaataccaacacccaaacttttacattccggagataaaagctatggtagaaatcatgaatacattttccgtgaatacatcttacaatcatgtaattttaaataaatttgctttttaaaaattaaaatcattggaatttcatccgtcaattgagaaagcagggattcaggaaatcaaaaaatttcaggaagaaaaacttcatgaacttttggtttacctggaaagccattcgcctttttatcaaaagctgtttatagaaaataatattaatattgccgatattcgtatgttggaggatcttcagaaaatccctacgactacgaagaatgatcttcagcagcacaatcatgattttttctgcataacacctgataaaattgttgattacagtaccacttccggaacattgggagatcctgtgacattcggattgtctgacggtgatcttgaaagacttgcttacaatgaagccatatcatttgcctgtgcaggaattcagaaaggagatgttgtgcagatgattacaaccattgacaaacgttttatggcaggacttgcttactttttaggcctaagaaaaatgggggcaagtgtggtgagaatgggaccgggaattcctgaactgcaatgggattctattttcagatacaaaccgaaatacctgattacagtgccttcttttctgctgaaaatgattgactatgccgaaaaacacggtttggattataaaaattcaagtgtgtatggagctgtgtgtattggagaaagcatcaaaaatcaggattttacagataatattctttcccagaagattaaagaaaagtgggatatcaaacttttttccacctatgcttctaccgagatgagcaccgcttttacagaatgtgaatttcagatcggaggacatcaccatccggaactgatcatcacagaaattctggatgacgaaggcaatcccgtaaaagaaggagagagtggtgagcttaccattacaactttaggggtggaagccattcctttattgagatttaaaacaggcgatatcgtaaaagctcactatgagctgtgccaatgtggaaggaatacgatgaggttaggacctgtgataggcagaaaacagcagatgatcaaatataaaggaacaacattgtatccgccggcaatgaatgatatcctgaatgatttcaacaatattttatgctatcagattgttattcaggccaacgaaatagggcttgatgaaattatcatcaaattaagcacagaagaagagcatgaaacttttgtaaatgaagtcagggatcacttccgggccaaattaagagtaagccccaaaattgaaatcattgatttcgatattctgtctaaaacagtttttaatccaaacagtaggaaacctattacttttattgatttgagatagattaattttttaaaggaaaacatgatattggtttttataatatctttggcgctgaaaaaattaatactatgaaaaagttattattgtttgtacttgctatgaccatgacagttgctgtaactgctcaaaaagtgaaaattcaaagtggagatcttaaatttctgaagggggttgaaactgtaaatgttatttttgactatgccgatatgaagttgctgaaagaaaattacacagaagaacaatacattccaaaaagagtagaagaactaaacagaaaaattgaaggaaatggagatatttggaaaaagcagtgggaaagaagtaaggaggaactttggaaccctaaattcattactatttttaataagactcttgaaaaagaggggattaagatgaaattgaaggaacatgcccaaagtccatatactttaaaagttaatgtgaagtgggtttatccgggatgggatgcagggataatgaagcaggctgcaaaagtcactactcagcttgtttttgtagaaacagcaacgaataagatagtttgcgatattgatagccaggaagcaccgggagatcaatggggtagtaacttcaacaatgaaacaagaataggtgaaggctttgcgaaaacaggtaaaacactagcacagaaaatagaaaaagaagtaaaataataaaaaaaaacggtctgaatttttcagaccgtttttttatgcttgattttgttgttcctgtttttccagtttgatcaggttcgcaagatttttaatcactgtatcatgtttctttacgaaaggattgtctttgttccagacataacccgctaaaactgcacatatctttttctttacatcagggttttccggctgatggaaaaatagctcctggagatttccggtataccactcttttacataggtagtgaaaacatccactccatataaaatataatctgtgtattccttctgccagtcaattttttctccgtttagctgccttaaagccagtttagcggccagcattcctgattctgtggcaaaagccattcctgatgaaaacacaggatcaaggaattctgaagcattccccgttaaagcaaatccgtctccgaataaacttttaaccgaacaggaataatctttcaaatgtcttggttcaaaaaggaaatccacattcccgaaacgttttacataatagtcagaaagagagattgcctttttcaaagcttcagtggtatctccgttttcagataatttgtcgatatattcagtaggtcccactattcctaaacttgtgtttccgttggaaaaaggaatgacccaaagccaaacctctgtttcgatgatgtcaaaagaaattaaagttccttcctctccaggttccctgttaatatcatgtacatgagaaaaaatagcggagtggggtgatagttttgaaggtttttcaaggtcaagaagacgaggtaatactcttccgtaaccgctggaatcgataacaaactttgcgtggatctctttcgtttccccatctttatttcttactgtagtcacagaatctgttccgtcaaacttaatatcaataacttcagtttcgaattcaagatcaattcctttattaatgacttcctgagcaagtgtattgtcgaaatcagccctgggaacctgccaggtccagtcccagccttccccgaatttgttgctgaaatcaaaaatgcagatttcgtcgccgcgaagaaaacgtgcaccaagctttttttcaaagcccattttatctaatgcagggaaaagtccggcctcatcaaagtggtccatcaccctcggaattaagctttctcccactaccagtctggggaattttgttttttcgactactttcacgttgacgttattcttctttaagtacgaagaagacacgcatccggaaggtccggctccgattacaagaacgtcaacaaattctttgctcatctttgattttttattttaataataacttttatctttgccgcaaaattagtgacaaataattaatattttacaaaattatcaactattacttttaattgatgaaaataaataactttttagaactgaaagactttcaaaaaattatcattgagaatgaaaaaatagaactggatgaatcgcttttatcaagagtggataaaagttttcagtttttaaaagagttttcaaaaaataaagtaatatatggtgtgaacactggttttggcccgatggctcaattcaaaatcagtgacgaagatacacaccagcttcagtataacctgatcagaagccattcttcaggtatcggaaatcctttacctgccgaagaagtaaaagcatgtatgctggcgagactgaataccttgtcactgggaaattcaggagtacaccagtctgtaatttaccttcttcaggaattgatcaacagggatattgttcctttaatatttgaacacggaggagtaggagcaagcggggaccttgttcagctggctcacctggctttggtactgattggagagggagaagtattttataaaggagaaagaaaatcaaccaaagaggtttttgaaacagaaggcttagagccgataaaagtagagatccgtgaaggtcttgctttgatgaacggaacttccgtaatgtccggaatcggtattgtaaatgcctataaagcgaatcagcttacagatatttctcttagactttcttgtgctatcaatgaaattgtgcaggcttatgatgatcacttgtcagaagcgttgaatggaacaaaaagacattacggccagcagaaagtagcagaaaaaatgcgtgcccatctggcggacagtaagctgatcagaaaaagagaagatcatctgtatacccattttgaagaacaggaaaaagtattcaaggaaaaagttcaggaatattattctttaagatgtgttcctcagatcttaggtccggtattggacacactggaatatacagaaaaagttcttgaaaatgagatcaattcagcgaatgataacccgattatcaatgttgaagatcagcatgtttaccatggaggaaacttccatggagattacatctctctggaaatggataagcttaaaattgtagttaccaaactgacaatgcttgcagaaaggcagttgaactatcttctgaatgccaagatcaatgaaattttgccaccttttgtaaatttaggtaaattaggtttcaatttcgggatgcagggggtgcagtttacagcaacttccactacggcagaaagccagatgctgtcaaattctatgtacgttcacagcattccgaacaataatgataatcaggatatcgttagtatgggtacaaatgctgcggtaatctgcagaaaggtcattgagaatgcttttgaagtattgaccattgaagctattacaatcattcaggctgttgaatatcttgggttccaggataaggtttcatcatctacaaaagaactgtatgatgatatcagaaaaattattcctgctttctcagacgatatggtgatgtatccgtatctggaagaagtaaagaaatatctgaaaggaatgtaactattagctgttatggattgtctttaaaatagatatccggcatcaatttttaaaaaaactaaaaacgatataaacactaacgcatgaaatgtgcaattgtaacaggaggctccagaggaatcgggaaggcaatctgtataaaactggctgaagagaaaaactatcacatccttattaactacgcttcaaacgaaaccgcagctaaagaaactttgactaaagtggaagaacttgggtgtacaggagaaatccttaaatttgatgtaggaaataccgaagaaacacatgctgttttaacagcatggcaggaaagaaatcctgatgcagtagtagaagtgatcgtcaataatgcgggaatcacgagagacggcctctttatgtggatgcagaaagaagattggaataatgtgatcaacaccagtctggacggattcttcaatgtgaccaatttctttatccaaaagctgcttcgcaacaaatacggaagaatcatcaatatggtttctgtatccggagtaaaaggaacagcaggccagacgaattactctgcagcaaaaggagctttggtaggtgctacaaaagcccttgcacaggaagttgcaaaaagaaatgttaccgtaaatgcggtagctccgggctttatcagaacagatatgactcaggaattcaatgaagaagaactgaaagcaatgatccctgccaacagattcggagaagcagaagaagtggcggatcttgtcgcatttttagcatctaaaaaatcttcctacattacaggagaagtgattaatattaacggaggaatttattcataacatggaaaatagggttgtaattaccgggatgggaatttattcctgcatcgggacgtctttagaagaggtcagggaatccctatatcaaggaaaatccggtattgttttagatcagcagagaaaagaatttggtttcagatcaggtcttactggagtggttccaaaaccggatcttaagaatcttctgaacagacgtcagcgtgtcagcatgggagaagaaagtgaatatgcttatctggctaccattgatgccttgaagcaggcgaatctggacgaagaattcctggatgcccatgaagtgggaattttatacggtaatgacagtgtttcccaggcagttgtagaatctatcgatattgcaagggaaaaaaaagatactacattgatgggatcgggagcgatctttaaatcaatgaactcaacggtaacgatgaacctttccacgatctttaagctgaaagggatcaatcttaccatcagtgcagcatgtgcaagtggttcacactcattggggctggcgtatatgatgatcaaaaatggttttcaggacatgatcatctgtggaggagcccaggaaaccaacaaatattccatggcaagctttgacgggctgggagtattctcagtgagagaagatgagcctgcaaaagcttccagacctttcgattcaggaagagatgggttgattccaagtggaggtgcagccacgctgattgtggaaagtttggaatctgcccaaagaagaggagtacccattattgctgaaattatcggctatggattttcttcaaacggaggtcatatctcaacaccgaatgtggatggccccgcgctggctatggacagagcattaaaacagtcaggattaaacgcttcagatatcgattatatcaatgcccatgcaacttctactcccattggtgatgccaacgaggcaaaggcaatttatgaaatcttcggcagtaaagttccggtaagctctaccaaatctatgaccggacatgaatgctggatggcgggcgcaagtgaagttatctactcaattctgatgatgcagaacgattttgttgctccgaatatcaatctggaaaaccctgataatgaggctaaaaagataaatttagtcacaaaaacaaaaaatcaaaaaattgatgtatttttgtcgaattcttttgggtttgggggaaccaattctgcactaatagttaaaaaatttgattaaaaacatggaaagggaaaaaattgttgctatcgttaatgattttctggtaaacgaattcgaggtagacggagacgaaatcagtaatgatgccaaccttaaaaatacactgggcctggatagcctggattatatcgacatggtagtcgtgatcgaatccaatttcggggtgaaattaggagaagcagatttcaagaaaatggtgacatttgacgatttctatacaacgattgaacataagattgctgaaaaaaacgcttagttattgagtaaatctttattctataaaatgtgccaatgtaataatatcacagtgcttcagtaatgaacacagcaaggtatattacattggttctctgttatattaaactggattatgaacaagtggaaaggtaaatctaaaggaacagtgctcggatacaggatattcgtctggtgtattagaaatatcggaatcagaagttcatacggagtgctttattttgtggcagcttattattcactgtttcagaaaaaaagcaaccaatatattctttattacttccggaaaagactgaattacgggtactggaaatccaaggcttctatctttaaaagctattttaccttcggaaaagttctgattgataaaacagctatttctgccggactcagagaaaaatacacctatgaatttgacggtattgaaaatctcagaagccttttagccgctaaaaaaggaggggtactgatcagcgcccatatcggtaattttgaaattgcagaacatttctttgcggatatcgacttcgactgccagatcaatctggtgaccacagatcaggaagtgacggttattaaagaatatctggaaagtgttgctgtaaaaaaaagtaacattaagttcatttatgttaaagacgatatgtcgcatatctttgagatcaataaggctttatcagaaaatgaactgatctgcttcaccggagaccggtattttgaaggatccaaatacctggaggcagaactgctagggaaaagcgcaaaatttccggccggcccgtttttgattgcctcaagattaggagtgcctgttgtctatgtttatgtgatgaaagagaataatcttcattatcatctttacgccagagtggctcagaatatcaaaaaccgtgattcgcaggggcttttacagtcttatgttcagaatcttgaaatgatgttgaaaaaatatccccttcaatggttcaattattttgatttttgggatgatgttgattaatttttctatttttatcccgtaaaaactaacgaaaaactaaaaccattaagatgtaccgagaattaagatgattaaaataatatttccggataaattttctttgcttaccgcacaaagtaagctttaaatgtcttaaattccctgtttcttaatcattaaaagcacattctcttttgaagaaagaatatgacatacttgtaatcggcagcggattgggaggtcttgtttcggctcttattttggcgaaggaaggtatgaaagtatgcgttcttgagaaaaataaccaatacggtggaaatctgcagaccttttcaagagataagcttatttttgatacaggagttcattatcttggaggtttgagtaaaggacaaaatctgaatcaattcttttcctacctggaaatcatggatgatcttgaactctatcccatggatgaagacggctatgacaggatcagttttggggatgatgaaacagaatatccgcatgcacaaggatatcagaattttgtggaacagctttccagatactttcccgaagaaaaagaaaacctcgagaactactgtgaggaaattcaatatgtctgcagccagtttcccagatatcatgtggtagggaaagaccattacaacgaagaaatcctgcatctcaataccaaaagattcattgaatctgttacccataacaaaaagcttcagtcggtgctgctgggttccaattttttatatgccggagactctgaaaatgttcctttttatgtgcatgccttaacggtaaactcttatattcaaagtgcctacaaatgtgtaaaaggaggaagccagatttccaagcttctgatcagaaaacttcgcgaatatggggcagaggtacataaacattctgaggtttctgaatttgtcttcaatgaaaataacgcattgacggccgtaaaaacaaagacaggaaaagaatatgccgcaaaacaatttatttccaatattgagatccgttccaccattaagctgatcggcgaagaaagattaaagaaatcctttctgaacagagttttaagctggaaaccggtttcatcctgctttagtgtttatctggttttaaagcctcacagccttccgaattttaattacaacagataccactattcatcggaagatctggtttggaatgcatctcaataccaaaaagaatcatggccggaaacctatatgctctcatccacaccttcaaaacatcatcctgagtttgcagaaagcctcaccgctatttcctatatggattttgaggaggtgaaagaatgggaaaatactttcaataccgtggcagatgaacatgaaagaggtgaagcttatgaaaaatttaagcttgaaaagaccgagaagatgctggatgcgctggaaaagaagattcctaatataagacatgctatcaaaacaatatacacttcttctccgttatcttacagggactatataggaaactttgaaggcaatatgtacggatacatgaaaagttctgagaatcctcttaaaacaatggtttctccccgtaccaaaattgacaatctgtttctgacaggacagtccgttaatatgcacgggattttaggagtaaccataggagcttttaatacctgtgcagagattctcggaaaagatacaatagacaggaggctgacacaagtgattaataaaaactaaaagtgaaaaaaactaataccatatattcattctgtaaaagaactcttctttattttaccctttgtttttcactggcatcctgcggaatttcaaagtctgttcatcatattcctgacgtaaagcaatactcattaaagattccggaagtaaacagagtcaacgacagcactttcagttacaatcagaattatcttaccaaaaataagcagcagctctgggagctttacatcaaaggaaatcctttgcagctgggatataataatggtgcactgacacagaatctcatgcagaggcaggaagaaatctttttctcaaaagtggaagggttcgttccatcaaaatttaaacaaagaatcttaagaggctttttaaaatggtacaatagaaaaatgtacctcaatgtaagagaagactatcaggccgaattatacggcttatcacaatactcatctgatcggtatgattttattgcacccaaatatctaaggagcctttacctgcacggggctcacgatatcgggcatgcgatgcaggatctggcgatggtaggctgtacctctcttgctgtttggaatgaaaatacagaagatggagaccttctgatcggaagaaatttcgatttttatgtgggtgatgattttgcaaaaaataaactggtagaatttgttcagccggaagaaggaattccttacatgtcggtaagctggccgggaatgatcggtgtggtttccgggatgaataaagaaggcattacagtaacgattaatgcggggaaatcaaaaattcctttgacggcaaagactcctatctcccttgttacaagagaaattcttcagtatgctaaaaatatagatgaggcgattgctattgctaaaaaaagaaaagttttcgtttcagaatctattcttgtaggaagtgctgcagacaaaaatgccgtaatcattgaggtctcacctaaaaatttcggagtttacaaagtgcagaataccagcagggttctttgtaccaaccattttcagtcggaagcctataaagatgacaaaagaaatcagaaacatattgaagaaagccattcaaaatacagatatgaaaaactacaggaacttttgcgggaagagaaaaagatcactccggaaagaatggcttccattttaaggaacagatcaggcttaaaagacaaaccgattggttatggtaatgaaaaagcactcaatcagcttctggcgcatcatgcagttatattttcgcctcagaaaaaactggcctgggtttcttccaatccgtatcagttgggggaatttgtctgctatgacctgaatgaaattttttcaggaaaaccattatcacaaagtttaaagtctaaaacagacctcaatattaaaagagatgctttcgctgattctgaagaattccaaaactatgagctgtctaaaatgtatggcaaagaaatcaatgaggccgctgatgataaaaacatgctattgacggatgatattattccttcttatcaggccatgaatcctgacttttggttggtttattatcaatccggaaaatattattttagcaaaaaagaatattcaatggcaaaaacagcgtttgaaaaagctcttacaaaagagattacaaccgttccggacagaaaaaatgtggaaaaatatctgaagaaaactttaaacaagctgaaatgatccccaaatacataaaactgctgttctgcattccttttgttattatcatttgttattcaatgtatttatgctcagtttacagctcaatacctgccactattccgattcacggatacggaaatatgaaagataactacggaagtaaaatatttcttgtgtttccggtgctgatgaacctggctgttcttatttttatctggctgattatcagaaggccggataagataaaatttacctttgaaatcaatgaaaatgaaagagaaaaaacatatcatatcacccagcttgctctggtaattattgcgatatttgttaccataatgatgacgccgctatcattttctgatgtggtttataaataaatgattatgaaaaaacttttaacccttttttttaccgtatggtttctgttatcattttctcaggacaggaaagagatcggaaatacttttatcaaaacattactggcagacaaaaatgcagagaaggctcattcttattttgatccttcggtagctggccagattcctgtagaacagctcaaagctattccggaacagcttcagggtcagattggagcactgaaaaatatccttgaagtgaataacgaaggaaatatttattatttctacaccgaatttgaaaagacaaaactggatgtccagcttacctttggagagaacaataaactactgggtttctttctggttcctcataaaacatttgaaaaaagagatgagaaaacagagttcaggataaagagtgatgctgttgaacttaaggggacacttctggttcccccttccgataataaaaagagactggtgatttttgtgcatggttcgggagcccatgacagagatgaaacaattggagaaaacaaaccttttaaagatatcgcagaatatcttttcagccacggaattgcttcttaccggtatgataaaaggatctattcctaccctgaaacattcaacgaaaaatctacggtagaagatgaaaccattaatgatgcggtaaatgctgctctttatttcaaaaataatcctgagtataaaggatatgagattattatccttggacacagccagggagcgtatatgatgcccaaaattgctgaaaaggctcaggtttcgaaatatgtttttatggccgggaatgcaagacccttgcaggatttgttagttgagcaatacgaataccttcactccctggacccggcgaatgttccggcagaagctgttcaggaaataaaaaagcaggttgcatttttaaactcatcccgatttaatctaaattcacctaaatcagaactacctttaggtcagtccgcagcatactggaagtatttgaaagattacaatcagcttaatgaagtgaaaaagatcaaggctccaatgctttttgtacagggaggaagagattatcaggtaactgagaaagatttcaatctttggaaagaaacattgaagaataataaggcagtagtttttaagttttatccggcattaagccacctgtttatttcaggttccggaaagccctcaccaaaagattatgaaacaaaaggaaaggtggatgagcagtttttgaaagacctgacagattttatattgaaataaataaaataagatcattgatcctcatgagtctggaattttgtttcaggctttttaattgctttccggacttactttattcaaaaataaaaaagaggcaattcctgcaattgcagaaaacgtagtgcttaagataaaactgccgataacgtattgcagcagattgtttttgatgagttcaaaatttaaatcctggcttaaaatatcactgtctccactcacaaatggcgcacccagaaaaagagaggcagcaatgataaaaggaataaaaggaggaaggctcacattggaggctacaaatgcaaggactttattgagcttgaaaagtacagacaaactgatcacaagaagggtctggaatccccagaatggtgaaagtcctataaatactcccaatgctatggaaaatgcttttgtacggttgctcccgtcactttctaagacatcttcccggatgaatcttttaaagcttttttttttgaagttattcacgaagtttctcggaataatataaaacaaagtaatcgttaccagaattgtattcagaatactgatccttgtaaaatccttgaaaggcctgaaatgggaaacccgttcggcgggatcatacaaaaccttaatcggaacattttttaccggaacatgcctccaggcagttcttacaatgatttcaatttcaaattcaaacttaggggtaaaatatttctttggaattttatgcaaaggataaagcctgtaaccggactgcgtgtcttccagcttgataccggtctcaaaccagaaccagaaattggaaaaacggtttccgaaactgctttttttaggaatgccatcctgagacatatttctgtttccaatcaggagaacatcttctttttccaggagcagtgcttctacaaatacaggaatatcatccgggtaatgctgcccgtctgaatcaatcgtgatggcatagtcaaacccgagtttctttgctgctctgaaacctgttttaagcccgcttccttttcctttgttctccggtaaagagattaccgtgatctgaggatactgagcaagaatttgtggtgtagaatctgtggagccatcattgaccacaataatactttcggtgtagttaagaacaccgtcaattaccctcttcagggttttttcattattgtaggtaggtattaaaacacatattttcttttcagaaattgcattttgtacttcagcaagggacatttttttattttaaagtggctctttccgcctctgtaatggttttagactgcattgcaaaccttttgatatagccttttaatgctgtgttctgtttgctgtaattgtttagcaggaatgccttatcatccttcatgcttcctcggtagcccacaattttagggatgttttcctgaacactcagcctgatcaggcgcaattctgcattgttaggattatttttaatcacattttcaaggcttgtagcccctgtttttaccaaagcctttctgttatttttgacaatttttgcctccatgatcttagctgcagccttgtatcctacagttacaggatcggatccggactgcttttctgcagtatcaataaagttttgcgtattggtattggattcattggctttggcatagctgtttctcagcgtttcaagatctgactgaaagaaaaaaacaaatgccgttataaatgacaggattagtttcatgaggttacttttttatagcttacagacagtttcaatgcaatagtctcgccaaaggaagttgtgttttttactttaacatcctcattgtcttcattaatatcaagctgaagctgtaaatccggagtttcaaaaggattgataatcgccatgaattttacattcgatgctgtttttaagaataattttgaaccggtaaattcctccgtaagttctttgatgatctgcatcatacaaacaccaggagtcaccggatttccaggaaaatgacctttgaaaatatcatggtctttattaagatgaatatgagcagtaaactttccgtcctctgccttctcgtatgatgttaaagtataaaagtctgtaagaatggtttgcatgatcttatttttaagattaaatatatcatcagtttctttccgggaagctgcatttattttaagcagtattcctgtaggaaattattccgtttcagttatttgaaatagttttatattgattttaaagtctttgtgctgcagctgtaagctatccgcgaagataggtttttttgcatcaaaagtaaaatcgattttttcattgttgtttttcgtgtaaacaatctgtttcagcaaattattttctttgttgaagaataaatagtagattttattattaattttagaaagataaatcttagcattttcattctcaaagctttcgcttaccggatattgtcttttcagcagctgctggaaatcatttttcagaaaattaatgacaatttttttatccagatcgggaagtacataattcagtttgaaatcctgatcagaaacttcaaaatcaatcagtttattcccaaagtctgacgttagggcaacgcgatgtgttgtttcattcagttttttgataatcagaataccgctcacatggtttttataaatgtccatctggcatttgtacacataatcttcaccggaagagaaatataagttttccaccatcttttcagaagatgaaacaggttttactgctgttaacttataggttttacaggaaacagccaggatcagaatcaggctataaagaaaactctgacgcaggaatggaagcattgatcttggtatttttgaaaacaatattcgtggtatctccggaagcttcagtcatattcacctgtgaaactgtagactggcttttagggaaatacagctcgatctgtttgatgtatttcagcaattgggctgttttaggaacaaacttcgccacattgtaattcccatttttaaaatatgttacggtaaactcaggatcattgaacatcgttccgttggaacttcctacaataagtttattgattttttcaaatgttttgctcttcgcatctacagacgactttttcccctgatcattgatgtagatcttattgcttttaaaaacgatactgtactgataaggttttgtatacttccagctcagcatattgggtgtctgcagcgacattcggccgtaggtcacaatacttttatccagaaaatccatctttttggtctgggtaaaatcactctgtaacgttttaatctctttggtgtctgaagaaaccttcgacacaaatgctttagcttcagctcctgacattgccgtattctgggcaaaaaagaatcctgaaaccaataagaatgctccgaaagcaatatttttaatcatttctatctgaatttaaaactgtatcaacagtaaaagttgaatattttttgtcctccaaaaatactaataaattagccagcacgcgaaaggtcttttctgaagtgtcatgaaggaggataatactgccttttttcaggcccttggttactctgttgtagattttcttttcatcgtcaatgatggtgtccagagaacgtacattccatccgatgcttactttatgggttctcctgattgctttagcaatattggggtttgtcactccgaacggtggcctgtaaagatctgtgctgatatttccggcatttttcattacttcatcacatttttcaatttcctcaatcatttttgatgtggataaaaagcctgtggaattggaatgtgataatgtatgattcccaatggtatgtccttctgcgataattctctgaaatgtctcagggtatttttcaatctgcttcccgatacagaagaaggtggcttttacctgatgttttttaagcaggtctaaaaatttaggggtaaattctgtaggcccgtcatcaaaagtaagggcaacttctttaattctcgtgcgtttatgagtgatactcttgacaaaatatcccagttcaatatcaaaagaaccccagactactacagcagaaaaagcaaaaaaacaaaacagatatacccaaaaacttccatggaacgcataaataaaaacgttacagaaaagatagaacaggataaagggataatgtttcattgctgactgttttattacaagttttatagtcgtaatatttattgtataccattgtcactccgaaggagtccagactaatttctaatttagattccacgcttcacttcagaaccttgttcgcagaccttttgtctgtgctctgaatgacaaatggactgtttagtttacctttctaaacgaattcgtcaattaaaccttttccaataacaccagactgtggtcattaccagccagatgattgtaaagaagaacattctttacgttttcttttttctttgcgttgatcatcatcacttcaggaatctgctgttctttaaggatatgacaggccataaaggttgaaaaaccacttgctgtattgaactctccactcagatgcttataatacagctgggcggaatccggaaaaagatccattgcttttatatagtaagtatctgaatctgcatccccgctgaaccctaagataacagcatcaatatcatgagttgatagactgtttttcgctaagaaattcttgataaaatcctgtacttcattcaattcaactttgttgctgatatggatattcttaagctgggcataagaattttcagttttatctttacctataacaaaaaagctggcaccttcgccccaaatcactccgttggtagtagaatgcagataatcagcgggaagatctgcttctttttttatggtattatttaaagagtaaagctccattgttctggcagtctgctcatctgtagagcctacaagaatgttttctgcttctccgtcattaatctgaagcttggcatctaataatgagaactccagcgaagaagaagtattcacatacgtgaagttgtaagcatgacactgtaagcccagagcaatctgtcccgctaccgtgttatgggtagattggatgaaaaaagtaggggtaagaaactcttcatgattatcaatcacatttttcaggaacttttcagagtcctgcgaacagcccattccggttcctacaataatggcatccggctgttcaattccggcttctttcagtgcataatgtgaggctacagaactcatttttactgttttggacattcttctgatcatggcaggcggaataaattccttgtaattgggttctacagccttaaggatgtttgaagaattttcaggatgaaggttctgaaggatattttcatttaaagtgtcctgaacggagatacaggatgcactgttgatgtatactgcactcatgattttgaaaaaattagtgttgaacagtttcctccgaatccaaatgaattggaaagcacatgattgatgttcttttctttcaattcggttaccggagtaagatcaaactcttccattttcgttttaaaattcaggttagggaagataacattgttttgcagggctaaaattgaaaatacagcttcaattcctgcagcagcagctaaagtatgtcccgtaaatgcttttgtagagctgaattcaggaacctggttttctccaaagattctgatcatggcaatgccttctgataaatcattattaggagtcgctgttccatgaacgttgatatagtctatattttctttttccaagccggagattttcaaagcctgctgcatagctaaaaatgcgccctgtccgttttctgaagatgcagtctgatggtgggcatcattggcatttccatatcctgaaagataagccaggacttttttattttcttttctgaccacttcttcggactcaagcaccaggaaagctgctgcttctccaaggttcagtccttttctgttgttgtcaaagggtgtattgtaagaatctgtaagaatcattagggtattgaaaccattcaacgtaaattttgaaagagaatctgctccgccgacaatcacgcggtccaatacaccgtttttaatcagttttgcgcccatcataatagcattggctgctgatgaacaggctgtactgatggtagaaaccatgcctctcaatcccagataatcagcaatggccaatgaggaatttccggcatcgtgtgcgtcaatatatttttgcttttcggggaagtcttcataagagtagaaatatttttcagtaatatccatcccgcctacactggtagatgaaatcagaccggttctgtacccgttgatatctgaaattcctgcactttctacagcttctttagcagcaatcatacccagtaaagaagttcttgtgacattgttgttttcatcaagatgaagtttctgtacaagctcttcattggataattttatttcacccgttttaataagtccggcgtgacgcgtttcaaacatttcgatatctgaaattccatgttttccggattgtaatgaaataaaattttcctccacattgtttccgatggaggaaatgatgcccattcccgttatggcaattttttgactcatggtactacatcatataacaatgcagcaatttaacaatttaccaataattgctacattgatgcactattagattgttacgttaatttattttgttctgttgttctcgatgaatgcagccattgtatcgatagattggaaaatttcctttccttttttaggatcagctaattttattccgtaatctttatcaagaagaacgatcagttccaaagcatcaatagaatccagtcctaatcctcctccgaataatggatcagcatctttgatttcttccacagatacgtcttcaaggttaagaacttcgataattttgtgcttcaattccgtttttaagttttccataattaagttgatttaccagtgtatcagtatcattaagaccattatatcattacactgttatattgttatattttataaggttagcaaatatacaaaagctttgtaattttcctgatacaattctacccagccgcacaatactttgtcagcctttccggatctgagaatctgttcggaataattgtttaaaaaattttcgtcaaattcgtccaaaatgaaaaaagcattttccgtctgcattttgtgcttaatactgatttccccgacacagatgttaggtaaagtatatacaaaaacagcgggacttggatagtaattgtcagaatcgttgatgctttcctggtatttgaaatcggtatccagactggaagatctgttggcaaaaacaatagctgttctgctgtggtcttcatccttcaggatcatttcagcagaaagaaaagccagtttactcagatgatccattttatgaaatttaggatagctgagttctaaatttttataagcttccttagcaaattcctggaaggcttcgctttgactttcaaaaaccagatctccgccaactgttatttttgaatgctctatgatacaagtgtttattttcttcatcacgctcaatttaacatttttccagcacaacagctgcgttacaaccaccgaatcctgaagccgtcttcagaatatatttaatttctgcagcctggtttttcctgataatattcaaaggctgggttattcccgtttcctcaaagttctttgatggaagtaaggtgctgtgcagagcactttccatagaaataatgctttcaagaaggcctgatacacccagacaatgcccgtaatagcctttcatactgttgagaggaatgttttgaagtcccattctgttaaaggcaatggcctccatttcatcgttatataaagtcgccgttccgtgagcagaaataaaatcaatttgttcagccgaaacattcgcttctgtcatagcatttttgatactggcatataagccatctcctgttctagatggtccggaaatatgattggcatcattgactgcagaatctcccagaattttaaacctgaatttttcgttttgtgagattgcttcgttactctgttcttcgtaaagacatgaagtgatatacacagctgctgccgcttcaccgatgttgattccatccctgtttttatcataaggcttacaaggtccggaaccaatggcctgaaacgagttgaatcctgaaataacaaattcagaaagttcatctcccgcaatcacgtaagcatctttatactttcctgcccggatcatatttttagctgccgcaatggccattactcctgaaacgcaggcattggaaaccacaacaggtttcgttttgaatccgaaaaaattggctattttttgtgccagttttgataaataaacgccttccggcaattcagactgattttttagcagactgatatttccttttgttgtggaaaggataaaagccgtgtcttctgacaggatatgttttttaacaagagggtgcaggcttaaaagaagcattttttccagtcttgtaaaattatcactgttattctgagcgtcgccgaagattctgccgaactcttcattaagttgatcagaatctatcatggcagcataacaagcatcctgactgcctgtgattttatgtaaagcaacacccgattttcctcctagaagcgcattccagttagattctgtattgaatcctaaaggggttacacaattgtagtctgtgatataaatttccttcctcatgataatcccattttatctttccagttttgaaaaaattccgggttgtaaaggcacagggttccgttactgtccaggaaaacctggatagtttcaccgctgcacaccaattgatcttcctgattgaaaagctcgtatctgtagatcagcttggcggaaacagaattgataaaagttgtcacaattctgaatgtttccccatattttaaaggaagaaaatgttcacaggtactttttacaatcggtgttacatacccggcattctgaatatcaagatatgtcaggccatgctgacgtccgaaggcttcccttccgtcctcaaaatacacgatgtaatgcccatgccagacaattcccagcggatccgtctcattgaaccgtactcttacttcttcagtacagcttaatatattttctttagactgcattttgtttcttttcgtaaaatagggaaacagctactgtggcaaggtaaaataagaacagtaaaaccagttctttggcaattccaccgatgccgctgtttcttaaaataatatcatagtaggcattcagtccccagttcattggagagaatttcgctatggtctgcatgaattccggcattaaaaatacgggaacccagattcctcctacagccgccagaactactacagaagttgctccaaagggagcagactgttcctgtgtatcggcaatcgttcctaacagtacaccgaatccgatggctgccaaccctgcaaacaaagttacgatgataagctgaaacatttttccggatacatcaaaggccggaagatccatataaggaaatagataaattcccaccgccaccatcagtaaaaactgaatgatgcagataataagataagtaaatgtttttcctaatatatgcacaaaatacggagtagggcttattcttgctcttacgcttgttccctggcttttttcctttaccagattgatggataaaggaactacaataaagaagatggcaaaaagagtccatgcaggaacgttgtgctgaacggaattcggcataacatccatttccccttttttcggggtgatttctttaaagctgatcaggtttttgttttcgtcaagattctctgtggtacccaactgatcctgaaatgccttataaatctttttattttcaatttcaaaaaccattttgttgacagaattcatcactgagtttttgaatcctgcgttggttgccgggtcgaagtataagtgaatttctttggcctttggaataattttattcacttttgcagaatctccttccagcccgaacgagcttacgatagtctgaaccttagaatcaatatttgaatttaaatctttcgttaaattgtcaggaatgacgattgccatctgatagtctcctgaaaaaacagcatcctgcgcagatttttcattgaagttggtcagcagccggaatgtcttgctgttttccagttctgctttgatgttctttgagacctcagacttgtcgttatcaataaaaatgatcggaatctttgatccttcaaggtttttaaaggtagaatcctgaataagggtaatggttacaatcaaaagcagcggcatcacaaaaatgatgacgatacctccgatatctcttttcagaagaagaatttctttaataaagcttctccacaatttatacaacaacatctcttaattcttttccggttaatgaaatgaaaacatcttcaaggttttctgcgcttgctattctgtttaccagttcttcaggggttcctacagcatggatttttccatgatcaataatggcaatttttgtacagaattcttccgcttctgaaaggtggtgagaagtatagatgatacaggttccctgcttattcaaatccaaaagatagtcaataattgcttttttagactgaacatccacacctacagtaggttcatccagaaagagaactttaggattgtgaagcgttcctgcgatgaggttgcagcggcgcttcattccgcctgaaaactgtcctacctgcttattggcaaattttgaaagtcccatgatctccagggattcatcaatggcttttttgagcaggttgtgctttaaaccataaaggcttccgaaaaacatcagattttcttttgcggtaagcgtaggatacaacgcatattcctgtggaacaattccgatgatctgtctgattttgaaaccatctttctgcggagacagtccgttaatggtaaactgacctgatgtaggctttatcagtccggaaagcatagaaattaatgttgttttcccggcaccgttaggcccaagaattccatagatttcatttttgctgatatttaatgtgatatcatttacagaaaaatcttcagaatttttgtatttcttatataagtttttgatttcaatcatattttccgccatatcagatcgcttttctcagttttttatagaaagcttcttccagatctgcaatatgcagcattgtttttgaaagttcattgtagatattgcttttcgaattcctgtttttatatacccttgcaatatcaacggcaaaatccctccaaaggtcaccaatagcagtaatttctttggataattcttttagctcatcatttttaagaataacagcagcttcctgaagaaatgctccatagataaatctgaagccaccacctccggttccgatttcctcctgcatcctgatcagctgccccagataatggttggttacttttgttccttttttctctgcccatttcgggatgcttttcgcgacccatctcatggcttttaccccgataagcggtaccggagccagcatatttttgcaggtatctttgattccttttttaatggcttcttcaagattcacattttcaggaacataaacagggtagtacatgtgtcctttcggaggcagtgctccttttgcgtatcttactttttccagttctgcttcggaaagggaagttgtgtaatccattaccggatcactgatcagaaattttccgtcttcttttccatagaccacaaggttgtgggcattgaagtggaatttatattcttcaggaaagtaagtaaggttgaaaacccctacctgaagccctgtcggtatattttgttccagatttctttcgagcgctttctgggcatccttaggatttgagaatttctctcttttaattttaattcctaatcttttggccgctttactgaaaattgcacccggcatcgggcggtagctgaagcccggagcaaaatttacctttaaaaaagggagatagacaaaaaacagtccggaaccgatcccgaagatcataggttcactaagtttaaggcctttgttgagcagtagattagaagcaacaccgttttcgcaatgcgcagtctgatggtgttcaaagtttaatttcatttgctgattgtatctttttcataggtaaaatgaagccttgcttcattatttcccgtcgaagttttttaattcatccactgaaattccgaatgcatcggcatattttttcagtgcagtttcgcttagtgttttgaatacttttggtttaaaatgtcttttgaccctccattgccacattcctacataagaagaaagaacgccaatatccattttattcagttccataaaataaacgatggggcttgcggtattattggccacatttttccttgcttcctcaattctttcatgaataagttccatcgattcatccagagcagctttcttggcatcccagcctgtactgtttgctgtcgtgtaattgtcattctcatccgtcacatacaggacttcagtcatgttggcggatttcaggttactttcgtcttgaggcaggtcttgttttttcatctaaataatgttatttttttagattccagatgagaaatggttcacctgtttttgattcttttaatcaggtggctaaaatagtgaaaatacattatatgtaaatcatattaaatctgaggagttattacttcaaaactgaggccgtattaaaacattttgcagattccaacagaaaataattatgttgaattactggtattataaagttttgttaattatttcaaatatatatattgtttgattgttttatctatatttgtttcattcaacaacaaaaactaataacttaaaacgaatttaaaccatgaaaaatttaaggttacttacaaagaatcaattgaaaaaagtaaaaggaggaatcacagtgtatatttcttgtgctaatggcaccaatggccaaatccgtaacgtggatatcaataccgatattgcaggtcctgctgagcagatttgcggaggaaatgattatgaagttgttatttagaataatttataaagatttaaactcagtcatgatgtagcttacgtcatgacttttttattccttttgcttgataataagtgttccacggatttataaaatgtttcacgtgaaataattcaatttctgatgatatttaaggtgttttattggtttgattatcagtagtttttagtgcgttttttattgaagttgaaataaatataatgaaggttttattgtaagattttataatcaactcaatagaagcgggctttagcccgcttgcagataggaatcaattcaattggctttagccgaaacctgattcatcacaaatgtcaacaatctggagtgcaatagtaaaaaaagctgcacaaaaagtacagctttactatatctatattcaattgaattttacgattttacttcctgaataaacaggttgatttctgctctgatcaataattcatcatgattgaaggtttcacaaaatatatggcagatattctcaaactgcgagataagtgatgccctggagataattttgtcattcacctttggaagagcaaaaacctcaattttcttgatattggtaatgaagccaataactttggtatctgcttcgggattttcgaagaagctttgtccaagaatcgatgagcaggtttgggccaggttttcaattaatccggcttctacaaattcattattgtgaacaaatatattatcttctttaatttcaaaggaagtcactactttttctttggtcagttcaagaatataatctgccataagcatcggctcgcgatgtggtaaaaagttgtgtatattgatgatattttcttcctttatttccatttcggtttattttacagcggttttcatttgagattttgcaatcacttcaccgttaagtttggttacgatatctaccagggttactcccattacttcattcagaattgttacctcagacttcagatggtcgccaattttaggcagttgttcagcttcaaaagacttaatggctcctatatatccggtaggtgcatcttttccaagcaggtaatatttatatcctgtatgtaaagcaacgctttgtgcctggtgttcaataagtcctgaggcctgaaataatccatcctggataaagaggttatcttctttgatttcaaaacctgacaggagatgattttcagaatactcggtcaattcatgtaccatcacaaaagggaacctttgcggaataagactttctacaaaatctttatcagatgtcggcagcttgttttccattagcaaacggttagtaaagcacatgaataagcaaatcttccgctttcaggaacacaaagaagtactttttctccttttttcagtcttcctgaattcatcagttcttcaagagcaataaagatagatcctgctccaatgtttcctacttctgaaaggttatagaaccatttttccgcagggaagtccattccttttttagcaaattcttctttgagtccgtctttgaaatagcccgaagagatatgagccagcacatgatcaattttttcaggatctaaattatgtttgtcaaaagaagaccttaaactttcagctccttttacaaggatatatttatccagaattttcgtatcctgtttgatggcaaaaatagattgtttcagccattcatcagaagggtaatctgcccatgatttcaggctcccatcttcaagtttatcacatccggcatacatacatgcctcaatttcgtgggcatatgaatagaagtcaatgaattctatctttaatgaagtgctgttttctcgtggcttattttccaaaagaaaagctcctgctccgtcagaaagcatccatctcaggaattctcttttgaaagcgatgataggtctttcttctaataattttaaattttcagcttcatggttaaatttatcagcagtcatccatgcagacattctttcggagcctgcacatacagcattttcctgtacgcctgcttttacagaaaggaatccgtaattcagcgcattcattcctgaattgcaaagacctgttgaagtattaatttcaatagattttccgatgttcagttcaccatgaaccatcgaagcgtgtgatggctggatctggtctggtgaagtggttcctaccgataataatttcatgtcttcctttttgaaattttcatcaaaaaggccttcgattgcttttgccgtaagctgcgcattagagtgtgtaggatttccttccttatctaaagcatagtatcttgttgtgattttattatttcttagaataagtgattttgctttggatggcgcatcattgataagcccaagataagtctccatttcatcattcgctaccggctcattgggtaagtattttgatgcttttgttataaatacgtcgtacattctattttaaattaattccttgtaaatatcttttttgtttttgtcttttaaaccaaaatataggggtggtaagaaggtgtaataccaaaacgacaggtgagataatccatatcgcggccatcaaatataccttaaagaattttatcagcaatggacgtttctcttttttcttgataatcagattagaccatactgtgaaaattttatttcctaccttctctacacgtaccagaaatgcacggatttcaatggctccgtatttaacaagatccggttgcagattcatcagatcattgttgttgaaatgtctttcaataatctcgccatactttacagaacctgcaatttcttcatcagaaacaccggctgccggaagcattcctgatttttctttccggcctgtggtaagccatctgagaatggtcagtacgctggtataattgtcatgtctgtctaccaatgctatatttccgacaagttttgcctgcagatctcttaaatatacttttagtttttcctgggaaagcatccacatatttcgggttccggaaatggtaactacaggagtatctttaaggataaggcctgcatactcactttttaagaatgaaataataggaatggatggtgtgagataccatacctgatatccgaacaggataagatcatactttttattgagaacttcttctgaaggtggaaggatttcttttggaatctgcagataggattcgggaaaagtgttgaaaaaaacatcacttggccagggaaacggaaagtcttccttgagcttaatattataataggtaacatcatatttctccttttgagcttcaaaagggctggcgatgttcttcacaatatcctccagttggccggtttgtgaataatatatgacaagtatatttttcttcattagttttctttagggtttacaaaaatatgtttttcatatttattaagtagatttaaatacttttatgaattcagaactgaatttcagtgtataattttcactttgaaaccaggtgttttttgcatttacgaaaatgatagtttcaggaagttcctgaaggtcactcattgtagaatgctcatctgatatgagaagaacgtcaattttcttattaatctcagaaaggtctttgatataatgtatttttcttctttttaccagatagctgtgcgcggcagtttccctcttttcatcgttccggatcatagagaaaattcttctgtttgcctgatataatgttaataaagcatctttttgcccaaaatcatcagctatatgaaggatgccggcgtcattgggaatatgcttgttaagctcaaaatatactgatttgttggtgttaaaatcttcttttacgtctttcactacttcactgtctttgtaaagatagctcaggaataatttcttcttaaaataattttcatcctcaatctcttcccgaagttttgcaaactcttctctgaagtaagcattgatctttttggttctctcagaatagtttttaccaaaattcatatcatctttgctgattctgctgcccacttttacagtgatactgccatcatagataataaagtctccttttggcaatacttcagaatttccatggatgtagattgggagaatatccaggccgaactgttctgcaagataaaatgctcctttatgaaatcttttgatgtcattggtataagaacgttctgcttcagggaaaaccactaatgagtacccttgttcaactttttccttcagtttttccatcccattttcaattccctgtgatacggggtaaaacccaagagctcttaccagctttccaaaaataggagactggtatacccagtcattcacaagatagatgattttatgagtcgtcattgcaatcgccagtgtatccagaaaggatgtatggttggcaatgatcactgccggtttgctgaaatcttccgacggattcttaatgaccttcttctttacaaaaggattagaataaagaacagaagttaaaaaccttgctaaaattattttgataatattcagggtttttcctttggaatttttgacaaagaagcttccgaaagcggaaaacagtagtccgccaattccgtaatacaggaatgaaaatacagaccatatgaacagtctgaaagtaatcggtgaaagtccttttttcgctctgttggtaatcagcagtctgaaccagaacggatatagggtagaggtaataataataaccgagaacattccgattaaagcaaccaaagccagggaatgcagagccggatgtttggcgaaaatcagggagccaatggaaagaatcgtagtgaaaacggcaagaataatagaaattctgtatgtaggcagttcattttttccagtggtatgctctttctgcatggcttgcgtaaggaaaatactgaagtcatcaccaaccccaaaaaccaatgtgcacactacagtactgaaaatattcagttcaagtccaagaaaatagaggattccggctgtaacaactcccgttaaaacaatcgggaacatggtaagaaccgttaattcaaaatttctgaaaaaaacaataatggttaaaataatggctagaagagagtagttgatcaaggtattgaaatcccttttcaataatccaaggaaattttcattcatctgctggcggtcaatagcaatagcatcatgcttcttttcaatatctttgataaaagcatcccttttcttttcgtctacttttacaacgttggaaacggtataaaaaccattctcgctgctcatgaattctgaaatctgaagcgctttaacttgttgataatccttcagttttaatacagaataatctttatgcaaaacttcattgaaattatcaaatgcagaactgttgaaacctaatttatttccgttactgatcagctcagaaatggtctggcttttctttttctcattccagaaactgttccattcatcaatctttttctgttggtctttttctgaaagcacaacacttccaattgaattgtagcttaaaattttgccctctttcttctctttttcaaggaagctgcttagttcagagtttctgcttaaagcatcttcttcagaatttccgtaagaaatcgtataaatagattttgaagtgatgtcggaaagcttctgtagctttgcttcactgatttttaattctttcggaatataattcagatctccaatgtcttcattaaatcctacatgtctgaatccaaacaggcaggccagaataataatggaacagcctatgatcaaaggcttgtttttttcgtacggataagagccaatcttatcaataaagttggtgttcaggtgttctcccttttcttttggtttataaagctgaggaacgataatcaatgctgtgatcgaagaaagaatcacggtaatggctgcaaaaagtcctaagtccttcaatgcttcagaacgtacgaaaaccaggcataagaatgaaacggctgtcgttgcgctgcttaatatgatcggttgggtaatctctttataaagttcttcaatattattgttatgcttgtaatgggtaagaatatgcagggcgtaatcaatggtaattccaatcaaaatagctcccacacttagtgaaattgccgaaatcttatctttaataaaataaagaaccaataaagcaagcaatacagaaaatactgttggtaaaaaaacaatgatgggagtaaagaaattcctgaaataatagatcagaagaatcaaaaggacggtcatagaaatgacaactgtattctggatgtcttttttgatctgttttgcgttggccaccgcaattacaggggaaccgaaatagctgatttctgtttttcccttgaactgcttattgatgccgtctttgatggaattgagctgatctacaaatgcttcattggcttttgtgtcattgcttttgtttttaggatcaatgaaaagcaggaggtttttgccgtcttttgttacaatatagctgtcttcaagtttgaagtctttgctgatgtttaaggcatttaatttttttattcccaaaaaagtaagtcccaaaggatcttttttaataaactctttagtgacaaggcttgtgggagaagccagtgagatataattatcctctacctttttggcaatgctgtctttttgcaatttctgattaagctccttatagtcattttcattaaggaagagtggaaggttctgattgacaaaatcaaaagtttctgaaatctcattatcattcactttaccctgaacggaaccgatatatttttgcagaggctcaattttttttaagaaagtatctgccgtttcagaaagctgaaagctatcttcgccggatttgttttcaataataacaataattttatctgaaaaattgagttgcttgagaacttttgctgtaagatctgatttttcatttttagggataatctgattgatgtcttcctcaaaattgatctttgacgcaaagaaaatgcataaaacggcaattcccatggctgtcagtacagatagaattttatttttggaaatcagataatataaaaatataaaaaagcgatgcattgcatttaaatcaagtctgcaaatttaattttttaagtattagttcaaaatatttagcaataagttttgactgaaaatcaataaaatattctaggatgattcaaaaaatattctacttttgcaaaagttcccttttgaaaaatgtattttaaaccacaattattattaaaaaataagaatctgttttagatatgttgaaaagaaatgatgaaaaaataaacggatttctatttgtaatagtacttccgctcctgttgtttgcgatgtcttattatggatttgaatcctcttatacaagactgaaaacatcagaaaaaacgcctgactttttgttttcctcggtatatgcttacagagtgattcccaattatctgagtgtgcagatgacggatctgatgtattatctcatcaacggtcctctgtctttctttaaagattttttgtccaaaaacggaactcctttttatcacggtcttttcctgatgaacagtgttttctttattttatgttccctgattttgaatgctgtttttcaactgaaatcaacaggccttcttctgaatcttaatgcaagaagaatcatccatcttctgtctgtatttttcattgtaataacacagtatgcgccgacaaactgtgatactatagcgcttttctgttatctttcgggtgtttttttaaccctgaaatattcggataccggaaaaaatattttcttttttattcttatcggcttaattgcaatctcaactctggtaagagaaacagcctgtctgaatattgccttttttgctgctgttttttttaatattgacgatttaaaaaaaggaaattatcagattatctggaaaataataccattggtggttgcttttctgattccttatctgggattaagagccatactggtacaggaagaaactacttttgtggaagggttttatatcaacagaaacttttccagtcctttcaatcttgcggggctggtatttgcgttaattgtgatttattttatatataatctttgtacagcgccagaaaacaggagtgttttcggaaagtattttttcttttccattccttaccttctgatgattactttagtaggactgtattgggaggtgaggctgtttctgcctttaattctgaccggaataatcacagcatatcatcagtttaaaaaaacatccgagatttagcatgagtttactacatccatattatttagttgcaatcctctatatgctgttcttcagttttcaggaagtgtatggaaagaaggttgataaaaaatggttctggttccttgcggtttattttatcattattgttggttttagaaaagatgtaggtccggattatggaagttataaaggaatttatatttactctgataccaaaagctattacagtatctttatgaagatgctccatatggaaggaactgacaatctggatgtggaatggctgtatacgctcattaataaaattcttctgaatatctttgatgcccctttttatatccttacattggtcattgctatttttgcaatgatctttaaagtagaatatacggaagataacacattttatccttttacctttaccctttttatgtttattcctaacttctttataggagaaagcggacaaatcagacagaatctgggcacctttatcgtttactttgccatacggtatattaaagaaaggaaattctggcattacttattttttatattcataggatcaggtatacacagtgtatgttatttattcctccccatgtactggctggcacgtgtcccgatcaataagacagtgatgctgattatgattgtgggttcagtctttttatctccttttgagatatacaggagttttggtagtctattagatggaatggcttctgacagtaccctggtagaagggttcaacggatatattgatcagacggcgcagcgattgaacgggggtattggaattccggaggtgatgatggctattcttacttttttcctttttgcttttgataccaagatgaaagaattatatccttattacgaataccatagaaattatgccgtaattggaatatgtctttactttatctttagaaataaccctgtattctcgtcaagacttgcgggtgccttcatcggatttgcctatattataattccaaatgcaatgtacgtggtttcaggaagagtaagaaatatgatctatgcatttattatttcactggtcgtgttcaattttgtggtctttgctatctttaacaatatcaaggcagggcgattttcaattgagagctatcagaactacattcttccatagaatttgaaaattagcaatatattaattataaagacagtcattaggctgtcttttttttgtgaaaaccttgttcatgtttgtgctgtttactagctttgtttttaaattattaataacataatttaaatatgttgtttttatttataaaataaatctctttttgttgatataggcttaaaaattgcacttgggtaatgacactaaattataaggtatgaaaaggttagctgaaaaattagcggcagtcttctgtctgatatcattgggaatctgttctaaagggaatgtcagagaaagcttttcctcaaatgggcatattaaagcagtctggattgctgaaaagacggactcactcgctaggccgttacccgaattgacgaaattgttccttccggattggaaaaaagctcctaacagttacatttttgatcccggtcagaatagtgagggattgctggttccggtaaaaaaagcgtatgcaatgtgggaaggcggcggatatcttaacgggagtggtattccggctggtgttgtaacagcggatgttttgtgggaagatgttcatggacttataaaatcgggggtaaactatgctctggaaataacaggaaccggacaggatgccaagataaaagtcccgattaataaaacaaaaaagggaaatgccgtcattgccttcaaagtaaatggagaaatttattggagctggcatatttgggtgacggatgatcctacaaacggctccacctacaaaagttttaacaacattaagagaatgaaatcagacggaaccactgaagttattcctgactctgactggaaatggatggatagaaaccttggcgcaattacaagttctatcactgcatcagactggaacagaagcattggacttttatatcagtggggacgaaaagatcctattcctccattagttacaagaggtaacgatttttatgaagcttcagggtcaataggcagaataagacatagagaagcaaagaatattaacaatgctgtaagtattgatgacctcaggaaatttgttctgctttctgcagctgaagtaaccaataatataagactttctgtaaaaaatcctttgagccttatttatgtgaacaaagatgataactccggtcaggcgtactacaataataatctcaaccttcctgtcaattggtttggaaaatctacaaccttgcccacgaacaggctttcagaacttaatctctggtctgataatgcgcaggggaaaatagagactgtttacaatactgatgacaaagcaaagccttatagagataaatcaccttatgatccgtgtcccaacggatggcgaattccctctatgctggttgccaacctggcttcttcatcctatgtggacgatatcagaatagacttttcaccttttggagtgagaaccaatatggcgaaaaatgtttttgaaaccaataaataccatatcattaagcctactaatgcaggagttcctgcttttatgacgggatttaaagtttatcccaactggggttttgatctgtcagctgtcggaggatataatatgggaatcttcccaggaaacggacagctgatcagaggagcccaccagggacagtatacagatcagcatcacactgcactttggacagcgactatggcccggcagtttgatacctctcctgctgttacggtcagaggactttctatgattccggataaaacgcagtcagatgtcccggatgcaaattatcctactattaaaggacgctattattactttcctatgtccgtaatgtacacttcggatgcgaatggctgcagatgtataaaagatcctctttacacgatcaatgactatgattttccaacagaatatctccctgcagctacagaatataaagaagggtttaataatccgaatacataccagattgtaaaaagcggagctgtttctactattgaaattccggtcagcaaagcattctctgtacaaagtcaattactgaataatactgaaatattaaacccttccagttttaataatttaaaaggaaatgtcctttggactaccaatccgggtcttgtcaataaaattacagtagtaaacccttcaccttcgtcactgcaggatatcgcaaattctaaaatagttgtggaaattgcctccaatgaaagtggaaatgcggttgtaacacttcataacggcagtatatcttcaccggtatattggagctggcatatttgggtgacagattctcctgtgggatcttacacctatactaccgagactccggcagcagttacaaactatgtgaattatgtagataaagctgatgtagttttccagacgacttttatggatcgaaatcttggagctgtagatgcttttcctgctgttgccaacccgcaggctcctaccgctgacgaacttttgaaaatccgtgcctctaccggtttgcattatcaatggggaagaaaagatcctattcctgtatttcaatatgcagataacagaagctcctacaatgtatttttgggtgcggctgcagacaatggaacagttacatacagtacacttaatccgactgactataataatctttcaggaaattatattgttccttacaatacttatgctgcagcatcaaatgtacagactgccgataagccgatagataaaatttccaaaatattatcttattctgtgaaaaatcctttggtgtatatggttcccagttcttttgctctttataacagcacaacacctaattataccagcggaacagactggcttgcaacagagcctaacttagctccggacagatggggaagaggagggaaaaaatcgcctttcgatccttgccctgaaggatggagaattcctgaccttacgaacgtagccttggtttcaggagcagatttcggacaaactccctggtataagaaagataaaaatgtagcaacgtcatacagtattgtgactgattatctgggagcaagggtgagaaacgctgccaatgctacagtgggatatatctttaataaccctgcatatcctttaggaaattatcctgattccggttcaagaggattcagaagtgtgacggcaaatcagtctgcacagggaacatttaatgtgctcaactatcaatatccggctgtctggacagctgctttaaattctaattatctgggaagatcaatcaatgctttatttgatgcggcagctacaaccaatagactaatagtctttcatgataataatgatccatatttcggaacgggatgccgatgtgtgaaaatagaatatgatgccaatggcaacgaagaagggcctgcttcaagaactaccgtaataccaaatggttctacattaagtactgcaaatgccgtacttaaaaataccgataacaagatctctgtgtatcccagccctgtatccaatattctttatataaaaagtacggaagataaagaatacgattttcaaatttttaatgccctggggcagcttgtaaaatcaggacattttattaataatcagacagatctctcatctttaaatgccggagtatacctgataagaatcaatagttcagaagcgacttttaagattataaaacgctaaggttttaaaataaatagtaagtggataagttcctatagaatgttttttgtcaagacatatttcttctattacagatggtgaaaaattctatattattatctgcagagaattgtataatagtctaaaacctatactgcaaaagacttgtttcttcagaaagcgggtattaaaatatagtataaagcgttaggaatagtaaattaaacctgcttaacaaaaagtatataataaaaaagctttacttttgcaaaaaattttttttagaatgtcgaaaaatttagtaatcgtagagtccccggcaaaggcaaaaactattcagaaatatttaggtaaggatttcgaagtgaaatccagtttcggtcatatccgtgatctgcctaaaaaaggaatgggaatagatcttgccacctttaatcctgattacgaagtttcagcagacaagaagaaattagtgacagaattaaaagctgccgtaaagaaagctgatatggtttggctggcttccgatgaggaccgcgagggagaggctattgcctggcacctggcagatgagctgaagctgaagcctgaaaacagaaaaagaattgttttccacgagattactaaaaatgccattctaaaagcaattgacaatccgagagatattgatcagaatctggtaaatgcacagcaggcaagacgtgtgctggacagaatcgtaggttttgaaatgtcacccgttttatggaaaaaagtaaaaccggggctgtctgcaggtagagtacaatctgtagccgtaagattaatcgttgaaagagaaaaggagatccgtgagttcataccgaaagcaagctttaagcttgatggtatctttttaaataaaacagagcaggaaattgctgccaagctgaagaaagattttgaaaaagaagaagatgcagaaaaattcctggagcaggcaaaaactacagaatttaaagttctgaatgttgaaaccaaaccaggtacccgttcggcttcagcaccttttacaacctctacattacagcaggaagcttcttcaagacttggttataatgtaaccaacaccatgcgtcttgcacagagactgtatgaagaagggtatattacctatatgagaacagactccgtgaacctttctcaggaagctattgaaggagcaaaaaaacaaatcatctcagaatacggaacagaatattcttcaccaagaaactatactacaaaatctgcttcagcacaggaagcgcacgaggccatccgtcctacagattttggagtaaaaagtataggagatgcacaactgaataaattgtatcagttaatatacagaagaacacttgcttctcagatggctaatgctaaaattgaaaagactgtaattgaaattggaaatacatctttgccacatcattttgaagcgcagggagaagtgatcatatttgacggtttcctgaaagcatacggaattgtgaagactgaagatgatgatgaagaaaacaacgataaattgctgccgaaagtgagcgtaggagaagtattaagttacaaaaccattactgctactgaaaagtttacaagaccaagtgcaagatatactgaagcaggattggtaagaaaacttgaagaattagggatcggtagaccttctacctatgcgcctactattcagactatccagaacagagagtatgtggataaaagagaaattgagccacagacccgcgaagtgatcaaaatgtctttggtaaaagacaaaatcaaaaaagtagttcttgaggaaaaattcggaggcgataaaaataaattcgttcctacagatatcggtgaagttgttaatgacttccttacagataacttcagggaaattcttgattacggtttcacagcaagagttgaagaaagctttgacgaaattgcaagcggtgatcagaagtggaaagaaatgatgacgaatttctattcaaaattccacccgagaattgaagatgtagaagaaaatgcagaccgtgcaacaggagacagacttttaggagtagatccgaagaccggtaaaaatgtacatgcaagaatcggaagattcggagcaatgatccagattggagaaacggatgatgaggaaaaaccgatctttgcatccttaatggcaggtcagaatattgcaaccattacttttgaagaagctctggaactgtttaaattacctttcgatttaaatacagttgacggacagccggtttctgtgggagtaggtagattcggaccttatgtcaaatggggagaaacatatatcagtattccgaaaggtgaagatccgctttctgtagatcagaagcgtgctgaggaaattatcagtgaaaagaaaattgctgatgctcctattgcaacctataaaggagaaccggtaacaaaaggatccggaagattcggaccatttatcaaatacaaagatatctttgtaaatgttccaaagagatatgattttgaaaacctttctcaaagcgatattaatgaactgattgatgctaaattggaaaaagaggccaaccgctatatccagcagtgggaaaaagaaaaaatttccattgaaaacggaagatggggacctttcatcaagtttggaaaagcgatgttcaaaattccgaaaaaagcagacgatacaaaatatgaagctgaggaattgaaagaactttctttagatgaggtgaaaaaatggattacagatcaggatccgaaagcctttgccgaaaagaaaaaaccagctgccaaaaaagcaacaactacaaaaaaaacaactgcagccaaaaagccggcagccaaaaaaaagtaaatgtaaaataatgatacaaagccgttaacatctgttgacggctttttttatgaacaaaagcatccatgtcttactcagtttctatgttttttgtatgtttgttttatcaagcaattaatcaattattacattcaaattaaaatatggatttcgaagactttatcatttcaccaagaaatttcaaaaccgaaagctggcagataggaagtcggattactaaagatatcagagaagacagtattgttctgctgtttatgtcagattacagaggtgccggaggcgatgctgaggttcaggattttacagctgtgagaaaagagttttataagctttcacagatggatttcgaaattcctgtggtggatcttggagatctggtatccgggaagtcagttcaggatacccattatatcttacaggaagttctgtcagcatgtcattataaaagagccattccggtgattatcggaggttccaatgattttgccttttcactattttcagcattgaattttcacaagaaaagtctcaattatacccagatcagcaacatcatttcccttcagcaaggagaagcgatcaatgaacacacttttttaagcaaaattttcggagctaaaaatttctccattaaaaattatcatcacttaggttatcagaaacatctgaacgaaatggattctgtaaggctgatcaaagaagtagaatttgacattgtaaggctggctgaaatgatgaattccacagagaagacagagcctttcttcagaaaagcagatctggtgacggtaaactgcgatgctatcgaaagttttagcgaacctttttcaatgaatccgcaggtaaatggattgaacagaagagaaatctgtgcctacatgaaagaaataggattgagtgaaaatctgaagtccgtaggaatttttaattataatatttattcggaaaaccagctgaaccatcagcttttagcacaaatgttatggtatctgatcgaagggatcaatatccagcattcccatccgaaagaaagaaattatgagctgttctatgtgctgatagatgacaggcaatatgcattcaagcgtgatactttcagtaatttgtggtattttggtgatgatgaaaatatagaaaactgcattccctgctccagaaaagattttgatgaagctaaaaaaggatggctgaatgcaagactgacgaaaatttaatgtatgacaaatgttccctcaagagtatccattattgttcccgtttataatgtcgaaaattatttggcaaaatgtcttgactcgctggtgaagcaaagtcttccggatattgaaattcttgtagtgaatgatggaagtaaggataactccgaaaaaattattgaaggatatgcacaaaagtatccggagaaaataaaagcttataccaaagagaacggaggcttaagcgatgcccgtaatttcgggatcgatagagcaatcggtgattatataggttttgtagacagtgatgattatgttactgaaactatgtttgaggaaatgcttcttttagcagaaaagcataatgctaaaatggtgatctcaaatattcagaaagtggatgagaatggcaaagttgttcaaaaactcactcagcttcccaatatgcccgaaaagataacccttgaaaataacttttctgtattttcggatatcagctactttgcgtgtaataagctgttcaaaaaagaactttttaatcagaaaagatttaaaaaaggtgttcattttgaagacattcagcttattccacagcttttactggaatgtgaaaccatagcgcaaacccagaatttccattatcagtatcttgaacgtaccgattccattacaaaaacccatacggaaaaagggcttgacatgcttaaagcagtgtctaatgtagaacaggtattcagagaatccccatattcccacaaaaaagaagaattgaaaaatttccagatttttgaaggggtttactcgtttctggcctatctggcgtttgtgaaagaagaagaaatattttatagtatgtctgatcaattggttctttttatgaaggaaagacaaataaaaattcaagatatattgaagtataatcgttttggtaagaattatcttttatctttgccgttgaagaaaaagattttttatctgttattttttgctggacagaaaaaattgataagaaaattaatttagtaaacacaaatgtaagtactgttatttcgtccattaggaatgataatgaagactttgtaagtcctgcattataagccttattgaagaaatacaagtgctgaataagaaaagaatgaaaaactttgaattgttcttaagcggatcgggaatacctattttctacataaaaatagggctgggtttcgttttctcctttttaattacatttttctccattcctaccattgttaagatctcaagaagaaagaatctgatggatgagcctggaataagaagttcgcaccttagagagattcccaatctgggaggaatagccattttttattctataggaatctgtgcttctatttttgcctatgagctgtttgatctctacaagtttctatttgcctcattaattattctgctttatattggagtaatggacgatattgtggttatgagagcttacaaaaagcttgtagcgcagattgttgtatcttcattgattgttattggatcagatatcagaatcagaagcttattcggaatattcggagtatatgagctggagtattttgtaagtgtgatcttcagtattataacatttattattctgattaatgctttcaacctgattgatgggatagatggactggcaggcggatattctgttatctgcagcgccttatttggaataagctattaccgtttgggagaatataactatccactggtagttttatctgttgttattatcgggactgtactggcatttttatactataatttgtcaaattaccggacccgtaaaatatttatgggtgacaccggatctatgctgcttggctttttgctggcctttacctccatttgttttatagacattttcatcgataaaaatctggtagatgtaccaaggtatcaccttcagtctgctccggtagtggcagttgccattctcattcttccgattgtagatacattaaatgtcattatgatcaggctttacaacaagaaatcaccgtttgatgcagataagaaccatattcatcataagctgctgaaattgaatcttacccatagaagatctactttctatattattctgtactatctgatgattgttgcagtagcttattatctgagacatattaatgtcaatattttattattagtggtgctttcactgggctttttgggcgcttatctgccggatttgctatatcggctaagaaataacaaaaattaacaattaaatattacttttgtaaataatattatatatgatgaaaaactttaaatatttatttttaatattccctcttttagttacctcatgtattacaacaaaggatgtaagatacttacagccgagtgagagtcttgtaattaatgaagaaggtcttgttccctacaacatccctgtttacaggattacaaaaaacgatatccttaaccttaatattgtgactactcccaaaggagatgccgcacaattttactcctcttacaatacctccggaggtattgcaggtggaagcgcagccagtcctgcaataacaggagggggtgcattaggagtgagcggaaacggcggaggaagcagaggcggaaatataaacttttatttcaatggtttgaaagttgacgccaatggtgaaatcaatgtttttggaatcggatatgtaaaagccgaaggaagaacattagatgatattactaaagaaattcaggaaaaagtaaatgaaaatttccaggaaggtaaatctgaagtacgtctgaatacagatggtattacgttttatatccttggtgatgttgaaactacgggtctttcaggagaaaaagttgttcacaaaaatacacttaccattaccgaagctttagccattaatggtgggctgaacagaacgatagacaaaaaagagattgttattcacagaaaacttccggaaggaatcaaaatcgctaaaatagatcttacccgtgaagatctgatgaattctcctttctattacgtacagaacggagatgaaatttatctgaacacaagagcaaaaagcttgaatggatttggaaaagatcctattcagactttaactacgggagtttcggtaattactacagcattatctatttatttacttcttaaaaatctttagccatgattccagaaagagtaaccgctgcagagaagaacaattctcagaaagaaaagtatgggtcgtttgcattatttgatttagaacactttttaagaagaatccttaagaactggtactggtttgtattcatgctttttatcggctatgccattgcatggatttacagtaagtactatgcgcagaatatttatgcgtctgacttgtctttaagtacatccagtaaaggttctgagtttttaccaacacagtctaaccaatctatcaactttatttggggggataccggaaaccaggatggtctttatctgaagaaaatgcttttatccagaacgcataatgaatttttggtgaaagaattagacctttttgtaaactattctacaaaaggacttataaaatctacctatctggataaagatgattcacccgtgtttcttcagattgataaaaaacaccttcagcagatcaattatcctattaccctgataccaaaaggtaatgggtcatatcaggtggttttaccggaagaaggggaatctactaatttatataattatgaagttgaaggctttcagaatgtaaatgcttatagcagaccagctgataaaattattaaaatcaatgagtggtacaatgctcctaacctgagattcagactgcttcaaaatcctgttcctgctaaaattaagttggacaatatcattgtaaaattaaactcagtaaatgagagtgtaaatgaaattataggtactacgggagtggattttgataaagaaatcaagtctatcatgattataactaaaagagggtataaccttaacagtacagttaatttccttaataaatctgttgcagagctgcaaaaaaagagattggctgacaaaaatattgttaataagaatactgatctctttttaaaggaaaatcttgctaatattcgtaaaaaacttgattcaagtgcaaatgtgctgaattatttgaaaacttcagaaaagctttataatattaaagacagggatgaaaaatctcttgaaaaaataaaagatctggaagctaaaaaagcagatatcataagcaaaatcaactccctgaacaatatcaaaaacacactgcagtctcagaattttgataaaatgattggaaccaatgctgcaggttttgaagatggagtattctcagcaacagttactgagcttaaagctttatatgctaaaaaagcagaaatggcttctatttataagccttcatcggagcctatgagagaaatcaacagacttattgatgaagcaagaatgggatcatccaatagcctaagagggtattataacagatattacgacgaaattaataaaattgaccgtgagatctcaggtgccaattcagatttagcttcttatcctgaaaaagaaagaagatacctggatgcagagagagggtataatatgattgaagctacttataacagcttactgggaagacagagtgatacccagatgagaatggctaccaatcaatctgatataacggtgattgacccggccaaaaacctggggcagagacctattgcacctaatgtaaagcttactaagacagccattatctccggaatgctgttgcttccgttgctgtttatctttcttggtgaagtgtttgataataagatcagaaatatcaaagaacttctgagtgctaccaagattccactgcttggtgtgataggaaataacagcaatgaaaatatgcttaccgttctggatcagccaaaatcatctgtttcagaggccttcagaggaataagagcaaatatgagattcctgatggataatgaaagtgaaaaaggaaaagtaattttggttacttcatctattggaggcgaagggaaaacatatgtatctatcaatctggcatccgttataggattaagtgataaaaaaacaatcctgttgggaatggaccttagaaaaccaaaaatcttcggagattttaagattgataataaatatggtatctcaaactacctgaccggagaagtaggaatagatcagattatcaataaaacgaggatccctaatcttgatgttgctacgtcagggcctatccctccaaatccatctgaacttttaatgagccagagaaatatcaaatttatagaagaacttaaagaaaaatatgatttcattattatagattcacctccggtaggtttggtggcagattcatatgaactgatgaagtattctgatgcaaatctatacgttgtgcgtcatgaatacacagaaaagtacatgctgaaaatgattacggaaaagtatcacaatgatgaaatcaataatttgggactcgtttataatgactacaatacgaagcaggggtatggctacggttatggctacggctacggctatggttacggctatggttattttgatgaagataaaaattataaagagcctttattgataagaatcagaaacagagtacaggtattatttaataaaaaataaagcattaaaccctcatttaatgggggttttttcatatttacggtattttcattctatgaaaaaaagaatatttttgccactttgccgtttactttataacaaattatgtttttttgtttatttttaactaaacattaagattatcattaatataaaaatgttttatatttgcaaaaattaaattttaaaataaccataaatccatattcttttatgaataaaaaattattgtttagcttccttgccttccttggagtggtaggtgttaaagcacaaagaaacgaattgggagttcgtctaggtatgagtaacctagtgggagatgtaggaaggacaaattatattttacaaaagccgttggatttaagcagaacgtcagattggggggtcccgttttatggtggtttattatatagatttaattttaacccgcatcagactgttagattggatttaggatacaaccagatccagtttagtgataaagcggcaaaagaagattatagaagaaatagaaactcatacggaaaaaataacgtgtatgaggcgagtttaatgtttgaatataacttttttcctgttaataatgagcagatcagcatgttaagcccttacatcttcggaggggtaggagctttgatgtttgatgctcccaaagctactcttgtgaatgatttcagaagagatgcggatggtgtagcgcaggctccgattaatgaattggactttaccactacaaccaattattcagtaggtaaaaaagtaaccatgcatatcccttttggagttggtttgaagtataaattcaaccactcatgggctgtatttgcagaagctacattcagatatacattgacggatcagctggattacagtaaaatcctttccaaagatgtaaaaagttcttttaatgctgatattctggaccctgctaccggaggttcattattacagtcaggaaattactatgcagtttctaaagaaagagaagcagagtttattaaaaagagaaatattggagatagcagatctaatgattggataaatacgttcagtttaggacttacttattcattcggaagacctccatgttattgtgaataatatgtcgttgattaaagataaaataaattctgagaatttaccgaaacacgtagccatcattatggatggtaatggaagatgggcaaaatctcgtggtgaggaaagaactttcggccacaaaaatgccattaatgctgtaagaaatgccattaatgcctgtaatgagatcaatatcccttatttaacattgtataccttctcatcagaaaactggagtcgtccggctgaagaagtgaatacccttatgaacctgttggtagaaaccttactgcttgaagcagaagagattttcagcaaaggcttaaggatgcatgttataggaaatctggacaagctgcctccattggtaagagagcagttggaacgtgtggtagagctcacaaaagaaaacacaaaaggaaaccttgtattggctataagctatggctcacaaaacgaaatactggaagccgtaaaaaatataagctctgatgtaaaagaaggaaaagttgagatagaaaatataaacgaaagtttattcgaaagttatctgtatacaaaagattttcctcctgtagatttactgatcagaaccagcggtgaaataaggataagcaactttctgctttggcagattgcttatgcagaattacagtttttaaatgttctgtggccggacttcaccaaagatattttcttccaatgtattgtagattatcaaaacaaagaaagaagatacgggttaaccggtgagcaagtaaaaggccaataaaattttaagaaaagaaagactcgataaaatgaagtttagactattacccatcattatgtttgctgcttctgcacatttttatggacaagtaactccacaagacagcacaaaagtaaataatgctgtacatgcagaaaatgaggcaggaacttatacacttaaagacatcgttgtagatggggtaaaaaaatatacaccagctcagatcttgagattcacgggccttactaaaggagaaagtgtagacattccgggacagaaaatcagcaacgctgtaaaaaaactttgggatacccaatctttttctgaagtggaggtttatgttcaaagcattgaaggacagactatcgttctgaaattttacctgcaggatctgaaagaacttggagaagttaaattcacgggcaaaggaatcggtaaatctaaaagcgaaaagctggcgaaggataataaccttaaaccgggaacaaaaattactcagaacctggtttcaagccttaaaactaatgtccctaaagactatattaaaaaaggttttgcagatgccaaaatcagtattcaggataaagtaaatgcaggagatcctgctttggtagactggacaattaatgtagataagggtaaaagaattaaaattgaccatattgaatttgaaggaaacgaaaatgtaaccgacaggaagcttagaaacaaagctttcaaagaaaccaaacaaaagcgttttggtatcggtggtattttgaaatcctcaaaattcattgaagataaatatcaggaggataagcagaaccttatcagttattataactctctggggtatagagacgcgaaaatcgtttcagactcagtatggagaaacaagagaaataactacgaaatcaatgtaaaacttaatgagggtaaaaaatattacatcggggatgttacgttcacgggtaatacggtatactctacagagtacttacaaagattgcttggatataagaaaggggatatttacgatgctgtaggattcaacaaaaaagttggagaagacggtggtaaagaagatgattcagatatcaaatctgtttacatgaataacggttaccttttctctaatgtaacacctgttgaaaaatcagtgtcaggagatgcggtaaaccttgaagtaagaattaatgaaggagagcaagctacatggaacaaagtaacatggcagggaaataccacaacccatgaccacgttattcttagagcactgagaacaaaacctggagagctgttcaagaaaacagaaattaaaagaacatacttcgatttggcagggatgtcattctttgaccctcagcagatcggtcaggatattcagccaaaccaggtggataataccgttgatattaactggaagcttgtagaaaaaggatcttctcaggttcagctacaggcaggttatggtggtaacagctttatcggaactttagggttgacatttaataacttctcattaaagaacttccttaaatttaaggatttcaaaccggtgcctcaaggagatggacaaaccttctctattcaggtacaggcaggacaatacttccagaactatggaatatcattcacagagccttggttatttggtacaagagcaacagccctttctgtaagtttgaacaactccagagtgagatatacagatcaatatggaagtgcccaaaaattgaatattttctctgcatcagcagggttgaacagattattgaactggcctgatgattacttctcattgtatacaggattacagttccagaagtatgatttcaacaattatcccttccagtttggtgatactacagaatataatggtactgccaataacttcagtgtcaatttaggattgagcagaaattcagccggtattgacccgattttcccgacaatgggatccaatatagagctttcagcaaaactgactcctccatactcattgtttaagaaaaaagactactcatcaatgtcagccattgataagtacaagtggatggaattctacaaaatcaaatttaaagcagacgtttacaacgaaatcattggaaaacttgtcttaaggtcttctgctgaaatgggattcatggatggatacaacaaccaattgggagcaccaccatttgaaagattctatatgggaggtacaggtcttttcggaggtcgatatgacggtagagaattgattcctttaagaggttatgaaaatgctactacagaaggaggtcaggcagaagatattactcagaaaggaggaggtacaatctacaacagatttaccctggaattaagatacccgatctcaatgagccagactgcaaaaatctacgcattaacatttgctgaaggaggtaacgtatggaattcatggagcacttacagcccgttccagctgaaaagatcagtcgggattggtgtaagagtttatatgggagcatttggattgatcggatttgactttgcattaggtcttgataagacattatcaggtgataagtccggatggagaaaccacttcttgatgaaccaaacactataattaaagatatgaagcactttaaaataatcttcacattcgcattacttttactgttcgggttaaacaatgcccagaaaatcggagtagtggataccaatgaaatactgaataaattacctcagtataaagaagctgaagcaagattaaattctcagattgatacctgggagtctgaacttcagagtcttcagtctgaatatgaaagaaaaaaagctgcttttgaaagtgaaaaagtattattgataggggatcaacttaaacttcgcgaaaaagaagttacagaccttgataaaaatattaaaacgacaacaagcttacgttttggggctaacggtgaaattacaaaactgagaacaaatctggttcagccttttcaggatcagatctgggaagcaatcaaaacaatgtccgaaaaaaatggcttgggcatagttcttgataaaagcaataacattagtgttattttccttcagtcaaagtatgattacactgagaaagtattgtctattctgttgaaaggaacagacaagaaggaaaaaacaaatagcaaaggcaaaaaataataatagaattaacttttgctatattttaaaatctaaaaacaaattaaattatttatttaccagttatgaaaaaattaagtgtattatttgcagcagtaatgatggttgtatctgtaggtatggcaaaagctcaaaaaattgctactttagatgtaatgggagttcttaacgcaatgccggagaaaaagaaagcagatgctgatcttaaaacattcttagatactaaacaagctgagattaagaaaaaagctgacgccgctcagactaaatatcagcaatatcagacagaagctcctaaaaaaacagctgatgaaaacaaagctagagaggaggagatgaaaaaattagctgatgaaatccagcaaatgcaggaaaaagctcaaaaagatctacaggctaagcaagatgtagctttcggacctattgagaaaaaattaaatgatgcagtagaaaaagtagctaaagctaacgggtacgattatattatggatgcaaactcaacagcattcctttataaagcaggaccggatgcaactccagctgtaaaaaaagaattaggaattcaataatttcagcaaattaacaaagatttataaaaccaaccgcctcttttagaggtggtttttttatttttgcggaatggaaaaagaagtatcaacgacggtcaaagttaggtttagtgattgcgatccgataggtcatttgaataatgtaaaatatctggattatatgtttaatgccagagaagatcatgtagaaacattttacggattcacctacgaagaatataccaagaaaaccggctgtacctggattgccattcaaaatgaaatagcttatttaaaagaagtacgatacaatacgcaggtagtaatcagcagcaaaaccatcgatgttcaggatagaacggccaaagtcgaaattctgatgaaaagtctggatgaaaaaacaattcatgccgtactttgggtaactgttatttattttaatgtcaaaacaagaaaatctgaagtccatcctgaagagatcaaaggaatttttgataaattctatgtagatctgatccagaaagacttccagtcaagagtgaagttcttaaggagccagaatgccaaaaactcttaatctcatttcttaaaggttccaatttaaaaattaataataaacaaatgaaaaaaatagcagtaatagggagtaacgggcaattaggcaactgcataaaaaagatagctcctgactttgaacatcagtatgaattcttatttacagactcttctacattagatgttaccagtgaagaacaggtgaacgatttcttttatgaaaacaaacctgattactgcatcaatgcttcagcatatacggcggtggatctggcagagaaggaaaaagaaaaagctttcgctgtgaatgctgatggagtagcccatctggctcaggcctgtgctgaatataaatctactttgattcatgtttctacggactatgtttttgatggtgctaccaatcttccgtattccgaagatgattttaccaatccgataggagtatatggggaatcaaaaagaaaaggagaagagcttgccctggaaatcaatccgaaaacaattattctgagaacctcatggctgtactctgaatttaataagaattttgtgaaaaccatgctgcacctgttctcgcagaaagatgagttgggaattgtagctgatcagttcgggcagccaaccaatgcaaatgatttggcagaagcaattatgcagattatccagactccgcaaaaaacctatggaatcttccatttctcaaactatccggagacaacctggtttgaattcgccaaaaaaattgctgagttttcaaaatcaccggtaaaattgaatgcgataaccactgaccaatatcctactccggctaaaaggcctgtaagaagcactatgtctttggataaaattgaagagacatataaaatagagcccaaacattgggaaaacagtcttgaagaatgtgttgaaatacttgcacaccaataatagataatatgaagaatattgcaatcatcttttccgtgttatgtatccagctgtggagcgctcagaatgtttatatgaccagagttgaaaaaacgaacgataactcagataaattcttttacagaaaagaggacgctgccacagatgctgtttatttaggagaagtagaagtacagggattttcaaaagatgatgcacttgtattttctctcgtatataaaaaagcaaaagagatcggtgccaatacatttcaattaaaacctttcgaaaacgttgacggtacgcctcagccattcaatgctgccaattataaagttgctttatattatacacctaaagaaaaattggcggttaagcatggagagatgtacatatttgcatcctctgaaaaagatcagaaaataaatatcaaccgtaaagactataccatcccgccaagaacatttttaaaattaaaagtagttccgggagaaatctataccatctcaacaaaaaaattgttaggctctacagtgaaagttcagccaaaagccaatgacgacaatctttatttccaggtttcatctttgaaagtaaagtcagataatacaggagtaggaggcctgaatctgaaatcgggagatattattggcctggaaaagtcttatgcagaatttttaagcataatttataaagagaagcatccataaaaaccaattataatagttgttttaggattcaaccttgaaaaagaactcttcaataatttttttgtttaaaatttttctacctgcctaccagtgctttaagagtaaatattacgaaacggtaaaatttatgttaaataaacttgttttgcgttgtgggaagttactatctttgccccactgaaaacgagagtagatcagtaagcgcagaagggcttttagctaagcaggaacattattacttcacaagagacagacgaaaaaaaactttaaaactttttacaaaaagagttgcgggataaaaaagagtttgtatctttgcagtccgaataaatcggagcgcaggagtagagggattgagggtttgagaaggattaaggttacttaaaaaactttaaaattttcttcaaaaacatttggtcatctaagctcacctgttcccattccgaacacagaagttaagcccaccagcgccgatggtactgctaacgcgggagagtaggccgccgccagtttttattttatttttaaaaatcctttatcaaatgatagaggattttttttgctttataccgaacttataagcaataagcaataagcaataagtaatgagtaataattgatgaatgataaacgatatttcaatcaattatcaactatcaaccatcacttatcacttaacattcatcattcatcattcatcattcatcattcatcacataccccattgtcactccgtaggagtctaaacaatacattttaaagctctattatcacctctatctaagattatcaaactaaaaaaaacttttgtagttctgtagtattcctacgaatcctttagaccctaataatgtgtctggacatagttgggatattagatcttactatgtaaattgacctcttaatctggatttgacaattcacaatttaacgctgatcacttattaatgatcatttataacatatccccatatcactccatcggagactaaacaaatccattatttttcttcaactcaattcccacaaagtactaaattaggctataacttatctgtctttaaattttacttaattatttaagtatcaaaagctttacactcatatcagtgatttaagatgttgttattaaaaagatttggttgcttttattaatgaatttaacataaataattactgattgtatattaatttaataataattacgttatttgttgaaatatcttgtgatattattaaatatataccaaatctaatttttatgagaaaaaccatttttaaggttgggctgctccaatccttattctttttcggtggattgtatgcacaaagtgattcaactaaagcgtcaaagattgatgaagtagttgttacagcttatggtgtaaaaaaagaaaaaaaagcgcttggatattctttccaggatgtgaaaggacaaactcttgtcgatgccaaagaaaataatgttaccaatgcattagtaggaaaggttgccggattacaagtgattaaaggaggttttggaccaggttcttcctccaaaattaatctgcggggatttaattcttttacaggagataatcaaccacttattgtggtggatggagttccattaagtaatagcttaggttcaaaggttaggcagaatggaaaagattctaataacgatttctggaatccggatcttgatatgggtaatggtttaagtgatatcaatccggacgacattgaaagtctttctgttttgaaaggtggtgctgcttctgctctttatggttccagaggtggaaacggtgttattttgattacaaccaaaaccggtaaaaggaaaggaggattaggaattacatattctacaagcttaggttttgaaaatatttttatgaaacctgatttgcagcatagtttcgcacaaggaagtaatggtttgcccaatccacaaggagttgataacacaacttcctggggacctgcctttgagggatcaaatatgaccgtccatgataacttaaaaaacttttttaagacaggaactaccgcacagcatacattgagctttcaggagaacttaggcgaaggatcaagcctgtacacttcagctaactatttaaacagtaatagccagattccgaactcaaaatatgagaggttcaattttatggcaaaaatgaattctaactttggggctaataaaagatggactactgaggtgaaagcccagtatatgagtgttaaaggtacaaacagaccttctgcagggcaaggtgatggaaattactacccaagaatccttctgatgcctcaaaatgttgatgtaagagattatcgtgagggacagatgcaaaatggagtgacatcgcgctggataacttctaatggaattaatccatattggacagcttataatgcattaaacgcggataaaaaagaccggtttttattaaacggatatcttaaatatcaatttaataactggctgagcgcagatgtaagattaggaacggatttctattccttaaatagtgatgcaagggtttggacgggatctggccgtaataactcttactctacaggtcaggaaaagttttatgagaataattatatcataagtcttaatgctaaaaaagataatattgttggtaaatggggtggctcgctttctgtttatgggcagatgatggaaagcagggataaagcactatatttttccacacaaaatcttattattgccaatgttttcagcacatctaatacgagtgatcttgcttctgttacgacgactgaagttgatctgtggaaaaaaattaattcagtatttgctgctgctgaaattaattatgacggatattggtttctaaatgctacggcaagaaatgattggtcttctactttgaatgttaataacaggtcttatttttattcttctgtgagtacttcattagttttgacagatctgctgaaaaaattaaatggtactactttaaatgccttaacatttgctaagcttcgcgcggcctacgcaattgtgggtaactctttacctcctcaaagcttgtataatacatatatcgcttctactgatccaaacggacatattgtacttgcaagaaacaagatactttttaatccggatttacatgcggaaaagcttaagacttttgaagttggagcagacatgaagttttttgacagagtgtccctggatgtaagttattttaataataatgccaccgatcagcttatagccattccgataaatccactttccggatatgaaagaatgatgattaattcaggagggctgcataataaagggtttgaattcgttatgaatacggatatatttaagaaggaaagttttgtgtggaatgtcaatgccaatttttcaacgttaaaaagcaatatcgataaaattgatggaattgtttcaaaatatcccttatcaggttttgataacgttgctttcttcgcagaagtaggaaaaccttacggagccatttacggaacaaaattcttaagagtagaagataccagcagtccttattacggaaaattgattgtggatcaaaacggcttaccgcaggcaacgcctgatcaatattatttaggagatcaaaccccgagagctttgtttggttttacaaacagctttgtttataaaaatattgggctttcatttttaattgatgggagaatcggaggtaaatttttctctgcaacgcaagctgcactacaagcgaatggacttgctgcagacactgcgcccggaggaaaacgtgataatatgattttggatgctgtagtggagggaaatggcggttatacatcaaatacaaaagagattactcaacaggattattggggagctgtaacatccggaaatttaggaattacagaacagaatatttacgatgctaccaatattcgtttaagaaatattcagctgacctataatttccctaaaagtattttccaaaaactagccttacagagtgctaaagtagcttttacagcaaataacgtatggatgatttacagtaaagccaaaggaatcgatccggaatctgtattcgcaattaattctaatgctacaggatttgaaaaccttgcttttcctacttcaagatcttatttatttacaattactttaggcttttaattaacaactgaaacaatgaaaaaatatatcttatcattttttacgattggcttactatgtacttcatgcaatgattttgaagacatcaataataatccgtttgccgtagacaccaataaggcagaacctgaatatttattaaataactcaattctcggtgctcagcaggatcctaatattgcagaacgtgtttttgttttgtattggaaaacagcagcaagacagcatttgacaaccggaattgcaggtggaacttatgacgattcctggacttccgaatattggaaatacatttcagattggctgaataatgcaaatgcagccattcagttggctaatgaaaaaaaggcggcaggacaaggaaaaccttattatgataatatcattcaggtttccagaatttggagagcttatttaatgagtgaattttcggacaatttcggacctcaacctattcaggcttttcagggaacgaatcctacttttaattctgaaaaagaagtgtattattttattttggaagaattaaaagatgcagccgcaaaaatggacacaacccaaggagtaccatccaatgcaaatgcctatgatatggtgtatggatttaactggactcaatgggtaaaatatgccaactctatgaggatgagaattgccatgagaatcgccgaagtagatccttcaaaagcaaaaacagaatttgaagctgcggctaattcaaatatgtttatcgctacaagtgcagataattttaaagttgctgaaaaaccgggctgggatgcgctaacaggtgtaatgtccagagaatggaactctcaaattttatcagcaacccttaataatttatacattggcttgggaggagtaaattctacagaccaattaccagcagctcaacatacacaggtaaaagcatctgattatattggtataaaatatgatcaacagttcactacaatgaccaacgacccaagtgcaggatactggctggacggattacctaataaaatcgacccaagagcatataaaacattttatattccgggggatcttacaagtccggtttattcattgtatccgacgtataccaatcaggcaactaccaatcacggagatcttacgtttgaagataattctaaaataacaataaataccgtaaatacctggaatgcctataccattggaaactggggtgtaaaagggcagagaaatggcttaagaaatgtagtaggatgtatgccggctttaggtaagcagtatagagaaagtaagaatgcaagaatattctttgcaagctgggaaacctatttccttttggctgaagctgcattgaaaggctggaccgttccaatgagtgatgaagctgcttataataaaggaattcaggaaagttttgtttataatggagtttcacaattctatggtcaatatattgcttcaacggattataaccgtgacggtacttctgtttcttatagtcatattacagaaccgggagtaagccatacgatgaaatataaagatcctgtaaccgggaacttggtttctgttgaaattaaatatcctgtgaataccatttataagaatggatccgtaaagaatgataaactgacaaagattattacccagaaatatattgccaatatgccttggttaccgttagaatcatggaatgatcagagaagacttgggctgccgttttttgaaaaccctgccattgaagctccattgcccaaccttcctaatctgagctcagggaactatatgacgaattctattcagaacttccctcagagattaagatatccaagtactttcagaaatactgatcagtctggatatgataaagctgtgcaattacttggtggtacagatgctgtactgactcctctttggtgggccaaacattaattgaattcaaatactaaaaaacaatccttttctgattttgaaagggattgtttttttagatacaaattgactgaatatctctttattgtattgttcaattaattctgataaaagtagtgtatggatatggattggcctgggagttttaattggctccaatggtaaaaacaacctgtgtactatatgctgtcgcaggaattgttacggaaacaccgcctatttccagctgtacattaatgcctgaataatctacactgttaccaagtcctagaaccccggtaaaggtaattgttgaaagggttgcggcactagcttgtggtatttctatataattagccgtaccgccattaattgtagccgtacacaaaacacaaaggccgttgattgttgctgtaccgccacttctttttgcataaagtttcagagaactgttccaggaagtaggagcaagctgcatgctgattcgggctccggaacttgtaagaagattcagaaaagatccgggtaaatggccagacaatgttagcaggctgggattgtcataagttccggcataattagttccggcttctgtaatagtgggtacagttgctgtccagctggttcccgtaatattaatggtttgtccattaagactgcttcctattattaaaataataacgtatagaaatcttttcagggatgattttatgatgggacttttagtgttcattttcggtttactctgtgatggtgtaggtgatgacaatagctgtattggcctgtgcaactaaattggcataagtatttgtggccagtgaaatggtgagtgcatgtccgttattggcaccattccctgtataagctcctccaataccactaatgatagtgacaggagtagttgtaaggatcacctggccagatgatgttcccaacgctcctccaccggctccggatgctgcggcggcctgaagtcttatattcactcctgctatcactttattcacagaggctgtaattcttctggtaagtccgctgggagaaatggcagaagtatagttgacccattttgacgtattgggagttggtgttccaagcgcatttcctgcctcggtaggggctgtgaagttcaaagcaatactacctgcaggttcaatatccatcaaagttactactggcagcgtaaggctgacagtagtgcttgcggtctgggaataaattgagccagatgcaataaataatataattaatagtatggaacggatcagaatcattttttcttttttatttcattatatcctactttcagggattcctgctgatatttgatttctaactgatgcttgacaacattaatcgttattttctttgtttccgaaggttttaaagtaaacataaatttgtctgtagagattttaaaacgtttatccagcccattacggtaaaccttaacagtccagtctccaggccggagataagtgaagtcaaactcttctcctatatagcataccttgcggaaagtctggtcgttattactggtttctacaataatactttctctttttctctttccttttcctgattgcagctgttcaatgtctaactgatccttttctcccgtttccaggaatctgacatacccctgaacattggctgcagttgttatcccgaaattaaaagtattctctttattgatgagtgatagaggagcgggaaatgtttgagtgggaatgtcattgatttctgtagttgaacggtctatttctaaaaaataatcacccggaataacatttttaaacatataatttccatccttatccgtaaccgacagataacttccaagcattaatctgattccatctgtctttttaactcccagattggcaacattgccagtcagcgaagtatactcagctgttttttgcaccggaatattaggacgccatgtataacgcatcgaaaatataaaatctttatccccgatttctcctctttgtaatgaatatcttcctgacagatcaagttcatttccaggaaatagctgctggtgaaaaagaagctcaaaaagattcctgtctttaaaatattcctccggcatataattgttctgataaaaaacacttaaactggtcttatcagaaaaccggctaaatatccttgctccgtaataaaggtttttttgattctgaagctgataccttgagctgatggcgtaactcccgaagatgttaaaagaggttctgaatttttggaatgagaaattggcagaataaaaagtggaattaccgctgaaacctgtcagataattatccgttttaccaaactgtccatccagattgatctggaaaactccgatctgctgattgatactcactttgaaataacgctcataatagtcaaactgtttgggctccaaacggtctttatacgtctgatgaccattattaagaataataaaaccgttgggcagatatctgtactgtataccatattgaaaatactttctgtaaggtgctgccagcaacagggtatcccgttgaaagtttttcgcatcctgcatatagttggcaaatacactgatttttttggtgatattgtaatacacatttccattaaaggtattcgtattggtaaaatatccggcaaaatccggactggctctcatatatattaaacttccgtttaacttcttgaaagcggcttctgcctgaagcaaataagctgttccatctgttttctgtgtcgtactgtaagctaattctccggacaggttaatgtttttagaaatcttaaattttccttttgcgtaggggagatgagcgtcagaatcaagtcttacctcaccgtaccttatttcttcttttctcggtgttttatagaggtatcctacagaaatttcagactctttcctgatcctgaaggctgaatagatattcaattcatcttttatatccctgaagaatctgggatgattataaaacccgccaaaacttactttattaagatcataccggatttctgccccgcgtccgtatcttgcaaattctgtgagataagatgaagagtaggttttatcaccgagatgaagaaaaaaattatctcgtttataattcacaaaatactcctcatattgggtgaaagtgttaagttctacaggattgtgagtgacagccctgaattcaacctgatttttattgtctttatcaagagttcctttaccataaatttcgccctgaaaaccatcatgataaactcccatattctgcatcccgataaaggataaagaaaaagcaaccagcagcctgtgataaatatctttttcagtgggttttaccgagataacctgggtactcgaatagtaatcctgactttctttggggtttccctttggatgaaccgaaagatttaggttttgaatttcattctgaacaagatccgggcttgtgactttgtgaatactgacggtttttgattcattgggagacagtatgattggcgaatcatggtcaacaactgcattcttgctgtcaagtacaatgctttccgttacattgccattattttttaaaaggaaagaggctttgatggtttctcctgctctaataaactcaggggcatccagaatggtgaccaaaagattcctgtttccggaaactgagatttctgaagtttttataaaagatattccgctgttacgatcagtaatatttaatgttacagaataagaaccttgtcttgtttctgtactgatacgtaatggaaccagataggctgatgtttcataagggctaagctgaaattcacctttagctaaaatagggtgtattgaagagcttgatgtgctgactgaaatatcataagtcctgctctctgccgaattattttctaatgtaaagggaatagaagtggacatccccggcattaaactatcttttttactggtcaatcggttggattgctgttgagaaaaaataaataccgggaataataatatgataataaataatgtccaagttttaatcattttttacttctaattccacattcagcgcaaatgcattttcctcttcatctgtggctattatggcggctctgtacttatctggtggtacggtattgatatcaatataaaatgttttggaagtatccggtagcagtcccatcgttaaacttgtatacgttcccactttttcacctgtcttacgattatagatttcaatggctgccgtaggtttacagtatagattgccattattggcaattgcgatctttacagttttctttccttcttgtttttctacttttacactttcaaacttaaggtccggtttggccttttccgtttcaatgtctgtaatgacctgaatggcatatcgtataactgaggtaatacttacaccaggctttttgtcgctgggttttatctcctctacaggttccaccatgataacactccaataacttcccggatccattgcttcattgggaactgttatttcataaaatacctcagttttttccttaccttttaaagtaaccagattagtattgagtttcagccactccccgttactgcgtctattggtacgtaatgctgtatagttgattgttccgtcagcgtggtaggtgtaatcctgtaaaaataattttacactctgaggattgctgcttgtattttcgatggcaattttccctttgtaaacctttccgttttctattttgtaagaatgcgtaagcccgttgagaatcacaatgccggcatgtaaaaagccgaactgcaaaatcagggtgatcaaaataagaatacgctttatcatatataaagtttggagttaaatcatagtaatacaaaaccaggaagaaattgataacaacttcttcttgttttggatgaaaaaaagaatctttgtttaaattctaattgtctgatattgtataggtaacggtggctactacagtggctgttgcctgcaaatctgcgtaggcagctactcctccggggccgcttcctgcagctagtgcataagtaagattgtgtccgttgttggctccattccctgtataagcacttccaattccggaaatgatagtctggtcagccgcgcttaaggttagcagacctgctgatgttcccaacgttccagcacctgatccggtagctgcagcagcagttacgtggatatcaactcccggaatgatagcattcatttttacacttacattacgggtagggtctgcaacagatttgatggaagagtaattaagccataacgttgtgttggctgcagcaggaatgatagggtttcctgcttctgtaggtgctgtaaagcctagagtaatgtttttagtggcagcaggttcaatatctaccagagccacttcaggaatagacactgtaacggtatgggtatctgtattggtatcctgtgcgctcagattccctgatagagcaagcgcaaataaagacgctgcaatagttaaatttaattttttcatgacactgttaattagttaagtgaagataagaaaattcagtctacggtgaaaaaaatataccacaatttttatataagtatttatttatcatatgtaatgcattatatgtggaaataactcaaaaaaaatcctgtacaattttgtgcaggattttgttggtattataagcattttttaagcccagtgcggatcagaaacggaaacttttccggtttctattcttccggcaaaatgccacagatgatcgtttaatttgattttcaggtcataccagcccttatatttatcaagatctataataattttttcttccgttttttgtaaagcaatggatttcttcgtttttctatacagatcttccagggttatagaaatatttttcttttgatgaattctgatggtcagttcaatctgattttttgaagttgtatttgttaaaatcacctctgtttccggaatattatctcctttaaatttcctgaaaaaaccattgggaccgaaaatttcgtaatcatacgctcctgaatgtacagcatgggatagtgtctgtctggaatataaggcatatgaaaaatgataattgttattgttgaactgagtcctgtcataaataagcaaaggaactccattctcttttaaattggacattttgatcttttccccttccaaattgacatggaaatgatagggtaaaggattggatggtttcaaacctctttcctgaatgtcaagtaaattttcattcagttcattttcagaataccatttcaggttgggaaccggtttatttttggcagcattaatggttttagcataatctttctgattcagataatccatctgcggggcttttacactggaagaattgaaagctgatgtaagatctccacatatcgctcttctccagtcactgatattctcaacatgaacattcttattgaattttttcatgatgaatttctccaggaactgtaatactgaagtgtggtctgatacttcggaattaacaaagcccccttttgtccatggggaagcaatgatcatgggaactctgtagcccaatcctacagttccttcaattttttcataattttttaaagttggatcagacatgtattcctgggatttgtctacatattccacaccttcttttccgttcatatcaacgggctggcttggatttatcggaggggcgaaaggcagtacatgatcaaagtagccgtcgttttcatcataattgatgataaatattgtttttttccaggtttcaggatctttggtcagaatattcaaaacctcggaaatataccatgctccataccacggtgatcccggatggtctgaaaaatgttccggagctaccagccatgaaaccagcggaagctttttctcttccacatctttacggaactggaataatacatcaccttctggaaccacaagtctttctccgttttcatcttttccgatttccagtttccagtaatcaggatcattcacattggtggtgaaagctttttcgtgaaggtttttctcttcttctgaaagttttgaataattatcaggatggtacttcacctgatcttcctgaacttcagccagcatgacctccagtcgttttttctgatcaggatttttttcaatttcctttttcagataggttatgatattgggaatattttcataatatccttttgaaaacttaacattgaattttgaaaaccactcaataggattatcggtaaaattactgagccaggcttcctgttctccggacattccttttggaagactgatttcattctgataaattctccacgaaacattctgttgttccagaatctccgggaaagttttccacttggcctgtctcgctttatcgtaatcaatattttcattgacaacattagctttcacttttccgttttgctgttctctcaatgttccggaccaaaggaatagtctgttcggagttgtcccggtaagggaagaacagaaatactggtcgaatatggtaaatgcatcagccagctgataataaaacggaaggtcctcacggttgtaatagcctaatgtcagcggaatatttttataatctttattgcctgaagctttggcctgaagccactggtcaaattttcctctgttaagcgccttttgctgatctgcccatgaatgaggcaatgagctcatccaggtagattttgtatttcttaaatccagacgggcaggagatgcatattttccattgtcattcttttgaaagaaaacaggatgtccgtcctgctttacaaaagctcttttatctaaaaagcctctcactcctttaagagcaccaaaagcatggtcaaaagaacgattctcctgcatcaggattacgacatgttctgcatcataaaatgtagactgggcagccgggtcaatggctaaagcttttaaaatggaaggatgcagtacgcctgaagttcctaaacctgctaataaaagacttgatttttctaaaaattctcttctgttcatgttcaatcgtaataagaaagaaaccgcaagttaataggattttcctgcggtttctttgtttttatataaaaataatcagatttttattgtaaccaccatggtttggagttgatattatcatttcctccgtactgagaggctaatgcggcttttaaattgctgctgttataattgtattcagattgcggatatctgaatctgaaaggtgcagcaactccggactttaacggataattcggatagcccgttcttaaataatcataataagaagtccactgcgcctgatgaaacataatcatatatttttgagtcatgatcttttccaactttgtctgtaaaggatcggcgtcgttataaactactaaaggtgttgtaaggtactgattcacgtcaaagcctgagaaatattgtcccggattttttacatatgtctgataaaaactgaaactagctttgatcgcattatcgtaatgtgttttcgcagatccggaaatccagcctcgggctgccgcttcagccaggataaactcaagttctgaatagcttaatacagaagcgggctcattggtaggatctttatagaaacgatcgtttactttggaaatatttttagcagtgatcagggctgcattgtcagaataaggcgaagtaggatttccgccgttatatgctgtataatctgtgattgcttttccggcttcttttgctcctgtagtctgtgcagcaaaagtgaacaaacgcgggtcgtgtctgtctttaaacatattaatgaaataatctgccatatacaaacttgaaccgtatccgctgttattaaacatcgtgtatctactgtctgcagcatcagcaaatttaagttcaccgttatccgcaatggaggtcataagagactggcttcctgcaattgaagcaaattctgaagcgatattatagcttcccaccgttgtttttttagataaagtgatcaggattttcaggcggaaggagttgatcagttttttccactttaaggcatctccgttgtatacaatatccccttcaattttgtcgctggtattaataagatcattagcttctttcaattctgataaaattccggccatgatcgcttcctgtgtatcatatttaggctgtgtgatcccggattcacctttggcagcttcagaatagggagcacttccgacttttaggctgatgttgaagaaatgataagctctcaagaattttccgatggccagataatttttatttcctcttttctctgcttcctgcatcattttccctgtattcagaagtcctttggtgtagacttcaaaagaagcatcgttccacttcatgtactggtatgaattttcaccatcagtaccaatcatcattcttgaagcatacatattatccccatttacctggaatgtatatttttcaacaaaggttagaagaaatttaggatcaatgctggcctggtcattaggattttcgttgatggtgtcaaggttggattcacatgaagccaatgtcagaagtcctgcagcaactatagacttcatcagccattttgccgttttacctttttgcccttttatatgatttattgtatttttcattgtcttgatgtactttttagttaaaacttaagattaaaaccgattccgaaccatctgctggatgggtcctgaatatcattagcgatatctccgcttctgcctgacctgatctggaagtccggatcggaataaaggtttttggattttttccacatcgccagattgtaggcagaaatattggcagtaaagccttttaccattccttttggatttagtaatgaagaaaaatcatattccagaactacagatctgagcttaacaaaagtcctgtcgaaaacgttggcaaattcttcactttcatcctgtgttactcttgcctggtatggataattctgtgcccagtcctggaaactgattgcttttgtgtgcggagtataaagacctgtcgcaggattgtaatttaccccatccggtacaaaataatacgttcccggatttgcatattcaagatctctgtatgctacagagttaggatgttttcctccccaccacatcttttcaacaacctgcgatctcattacccctccgatgcttccatcgattccgatatttaaagtaaatttcttgtatttaaaggtgttattaaaaccaaaagtccagtccggattgaaatgtcctaggttcgttggggcattagctcttgttggcattcccgtattggcatcaagaatgacttttccgtccggagacttttgccatgtatagtcataatagctgtccattctttcacccaacttaatgttttggtagttgggcatattatcataaatggaagtcagcttttgttcataagtactccagttaattaaagttttccaactgaaatcagctgtttttaccggaaccataccaagggtaatttcaaaaccttttgtagtgtactcatttccgtttacatattgtgaagtgaagcccgatgattcagctgccgggaactggagaatattgttataatccaatgttctgaaatatgtggcatccaaagtaattctgttattcaggaaacctgcacttaagcctaattcatatgattttgtctgctcaggcttcaaagaattttctacattcagggtggttggataataatatgtaggatttccgttgaatgtgattccctgattattcagataataattcctgatcgcataaggttggaaatcatacgctactttagcccatgaagcggaaagctttaacatattgatggactccggcatttttaccaggtttgaaatcactgcacttacggatgcagaagggtagaagtaagacctgttggctttaggcagtgtggatgaccagtcattacgccctgaaatattaatgaagaaagcgttgtataatccgatatcaatcgtagagtaagcactgtaaatcagcttttccttcaggtaggtgtagtttttcagcgctccgatagagttttcaaacgtatacacttcaggaatcttcaatccgtccgtagacctttcattgttgttgtttttataatagaaagcagaacctccggcattgatggtgaaatcaaagttatcagatatttttttcttgtaagttgccagcacatcgtagttaaggttccatgttttattatctttcagaatatatcctccacttctcggtgcactgtaattgaaataggaataaggactcaatatctccgttttgctgtggttttccacaatggatatttttccttttaccgaaagatcctgtgtagctttatactctaaacctgtctgcgcattgatgatattcgttttgttctgatttttataatactcagctccgaaccatgggttattgtaccatgcatagttccagttggcttgcgcccttccttcttttccgggaatccacatatgatttttaagtgctttgccgtctacatcgcctcccatccagatcaggatcgtgtacatgtgtccgcttggattgtaatcatagttgggaatgttaggagtgaaggcctggttgaagttgaattttgtatcgaaaatcagtttatctccgagatggttttcagaagagaagttgattccgtatttctgaagataagaattcggaaccctgtcatcataattcatgaaattcccggagaatctgtagacgtctttgttatttctatagctgatggcaaagttattattgttgataactgcaggttttaaaaaagtacttaagttatcatgatatttccagtcgatcggaactctttcatatcttgatttatcatcatactgagttcccgtcacagctccgtaccacggaacgatctggcctgttactttatctctgatcgggctgttccactgggcaatctgcaatccgggaacaaactttggcccccagatcatatctccgtcattaactcctccgtcagctccgtcccagaattcatatttcccatgagaaccgttaccatattcagtctgagttttagggagattggtaaagcctcctgtgatcatcgtattttgggagaattcaacggagaatcccttcttcttcgcattttttgtggtgatcaaaatggctccgtagcgacctcttgatccatataaagcagaagctgtagcccctttcagaacgttaatattttcaatattgttgggatctaaattctggaaaacctctttttccacaataacaccgtcaattacaaaaacaagatttgagtttcctctcagcgtaaactgtggagcctgctgcattcctgttggattggaaacattcagacccgcaacctgtccggagaataaattcccgatacttggtgtggtaattgtttcaaactgttttgttcccacttcctgggtcgcataaccaatcttttcttttttcttggcaatacccaaagcggtaataaccactccttcaatctgcttttcgtttgacttttttaaaacaacagaatactgtcttctggaagaaacctcaacggtatacacagaaaagtcaggagcaaaaaattcaagaatatctttgggatttgcagaaatggtgaaattcccgttttcatcagtagttgcggcctttcctgtatttttgtcggtgatattcacaccggaaacactggaaccgttttctgattttacatttccggtaatattaatttcctgggcagaaaaataaagaggaagtaaaaaaacggcaaaagtggctagagttttcttcatttttttgaagacaaatttagcagagcactgttacctgtattttaatgatgtattaaaataaaaatacgatttaatattttttaacaggaagaattaatagaaaggtaaaattgaaaatgccccttgtataagggattttgttttattatatagtattataaggtagaagctggaagagagaagcaggaagttattgtggtgttgttaacttcttgaagccccaagtaataagtttttgaagaaaatctttctatagaaataaaaggatagtaaaactgcgaattcaataacttccagtttccggtttccctcttcctctctatttctaaaacctgctcagaattccccagtggatttttgtatcattaaacttaaaaggatttccaaattcattaccattagacagctggaagctcatgaggccgataggaataaagaaattgaaaccaagcccgacactgtaaagtttgggctttacattcaaagatttattattgagctgtccgtattgcccgaagacatcgaagaaggcctgattaccgatcagataccggtactccagacttccgtagtagtaaaagtcggcggcgagcgagttttcattgaatccacgcatagaattccagccaccaaaacggtataattcgttggtggaaaactctattttagaatccatcatggctccttcccccttaatattcaggaaatgatttccggaaatatgataattgtgttccccaaagaaataaaactggttttgattagctttgatgttatctttagaataggtggttgtcaaaaaatcatatcctgcattaattcttgtcttataaaggaaaagatcaatatcagtaggttccgtcatttcaaaccataccccaatcccttttttattatagtctttcccctgaacatataaggagtcaataatggtagaactttccaaagttcctcttaaccctattttgtttcggttattgatatgataatagaaagcaggaaggaactttacattggcaaatgtagaatcctgcctgtagatattcactttcgcattcattccgacattggatttgaacaggtacggaatatccacctgaagatcaaaagtctgtcccttatccggattcctctgccaatataaattgacggtctcaaaaccattgaacatattcctgaaattcacattcatcgttccgtttaaggtaaacttggaagttttgtcatttccgaaaccgattaccccgtcaaaagtattggtctttttcttttccagaaacaggaaaatgctggtggaatcttttgtgaacagagtttgtggctgccgttcgagcgttaaaaaaggatggctctggaaggttttattaatggctaaaaggtttttgtcatcatagtttttgcctttgaactccttttcaaggttcttgatgaatcttttaggaactttttcgtatccttttactacaaatccgtcgatcgttcttttatcatttttattgatgtcaagttccacgatcggatagccgtttttttgccctttatatttagatttgatcctgctgaaagaatagccttcatcaatatacgtcttgttgatactcttcttggtagagtctaaatttttagtgaaaaaatctttctgaattttcagtttctgaaccagggaatccgtaaggtttacataggtttcattaaagttctttcctttatcatagaaaatttcagtgctgtctccctttacttttacgtctttcagtttggtaaagaaataattattctgagctaatgaatccaggaattttactgcagaagtagaatcttttaccttttttctgactttggtttctgtatcaatcagccaatactgcttcttctgcgcttgtgtaaaaacgcagaatagtacaaaaaatattttcagaaacagtttcaatcccaaatatatctacaccataggtagtgatgaaattaagcgtagttaagataaaacttaaggcgaagcttatcttaatgattctttacaacttaattcttcttaatggtttaaaattttattatcaaataacttactatacaactaaaactaatccagtttattatattttttcatcaaattctcataagttccctgcggaagaatccatttcaacggaactcctattttctgcccgaatttaccaaaataataatgcgctttccatttatcttttgctaaaagtttttcaatatattctgcaacttctaaaggatcagttccgtcatttacgtgggagttcatcaaagcatatactttgtcaaaaacgtttttgtaaggctgggaaacctgtgcaatcactctgttgtctgctatattggttttgatatccccaagatgcaatgaacaaacgtcaatattccacgggtaaacttcatacctcattgcttcggttactttatccagagcagattttgatgctgaataaaatcctcggaaaggcagtcccatttcacttccgatacttgaaacattgataatttttccaaatttatgctcacgcatgttcggaagcacagcactcatcatctgtacaggtccggcaagattcaggctgaaaagtttcagaatatcctctttcgtagaatcttccacagcacctaccattcccattccggcattgttgatcagaacatcaattttgctttctgtttttaaaacctccgaaactgcattctgaacagcagtgttatctgttacatctgtagggatggatttgaaatactgactttctgtatgttttcggcttagcccgtaaactttatgcccttttttaccaaaatattctgccaatgcaaacccgattcctgacgaggttcctgttataatgatggtcattgaattcttatgattttattatttttatttttcttctgatgccagggagacgtttttttaaagcctatgttcaaaagtaaaatctattttcagcaaatgtaaaaaaagaaaaatgaactttgttatggatacagctgtaaagttgaaagtattctttaaccgatttaaaataatccaatcaatgttagaaaagttattatattttagctctggtaaaattagtaattaattatgctataaattaatgatgaaaaaagaactgctaatattattcttactcaattttagcttttattgtacaggacaagaaataaaaattccagagaatttcactgaacattttattccaaaagtagaatctaaagaatggtttgttttggttaatgctaaagactgttatgctgtcaaaaaggataatggtagattgatcgtagaaaagaccagctattataaagagaattccgaattggaaatcgaagatggaaaattgattggagaaaacaaaggggaatttgggggagcattatactttcagcctaaggaagataaagacaaagttgtgaaaataaaatttggaaacattgttgatattttcagattccaaaataaaatttatttcacagaaggctcagggatttggggaaatttgtatgaattaaataaagattcagctttcacttataataaaatcgaatcttttggggatgccttagaagctgtagccgtatttgatgacagtatttatattgcctcttaccatggctttcataaggtagcggatgaaaaagcaactcttattttcagaaaacagttttgggataatctgtatccaaattctgtcgtagtatttgatgaagagaatatttttatgggtataagaagtgggattgttaaattaaatcttgtaaaaaacaccgttaacttttacagggaaaaagaactataattgtactacatatgatggatcaaaaaaaaataattttcacaaaacaataatacataaaccgcagaaaggcggtttttttattaagaaaaagtttttaccgttagccaaatttaagacaaacttaatctcaactatgcatacaatatttgaggaatgattacttttaattgtgtatatcattgaaatacagttttttaattttattttgtggtagaggttgacttaaaaaagccaaaatttcttaataaaaacataagaaaaccttaatgatgggtgagatcaggctgttctaattttgcacctaatcaaaaaggagatcatgaatgtatttaaaatccctgtatccgtaacttacttaacgggaagggtattacttattggtgcaatatcagcttcaccgatgttcctcgcacagaaaaaagacagcttaaaagaaaaatccatcgacgagattgttgtggttggatacggaacgcagaaaaaaagtaaagtttccggggctgtttcggaggcttcactggataagcttacttccaggtctttgtccggagtaggggaagtgcttcaggggaaggctcccggagtaacagtagtgaatgaaggtggagatcctaacggatcacctaaggtcaatatccgtggtttgggaggtatcaacggagaaacacctttgtatgtggtggatggagtggttttcaacggaacaccttcaatcaatccaaatgatattcaggacatctctgtactgaaagatgcttctgcagccatttacggagccagatcttccggaggggttatccttattaccactaaaaaaggaaagaagggaaatcttactgtagactttgatgttaaatatggtgtaaatcaggcatggaggctgaaagaatccctgaatgcagcagaatttcaggatgtcatgtacaaggcatatgaaaatgccggaaaattaggaagcttaccgatggcttttaatcccaatcagtatcctgacggaagaattaccagaacagactggatgaaggaaatcttcagaacaggaaccattcaggaatacaatgtaaatcttagcggcggaagtgagaaatccagatattttgtagggatgaaccacagaagcctggaaggaattttattgaatactcaggcaaaacgatataatttcagagtcaattctgagcataaagtaaaagactggttaacgatcggagaaaatatgtactataattactctgacggaaacacagcagataccaaaagtggatacacaggagccctggttgctgctatgtactatccgcccaatgttccggtatatacacccagcggtgctttctcaggattgcctattgatgtggcaggtggttacggagatatgatcaatcctgttgcttatcttaaaagaatcagcatcagaaatcctacccatgagattttgatcaatccttatgcggaaatcacgctggcgaaagatttaaaattccgttccaacttctcacagacttttaaactgggagatgtaaagaacttcacgtacagagttctggaagtcgggaaaatttttgataccaataatctggaataccaatccaacaattcttctactgcacttgcagagcagttgctgacttataaaatagctttaggacaacataattttgacttccttggcggttttactttccagaaaacgattgatgatggttttgtagcaaaatcctatgatttcagaagtgaagctgaagttttccaacaccttcagaacgcagcagacaccaataaagatgtttccagttaccggttcaaacagtctttggtttcttatctggcaagggtaaactatgactatgcaggaaagtatatcgtgagtttattgggaagacgcgatggttcttcattggtagcaaagcaaaacagatttgctaattattatgctgtttccggggcatgggtggtttcgaaagaaaatttcatgcaggatatttcatggctttcaagccttaagctgagaggaagttatggtattcttgggaatcttggaggaatttcacctcaggctgtcaatcctttgatgacaagagataacaacgttattttcggacaggatccttctcagaatattgcttattatgccaccacacgtcccaacccggatctgaaatggggtaaatctgagcagaccaacttcggggtagatgcttcatttcttcacaacagtctttccttacagtttgactacttcgtgaaaaattccaaagatcagatcttcaacgtaagcttaccaagtacagcaacgtacaataatcagtatgtgaatgccggattattccaggataaagggtatgaactgggaatcaattacaataagataatttccggtgattttactttctcagttggagtgacaatgagccaactaaaaaatacggtgaagcaacttgccaatgtggatgagatctttatcaatgacaacggggtaagaggggtattgaaaccaacccgggtgaaagtaggtgatcctctgtattctttctatggttataagaccggaggaattttccagactcaggaagaaatcaataattataaagatgctaatggaaaccttatccagccgaatgcaaaacccggagatatcaaatttctgaaaaaagaaggaaacacaggagtgcttaataataacgattttgtcaatcttggaagtccataccctaagttctcttacggattttcttacaacatgacatggaaaaactttgacctgaacttattcttccagggcgtttacggaaataaaattttcaacgggatgaagtttatttctttgaatccaggcggtacaggacagaactacaacatggacagagatatcctgaatgcatggacccctcagaacaccaataccgatattccaagactggtacacggggatccaagtggaaattactcaaaagtatcagatttctatgtggaagacggatcatacttaagactgaaaaaccttaccatcgggtattcattaccaaaagaattatatagaaaactggatgtaaacaaagtgagaatttatatgacttcaaacaacctgtttaccataacgaaatatacaggatttgatcctgaagtaggaatgaactcttacggagtagataccggaagatatcctcaggcacgttcattcatctttggagtagagatcggactataatttttaaccaacaaaaagtaagaaaatgaaacttttcaataaaatatttttaatatcaggaatatctgtaatgcttttatcctgtacaggagagctggatgttcagccggaaggaacacctactgaagccagcttctggaaaacggaaaacgatctgattaccggagcaaatgccatgtacaagcctttgtttgacggtgaattctacggaagaggtttgttctggtttatcaatgccagtgatgatatggtaacaggaagggcaaaaagtgaggcagataatgccaaaaacttcagcagtaattacatcgcggcaggagaccttgaaacccagtggaacaaaagatataatgtgatcggagtggccaaccgtgtgatccgtaatgttgataatatccagacttcacaggccattaaaaacaaataccttggagaagctttatttatgagcagcagaatgtattttgagcttgcttattcttatggaaatgaaaaagccggtgttccgattatcgatcgttcaaaagatccggatccaaacccgattccaagggcggccaacgtaatggagaattatacttacattgtaaacgacctgaaaagagcagcagaattattacctactcaggcagagcttcctgcaaaagattacggaagaccgcataaagctgcagcatgggcattgttggcaaaagtatacctgtttatgaaagactggaataatgcagaattttgggccaatgaagtcatgacaaaaggaaacagagccttattgggaaatttcgccgatgtttttaaagctgaaaataactacagttcagaatacatctggtccatcccgggaacacctaagtttactgcatggggaagtattcttccaggggtaatgcttgaaaacaaaggttggggagaatataacggatggggatatttccagccgacaaaagaactgtatgatgagtacgaagccggtgaccttagaagaagtgctaccattctgaaaatcggagataaatttacttttaacggaaaggaaagaatttatgcttccagtaattctcttaccggataccagttcaataaatatatggatgccttcaaatatcagctgaacagcggtcacgtgagtgccaacggagattatccttgtacagaccttgccgttccgattatgcgttatgctgaagtcatcctgattaaggcagaagctttactgatgcagggaaaatctgcagatcaggaaatcaatatgatcagagtacgtgcaggtttatctccgaaaaacggatgtacaatggcagatcttaagcatgaaagacgttgcgaactggctggtgaatgggcagacagacacagagaccttgtgcgttggggagatgcgcaggcagcttatgctaaacctctgcatggtatcaatggacaggtagtttgggccgcaagaaactttaatccggcagtacacaatgtttgggcagttccacaggcagaaatcgtaaacagtcatgggatcattaaacaaaatgagggctggtaaaatttaatctttatatataagacactctatcattgcagaacattctgtgatgatagagttttttcaaaaataggttgttccattcgacctataaaacaaaagatctacgaatgaaattatcaaaaattgtagccgttctggcactggctgttttttccgaaaatcaggcacagaattatttaaattataatgttgggaatgcacattcgcataatgattatatgcaggaaatccctttttggcaggcttattatgccaattttggttctatagaggcagatgtatttctggtaaaggaaaaactttgggttgcccacacggaaaaagagctttctgcagacagaacactagaaagtctttatctcgataatatttcaaaacagattaagctgaacaaaggaaatatctatcctgatgctaataaaaagcttcagttgctgatcgatattaaacaggattataaaacgtcactggcagctttggtcaatacattaaaaaagtaccctgagatcaccggaaattcaggaattaaaattgtgattaccggaggacgtccccagccggaagattttaaaagctatccaagctatctttattttgacggagatcttgataaaaactattctgctgatcagctgaaaagaatcggaatgttcagtgcagaccttcccggattggtaaaatggaacgggaaaggaattccaagggatgaggaaactgcaaaaattaaaattgcggtagacaaagcgcatgcccagcagaaacctgttcgtttttacggggctccggactttccgaatgcttgggtaaatctgatggatttaggagtggattatatcaataccgatcatattccggatcttaaaaagtttatgaacactattccgaaaaacttttataagaatacaaaagagtacagcacttatactcctacctataaaacagacggagtggagaaaaaggtaaagaatgtgatccttcttatacctgacggaacttctttacctcaatattatgctgcctttaccgcgaataaaggaaagctgaatgttttcaacatgaaatccacaggcctttccaaaaccaattcatccaatgcgtatattacagattcagcacctggttctacagcatttgccacaggtgtgaaaaccaaaaacacttttgtgggagtggataatatggggaaagcattggcacaaatccctgatataattgccgaaaaaggattggtttccggattgatttccacaggggatgttacggatgcaactcctgcagatttttatgctcattcagataacagaaacagttcggagcctattctgaaagattttgcagcttcaaaaacgaaaatattgatcggtggtcctacaagtggattgtctcaggaaaatatacagaaattcaaagatgctaaaatcgatctctatcaggatttgaaatcagtcaataaaatcaataaccgcacccttgtgattgatcctttggcttcacagagaattaccaatggaaggggaaactggctggctgatgcatttgatcttgctttaaatgatttaaaaaacaataaggaaggcttctttatgatgattgaagcttcgcaaacagatggcggagggcatagcaacaatatagagcagctggtcacagaattactggacttcgatcatgtggtaggaaaagctatgaagtttgctgacgaaaataaagagacattagtcattgttgtaggagatcacgaaacaggcggtttaacccttttagacggaagtctcaaagatggctgggtattcggaaacttcagtacaaatgaccatacttctattccatcaagtgtttttgcttacggaccgaattcaaaacaattcacaggactgtttgaaaacacagagatcttcaacaaaatactgtcagcctacggaattcagaagtagctttgatggatacttttttactttacaaagagactgtttcggcctgaagcagtcttttttctctcaataaaaaggccgcctcaaaaagagacagcctttgaataaatctaacaaataataatttagaaattggtgttaacgatcaattgagaaagctcagtactcacaaagtcaatcggcatgattccaaatgatccctgagtattggtctggaagaatgttttaagtctaggattaatattattggatactgtaggaatacttggaataccgaaaattccaggcttgtaaccactggtgaaattcacgaaaagtttgccgttcgtatcagttttagcttcattaagaagactggaaattccgttccatttatcatcattgttcgttaccttataataatcctgaaccttaagttgtactccggtattgttgatgtcaaaagttgtattgtctgcccatggtgaagcattgattcctttggttgttcccgaagagaatcttctgaataatttgatctttcctcttacagctcccagtgtaggaatattggctccaagatcccattttgaaggatttttctgaacataagaatcaaatgtttcttcaaaacttcgggtggtgttggacgcatcatattcttcttttacagacataatgatcgtttcagatggattgctctgaaggaatgcataacacgcatttaatacgtcgtcaaaattcatattctggtaaatcgaaccatgatgaatggcgaaagcattgttaatatgtctgcatcggatatccagaaaacgtacaccggcattcagctgttctgcaatgctgagatcctgggttttagctgtaccagatacaacaggagcatctatacgtgctccggaatcatgagtaccgggtatggaaatctttgaaatggaaatattatcctgaagaccggacatccagttattcagggcaacaggcaataatggagctctgctacttgattttgctaaagaaacagctttcatttcattagaatccctttccaacatactgtcgtttgaacaggagaaaaagatagatgcagttaccactccgagagtaatgttggtaaaacgtttcatgctttgtttgaacatagtttttttatttttaatgtagcttaaaaataaggatatatcaaagcacgaggagttaatttaactttaatagataattaagttgatataaagtaagggatcttgaagttgaaggctggaaaaccaattttttattaacgcaaagtttatttttagtttcggaaatattgaggaagcaaagctgaaatcaataaattgatctttctaagcgaatgcataacaattaagcttcatcagcgacattgtcgccttctttgctttctttaaatagaactatagaattgttttctttgcgtttttaaaagatacagcttttccagatagaagtttctcttaaaaaacaaaattctccttcaacccaggaattttgaacttgtggtctccgataaagaaatcattcattttaataagagccgggaatttacggataaattctttgtgtgagtttgccggtgtttttgcattttcgtcgcaggatgaatattccttgtcaacaataactttacctgtagaaaaattgatttcattcgtaaaactgaaatcacaggtatcttcaaaatgatcgtacaaaccgatcagataaaaatctccgttctgaaatctgaaggtatgtttatatttctgagtatgtcttgaattggtaaaaaaagtttgcccgatttgaaggctgttgttttttatactgacttcaagtgtattgtcagaaggataaaatccgaatccgcttgaaaaaatgatatcagaattttctttccatactttcagaccactgttttcatttttcagaatatagaaaacccttttatagtcacttgtaccttccggcttctgctcgtatgatgcttttatattcgtattaaatacaaggaccgtttcatcttttccatctttgtcaagatcgcctttggcttctgcaatctgagtataacccttcggaaccgaaaaatttttcagcttctgagcagataaacctgaaacagctaggacaatcaaaaaggaaaagaaagttttcatcattattatattcaacttgtttaaacttttgtttttgaaacattaagattgtattaaggtgttgagagtattaagatgagcttcgcttttaagcttaaaaatcagaatgattcatcttaactataatttatctctttaatccttcttaatggttttaaaatatacaactttaaacagcttcattgtaaaaatgtggtaatccgaaatataaatcatcttcagattaccacactttataatattaattaatgagtcagtatgctttcaagatcttcccagaacattggataagacttttccactacatcttcatcttcaatagtaagttcttgaatcagacaaaacggagcaaaactcatagccattctgtgatcctgataggttttgacagaaatatgttcttgtggctctttaaaactgattgattgaatagtgagatctgtaatttctgtttcagtacccagcttctgaagttcattatataaggcaagaagtctgtcggtttcctttacccttaatgttcccaatccggaaatctcaaaaggaattttcagggctgcagctgttacacaaagagtctgcgcaatatcaggacaattattcatatccaggacaattttttccggaaaagaaaaatcaggttgaggttccagcgttagctgatgttcatcttcagagaatgtagttttgataccgaagaatttctcgtagatgccggcaattgctgaatctccttgtgttgattctttgtaaaagcttttcagatgaatcgtttttcttcccaacgcacagatagagtagaagtaagaagccgagctccagtcactctctacttcataatgtacaacctcagcattcttgtcaggagtgaaaggttctaccttgatggtattcccttcaaaactgctttggattccgaacttagtcagaatatccagtgtcatttcaatataagatcttgaggtcacttcacctacaagattaatttgcaatccgttttcaagctttccggcaataagaagcagggacgtgataaactggcttgagatattcgcaggaacatttacggaagtctgggtgatctttcttcctctgatttttaaaggaggaaatccttcattttccatatactcaatttccactccaagatccctcaaagcgcttaccagatttttgatgggtctttctttcattcttccggaaccggtaagtattgtagttttaccttcctgaatagaatagtaggaagtaagaaaacgcattgcggttccagcatgatggatgtctacaacatctgtattctcagatagtgcctttttcagtaactgagtatcctgggagttggataaattcccgatttttatattgctaaacagactttccagaatcaataaacgattcgaaatacttttcgaaccgctgatctgtactgttttatctcctgataattttgatttttccagcttcttcattattattttctacattaagaaatgatgagttaaaaatgtaggaataatttaaaactcatcattgatcattattttaatttttcattattctgatgccggtctttatcccggtcagttttgattttcatttttctgtcgaaagcatcctgcagattaactccggtttggttagccaggcaaagtgttacaaaaagtacgtccgccagctcttcgccaagatctttattcttatcgctttccttttcgctttgctcaccataccttcttgcaataattcttgcgacttcacctacttcttccgtcagcatggccatattggtcagctcattaaaatatcttacaccgatggttttgatccactcatcgacttgctgctgtaaactggtaatttccattattggtaagcgcctagcgttgggttagttgttctggatacattcacaatatcaaaaggtaccgttgctgcaacagccgtatttccctttccaagagctggtgaaccaggttttacccttaaattcattttagccataaaataattgacaaactgtggatctgtatttttggtagtttgaatcactcgtggattattgtcaaaagtgaaacccgagcccgttgcactggtatattttattaatgaattttgaagcaggaattcaaattgctgtccgggagtttgttcaaaatgaatcgcatcatccctgtcagaatacacaatactgtttttgatgtcaagcagctgtaaagctccttgctgcgtctgtccggcatcattcttccattcgttggctgcaaaaattccagacctgtcaaaagaactcatagtattagagtaattggcaatggtagcgtgtgtatagctgtgttttccgccaaggaaaattccgatgcatgataagccacagttattcatcacaaggttgttggcgttcaccgtagaacctaccgcataaattccgtattcaaagaaagtatgaataaatgaattggtaatcgtcgcattggtttgtctcatatcaagccctcttgttcctccgaaaagtcttgcatggttcatcttaagggtagaattggcttccattctgatagaattccagtttttaggaatcgtatcataataagtgtcatttctgtctccacgaaggataacctggtcagcctgggttccgttgatattcaaaacagctccggaagaaactttcattccgctgtttttatgaaaatacactttagttccggcattgatatcaagggttacattaggattaatggttaaatttccgtagatgatctttgctttattattgttccatgtagtagaactggcaattacatttggatttccgggtgtctggataaaaaactcggcatcctgaaccacagaaaataaagttacatgctgctgcccggttgggcctgtgaaaagaattttgtcttcagcaatagcttccggtcccgtagcttccggggcaatctcaacaaatatataaaggctgtccttttttcttaaaggaacattgttaaaatcatatcccggttttccatctacattgattctgtataatgaggcagctcccttttcaagatttacccttgggatcatgatatccttatcttcattattatatacttttacaacataggtttctgaacgtacctggtggtataccgtatcacagaataccgtgtcgctggaaaaacgcagttcctgtgtagggctgtcgaacgtaatatcatctttattacatgatatagctgcaagtaacatccagaaggaaaaagccagtaataatttgaatttcattgaaattaaggtttaagtaagctccaaatttaacgaaaatactttaaatttcttatctataaaaaatattgaatcgagtatttggaatttagaaaaaatgttgtatttttgcaacctaaaatttagcagagaaatatccattactatttcgaaagcaaagtttaattttttaaaaatagtattatgaaaaacggaatccacccagaaaattatagacttgttgttttcaaagatatgagtaacgacgaggtgtttctttgcaagtctactgcagaaacaaaagacactattgagtatgaaggacaagagtatcctctaatcaaaatggaaatctcttcaacttctcaccctttctacactggtaaagtaaaactagttgacactgcaggtagagttgataagttcatgaacaaatacaaaaaattcgctaagtaatttttgtacactaaaaaataataaagtcttccagtttttgggagactttttttattgtaaatttgttaaccttgaattttaaaccttaaacttaaaaaactgaatgatgcagttagtattttcagacgcacaatattgggaagatttccttccgcttacttttacccgtccggttgccgctatgcgatgcggaattcttacattcgctgaaagatggcagaaaatcctggaaaacacagaagttacctatttcactgaaacctatcttcaggataaatttaaaagtccggaggaaaaagaaagtctttttctggttccgaattttctgccgacagaaactgtaattcaacagatcaaagatcttaagcaaggagaagcattggtttatgaggatgaattgatcgctgcaaaaatcaatatgaaaggtttttctctgaatcagattgagaaaatgacagatattaaggaagatcttgttttctttaaaagaccaaaagatctgtttacctataaccaccacgccattgattttgactttgatctgctgactaaaggaaggacctcacaggaactgtcttcaaccaatggattcttaggagataaaaaagatctgtttattgaagaaggagcttatgttgaattttctaccatcaataccaaaacaggtaagatttatattggtaaaaatactgagatcatggaaggttgtcatcttcgcgggccaatagcactttgtgatgattccaaatttaatctgggggcaaaaatctacggggcaaccacagtaggaccacattgtaaagtaggaggtgaagtaaacaatatcattatattcggatattccagtaaaggacatgaaggttttgtaggaaactctgtaataggagaatggtgtaatttcggagctgataccaattcttcgaatatgaagaacaattatggaaacgtaaaattctggagctacagaactaaagcttttgaagatacaggattacagtttgcgggtctgatcatgggcgatcattccaaaactgcgatcaatacccagctgaatacaggaacagtaattggcgtagcctccaatatctttaagccgggctttccgccgaaccttgtggaaaacttttcatggggcggactgaaagatgacgaaaggttcaaacttgacaaagtatatgaagtggcagaaagagctatggcaagaagaaaagtagctttatcagaagaggataaagcgattctgaaacatatttttgatacgtattaattcgattatcataaaaacttcaaatttttttgaagtttttttatttttgatgtaatagatatgtaacggcagttgtcttacctataagaaacaaaactcatgacccaagaaactttcaagaatacggtgtttattctcaaagacgagatgtatcgttttgcgaaacggtttgtcatgagcagtgatgaagcagaagatgtcgtacaggatctcatgatgaagttttggcagaagagggatgagcttgagcagttcgggaattttaaatcctatgcgctgaagtcggtccggaacgaatgcctgaacagattgaaacatcacgatgtaaagatcggctttgcggatatgcagcttcaccgctcggagctttacagtatggaagttgataaccttaaggaacatattgtaggatttatcaatcagctccccgaaaaacagaagatggtcatccacttgaaagatgtagaagaatatgatgtttccgaaatttctgaaatgctggaaatggaggaaaatgcagtaagggtaaacctgatgcgtgcgagacaaaaagtaaaagaacaaatctcacaactgatgagctatgaaaaaagatcaattacaagataaatacaacgaaatcttccgggagatcaaggaagaaaaaatggactggagctttgaagattttcttcagactgcagaaggtgcggaacctgaacaggatacgacacccattattccactggacagaaaaaagaagccctcctttcccaaatggttctggatggcggccggagtaatacttgttttcagtatcggttttttcctgaacaactataatacggatgttcaggacagggaaaagctggtaaaagatgaaatcctgaagcagaaatcgggttttattgaagaaaacagtgatcaccaggaacaggttgccgttaactataccgattctatttccggagcaaaaaaagattccgtatttcaggataaccaggtagcggaaaaagatgtaatggatgaaatccttccaaaaagaggaagacttaaaaaggaaacaagaccaagatatgtcagcaatgcctcaaataacaaaaatttaagtgattccgcagcggcgtacaatgactcttatgtgattgtaaacggaaaaagaatcagcagtgaaaaagaagccatagatgttgcaaaatattcctttatgaaattaggaaatgaatttaaaaaaacggtagcatcttctcagaaaaacgaaaatcttgacagcgaatactaaaaatcagatcaatctcatgaaaagaatattttttataatagccataatgctaagcagctttgcaacttcttttgcacagactgataaactgaacaagctttttcaggattttgaaaaaaatgggggagtaacatccatcaatatcaaaaaaccgatgttcaaactattaaacaccatcgatgttgatgatgcttacgtaggaaaaataaagcctattttgaacgatgttgatggtcttaaaattctgatcatccccaaaattacctttccggatcgtctgaaagatgagaatcttgcgaatgtaaaaatgaatgaagagaagacagacagggtgaataaagctttgaaatctctcaatttcaatgagctgatgtcaatgaacagtgacggaacctctatgaagtttcttgcagaagatgaaaaagataactatctggaaaatctagtgttcaatgttgattccaaagaagagaatattatttttattcttaacggaaaaatgaaactttctgatgtaaataagatcatcaactcaggtgaaacagcaacatcttctgttacatcttccgtgagaagcagtcttacttcagataatacatcctcctatctgaacggcgacagcagaaatgtaggtgaattctcaaaaatagatgccagtgtaggtgtaaatgttacttttaaacaggaaactccaagaagtgtaaaagtaattgctgatgcagacaagcttcagtatgttatcactaaggtagaagatggggttttaaagatatatgttgacaataaaggtgtaagaaatcttagatttaaaaatctcaatattaatgtttctgctcctactattaatagtataaaaacgtcatctggaagtgtatttacagcagtaaatcctgttacagaaaacagtctgacaattgaagcggaatccggttctgttattaaaggaaaattcaatgtaaaagaagtggcggcagtggaagtaagttccggttctgtattggacgttgatataaaaacttcaaaactggtattagatgcttcaagcggagccagtataaatttatcaggagaagcggcttctgcagtagtagatatcagtagcggtgcttcctgtaaagcagatgaccttaaaattgctacagcggttgcagaatctacttcaggtgcaagcctctccctgttagttaccgataaattaaaggtgaacgtttcatcaggagcttctgtgaagctgaaaggaaacccggaagtagatgcgaaagtagacaaagtttcgggaggaagcttcagacaaatcaaataaaaaccacactatgaaaactcttaagaacattttcctcactattctgactgtaactatgcttcaatcgtgtatcgtttcagaaaaaccgaacatagatttttttcagaattcaaaatatgattttaaaggagcggagtttgcgagtgttaatgttcctatgtttcttgccaaatcttatattaaaaaggctttaagagaagacggagaaaatgaagagacaatcaacctgataaaaaaggcttcaaaaataaaagtgcttaccgtgaccaacggaagcagagaaatgctttatgactatgcccggtatctgaatgatcatcattatgaagaatgggcaaccataaaacatgacggagataatatcaatgtaagggtaaagcaggatggagatgtgattaaaaatatgctgctcaccgtaggttttgatactaatgaaatggtattcgtagatgtgaaaggtaatttcacaccaaatgatatctcaagaatgattaactctgtttccgctaaataatcctggcaattccaaatcttcaacgcatggaaaaattaataagagaagttcggatccttaaaatctatgcagctgtacttactatattatgtctcatgtttttctttctggcatttaaaaatcaggcatccagcgaacgctttaaagaaatagatgtagaacggatcaatatcattgagaaagatggcactttaaaaatggtgattagtaataaagaacgccagcatcccggattggtaaaccacaaagaaatgaaagcccgtgaaagagaagcgggacttatattctttaattctatgggagatgaatgcggcgggctggtatacgatggaaatgataacggttccggaatggtatattctgtagatcagaggaatacagatcagattatgcagctgcagtattctgaatcagcagggaatgataaaaaaagagcatatggattgaagctttgggacagaccggataattttccattggaagatcttattaaagcaggagattctatcaaaaaactgaacaatccggaagcttcaaaaaaagcatttgcccaactacaggaaagtggcaagctgggaagtgaacgtttctttgcaggtaaaatggctaatggcgatgtgggtgtttttatacgtgatacaaatggtaaagtaagattaaaagtgtatgttgataaaaataatcaaacccatattgaaaatctggacgagaatgggaaattggttaaatagcttttatcaagaattataacacgtaacaagtagtttctacatattcaattattttgtaccgtaaccgttctgttaaaaaagagcggtttttttgatttaagttattgattattaaattttatttaaactattaaaaaggattttcatatctcaccaaaataacctaattttgcaaagaaagtaaagatgtctattcataacaaaattgtagagacagccatcactttcgatgacgttcttctagtcccttcttattcagaagttttacctaaccaggtttcattaaaatcaagacttaccgacaaaattacgctgaatgttccgatagtttccgctgcgatggacactgttactgaagctgatctggctatcgccttggcaagagtcggagggttaggctttattcacaaaaacatgacgatcgctgagcaggctgctcaggtaaaccgtgtgaagcgttccgaaaacggaatgatctcggatccggttacattatctaaagatcatacgctgggagaagctaaagatcttatgtcaagatataagatttcaggtcttccggtggtagatgctgataacgttctgatcggaattattaccaacagagatgtaaaatatcaggaaaatcttgatatgaaagtggaagagatcatgaccaaagaaaatctgatcacttcagataaggataccaatcttgaaaaggcgaaagaaatccttcttaagaacagagttgaaaaacttcctatcgtagataaagataataaacttgtaggactgattaccatcaaggatattgataatcaattggagtatcctaatgctaataaggaccagaacggtcgtcttattgtaggtgcaggagtaggagtaggtgaagatacgctggcaagaattgaggctttggttcaggccggtgttgatatcgtagctattgattctgcacacggtcattctaaaggagttttagacaaaatttcggaaatcagaagagcatatccggatcttgatgttgtaggtggaaatattgtaacggcagaagctgctaaagatcttattgaagctggagctaacgtgcttaaagttggggtaggaccgggttctatctgtacaacaagagtagttgcaggagtgggagtccctcagctgtctgcaatctataacgtttacgaatatgcgaagtcaaaaaatgtaacggtaatagctgacggtggaatcaaactttcaggagatattgttaaagctatcgcgagtggtgcaggagcagtaatgcttggttctctcttggcaggtacagatgaagctccgggagaagaaattatcttccagggaagaaaattcaaatcatatcagggaatgggaagtctttctgcaatgaagagaggaggtaaagagagatatttccagagtgaagctaaaaaattcgttccggaaggaatcgaaggaagagtgccacataaaggaaaactggaagatgtgattttccagttgacaggaggtcttagagcaggtatggggtattgtggtgcaaaagatattgaagcacttcagaaagattctaaactggtaatgatcacaggaagcggattgaaagaatctcacccgcatgatgtaattattacacaagaagctccgaattattctttataaaacgataattcaaatttaaaaaaccgcataatattatgcggtttttttatttgtgattgtttttaacatcttgatttacagtattttatttttaattgattattttgttgtattgttgaattatttatgtttttaattgttttttaattataatttaaataaaataactaccatttatgatcgtgttaatttaattttttgtttaaaatgtaacaatgtttaacttttttctactaactataataaaattttaaattatcagccttttttcagtgagtaatattgctgatttatatttaatattaataaatttacaacttgtttaatttttttaaaatattgaaatgaagaaaactatcctttgtggggcattgttactatccctttcactatctgcgcagcaaaaaaaagagtggtgtgattttgataatgaacagagagtacaccaaaaacagaatggggaaattgatgaaatgattcgcaatatccgtaacaaaattattagcagtaatcagaataccgcttctaaaaatgggagtgcctataaaattgtaaatggagtttatgaaattcctgtagtagtacacgtgattgtgcctacaggttctgctctcggaacagcttacaataaaacggatgcacaaattcaggcatggctggatcgttgtaatcaaatgtatgcaggtacttatcaatgggcgcagggaattcctgctgattttggtactgctgctacaatgccgattaaattggtattggctaaaagagacccaaactgtaatgccactacagggatcatcagatataatggcggaactcttacgggatatgatacatatggagtaaagcgtagtggtaccaatggtgttactacagatgaggtaaaaacaattgcacctcactggcctgaggcttcttacttcaatatctatattatgaataaagtagatggtggtggacaatatggaattatgggttgggctggattacctcaaaatgctgatgctaactacgaatcctttatgaaatcttttgtggttacattacaagacgatattacgcttgctcacgaatttggacatagtatgggactgcttcatacttttggtaatgctaatgctcagccgccacaaggaacaacttctacaacttactgtccggcaactaccaataattgtgctacagctgacgatcaggtttgtgatacggaaagatcaagaagtttattgaatgactttccggcacctaccaacaatgatatgaattattgtaccggtgcaaactatcagggggtacagtataatatgatgaattatacgaacccgatagcatttaaatttaccaatggacaacatgacagagccgccctgtatttctttttaatgaaaggatccctgagcacttcgttaggagcaacagctccttctgctgctgcttcgattggaacacctatcgctgcaacatgtaatccaagtggaataaccactcctgatgattatttcgtagggccaactcttgtaaaactgggaaatattaacaatgcatctacaggatattggactaataatgctaatttttatgaagactatacaggagcaagttgtctgagagctacatcaactgaacttgccgcaacaggtactcataatcttcaggtaaatgtatcaggatcaaataatgatataagagtctggattgattataataataacggaacgtttgaagcttctgaaatggtagcttcagctaatgatattatagcagatccgactacggaaataggtacttacagtactaacattacggctcctgcttcagtagtacttaatactccgctaagaatgagagttcttgtagatgatgagaaccctaatatgacgccttgtggacaattaatgtatgggcaggttgaagactatacagtaaaattcgttaccaacttaggtactagtgaagtaaaagcagataacggagatttaactatttatcctaaccctgttgcaaccggagacaaaatcttcattaaagctaaaaatggtaagaatctaaaagtttctatttctgatatgtcaggaagactgatatcagctccatctgttactgaagaaggaaatggtgttttcaaagttgaccagcagttagaaaaaggagtttatatgattcaggtttctaatggaaaagattctaagtcatctaaattgatcattaaataagctaaataccgcttattataataaatataaatgtctccattcttatggggacattttttattcaatcttaatatatttaaatctgggcttgataaccttgttcaggaattgccctttagatcttgcctttccaaacttttcaacaatatctgcagggactttcagatagtcataaaccgcacctgactgatatataattctcaatatttcagtttcagggaaataaatgaaatgatttacaacacttgatggcataatacgattcatgcaaaaaatattccttatcctgaaaataaaaagcctccggaattaccggaagctttaagtatgtattaaaaacagcttattttttcacaaatttaaattgatgagtctgaaaatttcgggtacttatttttaatatatagccaccaggaacaagttgcgaaacatcaattctgtaatcaaacatgtctgattttacaagacgtccatccatattataaatctggatagacaaaccgttatcaataccggaaatactgataaaatctgttaccggattagggaagatctgaattttatttttagcaagctctgaggttcccaatgttgtggtctgtacatcacccgtcatagtggaatttcctgtagtaagatttcctccacattgtccgttggtcattgctgtattttcaacccatgttccgacattattacctggaggtattgataatgaattatttcctgttgaattataatagatcagataaggagtggtaaaagttccattgccctcatcgcctagaaattcccatcttgtaagagtattattccattgaatcttaaattcacaggtgcctaatccactgcaatcctgtccgccgtcaatgggagttgtcatataaatgttcttgttaaaagcatctacaccggttttattaaaaataaatgtgttgggagggctgctgaacagattaggacatccactaaatgttatggtctgtgccaaagctgtgcttccggctatcagacataataagtaaagaattttcataagtattaattttgtgatgggtaaacccctgccaatgcaatgatgcatttcagggtaataaaaggaggcctgttttcatgaggctggtttcctcctgtatttcctatcatcgtgtttttcatacttgtatttgctgctgtatcagaatattctttatcaagaacttttgtgtctgccggaagattattggttggtgaattttggtttccttctgctgttacagcacttacagtatgattatgggctggcatttctgttatagttaatgttacgctttcagctcctccaatttgccccatggtgtaagtagtaccccctcccggagcctgtccattatgtacaagtacccttcctctcatatcaggtaaggcaaatgtggtagttccatttcctccataagtggttcctaacaatgaaaaaagggcttggttttgagcgataggcaggagctgcccattacattctgcccaatattttggagcaaaattataaggtacaaaggctatttgccctaaaaatggttctgatgcctgagcttttagagcaggagcaaatgcactgcataccagcagtgtacatgcaaaaaataagtttttcatgataataaggattttaagtcatataaaattagaaaatatttcgcataaaatacctcattaaaagaaaaacctttcactataaagtaaaaggttagattttatttatcaaaattgatattattatagattttttctctaatatatatgtcctgatttattctcttagtttttcaagttatccttaaaatcatcaattctgaaatctgtcagagcatttcctttttcaattttttctttggaatacaatctgaaatcattttctgttttttctaaaagataatcataaggtcctatgtgagaaattagctttaccagaaccggagaaatctcgagacatatgaataatcccatgataaaagctgctgcaagtcctataatagcggaatttttaccaagctcatccagtgcctgaagtctggcagcaaatccattgaatttatcttcaaaagtctctgtagatttcctttctgtttccagattggtatatacttttgaaatttccttgtctaaatattccagtcgtggagctgattgtttttgaaagttctcaagatcctgtctgcgttgctctttcaattcctgtttacgttttgcattgggtccataaccttcttttccgctggttaaaccggattgttttcccagaatttctttttcaagttcaacggaagccgaatcataagctttctgatactgtgctatttttcctgagatctgttgcttttctgtctcaaaaggaccgctttgctgaagaattcttccgttcatttctccctgaagctgttttttatttctttgaataatggtattcagctgtttgtttacttctttttcaaaaattttaagctccagtggtttggaaatgataattcccagaaatgtagcaagtataagacgcggaatggccatcagaatctgattccaccacgttccggttttcttgatggaagaaacaatataacggtcaagattaaagatcattaatccccaaagaattccaaatcctacagcagcccaaatattatcaaatactgtatacatagcataacctgcagataatgtggcgaacactgcagtaaaaagtacaatccctcctattccggaaaatttattccattcacttggagtctttcttaagatatggatgttcccgcctgaacataccatcagaaatttttggaaccagtttattttatgagtcccttgatttatagtttgttggtttgttttcatacctgaaaatttatacaaaggtagtactaaaaatcataccaatgtaaaagatagtattatgttttaccaagtaattgtatgtatttgtgtaatgtgttgttttttaggaggttaaatttactttatgaagatttgctaaaaaaatagtaaaaattacttcaatctgtccggattctgctttaaaaaactttcccatccggaatacgatttggtatccgtaatggttccggaattgaaatgatgacatactgcaactgcaagtccgtcagaagcatctaaatatttggtaggaaattcttttaactttagaagattctgtagcattcctgctacctgttccttgctcgcatttccgtttccggtaatggccattttgattttttttggggaatattctgtaatagggatatttctgtaaagactggccgccatggcaactccctgggcgcgtcccagcttcagcatactctgtacgttttttccgtaaaaaggagcctcaagggctacttcatcaggatgaaattcatcaataagagagagggtcctttcgaaaatgtatttaagtttagtttcgtgattgggatatttttttaagatcagttcatgaatagaaaccagctccatttttcctttttttacggagatgatgccaaatcccattacagttgttcccgggtcaatccctaaaattattttctctgaaatcattgctccaaagatagggactttctctgtttttaatgaaaaaagtattaataatggttttatattatgtttaaaattttaatacctttaaataaaaatgattatgaaaaatgtatttaatgtttttattgttcctgtttttctgttgtttggtcttcaggatggaaataatttagttcagaataagcattcggacactatgaaaacaaataatgaccggattatttatttgtttttcaaggcagacaaagatcagtcaggaaatgcaaaaattacgctgcaaagcacaagaattactgagggaaaattaaaatatatgccttcttttgaaagggataatgtccgtaaaggtgatcttatcataacacttacaggttctgctgataaagaagagggaaagctgcttgtaaaggatccatttaacccggaaatggaagtctatgaaaaagaaggaatttccagacataagccttctcttcagaatgcagaattcagtacccgcttttcatattctgaaaatgttcagtctgtgaaaattgaaaaggcaactgatgacggtgtacaactcatattcacgcaaaaactataattatgaaagaagttttattatcccttttgataggcagcagctgttttgcccagacattcgagaccgttccccttttgcagaacggagataacagtaaaagaattgttattgcagttttaggagacgggtttacctcggcacagcagtctgcttttacgacatctgctcaaaataccgtcaattatctttttacaaaaagtccctatacagaatataagaattactttaatgcctatgcagtaaaggtaatttccgcagaatccggggtaaaacatccgggaacagcaacagatgttgcagagcctgtgattcctgtaaccaatcctaataactatcttggatccactttcgatgtaggagtccacaggtgtatatacagcaatactaccaataaagtaggacaggttctggccgcaaatatcccggactatgatatcacttatgtgctgggtaattctacagagtatggaggttgtggtggtacgtatgcgtttgcttcattaaatggatcatccaatgaaattgttgtacatgagctggggcactcttttggaaagcttgctgatgaatattggttttcaggttcacttgaatctgcaaataaaacacagaattctaatcctgcaaccataaaatggaaaaattgggtgggattgaatggagtaggagtatatgctcatgcagaaagcccaagttggttcagaccacatcagagttgcgagatgaggtatcttaatcagcagttctgttccgtatgtaaggaagcaattatagaaagaattcatactttggtttctcctgtggattcttatactcctgcaaataatacgactgttaatgctacttccaatgttacttttacggtcaacgaaatccttcctattccgaatactctggttaacacctggaggttaaacggaacagtattgggagcaacaggaaatactgttacgattaccccgggacagctgaatagcggaagcaataccctgactgtttcggttgttgataataatccgcttctgaaagtagataatcacagtacacttcatattacaaatgtttcctggacattaagtaaatcaactctaaaactttcagaagttaaagcagaagagagacgattcagtatttatccgaatccgacagacggagagtttttcattaaaagcaaacaggagttttcaaaaaatataagtcttgaagtatatgatgcttcaggaaaactgattccatccgggtttgaactgaaagattcttcaatacgggtcgatcttaaaaactatcctgcgggaacttatctgctgaatgtaaaagaaaataatatcctgatcatttcccagaaaattataaaagaataaactaaaagaaaccggctcttgggccggttttattttttcagtttcttttctgcaataggaatccatcttccatcatgacgtaaaagtagtattttgtcaactaagaatttcgttttgtattcctttgttttatatttttcccacgctttgagataattctcccaggttaaatttctgtatccgacagtcatatgtggattaaaagaatagtggccgaaattaaaatgttcttttaccttatgataaagttctgctaagtgtacattttcttttggatgaatataaagtacagggtttttaggattgggaaagctcccgaatccatccagttcaatttcaaaaggatccatttctgtattgattttctggaaagctgtgtgaatatcaccttccagttcaggttctcttgaaaaaggagggagaagagtaatatgggcctcattctgcagtgctttggaattgtcataatgaatagccagatctcttttaaagttttttacttcttcaataatctcttgcggaggataaactgctatgaagtacatttttttcatggaacaagtttgatgtgctttataatgtaatgtcagattattgttttgatctcagttgcgaaagcgtattttcaagatggtcagtaattttttttacttcaatatgaggtctgaagatcactccttttcctttttcttcatctgcaatattagataaaataatgacagaggtttttgtgtccgggtaatagatgttcagagaaggggaaccttttacatagccactgtggaaataagaattgggttggccgatattcagcataattccataggcataacccatttttccaaagatggcatggcgcctttccgcactttttgccataaaaagtttcagtgtttccggttttaatatttttccgccatacagagcgttattccatgcatgaagatcctgaatggtagacaatattccgccagccggagttccgatttcctttcctcctaatcttttcggcatgttgggaacttcctggaatttagcaggcgtgccaatataggcactcgcaaaattatttcctttaaaaatatctcccgtagaagaatgtttcattcctgcctttttgaaaagttccagaacattctcatcatatgatttcccggaaaccttttccacaatttttccaagtgtattaaagccgtcgttagagtagaagaaatctgccccgctcttaaacatcagctttccacccatgatatttaaccctgaggtatggtttaacaattgatgtatcgttatattctcatattctttggtctgaaattccttcagatattttgaagctttatcggttacgttcagttttccctgttccatctgcagtaaaattaaaacggcagtgaattgcttgcttacagagcctatggcaaaaatagtattgctgtcaatttttgtttttcttttaaaatctgaataaccgttttctcttctgtaaagaggtaaagagtctttgaaaacggcaatgcttccattgaagtgatactttttaaaagcagaatcaatctgttgttccaaaagtgttttctgaaaagctgatatggtagagtctataattgcttttttatcaacggcattgacttttggagcttcagtggtacaggaaaacaaaaaacagaaaagggacaggaatattaaatttttgatcacaggtgttgtatttttaaatgatgattgtattcttaaagatactaaaatatccaaaagagcattatgggatgcaaattgcgtgctagaaaggggtttttataccggctctttgtcattttatggttcccttttaatatttttgaataatatttgtcacaaaattatgaatgaacagttgaaaaacgattcagcaaacgtacgccatctgctggatattgtcaaagaacagggaatagaatacctgaactctattgaagaaagatctacatcggtagtcaaccatacattagaaaaacatgcactgcctgattcaggatatggaacggaagagactctgcggatttttaaccagaaatttgaaccggtaatggtagcttcttccggaccaagatactggggatttgtaaccggtggcgctactccggcatctgttgcgggagattggcttacaactatttatgatcagaatacccagactatgaaagggcagggagatatttcaggagttatagaagtggaagcaatacggcttttgcaggagcttcttcagcttccggaaagctttttgggaggttttgtaacgggtgctaccatgtccaattttacctgtcttgctgttgcccgtcaatggcttggaaaagcgcttggaaaagatattgccagagaagggatttctgagaaaataaaagtgctgggtgccactcctcattcttcgtctattaaatcactttcgttattggggttggggagcaataacattattcagattaaaattcaggaaggaaacagtgaagctatttgcatagaggatcttgaagaaaatatcctgaaacttaacggtgcgccatttattttaatttccagcggcggaacggtgaatacagtagattttgatgactttaaggcaatcagcaggctaaaagaaaaatataacttctggtggcatattgatgcggcttttggtggttttgcagcctgttcaaccacacacaggcatctagtagagaactgggaacttgcggacagtattacagtagactgccacaaatggatgaatgtaccttatgagagtgctgtatttctgattaaagaacaatataaaatcctgcagattgaaacttttcagaactccaatgctccttaccttggagatcctttggataatttcaattatttaaatttccttcctgagaattcaagaaggctgaaggcgctaccggcctggttttctcttatggcttatggtagaaagggatatcaggagattgtggatgataatatatcctgggcggaaaaatttggagacctgattgaaaacagtaatgattttaaactgctcgctcccgtaagattgaataccgtttgctttacattaaaagatgatacaaggcagaatgaggttgatttatttctggaaaaggtcaatgatacagggaaagtcttcatgactccaactttttacaataatcataaagggattagagcagcttttgttaactggatgaccggtgaaaaagatgttcatgccgtatttgaaattatgaacgaagtttttacttcattaaaataacatcttgaaaagcctgtggactattatccacaggcttattttactaacagatcacagaaccagaaggtatattctccgtcttcctcttcaggagttgttttgggtttgggataggttttcttgaccgtttctccgatgtcaaaccggattggatttttgaaaattggaccgtcaaaagtaaaggtgtgaaattctccgttttctccgcatggatctacattttcaggaagatcatcaatgaacttctgatcaataatccggcctgcaaaacttttatcaaggtaagatccgttcacacatgttacaatcgttttaaagccaagggctaaaaattcatggatgaggttggatgtatcttttttccaaagcggaaatacggctttcataccgactgcatgtaattggtcttccctatattttctcagatcctccaaaaaaatatccccgaaaacggaatgcgtaataccctgagcctgaattccagccatcgttgtactcatgatttgctgatattcttccatggacggttctttaggaagttccattttaattaatgggattcccaaactttcagcttgcttttccaacagagaaacatgaaccccatgcatagaaatccgttgaaattcctgattgatactggtaaacagagtgctgatctcgtattgatcttcctgtagtattttgtaaagggcaagcgcagaatcttttccgctgctccagttgaataaagcttttggtttcattgtaaaaataaaaatagataaataaatcaataaaatctgattgattggctctggacaatctggaaaactatctctttattaaatagaaacctcatagcacataatgctgtgaggtttatcggttgatgattttatttcaggttaatgtctctttcctctgccttagcttgatctaaagtggatcttaccccttgtattgaagattcgtagttgttatctttccattttttcaatgtaacatttttcatattcaggctagacatgaccaggctttgatcagacagatcaattaaacttgtattcaaaaaggtatgagccatctttcctgtttcaatcattccgtaataggagatcataaagccatgatttacatctgcaaataataattcatcaatattatacttagcttttaaatcactaaaatcgtatcgtgaatatttttttccttctgcttttgtaccattaaacttttttgccgttttggaatcaaatttttcatcaataatgacaacttctttcccttttgattttagaatctcagagtacattgcaatcaattcttcttttgggtggattttttcaccaatgagattcaatgcttcctgatatttatctccagaggtaactgccatatctaaaagcccttgtgaaccctctttgtattttgccggtggagttgcattcactaaaattcctacttttgaagacttgtcccagtatgtaggagttagagcaactttaggtaagcagcttgtaagtactgttaatgctgcaaaaaaaagaaataattttttcataatttaaattaaaatgtgcgcaaaattattaaaataccttgaaggctgaaagtgttgaaatataaaaacctcaaagaatttctttgaggtttgatttataaaaaatgtatgtccattaaggcttacatatttcttctgtatttaccacctacttcaaataaagcattggtaatttgtcctaaagaacagtatttcacagcatccatcatcacttcaaacaagttctgctggttgatggctgcgtgctgaagttttcttaaggcttcctcagacttgttttcattggctttctggaagttatgaagagattcaatctgtgcctgtttttcctcttctgtagaacggataacttctcctggtaaaaccgttggtgaaccatcttttcctaagaaggtatttactccgatgatcggatattcgccggtatgcttcagccattcgtaatgcatagattcttcctgaatttttgaacgctgatacatcgtttccatcgctccaagaacacctcctctttccgtaattctgtcgaattctgcatatactgcttcttctacaagatccgttaattcttcaataatgaatgatccctgaagcgggttttcatttttagctaaacctaactctttattgatgatcagctggattgccatggctcttcttactgactgctcagtaggagtggtaatcgcttcgtcataagcattggtgtgaagagagttacagttatcatagatcgcataaagcgcctgaagagtagttctgatatcattgaagtcaatttcctgagcgtgcagagaacgtcctgatgtctggatgtggtatttcaacatctggcttctttcatcagctccgtattttaacttcattgcttttgcccagattcttcttgcaacacggccgattactgaatactcaggatcgataccgttggagaagaagaaagataagtttggtgcaaaatcattgatgtccattccacggcttaagtaatactctacataggtgaaaccgttagccagggtaaatgccaactgggaaaccggattagctcccgcttcggcaatatgatatcctgaaatggaaacagagtagaagtttcttactttttccctgatgaaatattcctgaacgtcacccattaatctcagagcgaattctgtagagaagatacacgtattctgagcctggtcttcttttaagatgtcagcctgaacagtaccacgaacggtagcaatcgttttagctttaatttctgcatatacttcagcagggatcacttcatcacctgttaatcctaaaagctgcagtcctaaaccattattggatggaggaagctcaccgttgtatttcggcctttctaatcctttatcatcaaatttttctttaagtttagcctctactttagcttctaaaccattttctttgatatatttttcaacattctgatcgatggcagcattcatgaagaaagccagcagcattggtgcaggaccattgattgtcattgaaactgaagtcagggcattcacaagatcaaatcctgaatacagttttttagcgtcatccaatgtagcaatagaaacccctgcatttccgatcttaccataaatatccggtggtaaagcaggatcctggccatacaatgttacagagtcaaaagctgttgataaacgttttgcaggcatttctgcagaaacatagtggaatcttctgttggttctctcaggacctccttctcctgcaaacatccttgtcggatcttcaccggttcttttgaacggataaatacctgcagtataagggaaacttcccggaaggttttcctgtcctttccatttgatcagatcgccccagtcattgtattttggtaatgctatttttggaattcttaaatgagataaagattcagttgatgtttcaactttaatttcttttcctcttacaaaataagaatagaactcagcatggaatgcttttttcgtatcatcccatgttttaaggaaatcgatgttctcctgctgaagctctttttctgctttttggtactcagcatccaaagcttcattggaaatcatatttttaactccttcaatatgatacatctttctggcaagctcagcctgtttttctacattggcatcatattgtttgttgttttcgacaatttcagaaaggtaacgaactcttttcggagggataatggttacttcatctgtgatttcctgctcaacaaaagtatttaagtgtaaatcagcaaacttttcatttacttttgaaaccaatctgttgtataattcagtagtgccatgatcgctgaactgagacgccttcgttgcataaaccggcatatcttccagctgactttcccacaaaaggtggtttctctggaattgttttcttactgcctgaagagcatccaatgcaccacgtttgtcagatttatttaaagcgacaagatctgcataatctaacatatcgattttctccagctgtgtggaagctccgtattcaggagtcattacatacatagaaacatctgcaaaatccgaaacttctgaaccagactgcccgatccctgaagtttcaaggataataacgtccggatgagccagtttcaatacattcagtgcagaatgaataaacggagaaacggaaacgttattttctctggtagccatggaacgcatataaactcttggatcattgatcgcattcatacggattctgtctcccaaaagagcacctcctgttttctttttcgaagggtcaatagagataatggctatttttttatcagtattcgaacgtaaaaaacgtcttaccaattcgtcggttaaagaagatttacctgctcctccggtacctgtgataccgatgatcgggatggttaaatctttggacttctcatcgattgcttttaccagctcaggcttctcatctgaaaagttttcaaccgcagaaatgatttgcgcaatgctggaagggttttcaaaactgatatcatcaagatcttttgctgtaacatcttttcctgtagcaaaatctgatctttgtaccaggtcatcaatcattccctgaagaccaagttcacggccgtcatccggagaataaattctgtcgattccataagacataaggtctttgatctcttccggcaggattacaccgccgccgccgccaaaaattttgatctgaggcgagtttttctctctcagaaggtcgtaaatatatttgaaatattcattgtgacctccctgatatgaagttaatgcaatggcattggcatcttcctggatcgctgtatttacaacttcctctgctgatttatcgtgtcccaggtggatcacttcgcatcctgttccctgaataacacgacgcataatattgatcgcagcatcatgcccatcaaataatgaagcagctgttacgattcttaccttgttggttggagtatatttttgggtttccataaaaattctagacagtttctaagttctcaaatatagtaataaaatgaaaacctcgtattgtgaggtaaggttctgatttttaaacttttatggtaattgttttttaagctcgaaatactttgttagaggttaggtctgtattttacagattactacactattctgtaaaaatataaatgtcagcagataataaccgctgacattttttcttttgtgtcatgaagtttggtctttatttcataaaaaatgatctgtattattatttttctgaaaaaagtgtttttcttttgctgtccaatccccagtttaatcctaaaaatgtaatgagattatttttgtcgccataattttttccaaatgcagcattgatgtacacactgtcagacactttatagttgataattccgttggaacggtaagtgtcatccaaatcactgcttctgtagatgaactcatatccgatagaaaatctgttgtatacaagctctatttttccaccgaaatcataattatcagtcctgctgaatccgctggctgcatcataaatcgttctatcctgcaggtatcttgcaacagcatagaagtttaatcttttctcaatttttgaggcgtctgtggtgaaggcttctttgatgattactcttgatttttcatcattttgatcttcttttttctttggagattttgttctttccagattgatcccggaactcatggtgatccagaatcccagtttcccaaactgattattcttgaactgattatctaaaaagaaagtactgtaggccgaagcaatatctaattgaaaagcaggtttttcatcaagatactttttataattttcggtttcggtcttgtaataatctgggacaaacttttctaatgcttttgccttcatctcatttttttcatccgggctggcattggatgcttctatatcattatactcctttgatttttcaaacactgcctggatatcttttaattgctttgaaatgttatcatttgaagtggtaatagcttctatgttttttttattccttacttttaagatagtggttcgtaaagaaaaagataccgaagggttttccgtgtcaaggtcttcaattttataattcctcagaaaggcaaatgagacagaaacgtttttggcttcactgaaaatgttatttttatactcataactgttatctggttttttaatgcttttaatgcctgcatattttaaagcatccatctctgttaaagtaaataaatgggtaggagtaagttctaccgcataggcattgggaaggccgtcattttcgctgaatgaattgacaatactgctcataaaagccttttttgatttcggggtctccagatcagaacttgctaagccgaggagcattacacttggagcattggaaagttccaatttgtttaattctgcactgatttctttgctttgagcaaacaataatgccatattagacaccagcgctgctagtagtactatctttttcatagctcaacttttatgtatttataaacaccatagataaacttaccggctagatcatcggttgttttaccttcaaaaggattgaagtgaaaatttttggaaggaatctgagggaattcaaactttatcctgcatgtattgattaagatctgcagatggttcacctgcatattaatattgaaagaagtagcgaaaagtaaattgtctgatgctaaatctgcttttggaatggtaaaagaaaatttatcatcatttaaattattgtcatctattctctttccgttaatgataaaatgcgggtcgccaaattgtgtattggcactgattattacattcacttcaacattattttctttaaagtgcgtaatttttactgttttttgagggatttttttcatgtctgttaatgttgtattgtgtattctctcctaaaatgaggaagaaattttagttttgattacttcaaatttatggtttatagtattggttgtcaattacctctttgggtactattatttaatataatgaagttaaccgattttgtttaatcagtttatgaaacctgcttttaattcatttattaaaatatttacaacgattccatagcccgtttaaattctctacttttgcagaatatttctacagacatgcaaaaagctttgatgtatttcgccttgggaaccgttgtaagtttccttatcaattatttctttttaagttctgaaaacatcggactggatatttactatgcctttgcctttggctcagcctggggaattgcttattatctggatactcctgattttacgctgccaaagaaattaggcctttcatttgtggcaatggggcttctggttcttttaggaacattgatttttacgcttgaactggcaatcccttctattctgaaattttcaacagttttcgttgcctattatttatttgcaagtttcagaggcaataaatcccttagaaactagtgcagcataataaagctcagatacatcagcaccaggaacatcagaagcaatccgatataattaacaataaataataaggagcctttcagtatacttattctttttttggtttcatataccctgtggtgcgctacaaagaaatagatcgtcatataagtagccagcgccagacatgccagaacatatagtaaggtaagtatactattgtccggtaggaaacttgtgattttttctcctacgataaacatcagcactcctaataagagaaaggagaaataatggagggtgaaaatcccatgatcaaaataccaccattttttcttattatgaaacagccataaaaagaatgcaaatatcgggaggtacacaaaaagtgctttgggaatagtatggatgaagttttccttatatttttcccagatctgatgtttactgtatccttcttcttttagatcaaatactttatttgcaatgggacgcatcaatgtgtagatgccagtattatctttagcacgaatagaatcatattgcttcatcgtgtaggctttcataatggatgcttctttagtatcaaatgtactgtcaaaaagctcatctttttcctgttcgtcttttatctttaaagtatccagcgttttttgtgctgcagcagctgtttcatgagataagagacctcctttctgcaaatcttttacaacgtctttagagattttcttttgcttttctgcttttacttctgttttaatagggctgggtttctctgcctcctctttggcatgaggtataagattgggaagaaagaacgtaataaaacttatgaaaatatatagttttacaggtgctacatacaattgtctttttcccgccagatattccttcgtaagtttgccgggacgggtaaaaagatactgtatggttttccagaactgtccgtcataatgagtaaaatcctctatgaaatgagtaaaaagaaaatgaaacggctgtctgctttcaatgttttcctgcccgcagtgggggcaaaacctttcttcaacctgatgtccgcagttaagacaggttttatcatctcgtagttttccgtggctcatgaattatggaatatgattaccacaaatataattatttaagtgaaaatataatgatatgggaggattttaaagagaacgttaaagtaaatttaataaaagaaagagttgagggaataaactctttgctgtttcattgtgctttcagaatcttcgaaagtgttttttcatcgcccatcagttcgcaagatttatgccaaagctgtaaataatgttaaaatctattgatactggggtatatagctaataatatatagattaaataaaatatgtttttgggttacaaaaataatttgtacctttgcacacccttttaggggtaaattatgtttaatctttaactaaaacgtgtgaatacattaagttacaaaactgtttcagcgaacaaagctactgctaataaagaatgggttgtggtagacgctgaaggacagccgttaggtagattagcttctacggttgcaaagattttgagaggtaagcacaaaacgaactacacacctcacgtagattgtggtgataacgtaatcgttttgaatgctgggaaaattacactttccggaaacaagtgggctgataagacttatatctggcatacaggatatcctggtggacagaagtctatgactgcggctgaacttcaaaagaaagattctttaaaggtattagagaagtctgtaaaagggatgttacctaaaaacagattaggagctgctatccttaagaacctttatttatatgaaggaactgagcacaaacatgaagctcaacagcctaaaacaattaatgttaacgaatttaaataattaattatgtctatagttcacaaaatcggaagaagaaaaacttctgtagctagagtttatgtaaaaccaggttctggtgttattacagtaaacggtaaagacgctaaagaatatttctctacagatgtaatggtttacaaattaaaccaaccgttcatcctttctgagactgttggtcagtatgacgttaccgtaaacgtattcggtggtggaaatacaggtcaggcagaagctatcagattaggtatttcaagagctttatgcgaaatcaacgctgagttcagattagcattgaagccagctggtttacttacaagagacgcaagaatggtggaaagaaagaagccaggtcagaaaaaagcaagaaagagattccaattctcaaaacgttaagatttctcgttggcagatggcttatggctattggctacaggaatgtattaaattttttttaaacttaatctcggcgaaaagcccattgccaaaagcaaaaagcagaccgccaattgcccgttacgtttagcatccaaacgcttctcccatctaaagaagttgttgattgtttaaaagacggaaagtaaactaacaaaaacagaaaacatggcaaaagcaaatgtaaaagaccttttagaggctggcgtacacttcggtcacatgaccagaaagtggaacccaaatatggctccatacatttttatggagaaaaacggtattcacattgtagacttacataaaacagcagttaaattggatgaagcttgcaacgctttagaaaaattaacttctgcaggtaaaaaagttcttttcgtagctactaagaagcaggcgaaagaagttgttgcaaaacacgcttctgaacttaatatgccttatattacagaaagatggccaggtggtatgttaacgaacttcgttactatcagaaaggctgtaaagaagatgaatgctatcgacaaaatgaaaaaagacggtacattcgaaactttatctaaaaaagaaagattacaggttgacagacaaagagctaacctagagaagaacttaggttctatcgctgacatggttagacttccatctgctgtatttgtagttgatatcttaagagagcacatcgcggtaactgaagctaagaaattaggtattccagttttcggtatcgttgatacaaactctgacccaagaaaagttgacttcgttatcccaggaaacgatgatgcttctaagtctattgatatgatccttagcgtagtttctgaatctatcaaagaaggtcagtctcaaagaaaagctgataaagaaaaatctaaagaagaaggagaaaaagtatctgctgatacagatgctgatttcgatgcagaataattgaagattttctttaatataggaaaaacgctggatttcgatccagcgtttttttattgtttatatcggattacaggccgtcttatagtacattagatgtattggtttatatttccattaaaaataaaaacctgcagaatcctgcaggttgtatttagtttgaaagctttatagaataagaagtggttatgaattttgtagattgatacgttgagttacataaaactccggataatctgtagttttgatttttaggaaccatcgtgtatccaatctttcctgcaccgatagggattttcttgaaaaaattacccccgcttattgtaagtaccatattacatggcgatttgttttcaaccgaaatagaagttctgggattctgtggatcatcattgttaagaagatcgttaagaacttcagctgtttccggtttgtaggtctttatgagttcattatattctcgttccgtattggctctgttacctgttgaattaccggcaggataagggtaggatgttcttccgggataaccgccgtaatttacattacagccggcaagaatcactgaaaatccggcaaaaactaatagctttttcatactactattttattttttgatttttcttttgtttgatggcttcttgttctgagcttcatccttttcggttgtactgttttctatttctgccgttttcggactaccaaccgttacaaatatactttttttaatatctttctgggagaaatattttatatcacagatattactgctcagggtatatgaacctttattgattacaataaaattttctccgtgtgcaggaacagcgaggttataatagtcttttccctcaacccgtaatacaatattacaatccgaattatttttaaataagagtatagcctccttgcgtgtaatatcttcattgaacattgcgttcagaagcttcactgtcttttccttatgttcagaagaagtttctgcgataagttttttaaactcttcagcatcatctgaattaggatttctcatgatgtttttaggaatatcggagataacaggccttgcttccataggcttggctgtacaggcaccttttgtccactctgcattttttaaggcaataagcttgggctttagtacgcttttcttcggatcatcagggtgagtattcttaatatactcttcaatttctttgatatcaatgcttttcagaatatctttatttctttttttctgtgcagatatcacgttggggaacagaaatgtgaagattaaaaataatacgattaaaggttttcttttcatcaattgttattttatatcatgagcttatccggaatttgatataagtaatggtttttcctttggctgagaaaagttcttcataatatgttttgatatctctcagatgttcggtgttcgggtcatactccggagctccatagatgtcgtgatgagcactgatgatttcatagccggctccctgtaaataacctaatgtatagccatgtaaaaactctgaatccgttttcagatggatgataccaccaggcttcagaaattttttatatcggttcaaaaagtcaggatgagttaatctgtgttttgttcttttgaatttgatctgtggatcaggaaacgtaatccagatttcatccacttcattttcagcaaagaaatagtcaacaagttcaatctgtgttctcaggaaagcaacgttattcatattgttttctacagcttctttagcgccgaaccagaatcttgcccctttgatatcaattccgataaagtttttctcaggaaatgcttttgcgagtcctacagaatattcgccctttccacatcctaattccaaaacgattggattgtcgttcttaaaaaagttttctctccattttcccctgagttcgaatccttttaaggcatcttctcttgtgggttggattacatttggtaatattttgttttctgcaaatcttgctaatttattcttgcccattgagttataaaatgagtgcaaaaatactaaaaatttatggagaatctctttcttttaaaggtaaaagacaggaagatacttcagttaaaattaagattaatggcttcccaacgctaccataattggtctttcaatggttttttgtgaagcatattgggctccgcaaaccagactggagaaaagatactggcctttttcaataacaatagaaccttcaccctgagccggaactgccagcctgtacttggtggttcccacgccttcaattcttacaataatattgcagtctgacttattctgaatcatgacaatacattccttagcattaagatcattatcgaataaagaattcaggatttttacagttctgtttttgtgctctaccggggacactgccatcagcatattgaattcttcagcttcagcattaggaatcgctgtattagctgttgcatttacaacaaatgtattctgggcattacttggagtataaacagtagtgggttgttttgccgccagttcagccttatattttgcaatctgtttttgtttgatgatggcgttcatttcatcaaaggtaatctttgtagaaggccttcttttcagcatagcaagcatttcctgcatatcttttaccttctgatcagcaggatgtgcgtttttgatgtattctctcatcatttccataacccttggtttcagaacggatcttcggggatcatcaggatgagcgtctcttagaaaggcattgatctcatagatatttttacttttcagaatatcactgtagtctttcccttttttttgagcagacacagtaaataaaaacatacagctaagaagtaaaagtacttttttcattaattaatatttaattaggaattcggtgctcctcctttaatttgtgttttggttgtttagttttattggataacgaaatatcctgtgtttttatttttaaacacatgtttgtgagataaaattaaacatatttttgaataatgaagaattatatggggtaaaagttgaataattcatattgtgaacgttgcgaacggttattggaaggcattttccggctattcgaaaaaaaataatccatgtgttgacatggattatttaatattatttgatctgaattcttagttgctgcttacaacctcttgaagatgagaacttctaagtcttttctgatagatcggaagatatttttcaataggaattttaatcgcttcaaaattgcctgccaatacataagcttgaatattttcagatgtataaacaaactgaaggaagttatcaatcagattttcaggaattttaaatttcgcaaaataatcttttccaaggtaatttttaatctgtgcaacagagctattcattctttcgtaagcctgataacgttgttttttctttctttctccggaaaggatgtcatagatactttcaagactgaaggtaagacctccgtctctcagcccggctacaggaagttcaggaggtgttccgtcacctttcggctcgggaagaccaattactttcttaagcgcatatgctttgtcttcttttcttaaagcgtttacatcatagcgaagattccctgtaggcttgaacctgctgagaacgatttcctgaatttcataatacgcgattttaagctcaacaaggtttttttgttgcattaactgaggagtcagcttaatatcttttctttcggtaacaatagaggtaaaccggatcacatctcctgcgttggcaggaatattaaaattaccgttgtagtccgtaagaacggttttctgtgtgttcaggtttgtgacatagacctgattgagatataaaatagagttgtctctcaaaaatacctcaccggaatatatttgtgcattaatttttgcaagaaaaaccaatagcagtagagtaaacagtttcttcatataatgcgcaaaattacatagaaataaagcaattttacattattagatgaagaatagtggttaaagttatattaaactttgggatttaattgttaaggagtgttagaaatttgccattcatttaaaaaatgagagatttatataaaaatcaggaagaaaaagagtgatatatttaagttgcttttttctcggttttgctatctgtgttttacaagcagccagcttgtgtattttaccattaatgtagaaccatattcagtccaggtgataaagtaccagtaagttgcagtaggaacatatctaccaccgactcttccatcccaggtatatctgttttcaggagtccctctaaagacttctgcaccatatctgtcaaagatgcggaatacaagattatcattagccattagggcagaataatcgattccttcgttataaccatctccattcggagtaatggtattaatcaggttgatgatagcaaatggttttttgacttcttcacacattctagaatcccttacgaatacattgtgtccccctcttggtacattgtagaaaatattggaactttgccatattaccccgtctaaagaatactcataaggaggagtgccaccacttactccgacttttattgttgttccatcaatctcaatagaggtaatcatgggaagaggaaattcagtaacattcacatactgtttgtaaacacagccattggaggtaagctgtacccaataacttcccggagcgacattggtgatggaaggagtggtagctcctgtgctccataagtatttttcaaaaccaggccccgcatcaagtgtggtagtggttttcggacatatagctttatcttttaatacatctgattttttaggaactttaatgttgattttgagagtacctacttccggacagacatcatttttttcgaaacggatataataagtctgagaatttgcaatattaacaggtgatgaaattatatttacattgttccgggcatcagataatgtagcatgaaaagtgaatgaaacattcggatccagtgtaaactgaggaataaactgagccagattgacactttttactccatccaaatcatcatcacaaatactttctgtaacagtgtcagtaataagtgttaatttggctccaatactgaattgtaatggcttgatgacagaagcacatccatccggagaatctactctgatgtaaatcgtagtagtagctgtataactccaattgttaggaagtgtattattgtttccggcgttggcatctgccagactcgcataatatcttacattagtaaaataatttggattgttaagtacaataggggtgatattggaaagtatgactgtaactgtcccatccagattatcatcacagaaaattccattgtaattatccagaataatagctttattgaaaagagataatgttatttgcgcaatacttttacacccaatattgtttttgacaacggcatatatgatagtagtattcggtgctgtatatgatgttgcattggttatcattgctgctgcattttcattctgtgcatctacgagagtaggatagtaagtgatagtaacagaggagttgttggtgatgttagctgtagtcagattgaatgttccttgtccatttatatcacaggcagataatgttgcattcattactgtaagagcctgaatattgatagtaactgttatcgtttcacaatccggaaagtcaggatcatttccacaaaatgtatatatgaatgtgtcagttcctgccgtgccaggagtatttacagtgtaagtaataacgccggttgtagagtttataactgctgtacctaatgttggtgcagctgtaatagctaccgtggcgggaacaggagtttgtgatgagctgctgaaggcaggtggtatagtctgcgaagtacaaacgttgtaggaagtattggtaagttttgtacaattcagaaccttaaatttttcagtaactaaaggtgcacagcttcccattgttacagagcacgtataatatccgggtagtgtaggagtaattgtagatgctgtagcccccggaacaagtgtaccgtttctataccactgataggtatcgtagataagtggatccacagtaagaactaccccaggaatacagccaccgccagattgtaaaatgacaggctgcgtaggaaaacctgcaaaaaaacctccgtaccctacagcatcactgccggcagtgatgcctgccataatagccttgtctgaaactacagtaatagtacctgttatattaggaattccatatgtaacccagttgttggttcctgtcatattgtagggacctgttatcgcaggaggattggtgccatttactgtaatattagctcctctttctgtaataagattcagttttgttggaatgttcagaatacccccgggattaccattagaatggacaaaattttcattaataagtcccagctcattaatctgcttcggaaggtaacagttcaaagcaggaataaagttaaatcctccggtagccgtttcattccccgaatttgaatctcctgctaaaatctgatagacataagcattttttgatgttttgacatataaattataatgtccgtttccctgaagaatatatttggaatcaggaataacaaaatatttccctgcatttatggtagcgacaggagggatctcattattgacaaaaatctgagtgttgtcttctgtggcaataacaacggcaccttccatattggcaccaattggcccattcccttttacaagagcaaattcatttccaagcctgttgacaggtactgcctggtccattaaaatatctgagctggacggaaagtttcctgcatattgcccgttaaaatttccattagtaacattaatgggcttgtttgaaatgatttttgagccaataaaaccgtcagagttcccggctatattgccgatcccgtcaataatgtatgattgtcctttattcaaagtaaaagttattgtcggattcgtagctccggtcattccgtttgaaaactgaacagtaggactatatccggaaatggtaaccgttgtattatcttcagttgcgagtacactggtcataaagtttagaatattattgcttacacttataggagcagaagctgcataaaacgtttttccggtagaaggaattcctttggaagtaataatttctgcatgattgaatactgaaaaccttaaattggcataaaaagggaagtctgctttaagatataatcctttggttgttggagtaaataaatcagtctgttgtgtggtaataatataatttcttaacacatcgaatttttgcggattatttttactgatatttactgttccgatcagaacattattattataaatgtttactggaaagggagttgttctgctagtggatagatatagtttttgataaggattgggggcgccggttctgtctatcattggagcaaaccaatgctctcggtccaattgggcaaaagcagaggtgaaaatataaaatataaataaaaaagatagaattttcttcattcagtaggagtatttgtcacaaatttaacaataaaaaacattgaattattgtaaatgtaataaaaaaagccacgattatacaatcgcagcttattaaatatagttttaaactaattattactctctgttcttaacaagaatccaacccgtatattttattggagtcttctccttattggattcattccatgtaatatgataccagtatgttcctgttcccaatttcttatcaaaatgttttccgtcccatctgtagttattgaatctgtttccggtgaataccatatttccgtatctgtcatacactacaaagcttaggttttctttataagcaagctcactgtaatcaatgtaatcatttacgttatccccattaggagtaatagcatttaacagattaggaatggtaagttctacagcaataggggtacagttataaaaatcttttacataaaaagtatgctgtcctcttgtcaaacccgtaaaagtatttgaatcctgccagttagcagttccgtcaactgcatatttgtaaggagctttaccgccgttgacaattacagttgctgtattgttgttgatctcaacggtttggattaccggatcttcaacttttttaacttttactgtctgtgtaaggaaacatccgcttttaccaagaattactgtatattctccaacacctacatctctgatgcctgaagtggtagcaccagtgctccattggtacgaatcgtatcctggaccagcatccagattagtttttgcgtccatacagatatactgatctacaagtaccggtgactttttgataggaagtacaatcagttcaattttcgcatttgcggtacatccttcggcagtggttacttttacatatacaaatcctcctgttgatgggaagttttccggagttgtgatttcattgatccctgcagtaagatcattcagggtacgataatatttttttacaacagcgttatagtctgttaccttagctttcgtaagatcgaaataagcataaggtgccacatcataccagcaagctttaatggatgtatccgtaacaatgaatggtactacagtaaggtttagcgtcacttgttcacaatctgtaaattcaactgagtttccgcagaatttataaactattttatctggtcctaaatatcctggattaggtgtataagtgattgttccgtttggatttactacagctgttcctttcgtaggaggggttaaaattactactgtacttggaaccaccgtttgtgtggaagaagtaaatgtaggagttataatttttgtagaacaagcatttaatgcctgagttgtttcttttaaacaggtttgtactttatagattggagttgtcacaggcggacatgtacccattgttacttttacggtataatttcctgactgtgtaggtgtgtaagtataagtagttgctccaggaatagctactccgtcacggtaccattggtatgtttcgtatccgtcatctacttccagaataattcccggaacacattctcctgctttcttggcgataacaggaatggatgagaatccggcaaaataccctccgtaccctgctgtactataccccccattgatccctgctgttacagcttttgtggaattaattttaatatttcctgttactcctgttattccataagtaacccaattactgtttcctgttaatggaaatggtccgtctgtagcaaggggaggaacatcgtttactaatacagtggcgcccgcttcagttagaatatttaattttacgattaagtctccttgtgtagtacttgctccgcctggaccaagtggcatctcattaattttaccgatttcatcaatttttctcggcaagaaacagtttaatggcggaatatagttgaatccgttggttgcagcatttgatccgattcctataaactggtaaagatatacattcttggtagttgaaataaacatattggaatgtccagtaccttggcttacatagcttgtttcattgattctataccattgtcccgatgcaagtgttgcaacaggagtggttccaccgtttaaataaacttccgtgttatcttcagtagcaataataagtcctccttccatgttcaggttaggagctgtagatctggtttttaccattgcgaatgtattgccaagcctatcaaccggaactgattgatccagaataggatctgtaccggatgttggggttgagaagttaccgttgcaacttccattggtaagagttacaggcttatctgcaaccactttggctcccatgaatcctgttttgttagcagattgcgttccagagcctgcaaaaatgaaagattgtcctttctgtaatgtaaaggtatgagaattgctggttggagttccgttgataaaaactactccggcagtagggttccatgttacagtgacattagtattatcttcagtagccaggatgccggcagtaaaattgtaaaaactgctggtatcagtattaggactttgagcaacaaaaaaagttttcccaattcctgcctttcctttgctggtaataacctccccgtgtatatcctgagcaagtcttaaactgcagtagaatggttttgctcctttcagatagagtcccttattgataacagtaaaagcatcagttgttgaacctgtagaaataaggccgttggcaaccttataggtttgtgggttacctttgctgatcgtaactgtagtaataggagcgttattgttgtagattatcacatcaaaaggtgtaggcgagtcagtagaaagatatatcatattggtatagcttccgtaactgtcataataaggagcaatccaatgctcggtatccctttgtgcaaagagtgtattaattgtcaaaaaaattaataccagactgagtagaaatcttttcatgtgtatggaattaggatttctacaaaaataaaataaaaaatgaattacttttaataaaatttaaataaatgttaaaaaacaccctcaatttttaactaaaagctatattgggtatgaaactggtaatttggagtttgcttggtaataatatataagctgaattgttgtaattataaagatgtttaagaataaaaaatcccggtgaatttcaccgggattcaatattttttttggaaagattgattaagctaagcttactcttacaaatcctgtcacttttaagtctgcgtttacagattttacataatcagcaactgagatacttccgtctttaatgaaatcctggtgtaccaaagtgttatctttgtagaatctctgcattttacctttaaggatgttatcgataatgtttgcaggcttaccttcttcagtaagtttgtgtctttcgatctctaattctctgtcaatagtttcctgagaaacagcattttcgtcaagagcaattgggttcattgcagcaacctgcatagaaacagctttagcagcttcttcagctccgtctactttagcagaaagagaagtaatagcagcaattttatttcctgcgtggatataagctcctaagaaaggtccttggattctttcgaaagaaccgatttcaattttctcaccgataactcctgtttgctcaactaatttctcagcaacagtaattccgtggaagtcagtagataaaagttcttctttagtagcagcgaatattgccatttcagctagttcgtaagctagctcaatgaacgcttcatttttagcaacgaagtcagtttcacagtttaaagaaattacagcacctaaagtgttgtcttcgtttactcttgcgattactgcaccttcagtagactctctgtcagctctgttagcagcaactttttgtcctttttttctaaggatatctaccgctttttcgaagtctccttcagcttcaactagagctttcttgcagtccatcatacctgcacctgtttggtttcttaatttagctacgtctgcagcaactggtgtataagacataatatctattattttttatttaaagattagtattaatttttagcttaattttagagcagtgcaaagataatgattttaatgataaactaaaaaatgacttttcacgttattaatatatttaatactattttaaaggtttgattaatgaaaaaaatcttcttccttctatttatatgcatttttgctctaggtttttcccaaaaaaagaaaaaaacaaaatctaaagctgttgttgagaaagaaaccgtaattatctatacagaacaggaagctgagacttcaaaagaggcgagagtaattgccggctttttaaaacagaatcccggacatgccaaaacagactacttcaaaaggaaactgattgatattattatggcggataattcccctgaagcaaaaccaaccattaagcctatcagtaaggaaaaaattgaaaatattgttaagaataatgaattgaacagcggaaagacgatagccgctaataaaacatatactgccaatgggaaacctgtttctaataatacagcagctgctatagaagctttaaaagaggaaagaagaacaactaactttgcatctgtaggttctgcaaaaagtgccggtacttctaaagccggacccagtgaagaaaataaaagaacagcagcaatgcttacacacctttttaataatgatattaataaaaacgaagcatatatcaatattaaaaacagatccacctgcaatcttattgtaaagataagtggtaaaaaatattataatctcagtgtacctgccaaaggagaaaattttattctcgtagataaaggtgaatatgtgctgaccacaatggtttgtgatgcaaagtattcatccttgaagaaaatcacccaggatattgaaattgcactgaatattgaataggatttttaattaatagaatagaagaaaactaaagcaaaaaggttaagaaattttttcttaaccttttatttttatcctttaaactgacccatcgcaatgaacttgtcctgtctctgggtttcaagctcctgtcctgtgaatttggagaaagctttgatgttttgtaaaatcgaatttttcaggttcaaataggttgtctcctgatcataatgagcgccaccaagtggttcttcaatgattccgtcaatgaatttttctcttaatgcgtcctgaggagtaaggtttaatgcattggctgcatcttccttatgatcccagtttctccataagatagaagaacagctttccggtgcaattactgtataccatgtattttcaagcatatatactttatttccgacacctattcccagtgctccgccgctggctccttctccgatgatgtaagtgaagatcggagttttcagctgcaccatttcaaaaatatttcttgcaatagcttctccttgtcctctttcttctgcttccaatccaggataagctcccggtgtatctactaaggttaccacagggatattgaatttttcagcaagcttcattagtcttaaagcttttctgtatccttccggattgggcattccaaatcttctgtgttgtctttcttttgtcgttcttcctttttgagtccctatgatcattactctctgaccatccagggtaatcaatcctccaatcattgccggatcatcagcgaaatttctgtctccatgaagttctaagaaactgcctttatctgccattccgtggatgtagtctaatgtataaggacgatccgggtgacgggacagttgtactctttgccaaggtgtaagatttccatagatttcttttttcttttctaaaatcttatcctcaatctggctgcatgctaattttacatcaacaccactttcttctcctactaaagaacacgtctggtattggtccatcaattctttgataggaagttcgaaacttaaatattccatttcttgaagtaaattaaatctttcaaatgtatgaaaaattatggttattctatttaaaattatttatagcattgtttattctggagatactttcctctttaccaaggatttccagaatatccggtacatccggccctttcaattctcctaccaaggaaagacgtaaaggcatcatcactttacccatgcctaaccccttattttcggcgaaatcatgcatggtttgcttcaggatttcagcagtaaagtcggcagattcaaatgttgaagccaattcacctaaaatggacgatgtttcatcattccatgcttttttcgaagctttttcatcataggaagttggtgcttcaaagaagaattttccgttttcatagatatctttagggaaagtcgctctttctttcatcagatgaataacctttagtaacttttcatcagatacaccggaaagatcaaggtctgtatttttcaggatctgaagaagttcttcgtcagacttcatctgaatatactgatgattgaaccattccgctttttctttactgaatcgtgcgcctgctttatgtactttatgaagatcgaattccttaatcatttcctccaaaggaagaatttccttatcatctgccggagaccatcccaatagcgctaccatattgatgaaagcatcaggaagataaccgttttctctgtatcctttagagattataccggtagcaggatctttgaaatcaagagggaataccgggaatccgaacttatctccgtctcttttgcttaatttcccttttccttcaggttttaaaattaaagaaaggtgtgcaaattgtggcgcttcccattgcatggcttcatataataaggtatgaagtcctaaagacggaagccattcttctccacggattacatgagagatttccatttcatggtcatcgataatgttggcaaaatggtacgttggcattccatcattctttaccagaactttatcatctaaagtatttgtatttacagagaatttcccacggataatatcctcaagattcaatactctgtccacaggcattttaaatcgtactacataaggagttttttcatccagcaatctctgaacttcgtcttctgaaagggcgagactgtttctcaaacggtttcttgttttattatcataggaaaagacatcacctctggcttcgtattctgcacggatggcatccagttcttctgcagtatcaaaagcgatataagcataatctgttttcaggatctgctcagtatatctgtcgtagatatctcttctttcagattgtctgtaaggagcaaactttcctccttttttaggactttcatcagggatgattccgcaccattctaatgcttcctcaatatattcctcagctccttctacatatctggcggtatcagtatcttcaattctcaatacaaactcaccaccctggtttttagcaaaaaggtaatcatataatgcggttcttacgcctcccaaatgtaacggtcctgtaggacttggagcaaaacgtactcttactttctccatttcaatttaaatttttgcaaatttacttaaaattatgcgtttaagagatgatttatgatctcgtattggtttttttggatgtaacttttttatttatttctacagattttcgataaatactgttttaaagctcttatcttatatttctgataataattttgattatggattgtaatctgtgaatggttgtattatggatattaaagtcataaataataaatattgaatttgatgtaaatggtcttttagaaagaacgttaaaatttatttcataatttatttttttttatttaaatcactaactggagattgtttaattctttattcattagtatttcatgtactatataaaatcactaataaatgacatatatcattttagtttttgcttttcaccgaatcttgaattttatatttgcagagaattttaaaataatactatgaaaaaacaaattttatttagcctcggtacatcgctgatgcttttcatgggatcatgctcttatgaagatctgaatactggaacttctgctcctgacaatccggcaaaaaccaatcgtttgtctgctgcaaaatttgcaggtgatggggtttatgatgttttagggcatggttttaatgctactggtgagtatgccaatgcaaactctgccggttttaaagtaattgatatcgacagatttaagacagaacaggcagctaggcttatttctgaaaatgccaatactcaacaatatattgaagaatacggagagaatgctgagacttattctaaaatggtttctacgaaagtagatgctacagcgggaattcctttgttcaaaaaaacattatctgtgggattcaactctgcggtgactaccaatcataaattcgatgcaaaatatatttatggaagttataatcttctaattaaacagaaaagactgaggtttaatgcaacaacagatatgcttgctgattacgtaactcctgaatttacacaggatttacagactaaatcaccacaacaaattgtacaggattatggtactcacgtgatggttgatatttatacaggggcaaaaatggatattatgttccagtctgaaacgagcaacgaaagtcgtgaacgtgctgcaagaataggcgtgaaaattggaatgcttaaagcttttgatgtagatgttcagaatgatgtgaatacatcagaatcttctatgaattattctaaaaagctatcatacaggacaagaggtggagatccgtcaaaaggtttggtaggagaattaaatcttgatcagtcaaccccaaaaataaatattgcgaattggcaaaacagctcaacagctaataattctgtgttagttgaatttggaaataacgggttggttcttatttacaatctggtaaaagatccagctaaaaaggctcagcttaaggcttacgtagatcagtatttattggataaccagatttcactggaatataatacgacaatgttatatggttatcaaaatcaggcagacagtaatcattattttacttttaataccaatcttcagccctcttcttactggactaacgaaggacctacgtttaaagtattccagtataaagcgcctaatacagttccgatttactgtttcaagagtacttcaggtgctcatcattattacacgcagtcaagcacattacagccatcatcctattgggatgtttatatgggaatagcattttatgcttataaagaccccgcagctgacagaattccggtttataattataaagcaaaaaatcaatcagatcattatctgacagtgaatcctaacctcggaccaacaagttattgggtaagagaaggaatagctttctatattcctgctaattaaatttcagaaatttaatataaattaatttgataatattattaagtgcagtcagtggttttggcttcactttttattaatagagttttaatggaatgattaaatttacttaataatgacatttatcattgcttagttcttttttcactcagtattgaatattatatttgtgaaaacttttaaataacctatgaaaaaacaaattttattttgcttcagtagtctactgatgctttttatgagttcatgttcttcagaagatctgaatcctgaagtaactccggaaaattctgctaaaaccaatcgtttgtcagccgctaaattcgcaggagatggaatttacgatgtattgggacatggttataatgttgccggtgagtatgccaatgctactgctgctggttttaaagtgatcgacattgaccgtttcaaattggagcaggcaagcagattgatcagcgaaaatacattctcacaggaatacaccgaagaatatggagaaaatgcagaatcatattctaaaatggtttccactaaagtcaacgctactgccggtattccattattcaagaaaacactttcagtaggattcaattctgcagtaactaccaacaataagtttgagggaaaatacatctacggaagctataaccttacgattaaacaaaaaagagtaagattcaatgctactacagatatgctgggagattacctgaccccggaatttgctcaggatttgcagacaaaaaccccacagcagattgtacaggattatggaacacacgtagcagttgatatctatactggagcgaaactggatgttttattccaggcggaaacaagaagtcagagccgtgaccgtgctgcaagaattggtgtaaaggtaggaatgaaggatatctttgatgtagatgttaccaatgatgtaaatacttcagaatcatccatgaactattctaaaaaattggcttataaaacaagagggggagatccttcaaaagggcttgtgggagatctgaatcttgatcagacaaatcctaagattaacatttccaattggcaaagcagttctaatgcgagcaattcagtccttgtagatttcggaaataacggattggttattatttatgacctagtaaaggatgctgctaaaaaagctcagcttaaggcttatgtagatcagtatctgattgacaataaagtgtacatggaatttaatacaattccaatttacagatattacaatggagtagatcattattatacaaaaactccgggaagctacagcggatattcttttgaaggaacagaatttaatgcattcttatataaagctccgaacactattcctatctacagatactggaatggtaaagatcactactatacaagaactccgggatattaccagggatatgtggatgaaggaatcgagtttaacgcttttgctactcaggagcctaatacagttcctatctacagatattggaatggtaaagatcactattattcaagatcaagtgtaagaccttcgggatatgtttatgaaggaattgaattttacgcatactaaaaatattgatattttacagcaaagaagccgtttcaaatctgagacggcttctttcattaaggagttttatttataattaattatgtataaaagataagtacatatgaacatttcatatatccttatctttttaaaatgtatttttgtaccagataattattgaaaattataaatgaaaaaagcaatctgcctttttatcgttggagaaaagtacctgaagctattcaataaatgcaaagctcaatttgaaaattatgctaagaaatgcgatgcagaactcttaattattgataagcccttagatgagacctttgtacgacctcttctatctcaaaaattactgattccttccaaaacagaggagtatgatatggtgctttttttagatctggatattgtcatatctgaaaatgctccgtctatttttgattttctgcctgaagataaatacttcggtgctgttttggatcccagaggtactgaggaatttaataagacatggggacatattcccagaatactggaagagaccactgaaatctattttacagaccgtcactttgatgctagcccgttgctacaaggaagtataaatggaggagtatttgttttccgtcctaaaaaagtaagtgaaatttttagcagctattatttttcagaccataatcaaggagcactcaacagtttcgaagaaacaccttttgcatattattcccaaattaataattggtttgaggcattgcctgctaaatttaatactcaggttttatataaaataaaaggtacatctattggtcatcagattgaaaatgatgaaaagaaagttcctaagtttttaaggaaatattattataaaaaaaatgatgcctttttttatcctacccggaaatataaaaactttgtaagaaatatcattaaagataactattttactcatttttctggtaattaccctataatatacatttaaattatgcacatactttcacgtttatttagttcttttattactgtatcttacgcaattacagtaaataatgaagttaaagaattaaaaaaattactggatatccttttaccactgattgataaaaatgatgaagtgattgttcttcaggatataaccaatgaaactgtagaggttacaaaacttttggagaaatatagtaatattacaaaggtgcaggccaggcttgacggtgatttcgccgggtttaaaaacaatcttttcaaatatgctaaatgtcagtatctttttcaaattgatgctgatgaatatccaacaaaagatcttatcaaatcacttaaaccgtatctgcgtaaagaaagacgtggagattgtttttttgttccaagaatcaatactgtagagggtattacagctgattatattaaaaaaatgaactggactataaatgataagggatatatcaatttcccggattatcagcccagaattattaaaaataataaaaaaatattctggaagaatagagtgcatgaaaccttccacggctttaaacgaattaaagaaatgcctaagaattataacctttgtctaatccatgaaaaagattttgaacggcagaaaaggcaaaatgaattttatgaaacgcttgcagattaatcttcccaaaaatactttctgtttttcccggtaagtttattcttcatattttttatttttacttttaattttacaaaagttagcttacgaaggccatttaccttatcttgtaagaccctattttgttcctctaatgtctgatgttttagcttcatcagcatgatttcgttttctgtattgttcttttctaaggacaaaatattgtgttggatataatccagcctctttttcattttggcacctatagcttttgcattgaagaggtacatatcttcacgggcttttgctccaattttttgtgcctcttcattattgctgaatacaaaattcattagctgtgcggcatgaatgacatccggctcagcccaggaagaaccttgttgtaactgaccaacactttttgttaattctaccattttatattttacagcatatgaattattaacattcataaactctaaattacctgaataacctgttgcaatcactggttttcctagagccattgcttcagcgatcgtcaatccaaaaccttcggatctatgcagtgatatataacaatcacattgatttattaaagccagaagattttctcttcttagcatttcttcaacaatgataatattttcccgattctgaatccttttcagaatagtttctttatcttgagggaaataggtaggaattgaggtctttattaccagttgcacattctcatcgtttggaaaggctttttcaaaagcatcaataacagcaattgtattttttctttccaaatgactgttataatcaaacataaaaaggaatgtaaatttatctttactaaaactgaattctttttccttatcaatatctttatcttttatatcaataatgtgcggtatattaataaccggaataggcgattttgctgcaactattttttgacaaaaggaagatggcacccaaatttcatcaaaaagactgaaatagtcattataactatcgggaaactctgacagttcccatgcccagaagccaatattgtatctttttttaaaaaaatccgcgcctttttcctcgtagaaggaaggtattgtgtctggattgagatgtatgatatttatattgtaaataggatcttcagaaagttgtttctctactgaactgtcgtttaatctgttttttaaatcaagattaaaattgatgggaacatgggggatagatgctgcttcaagagcttttatgtttcctctgactgcttcaccaaaaccgatttctgctttgaaaaaaccggagatatttactccgaaattaccttctgtcattgtggccttatttattgaaatataaaatttaatcttctgtttattttttagcggaaagcataatttttttccagagagctatagtatcctgctcttcgttttgcaaattatagtttcccaaaataaagctggaagcattttttcctttctgtagaatttcatcaggattttcttcgtaaacttttattgcgtcttctatttttgtaacaaactcaataatatttccatcctcaacctgagacgaaatttcacgcttaaaatattcttttccaccctgtcctctatatcctatcacataacagccacacgccattgcttccacaggaggaagcccgaaaccttccttgtgattgaaacataaaaagaatgtactttttttcatgatgtcagcaacttcctgttcagttttattatcgattggaacaagattccatccattgagagagcctctttgttttaaaatagaaataacctgtgttacatcatcactcagctttcttggcataaaacaaatttgcttttctttattttctgaatagttaaatacatgatgatttactcctaatctcatttttaaaatatcagattgtgggaaagcaagtctcatataagtaagtgcatcttcagatgcgactatagttgccagcgtattgggatgattgtatggggttattttataattctcataaattgaaaagtaattaaatgtatagtagcaattttgattgaaaatgacttttgcaacatccggttctatgtgatgtattttggggccataaatctccgggaacaccaatatggcctctttttcaatttttttacttctttgctgaaggaaaaacaaagcagtttttttaaaaaaattaagctttttgtttttataagaatattttaactttttaaaaagataggggctgtatacaattggaacatcaatattaaaccagctgtcttttttgccaattttcttatgaagtatataagcatcaaacccattcttattcaggatctccacctgtctgtagatttgttttactcctccactggcaaaggtattatttggacagacaaaatatattttagttttcattgttaatagaaagtatagtttttacccaatttttaatgtaatatttttcctttatcaattctgaaggttcttcatatgcattgctaataaatgattcaggaatattgatattctgaatatcctctataatgaaaatatttgcgggattataaaaatcataatgagcaatctccttattggttgtaataagctttttatgcagacctatcgcctcgtagggtctgaaggaaagtcctttttgatgaggatgtgcaagatccagtatgattttactatctaaataatatcgataagactctgagaaaggtataatatcatgtataatttctatttctttgggtatcttttctgtaatagaggttggcttataagtgaaaatcctaccctttgcagaaatactgtttttattaaaatattcaaaaagtgaaatagtttcctgaattctcttgtcgtatgttgctaaatagctgatatcgtaagttgttgcggaatcgttattttcaataaaataaaaattggtgatataatgaagattatattctttacagtcatcagaatcgaaactgcagcatacgttaaatttattgatatactctttctgagtaggtattttctgaatactatcccaaaatagaacaatggaatgcttggatttttttatcgcaagatcaagatcgtttagagacagaacatctggtctgttgaccaaaagtacatcataatccagactgctaattgttttctgaatatgctcatctctttttatattttttaaatttttaccaagaaaagttttcagcagaaaattgtaaatcttttcaaaaatatttttgtactgatatggcaatgttgaattaatatgagtgacatcaaagccactatattttttaagaccctcaaaaacaacttcattaaacccatagtaacctggagcaataaataacagtttttttttcataatttattaccattattatctatttcaaaaaccttgttcacccaactatccaaagtatatctgtaatagatttcttccggaattttctcgtaaggcttttcaaagaaagatttgtcaagattactaatatttttgtttaaaatcaaaatattattgggattgtaaaagtcataggttttaatggcttcgttatcagtaatgattttcttatccagagccatggcttcaaaaaccctgaagctgagtccgtattgcccttcacgcataaggtccagtaacactttagagtttttataatacttgggaagatcattatgcggaatttttttgatactgaaaatcagaaaaagatttttcggtaccgtcatgaaaatattggtcagctgatgcttccatgatttctttccgataatcatgatctgaaatttaagtcccagttcaatcagctttctagccagtaatttgatgagtgagacccttctgttatcataagaagtaatgtagaaaaggtccatttcgggttgttgggtttcttctgagcagtgcggaaggtaaatataattcgttaatttttcgaatccgtgttttttaacatcaatatgatcgaaggaaaatactttgtcaaaaagatacagtttatcttctacaggaactctttcaagattatcataaaggtaggtaaccaggcggtctgtatatttacggatttttttaagcgtagaaagatcaaacgtatcaggattcatcaccagtatctgatcctgatgtcctaatttttcaagcgaatccagaacgtatttctgtcttttttcggtcttgagatttttatttaaaaaagttttgctgagagcatttacggccctttcattaaagttggaatgagtaacagtactgatctttatatgatgagcatcaatacctcgtttgcataatgtttcaacaatatacttatcataatcccaaaaatcataactaatgatacaaatcttcattcaactaattttgctctttttttaatgattcataggtttcataaacacttaaagattgcaggtatgatagctgatacccttcttttccgtctaaaattccaagtctcattatataggctttaaagaatttaaaagctgttttaagatattgaactaaaacactgtacttttttccttttgcagccagttctttcccctttaaaactccgtaatgaatcattttttctttgtaggattcataatctgaaacggagtagtggagtaatttattttttaaaactccgatggttcccttcacctccagagtttcgtgtacctttttacctgccatatatctggccttcgattttctgaacagcctgaagtttttatcagactgagttcctgaaaaatgaataggtttctgggcaaaaaagaatttcctgtaaaaatagtaggcatccttttgcccggtttttttcagctcatcaatgatttcctgcttcagggccggcgtaattctttcatcaccgtccaaaaataaaacccagtcgttggttgcagcatccagagccagatttctttgctttgtaaagtcttcaaatttattctgaattacttttacgtgcgggaatttctttgcaatttctacagttttatccgtactaaaagagtcaacgactattatttcatcacaaaaatcaaaggactcaaggacagcctgtatatttttttcttcattatatgttatgattaaaccacttatattcatcacaacgctttgtttgatagagaagtacataaacacctcccttaatattgttttttaaaatagttttaatctgccaaagataagttttaatttgaattttatgatcgaatctttgccttttatatcaattctacacagctcgtaaggatgccgggtaggataataattcactttatttcctattcttactgcaaaatcaattcctaatttttttaaaattgaaaaaaaagcgaatttatcttcttttttttgaggatatttaccataaggatatgccaaaatcttggaatagctgatgttttgggcatccagcacctccatattcttttttagatctttttctataaaatcagcagaagcatctttcagattttcatgcgcatggctgtggagtgcaatctcaaagtattttttatccagacttctgatttcatcaaaggtcatcatcggataatttttatatccattttcaataaatccggttgggatgaaaatagttgctttcagattatatttttccagtaaagacggcaggtattcaaggttatttttgtatccgtcatcgaaggtgataataatattcttttttgatgaaagagtaagctcagaaaaaaaatgcggtgtatattttttacggctcagataagaaaactgctgctcaagattttttaaggagactgtaaggtcttcatagctttctttttcaatctggtgatacatgaggataaccagtctgttataaggaagtgcaaaaagatacagacggaaatacacgacgataaatatcgccaacacaacaggaatcagataaaggatcatactatctactgtgttttttcaattccgacaatcttattttttcacgaagcttaatatattttaaaaaggtatagtaagacattgttttagcgatataaaagcctggaaatccatccaggaaaccaagtctgaaaataaagaccttgataaactcgaataccgggcttacaatgatcttaaatcttttgactttcattcctctttcaaacattttctcagccatcatatcggaatatttattgatttttgagacatgatgatggatgcttttgtaggtataatgattcagccttccctccataatacaggctttctgatcagtaatcagaaactcatgaactttatcatcagaataccttgcatatttttttctgaacagcctttcacggtatacatttccccaacctccgaatctgatcagatgaattcccagatgattattgaacttcgctttatacacattgcacgctgtgctttctgaagaaacaatcttttgtatggattttttcagcactgcatcaggaacttcatctgcatccagaaacagaacccattcgtgggaacataaatcaagggcatggtttttttgttcaccatacccgttaaatgttttctcaaagaattttacctgaggatatttttgagtgcaaatctcttttgtcttatctgttgaaaagctgtcgacaatgatgatttcatcaacgatgtctgttaatgaatctaaaagtcttacgatgttctcttcttcattataagtaatgattgcaagggaaagagccatttctatttaaactctagaatagtcttttcaataattttcacacaatccagtaattgttcttcggtaattaccaatggtggtgccaaccttatgatattgccgtgggtaggtttggccagcaatccgttttctttcagttgtaaacaaagattccaggcagtggaactttcaggagtatcattgataaggatagcatttaaaaggccttttcctcttactttggtgataaggtctgtcttttcgatcagtttctctatttcagctctgaaaagtttccctaattcttcagctctttcagatagattttcttcagctactacatccagtgcagcaacggctacagcgcaggcaatagggtttcctccgaatgtagaaccgtgttgtcccggtttgataacattcatgatgttgtcatttgctaatacagcagatacaggatacattcctccggaaagggctttccccaagatcaagatatccggctgtacatcttcatggtggcatgcaataagttttcctgttcttgcaataccggtctgaacttcgtcagcaataaaaagaacattgtgctttttacacagctcagaagcatttttcagaaaattttcatccggaacatatactccggcttcgccctgaataggctctacaaggaatgccgcaatattttctgcctctctgtttagaacttcttccaaagcagcaatgtcattgtaaggaattttaataaatcctggggtaaaaggtccgtagttctggttggcatccggatcattggagaaagaaacaatagtggttgttcttccgtggaaattgttttcacaaacgataatttttgcagcgttttctgcaattcctttcacctcatagctccattttctggctaattttacagctgtttccacagcttcagccccagagttcataggtaaaactttatcaaatccaaaaagattagtaattttttgttcgtattctcctaatttggagttgtagaacgctcttgaagttaaagccagcttttgtgcctgctctaccagagctcctacaattttaggatgagaatgtccctggttcacagcagaatatgctgaaagaaaatcatagtaccttttcccctctacatcccaaacgaaaacaccttctccgcggtccagaactactggaagtgggtgatagttgtgcgctccatgtttgtcttcaaggtcaataaaatactgtgagttttttgtttgttctgctgttgacataaattttggttttcaacaaatttacacaatattaatgatacccataaacaaaaatagagtagagtataatgctgtaattagagtatattttgaggtaaaataaatccttgaatggaaaatatttttttaacggataacagttgcaggtattctatctttaagaataagaaatttatactgagaagataattctacattttaatcattccgatattgattgctgttccatcaggactataatttttaaatacttttccctaattagcttttgattggggttgtcttataaattgttctagtacgaaatatcaaaaactttttccatttgtttttcgttaacagagccaggtgttgcctttagtaaagtattgcggagccaaactgccagactgttttcataatgggatattttaccgatggctgagcttgtgttgacaatgtaatgtgcttttttcatacgcagtttttcgtattgagtgaagacttcatctacgtttttcccttcaccaaaaagttttccgaggatatatgcatcttcaatggcctggcaggcaccttgtcccatattaggagttgttgcatgggctgcatctccaatcaggcaaacacggtctttttgccattgataaatcggttccaaatcgataatgtcgctgacaaatattttttctttcggtgttacggaaatcatttttggaatttcgggattaaattcagcaaaaagctcagcaagattatcgggatttttaaccaggtgctcgttaaccacagcgtaccagtaaactttgtgatcactaattttcacgaagccgaagcgtctgccttttccccaggcttcataagcatggtgattatatttttctgtccaatcagattcgatgacagcacgccagcatttttgcttggaagatctgagttttccaatatttaaaatttgatggcgtactactgatttaatgccatctgccccaataacagcatctgcattaacgatagtttcgtcttcaaaagtgagttgataaccgttttcctgttcgattttggataaacgtttagaaagtttaatgttttcaaaaccaatttcttcagccagaatcatttgcaaatcggcacgatgaatggcaatattgcttactccatatttactttcgaatgtattcagttgtacatccgataaggttttgagctgtggatcagtaatgttaatagttgaaattttatgacctgctttttcgattttgtggcgaatgctaagtttgtcaaagacctgcatggcattattagccataatgattccggcgcccacaggttttatttcaggtgcactttcataaacgataatgtccagattatttttttgtaaggctaaagctgttgtcaaaccaccaattccgccaccgataattgctattttcattttgattgcatttatattatgaggcaaaattaaaggctggaaaaaccaaaaacgttcacttaagttaattttctgaaattagtaaattcttttccggattctgcttagcgattgtggtgtaattcctaaataggacgaaatatatttctgtggaattttgttcagaatttcgggtgactttttcaggagattgagataacgttcttccggtgtataaaaaaacagctcgtcaagcctttgttttgcatccagaaaagctaaatcggatatgcgttttgcaagcccaagccagaaaatatctttctgaattaaaatctcaacatcttttttattaaaatacaaaacttcagtttttagaagagcctgtataacagccattgatttttttccggtaatatagcttgcgtaatcaccaattacatcattattcacctgtaaaaggtagctgatatcttcgcctttctcgttgatataataaatccggacggcgccattcaaaatgagtcctaaacgattaaatactccatttttaggttctatcattttgtttttatcataagttactatatagcaaatatccaaaaattccttcgcacgctccatagaaatctgaagtgtctctgctaatttctcctgtatttctgatgtcatcgctcttatgtctgttttaattgatactacaaaaataacttttcctgctttatttagaacgaaatagagtatacaactaaagaaggcgccttttcggacgccttctttttatatgaatgataattctttttagtgattatcatattttctatccattacaaaatcttccatgaattttgtagtatagtttcctgaaagataatcttcattatccatcagctgtctgtggaaaggaatagttgtttttactccttcaatatagaattcttcaagagcacgtctcatttttgcaatagcttcttcacgggtctgagccgtcgtgataagtttagcaatcattgagtcatagttggaaggaattgtatatccggaatacacgtgagtatctactctgattccgtgtccgccagggatatttaatcctgtgattttccccggagacggtctgaagtctgcgtaaggatcttctgcgttaattctacattcgattgaatgtaatttaggataatagttgattcctgaaataggagttcctgcagcaagaagaatttgttctctgatcaggtcataatcaattacctgttcagtaataggatgctctacctgaattcttgtgttcatttccatgaaatagaaatttctgtgcttgtctacaaggaattcaatagttcctaccccttcgtatccaataaattcagcagcttttacagcagcagcacccattttttcacgaagttcatccgtcatgaaaggagaaggagtttcttcagttaatttctgatttcttctctgtacggaacagtctctttcggaaaggtggcaagctttaccgaattggtcaccggcaacctgaatttcaatgtgtcttggctcttcaatcagtttttccatatacatacctccgtttccaaaggcagctacagcttcctgaatagcagattcccagtgatctttaaggtcttcagctttccaaacagctctcatccctttaccaccaccaccggcagttgctttaatcattacaggatatcctgtttcttcagcaatctttacagcgtgttcataagattcaattaacccatcagaacctggcacacatggtacaccggcagctttcatggtagccttggcatttgccttgtctcccattttttcaatctgttcaggagatgcaccaatgaacttgatgccgttcttctggcagattcttgagaaattagcattttcagataagaatccgtaacctgggtgaatggcgtcagcattggtaatttccgcagcagcaataatgttagggattttaagatatgagtctttactcattgcaggaccaatacataccgcttcatcagcaaatcttacgtgaagactgtctttatcagcagtagagtataccgcaacggttttgattcccatttctttacaagtacgtaaaatacgcattgcaatttcgccacgattggctattaatatttttttgaacatcttaatacgatttgaaatttgaaaatttgaaatttgaaattgactttatcatcaattatcaatcatcattaatcaatatttaattaagatggatctactaagaataatggttggtcgtattctaccggagtagcgtcgtcaactaaaattttaacaatttttccgctgatttcagattcaatctggttgaatagcttcattgcttcaataacgcaaactactttaccagcagaaacttcatcacctacatttacaaatacatctttatcaggagatggttttctatagaaagtaccgatcattggagatttgatcgttacatatttgctgtcatcagatgtagcttcagccttttcagcagttgctgcagccggagttgcaacaggtgccggagcagctactgcttgaggagcagtgtgatatactgcaggttgtgcataaacagcatcgcttccagctaatggagttttaatagtgatttcgaaatctttagttttgtacttcacttctgaaacttcagccttagatacaaacttgataagattttgtatgtctttaatgtccataaatttgatatttgatttgatgccaaagataccaaaaaaacgtaaaaaacaacaaaaaaccgccaaattttatcaaaattgggcggtttttgtattaaaatgaggctttttcagtgaaaagcgactcttagttttcttcagtagctgctacttctttttccaatactactttacctctgtagtataattttccttcatgccagtgagctctgtggtataggtgaagctctcctgttgttgcatctttagctaattgaggaactacagctttgtagtgagttcttctcttatctcttcttgtagacgactgtcttctctttggatgtgccattttctaataacttttttaattgatgagcgatgagattcatcatctcatcatatttaaattattctatttaattattgtctcttaatttttttaaagcatcccatcttggatcgctttcatgttcttcctcttctgctacctcaatatctttaggactgaactggtcaagaattttaagatcttcatcacttacattcggtgaaatctttttcatcgggatagaaagcattacattttcgtagatcaaatgcgctacgttgaaggcgtgctctccggtaggaatggtaatcacatcttcattgctgtcatcatattcttccccgaaattcaccagaatcttgatctcattctctataggatagtcgaaattttcatttgtgatgtcacaaactaattcaaccagtcctttaattttaatctcaaactccaggaaagtagtgtgtttatcaagtgatacattcacttctattctgggatttgtaaattcctgctcagtgtcaaataattgaaagaacgttttatctatctcaaatttgaactcgtgtcttccgtttttaagtccggaaaagcttacgtcatagtttcttaacttgtccataaaatgagtgtgcaaaaatatgcattttttttataataacaaataaaatctgaaacaaattaatttaaaatttgttttaaagatttatgcttcagtttcctccggtagatcttcatctattccgttgtctacagccatttttctaggctgcaggcggtcgctcatcagttcgctgtattcacttctgtttttgaaaaccttaatagcagtgaagatggcttctataaaactttgttcgtcagcgatattttttcctgcaatatcataagcaactccatgatccggagatgttctgataaaaggaagtcctgcagtataatttaccccttcttcatacgctaatgttttgaacggagccagcccctgatcatgatacattgcgagcactgcgtcaaaatttttgtatttgttgggctggaaaaagctgtctgccggaaaaggtccgaatgccagtattccattgtcagaaagttctttaatagccgggctgatgatttcaatttcttcacttccgataacacctccgtcaccagcgtgcggatttaatcctaatacagcaattttaggtttttgaatgcagaaatcttctacaagcgtttggttcaatactttgatctgcttctttattttttctttggaaatattttcagctacctgtgcaataggaatatgatgcgtagaaacagccactttaagatcttcagtcacgaggaacatgagtccttttttgttgaatttttcctcaaaatatcctgtatgtcctgcatgtttaaagcccatctttaccatttcatccttattgataggtgcggttaccagtacatcaatatcacctcttatcaaggcttcagtagctgcttccagagaatcaatcgccattttggtagactcttcagtgggaactcccaattcaacattcacgttttctttcgtgagattcaccatattaagcttacctgcctgggcctgtgaagcttcattgatataattgaaattgagattcagcttaaaaatatttttctgataagtgaataatttccccgaaccaaaaattacaggagtgaaaaaatctgtaatggttttgtctttcagagacttcataatgatctccggaccgatgccgttgaaatcaccgattgaaattcctactcgtactttatggttttttgggctcattttgattatctttgaagattataatttacaaatttagcaaaaaataatatgttcacaggaattattgaagcagttggtgttattgagaagattgaagaaaaaggaagcaatatagattttacccttacatgtccttttacaaacgagctgaaaatagaccagagcctggcacacaacggctgttgccttacggttgtagagattaaagacaatcattatgtggttacagcaatcaacgaaacattggaaaaaaccaaccttggaaaatgggaactgggaactgttgtgaatcttgaacgctgcatgaagatggatggaagactggatggtcatatcgttcagggacatgttgataaaaccggtgaagtggtaagtattgaaaataaagacggaagttatttcattaccatgaaatatgagaatgacggaagttttgtaacggtgcctcagggttccattacagtaaacgggatcagtcttactgttgctaaaagcgaagatgctcagttttccgtagctattattccttatacctgggaatttacaaatatgaaacatttgaaaattggtgataaagtaaacctggaatttgatatcattggtaagtatattgctaggttaattaaaaagtagaatgtcaattaataagtataaaggatatagcttaaggaaccgggtgtttttcggatttctgctggtatgcttcttaagtgttgttgccacctcgcttgttccttattttgtattaaggaataactccatgcagcaaagtaatattgacatgcaggagaagaccaatgctgtgatgcggtatctggactatgcggtaagccgtacattggtggagactgaaaatcttcctacggttttagggaacaaaatttttgaaattgcagatattaaccagcatgatattgttatttatgatctgaaagggaattacctgctttccaacaaagatgaaagcctgatagaccagaagacgatttccattgatatcattaataaaattctttctactgatgcaagggttgatctgactaggtatgatgctgctaaagatgctaagctgacctcttcctatcttctgctgaaaaataatgagcttgaacccatcggcattgtttatattcctttatatcataatgagtctgcttaccttgatgttcttcatcaatatgtaaaatatattcttctggtcgatatattccttatcctctttagtatctggatcagctgggttacttctaacagccttgcaaaaaccattacgaagttctctgatatgattacgcgtatcacattgtttgaaaacgaaatgcgccctatcagatattataagaatgatgagcttaatgcgctggcgagagcttataacagaatgattctgcagattcaggaccagaaagagaggcttagatttaaagcttctgaagaagcctggagagagatggccaagcaggtagctcatgaggtgaaaaacccattaactccgatgaagctgaccatccagaattttgaaagaaaatttgatccggaagatccgaatatcagagaaagagtaaaacagatgagtaaaaccattgtggatcagattgatctgattgctacggtagcctcggctttctcggaatttgcaaaacttcctgaaaaaaataatgaagtcatcaatctgaatacagaagttgaagatattctccgggtattcaatgatgacagtattttcatgcatgccaataagagcaatattatgatcaatatggacaggatttatctttccagaatcataacaaatcttgttactaatgcaaaacaggcagaaagcgaccagagaaaactgattattaatgtagatgtggaacagcatcagagaagagtaatgatctctgttcaggataacggaataggaattcccgaaaacatgtacgaaagaatctttgaaccgaatttcacgtctaaaaacagtggaatggggcttgggctttctatggtgagaaaaatgattgaagattataaaggtgagatctctgttaaatctgaagtagggaagggatctacattcattattacactgcctaccaatttatagtgaaaccttttacttttaagcaatttgaaatccagcagtctaaagacgtcttccgtgtgggaacagatggtgttctgcttggagccttggctgatgttgaattggcttcccgtgttttggaagtaggcaccggtacaggattaatctctctgatgctggcgcaaagaaattcgcatgctgaatttttaggattggatattaatgaagatgcagcacagcttaccagtcttaattttgaaaattctccttttcgtctaaggctgaaaaatagtcaccaggattttaaaacttttgaaacgagtgaccggtttgatcttatcgtatccaatcctccgtattttgaagaatcaggatctgaaaaagataagatagcccgtcagaccgtagaactgaacttcagccagttgataaccagggcggcagaattgttgtccggcagcggaattttttccgtaatcatacctgttgaggcaagagagatttttgtttcaattggtaaagagaataatctgtatctgaaaagaaaaattaatattaaaggaattgaaggttctaagaccaaaagacttattctggagttttcttcggaagcgaaagaggttgatgagtctgatttcattatagaaaaaagtccgagacaatactcggacccatatcttgaactcaccaaagagtttcatgtttttaagtaaagaagttagaaattagattttagaagttagttatttctgactttcttaatcttttagttcttattcgaataattctgaagtatccaatacagaaacttttccgtcctcgcatctgatcgcttcaccagggaagttctggatcatatggtaatcgtgtgttgccattactacagcggcaccattttcaagagcaacctgcttcaataatgtcataatttcgttggaagtttcagggtcaaggtttcctgtaggctcatctgccaggataagatcaggatggttaaggagagctcttgcaatagcaatacgctgttgttcccctccggaaagttcatgaggcattttatgctttttgcttttcatgttcacgcttcccaaaacctcattgatacggtcttccatttttactttgtcattccagcctgtggcttcaagaacaaattttaagttcttttcaaccgttctgtccgaaagtaactggaagtcctggaatacaattcctaattttcttctcaggttaggaatgtcagaaggctttagctttgccagatcaaaccctacaaccgctccgtgccctgatgccaatggaatatgtccgtaaagcgttttcagaagagagctttttccggaacctgtttttccgataagatagcagaatctgccttttttaatgttaagatttacatcagaaagtacagtaaagtttttttgcgcaatcttggcgtgttgtaaacttatgatgttatctccggagatatgtgtatgtggcataattaaattttaaaggctgttttctaacaaaaaaatttcaatctttaaaaatagaaaaaagaagtctatctgactctaattttagtaaattttaacaacaaaaaatgcctgaaaagtaacttctcaagcatgttttgtatatgataatgtagaaattatctcttagcgcgtgcagcacttacagttaatctctttctgcctttagctcttctcgcagccaaaactcttcttccatttggcgtagacattctttctctgaaaccgtgtttgtttcttctctttctttctgatggctggaatgttcttttactcattactatatgtttaaatcgtaattaatctattaattttcaggttgcaaagatatataaatttttataagttacaaactttaattatctttttttaaaattaaatttaatgtttttcggtcgggcttttacaaaccctcatggcaaaaccattttccggtacaaaaataatatttaaatgatttatataaaagctctatctttgaaaactttaattttaacgaaaaataaacaccggatgtttacaccagcagaacttttagatatcaatacattacttacccaagacagcaaaatagtgatccttacccattataatccggatggagatgctattggttcaagtttgggattgaaacattatctgaaagcaaaaggaattcatgcagaggttattgtacctaatgattttccaaagtttctgaaatggatgccggaatctaaaaaagttattattgctgagtataaaagaaagctggcttctgatatgattgcaggagcagacgttattttctgtctggattttaattctccatcaaggatcggattactgggagactggctgataaaagctccggggaagaaaatccttattgaccaccaccagcagccggaaaaatttgattttgtgtattcggatacggtaattcctgccacttcacagatgatctatcatttcatagaagcaatggatgatgaaaaactggtgaaccaggatatggcagaatgtctttatacaggaattatgacagataccggtggtttccgttttcgttctaccagtgccactacacacaggattattgctcatctgattgaaaatggggcagatcctgcgatgatcacctccaatacatgggataccaatacggtttcgcgcctgcatttacttgccctggttcttgggagaatagaagtagtgaatgatggtacagtagcggttttgagccttacaagaaacgagctgaaagaatatggtttccagaaaggagatacagaaggttttgtaaactatggcttaagtattgccggcgttaaaatgtcagcattctttatggaagatttatatgaagacttcgttaaaatttctttcaggagcaaagatgatgtggatgtaaaccaattctcaagaaaatatttcaatggtggcgggcatattaatgcagcgggcggaaaatctttagattctctggcaggaaccatagaaacctttaaagataaagtcaaagaggaaggctggtaggaacacataaaaggcaagctataaaagtctgtatattctttatccaaaatcctggatacttttacgatatcccttttcttcaagctcctgacaggtatattcgtacacctgctgaaacatttcatccatatatcttttgttgaaaagactgtattttgtcattttgggcggatccagaaatatattgcagtatttggctttagaatacacggattttgcaatcgccaagtgaaggattctgtcaaactccttcatcaggctcattttttttaattcatcataactgatggagttgacatgggaagcaatcaggaaattacatttatcaatgataggctcaatgggaagattgtccagaacacctccgtccacataaattttctctcccatccttaccggaggaagaataaaaggaacacttgatgaggccagcagcggtccgaaaagttctccctcagaaaagaaatctacgataccttgcgtcatttcagtagctgcaacatacacaggaatttttaaaatactaaagttatcttcaggaaaataatctttgaataattttacaataaagttggagctgaaaattccgttttttgataattttaatgcagatctggagaaaaaagaagtttgtcttacaatttccatcatttcgtccggtgtttttccaaaagaataaaaagcaccaataatagagcctgcgctggttccggagataatgtgcggtttcaggttatattcttccaaagctttcagtacggcaatatgagcaattccacgcattcctccgcctgaaagtgtaagcccgataaccggtggtgccggtggtttcttttttttgaatgaaaataaagccattaccaaaattatcctctactaatatacaggattttttgttaaataagactttaatctatcaggaagaatgttataaaaccagttttttaggaagattgtgaagaagttccgtattgatgatttctgcacagatacctggcttttcccagtgaccgttatgtccgcagtccaggatataagatttgatattcgtcctgtccggaagatgtttgatcatcatatcggtttttacggcgttatcatgtttaccggctaatactaagattttagcttccagcttttcaaggacatgttttttgtctgttctttctaccatacctttcacacaggctagagcccctaaattattggtggaaagagctgtttcgagtgctgtttcaatttttccttccagaatatccctttcatttggattgaataaattgggtactccggctcttgcataatgggcaaatgcatctttaatgattctgtagctcttgatgcgctgctgttttttctcttcatcatccggaaaataagtagagaaaaataaagttaagctttttaaaagatcagggtatttttcagcaaaggcaagtgcagtatatcctcccatggaatgtcccaaaaggtgaactttctctaaatgctgatcatccagtactttttttacctcctctgccatcagttccatggtatgaatctctgcgagaatttcagactgtccgtggcccggaaggtcaattttaaggaatgaaaaatctttggaaagatgatgttccatgtcgctccagatggatagattttccataaaaccgtgaagaagcaccaaagtttcttttccgtttccttttctttcaaagttcagcataattccaaaaatttagaaggttaataatacagcaggttatctgcagactcgtttctcctttcaaaattaatcaaaaaaagggcatccaaaaaatgcccttgtcttttattgagttaattccttataaacctttgtttcccagggtttgatatccgttacaccatatctttcctttttagaaatcgcaagattgtccagcatgtctacaaaattcttgtaattggcttcatccgttggttttacaataactgtaaaattgttggatgccggagcatttttatacgcatcggcaatgatctttgaaatcttgattccactgaaatcagtttctttaagattagtagtgtttaaatcttttgcattactttgatgataaaatacccggttgtcctttcccaggataaatgtgatctggtttttgtctccaattacattttcaacaggtttgtgatcaggatcttttgccggtagtcccagatccattacgttaggttttgtaaagttagtggtgaacataaagaatgtgatcaataagaatcccagatcaaccataggagtcatgtctactctgatcatttttttcttttgtttgctgccttgtttctcttgtgcaattacttctgccatgatttaaagtttttaaatgttaaacggtatttgttgagtaattcaaacaaaacacatgccttgtttgttgaataatcaatagattcatgaatttattgatggtttttatattgaattttaaaattccgtttcttcttttaaaactgattaatcaatgatgtttctggctttctgataattgtattttcagtctcatatttttcaaaattgattctaaaatttttcatcaactgctgcaaaaaaaactcacacggcaaagtgtgagttttcaaatgatatgtaaataattttatttattctttttatagtaattaaccccgcattctaggaattttttaaaatcctcttttggcatgtatcctgaaaccggcgtgttgattacttttccgtccggagtgatcaaaacatagtgaggctgtgagttattattaaagttaacctgctggaataaactccatctgtcaccaattgtttttacttttttaatctgcccgtcgccaaggtcaatttttgttttctgatcttcaggaagctcttccttatcatctacatataaagaagctagtactacatcattctgaaggataggcaagatatctgcttcactccagacaaactcttccatttttctacagttttcacaaccgtatccggtaaagtcaataagaatgggtttatcttcttttttagccaactctaccgctttgaagaaatcatgttcggggtgcattcccagaattccgtctttttcatcatggaaataacttacattcagtggaggtaaaattccacttaatagctgaagtttcggacgatcagatggaattaatccctggatcaggtaaatcacaaaaccgattcccaatgctcccaatacctttcttgtaacggagatcttaggctttttatcatcatgcgggaatctgataaatcctaataaatataaagccaatcctaatgcaacaatgatccagatagcgataaaaagctctctttttaaaaggaaagttttggatacaaggtctgccttagataagaatttcaatgctaatgccagctctacgaaacctaaaactacttttacggtattcatccatcctcctgatttcggaagactttgcagcgcttgcgggaataaagccagtagtccgaaaacaatagcccaggcaagaccaaatcccgccaatgcaaatgtcagcaacatcgggacatttgtagaacctgttaccgcacttcctaataaacttcctaagataggtcctgtacaagagaaagaaacaattaccaaagttaatgccatgaagaaaattccgataattcctcctgcttcttcagctttggaagatttgttggctactgaacttggcaacgtgatatcataatacccgaagaaacttccggcaaagaagatgaatataataaagaaggcaatattaagccatacacttgtggaaatttcattgaagatatttcctgcaataccgtcgataacgtggaatggaatacttaataaaacgaagataagaagaatgaaaaacccataaataagagcatctctttttcctttggctttgtttttagttccttttgtaaagaatgaaactgtcaacggaatcatcgggaaaacacatggtgtaagcaatgcgattaatcctccgataaatcctaagaacaaataagtccagtaattttcatccacttttgcggaagctgtaccgcaatctgttaatggttttttgaaatctattgtttcaattttcagctgcttaggatccagttttgacgtttctgtaatcgtagcttcgttttttgcaggattttcagtaaccgtctcagttacttttactgagtcttttacaggagaagctgtttcttcagttaccgtctcttccgttgcaccttttggtgtgactttctggttgaattctaacgtattaggagcaaggcaaactctgtcatcacaagtctgatacgtaatttcagaagtgacatctgcaggttttgccggatcttttagcttaaacttctgcttaaaaccggctgaattagaatagtaaacaattgttcccccgaatgcttcagaaaattcttcgtgttttttacccacttcggtaaactttccaatcagttcgatattctttcctgtaactttatattcagtaggaattccggtatcttccggcaaatctttggagtaaatgtgccacccgctttccattgtcgcattcagcactgcttcgtactggttgttaccaaggtcattgatggtgaatttaaactttacaggattttttatctgtgcattaattcccgtcgctaaaaataatagaattaataaaaaccaatttctaaatttcattgttcatttcattaaaaattttgagactccatttcgtcttctcattcattgcatatcgtctgtcctgtctgattgggataaccccaagtacagaatcattgctgtcagcaagtatccagattttttgcctcgctaaaatagataatttttcgtccctaaaaaatttagaaactttctttttcccagaaaaacctgtgggataaaattcatcaccttctttttgctttcttaaacgcagtgggaaatgaagtttttcagcatcaaaatcccactcaaagcctttattgattccatcaatgctttcaatatgatctacgagattgatggtaatctggttttcggaaaaatcaaaatgatcgatcaggacaatttcttctttagattctttttcttgacttctatcaataaaaatcagttcatcacggttaacaattaactgatattcttttgaaaaaaaagaactgttgttttccgctttaaaaattttggggatttcttcctcctggttgaaaccgtatttttttaaaatttcgaattttacgaaatcgctttcctgatccagcttttcctttgataagattttatagtcttggttaaatactgtaagtttattttctatttcctgaatctgtttctgaacaaaatccttggtttgattcagcagagaagaactttttctgaagttgtccagaaaatgttcgttggtttccatcagcatcggaacaatctgatttctaatcttattcctcagataatcattttttttattggagagatcttcccggaattcaatatggttcaattctgcaaactgataaatttctttttttgaaaaatttaaaagcggtctgagaatattattgtcatgggaaggaattccgcttaatccgttgatgccggcagccttggaaagattgatgataaaagtttccagctgatcattcagatgatgggctgttaccagaaattccagtttttccttttcctggatttctttgaaaaacttatatctgagttcccgtgcccaaagctgaatagagttttccggtttctgatctttttctgaaacttcatacagatgaaattttatatgatttttctcacaaaaatcctgtactgttttctgatccagatccgaatcattaccacgaagtttataattgatatgagcaacctgaaaccggaactttgaatcctgaatttcctgcccgaaatccctgaacaaagaggctagaaccatagagtcagcacctccgcttactgccagaagataggtgtgcttttccggctcgtgaacgagattttttaattgattgataaaggttaattttttcaacatatatgttgagaatttcttttatgcaaagataaccgatataattcaattgaatttccctaactttgagtagtctaaaaatgattatttatgaagattttaaaaattttagcagtttctgcaatggcgctgggaatgacatcttgtgtcagcaagaagcagtatgacgctttgagcacaaactataagcagtgtattgaaaacatcggagaaagacaaagagaaattcaggatttgaaatctcagaactctgcattgacaggtgaaaacaatttgctgaaaagtcagcatgatgctttaaaatcatcattggatgcatgtttgtccaataccggaaaaagttctgctaacattgataaactggtaggagaaatcaatgcttccaattcttatatcaagcaactgatctccagcaatgcgaagaatgacagcctgaaccttgcattgtctaacaaactgaagagatctttggataatgtatcagatgaagatgttcaggtaaaagtattgaaaggagtagtaatgatctctctttctgataaaatgttatacaaaacgggagattacaatattttacctgcagctcaggaagtgttaggtaaagtagcgaaagtaatcaatgattatgataaatattcagtgctgatcgaaggtaacacggataatgctccattaaactcaccgaatcttccgagagacaactgggatctttctgcattaagaggtacttctgttgctaaagttcttcagactcagtttggtgtggatcctgcaagaattacagccggtggacgttctgagtacaacccgaaagctacaaacatgagtgtttcaggaagagcagaaaacagaagaacagaaatcatcattatgcctaaacttgacgagtttatgaaactgatggatatcgctcctaaaaaataatcactcaatcatacataaaaaaaatcccgaagcaattcgggattttttatgttaattgtcaaccttaagcctattaattcttaagtttcaagtactgtgtcagacaaaaataaaccccgaaggtgggcggggcttatttttaatcaaattaattcttcctttttcaggagcgaaataattcgttgcaaaaatgaagtggatatttctgtcttactttttgctgcagaagaatcagttctacctctcggtaaaacttttttgtgattctcatggttagtttgtgtctctcctgcaatcatcttgtttctcttagtgtttttaccccttattcttatggcaaacttagcactaataccacaaaaataccatccgtgttttcccggtattttatatggggtttttactgatatttaaatttttatacatttaatagttgatttttaagtatataattagttgattaataaaagaatgtgtatatttatatctctattaaaggaaatattatagagatgtccgaaaatctaaagagtaggaaattaatactaaactaaaattattatgaaaaattcgaaaaaactttcaagaggagaaatgaaaactgtacaaggtgctattaacgggtgtaatccacagatattttgtactagcctacaaacaaagtgttgcccaggatgggtttgtgctggtataagagaatattgtattgcgatataaaattttaaaagctaagtacatgaataaagagggattaatttctctctttttttgtatcttactttgcagtgtagaaagaaactttaaaatccttaaatttgtttaaattaaaattatatgagtttttttgaagaaaagaatcctgaaatggatagatatttggaagcacatgcttcttcggaatctgaaattctgaaaaagctgagaagggagacttatcagaagacgacacagcctcatatgatttcaggatatcagcagggaagattgttgacgattatttcccaaatgttgaaaccgaaaaatattcttgaaataggaacttttacaggatatgctactttgtgtcttgcatcaggattggcaaaagacggaaaaattacaacattggatgtgaatgaggatcttgcctatcttccaaaaaaatattttgaatccagcgaatatgccagccagattgattttaaacttcaggatgccaaggaatatttaaaagaaacaaatgaattttttgatttgattttcgtagatgctgataaagaaaactatgccgaatatttcagattgataaaaccacatacaaagtccggaactgtaattctgtttgataatgttctgtggtacggaaaagtattggaagaaaatccgaagttgaagtctacccagtctattcaggagttaaatgatttagcggcaaaagacgaagattttgaaaatcttattttacctttgcgtgatggagtcaactttcttcgcagaaagtaactgaaatattcaaggattaaacatttaaagagatacagcattgtattttaatctttaaattattcaatctttaaattgagaattaatgaataaaggaatttgtattgttacagtagcgccggtccgtgcagagaattctgacagggctgaaattgttacggaaatattgttcggggaaagtgccgatattttggaagtagataaaaactggaccaaaataaagatgcactatgacggctatgaaggatggatggataccaaacagctaaaaccggtaacagatgaggagctcgctaatagaaaagtgactgtcgttactgaagatttttcttctgtactgatgaatgacgggaagactttactgtcgatgggttcggaagtggaatttccagtagtagcttcaagaagaagccatgatgtacgtgaaagtattgcgctgacggcaaaagaattccttaatgtaccctatctgtggggaggcaaaagcttttttgcagtagactgctccggctttacccaattggtctataaaattcacaatattaaaattccaagagatgcttcacagcaggctgaagtgggagaaccgcttacctttgtagaagaaacacagcccggagatcttgctttctttgaaaatgctgaagggaaaattatccatgtaggaattatgctggataatcagaaaattattcatgcttccggaaaagtaagaattgacactttggattccaccgggattttcaataaagaaatgaataaacatactcacaagcttagagtgctgaaaagtataatctagcctaggttaaatctcatttgaaatggaaaatattctttttataatttttgatatttttaattttggatgggtagcttttttatggtggtttaccttgaaaaattatagtgctttgccagatcgtattcctgtgcattttgatctggaaggaaaaccagatggctttggagggaaaatctatgcctttctgatgccagtactggcgctggggctttatgcagtgttcacctatggaaccagacatcctgaagatactaatttcccggtagagattacagatcagaatatgaatgcccagtttttaattatgaaaatcggattgagaaccctctttcttatattgggcatggtttttttgaatattcaggactatatgttcagatatgctgctgatgataaggctaaacctagaatctcaatcgccaccatctttttatcagttgtattgtttgttcctttattacttttcattactcacttgtttaaatgatacattctaaagaaaattcagaacactatatctggggaaaccaatgtgacagctgggtccttaaaaacacgcgaaacttatctgtgaagcaggaaaagatgcctgccggaacttcagaaaaactgcactaccatgagatagcggaacagtttttctacatcctcaaaggagaagcagtattctttatcaatgaagaaaagttttgggttaaacaaaatgaatctatttctattgcaccgggaacaaggcattttatctccaatgaatctgaaacggaaattgagtttttagtcatatcaaatcctcctacggatcatgatagaattgaaattaaagaataattaaaatggcttttctatacaatctatttatcagtctgctgacttttggaatgaaggttttcgccttgtttaatgataaaactaaaaaaggcgttgaagggaggagcgagtctttgaccaaagtaaaatcttcattttcacagacagataaggtaatctggatgcatgctgccagtttaggagaatatgagcagggattgccggttctggaaaagcttaaggaaagttttcccggccataaagtcctggtgactttcttttccccgtcaggatatgagaatgtggtgaaaaagaaacatatggcagatgtaatctgttacttacctttcgataaaaaacatactgttaaagagtttatatcacaatttaatactgaactattttttacggttaaatatgactactggtataacctgcttgctgaacttaagaatcaggggacgaaagtttatgtaatttctgcactgttctatgaaaggcaatctttttttacctcatatggcaagtggtttgtaaagcagcttcagaacaatgtagattggtttttccatcagactcagttttcattggcccttgcgaaaagtgtagggttgataaagtcttccgtaactggagatacaaggtttgacagggtaaaacaacttcgtgaacgtaacaatcatgtagactttattactgattttaaaggagaaagtaaagccattgttttcggaagttcctggcaggctgaagagaaaatagcagaagcggtctcccgtaaaaataatacggtgaagctcatcatagcacctcatgatctgaaaagagtagagcatcttaaaaatatattcccagatgccttattgtacagtgaaatacataattttcagtcttcaattcccaattcccagattctgattatagacagtataggcttgttatcaaaactatattcatatgccgaggtggctgttgtgggaggaggatttcacgatgcaggccttcataatatcctggaggcggcaacttttggcgttcctgtggtctttggaaatcattacaaaaagaatcccgaagctgatgatctgatcactgctggtggcggaaaatcttttccagacgaatatacggctgcagaatttgttttatttcttaccaataaggataataaagaagaacttgcggagatgtcccggaatgcaggaaagtttatagataataagcctgattctaccagaatgattcttcagaaaatcttatcttaaaaatccctggcttttaatttctttcatgatctgatcaatattcccgggaattttatcacattcaaaccaattaagatcaagcccattattaatacacagcttttgcaggtagtgattttctaagattttatctgaagtttcacgaagatattcatcaatttccagccagtaatcttcatccagttttttaattaaaagcaaagacttaaatactttgttgatcatataaatataaagtttataaacattatcaaacctctgtctgctgagatcactgttgttttccaatactttgttgatcagaagaagattcagtgaaacttccccgaacttgtcagtggtgattttgacgtgttcagtaatttcagcgcttatttttcggatgatggtcagaaaatatttggcgtttccgatatattttgcagccagatggacctgctcttccacatgttcttccatggcatttcttttatcatccgtagtttccgggtcaatcagttcgaaatatagctttttggataacaatttgtccttcctcaggagtctgaaaatgagtttgtctttctcggcacctgaaaaagcactcagagcggctttgaactcttttgaatactccattaattaaaaattttagaatatttgaggaatccgtttagcgcccagttagccgtataatataatgactttaatgttgaaaatcccatgaaatctttatagacaaggtattgatctttgatgatgttttttttatttctggaaacactgttttcccgcattctgtactttgccagcgttttttttactggcatcccttccggaatgacctttaaaagattaagccacatcacatggtcctcgcgtttgctttttacagggaacagaaatttaccaactctttgggtatcatacatggtagagaccggagcaagacggcatgtcttcaatagattagagaaagtaactgttttgtcagccagaaagtctttcagtataggctgcagctgctcattacatctggaataattacagtagacaagttctacatggtgttcctgcatataaccggtcatggtttcaagatattcgggataccagtaatcatcagaatccagaaaggcgatatatcttccctgggctctttccaggctgttgttccttgcatttcctgcgcctccgtttttctccagtacctgcagctttattctgggatcattatatttcctgatgatctcaacagtattatctttagaaaggtcatcagtgatcagccattcccagttttcataggtttggttaagaacagactgtatggtttcctcgataaattctgcagaattataacagggagtaataatggagacaagatctttcatttatgctttttgaattgtaaaattataaaaatcttttttcataaagatgccaggaagcaattcctaccccgattactaccaacatgcataccaatcccatgaaataaggattgtagctggcgaaaagccccaatgttgcaaataccctgataatagggaagtggaatatataaatgccgtaagtgaaatctccgtactttccaaaattgttcaggaacttaaatgaataagcaatgtacagaacaataatactgatcatcattggagaaaatagttttattttaaaaataagatctatccagacagtaattatcgcaatgatgaataaagcatttttatgtttgataaacttatcaaagttaaagtagatcagcattccgccaatgaaataacataatgatcccggtaattgtctggaaagggcagcttttccggccatttcaaaatagttgagataaatcagtgaaagaaaatacaatacaatcagactggtattccggtatttattattttttccaaacaataaaaacatcagtggaacagcaatataaaagcacatttctattttaagggtccacaatgctccgtttactgcctggtttccgaatacaccgggaagccatggcgctttaaaattcatgaaaattgaattccagaataggtatttatacacctgtgtattgccaaaatactcagaaaaaggtaaagtgctgaccaggcttaataatgttgcacatagaaatacaaccaataaataggcaggaacaattctgttgaatcgctttttggcgtagctttttaagcttgatgacctttcataacttctcgcaataagaaatccactaacgataaaaaatgagaaaacagccacttccacagggctgtgcgttaaaattgtaagctggtcagcgccgcttaatgcccccaaatgtcccacaaagacaatgaaagcaaggagaacacgtataaaatcaaaattgtttctcgttatatcctgcatttgtattttgtttcatgcaaaaataacttttttaatacaatgaatgatgctcatgtattcattatttgttaaataaagggaaaagtacatcagagtgttttaaaatatatataaataaagcccgatgaaataatttttcataaaaaatagtaatataaatcaaaaaaattataattttagcgcttgaaaaaattgatctatgaagaaattagcattactatttgcaggtttgtctttgtttgcagctacaggatgtagtgataataacgatactgttctggaagctcctctggttgggacctggcaaccgttaaaagaagtagttactactgtggagaccggcgaggatccggtgtctaacacaattacttatactgactgtcagaaacagaccagatggtggttcagcgctgactccaagggagggaaaacaaactggggagatactgctacacctggtcagtgtgctattctttcagaaataaaattcaactatacctataataaagaaggaaaagatgttcagatgaaaattcagggagtcgtagagccgcagaatgcaaagattattactttgaatgaaacaacgcttaatcttgcagtaagagaggagactcaggatcctaagatattccagacaagaacatataccttcaagagagttcctcaataatagtatatacttcaggatataaaacagatctcatctccggatgggatttttttgttgaagccggaattgcaattcatcataaattaaatttctatttcctttaaaatcattatttttgtgattcttgtaaaaagggaaaaataattcaatacttaaagtctaacatataacatctatataaagtgttttacgatcatcagcagatagaaaaaaagtggcagaaatactgggaggataatcaaacctataaaacctctaataacacagataaacctaagttttatgtactcgatatgtttccgtacccatcaggagcaggacttcacgtaggtcacccgctgggatatattgcatcggatatctatgcgagatataaaagacatcaggggtttaatgttcttcacccggtaggatatgacagctttggtcttcctgctgaacagtatgctattcagactgggcagcatccggcaattactacagaacagaatatcaacagatatgaggagcagttaagaaaaataggtttttcatttgactggagcagagaagtaagaacttcagatgcatcttattataaatggacacaatggatttttatccagctgtaccactcctggtataataaaaatacagacaaggcagaagctattgattctttgattcagcattttgaagaaaaaggaacggaaggcttaaatgcaaatcagaacgatgaattaaatttcacagcagaagaatggaggaatgcttccgatcttgataaagaagatatcttattaaactatcgtcttgcttacagggcagagactactgtaaactggtgcccggcgttaggaacagtactggccaatgatgaggtgaaagatggaaaatccgaaagaggaggattcccggttttccaaaagaaaatgatgcagtggagtatgagaatctccgcatactctgaaagactgttacagggattaaatactttagactggccacagccgttgaaagattcccaggaatattggattggaaaatctcagggagcgcaggttcagtttcaggtagaaggtcatgacgagattgttgaggtatttacaacaagacctgataccatctttggagcgacgtttatggtactggctccggaaaaccctttagtggaaacgattacgactgacgctcaaaaagcagaagtagacacttatattgaagaaacttctaaaaagaccgaaagagacagaatgtctgacgtgaaaaacgtgagcggagctttcaccggaagttatgcgatcaatccgttcagcaatgaaaaaatgccgatctatatttcagactatgtactgatgggatatgggacaggtgcggtaatggccgttcctgcacatgatgagcgtgatcacagatttgccaggaagtttaatcttgaaattaaaaaagttgtagagactgaagaagacgttcaggagaaatcttttgattctaaagattccgtttgtgtaaactctgatttcttaaacggattacattataatgaagcgaaagcaaaaataatttccgagatcgaaaccaaaggaatcggccacggaactaccaactacagacaacgtgatgctattttctcaagacagcgctattggggagaacctgttcctatatattataaggatggaatgccatacacgttgccaacttccgctttacctctggaacttcctgaagttgaaaaatacttacctacagaagatggagatccaccactaggaaacgcaaaagaatttgcatgggatgaggttaatcagaaagtagttgctacagacttaattgatgataaaactattttcccgttagaattatctactatgccgggatgggcaggaagctcatggtacttccttagatatatggatcctaatgatcaggaagcttttgttaaaaaagaactggcagactattggggacaggtagacctatatataggaggaagcgagcatgcaaccggccacttattatattcccgtttctggaacatgttcttaaaagacagaggatatatcagccatgatgagccattccagaaattgatcaaccaggggatgatcttagggatgagtgcatttgtgtacagaattgatggtacaaatcaatatgtatccaaaaatctggctaaagattataaaactcaacagattcacgtagatgtatccttattaaaagggacctctgatgaattggatacagaagctttcaaggcatggagaccggattatgctgatgcagaatttattctggaagatggaaaatacatcaccgaccgtgaagtagaaaaaatgtccaagtctaaatataatgtagtaaaccctgatgacatctgtgaagaatatggtgcggatggtttaagattatatgaaatgttcttaggaccattggagcaatccaaaccttggaatacacaagggcttagcggagtatatggcttccttaaaaaattctggaatctttattttaacggagatgtatttgaagtttcagacgaagaacctacaaaagctgaatataaagttttacataccttaataaagaaggtcgtatatgatattgaaaacttctctttcaatacatccgtatcatcatttatgattgctgtaaacgaacttcagaaaataaaatgtaacaaacgcaatattttagaaccgttagccgttatcatttctccttatgctcctcatatctgtgaagaattgtggaatttattaggacatgatacttcgatagaatttgaaaaattcccggtattgaatgaggattatcttgttgaagacgaaattgagtatccggtaagcgtaaatggcaaaatgaagttcaaaatttcactttcagctcaattatctgccaaggaagtggaagatttggtgatttcgaacgagaaaatgcaacagattttggagggtaaaacccctaaaaaaatcattgtagtccctcaccgtattgtgaatatcgtaatttaaaaaaaaattaacattgggaaattaaaaaaaatgagagtctaatttttttgattttttaattcaaacgttaaatttggaaaaaataagtaaaataatttaaaataattattatttcgaaatcgtattaaaatttctttatcaaaaaaaagcaaaatgtttaattaagactcttgcattttaattaattttgcctttaatttacaccctgtaaaattttaaaacaatataatttagttaaatatggaaatgaatgtttcaaaaaatgatgagcaagtagttgctagaaaggcaggaggtttaaatccagctgttattattcctattctatttgctataggagtatgtatttatttattcgttcttggtagcccaggaaactttaaagatgcagacaaactaggaagtggatctgtagctttttcaagtgttgaaggaaaagacattcacccagaatcgtttttaggtattatctacaaaggaggggttatcgtaccaatcttgattactttcatgattactgtaatcgttttctcttttgaaagatatttcgttcttggtaaagcagctggaaaaggaaacttagacaacttcgttgttcaggtaagaagcttactaaaccaaaacaaaatcgacgaagctatcgaagagtgtgacagacaacaaggttctgttggtaacgtagtaaaagaaggtcttactacttataaagcacttgctcacgatactacattaaataaggagcagaaaatggtagcacttaacaaagctatcgaagaagctactactcttgagatgccaatgcttgagaaaaacatgatgatcctttctactctaggtacggttgcaacgttagtagcactactaggaacggtaatcgggatgatcaaggcgttcttcgcattaggttcaggaggtggtactccggatgctgctgctctatctacaggtatctctgaagccttgatcaacacggcattaggtattggtacttcagcaatcgctattatcctttacaacttctttacatctaaaattgacggattaacttacaagatcgatgagatctctatgagtatccaacaatctttcgctgaattcaactaagaattagcaagatatttgcattagcaattaaaagaagtttaattaaaaatattttataataatggcgagagtcaaaccaaaaagacatggagtaattacggacatgactgcaatgtgtgacgttgcgttcctactccttacgttctttatcttgaccactcagtttaaaaaacctgacgtggagcagatcaaaccgccatcttcaatttcggaaaaattgcttcctgatgctagtttaatgactatcaatgctactccggacgggaaattctatttccagccagtagaaaatgcatcagaaagagttgctcttttggataaaatgggacaaaagtatggaattacttttaacaacaatcaaaaggctgctttccagaaagttcaggcaatcggtgttccaatgaaccagcttaaaggctacttggatatgtctgaagatgagcagaaaaattataagagtcctacaggaattcctatggacagtacaaataagcaattaattgattgggtaaaagaaagtttgagcgttaatcctgactacaagttagcaattaaaggtgacgttactactcaataccctaaagtgaaaagcctatttgaaggtttaagagatattgattttcttaaattttggttgattacatcacaagaaggtaaacctaacgaataatatcgatagaaatggcagaagtacaagtacaagaaaaaggcggcaagggcggcaaggtccgttccaagaagcagagtaccagagtcgatatgactccgatggtggacttgggttttctattgattaccttctttatgttcacaactacgttcagtaaaccgaatgttatggatttgggtcttccggcgaaaccgaaaaaagatcagccgaaaccacctccaacagaaattaaactttcgaactctatctctatattattaggtaagaacaacagagtattttggcaccagcaggatgctacatccctgaatgaccagactcttatggaaactacccttgacagagaaggaatcagaaaagtaattcagcaggcaaaatctagagctgcagatccggctaaatttaccgtgatcattaagccgactgacgatgctgtatataagaactttgttgatattcttgacgaaatggcaattaccaagagtgagcagtacggtgttactgatattaagccttgggagaaagctgtgtacgagaaaaaagtaggaggtgctgctgcaccggctgctgctacaaagtaatttaaccataaaattgttatatctaatctatggcagatgaaaatgtatacggtcagaatcttactttagacgagatcgtatttgaaaatagaaacaaggaatatggtgcctatgatcttagacatcagtatccgagacttttaacaaagtcttttatcatcggaacagctttattccttttggcagctttgtctccgttcatctatcttacgattaaaaatcttacagctccgcctaaacaggaagtaaaggcagatcttgtagatattatcgaagaagatccgattatcgagcagcctaaagaagaagaaccacctccaccacctccaccaccaaaagaggaggagaaaattgaggttattcagaacgtggttcctgagcctgtaaaagctccgaaaattgaaactccaccaccaccgatctctaaacagttggaaactacaaccggtttacagaatcaggagggggtaaaagctccggcttatacaccaccaccgccaccaccatctacaggtactaaagcaagtacagtagaagtaaaagcgaacaaccctaacgagatctataaagatgttgaccagtctgcagaatatcctggaggtatgggagcattaagaaagttcctgggtgataactttgatacttctttgatggaaggaggtgaaggaacacttaaagctaagcttaagttcgttgtagaaaaagacggaactgtatcaaacgttactattgaagaaaaatctccaaatggcgactttaacagtgaagctgtacgtgtagttaagaaacttaaaaaatggactcctgcaaagagaaacggggagagcgttagatcttactatagtgtaccatttactatgaactttgaataagacttatttattcaaaatataaataaaaagagaggcatatgcttctctttttattttttttggtatttttgttacatgatgttcaattggttatccctggttacgggattgttttatatcgttttaggaattgtagtgattgtctacaaattcttctttactattttagaacctgctgttgcctacgcattaggagtagtactggttatttatggtattttcagaatttacagggcgatctcaagaattaaacaatcgagaaatgaagaatagtttcaagcttgcagtaatttttgctttgagcataatgctggcaggctgcaaaaaggagaagaattctccttcctatcacaaaggtgacctcacaatttttactgacgaatcctttcaaagcgttacagaagcattagctgaaggctatatgatcaactaccctgaaacccacatcaaagtagaaaccaagaaggaagatttaggacttcttgatcttttaaaaggaagtgctaaagtggtggtaatgtccagaaatcttactcccgaagaaataaaaacatacgaggaaagaacagatttaaagtttcttcctgccagattcgctgcagatgcagtcgtttttgttgtgcctaaagattctccgaaagaaagtatttctatggatgaaatcaataacgggctgacgtctgataaaaaagaatttatcttcgacggaaccaattcaagtaatctgaattttgttgctgaaaaatttaaaaaacagccaaaagatttgaaattttccattattcccggaaatcaaaagattattgaggagttagggaaatatccggataaaataggcgttattggccttaatacttttagccgtccttatgataaaacttcggaaagattaagagagatggtaaaggttcttcctgtggtagataaaggaaaatcatataacgcagattttgatgggctccgtactatggaatatccgtttacaagagtgctttactttctgattaacgaaggtaattttaatatcgccaatggatttataagattttcatgtacccatttggggcagaaaattgtacagaaggaaggtttgcagccctataatctgtataagagagaggtgcagatgcgttaaaaaaaattaaattcacaatttattcccattaaaaataaagatttggtctgaaaattgtgtagaatataactcaattatttagaaaatataaaatgaaagatataatgaatatgaatgtaaagaagattgcttttggagcagccgtggtattttttaccggttttgcctctgcacagacattgcaggatggtatcaacagtatagacagtgataaatttgcacaggcaaaaacaaacttcactgaaatgatcgctaaagagcctacagctgaaaactacttctatttaggaaatactttcttaagacaaggagagccggattatgctaaagcaactgagaacttcaacaagggattagctgctgacggtaaaagctatcttaacaaaatcggtttagctgctgttaaattaggtaaaggggataaaaatgccgttgctgaaattcagaaagtagttactgattcaaaagaaaaagatgctgaagtattattcagagcagcagaagctttaactttatttgaaaagaacagttctcctgatcttgctattcagtaccttaataaggctattgaaaaagctgagaaaaaaggagttcctgcacattattattatacattaggagacgcttacagattgaaaagatctccgggggaagcaatgtcggcttacgacaaggcgttacctgtagctaaaaataaagcttccgtttacacgagaatggctacattatggatggctgcacaggtatggcaaaaagctaaagaaagcgttgataaagcaattgcagtagaccctacttatgctccggcttacaaagcattagctggttatgatatcagataccaacaaaatgcaaaagccacacaagaccttatcaactatacaaaatatgctgatgaagatccatatactcaattagaaattgctaaattatacttcaccaatgaagattatgcaaactctaaaatggtattggacaagatttttgataaaattgacgatcctattaagttcaaattaagagcttacaacgcatatgcagacagaaactatgcagatgcaaagcaaaatatggatactttcgtttctcaggctgagaaaacaagaatattgcctgctgaccaaggtttacagggacttattgctgctggtttagcaaaagacgaaaaagatgctgctaaaaaatctgctttaatggctgaagctcagcaaaaggtgggtattgcaaaagctgctaaagatgaaacaatgaagtgggatcttgaattggctaacatcgcaggtggtggaggtgcttctcaggcagaagctgacaaaggacctactaaccctaccattgaagcgttgaaaaagcaagttgctgcaaacagccaggattctgatgctttatttaagctggcaaccgcttaccaggatgctaaaaactggaacggggctatccttacatggcagaaaatgtcagctcttcttccagactgggcaccggcatactatagccagggatattcttaccaacaggcaggaaataatgaggctgcaaaattggcttatgaaaaattcatcagcacagtaaagccggctgatcaggaagcaaacaagcagactctagcttatgcttacttcgcggtagcatatatgagcaaagattctgatcctgcaaaagcaaaagattatgtagcgaagtctttacagctagatcctacataccaggatgctgtaaaattaaatgcagaaatcaacaagtaatttaaaatttaaattatagatattaaaacttcccattcgtaatgtttgggaagtttttattttaaatcctatctttgaatctatgaaaactgatatacttgcttttggtgcacatcctgatgatgtggaactgggatgtggaggaactattgctaaaatggtttctgaaggaaaaaaatgtgtggttgtagatcttacaagaggtgagctcggaacaagaggaacagatgaaaccagaaaaacggaagcggctgatgctgccaaaatcttgggtctttcctcaagagagaacctggggatgaaagatggatttttggtaaattcagaagaatatcagatgaggatcgtaaaaatgatccgcaaatacaggccagaaatcgtcttagcgaatgcaattgatgatagacatccggatcatgcaaaaggagcgaaattagtgtcggatgcgtgctttttgtccggactgagaaaaattgaaacggtattggaaggggagagccaagaagtatggagaccgaagcatgtttttcattatatccaatggaaaaatattcaaccggaatttgtgattgacatttctgaatttcttgacaaaaagattgatgcatgtatggcctataaaacccagttttatgatccaacttctaaagaacctgaaactccaattaccacaaaagacttttatgagagcttaacttaccgtgcacaggatttaggtcggttatcgggagttacttacgctgaggggtttacgtctgagaagttaatttctttgaaaaattttgacggaattgtttggtagttgaggaaattgtcctatatttgcactcagaaaacggtgattgtagctcagttggttagagcgtcggattgtggttccgaaggtcgtgggttcgagacccatcattcacccaaagaaagtacactttttgaaagtgtacttttttatttcctatccattttcaatcatttgcaactcagttttcatctactttttattgaatacttttttcagtttgtacttataaatcttgtgtaaatatgcaaaaatggtttttactaaaatctttaagtactcttgaagcagttgaaattatattcatattttaaataggaatgatgacttcagagcataaaaaaagcatctttttcagatgcttgtgtttttagatattcttttttaaacttcgtcgtcagaatctattgtataagatctgcttttgaagtccttgtcatgtttttctgaaattacatcctcacccttttcattaatgatgaaatctgtggactcattaaacatctcctggaaacttttaaaatcttccttgtaaaggtaaattttatgcttctcgaatgtagcttccccattctctccgaaattcttcttactctcagtgattgtaagataataatctcctgctttcgtctcgcgcacatcaaagaaataagttcttcttcctgcttttaacaccttcgtgaaaatctcattttcatggcgttccttgtattcactcattgttagatattttttaatcttgttaagaacaaatataaaagaattcttttaatcacaaaattttttttatgatttatttaacaattgagaacgaaatggctatgcggttacagaattggcaatttcagtcaggttgataatctggtgggctttttgagcgctagactctctgtgtgtgataattatggaagtggcgttactgatttttttatcaatattttccagaatattgtgttcggtttcggtatctaaagcggatagagaatcgtcaaaaataatgatattagggtctttaattaacgctctggcgatacaaattctctgcttttgaccccctgaaagcatgacgccacgttcacctacaagtgttttatattggtctttgaactcaacaatatttttgtgaacatctgcaattttggcatactctactactttttcgtgagaaggatgatcgatggcaaatccaatattattttcgatagtatctgagaataaatagctttcctgaggaatgtatccgataaagtttctgtagttatccagattatggtctttaagatttttaccatcaatcaaaatttcaccctcagttggatctatcagccggcataaaagcagggcaattgttgattttccgcttccggttttacccataatagctaaagactctccggcttttactttgaagcttaaattatccagtgccttgattcccgtattaggatatacgtaagaaacatttctgaattctatatctcctttaatagggtagttttcaaaattagtattaatgatctcggatttcttatccataaattcattgattctttgcatagatgcttcagccctctggttcacggaagttacccatccaaccatagagaaggggaaaatcagggtgttgatatacatgaagaaatcagcaattttaccaatgcttaactctccggcaatatactttgtaccgcctatcaatatgatggcaacgttcaataatccaataacaaaaagaataatggtgaagaaataagcttctgtcttcgcaagatctaaagccttattctggtaatcagtaactttaactccgtagtttttttcaatgtatttttctctcgcgaaaaattttacgacacggattccggaaaaactatcctgaacaaaagtggaaattgcagactggcttttctgcatgatcttcgattttttgttaataatcgaacttactttataaattgcatatgataaaataggaagcggaagtaaagtccacatcgtcatggaagcatccgtttttaccatataaatagcagtgatcagcacaagaacaatcaggttggccacatacattactccgggcccgagatacattcttacagctactacatcttcactcagcctgttcatcaagtctccaatagtagtctgcttataatccgttaaagataaatcctgataatgtctgtatattttatttttaagctcatattctatccttctggaagcaacaataatggtctgtctcatcataaaggtgaagaatccggttagaagagagcatcctacaataattccaacataaattaaaacctgctggttaaagccaagattcccgcttttagtaagttcatctacagatttccctacaaactgaaccttatatatgttaaagaaattactggcaataataaatagtactccccaaaacaataatattctgtgtttccaaaaataaggatttaaggtttttagcgctttcatatagtttgacaaaattacaaaaatgtcatcacactacgaatttcatcaattttaaattttgtatctttgcacccataaaaaagctctttgaatgttaggaagacgacaaatccgtgaaaaagtagtacagacagtgtattcatactaccaaaatcctgtaaaatttgatgttttagagaaaaacatgtttgccgggatagagaaaatctattatctgtacatctaccagcttaattttttggtagctcttaaagaattggcagaacaccagatcgaaattggtaagaataagtttcttaaaactgatgctgatatcaatcctaaccaaaaattcatcaacaaccaggtattgcttaaactggaagaaaatcctgaaagattattttttaccggtcagcacaaacaactgaaatgggatatgcatgatgatttattggtaaaaactttccaaagaattactgcagggaaacgttatcaggatttcatgaaagaagaaggttactcttttgaagaagatcagaaatttatcggtaaattatttttaagatatattgctgagaatgaagattttcatgattatttaggagataaggaactttcatggtatgatgatatccacattgccaattcaatggtacagaaaacaattggtttcctgagagaggatgaagaaagcagaactttgatcaagatgattaaagatgaagatgataaaactttcgctgcaaaactgttgaaagacacattgaataactgggagaacaatgaaaagaaactggaagaaagacttgaaaactgggatctggaaagagtttctctaatggataaagtaattttgtctacagcaattgctgaacttgataactttgctttcacgccttcaagagtcatcattaatgaatatattgagattgcaaaagtatttgctacagaccgttccaatattttcatcaatggtattttagataaatattgtaaagatcaaaatagaatataaaatgaaaaagacgttatcaattatcgccttgtcaattataggctttgggttagtttcatgtaaaaaagaaaacaaagaaactcaaggtactgaaactgcagctactgactctgcaaccgttgcggctcctctaactgattctgcagcagcacctgcaactggtgaagcagcagctccggtttctaatcaaccttctacttctgttgctttatctgaaaacagtttcgatttcggaaaaatcaaaaaaggagataaagtagagcacgtatacgaaattaccaacacggggaaaaatccattgatcatttctgaagtgaagccaggatgcggatgtacagctccggactttacgaaagaaccaattatgcctggtaagaaaggaaaagttacattgcattttgattcttcaagcttcgacggaaacgttcagaagtatgcagatgtttttgcaaacgtagaaaaagctccgatcagattaacgttcactgcgaacattcaaccataataattaaaatatgctgacattatttttacaggcacagcctcagggatcttcatcaatgatgctgatcatgatgggtgtaatgtttgtagggttttatttcctgatgataagacctcagatgagaaaacagaagcaggaaaagaactttcaggaaaaccttaaagtaggaacaagagtagtgcttacatcaggtcttcacggaagaattgctcaggttcaggatgatggttttgtaatcgaaactttatccggaaagctgaaattcgaaaaagctgcggtttcaagagaaatgacagaagcccgctttggagcaaaatctgctgataaggcagacgataaaaaagaaacagccactgaagaaaaaaaataattcagtctgaaaatatttggttgcggcgggtgaacaaagttcacccgccgcagcttttttatgcacaattataaaagcaaatttatcctgtgtttattagtggaaagatattgtttaaataaaaatttatctttgtgctatgaatcaaaatacaaacaaaacggtcctgattttgggagctaattcagatgttgccaaacaatgtataaagcaatatcttgaaaaaggattttcagtaattgctgcctccagaaatacggcttcactggaaaattttatcggctcaaataatctggatcaatcaaaaatttctgttttgtattttgatgctgcggattttgattctcatcaccaattttatgctgacctttctgtaaaacctcatattgtagtgtatgccgcaggctttttagtagacaatcaaaaagcgctaactgacttcaagggagctaaacaaatgatggaggttaattacatgggaggcgtatctgttctgagtattattgcaatggacgaaagcaataagaatctggaaagaattgtcgggctttcttcattgtccggagtaagaggaaggaaaagtaattttgtctatggaagtacaaaggctgcatttacacagtttttggctggattgagacaggagctgtcttcccgtaaaatcattgtgaatgctctggtcatcggctatatcagaacaaaaataaacgaaggactggatttgaatgaatctctgatcatggaaccagagtatgtagcgaaattcattgtcaatgcaggaaattcttttactattgttccaaactttaagtggaaaattatttaccatatcctgaggcttttaccggaaaatctggtggcaaaattaccttaggtaatatttatttaattgttattttctttaaggttaatacacttcggtaccgtttttgtaattctatgacccgaaaattatttcttcctgcaaaattcaatttctgaatgagtattgagtaaagctgaaacattccgttctgcttgcaatctgtttttaaggatcaatataatttactttcactccgggagtgtaagttgaatttctgtttaaattttgcaggagatgtcaatacctattgatataaatagtaaaacacatatataatacaaaaatggacgatttagaattgaacaagatccagcagcactgggatacattaatttcttcagcaatttcatgggccccgagaatttttactgcaatcatttctgcattattaatttacctgattggatcgtggatgataagaatgattaaaaagctggttgaaaaagctttcaaaaaacggaatatggaagcttctctgcagcattttcttttaaacattatcaactggggactgaatattctgttgttcatcgtagttgtaactcagctgggggtacaaacttctgcatttgtagccatgattggtgccgcaggtttggcagtaggtttagctttacagggatccttaacgaattttgcgggtggaattttgattttattattaaaaccttttaagattggtgactttatttctaccaattcaggagtttcaggaactgtagatgctatagatatctttcatacaaaactcattacaccacaaaaccaacttatcgttattcctaacggcgttgtttccaacaatagtattaccaattttactcaattggggacaagaagaacatcattggatatcggagttgcttatgatgcagatttaagacatacaaaagatcttttaatgaatgtcattaaaaataatcagtatgctctttcaacacctgctccacaggtagtggtaacagaacttggagaaagtgctgtcaatttatctgtaagggtaagctcctccactgaaaacttctggactatgaatgaggaactgatcattagttgtaaagaagctctcgacaaagcgggaatcggaattccttttccgcaaagagatgtacatatttacaatcaataattatatttaattttttaagaaactcctgcatatattatgtgggagtttttattttaatctatattctgcagcgcctccaaagccttcatcatatcaattcccttacctaaaaccggcttgaacaaatcacccttttctttaatcctatcaagagcgttgtcaatattaaaatccgtaggcttcacacctggttttaattcatcccaatccagaggcatagaaactgaagctccctgtttaggtcttaagctatatgcactcgccaaggtttgcccggttctgttctgcaggtaatcaagataaatttttttgttatctcttttctgaaggcttctctctaaagtggtcagttcaggaagtttttcattcacctgtttcatcagaatatgggcgaaatcttttacctggtcaaaatcatatttaccacccattggaatataaacgtgaatgccagtgctgcctgaggttttgcaatagccttttattttaatcgattttaaaacttcattcacctgaagcgctgtttcaatcacatcatcaaatgtattcttttttgacggatcaagatccagaacgaggtagtcaggatgttcaagatctggaagtgagctgttccacggattcatatcaatacaacctaaattattcagataagctaaggttgctttatcattacagtaaatatagtcgatatatttgtcattcgattcagaatatacctgcgtggtttttatccagtccggtatggtgtctcctgcatctttctgataaaagccctgttcttcaattccattgggaaaacggttcagagaaagaggacggttcttcagataaggtaaaatataagtcgccacagactggtaatagtcaataacatctccctttgtaatgccatctttaggaaaatagatcttatcctgattggtcagtttaactttatgtttatctagtgtgatctccttttctttttcagaattttctgtttttttagatgatgtttttgtcttcatttctttaggtttttcggtgaagggtgattccttgatatcttctggtcctttgtcctctctgacggttataaaaacaggatgtctgaatattccgtcccgggtaatttcagaatatttgatttcgcataccagttccggctttatccacgttacaggcatattcgttttaggaattttttcgaaaggggaggattttacaattaatttctcaagtctttgataaagttcctttaaagacgttttgttaaatcctgtacctgtatggccgcaataggtaagtttttgattaatatatctccccagtatcaatgccccgaaactttcacgtgatcctctcggttctgtaaaaccacaaataattacttcttcagtatttgaaaattttattttaagccagtcactggttctgtggttttcaatatataaactgtccgcccgctttgcaatcataccttccagctgcatttttttcatttgcttaaaaaattcaatgcctttttcaggaatatgatcacaatatttaatggtatcagtttcaattaaagcttcttttaaaagttctttgcgctgaatgagcggaagttcttcagtagaatggccattcagccaaagaaggtcaaaaacctggtaaacaagtggagtgcctggattatccccgatttgctgtagaagctggaaattgggctttccctgttcgtcataggcgacaacttcgccatccagaatcatctgatatttttgcttatcgaaatcctgaacaattttgtcaaattttgataaaaatgaaatcccgttccgggaatagaagagtgggctttcatggctgaggtccgcaatggctctgtagccgtcccattttatttcaaatatccagtctttatcgttgaaagcatcttcggaaagtttggccagcattggcctgatgaaagatttaagctttttttcgtttgttaaagaattgaaacttctgaatggtttttcagaagttacgacctctttttttcttttatttttaggctttttttttcctctaaaaattttgtgaccaaagattttggtgatgtgttttcttcagcatcatacggactttctgcaaattcgtctttatgcttaatgagcagccatgagttgtcatccgtatttttcatttttaccaaagcaaattctccttttagttttttgccgtgcaaaataaactttaaagaaccagcatgaagttctttcagaagttctttttcatcagaaagcttagaattctcttccaaaggttcgtaagttccgctgtcccatacttccacttgtccggctccataatttccttctgggatattaccctcaaaatctttataatcgtaaggatgatcttctaccatcatggcaagacgtttgtcttttgggtctaaagacggacctttcggaacagcccagcttttcagtacaccttccatttcaagccggaagtcataatgaagcctggaagctgcatgtctctgtataacaaatatcagcttgtctttgcttttctttgtttttccctttggttcgctggtttcattgaactttcttttgttatgataatctttgagagccattacgatgcggatttggatttagaggtattcaagctggcttttaattgagccataaggtcaatcactttaccttcttttgcaggctgagctttgttggcttttacgtttttgccttttgctttctgtttgatgatcttcatcaattcatcagaataggtgtctttatacatagcgggatcaaattcctgtgaaagctgctcaatcagacttactgccattttaagctctgcaggtttgggagccttttgggcagggatttttaaatcttcataatcccttatttcctgagcaaatcttaaacggttcaggactaaaatttcatcattgtaaggacgtatcattccaatagctgcgctgtcacggagtacaaatgtccctacgcctaccatgccggttttttcaagtgccttcaataaaagcctgtaagcactttctccatttttctgaggttccagataataaggtgtttcaaaataaacactatctacttcctcttctttaacgaattggtcaatagaaagtatttttgtcttttcagggcttgctgcttcgtaatcttcttcatcaagaacgatgtatttgtcgtccatgagataacctttgacgatgttttcccattttacttcttttcccgtattttcattcactcttttgaaccggatattggaaaaatcagacttatcgagcatgtcgagatccagttttgtggtttccgttgccgagtaaattttaacaggaatgtttactaaaccgaagccaatggcgccgttccaaattgctttcattgtcttacgtttttaaaaatcaagcaattaatatgccgccaaaaggtcatgtggtaccttttgtaaactttgttaccaaatgacaattgttttttgcggtgacttttatacctttatatttccgcaattcgtggctgataatacatatggaagagctttttacttatatcagaaaattcgtaacactgaatcctcaggatgagcttttgattgctgagggaattcgggaaatcactgtaaagaaaggggatctttttgtagaagccgggaaagtaagccaaagaattgcttttgtaaagaaaggtgttttcagatctttatattataacagacagggagatgattttaccagatatttcatttatgaaggacggtttatcggggattttcagggttttactgatcagttgcctgcccatgaagatattgaggctattactgatgcagttctgttggtgattgattttaagcactttaaaattctggaagataaaatttccgtgtggcctgttttgtttgcaagaattcatggttttgttgccgagaacaaactcaaagtggcgagcatcatgttgaatcaggatgcaaaatcacggtatattcactttttaaatcattatcccggccttgccaatagagttccgcagtctatgctggcatcctatcttggggttacaccttcttcgttgagcaggatcaggagaaatatcttataaggtttgagagtaggagagtatagtgtttatgagtttaccaacttctgacatctcataatcgctttttgtcaaatgacaatggtctttctgtctgactgccatagctttgcctcataaaatttaaagtacaaatatggatattgtattaggactacaatggggagatgaaggtaaaggcaagtttattgatcttatcagtgagaattatgatattacagctcgttttaacggcggatctaatgctgggcacagcatagaaagaaacggccgcagaataacgcttaaaatgattccttcgggaatctttatgaatagtgtgcagaatgtaatcggtaccggaactgttattgatccggtaagttttaaaaaagaaattctgaatcttcaggtatttgataatactattcagccggaaaataatatcattatttctcaaaaagcacacctcgtaatgccaacgcataaacttcttgatatttttatggaggaaagctctgagtacaccacaatcggaactacaaaaaatgggattgctcaggcatattcaaacaaaatactaagacagaacctgcgagtaggagatatattttcatcagattttcaaagcagggcgcagcatattctgaatagagattatagaatgctggaagaaggaggaatgattgttctgcctgctttagaagaaatcagtaaagagttttttgaagcggtggaattccttaaaaaattcaattgtacagacacagagatttatcttaacaaagctttatctgaaggtaaaaaggttttagcagaaggatctcaggcagcgatgctggatattgatcacggtacttacccgtatgtaacgtcttcttcaacgaccgcatcaggcgcgagtagtggcttaggtgtatcaccgaaaaagatcggtgaaatttatggaatagcaaaagcatattgtacccgtgtggggaatggtgcattcccaactgaacttttagatgaatttggagatgatctcagaatgaaggggaatgaatttggttccaatacaggtcgtccaagaagagtaggctggctggatcttcctgctttaaaatatgcggtgatgatcaatggggttactcaattggttctgacaaaagccgatgttttaagcggattgaaatctgtagcagtctgtactcattatgaacttgaagacggaaaaacagtaacggtttcgggactacttccggaaaatggaaaaccggtattcaaatggatgaatggctggaatgctgatttttccgcaatgaaaaatccttcagagctccccaaagaaatgaatgaatttttatcatttctggaagcagaattagagattccggttgcttatctttctaccgggccgggaagggagcaaatgttgaaattggccataaaataattttagacagtttgtatatactgatctgataaacagaagaggttagaaaatttattttctaacctctttatttgtgtaaaaaagcttagttaacttttgtaagagtaaagcgctgttttggagaaggctgaaccgtttgatccgtagtgccgattacaatcggggtaagattcgttgttaaaccatcttttacctccaatcttaatgccggcgcattcttgggagcgaatccaaaaccattgttcccaaggttaaataataaccatttctggaaatctgtattagcattggttcttaattcaacagctgttccacttgttgttccgttaccttttacagtcagtacttttgaaggatccagtatggatttgatgatgtaatacccatgatctgatttactgaaagtaaatctctggttatttcctgtagatgctgaataaagaattacgctggtgccgtctgtagtagaacttccggaaatatctacatttttatcattcgctaaagctgttgttatagtataagttccgttgattgtagagcttgcattgactggtccgtacaaatgatttattcctgcataatcacctgcagataaccctgttctttgcttggtaaatgtagatccgtcaagtttagtcattacaggctggcttggatctatagcaaaatctgtagactgatacatcatgactgaaccgaaatcaaacgcaccatatcctgcgtaatcattgtaaaggttgaagttatggcggcttccttctacggctttgttaacatctacaataatgtactggtctctgtccggacgacactgttcatgcatgattcccatggaatgcattatttcgtgggcgataatggcgggatatgtaatattataaattttaataccgtttactctgtttttctgccatccaagcggagagctgttggaggttgtataagtaaaggtgatgtattcggtttggttcgtacgttgaacaaactgcatactggtttgagaagagatcatatcaaacgctttgttgatattggtaaggaacgtattgtaattctgggtactcatagttccctggctgggtaacgtataatagactgttgcattcggccatgtcttaataaatgagcttacaatagtgcttttttcagtcgtggatatttcagaattggcctgcatttttaacttgtcaaactgctcggcgctaatcgtaatatcatctgcataaaaatattcaccatttacttcattaacgtaggtatattttccgttaattaataatttgtgaatctttgtattgtccagttttgttgtttgatctattggatctgactgtgcattttcaatatccgacctgcatgaattcagtgccagaacaaggcatcctgataagagtaatagtttgcttttcatattatttaatattggttggtgatcaggtttaaatatgaacagctatattattattcacgcaaaagattattaaaattaatcatttctaagtttgattaaatcttcattataattcagctgtatgctgtaaatatattaataaaagattattattgtatataacataatataatgattgttttattgttttcttatgtgataaatgtaaatgtttcgttaattaatttgaaatattttattttttactattaaatttaaaattaagttatttcactaatatttgatttgcaaatgaaagttgtactttatactgctatagagttgattttgttgatgaattaataaatgtactgaaatttgtaaggctataaactccaaataatgctgtcttatgaacatgcatttttgtaaaagttgaattgaatattcctgtaattaagaatataaaaaaagcggggcaaataccccgctttacatttatgcttttaagttcaattgtaattccagttcgtctagctgtgcatcggcaatagaagcaggagcatcaatcattacatcccgtcctgaattgttcttagggaaagcaatgtaatctctgatcacttcatttccatcaagaatagctaccagacggtcaaacccgaatgctaaacctccgtgtggcggtgcaccatatttaaacgcattcattaggaatccaaactgagcttcagcttcttctctggtaaatcctaataaatcaaacattttagactgaagatctttatcaaaaattctgatagaacctccaccgatttcatttccgttcagaaccatatcataagcgttggctcttgcttttccaggatcagtttctaataaatgaatatcttccggcttcggagaagtgaaagggtggtgcattgcatgatatctttcagtttcttcgtcccattccaacagagggaagtcaacaacccaaagtggtgcaaactcattgccttttctcaatcctaaacggttaccaagttccattctcaaggctgaaagctgagctcttactttgttttcgtttccggaaagaatcaacattaagtctccttcttttgccccgaatttttcgatgattttcgctaaatcctcttcattgtagaatttgtttaccgatgaggtttttactccatcattctggaattttacccaaaccattcctgaagcaccaatctgcgggcgttttacccaatcaacaagctcatcaatctgctttcttgtatattctgcacatccttctacattgattccgacaaccaattcagcatcatcaaatatcttaaagtcttttccttttacaagctcattcagttctacgaactccattccgaaacggatatccggtttgtcgtttccgtattttctcatcgcatctgcgaaagtcattcttggaaaatccccgaattcctgacctgtaatatcttttaaaagagctttagtcattccttcgaatacgttcataacatcttcctgttctacaaaggccatttcacagtcgatctgtgtaaattccggctgtctgtccgctcttaaatcctcatcacggaaacattttacaatctggaaatatttatccattccacctaccatcaaaagctgtttgaaagtctgtggagactgtggcaatgcataaaactgtcccggattcattctgctcggcacaacgaaatctcttgctccttccggagtagatttgatcagaacaggtgtttccacttcaatgaaaccttcgtcagacaaataatttcttactttctgtgccattttgtgacggaaaatcagtttatcttttaccggatttcttctgatatccagataacggtatttcattcttaattcctcaccgccgtcagtttcatcctcaatggtaaaaggtggcagctgagaatcattcagaattgtaagtttttccacaaggatttcaatttctcctgtcggaatattaggatttttgcttactctttcaataactcttccggtagcctgaatcacaaattcacggcccagttttttagcctcttccatcagttgtgctgaagaacgctcctggtcaaaaaccagctgggtaattccgtaacgatctcgaagatctacccaaatcataaatcctttatcacggatagtctgtacccatcctgatagtgtaacttcttcattcagatttttcagagatagctctccgttggtgtgtgatcgaaacataattatttgtttaaagttcaatgtttaaggtccaattccggatcttgaatttttcgttggcaaagataagatttttgcaggttttataaataaaaaaaacttcctttcggaagtttcatatattgtttttagattttttaatctctattgccgccttttgcgatgagaattttctttatttcttcactgccttttgtttcatcagctacttcaagaggtgttttattctgacattttttgttaacattggctttattgtccaaaaggaaattcagaatattctttctgtcagccatcacactgaaaccaagaggtgaataaagtatatctccaacaaggaaacatttgttgtaatctcccggtgcaaactgttttttaaatgttgctatatcatcagaataaatggctttcatcttttcctgagtcattctctgggcagatagcatgcttccggacagtaacattccaaatagaaagatagtagagattatttttttcataagaataatttttaagaatatacaaatctaaattaaattttattaccaattgctaagtttttctaataattggatttgtatttttgggattatctaaattaataattgtgaaatgacaaaatatgttgaatttttgaaaaaagcgtttagcggggaagagacagattttaccagagtaaatatcagaagtgccgtattgcttttagctattcccatgatgctggaaatggctatggagtccgtatttgcgcttgtagatctttattttgtcggccatttgaaagaaagtggttttgctatccagacagttggacttactgaatctgtactttcagtaatgtattctattgcgatagggatgagtatggcggcaacagctttagtggcaagacgaatcggggaaaaaaatccggaacaggcttccagaagtgctgcgcaggtattgcttgtttcctttgctattacgtttgttttaagtttactgggagtgatctatgcagaagaaattctgattctgatgggggctaaaccagaggctgcatattatggaaagaattttaccagaattatgatgggaagcagtacgattatcatgcttttgtttttaatcaatgggattttcaggggagctggaaatgcgatgattgcgatgaaaagtttatggatcgccaatattgccaatattattctttgtccggttctgataaaaggtctgggccctgtgcctgctttgggattgaccggagctgctctggcaactaccataggacgaagtattggggttatttaccaattataccatcttttggtggcagatactcagataagaattaaactttcttattttaaacccaattatgaatcaatccaatccatcataaaaattgcaacaccgggaatttttcagtttgtcattgcttcatgcagctggattttccttgcagaattggtagcaactacaggaggagagaatgcatcggcaggttatcagactgctttgagattaatgatgttcttcatgcttcctgcctggggattgagtaatgcagcctccactttggtagggcagaatatgggagccaatgaaatgatgagagctgaacagtcggtaatgaaaaccgtaaaatataatgtcatctttatgctggtagtaagcctgatatttatttttatgggaaattttttagtagggtttttcactcaggaaacagccattaaagactttgccaaaaatgcgcttcagattatgagtaccgggtttattttttatggaatcggaatggtgatgattaatgcttttaatggtgctggtgatacatggactccaacctgggtaaatctttttgggttctggctgtttcagattcctctggcctattttttatcgaaatattttgaactggggcctaaaggagtttttatttcaattcctgcagcagaaaccttaattaccattgtcgcttttattttatttaaaaaaggaaaatggaaaacgataaaagtttaaagcagggtgctggaagatgtaagaaggaagtcctggcagtctgaatatttaaatggccttttgttatcaaaatgaaaaaaagataagtgatctgcagattaagcgtcgaaacaggtaacctgattaacttccagcctcccacttccagcttcccttcttattttataaaattttaacagcttctttaattggattttatcgctgtattttttaaattcgtaggaacaacaaatacatcatactatgggaaaaggagacaaaaaatcaagaagaggaaagattaattccggaagttatggtaaaagaagacctaaaaaagcctcaaaatcttttgtagcttctgaagaaaaatctaaaaagtaattaaaaataaaaagaccgaagattattatctccggtcttttttatgaaaattaaattaattatttacctccaagaatattaccaaggatgctgcctaagccaccacctccttgttgctggtttccaccgccacccaatacacttcccagtatatcgttcaggggatttcctgatgattgagattgtccgccgcctaaaacacttccaagaatgtcatttaaaggattagcctgctgagcctgagcctggtttgaagcatttccaaggattcctcccaacaaatctcccaagccgcctgctcctacattattttgttgcttttgctgaccgatgtaacccattacaacaggcgcaagcatagcaagaataggtccaattttatctattgaaatcccggtgttttgtgacaactggttttcgacagtgcttttttgtccgccaaagatatgatcaagaatagatccgccttcagcctgtcttgcttcaatttgtgaagcgtcatttaaaatacttccgttatggtctttatctaaagcattatttaaagcttctgcttcttttgcatcctgagacttatttctaaggtaagaaataataagaggggtcgctacagctaatagggcgatcacctggtttttgctgattccgaatttgttttcagcctgttcagcaacctggttgcctgtattccctgtaagtaggtcaattaaactcattttttgtgtttatttagtattaagtacaccaaagttatcaaaaaatatgcctcataaaatgaccgtctttcataattattgttaaagttttctgatctgttcttctgtatatcctttgctttttaacagctttatatattctacagcactattggtcatccattcaataggttccggtgcctgttttttatcaatagtaaactccagaatccctacattgttgttcatccatggaagtacataataagagagcccgcctttatattccttaaatgaatggaattcttttcctttctctgttaaggatatgactttataaaacagaagatatcccacaggaatcaacagacaaacccatgaaaattttctcagatgagcatactttgcagcagaaagaccatacccgatagacaaagcaaaaataatattgaaaggcaggaagaaaacgtaattgtctgatactgcataaaaggttgaaaatccatatacacatacagctcccactgcaaaaacaaaaaacatttttctattggtcttgtacagaaataagatacctgcgactccgaaaaatgtaaacaggttgaaattataaataagatatacaaaagattgaaaaaaatcctttacatattgaatgaaatcttttttcagggaatcttctacccatgttccctggtcagaactataaggagatttgaaaggcagcccctgggagatatttaaaatgaataaagaactgaatagcagaataaaaatcaataatgatgctgccgcatattttttttcatttctgaaataaaatagaaagaccaataaggcaggaatcagaagaatattctgaatatgcacccataagcttatccctaaaaataaactgcttaacaggatatatattcttttgttttccgtaaaacttctgataaccgaaaagaaaaaaagacttacccaaagcgaattataagtatatacttctacgatttcggcatttctccaaaaggtaaaactgaaaccaaatacaaaagcagccgtaatagatgcccattctttttttaaaatactttttactgtaagataaatgacagaaactgtagctgctgccgaagaaactactaaaaaccggcttgcttcaattgcgttgatgcctgccagatttttaatgaaaataacagtattaatatataaaaagtgactggttgcagtagcggttgtttcccataggcctttttctgcactcagtacaaatcctacacagtctgcaaaaggaatttttgaaaaacttccacaataataaataccaagaaaaataataaataaaaatacagctgatagagatttgttcatatcagttctttacaattggaacattagaacaagcttctccgaacatcagggattttactattggttttaattgttctaccaattcaatataagcattttcaggaatttctttatcagagcagccttttacaagcactctttttcctctcatttcctcaaaatcataagtctggatagcattatgcattaaaataacttccagatcttcccggcttccaaaaactattttcctggccacgtctgtaagttttgctgttaatacaaaataagcccaaagtggaataatagtatctacagaattgtagatgtatatataagtgtctttatactgttcagtatctattgcatctaccttttcacggaaatctttttctttgagaatcatctcctgaaaaagaaaatctttaaggtcaatacctcttctttccccttttggaagtaaagtggtaaggtcaaaattaataaggccgctttctgcaactttattcctgatttcaaattcttctgacattttttatcattatctttgaacaaatttacgaattaagatcatatctgtcttaatttgttctctatccttactatagaaatgaaatattatattattgcaggagaagcttccggtgatttgcatggaagcaacctgatgaaagccttgaaacataaagatcctaatgcggaattcagattttggggaggtgatctgatgaaagctcagggtggaacattggtaaaacattatcgtgaccttgcttttatgggatttctggaagttgtgatgaacctccgcaccattctgaataatattaaattctgtaaagaggatattcagaagaacagacctgatgttttgattctggtagattatccgggttttaacctgagaattgccagatttgccaaagagcttggaatcaaagtcgtttattatatttctccgcagctttgggcgtggaaagaaggccgtgtagagattatcaaaaaatatgtggatgaaatgatggtcatccttccttttgaagaggacttttacagaaaacatggagttcattctcattttgtaggacatcctttgctggatgctatctcagatttgcaggaaatcagtgttgaaaaattcaaatctgaaaacggactcaatgaaaaagaaatcattgctcttttaccgggttccagagaacaggaagtggaaaagatgcttgaaatgatgctttctgtaagaccgcaatttcaaaactatcagtttgtgattgccggagcgccaagtcttccgaaagaattttatcagaaatatgtggatgataatgttcattttgtttccaataaaacctatgacttgctaagatgttcaaaggcggctctcgtaacttccggaacagctaccctggaaactgctttgctgaacattcctgaagtagtttgctatcgcggaagcaaaatttcttatgccattgcaaaaagactggtgaaaaatatcaattacatttctctggttaacctgattatggacagagaagtggtgaaggaactgattcaaaatgatctgaatactaaaaatctggtaactgaactcaataaaattcttacaggagaaaaaagagaacaggttctgaatgactaccatcttctgagagaaaaacttggtggaaaaggagccagtgaacatgctgctgaggtaatattgaaagtgtaatatttaccaaggtctttaagaatttaattactttttaactatgaattattttaaccgtttcctgctactactgataattacatttttctcaaacagttttgctcagcagaatgatgaaagagataaagtccagatattttattacggatggtatggaaatcctgcaacagacggaagttatcagcactggaatcatgaaatccttccgcattggaataatccgaaatggaataacctcgggcaccatacaggaggagatgatattggcgctaatttttatccggcactgggaaattacagttccaatgatccaaagatcattgagaagcatatgaaaatgatcaaggatgccggagtaggagtagttgtagtaagctggctgggaaaagattcatatacagataaaagccttaacaaatatctgaatattgccgatcggtttaatttaaagatagcattccatatagagcctttctataaaaatacaacagaattaaaagaacagctttcttatctcataaaaaactattctcatcatcacgctttctataaaaaagaggggaaaccacttttctatgtgtatgacagttataaaattcctaaggaagaatgggctgaaatactatccaaaaaaggaaaaaaaacagttagaaatacagatttagatgctgtttatatcgggctttgggttgaaaaagatgatgcgaaattttttgattcagcaggttttgatggcttttatacctattttgccagcgaaggttttgtgtatggaagtacaattgccaactgggattttatggcaagttttgctaaagagcatcatctgatttttatcccttgtgtcgggccgggctattcagatacaagaatacgtccatggaatgaagctaactttaaaagcagaaacaatggaaagtattacgaaaatatgtttgatgctgccatcaaagttaatccggatttcattggaatcacatcattcaatgaatggcatgaaggaacacagatagagccagctgttcctaaaaaagcaggtgatttcaaatatgaagattatgggaaagatcctttattttatattaaagaaacaaagcgtttgacggataaatttctgaaaaagagatagcatactttcaaacgtaatttttataaaaataaattaagctttctgttgacatctttgatggataacgggacgcttatcagttatttaggagataatacatcaatcattaattatctaatttttacagataattattggaattgcaaaaacagcctcttcttattctcgcagtatgctttattcttggaatttttttccaggatgaaatggtgttggcagaatatgctatttattgggctgctgcaatttgtttaatccttctggctatagtatgctttcattcttattttctgtacaaaaccaggacagctttactgatgcttttattttttggagcgggaattattcttcatttttataattccttttcatcagatgaacattcgcagataaagcaaaaagaaataattgtttttaagatttctcaaaaactgaactctacggaaaaatatagaaaatatgaaggaacagcacaaactggaaacaaaagtttaaattcaattttttatgttccaagagattataaagagctggattttattcattactacaagactgaggcttatattacacagcctaaagctcctcaatatgattttcagtttgattacgtccggtatctcgcaagaaaacatatttattatcagacttatatttcaaaagaagtcggatctgcagaacggtatgatttaacaattagagataagttgcggcaatacaggtttacagttcttaatagaattgataaaaccggcatgtcaggaaaaagcaaagaatttttaaaaggccttattctggcagatcgaacagaaattgatgcggatactgtcagagattttaataaatccggattggttcattttctggcaatctccggaacccatattgttgtgattttcggaatgttttactttttgctgagccgttttacccctttaagcttcagaaaatatgcaatggttatcagtttggcttttatctggctgtttgctgcttttatcggatttggaaattcagttttgcgttcctgtattatgctcagtgtttattttaccttcattttacttcaacggaaatcggatcttcttcattcattggcattatcagccttctttattttaattgctgatacacaacagctttttgatgtaggatttcagctcagctttttagctgttttgggaattttttggctgaatcagcccttgttaaaatactttcccaggcaggatagttatatcaaaaaaatactgtttaataccattacagtatctctgtcggctcagctggcaacactgcctgttgtgctgtattacttccatcagttttcattcatctcgatcattgcgaattttattatagttcctttctccgaaatcatcattgtgttttcattcttaatgactgcgctcatttctgccagcgctgattttgaattgataaacaggttatatgattttgtgattcagattttactcaagatgatccattggtttgctgaggtagatgtattgttttttgaaaatattccgatgaactggatagaagtactgtctgtttcggttgttatttttttactaagacctttgatactgaaatttaattttaaaaattcaatggcattgataatggccgctttagtatttctgatgataagaacggggagtacagcttttgaaaaccgtaaagaagaaatattggttcatacctttggtaaaaacaaagttttctccataaaaacggggagtaaagtatctttctggatttcggatatgaaaagtgaggcgaagattctacagtatgtcatcaatccctattgtgcttccagacgagtgaaatattttgagataaaaagcatgtcatcctctgtccaaaaagtggttttcagagataaagtttaccatctgaaatgatggttcttaagatagagattttcgtgcatttataatggatgaattcttatttagaaagattacaaactgtctaattgtgagatttctcactttttgatattgttaaactttcttaattttgtggaaattcaaatttaaacttatatggcaggtttaacgagttctacgataggtagaaaatatgctatggcattatcagctctatttttgctgatttttcttatactgcatttgacgaccaatttgttatcagttctgaatcgtgatgcattcaatacagcatcagattttatgggctataatccttttgtgcagttcttaatgcagcctattcttggttttgcagtaattttccatttcattatggggtttgtattggagatcaagaataataaagcgcgtcctataaagtacgcatctaacaacccttctgtgaactcttcatggatgtccagaaatatgattatttcaggagcagttgttttagcttttttagtgcttcacttttacgatttctggttacacgaaatcaattacaagtatgtagaagttttgactcctgatgcagaacgtttctggccggagcttcatgagaagtttgccgatatctggagagtggctttatatgtaattgcttttgttttactaggcttacacttagctcacggattccagtcttcattccagtctatcggggcaagacatccaaaatatacaccggtaatcaaagctttcgggaaatggtattcaatccttattcctgcagggtttatttttatcgcaatttttcactttgtaactcaataatatcaatatactaatatgagtaaattagattcaaaaattccagcgggtcctttaaaggataaatggaaaaatcataaagaccatatgaaccttgttgcaccaaacaacagagataagattgatattattgttgtaggtacaggtttggcaggaggttctgcagcagctacattagctgagcaaggatacaatgtaaaagcattctgctaccaggattctccaagaagagctcactctattgcagctcagggagggatcaacgcagctaagaattatcagggagacggtgactctacttacagattattctatgataccatcaagggtggtgactatagagcaagagaggctaacgtttacagactggctgaagtttctgcaaatattattgaccagtgtgtttcccagggggttcctttcgggagagattacggaggtcagttagataaccgttcatttggtggggttcaggtaaaaagaactttctacgcaaaaggacaaaccggacagcagttattattaggtgcttattctgcaatgagccgtcagatcggtaaaggtagaatcaaaatgtacaaccgtcatgaaatgatggatcttgtaattgttgacggaaaagcaagaggaatcatcgccagaaaccttgtaacaggtgaaatcgaaagacattctgctcacgctgtagtgattgcttcaggaggatatggaaacgtatatttcctttctaccaacgcaatgggatcaaacgtttctgcagcttggaaaattcacaagaaaggagcttacttcgcaaacccttgctatgtacagattcacccgacttgtattccggttcacggaacacagcagtctaaactgactttgatgtctgaatcattaagaaactcaggaagaatctgggttcctaaaaagattgaagattcggtagccatcagagaaggtaaactgagacctgaaaatattaaagaagaagatagagattattatttagaaagaagatatcctgcattcggtaaccttgtacctagagacgttgcttcaagagccgctaaggagagatgtgatgccggattcggaattgaaaataacgatacaaaagaaggtgtttaccttgatttctctacagagatcatgaaaaaaggtagagaagccgctatagaaaaacatattcataacccgacagatcagcagatctatgaccttggtaagaagtgggtagaggagaaatacggtaacctgttcgtaatgtacgaaaaaattacagcggatgatccttacaaaactccaatgaagatctatcctgcagttcactatacaatgggaggtgtatgggttgattataaccttcagtctaccatccctggatgtttcgtaatcggtgaggccaacttctcagatcacggtgcaaacagattaggtgcttctgcattgatgcaaggtcttgctgacggatattttgtacttccttacacgattgcagattacctttctgcagatatcagaacaggagctattcctaccaattcaggatcgtttgacgaagctgagaaaggaattaaagagaaaattgatttcttcttaaataataaaggaactcattcagtagattatttccataagaaactgggacacatcatgtggaacaaagtaggtatgggaagaactcctgaaggattgagagaagctatcaaagaaatcgaagaagtaagaaacgatttctggaaaaacgtaaaagtacctggtgaaggagaagggatgaacactgagcttgaaaaagcattcagagtggcagacttcctggaacttggacaattaatggctatcgatgcactacacagaaatgaatcttgtggtggacatttccgtgaagaccattcaactccggacggagaagcggaaagagatgacgtaaactacaaatacgtcggagcttgggaatatcagggagcagatatcaacgcggaagtgttgcataaagaagaactgatctacgagaacatcgaggttaaaactagaagttataaataatctccaacctataaatataacattatgagtgcaaaaaaaggcttacatcttacgctgaaaatttggagacaaaaaaatagtaaaactaaaggtcagtttgagacctataaaatatcagatgtatctacagactcttcatttttagagatgctggatattctgaacgaaaatttaattaacgaaggtaaagaacctatcgctttcgatcacgactgtcgtgaaggaatctgcgggatgtgttccctttacatcaatggtagagctcacgggccggatacagggattactacctgccagcttcacatgagaatgttcaaagatggtgaaactatcgttatcgaaccgtggagaagtgctgctttcccggttatcaaagacttaatggtggacagaagcgcattcgacagagtaatggctgcaggtggtttcatttctgtgaatacttctggtaatacattggatgctaatgctattccggttccgaaagaagatgcagacagagcaatggatgctgcggcttgtatcggatgtggtgcttgtgtagctacatgtaaaaacggatctgcaatgcttttcgtaggagctaaggtttctcagtatgcattgcttcctcaaggtagagtagaagctaagagaagagttctaaacatggtaaaagctatggatgaagaaggattcggtaactgttcaaatactggtgcatgtgaagtagaatgtcctaaagggatttcgcttgaaaacatcgcaagaatgaacagagaatacatggctgctcttgtagatcaaggatagaattgattcaaatacatagaaaatcgccttcattttggaggcgatttttttatgatagggattggcctgttaaagtttgttaacttattgccgggtttttgctgttttttatttattaagtatatatttggagcgtagttgaatgggtttcaaaaaacacgttcaattgcttttttaccatgaaaaagagattattagacaatacaaatcctgcttttgaacggtaataataaaatttttaaaaaaaattgatagtgtgaattagcaagccctaaaaagcgtatttttgtgtaatattaaaaattgaaatgaaaaaatatcttttattgtttatcatcgcattttttgtgatgtcttgttcaaaaaaagtagaagtaaaaggaaaaattactggaagctcaccattagaaagaattgaatttgtagaagcttcaggagtaggaaccctgcctttaattaatataggtctggataaagacggaaacttttcaggaaattttgaagctcctaaagacggtatgtacgtaatcaactatgcgggcagacaaaacctgatctatcttgaaggaggacaaaaagtaaatatctccggaaacggagctactttcccaaatgaattcgtcattaccggagatgctaaaaagaacaatgatttccttacagcttctcagaagtttttagctgaatatggtactaaggttaacttacaagtattaatgagtggagatgaagctgcatttttgaaagggatgcacaaaattgaaaatgatattaataaaaatgtagatgatcttgcaaaaaagaataatccaagtaaagcacttttagaatggaagaaaaacgatgtgaaagtaaccattcttaatttacttgccaattatgaaatgtctcacgggccaatgtccggaaacccttcttacaaagcttctaaagctttcaaagattacgaaacacagttagaaactgataaagatgcgatggtgaaaactattcctctttacagacagtatcttcttgtaaaaatgactccggatttccagaaatatgctgaagcaaacagcaagggaaaaacaggaattacaacttctgagatgttcgctcagtatttaaaaactaagaaagatttgtctcagactgcaaaagattatcttttggcatttgtaatggctcaggctgatattcatccgacaactcctgccgcaaatattgacaagattaagaagatcattgattcagatattaaagatgctacgattaaaagtgatcttttaaaaatgcaggtggctattacaggacttaaaatcggagaagcagctcctgaagcagctttaataaaacaagatggaaagtcatataaactttctgaaaacaaaggtaaaccttatatgctgttcttctatgcttcatggaacccttacatcagcgaagctacagtaccagtattgaaagaagtggtgaacttctataagtctaaaatgaattttgtatatgtaaacgttgacgatacaaaagaccagttcattaagacaagcaactctttgttaaaaggaattcagggagtaaatgtttacggagaaggaggtttaaactctgatattgctaagaaatatggagtatacggattcaaattaccttgctttgtcatcattgataaagatggtaaaattgccagcagatctttcgtaaatcttggtgagcaggaattagtaactattttggataaacaaacaggtctttcagcgccaaaagtagatccgaatgctcaaatgcagccacaattacagcttgatccttctgccgcacagcagaaagcttcacagccagcaaatccgcagccggctccgacaaaataataaactttaacacagtatagaaaccttatcttcggataaggttttttttattgtatttttgcaaactgaaacgtaaggtttcaattaggaaaatagaaaattttagaatgagcaggaagaaaaaaagagatatagttcttgaaaatataaaactgttaactgccggggcaaaaggcgttgcaatcggaagaacagacgaaggtaagaccgtaatggtctcaggtgcaattccaggtgatgttgtcaatgtgagagtgaaaaaagcgaagtcaaaatattatgaaggcgaagctgtggaaattcttgaaaaatcacctttcagagtagagcctaaatgtatccacttcggtacctgcggagggtgcaagtggcagaatatgagctatgaaaaacagcttgattttaaacaggaggaagtttacaacaatattaaaagaatcggaggtattgataattttgaaaccgtgccaattctaggatctgaagagcagtatttttacagaaataaaatggagttttctttctccaatgcaagatggcttactcagtacgaaatcagttctgaagaaaactttggaagcaaagacgctttaggtttccatattcctggaatgtggagcaaaattcttgacctgaaagaatgtttccttcaggaagatccttccaatgccataagactggctgtaaaagaatatggagtaaacaatggactggacttctttgatgtaagaaatcaggaagggtttttaagaaccttaatgatgagacagaattccaaaggagaatggatggttcttttccagctttacagagaagaaaaagaaaacagagaaaagctttttgaattcttattagagaaattccctcagattaaaacgttggtgtatgctatcaattctaaacagaatgattctatttatgatttaaatattgaagtatattttggggaaggataccttatggaagaaatggacggactgcagtttaagatcggcccgaaatcgttctttcagaccaactacaagcaggctttggaactgtatagaaaaactctggagttcgcagacctgaaaggagatgaagtggtatatgacctttacacaggaacaggaacaattgcgcagtatgtagcaagaaacgcaaaacaggtaatcggaatagaatctgttcaggaagcgatagatgcagctatagaacatgctgcattgaacggacttaccaatacaacattctattgtggagatatgaaagatatcttcaatgatgaattcatggctaatcaccctaaagcagatgtattaatcacagatccaccaagagacggaatgcaccagaaggtggtagaacaaatcttaaaactttcaccggaaaaagtagtttatgtaagctgcaactcagcaacgcaggcaagagaccttgctttgatgaaagatcattatactttagtaaagatcttaccggtagatatgttcccgcagacacaccatgttgagaacattgcattgcttgttaaaaaataaattatttaaatttgaatttccaaatcttaatatgaaatactttaaatttctcattgtaatctgttttttagggatgcttttttcctgtggcggtgatgatgatatctgtgaaagcggggaaggaactcccagaatgaaggtaggtttcaggacactggcaagcggaaaagatacaaccatagatactttgtatgtatcagtagactatggtgcaggaaaggtggatctgggaaaacttgcaaacattgatttcaggttaattcctttacgtgtagacaactcaccctatacagatgtttatttcaaaaccagattaaaagggccggagtctcatgtaagaataagttatagcacaaagtcaacctatgtgtctcctggatgcggaatcaaaaaaacttatgaaaatttaacttcagaattagtaactccgaatcctgttcagaaactggaagccggacaaaatcaaatagagaatgaagacaagactaatctttacctttctttttagtttattgggaataataagctcggcacaagagaaaaaaaaggaagcagagaaggaagttcatgagaaatataagcctaattttatggttgggcttgatgtattgaataccggagttgggttcttttcggacagaaagctgtatcagggatttatttcttcgaaaatcagaggaaatgtacatgccattgcagaagcaggttttgaaaaaaatatataccagaagaacggttatgatgctaaagtaaatggtcctttcgttaagctgggagccttctacatgctggcaaaagatgcggaaaatgaatttaacggattttatgcaggagggaaggctgccggatcattctacaaccaggaatatatggcggtgcccgttcgtggatttggaggaagtaactcttctgaagcttttccttcatcatcacagtcttctttctggcttgagggaactataggaggcagagtacagttatttaattccaacttctatattgacgtgaatcttcagccaagatatctggtgtacacttccaagcaggatgatatttctccaatgattgttcccggcttcggaagaagttcttcaaagttcaatatgggatttgcatggaatgttgcttataagttttaaaaatagcaaaccttaacttttaaaatatataaaatacaaactttagactgttctaaattttgtattttttttaatgaatagacttgctgggtgtataatattaaaaaatattaacttattttatttgtgtgagttataaattagctatatttggcggaaattataattgtgttttaatttatgaaaagagtatttactgctttaatgtttacttttataggaggagcagtgttcggccaatggacaccaacttcttttaaaaaaggaaacgataacaaaagaagtacaggatttagagtagatcaatctaatgtaaaacctgatggctattataaattggacttagacttactaagatctcaattgaagaatgctaaagagatgggccctaatgctgctcctgttattatttcacttcctaatctggatgggaaaattgaaagatttcaggtgtatagcttcccggttatggttaaggaattagctgataagtatgatttaggttcttacgttgggaccagcgttgatgaccctactaaatatttaagatttagtgttgctcctaatgattttcagtctatgattattcatggagataagtatgaattcattgaacctgctaatgctgataagtccgtatatgcagtacaccctaaaacaatgaagaatggagaaggctttgtttgttcaacagaagaaagcccgcaagctaaaaagcaaatccaggctttattacagaaaggaaagtcttttacaaaccaaccaaccaattttgctaaaaattctgataagaaatacagaacaatgagattggcaatgtctgttacaggggagtacactcaatactttatgacacttgctggtgtaccttctacggctacagatgatcagaaaagagctcctgcattagttgctatcaacaatactctgaccagagtaaacggagtttttgaaaaagattttgcattgcatttgaatttacagaattttcccaatgtaatttatattgatccagctacagatccatattctgctgctaacgtaggagcgggtggagcatggaatggagaactacaggctgctttgacagctaatgtaggagatgctaactacgacatcggacatttgttcggtaaatcgggtggtggaggaaatgccggatgtatcggatgtgtatgtattaaccctactactcaggttcctgaagggaaaggttcagggtttacttctcctgcgaatggaattccatcaggtgatagctttgatatcgactatgttgcacacgagatggggcaccagttaggagctaatcatactttctctcataatgttgaaggaagtggagtaaacatggagcctggttcaggatctactattatgggatatgcaggtataacaggtgctaatactgacgttcaggcaaattcagatccatattttcacgttgcaagtattgatcagatccaagaaaatctcattgataaaacttgtgatgtagaaactgcaattacaaataatccacctgtaattggtgatttaccaacttataatattcctaaaggaacggcatttgtgcttacagcttctgctacagatgctgaaaatgaccctcttacttatgcctgggaagaagttgatgatgctatagctcctattaataaatttaatttagggttaactaaaaccggagcatcattcagatctaagtatacaggaacaaatccaacaagatattttcctagttttacatctgtaatgaatggggtacttaataatgcgaataacacttgggaatctgtttcaatgttgcctagaactactaactttgctgttacagtaagggataacaatgcaaatgttctgcaacagcaaactaaacacagtgttcagacaattgtggtaggtgataacggtcctttcagattggctaatcaatatgctgatgtgaacacgccaactccaatccagtggattgttgccaataccaatgcagctccttataatgttgctaatgtaaagattgactatactacagataacggtacaaactggactgtattatctgcttcaacaccaaacgacggatctgaaaactttactttcccttcttcattgaatggtcagactattaaagtgagaatttcttcaataggtaatgtcttttatgctgtagggcctgttagcattgcgcctctatctgcatgtagcagtgctgcaccaacgaatgtggttgtaagtaatatcacatttagtaccgcaagtgtttcttggatgtcttatactggtgctacttataaggtacgctacaaaaagacaagtggaagtgtttggactgaaattaatacaacagttccttctgttaatttagataatttagtagatgctactgcatatgaggtacaagttgctgtagtttgtaataatactgtaggtacttattctgcatcagttaatttcagtactccggcacttgcatattgttcagcagcaggaaatactggtagcccgatctacatatcgaatgtaacattggccaatatcaataacactactgcagcagctagtggttatactaactttacaaacaacacagctcttcaggttaatctgacaaaaggaaatacgtatcctatcactgttaaagtagcaaattcatctacttatgtaagcgcaatcgtagcttatatcgattttaataaggatggattctttgatgacactgaagcggttatggatcttccttgtggaacttttgccaacaatacagctaccggatcatttacaattccaaatgacgcaatcgaaggttcagctctaagaatgagagttgttggcttttacgttggagcaaataatgcaggtttctatttaccttcaagctatctttgcggtattaatttccaatacggagaagttgaagactataacgtagttattacaggtaaccttgctactgctgagactgctgttaaaaataatggcattcagatttatccgaatccggtaagtgatgttctaaacattactaaagtttcagataaagcaacctataaaatctatagtgctgccggacaattagtagataaaggaaatatcaataatggaaaagtgaatgtttccgctttagttaaaggtggttatgtaattacaatagatgataaaggaattgagcaattcaaatctaaattcattaagaaataagcataacttttaaatattagtaaatccccggaaatttccggggatttctttatttaaagcataaagagataatttgctattttttttcaaaaaaaacctaaatgcacttataaattaataataaaaaatgattagatttgtctgattaatatataatgaaaacattatgaagaaactctttacctctttaattctgtttctctgtttgatttgcacaggctttgtatctaaagtctcggctcaggcaggccagattgggacaggaacgggtacctcagtgtatctccccatacgttcctattacgggtatagttattcccagcagatttatactgctgcggaagtctcggctgccattggtacgtcgacctatatcacagccgtaaagttttatgtagacaccgtatcaaactctccggattcctacaaggattgggttgtttacatgggaaacaccacccagaataactttacgtccaacacaaactggattccgttaggttccttaactcaggtgtatgcaggagatttacctgccatatcaaatggaaactgggttactcttcagttgaatactccgtttatctggaatggtacagacaatcttgcgattgctgtaaatgaaaaaacgccaggttattcatcttctccgggtacagcctggggaacttataatgctggggctaacagaggtattctttattatgaagataccacaaacccaaatccggcttcaccaccttctgcatcaagcagatattctgatattcccagaatacagttggtaagccatcagctgactccatgtactactgctccgccaacgaatattactgtaagtaatataactacggtgtcagcagttgttaactggtatacggctacaggttctacttatgtagtaagatacagaagtttaccttcaggtacgtggcagcaggttaacgttacaactcctctttcaggaagtgcaacaatttctggacttacagagcaaacccagtatgaagtacaggtggctactgtctgtggaggtactcagggagcattttcttccagtgtaaactttacaactccggcacttagttattgtaactccggtgctacgagtacttatattgatggatatatcaaccaggttgcagttaacgcacaaggtgccccatctatgtatagtaactctgatcagagcggttatacagattacagtacagatccttcaagagtggttactttggtaagaggtggtagtgctaccgtttctgtttcaaaaacgtggccaggttatcaatatggcttcttaacaggagtttggattgactttaaccgtaatggtatttttgaagcatctgaaagagtacttacttcaccaagtaataccacaactccggtaacagctacatttacagttccaactgctgccgctggtgcttatacaggaaacctgacgacaagaatgcgtgttgtattaaatgaatacagccctattaatgcttgtggaacatactcttatggtgaaactgaagattatgcagtaaaactgatagatctgtctgcgtgtagtacagcaccgccttccggcatcatggtgaataacgtaactccttcttcagctaatgttacctgggtttctactacaggagctacctatattgtaagatacagagtttctccttccggagcatggcagcaaattgcagtcaacacaccattaatcagtaaccaattactttcaggattgttggaacaaacaacatacgaagtacaggtagctactatttgtggaggaacaacaggtgctttctctccaagtgttacctttacaacacctgctcttacctattgtacagctggtcctacaagtaatactgcaacaagcggttatattaataatgtaacggttactccgacgaacactcctataatgataagtaattctgtatctgataattataaagattatacaacagatgcaacgagagtagttatctttgaaagaggttcggccaataataaaatttctgtaaacaaatactggcctggttctcctacatcatatggagtttcagcatgggtagactttaacagaaacggaacgtttgaaacaagtgagagaattcttaacaccacttataacacaactactccggtaacggctactttctcagtacctactgttgcgagtggtaacgtatatacaggaaaccttcctacccgtatgcgtgttgtaatgagatattttgataatgctaacccttgtggaacattctctcagggagaggtggaagactatgcagtaaaatttgtcgattctcagaactgttcaacggcccctcctacaaatatcacggtaaacaatattggtgcaactacagcaactgtatcatgggttgctactgtaggagctacttataatatcagatggagaactactcctggaggtgtttggcaaactgctacagttcctgccggtcagaacttctatggaattactggacttacagaacaaacgaattatgaagttcaggtttcaacaacttgtaatggttctacaggatcttattccggctcagtaacatttacaactccaccgttgtcttactgtcagatgacaggtacaggaacaaatgaccatatttcaaatgtaacagttacctcttcaaaccttggtgttccaccaatgaataatacttcggtacagggtaactataccagctacactactcctgagacactgattactttagatgtaaattctcaaaataataaaatatcagtagcaaaaggttggacgggttcaacaggaaacgatgctgtaacagcctggatcgactttgacagaaacggacagtttacagatgcagagagaattttaatttctccggctaatacaactactcctgttacggctacatttgcagttccttcaacagcttatactggtgcattgactacaacaatgagggtagtactgaaacgttcaaatgctcctgtaatgtgtcagaatgctgtggatggagaagttgaggattacagagtaagaatcagaccttgtagcaatgcaactccgaacgctccgacatttacaaccactcatacaacagctactgttactattacaggaacaggagtgagctacgtggtaagatacagagttcagggaacaacagcgtggactgaagtatatgcttctacacaattaggtaaccttccattagttatcaataaccttacacctgctactacttacgaggttgaagtagctgcaatttgcggggatgttgtaggaacggctactccaatcaagacatttacaacaagatgtgatcctacacctcctaatgtaaccgtaagtaatataactccaacaaccgcattgattacatgggctccattagcggcaagctctacgtacactatgagatggagaaaagtaggtaccactacatggacaacagtaagcttacctgcgccaccagcgaatacttatgttttaggaagtacaactccattagagtcgtatacgacatatgaagttcagatcgctaaccagtgtaatggtgaaacgacactgaatccatattcaaaccctaaagtatttacaacagaaagaatctgtgagatcccgccaccaggattaacaattactcaattgcttcctacatcagcggcaattcagtgggatcctttccctggagcaacgtatgttcttagatatagaaaagtaggtattccaagctggacagaagtaccatcattagttaataaccttgtattgacaggccttacagaattaacaaaatatgaaatgcaggtagtaaatatctgtaatggtacgccaggaaactatactcctccttactactttacaacacctacagtaatctactgtaaaatgaaggctgagaactctacaggagagcatatctctaaagtaactgtgaagcctacaggtaagaaaacaatggagaatgagtccggagcttctacatatacagattatacaggagtgcctaaaacattcatcgagatgattcagggatcaacggataacgagatcatcatcgagaaaaaatggaccggaactacttacaacgaaggaatcgctgtatggattgacttcaacagaaacggagagtttgatatcaacgaaagagtattcacttcttcacctaattcaaacagcccggtttcaggtaaattcaatgtaccggcagatgcatttgtaagtatgacagactataagtacgttgtgatgagagtagcaatgtccagagatggtattccggtaaactgtacagacttcaagaacggagaggtagaagattacacggtaagaatttctaaacctgctgttttcaatccgattgatcagacaagtgttatgatttatcctaatccggtaagttcagtattgtttgtgaaaaatgttagcaagagagctaaatataagatctacaatgctgcagggcaggtaatcgcagacggtatcttattaaataaccagatcaacgtaagcagattgattaacggtgtttatgtaattgatatcgatgataacggtaacactacacaaaagaaatttatcaaagaataagacataaatttcaaatagaataagcctccagaaatggaggctttttttgtggtggattcacttccacataatatattttttgcgaaaaaaactcgttagaaagcttctaacgagtttttatttattcaatgccgaagattaccttttcggtctgttcctttaattcttccagattggtattattgtaaatgatgcaatctgccattttaattttatccctttcaggcatttgtttttccatgaccgcttctacctcacggtaggttttgttatctctgtccatcactcttttgattctgatattatcctcagcggttaccaaaagagatttataacattgtctgttcagtttgagttcaaaaagaagagctgtttctttgaaaactaaatatttgctttgtttgtttacccagttttcaaaatcaatttttactgcaggatgaatgatttcatttaattgttgaagcaaatctctattgttaaaaactttatctgcaacaaattttctgtcatacaatccgttttcatcgtaagcatcttcaccaagaagttccttgatttttattttcagttcttcgctttcattgacaatagctttggccctgtcatcagagtaatagaccggaaaaccgaattcctctataaaatgagccacagtagtttttccggagcctattccgccggttaaacctatgatcttgggtgctggttccggctctgtctgctgtgtttctgaatgtaattcttccataattaaaaattaatatccaaaaacatcattaaagctgaatgtctcatcaagtcttacccctttatcggtcatttttaaacttgcaagttcattatgggcatcatgttcaaagaacaataagtattcattatctacacactgcttaaggaattttcctttttcttccagtgttaaaagtggtctggtgtcatatcccatcacatatacctggttgatatgtcctgccgtaggaataagatcggctgcaaaaacaatagttttttcctggtattgaattaccgggagcatttgcttttctgtatggccgtctacaaaaatcacatccattttaagatccggtgcaaaaccgtagtttccggtggtaggaagaggcaaaaagttaagctgtccgctttcctgcatcggtataatattttccttcaggaagctggctttttctcttggattaggttctgttgcccactgccagtggttttcattagtccagaagttggcatttttaaaagccggtctgtatccggttctgtcatcgttccattctatagcgcccccacagtggtcgaagtggaggtgtgtaaggaacacatccgtaatatcttcctttacaaagccgtattttttaagatttttatcaagggtatcatcgccccaaagagagtagtgaccgaaaaatttatcatcctgtttattgccaaggccgcagtctacaaggatcagtttttttccgtcttcaatgagcagggaacgggttcccaattcgatcaggtttttttcgtctgccgggttggttttttcccacagactcttcgggacgactccgaacatggcaccgccgtccagtttaaattttccacattgtattggatataacttcatatgtatattttgattatttttttattaatttcattttctccacaatttttcttgcattatcatcagattgctcaagctgggtgatgatattgttaaaatcattctcttttctgttctgagaaagtttttgtttaataaatatctcagttggaataattttaatcccaaaagctcccttcatttctttttccacaaactcccttcccatatcttttaccatcatcggacattgctggaaactttcatatttagatgttaatttatccaaatgggtatacagttcatcatgatccattatttcaacttttccgtgaatctgtacagcttcataattccaggtggaaacattaatatgatcataccagctgctggatatataagtgtgggctcccaaaaagtcacaaagaacttcatcaccgttttttaaggtttttgcctggggattagcccttgaaatatgagtttcaatataaatattttcaggatcatcttcgttgagcatcatcattgaatgagttgcccgtatcttatcaactgaagaaatcagtaaagcaaaagaattttctctgatgatctctctcatcaaattataatcttcacttttgtataatttaggtataaacataaattaatcaattctcattaatcttaaactttaacccttgaaccttgaatttaaaatagctctcccgggtttttaggtcttgtaatattcagatgtctgtacgctttgtcagtaacttctcttcctctcggagtccggataataaatccttcctgaatcagaaacggttcataaacctcttccagtgtttccggattttcaccaatggatgttgccagggcagaaataccaacaggctttcctttaaaattttcaatcataacacgcattatcttattgtccatttcatccagaccaaattcatccacattcagagagtccagcgcatatttagtgatcttaatctcaatttcaccatttccttttatttcagcgaaatcacgtacccttctcagcaatgcattcgcaatcctcggagttccgcggcttcttcttgcaatctcaatggctgcatcttcataaatgatgactcccagaactcttgcacttctctgaataatcatagacagaagttcaatagaataatattccagcctgctttgaatcccaaatcgggcaagcattggtttggtaagcataccacttcttgtagtagctcctaccaaagtaaaaggatttaatccgatctgcacgcttctggcattgggacctgtttccagcataatatcaatcttgtagtcttccattgcagaatacagatattcctctacaacaggagaaagacggtgaatctcgtcaataaaaagcacatcattttcttccagattggtcaataaaccggctaaacttccgggtttatccaatacaggaccagaagtaatcttacagtttactcccagttcattggcgataatattggctaaagtagtttttccaagccccggcgggccatgcaataaaacatgatccagtgctccgccacgtcttttagcggcagtaacgaagacctcaagattttccagcgtttttctctgtcccgcaaaatctttaaagctctggggacggatctgctcttcctgcatcagctcctctcgtgagtagttttccttatctggatgtaaaaaatctggcattaattcatttcatttacctcaaagatagcaaatttagactaagattaaagggcagattgagaaaacgtttagattgaagtcaaggttctttccaaggttaaaaatgagaagacctaagatttaaataattgggatattttaagtatttttgagaggagaaattattaataaaaattaataaaattttgaatgtttagcagaaagatactgattgtaaaatgagtcggtctcaatctaagcattacattaactttaagcgaatgaaattaataggaccattcaggcaggtggtaacgcttgcagaccttcctttaagaggaaaaatttccgatgaacagctggaaattattgtagacggaggaataatagtagatcagaataccattcataagattggaaattttgaaacattaaaaacagaaaatcctgccatagaaattgagcatattgaaggagaacaggttgttcttcctgcttttgtagattctcatacccatatttgtttcggaggaaaccgtgctaatgattttgccatgcgtaatgcaggtaaaacttatctggagattgcagaaagcggcggtggaatctggagttctgtacagcacacaagaaatgcatcagaaggagagttgctgaaaaccttagtagaaagaaccaattttttgcttggcttgggcattaccacaattgaagtaaagagcggttacggtctggatgtggaaaacgagctgaaaatgcttaggatcataaaaaaagcccagagcgaaacaaaggcaactttagtccctacatgtctttcagcacacttgaaaccaagagattttgaaggtggcaatcctgaatatcttaaatatattcttaccgaaattttaccaagagttaaagaagaaggcttggcaagcagggtagatatttttattgaaaaatccgcatttcaacctgaagaaagtaaagaattcttactaaaagcaaaagaattaggttttgaaattacggttcatgcggatcagtttactcccggaagctcaagaattgcggtagaagtgggcgcgaagtctgcagaccatcttgaagcaaccattgatgaagatattcaattccttgcagagtctgacactgtagcaacagctcttcccggagcaagcctgggattgggggaaaagtttactcctgcaagaaaattattggacgcaggtgctattgtagccattgcaagtgactggaatcccggatctgcacctatgggcaatttaataacccaggcctctattctggccacttttcagaagcttacaacagctgaagtattggcaggcatgacattccgagctgcttatgcattgaaccttgaagacagaggacagttgcaggcaggaaagaaggctgattttgtcacttttagaactaataacttccaaaatgtattgtataatcaggggagtttaaaagctgataaagtatatattgatggaaatctgatataaaaattataaattaaccatatttgttcttcaggcagccggtttccaatgtctgctgaatgaagaacagacaataggcaaatgactgaataatgaataatatttggcaaggcagattggacggagaagagcttctctatcacaggatatttcaacgagtaaaggaagagcgtaattatgacaatatttctacaggtgattttgcattgcatggttttgctgtagatgaaggtgtcagaagaaataaaggccgtcagggcgctaaagatgctcccgatgttatcagaaaaaacatgtctaattttcctgtaatccttccggatttttcaatgctggattttggaaatgttacctgtgaaaacggcaatctggaaagtacacagaatgatcttgccaaaaatgtttcaaaagtacttttaaaaggcggaaaatcccttgtgctgggcggaggtcatgaagtgacttatgcgcattatttgggggttaaaacagcttttcctgaacaaaaaattgggattatcaatattgatgctcattttgacaacagacagcctgaaaaaggtgtagggccaagttcaggaacaggattctggcagattgcgcaggaggggccgatcaattctctgcatattggaattcagagaaactcaaatacattgaaactttttgatacagctcatcaatacgggatgaagtacatcctggcagatgaattattttttgaaaatcttccttccatttaccagcgcattaatgatttgctggacaatgtggattttgcctatcttactatttgtatggatgtttttaatgcatcaattgctcccggagtttccgccgcagcgtacaatggtatctttgcagatacaacctttatgcatttttacaggcatatcttaaaaaacaaaaaactggttgcactggatgtcgcagaagtgaatccttctttcgatattcaggacagaaccgcaagactggcagcgtgtcttgtgaatgaatggctaatgatgtaaggtaaagctatattcttccgatagagaaaatcattattttattgacccctaaggaatggaatttgctgatttcaccgtgcttttaaaataaaagcacttataaattcattagctgaatttaaaacagaaatttatattatggaacaattaattgaaagcaagcttattaaagcagataaagcgttttcagtgtggagaaaagtgccgtttgaggaaaggcagaagttaattgcaaaagcagcagagattttaaagaataattcggagaaatttggaaggatcattacaacagaaatgaataagcccatttctgaatccattgctgaagtggaaaagtgtgcattaatgatgaattattatgcagctgcagaaaatatattaaaacctgaaaaagtagaatctgaatttacttactctgaagttcattatgctccgaaaggagtgattttaggagtaatgccctggaattttcctttctggcaggtattgagatttgctattcccgcgattctggctggaaatacagtggttttaaagcatgcatcaatttgtttcggaagtggaaatgctatcgaagatgttcttttggaagctggtttcccggaagggatttttcagaatcttgaagtgggacacaaagatgtaaaagaaatcctggagcatgacactgtaaaaggagtgagcttaacaggtagtggaaaagcaggcggggaagtagcttcaatagcaggtttaaatatcaagaaatctttacttgaactgggaggaagtgattcttttatcatttttgacgatgctgatctggaagaggcggcaaaggccggagcaaaatcaaggcttcaaaattgtgggcaaacctgtactgcagctaaaagatttattattgatgaaaagattgaagatcagtttttacctgtttttattgaagaatataaaaaatatgagattggagatcctttagataaagagacgaaattagcaggaatggcaagacccgacctggcagatgagctggaagcccagttcaacagagcattggaaaatggtgcagagattattattcctttggaaagggtttcagagaatgaatttaaaccaggtttaatcagagttcaggaagggaatcccattttaaaagaagagcttttcggaccgcttggtatggtaatgactgcaaaaaatgacgaagaagctttacaaatggcgaatgatattcctttcggactttccaattctgtttggaccaaaaataaagaacgtcagttattctttattgaaaaccttgaatctggaacagttaacatcaacagaatgacaagctctgatccgcgttttccgtttggaggaacaaaagcttcaggatatggaacagaattgtctctgttagccttgaaagaatttgtaacagctaaaactattgtaggtaattaaaatatatacggatgtcattccggggaaccgaggaatgtggagattcttcactttaatccgtttcgttcagaatgattaactgtactttataagttaacagtatactttacactataaataaaagctcccgggaagtaattcccgggagctttttatgtttttacaaaagtaatttgcttattgcttatactgtagtcaatctcagtgtatttgtttttccaccttcatatgatggagtagcattgatattgattacaaagtctcctgtctcaatataaccataattatgagtcagcatatttacctggatgattgtttcatctgtagacttcttcatatcataataataggcgtggacaccccaaagcaggttcagcattgtgatcactcttctgttaccactgtatacaatgatgtgtgagtttggtctgtgtgctgccagctggaaagccgtatatcctgaatgagtaagtgttacaatagcagaaacgtttgttgttttggcaattcttactgctgcaagacaaactctgtttgtaataaatctctcatcgatgcagttataatctttctcaataggctcatttttatgttgatagaaatgagtagtttcaatattctttacaattttagccatgttttccacaacctgtacaggatacctacctacagaagtttctcctgaaagcattactgcatcagctccatccaatacagagttggctacatcatttacttctgctctggttggcgttaagctgttgatcatagtttccatcatctgggttgcaataattaccggtttggaataaaatcttgctttctctaccaggtttttctgaatggcaggcacttcttccatcggaacttctactcccaggtcaccacgggcaaccattaatccgtcacattcaagaaggatttcgtcaatatttttaaccccttcaggtttttcaatcttcgcaataatcggagtcttgaatttaccattcggatggcttgcaattaattctttcaggtcaatgatatcctgagcatgacgcacaaaagaaagagcaatccagtcaacttccatatcaagcatgaaattggcatcctgaatatccttttctgtcaatgcaggaagagatacctgtgtattaggcaggttaaccccttttttggaacttagaggtcccccctggatggttttagcttttacagtatccttttcattggtttcagtaacttccagtaccagcttcccgtcatcgataaggattctttcccctacttttacgtcctgtggaaactgttgataagtcatatatacctttgtagaatctccctccatcttttcattggtgaaagtaagaatatcaccaggattaaggtaagatccttcctttactacacctactctcagtttaggaccctgaaggtctcccaaaatacccactgaataaccatactcgctgtttagctctctaattatttcaatattttttcggactaagtcgtaatctgcatgggaaaaatttattctgaaaatatcaacacccgctttcattaaatctaacattacctcctttgacgatgaagcaggtcctagtgttgcgataatttttgtcttctttaaatacttattcataatactggataatttgataaagttcctcttcagaactcagtgtataatcttgaattggaaacacaagattttcagggagcaaaattacggaaaaatcaggaaactgttccgaactatgcaaaatatattctacatctacctgattatttaataaaaatttaatgttttcttcttctgtaaagagttctgtctgaatttttttttgcttactttcagaagatttatttgaaatgaaggtaaaacaggtctttgtagacttgtgataagcctcaaatcttggaaaaaaataatcataataccctccgtgaaagacaagatctttctttcttgaaaaacagaggtcgttggtttgatttattttatagaaaaactcatgagcgggtatatcttttgctaatcttaccagtcctatggcaatatcttcaaattctatatcatcaagatcataaagtttttgaatttccaagtatattttcttttttgtttaaaatataaaatgccctctgtgctgccttttcctctgccttctttttggaagtctccgttgcattagcaattttctcttctcccagccatacatgacacctgaatacgacagatttattggcctggatttcctcacaggtttcgtactttatattgacctttttcttttggctccattcgagcagaagacctttatagcttacaattttattttccagcttattgatctcggaaggggtcagcaatttttccagaatgatccttttacaggcatcataatggaagtctaaataaacggcacctattaaggcttcgaataaattcccggagatattctctcccaaagctgaagaactgttttgcttttgcaaaaggttggtaagcttgagatcttctcctaatttattgaggtttttcctattaacaatcttagatttcatctgtgtcaggtatccttcattagcctgaggataggtctggaacaaatgacaagaaataattgtacccaaaacagaatctcccaaaaattcaagtctttcgtaattactgtcttgatttttagaagaatttttcaaagaaaaagcttcacggtaaagagcaatattctgtacctctgtacccaacacttttttaagttcggtactgagaaaataatctctctccgttaattgtctttttctttttttgagaaggaatttagaaaagtatttctgtaactccattcattgaatttagattttcttaaatagaacgcaagcgttgtgcccgccaaatccaaaagtattgctcatggctacttttacatctttctttacagcggtattaaacgtaaagtttaatctgctgtcaatgttttcatcatcagtaaaatggttgatggtaggaggaacagtaccatgaataatagttcccaatgcagcgatagcttcaataacacctgcagcacctaaaaggtggccagtcattgattttgtagaattaatctgaatatcgtaagcatgctcgcctaataatttcgaaattgcattggattctgcgatgtctcctaatggagtagaagtaccatgcatattgatatgatctacttcatcagcagttaagcctgcatcttccaaacagtttttcattaccagataagcgcccagaccttcaggatgtggagcagtcatgtgatgtgcatcagcacttaaaccacctcccaataattctgcataaattgtagcaccacgttttaccgcgtgctcatattcttcaagaacgatacatccggctccttcacctagtacaaatccatctctgtctttgtcgaatggtcttgatgctgtttttggatcgtcatttcttgtagaaagtgccatcattgcgttgaatccaccgacaccacttgctgtaacggctgcttcagagcctccacacacaatcacgtctgcttttcctaactggatcagcattttggaatcaattatagcatttgctgaagatgcacatgcagatacagtagtataattaggtccgtggaaaccatattcaattgaaatatgtccaggagtgatatccgcaatcatttttgggataaagaaagggttgaatctcggaatttccgtattggcccatcctaacacttcagtttcaaaagtctctaatcctccgattccggaaccccagattacaccgactctgtttttatctacattgtcttcaataattccggaatgcgctactgcttctcttgcagcaacaagtcccaattgagtatttcggtccatttttttagcctctttcttatcgaaatgctgtagcggatcgaagttttttacctcgcaagcgaactttgttttaaagtttgtggcatcaaaaagagtaatcggagcggcaccgctctcacctttcacaagattttcccagtattcttttgcattatttcctattggtgttattgctccaaatccggttacaactactctttttaattccataaactttgtttaatttctttttttgttgaagaatattatttatttactacttcttcgatgtaagcgatagcgtgtcctacagtagtaattttttcagcttggtcatcagggatctgaatgttaaattctttttcaaattccatgattaactcaactgtatctagtgaatcagctcctaaatcgttagtgaagctagcttcaggagttacttctgtttcttcaacgtcaagcttatcagcgatgatagcttttactcttgatgcaatgtctgacatagtaaattatttttttaattgttagatggtgcaaatatataaaattctttacgataaaacatttttttagtcttttttgtggaccagaaggttttattttgggttgtggagttttagtgttttagttttcagtaggttatatttattatctgaagatgaatgtaaaatcgatatttagaaagactggaagagtccctgaatgatatgctttcaatttccatcttatggacttcagtttttagaatatcatcttacaattaactatttatttagctaaataggttttctttttttgaaacatacttatatatagtataaaatacacgatgtattgcatgaaatattcttaaagactaagatgtataaagagtataataaaaaaaccatcgagaaatcgatggttttgtggagttggagggattcgaaccctcgtccaaacaagcaatacataagctttctacatgcttattctgctattggttttcgacgggaagcagagagcagacgcccaacttccggcttatcttctaaagttttcgtgctttagccgaagcttctaaagccttatttccgcattcctatatcccaggatcaaacgccgcagaacagagcatttgtggaatatcttgcttccttactgaaatcttcgggaaaacgcttgaatctactatacttcgatattaagctgcaagagcgaactcttcgttgccagttaaaattctgtagcaagggattatagagatcgcgctacggttctctgcatgcttacttacccattggtcttgctgtcgaaaccagtcaaccccatgaataaagtaaatgcaaagatagtattttttgtttatatttcgttactatagatggtttttaatgaaaattaaagcttaaataatttacttggggtaggtgagatttgaatattaagttattgtggataaaaatattattgtctgctaaggtcctttattacggcgatttttcgaagatccggggcagagtggtgatggtttattgtaatatattttgtgttctcataaaaaatgtctacttttgcaatccaaaatgagatgtaaaatatgttaataattccagtaaaagatggtgaatccatcgacagagctttaaaaaaatacaagagaaaatttgataaaacaggtacagttcgtcaattaagagctagacaacagtttattaagccttctgtaactttgagacaagctagactaaaagctgcctacaaacaaagaacacttagcaaagaagagcaggcttaagattttttcttaaccatatattaattcatttcttaaattcttatatttgagaaatgaatttttatttttataccccatgatgctggaaaagtttttagaatacctggaattcgaaaaaaggtactctcctcatactatcacaagctacaaaaaagaccttgaagacttttcccatttctttctccgaacagaatcttccgacaatttagccaaagcagacaagaaaattatcagaaatttcattgtcgaattgagtgaacataatatttccaagagaagcattaatagaaagctgtcctctctccgtagtttttatctttttcttttaaaaattggtgaaattaaagtttctcccactgaagggatctcttccctgaagttttatgctgaaaaacagattcctatgtctaaagaggaaatggcagatcttaatgatagggtgtttgaacaggtgcatgatgtgcttgaaaaatgcattatggaagttctttatcagaccggcatgcgtaaagctgaactttgtggcctgatatttgagaatgttgacttatacggaaaagaattaaaagtaataggaaaagggaataaagaaagggtagttcccatatccaatgaactggctgaacttcttacaagttatcttgaaataagaaatccgcagacagaatataaatcatatttttttgtcaataagaaagggaaaaaactcaacgaaaaatttgtttatgtggtagttaataagtaccttagtcttataacaacgaaagaaaaaaaaagccctcacatccttcggcatagctttgctacacacgttttggataatggggcggagatctccaaagtgaaaaaaatattagggcattccagtcttgccagtactcaggtctacacgaatgctaatattgaacaattgaaaaaagtgtttaatcaggctcaccctcgagcatcaaaaaaagaagaattatgaagatttcagtacaatcaattggtttaactccacacgaaccactagaatcacacatcgacaaaaaagtaagcaaattagataccttctatgacaagattcaggagtgtaaggtatttttgaaagttgaaaataattcggataaagcgaataaaacagccgagattattttagcggttccgggagacgatatcgtagtaaagaagactactacaagttttgaagaaagtctggacctttgtgttgatactgctaaaaagctattaatcaagaaaaaagaaatggcataggaaaaaaagttaaaaaaagtttataaaaaatttgagaattcaaaaaatccgttctatatttgcactcgcaaaaaaggaacagcgatcttttgaattcttttttatattgcctccatagctcagttggccagagcacgtgatttgtaatctcggggtcgtgggttcgaatccctctggaggctcataaaatataaaactttggggagattccagagtggctaaatgggactgactgtaactcagttgcttcggcttcgtaggttcgaatcctgctctccccactttatatttttataaaaaaaacttgcaggattaaagaagttttcttagttttgcacagcgtttaccaataattttggaaacaaaattgcggaagtagctcagttggtagagcgtcagccttccaagctgaatgtcgcgggttcgacccccgtcttccgctcagaaaatcactcttatggtgtgatttttttttaacactgaaatgtgtagagtagagtttctcaatcgctttcagtccttattaaaatgcctccatagctcagttggccagagcacgtgatttgtaatctcggggtcgtgggttcgaatccctctggaggctcattttaatgtaaacatgaggggagattccagagtggctaaatgggactgactgtaactcagttgcttcggcttcgtaggttcgaatcctgctctccccacattttatattataaaaaaaaacttgcaggattaaagaagttttcttagttttgcacagcgttaccaatagttttggaaacaaaattgcggaagtagctcagttggtagagcgtcagccttccaagctgaatgtcgcgggttcgacccccgtcttccgctcaacgaaaaatcacgctacttagtgtgatttttttagttgatgccgacttagctcagcggtagagtgcttccttggtaaggaagaggtcacgggttcaagtcccgtagttggctctcaattttcccgaattttgttcgggatttttttttacccgtcagaaaaagaaattgccggccgacagatctttatcgttaaacctccaattagataattcttgaaattatttttcatttttatataagctttttattgatgaaccgaaatgcagggatcattgaaacttttgattcacctttagaatcacaatcataaattttctttaaattcgtgtaaaataaattttgatgaatattcttttattggaagatgatctcattctgtctgcggagctttgcagatttttagaatcaaataattttaactgtgataagatctacgacggggagacttttatccgccagataaaaaataatacctatgatctgtatctgctggatatcaatgttcctaaaataaacggacttgatgtttgccagacaatccgttcttttgataaaaataccccaatcattatcatttctgcttatggagatatctctgataaaaaagatgcttttacaagacttgctgatgattatctggtaaagccttttcagtttgaagagcttcttttaagaattaattcattgttgagaagaaaagctccttctgataatgcagatcaggatattctaagaattgatgaccttattattaacaagacagaacagaaggtgtatcgtggaggaaatgaaataacccttacgctaaaagaattccagctgctggtttatcttgccgaggcgcagggaagaacagtttccaagcagcagatcacagaacatgtctgggaacataatttcaatacgaataccaatacggtggaagtttatatcaactttctgaggaaaaagattgataaagattttaaaataaaactgatccacacccgttcaggtttcggatactacctaagtccattataaatgtctttaaaaagaaagatagctttaacgatcagtatcgccttttcattactttttggaatggtgatggcggtcatttatttatcttttaatgatttcaggagagatgaatttaaagaacggttcagacagaggcttgaatttacttcccattttatctcaaaatccaaagactttgaagaagaagctcctgttttttttaatgagaattctgataatattcttttaaatgaaaaaatcttaattttcaacgagaaaaaagagttaatctacagtacaatcaaagaccggaatgttacctgggacagcgccatgctgaaagagctggataaaaagaaaatcatttataccgaaaaaacagttccggaaatttatgcagcactcaggaatattaatggtgaaaactattatatccttaccagtgcctttgataccaacggaaaatccaagctgggatacctgaaatatcttttgattacagcttatgtgatgagtacgatgcttattgggtttttcagctattactttgttgagaagtttcttcgtccgctggaagaccttaacaaagaaatttccgaggttaccgctcataaactgacaacacagattcctgttgagcaatctaatgatgaagtcagcgttcttgcaaaatcttttaatacaatgattgcaagactggatgatgtatttcagtcacaaaaggattttacggcaagtgcttcgcatgagattcggactcctattacaagaatggcatttcagctggagaatcttattaaattcgaagaacactcaccggaaacattatcttctttaaaacaaattcaacgggatatctatcagttgtcagatcttaccaattcacttttactgctgacaaagtttgataaagaaaatattcagagcatttatgaagaagtaagaattgatgaagtaatttttgaagcttttgaggctgtagaaaaaagttatccacagcttaaactggatttcctgattaatgaagacagctccgaaaatgcgtttctgacgataaaaggaatccagtcactcctggtgattgtctttatcaatttgttcaaaaatgctgccgtttattctgataatacagaagtaaaagttttgattaccgaaacaaatgataatctttccattgaagttatttcccatggcaataccatccctgaagaagagcagagtaaactgtttgaagctttcacaagaggaaacaattcccagaatattgcaggatcaggtttaggactcagaattgtcaaaagaatcctggaatatcatgatgcagatatcatttattcttcacctgaagaatacataaacaggtttacactatattttaaaaaataaattaaagcagctggtccggaaatcagttgctttttttgttaaactcccgattaaaattttaataaaaatatcaacgttccgggaaaaaagatttctttttttattgattaagctttcatgaaacagcctgtttaaggctattttaatatttttttaagcgtcatttaagtttcttttaatcgcatcaaagcaattttgtattttaaaaagaaaaataatgaacagaattgcagtgctgtgcctcgccgtttcctcattcatggcggcacaacagcagatgtctcttttggaatgcgaagaagcctttcagaagaacaacctccagctgctcgccgaacaatataacatcaatatggctgatgcggatattctgcaggctaaaatctgggaattacctcagttaagcgggcagttcaatgcctataatcctcaggataaaaagttttttgatgtcggacactcaaaaggagcaggaattacacaattgatttatatgggtggtaaaaagaaaaatgaaatcgcttttgccaaatccaataaagaactggcgcagcttcagttttcccaattgcttgccgacctgagagcccaactccgttctgcttattttaatctttactacgaaaagctaaaacttgaaaataccaacaagcagctgggatatatgaatgatcttttgaatgcatatcgtatacagtcagcaaaaggaaacgtttctctcaaagatgctgtaagactgcaaagtattgtaatccagctgaatcatgacaaacttgagattaataaaaatattctggatttcgaacagaatttaaaagtcttaacaggtgtttcagaggatatagaaccgacaatgtctgaggcagaagccaaagaagttttgtcagcacagcctttcggcgatgaagaagaacttaaaagtaaagctcttgagaataatgctgattaccggtacaatcttaaactcattgataacagtaagctctatgcacagtggcagaaatctttgaatgtaccagacgtcacagtaggtgctgcatgggatcaggcaggtggaacctttaataatgaagcaaatctgacattaggaattcctttacctttatggaaagccaatcaggggaatgtggaaaaagctaactatgctattcagcagaatcagaaaaatgctgattttcaaaaactgacccttgaaaccaaagtgcagtctgcttataaaacctggaaagctcagtatgaccagctacaggatgttaaaaccacagatcttcagaatatggagcttgtctacaccggaatgctgaataatttcagaaaaggaaatgtgaatctgattgagttcacagattttatggacagctacagggaaacagcccttcagatctatgatatgaaaaatgagatcatgcaatctgcagaacagcttaatcaactagtacaaacgaaaatcttctattaaaatcatgaaaacatatattatccccgtattgatggtccttttgttagcggcctgttcaaaaaaagaggaagaaaaaaccaaccaggccaaaaaaggatttgaattaagcaataccatgttgaattccatttccttagccaaagttgaaaaaaagaatatagaagatgaatacagtttttacggcaaaatctctgcagacaaaaacagttatatagatgtatacccattggtaggaggaaacgtaatgagtgtcaatgtggagcttggagattatgtgaaaaaaggtcaggtattggctactatcagaagtactgagcttgcagaaatccagaaagatgtaagtgatgccaaaaccgatctggtagtggcaaaaaataaccttcgtgttgccaaagaactctacgaaggaaagctgaatactgaaagagatgttctggaagctaaaagccaattacaaaaagccgaagaccaattgcagagagcaacagcggtaagtacggtttataatgttaaaaccggaaacatatacagtgtggtggcaccgataagcggatacattgttcagaaaagtatcaataaagatatgcagctgagaagtgataggagcgataacatttttgatgttgccaataccactaatgtatgggccattatgaatgtcaatgagtctgatatcgataagatcagccttggaatgaaagctcaggtttctacactttcttatccggataaagtttttgatggtaaaattgataaaatattcaagattattgatccgcagaccaatgctatgcaggcaagagtggtcctggataacgccaacggacttctgattccggacagtaaggcaacgataaaagtttccagtctggaaagtaatacaaccttaacggtcccttccaaagctgtcatctttgatgataataaaagctttgtagtgatttttaaatccagaacagatgtaaagatcagagaaattaaagtgctgaagcaggtaggtgatatcacttatgttgccgacggactgaaagaaggagaagaagtaattaccaacaaccagttgctgatctaccgctcgctgaacagctaatcttatgaaacccttaagaatgctacatttttctttaacggcttttttaggtcatcaatttatctgtcatgaataaattcattaaaaatataattgctttttcattaaaaaataaagcatttacctttatctgggttgcaattttagccatctccggatttataagtttcaaaaatatgcctattgaagcttttccggatgttaccaatacccagatcgtaatcattacccaatggaatgggcgtagtgcggaagaagtagaacgttttgtcaccacacccatcgaattggcgatgagcccggttcagaagaaaacaagtgtgagaagtaccactatgtttggactttctattgttaaaattctgtttgacgacggggtggatgatacttttgccagaaatcaggttaataaccagttaagaaccattagccttcctgatgaggtagatccggaagtacagccaccctacgggccaaccggggagattttccgctatacattggaaagtaaaacaaaagattcccgggcattgcttactttacaaaattgggtgatagaccgtgccttaagaggggtacctggtgttgccgatatcaatgtcttcggagggcaggataaagtttttgagctgagcattgatcccagagcactggataaatataatcttactccgcttcaggtatatgatgccgttaccaagagcaatctgaatgttggtggtgatgttattgaaaaaaacgggcaggcttatgtggtaagggggattggtttggtaaaatcagttgcggatattggtaatattaccatccagaatgacagcggaaaccctgtgctggtaaaaaatgtggcggatgtccatgaaagctctatgccaagggtaggacaggctgcactgaatcatcatgacgatacggtggaaggaattgttgtgatgagaaaaggagagaaccccagagaagttttggtaggagtaaaagctaaaatcaaagagcttaacgaaaaaattcttcccaaagatgtcaaaatggtcactttctacgatagggacaacctgatggattttaccacccataccgtaatgcataaccttattgaaggaattgtactggtaacggtaattgttttaatttttatggccgactggagaacaacgctgattgtttccattatcattccattatctctattgtttgcatttttatgcttaaaactggctggaatgagtgcaaatcttctctctttaggagcggtagacttcgggattattatagatggagccgtcgtcatggtggaaggactctttgtgatgctcgatcataaagcgcaccgatacggaacagagaaattcaataaactagcgaaaggaggctggatcaagcagaccggtaccggattgggaaaagccattttcttttcaaaattaatcatcattacttctctgattcctattttttcattccagaaagtagaagggaaaatgttctctccgctggccttcacacttgggtttgcattaatgggagcgctgatatttactttaaccctggttcctgttctttcccatatccttttgaataaaaatgtgaaggaaaaaaataacccttttgttaacttctgggacagaatcgttttaaaaggctttaatttcacatttaagcataaaaaaaccagtatgatcgtagcggtctccttcctggcagttactctgttttccggaaaattccttggaacagaatttttgccgcagttgaatgaaggttcattgtggattactgcagaaatgccgatgagctcctcactgaaagaatctctgaaaacagcagaccttctaaagaaagacattatgagcttctctgaggtaaccgatgtgcttgcgcagaccggaagaagtaatgatggaacggatcccaacggattcggatttgtacagtttgctgtaaacctcaagccaagagaagaatggaaacgtaagattacttatgatgaactgattaatgaaattgacaaaaagctcagaagctaccaaggaattactttcaactattcgcagcctatttcagataatgtggcagaagcagtagcaggctttaaagcagaaaacgggattaaaatctacggtgataacctggaaacactggataaacttgctcatgaagttttattgaaaatcaaagatgtggacggggtaaaagatcccggaattattaaaaatattggtcagccggaagtaagtgttgttttggacagagataaaatggcagcttatggagtaatgccggcagacgcacaagctgtgctggaaatggcttttgggggtaaaactgcttcagaaatgtttgacggtgaaagaaaattcccgatccgtctccggtattcacaggaatacagaacaaatgagaatgatattgctgctttgatggttcctactcaggatggagcaaagatccctttaaaggaaataagtacgattgttaaagataacggagctgcgtttatttacagagataatatcaaacgttatatcggggttaagttctcaatccgtgacagggacctgggaagtacgattgcggatgctcagaaaaaagtagcaacaattgagctgccggatggttattccgtaggatggactggtcagtttgaaaatcagcagcgtgcctctcacagacttgcgcaggtggtgccggtgagtattctcatgatcttcttcctgctgtttatcctgtttggaaatatgagggactcgcttcttgtattagctaacgtaccttttgccttaatcggaggaattatcgccttgcatgttaccggaatcaattttggaatctctgccggagtagggatgattgcccttctgggaatttgtatccagaacggagtaatccttatcacagaatttcaccagaatgttaaaaatggccttgatatagatactgccattttaaatggcgtgaaatcaagaacaagaccggtgattatgactgcccttatggcatctatcgggcttatgcccgcggcgttgtctacaggaatcggttcagaatcccagaaacctctcgccattgttattattggaggattgattacagcaaccgtacttaccctgcttattttcccgattattttctggattttcaacagaaccaaaaaactcagccaaatctgatcttatctttcatttatattaattgagcctggaatattctgtatttcaggctttttagtaaaaggtttcagaaagtttttttcaatccggaaaaatgtgtaaatttgcagtctcaatacgttaaaatataaggtttgtccttcactggatgagaatattgaaagtttttttaataaaaagtttttggtatttaaaaattcattatatttgcacaccgaaaatttgaaaaacaataaataaataattttaaatcatggcaaaggaaacgtttaatcgtaacaaaccacacttgaacattggtactattggtcacgttgaccatggtaaaactacacttactgcagctatcagtagtgtattagctaacaaaggtcttgctgagaaaaaagacttctctgctattgactctgctccagaagaaaaagaaagaggtatcactattaatacagctcacatcgagtacgaaactgaaaacagacactatgcacacgttgactgtccaggtcacgctgactacgttaagaacatggtaactggtgctgctcagatggatggagcaatcttagtatgtgctgcaactgatggaccaatgcctcaaactagagagcacatcctactttgccgtcaggtaaacgtaccaagaatcgttgttttcatgaacaaagttgatatggtggatgatgctgagcttttagagcttgttgaacttgaacttagagatttattatctacttacgaatatgatggagataactctccagtaatccagggatctgctcttggtgctcttaacggagacgagaagtgggttaaaactgtagaagaattaatggatgctgttgatacttggatcgagcaaccagtaagagatcaggataagccattcttgatgccaatcgaagacgtattctctattacaggtagaggtactgtagcaactggtagaatcgagtctggtgttatcaacactggtgatccagttgatatcgttggtatgggtgatgaaaaattaacttctacaattacaggggttgagatgttcagaaaaatcctagacagaggtgaagctggtgataacgtaggtctattgttgagaggtattgaaaaaactgacatcaagagaggtatggttatcgctaagaaagattctgttaaaccacacaaaaaattcaaagctgaggtttatatcctttctaaagaagaaggtggacgtcacactccattccacaacaaatatcgtcctcagttctacgtaagaactactgacgttacaggtgaaatcttcttaccagaaggtgtagaaatggtaatgcctggtgacaacttaactatcactgtagaattgttacaaccaatcgctcttaacgagggtcttagattcgcgatcagagaaggaggtagaacagttggtgctggtcaggttactgaaatcttagattaatatcttaaaatataaaagcttccgtaaggaatctctttacggagctttttaactacgggcatcgtccaatggtaggataccggtctccaaaaccgttgatcagggttcgaatccttgtgcccgtgcaaatataaattatgagttcatttgtcgattttttaaaaggttcttataacgaattcagacataaagttgaatggccaaaatgggctgaccttcagtcttctacaattgtagtgactattgcgacagtgattctggctttatttacctttggagttgatgaattgttttcaaaagcaatcagcaacataataggaatgttaatcaacttgtttaattaacaaaaaagtattttcccataatgagcgaattgaaatggtatgtgctgaaagctatcagcggacaggaaaataaagtgaaaaactatattgagacagaaatcaaacgtctagggtttgagcagtacgttactcaagtggttattcctatggaaaaggtgatccagattagaaacggtaaaaaagttcctaaagaaagaccttactatcctggctacttaatgatcgaagctgatctgatgggagaaattcctcacgttatcaagaatattcctggagttatttctttcttaagcttaacaaaaggaggtgatcctgttccaatgagaaaatcagaggttaacagaatgcttggaagaatggatgaactttctgaatttgcaagtgatgttgaaattccttacgtagtaggtgaaaacgttaaagtaatcgatggacctttcaacggattcaatggtacagttgagaaaattcttgaagacaaaaagaaaattgaagtttctgtattgatcttcggtagaaagactccaatggaactaagctacatgcaagtagaaaaagtttaatattattttataaaatataagaagactgcttaatagcagtcttttttgtgtttattggattctggtaattttacaaagttaagatcagataaagacattgtgaaggtgacacccttaaagaaattcaatgatgctttgtaaagtctataacattaaggttgattttaaaattccaatattctattaacttataataatatatagatatttaattttcataatttttcccttttattagagtttttttaagtttattgaaattgttttgctaatgtttcaaactcataactctgttaactgcttctaagggatagtttgctttaataattttatcactgttttgtgattatacttgttttctcataaaggatctctttcgaattgtttaattcaattttggatggcatgtttcttgcaaccaaggtgttaactaatccattgattttatattttttatttcatacactgcttgcggttgtagaataattttctattttaagttgaaaataaaaaaatataaaaaaaacaggttggttaaaaacacaagtcttatataaacacatacccaatgacaaaaattatttcgatgatcactctggtgagtacatctgtgctcgcgaacgcacaggttggtatcaatactgcaacacctgaaaaggagcttacagtaaacggtacgatgaagacatcaggaattgttttcaagcagccaatggaaaaactgaaagcggatgagaattacactttcattatcaaatcgccggctccggagaacaaaattactgcttataatgactcttttgtacctaattcaccggctcccattaaccttattcagttcaagattacgtgtgatcctgcagataaagattgggtgaatcagtttgatacaaaaatcaattctaaaaaattcctggtagtcatttcttcttttggctttacacaacctacaagaacgttttctgccaactggctaactcctgtacctcagatttttgcttattcttcaggagggacgtggaagctgaaggcagactatcatggattctctccggattcatcacttcccacaggggtttggacgctaaatctgttggtatttgacagatcatatgccaaggatttcaattctacacaaaaccttaatgcttcaggaacaggggctgcagcaactccattaattcaataaaacataaattatatgaaaaaaattattgcgatactctttacgggttttgctgcattaagcatgcatgcccaagtaggaatcaatacaaatacgccgaaaggaactcttgatgtggaaggtgaaacattggtagagtcctatttaatagatacggaaaatacgaaggcgggagggaactaccttcttcttacccgttcaaaagacagttcaccggtaggcaaagttaagctgctggatatatcgcttcgtaatgtagcgcccgtaaatatgtataatgttgtattgaaaaatgtgagacaggatgaagtagtgaatctcaatacaggattagatgcgagcaaatatgttgtggctattacaggtgctgtttttacagaagcggtttcagcggcaaatatgacaacaaatccaaaatcgtatggatcttattccacagaaattactcaggtaaccagtggtggtaaaagctaccatgctattaatttagcttttaaaggagccggaactgtttcatctcaaaacggtacatggatgtttactttaaatgtctttgaaaagtcattggttaaagactggggaactttcaacggttctgtttcagcatcagcttcgcctggctattcaggagtttcaaccaacacacctctaggacttcaataaaaagctatgaaaagaaaaatttatatcacaataatcatgtgtctgggattgtttataaatgcccagcagggaaaagtagggatcaacacagcaaatcctacggaaacacttgacgttaatggtaaaacatataccaattctttatacttgagaaatccgggagaacctaccatgtcgggaggaagctttctggcaacttcagaaaatgctttgcagttatatgacccagctttggaaagcagcggattgtttaattaccttaaacttacccttaccggagtgccaggtacaggaattgaagattatgacacaaagatagacgctaacaattttcttgttgtactccataactactcattcaaactgaatgatggtacgaccagtgtaatgcttgactacggagataacggtattaatgataacaaacagggatctcctaatgttgttgcattcaaaagtaacgggacatggcatatcagagcaaagtttacagacagcagaattattgctatgaatgcatccactccgtcaagaacgtataataactttaccgttgatctgtatctgatggcatacaaaagattaattgaaaaacaaaacatcagtgatgttaatgctgatctgggaggaaatgatggctctacccagacgattaataaaccatcgggtttttaacagattttcccgtcagaatatatgaaacggctatttaattttaaatagccgttttatttttattacccgaaatacttaagaatttatttccgcgggataataactattttataaaactttttaaaaatcagtaatttccatttgctaattcaaaaatattttatacttttgcagtccaaaaagtaggtttgtcataggtgagtacgataacctactgaataataaatgcttccaaactcattaattattcaaatttaaaaaacaaacaatggctaagaaagtctttaaaatggtaaagcttcaggtgaaaggtggcgcagctaacccttctccaccagtaggtccagcattgggttctgcaggtgtgaacatcatggagttttgtaagcaatttaacggaagaacccaagataagccagggcaagttttacctgtagtaattacagtatacgaagacaagtcttttgaattcgttattaaaactccacctgcagcaatccagctaatggatgcagctaagatcaagggaggttctggtgaaccaaacagaaacaaagtaggttctgtaacttgggaacaagtaaagaaaatcgctgaagataaaatggcggatcttaactgttttacaatggactctgctctttctatggttgcaggtactgccagatctatgggattaagagtaacaggaactaaaccaactaacgcttaaaacttaaagaaatggcaaaattaactaaaaagcaaaaggaagctttaagcaaagtagaaaaaggaagaatctataaccttgaagaaggttcagctcttgtaaaagaagtgaacactacaaagtttgatgcttcagtagatatcgctgtaagattaggtgtagaccctagaaaagcaaaccaaatggtaagaggtgttgtatctcttcctcacggaactggtaaagatgttaaagttttggctttagtaactccagataaagaagcagaagctaaagctgctggtgctgactatgtaggtcttgacgaatatttacaaaagatcaaagaaggttggacagacgttgacgttatcgttacgatgccagctgtaatgggaaaattaggtccattaggtagagtattaggtccaagaggtttaatgccaaaccctaagtcaggaactgtaaccatggaaattggtaaagcagtaactgaagtaaaagcaggtaaaattgatttcaaagtagacaagtatggtatcatccatgctggtattggtaaagtatctttcgatgctgctaagatcaaagaaaatgctcaggaattaatccagacattgatcaaaatgaagccaactgctgctaaaggaacttacgtgaagtctatttatttgtcttctacaatgagcccgggtattgcaattgatactaaatctgttaactaatatttaatcctaaaacaatgacaaaagaccaaaaagttgtagcaatacaagagatcaaagatttgcttcaggatgcaaaagtagtatacgtagcagatttagaaggtttgaacgctggtaaatcttcagatttcagaagacaggctttcaaacaaaatatcaaagtgaaagttgttaaaaatacacttttacaaaaagcaatggagcaaattgatggagtagattactctgaaatgttcccatctttcaaaggaaactcagcgttgatgatttctgaaacagctaatgctcctgcgaaattaatccaaggattcagaaagaaagaagaaaagccggctttgaagtctgctttcgttcaggaaactttctatattggtgacaacaacctggatatgttggctaacatcaagtctagagaagaaatgatcggtgaaatcatcggattacttcagtctccaatccagagagttgtttctgctcttcaaaacaaacctgaaactgtagaagctaaagctgaaaaagctgctcctgctgttgaagaaactcctgctgctgaagctccagaagctgctgcagatagcactgaagaaacaagtgctgaataattacactcaaaaaattaaataaataatcaacaaaaacattacaacaatgtcagatttaaaaaatttagctgaaacgctagtaaacctaactgtaaaagacgtaaacgaattagctgctatccttaaggatgagtacggaattgagccagctgctgctgctgtagtagttgcaggtggagctgcaggtgaagctgctgaagaaaaaactgaattcgacgtaattcttaagtctgcaggtgcttctaaattagctatcgttaaattagtaaaagatttaactggtgctggtcttaaagaagctaaagatatcgtagacggtgctccagctccaatcaaaactggtgtatctaaagacgaagctgaagctcttaagaagcaattagaagaagctggtgctgaagtagaattgaaataatttcaattttattataaatatagaagcccgggcgtattgcccgggcttttttgttgtaaattattgtaatctgtattttaatttataattgtatttgattattgttaactcctgttttgttatattttattatgattgattatttagttaaaaatagtgatttattttgtcttttatttatctattgtttgttttatgtaaatttttattaataaaatatatttttgattgaaaaaatattatatttgtaaaggaaaaacacacataattggatagaaattattttctttcttatagtcataagatagtacttctgttgctgctggtggctgtgggaaaactaaatgttaaacttatatctgtaactgatggtaaagatgttttactttattgtgcagatatatatactcaacgatgcataactgatgtttcagttcatcatggggtggatggctcagttttacataaatctgctgatcataattcagtcaattcattgtgttctggctcacagcatcatctttctctttctaatcatctttttaccgagattttacttgttaaaaatataaagactattgccaatcataatgatctgatatttttgcatcttttcggcagacgaaatatttttttcaactttaaggagttgggaaactttcatattaattcagccaggctcattgatgggtttaaatttgttattaaaattcccgataagctgattcatacaattaaccattaattctgaacaatttacggtgtgttcattgtgaaatattcgttatttcatttattgtcagatgaaatcggctataatttcatttttaaaagcacatataaaaacatcatatatcattagaaatgaaagatcaattattaaaactagttctttccagttgatttgttaattaacgcacagatagggattaattcatccttaccaaaagttcttttgatcacttttcaatagaagtaaaatttgcaggagtgatttgcttctaggattacaggagtagaatataatctaaaagccaataggtaagggtagtatggtttagctaaaacagatagattaaatcaaaataaaatcttataaggttattgtgaaataatcataagattagcttgtgttgtggaggggttgctcatcgttggcagcctctcttattttaaaagcctcaaaatgagatgatttatttgttattgtggataactttttgtatctttgcccctcttttggcgcgaaaaattgtttgtaaatttataaaatactgaaaatcagctctttcattgtgtaaagcatggaagggatttcttgtatataaatacagcagaattactgcctcaaaagtaagaaaaatattttgcattacgctgtgaaaagatataccagtgttgcagttagaaagagccaggtacaaaggagaaagagcataaggtctttcgtgagcgccaaaaacacttctacctttacttttgccttgtttctcgttcttttctgatattttttaatgaatcaaaatattttttaaccctttcttaaaagttttatgagtaaaacaaaatcaacaactcaaggaaatccgagaattaatttctcatcagcgaaaggaaaaatcatcactcctgactttttggatatccaaatcgagtctttcagagagtttttccagcttgatacacttcctgaagccagaaagacagaagctctttacaagactttccaagagaatttcccaattacggattcaagaaaccagttcgtattagaattcttagactatctggtagattctccacgttattcaattgatgagtgtgtggaaagaggacttacttattcagttcctctaaaagctagacttaaattgtattgtactgacccggaacacgaagatttccagactgtggttcaggatgtatatttaggtccggttccttatatgacgccaagtggttctttcatcatcaatggtgcagagagagttatcgttacgcagcttcaccgttcacctggtgtattcttcggacagacttaccacgcaaacggaaccaaactttactattcaagaattatccctttcaaaggatcttggatggaatttacaacagatatcaacagcgtaatgtacgcgtatatcgaccgtaagaaaaaattaccattaacaactttattaagagcgatcgggtatgagtctgataaggatatccttcagatcttcgaccttgctgaagaagtgaaagtttctaaagctgcccttaaaaaagtggaagggagaacattggctgcgagagtattgaacacatggttcgaagacttcgtagacgaagatacaggggaagtagtttctatcgaaagaaacgaaatcatcctggatagagaaaccatcttggaaaaagaacacttagatcttatccttgatgctggagtgaaatcaattcttattcacaaagaaaacagcaacgaattctctatcatccagaatacattacaaaaagaccctaccaactctgaaaaagaagcggtagagtacatttatcgtcagttaagaaacgcagatccgccagatgaggaaactgcaagaggaatcattgaaaaattattcttctctgagcagagatactctttaggtgaagtgggacgttacagattgaacaaaaagttaggtcttaacattcctactacaactgaggttcttacaaaagaagatattattgctatcgtaagacaccttatcgaacttgttaactctaaagctgaggttgatgatattgaccacttgtcaaacagaagaattaaaactgttggtgagcaattagcaggacagtttggtgtaggtctttcaagaattgcaagaacaatcaaggagagaatgaacgttagagataacgaaatctttactccacttgaccttgtaaatgctaaaacattaacatctgtaatcaactcattctttggtaccaaccagctatctcagttcatggaccaaaccaaccctctgtcagagatcactcacaagagaagattatctgcactgggacctggtggtttatcaagagaaagagcaggtttcgaggttcgtgacgttcaccatactcactatggaagaatctgtccgattgaaactccggaaggaccaaacatcggtttgatttcatctttaggaatttatgcgaaaatcaacaacctaggtttcatcgaaactccatatagaaaagtggaaggtggtaaggttgatcttaacgctgatcctatttacttaaatgcagaagacgaagaagctaaggtaattgctcaggcaaacgttgaattgagcgataacggtgatttcgaaacagacagaattattgcaagattggatggtgattatccggtagtagaacctaatcaggtagaccttatcgacgtagcaccaaaccagatttccggtatttccgcttcattgattccattcctggagcatgatgatgcgaaccgtgcattgatgggatccaacatgatgcgtcaggccgttcctctattgaagccacaggctccgattgttggtacagggcttgagcaacaagttgcaagagattcaagaattttaattaacgctgaaggtacaggtacagtacagtacgtagatgctgacaaaatcgtaattaagtacgaaagaagcgaagacgaagatttagtacaattcgaatctgctactaaaacatacaaccttaccaagttcagaaaaaccaaccagagtacaaccattaccctaagaccaaacgtaagagtaggtgatgtagtggaaaaaggacaggtgctttgcgacggttatgctactgaaaaaggagaattggctcttggtagaaacttagtagtagcgttcatgccttggaaagggtacaacttcgaggatgcgatcgtaatcaacgaaaaagttgtgcgtgaagactggtttacttcaatccacgtagatgaatattctcttgaagttcgtgataccaaattaggtatggaagagcttacagcagatattccaaatgtatctgaagaagctaccaaagatcttgacgagaacggtatgatcagaatcggtgctgaagtgaagcctggagatattatgattggtaaaatcactccaaaaggtgaatcagacccgactcctgaagaaaaacttcttagagcaatctttggtgataaagctggcgatgtgaaggatgcttcattgaaagctgactcttcattaagaggagttgttatcaacaagaaattgttctccagaaatattaaagacaaaaagaaaagaactgaagaaaaacttaaacttgaagaaattgaaaacacttacaaggctaagtttgacgagttgagaaatactttaattgagaaattaaatacactggtaagcggtaaaacttctcagggggtacacaatgaccttgacgaagagatcatcggcaaaggtgtgaaattcactcacaagttattaacttcagttgaagattatgtaaacgttagcggttcagactggacagtagacgctgacaagaatgaattgatcaaacaattgattcacaactacaaaatcaaatataacgacatccagggagttaaaaaccgtgagaaatttgctatttcaatcggagacgagcttccggcaggtatcatgaagctggctaaagtttacatcgctaagaaacgtaaactgaatgtaggggataagatggcaggacgtcacggtaacaaaggtatcgtatcaagaatcgttcgtgaagaagatatgccattccttgaagacggaacaccggtagatatcgtattgaatccacttggggtaccttcacgtatgaacatcggacagatttatgaaacagttcttggatgggctggtcagaaactgggaatgaagttcgctacaccaatctttgacggggcaactcttgatcagattactgaatatacagacaaggcaggtcttcctaaattcggtcacacttacctttatgatggtggtaccggagaaagatttactcaggctgcgactgtaggtgttatttacatgctgaaactaggacacatggttgatgacaaaatgcacgcacgttctattggtccttactcattgattactcagcagccgttaggaggtaaagctcagttcggaggtcagagattcggagagatggaggtttgggcacttgaagcattcggtgcatctaacatcctgagagaaatcctgactgtgaagtcggatgacgtgattggtagagcaaaaacttatgaagctatcgcgaaaggtgaatctatgcctgaaccaggtattccggaatcattcaacgtattacttcacgagttacaaggtcttggactagacgtaagattggaggagtaaattaaagatttaattactaaaaattaaagaattaataaactccgagatgataagagcgaaagtgtaaagctttcaatctttaatctttataatcaaaaataaaattatgtcaaataaaaataaatcaagtagatttaataaaataaccatcggtttagcttcaccggagtctattttacaagactcaagaggggaggttttaaaaccggaaactattaactacagaactcacaagcctgaaagagacgggctattctgtgagaaaatctttggtcctgtaaaggattacgaatgtgcttgtggtaaatacaagagaattcgttacaaagggatcgtttgtgaccgttgtggagtagaagttactgagaagaaagtaagaagagaaagaatcgggcacatcaaccttgtagttccaattgcacacatctggtatttccgttcattaccaaacaaaatcggataccttttaggaattccttctaagaaattagatatgatcatctactacgaaagatatgtagtgatccagcagggtattgctaaaaaattagacggttctgattttgaaaacatggaattccttacagaagaagagtacctggatatcatggaaactcttcctgtagaaaaccagtatcttgatgattctgatccaaacaaattcatcgccagaatgggtgctgaagctgtggaagatcttttaaaaagaatcgatcttgatgcattgtctttcgacttgagacacaaagctcacaacgaaggttcaaaacaaagaagaacagaagctcttaagagattgaacgttgtagaggcattaagaggtgccaatacaagaatgatcaacaggccggagtggatgatcatgcgtgtacttcctgttataccaccagaactaagaccattggttccattggatggaggacgtttcgctacttctgacttaaatgacctttatagaagagttattatcagaaataaccgtttgaagagactattggagatcaaagctcctgaagtaatcttgagaaacgagaagcgtatgcttcaggaatcagtagattcattattcgataacacaagaaaatcttctgcagtaaaatctgaatcaaacagaccattgaaatcactttctgattcattgaaaggtaagcaaggtcgtttccgtcagaacctactagggaaaagggttgactactctgcgcgttcggtaattgttgtaggtccaaacctacagcttcacgaatgtggtattcctaaagatatggcagctgaactttacaaaccgttcatcattagaaaactgattgaaagaggtattgtaaaaacagtaaaatctgcaaagagaattatcgacagaaaagaaccggtagtttatgatatccttgaaaacgtgatgaaaggtcacccggtactattgaacagggcacctactcttcacaggctgggtattcaggctttccaacctaagatgatcgaaggtaaggcaatccagctacacccgttagtaactacggccttcaacgccgatttcgatggtgaccagatggcggtacacttgccactaggaccagaagcgatccttgaagctcagttattgatgttaggttctcagaacattctgaaccctgcaaacggttctccaattacggtaccatctcaggacatggttcttggtctttatttcatgactaaagaattaagctctactgagacgatgaaagtaaaaggagaaggtcttgctttctattctcctgaagaagcggaaatcgcttacgcagaaggaaaagtttccttaaatgctaaggtaagatgtaaattacctgttaaggaaaacggagaaattgtaacaagactgatcgaaactactgtaggtagaatcttattcaaccagattgtacctaagcaggtaggatatatcaatgaacttcttactaagaaatcattgagaaatgtaatcggtaagatccttgctgatacagatttccctacaactgtgaagttccttgatgcaatgaaagacttaggttactcaaacgcattcaaaggaggtctatcgttctctcttggagatatcgtagtacctgtggagaaaaagcagatgattgcacaatcaattgaaactgtagacgaaatcagagctaactataacatgggtctgattaccgatacagaacgttataaccaggtaatcgacgtttggacaaacaccaacgccggattaactgaaatgatcatgagcagaatgaaaactgaccaaggtggtttcaactctgtatacatgatgcttgactctggagcgaggggttctaaagaacagatccgtcagttatcagggatgagaggtttgatggcaaaaccgcaaaaagccggttctaccggtgcggagatcatcgaaaacccgatccttgcgaactttaaggaaggtctttcgattctagagtactttatctctacccacggtgcccgtaaaggtcttgcggataccgctcttaagacagccgatgccggttacttaacgagaagattggtagacgttgcacaggacgttatcgttacagaagacgactgtggaacattaagaggtacagaagttactgcacttaagaaaaatgacgagatcgttgaaaaaatctctgaaagaatcttaggtagagtatctttacataatgtttacgatcctgaaacagatgaattaatcactgaggctgaccaggtaattactgagcaattagcgaagagaattgaggaggctggattagaagctgttgaggttcgttcaccattaacttgtgaggctaagaaaggtatctgtgcgaaatgttacggtagaaacttagcaacaggtaagatgatccacatgggtgaagcggtaggtgtaattgcagcacaatcaattggtgaaccaggtactcagcttacgttgagaactttccaccaggggggtactgcaggaaacgtatcagaaaacccatctatcgtggcaagaagagatggtatcgttgaaatggatgaagtaagaacaattacttctgaagatgaaaacggtaatactgctgaggttgtggtttcacgttcaacagaattcagattagttgctgataatgagtcaagaactccattaatggtagctaacgtaccttacggatcgatattatctgtaaaaccaggtgataaagtgaagaaaggagatacaatctgtagatgggatccgtataacgcggttatcattgctgaaacttcaggtaaggtagaatatgaggatatcatccagggtatttcattccagcttgaaattgacgaacagacaggatttgaagagaaagtaatttctgaatccagaaataagaaagccgtacctaccttgaaagtggtagactctaaaggagttgagcaaaaagcttacaacttaccggtaggagcccacttgatggttaacgatggtgagaaaattaaggctggtaaagtcttaatcaagatcccgagaaaatctgcaaaagcaggggatatcaccggaggtcttccgagagttaccgaattattcgaagcaagaaacccttcaaacccagcggttgttactgaaatcgacggggtagtttcttacggaaaaatcaagagaggtaaccgtgaacttattgttgaggctaaaacaggtgaaagaaagatttacctggtaaaactttccaaccagattcttgttcaggagaatgacttcgtaagagcaggatctccgctttctgacggttctatcacaccggaagatatcttaagaattaaaggtccaacagctgttcaggaatacttagtaaacgagattcaggaagtttaccgtctacaaggggtaaaaatcgacgacaagcacttcgaaattatcgtaagacagatgatgacgaaagtatctatcgtggatggaggtgatactcagttccttgaaggagctcttgagcacaagtatgatttcttggaagaaaacaacagagtatttggtcttaaagtcgtagtagatgctggtgattctaaagaattcaaaccaggtcagatgattactgcaagagaattaagagatgaaaactctaagttgaagcgtgaagatttagcattggtagaagtaagagaagctcttcctgctacagcaactcctgtactgcaaggtattacaagagctgcccttcagactaaatcattcatgtctgcagcatcgttccaggaaaccactaaagttcttaacgaggcagcagttgctggtaagatagacgatcttaacggtcttaaagaaaatgtaattgtaggtcacagaattcctgcaggtacaggtcttaaagagtatcagaacgttattgtaggttctaagaaggaattcgaagaccttaactaaaattaatgatttgaaatttgggatttgaaattatttttatattttcacaatctcaaatttcgaattttaaaaacataatttataacaatggacaacaatcaaaatccacaagacgggaacatcaacatcgaattaaatgaaatggtagctgctggtatctatgctaacctggctttagtaaaccactctccatctgaatttgtagtagactttattcagttgatgccaggtgttcagcaggcgaaagtaagatcaagagtaattcttgctccacttcacgctaaaagagtattaaacgctcttcagcagaacatcgctaactacgagcagcagttcggagaaatcaaagaggttgagcctttcgtattaggaggaaacaacgttcaagcgtaagatttcttttacaataaataaagaatgccctggttttttaccggggcatttttttattatctgttttgcatataattcactaatcagtttctttttttctccttttttatttttcgcaatattattttaaaaatatactaaaaaaatgtaaataatgtaatttaatatattaatgttaatttttgttataaattattgataattaatttaaattagttaataaattcgtttttcttgattaaatttgtgaaaaattgaatggaatgaaaatctaccctattgcagtagctttactctgcgtcaatgtatgcgcacaaaagcaaaatacacttaaagacaatcaaaaacacttgcagaagctgtatgctaaatatgacaaagaccttaaaaaggctcataaaattgcaaaagcggcaggaatacctcctaattcatacaatgaggaagactataaaagaacaatggatcctgtaacagggagaacaaactttgaaggactggcaaagataaacgaagatatcttaacaggtaagtatcagccttcacagcctatgtcttttatttctaacaatacctctgctacaggtaaaatagtaaatgaaccctggattgaaagaggtccgtatagtgtaggaggaagaacaagggcaatcatgtacgatccaaatgatcctacaggtaaacgggttttcgcaggaagtgtttccggaggactttgggtaaatcaggatccttctgtagctgctaatgaatggcagccattaagtacattctgggcaaatacttccgtttcaagtattacttacgatccaaacaacccacaagttttctatgtaggaacaggagaagctccaactgctgatgcagtaggatcgggaatatggaaatcaacggatgctggtgtaacatggacccagattttcaccattccggttacttattcttcatccggagtaagaaacggtaacttttatattaatgatatcaaagtaagaaataacaatggagtttctgaagtatatgcaggggtaagtggctcttatgtaggaatttcgtttaatgacggatggcagggattaagccaggccggattgtacaaatctacagatggaggagcaacatttacaaaaaacagcagtttattggctcttaacacaactactggtgtaaccagcacaacaggatattctattcagcagatagaaatcggagcagataactcagtatgggtttctaccagatcttccagattttcaaatatagattccggagggcgaatttttaaatccgctgacgggaatacatttaatcaggtatataatgtagggaacagtggctcgagagttaattttacactttccagaacagatgccaataaaatatatgcattcatgcagggagcatcctcttcagaacctatcagaattgcaaaatctacagatggaggaacaacctggctggcaactaatgatgctgcaccggttttagcattgcctactgctactgataccagtattcctgctaatgacttcacaagaggacagtctttctatgacctgatcattgcggcagatcctttggatgataatacactttatattgggggtatcgatttgtataaatctacgaatggaggaacaagctggacgcagatctccaagtggtccaataacaataatatggccgctttacaggtttcacaggtacatgctgatcagcacgaaattgtattcaatccttataataactatggaacagggcaaatgatgtttggaaatgacggaggaatctattatgctgccaataaagctaatatcggcgctgtaggtgggtttgcctccagaaataccagatataatgtcacccagttttactctgccatgctgaacccaacgaaaacacctgttgacgaagaattattggctggagcacaggataatggctcatggtggctgtatggagtaccacaggcaaattatttccttacctctcaatctgctacaggaggtgacggaatgtataccgagtatgacgatcaggataattatgaaatcgcaagttatgtttacaatagccattatttattgactaacaactcatattaccttatctctaccagtgctaacagaaacatggggcactttgtcaatgaaattgctttagacagaaccaatgatgttttctattcttaccgttccggactgacacttttcagaacaagcggactttctgcaacagcaacatcttttaccaataatgtggttacagtgggaactgcacaatcaaacgagcagatttcatggatgaaagtatctccgtatacaactgcttccacaacactttttgtaggaaccaatctgggaagaatttttaaagtaacaaatgccaataccacagcatatgctgcaactttgttaacctcaccggtaacaggaactgtttctgatatagaatttggcgccaacgaaaatgagattattgtaactttttccaattataaccttaccagtgttttctattctacagatggaggaacaacctggcagaacaaggaaggaaaccttcctgacatgccggtaagaaccgtactcagaaaccccgacaatccgaatgaagtgctggtaggaactgaaatgggagtttggggaacaactaatttcctggcaacaactccggaatgggcttcagtgacaggaaatataggaaatgtaagaattaccaacttagattacagacctgttaccaaaacagttttggtttctacctatggcagaggagcatggacaacccaaaatacagtacctgctttgtcaacagctgagaccaaatctaagaaagacatgaccattatatatccgaatccttcaaaaggaatttcccatttgagatttaataccgctaaatacagcagtgtggatataagcatcgtggatggctcgggaagattagtttacagtaagaaaaatgtgaagtctgatgaagagttcggacaaaaacttgtacctggaaattatattttaaaagccgagtctaaaggtgaaatcgtatatagcggtaacttcctggtattaggacgcacaggcggtgatgatgattagaaaatgaataatcaattgtatataatattattttggatgctggcttcctgcgggatgccggtatcctctttatctcaggataaaacagtatctgtgatttccgctgaaaaaaaagaatggataggaggaagagctggcgtaagaggagcggtatatactgttaaactgaagaagaaaaataacagtgtcatcactgtaaaaacttttagagcggaaggaaataccattccgtttgtacagaataatgcaggtagtataatagcaataatcggaaatcttccctacaaaaatgatgaagatataaagactgctgatcagatgccggctggatcacctgtagaaaattctgttcccaaaaaattaaatccaaaagacaattggatagagtatactgtaaaaggttcgcaggtattgcataaaataaattttgaaagatttatatccatagaaacatctgaagagcctgcaccttaaaattaatttcaatctttgaataaaaaattactttttatttttctctgttttccggtaatcatattattcagcaatgtgatgtattctgtagtttctcatgttaaaagagaactgtatgaaaagacacaatacagtattgcaaagaataatttcaggaaatccgaaaccatttgttttaccgaaaaagatcttactgaagcagaatggaaagaagaaaaagaatttacacttcatggattttcttatgatattatccggataagtaaagtgaatgggaaaaaatattttttctgttatattgataaaaaagatattatcatcaattctctattagacttttccaaaaaaattgcttttaaaaaaacatgcttaaagctgcagattaaccttcccggtaacaataaaagcatccttaagacaccgggcttttttgccgtttttgaaaaaaaggaattttgttttttttcagatcatttcttaaaaaccatttccaaacattataatcaacaggaaaatactcattatttatccattatttttccccctccggaaattcattgctgctacaatgaaatatgatattaatggtaataaatttaaataatgaaaaaatatataggcatagcagctttgttaggctgtactattgcacatgctcagcaaacacaggaaggatcaattgatgaggtcaatatccttggaagaaaaaaaattaagcaggaacgcgcagaattcaaaagacatgcacaatctgtagaaaccttgtctgaagaagatcttaaccgaaataatcccgcagcaattgaccagactttatccacaatgccaggacttcaggtagataaacgaacgaattttggagggcagaggctcgtcctgagaggatatgggaatgaccagaaatttaataactggggagttaaggcttactggaataatatgcccttaacaaacgccgaaggcatcactgttttggacgatgtggactttgcttacgtaaccaatgttgaagtgatcaaaggtccggctgcaaccatgtatggaggaggtgtaggtggagctgtgcgcttctatacacgtccggattttacaaaaggagcatcagtttcagaaaacgcaatgtttggtgctttcaaaacctttcagtcaagaacacagctgaatgttgccgatgataattattcagtaagtgctgcatacggacatcttgaaacagatggatacagacccaacggtggaggtttgaaaaactttttcaatgtcaatggtacggtcaaattgagcaaaaaagaccagttaagcttctttgcaagccaggcttattcctatgaacatacttcaggacagatttcatatgctgattattatgcagggattgataatggaaatgctgcttatatcagcaaaaatgccggcacaaaaataaaatccacaagagtaggattgagtaattccgtaagtcttacttcaaacctgagaaattataccactttattttattataacggaaatacagaaagtgtttcagcaggagcatatggagtgacaagttccccgaatgtagggctacgttctacttttaccctgaaaaatgaatttaaagactttgaaaaccgactggattttggagctgagatacagaattctgtttctacaacttccagctatcgcttcgatgggactaatccatcacagccattactgaccacaggaatgtccggagcttcttattttaagtataataataatcaatctacctattttgtgatcgattatcttacgtataagccctggggacttacattattggcaggaataagcggtaacagaaccaactatgacaggaaagacctttttgctttgccagggttggttgcaggccgtaaggaccagtctttcaacaagaaatatgacatggcctttacgcctcactttgcattacagaaagaatggaaacatcagatctttaatctaagctatagtgaaggctataattctcctacggcagcttcttcgtttataacagccaccaacaccgtaaatgatgacctgaaacctgagcgtgcaagaatgctggatttcagtgtacatgggcttttactcaatacaaaattagattaccgtatttcagcattcagaatagactattccgataagcttacacagctcacaattcctaatagtaagattccgggacaaacctattggacaaataccggaagtcagaaaaatacaggacttgagttcagcgtaggatatcagtacagaacagagaactcatttattgagagaattgttccctttgtaaatctttcttattatgacgcaaagtataaagattttacaaccatagtcggaggaatagaaaaaccttatgatcacaaatctgtggtgggtgttccaagaaataaatatgctgtaggattagatatttttaccaagccgggattttatcttgtgaatacctataactatctgggaaatgtttattctgattttaacaatgagaatctggtaaaaggttttgggttacttaattcaaaattaggatttaaaaagtcattcaataaactggatctggacctgtatgttatgggcaataatcttacgaaccagattaactatacctttttattcttggggagtaatatcaatgattcagataagggaagcaattatacagttcctacagaccttaacccggggcctggaaaagcttatttcttttatggattcaatgtaaaatacagattctaaattcaaaaacttactctatcaagttggttttgatgataaaataccctggtttttgccagggtatttttatacccttaaatatgaaaaataaaactgaatttgattaattgttaattttctttaataatttaaaaatatacagtaacgatatgtcatttttatatctttgtttatgaaaatgtagaaaatataagttatgattgataattcgtttgctgtaagcaagtttggctttcttggtgctgattttttatcagagctcgaaaagcatgctgttgttactgatataaaggccaaaaccgaaatcataagagaagggcaaaaaaataaatttgttccctttttaataaagggatctatcaaagtttttactcttaatgatggaagagaactcatctactattatattaaaccgaaagatagttgtctcatgaccttttcatctatcctgacggattatattagtagagtatatgcgattgccgaagaagattccagagcgattctcatccctgtttctgtaatgcatgaatggctgatcagatttccggagatcaacaaactgttttaccatgaatatgaccgccggttttccgaggtgatgaatatggtgaatgatgcagtttttcacaagttggataagagagtgctgaatcatatcaaacagcagattttgtccaccggaaacaaccctattaagattactcaccgtgaaattgccagcagtctgggaacttccagagaagtggtaagcagggttttgaaaaaaattgaaagcgaaggagaaattgttcagactaaagaaggtataaaagttcctgtaaatgaaaatgttaggatagtctaatttcaattgtttgaaaagtttatttctgttattgataaaaacaattcgactggtgacttttatcacctgattttgaattgggaactcaataagtttgttatatcataatttaatgcaaattgtatatgacaaaaactctcttatttttgtcggtactttcatcaggtcttgtctttgcacaggaagatctgctgaaagatattgacacggttaaaaccaatacagaaacttcacaacccgctttcaaagccctgcagattgtaacaggacaatctacaaaactggcagccaaaaaagaatggtatattgtggttgcccatagatttggagatataagtgcaggatttaaagactttttcggtctggatcatgcttcaaccaaactgggggtgatctacggtatttcagatgccgtttcagtaagcctgtccagagaaacaaacatgaaaacgtttgagggagctgttaaatacagactggtaaggcaaaatgaaaatttcccggtagatattgtgggatacaatgtattggctgccaatactgaactggataaagatacatatccacaccttaaattcagtgacaggcttgcctatcttacccaggcattgatttcaagaagattcaatgataagctttctttacagcttaccccttcctttattcataaaaacctttacgaacctactattgaaaacaaaaatcagtttttagcaggtttgggaggacgatataaagtttcaaaaagagtttctgtgaatgcagaatactttgtgagttttgacgatcacagtttttataaaaacccactatcacttggggtagatatagagaccggaggacatgtgttccagcttttacttacaaactcccagattaattctgatatcggatatcttaccaatgccaccggagcatggggaaagggacatattttctttgggtttaatctttatagagttttttaatatgaaaaagctaacatccttattgatattgtcgtcagcaatcatactgacggcttgtgacagcagaacttatgaagaaatttctgataatacccccatcacagtacctgtaaaatatacagcagatgtaaaacctgtagtggataacaactgcatcagctgccattctgccggaagctttaaaccactggttacctatgatcaggtaaaaaacaacatagacggaattctggaccgtatccaaaggccaaacggagatcccgggaaaatgcctcagggaggatctttatccgcagcccagatcaatattttcatcaaatggaaagctgacggactcaatgaaaattaaaaaaaattgatatgaaaaaattagcattattaagcgtattactgctttccgcgggttatgcttcagcacagaaatacagttctaagacaggaaaagtgacttttgaagcttcggttcctttgtttgatgacatttttgcccaggatgataataatattgtgatcctcaatgcagataatggtgaaatggcatcagtctcaaccgttaaaaactttcattttaaaaccaaattaatggaagagcatttcaatgaaagctatgcagaatctgcaaaatatccgaaaacaactttcaaaggaaaaattatcaactttgataagacaaagcttacggctagtcctcagaaatatactgttcagggaactttaaactttcatggggtagacaaagctgttgcttctgctgccacattatactcaaaggacgggaagatctatatgcagggcagttttatagcaaagcctgcagactataaagtgactattcctaaaatggttaccaaaaaagttgctgagaatgttaacatcgaatacaactatgtaatggtaaaacaatgagaaatataatcttagtgttaggactctttctggggatatgcctatcggcccaggaaaaagcaaaatcaatctttgatattgccagaagcggaaccgttgcagaagtgcaggaactgatgaaacaaaatccggatattataaatcaggtgaatgaaaatggtttctcaccacttattctggcctgttacagaggaaatgtcagcgttgcagattttctgattgacaatgtaaaagatgtcaattataaaagtcgtgaaggtactgcattggccggccttgccattagatacaataaagatctggtggaacatctgcttaagaaaaaagcagaccccaatattgcagacgctaccggatatacccctttattctgggctgtaaaatcaggaaataaagagctgatagagcagctgttgaaatataaagcagataaaacaaagaaagattcaatgggaatgacaccttttgaatatgcattacaaaccaacaacaaagaaataattaatctcttaaaaaattgatatgaaaaaaactctactagcgcttagcgtacttcttgccaattttgcattggcgcagttttcgtcaggaacggtaaacttaccggcaacttccatgacggtgaaattagatacgactcctaccggagcaacgattacagtaacaggtgacagcaactctatgttaggaatcggctttggaactgtgggaatggctccgggatcagacgggtttatttacaactcatctgctaacagagattatacatttatcggaatgacaactcctaccgctgatgcagttcaggactggattgaaacttccaacactgtttcaggatctacaagaactgtagtggcaacaagaagtctttccggaggagcaggcgattttgccattgccaatgctgcaggaacaattaatatcttctattcccgtaaaagtggaggtacttctttaggatatcacgatgcaggacgaggatatgcaacattaacaatgactgcagcttctttgtcgaccaatgaaattgctgctaacaacaaaaaggtaaatctttacccaaatcctgctaaagcaacagtaagtttcaaaaactttgataaaatcaagactgttgatatctatgaagcaacgggaagaaaggtgaaatcagtaaagcctgaaggcgaaagcatcagtgttgcagatttacaatcaggaagttattatgttgaaatcctgctgaaagatggaaccatatcttacgaaaaactgattaaagaataatttttcagaaaaaacacacctaaatattttttaaacaaggtacctctgatctgtcaggggtaccattttttttcttaaagtcccgatgtcagggcgattgcgttaaaattcgtatatttgtgtatatccggattcttaacaaaaaggcaatttttagctttataacttttacgcacaatggaatttaaaaccttagccaatatcacaacagatgagcttttatcagtattcaattattcattttcagattacgttgttccttttcatttaacgaaagaggtacttatttcaaaaattgctgcagaaaaattagatatgagtttatctgcaggggcatttgaagatggcaaactcgttggctttatccttcagtctgaaaaagttgaaaatggtgaaaagattatttacaatggcggaacgggagttattccggaaagcagaggtaagggattggtgagaaaaatgtatgattttattattcctgttttaaaagaaagaaatgccaatacattattgctggaggttattgaaggaaatcagcctgctatcagagcctatgaaaacctgggtttttcggttgtgcgaagattactttgttttaatggaagtatccagcagggaaaagaaaatgctgaggtttctattaaggatttgaaagactttcaatgggagttgttacgctctttctgggatatcgaaccttcatggcagggatctgttttcgtgctggacccgatgccggaaagctatattaccttgggcgcttatgatggagatcagctcgttggatatattgtttatggggcggcagctaaaaaaatataccagtttgcagtagataaaaattacagaaaccgtggaattggcacaaagctttttaatgccataagagaaaaaaatggcggacaaaccatagccttgaataatgtggatgattcctcggaaagtaccagcaaattccttagtgaaaaattaggacttaacaactggctttcacagtttgaaatgaaaagaactatttgatgatctttaattttgatttaaaaaaataagcgttttaatatacttttaatcatttaaactttccaagcagaaatatagaatgtaactttgcggaaaatttaaaacaatgaagcgaggaatccattttttactgttgctgatctcttttacgacatttgcacagcaggtaaatattgatacagctcaggttgtcatcccaggaagacaaaacagtaccgaagcacagtcaaagccttatgtgattatgatatctactgacgggttccgttatgactatgcccggaagtataatgcagaaaaccttttgaagttcgccaatgacggcgtaaaggctgaagcaatgattccaagctatccaagcattacatttcccaaccactggagcttaattaccggactttatccatctcatcatggtctgatcgataattttttctacgattacaagagaaaagaaggatatgcaatgagcaataagaaaaatgctgaggatggaagctggtatggagggactccgctttggggacttgccgaaaaacagggaatggtatcagcctctttaatgtgggtaggttctgccagtgatgcaggaggaatgaggcctacttattattatccgtatcatgagaaattcacgccttctgaaaaagttgaaaaagtggtaaactggctgaaattaccggaagataaaagacctcattttatttcattgtattttcctgaagtggatgggagcggacatcattacggtcctgatgctaaagaaactgaaaatgcagtacatctgatagatcaggctgttggcgatcttgttcagaaagtaaacggccttggcttaaaagatgtcaattttgttttcgtttcagatcatgggatgatcaaagtagacgggggcacacctcttgaaattccggctgttctttttgataaaaacagattcgatttttataattctcagactttgctaagagtttatgttaaaaatcccgatgaggtaaaaaaggtgtataaagaactgaaagccggtaaaacagatgattacgaagtatatcttgataaaaaacttccaagatatctgcattttgcagccagagatgatcaatacaacagaatcggacagattttactgatcccgaaagcccctaagatttttctggaaaaaggcaagaaaacttcggttggaaaacatggttacaatcctaaaactgttccggaaatgaaagccacattctttgcatggggaccggaatttaaaaataacctgactatcggagagtttgccaatatcaatgtctatcctttggtggcagaaattttaggactgaaaattgatcagcctatcgatggcaagcttaaagttttaaaagaaacactgaacgagaaaaaataatcttgaggattaaaacataataataaacgagtttcggcgcaccaaaggtgcgccgaaactcgttttaatttatcttgaaacaagacaagaaattaaaatctggaagaaaactccttcgcaaaatcctctaacttaatctttcctgtcacaggagaaccgtgatcaataaaatctttttgcacaacccctgttctgattcctctacccatttcaacatacaacttagccatatcttcgggtaatccggcctgaagcattccgtttaaagactcttcatcagagaattctacccatggaagctcaggtttatcaactgaagttcccagaacctttgcaaaatccgaggctgttcttacatcactcacaatataacggatattgttggtatttcctccttttaccagttcttcagcagctgctttggcaatatcattgggatgtacaataggtatttcaacacttgcaggataatttgctccaatgattcctgcattctgaattaatggaatatcgttgaaaaaattattgtaaaaatatccagcccttaaaaaagtaaaagaggtattttctacttcattatacaatttctcaatattatgaagacctgcgatagggccattttctacgggagattctgctcctacgctgcttaacattactgctctttttacatgggcttttttcaaagcttccgcataattttttcctgcattggttgtgttttcaacaatcttatccggactgattgctggaggagtcataacaaaaacagcatcagctccttcaaatgtctgagttaaaaagttaacgtttgtgatagatcctatggccggggttgctcccaaagattcaatatcctgttttctggcctcattgctgcttataacagtaacagtatgcccttcggcaattaattgttgggctaatggtttagctacatttcctaatgatcctgtgattacgattttcatatgtaaatatttttttatttctgggaacaaagttatatttgtacttacttttatacaagtacttaccctaaagtatgtagatatgacagctatcaaagagagttcaaccattcaggagaataaaaagacagtacaggattgtccggtaatgtacgttatggaaagaatcggcggattctggaaaccgattatcctgttcaatctttccaccggggaaaaaagatacagcgaattgaaaaaagcaattcctgccgtcacagaaaaaatgcttattcagcacttgaagcagcttgaagcagatggattaattgtcagaacggcaaaacctgtcattcctccacatgttacttataaattaagtgaagccggtaatgagcttgctcccgttattgatgcgatggctgcctgggcttttcaggatatggaaaggaatgataataaatgtgctgaaggaaacagatatatcaccaatcaggatcagaatgcttttagccggaatctgaaaaaataaaaacaggcgcttacgatgaagcgcctgtttctgttaatattttatagaagaattataaagactgcatatcaataacgaagcggtattttacatcgcttttcagcattctttcataggcctggttgatatcctgcatcttaatcagttcaatatcagaaacaatattgtgttttccacagaaatccaacagttcctgagtttctgcaatacctccaatcaaagatcctgcaacagaacggcgttggaagatcatcggtcttgtacttacctgcgtttcctggaattcacctacgaatcctacaagaaccagagttccgttcagagaaagagtttgcatataaggattgatgtcgtgctcataaggtaccgtatcaatgataagatcaaatttaccctttacagcacccatctgtgaatcatcggtagaaattactacatgatctgctccaagctgtttcgcatcatccgtttttcccggagttcttgagaataaagtaacttccgctcccaatccttttgctaatttaatagccatgtgtcctaaaccgcctaatcctacaactgcaacttttgaacccgggccggcgttccagtgtcttaacggtgaccacgtggtaattccggcgcatagaagcggtgctactgctgccagatccagattttcaggaacacttaaaacaaaatgttcgtcaaccactactttttgggaatatcctccaaaagtatgacctccaaggtgtttatcttttccgttgtaagtccctgtaaatccattctggcaatattgttccaaatcgtgtttgcagctgtcgcaatgtccgcatgaatctaccatgcatcctactgccgcaagatctcctgctttaaattttgaaacctcgcttcctacttttgtaattcttcccacaatttcatgacccggaactacaggatacaaagacccgccccagtcgtttcttgcagtatgaagatcagagtggcataccccacagtatagaatttcaatttctacatctgttgcggtgacttctcttctttcaatattcatttctttcagatctgctgtggtagactctgctccataagcttttactgtaattgtactcatttttatatttagtttatttaggataaattatagtgtttttcatttgttatgatcttattgctttacaacctgttgtcaatctgccgttcggagtggaaatccataacgatacaaaagtcgaaacttttcaatgaactgtacttatacagattaccgaattacttaccaattttacagacactatttcagttataaaggaaagtggtaattttggatagaattaaaaatatacttcatggaaaatcaggaggttgaaatctataatagtgtctcggaatataataaaatggccaatcatgaaacccttcatccgttggtcagtattattgatttttcaaaatccgatcttatctgtcaacataaaaggaaattcggcttttataccgtttttctgaaagatgttatgtgcggagacatgctgtatggaaagcatagctacgactatcaggaagggacactggttttcattgctcccgggcaaacctatggaatctataacaaagataaatttgttcagcctgcgggctttgctttgatctttcatcctgatttaataaaaggaaccaacttagggaagaatatgaaagactattcctttttctcttatgatgtgcatgaagccttacatctctcagaaaaagaaagggaagtggtactggactgttttaaaaatattaagctggaactggaacaggctattgataaacacagtaaatctttaattgttaataatattgaactgttccttaattactgcatgcgtttttacgaccgtcagtttattaccagagatcatatcaaccagggagtgatcgggaaatttgaaaatctggttgatgattacttaaaatccgaggacccgaaaaatataggttttcccatggtcaattattttgcagaaaaactgaacctgtctgccaattatttcggtgacctgattaaaaaagaattaggtatttccgcccaggaatttatccacaataagcttattgatgtagcaaaagaacaaattctggatcaggaaaaaacaatcagtgaaatttcctatgatctagggtttaaatatccgcagcattttacaagactgtttaaaaccaaagttggtatttctccgagtgaatataaaaccctgaactagttttttaacacgaataacactaatcttttcacgaaagacacaataattattagtggatattagtgcgtttatttgtgacattcgtgtttagaatattttatcacaaataacactaatctctttaccaattgacacaataattattagtgaatatttatgtactcatttgtaatatttgtgtctaaataattaaatttaaggagaaaagttttactattctaaaaatgacactaaacccgaaagagaccgctgtttttgagacccgttttggaagaattacagcattaaaagaagaaggcgttttccagattaaaagcatccgttatgcccactctgaaagatttaaaaaaccggttgctgtagaagctactttatcttcaatcatcatttctcctgaaaaaactccggtttgcccgcaggctttaagtccgcttgttgaaaaaatgattggagcgactcctgttgaaagttttgaacccgatgaatctacccaatatctttccgtaacaagacctgaaatcgtttctgaaaacgaaaaactgcctgtcgtggtttggatccatggaggttcccatgaaataggttgtggcgatcttgccactgctgatcctgctgaatgggtgaaagaacagcatattattgttgttacggtttcatatcgtctgggacttttcggtttcctgggaggagatgaaaaaagacctgccaatctagggctgttagatatcattgaagctttgaagtggattaaaaaatatattgcagatttcggaggtgatgaaaataatattactcttttagggcaatcttccggaggagatgccatcgcccatttgatgatttcggagggcgttgaaaacctgtttcaacgtttgattatccagagcgctcctctgggcttacgtcataaaagacagaaaatgtctgcagaatttctgaaaaaaactgaagtattgaaagatgaaaccgatgttttaaaaatgatggatgaatataagatatttgttccttcagtaataaaatatggtttaaaagcagcaatgccttttggtacgcagtatggattcttccctttgtgtaaggaagaagagtcggtggagatgtggaaaaaaaatgctctgaaatatgatgttctgattggtctgaataatgatgaaactgcattttatctcaagacatcagaagctttaaataaatatttcggaaaagggttgggactaaagattatggataaaactgttgaaaagactacagaatttatctatggagctccggcaaagcaatttgcagaaaatctggcagatgccggtggaaatgtttacctgtttagaattcattcaaaactgaaagataatcatatcggggcaccgcattgtattgaccttcctttaatttttggcaacgaagccgcctggaaatcttctgaattgctgaaaaatattccctggagccgcattcatgagaacggaaaaaaactaagagcgctctgggcagaatttgcgcgcaccggaaaaatagctgatacctcagaaagaccggaaatcctggagctccgaaagatataaccgcacatcaacttaccaggacctctcaactttatccatattcaattaaagacttaaacattccctcctgtggagggtggcgaaaattcaaagaattttggacggggcggtacactgaagtatcaacactcgttttcaattttaatgtaaattttatatattgatttatgtttttggtataaaatgttcattcataattgcaatttttaatgtatatttaataactaaaccataaaaaataataattatgaaaacaaacaaagatttcaaagtaaaaaaaattaaccgtcaggagttgaagagcttaaaagccggagatatcaacagaggcagagtgtgctgtacttcaaacgaagacggacaatgctgtgaatgggctaaagatatctggtactgccagtatatctattgctaaatacagtctgataaaatataaggcatacataattatcatgtatgcctttttatgtatagaagtttattttattccgggatccagacgcttacatttcccgccggaacaggaaagttgccccagccattttcatcaatgatcactttgtctttacatcgtttcaataaatctttaaactttttcccggcgtaaagtgttccgacctccataggcttattataagcatctttattgcttaagactacggcacagcctgtatgatcatcgtctcctgtacgaacccatccgagacagttggcgtcctcaaaataatcatgctgatcaccataagcgtgatcttttcttgcctttaacagctcttcaataccgtctattttgggcatgaatatttcctgatcattaccttctctgtctttatccacataatgagctccatagagatcaggataaaacacacatggatagccatcttttctcaataaaataagtgcataagcaataggtttgaaccaaggctctacaggagcttcgagatcctgtaatggctgtgtatcatgattggctaccaaactcacagaatgcatggggtctgcctgagtaagagtttcatcgaaaatccgtcggagatcgtaagaactcccttctctggaagctgtatgaaaattattctgtaacgaactgtcgaaaagactcatgcagccttctgtcacttcaatgtatttctggagaagattaagatatcccggagcccagtattctccaacggcgaaaatatcttttcctgaattggagcgtaaaagcgtaagccattctttgtaaaaatcaaaagaaatatgttttaaagcatccagtctcaccccatcaaaatctgtctggtcaaaataccattttgcccaattgttgagttcttcccgtacaaaaggattccggtgttcgatgtcattatacatcaggtaatcataatttcctttttcatcatcaatcatttcttcccagtcgtttccatattcagattggattttaaagatatgagagtccataccttctgcgtaatccacaccactgaaacaggtaaaattccattcaaaatcagaatatttttttcctcttccgggaaaggtaaatttggtataagactctatttcgatgacatcagagattactttctctctgttttcttcgtctacttttactactttgaatttttccagttcgtcaccgcctgctttatgccccagaacaatatctacaatcacttgtatattgtgtttttttaaggctttaatagctttgatataatcgtttttggtgccgtattttgtaggaatagttcctttttgatcaaactctcccagatcatacaggtcataggcatcatatcctatcgaataaccgccgtttgtacctttataagctggaggaagccatgcagatgttattccaagttttgctaaatatccggcctgtttttcggcctctttccataactttccgtctccttcagaataccagtggaaaaactggatcatggttgggttcatacatttactgatttggtggatacaatttagtgaaaaaatatgacctagtcactttcaaattcttcaaacgggatttttagttgaacggaaacctgctttttttcttctgtgttaagatgagaaagagataatcctaataagcgtaccgccttatcgaaaggccgaagttcccatagtttttttccggtagtaaaatactgttcgggagaagaaaaatattcttcctttgtgatacttcttgtgaaaagagagaaatctttatactttatttttaatgttaaagtccttccgagaatattgtttttctgtaatctctggtgaagttcctgtgccagactttccagtttttcattaatctgctgttcatccagaagatcttcaaaaaatgttctttccaccgctacacttttctgaatccggtgaggttttacctcagaagtatgaataccgcgcaccacgttataataatgctggccggactttccaaaaattcttatcagatcttcaagagatttcttttttaaatcttttcctttataaattcctaaactaaacattttgttagctgtaacctttcccacaccataaaatttttctacaggtaattcttccaggaattcttccatcttatccgggtggattgttttctggccattgggtttattgatatcggaagctactttagccaggaatttattgaccgaaattcctgcagaggctgtcagtccggtctgctcaaaaattttctgacggatttctttggcgatgaggttggcagactccattccctttttattttcggtgacatcaagatacgcttcatccaatgataggggttctaccagatccgtatattcatagaaaatttcccggatctttttcgaaatttctttatatctggcaaagcggggaggaacaaaaataagctgcgggcatttttctttggcagtcttactgggcatggcagaacgaacaccatattttctggcctcatagcttgcggcagcaacaacaccacgatgctgtccacctacagcgatgggcttacctttcagtgtaggattatcatgctgctccacagaagcatagaatgcatccatgtccacatgaataattttacgaagaggcaaagaaaaatccatatacaaagatatggattcctttattgacggtaaatttttttgtaggagggaagtctgaagctgggagagggaagttaatgaggacaatatagaaattgatgacctgtttattgaaaattaataaaaaaaatcacaagctattcttagtgcatcaactacttccagcttccagcttcaatcttccagcatttactccttcagtctcatggtgagcagatgcggctcaaaacctgctttttcataagcttttacagcagattcattttgggcatatacatccagtcttacttcattcattcctctggatttcgaccatgaaataagttcatcggtaatcactttattgattccttttccacgatgttcaggtctgacgtacataaaacctaaatacgcatattctttaaactgatagtaatctttctctgcttttttaatcagggcatatcctgatgcaataatctcattattttcttctgcaacaattactgtcgcgtccggagactgtatcagatgttttaaatcataataatgaatttctccttcaataagcgtactattgaaaggtctttcagcagtcacaatgccctgttcaaattctaaaagagtttttaaatcctgttctgtagcttctcttgtgatcatggtgttatataaataaaatgttaaaactcattgaaagcagatcatttccaatgagtttttatgttttaaagttaatggcaactattttaaaagttgatcgatggtttgttgaatctccggatcttcaggtgatattgcgtaatattttgcaattgaagatttctgatcgatgaccatatatctcgggatccagttaagatctacataattattaaaatcatttttccagcctgtggaaaaccaataattttctttgtgtttcatatcaaatctttcaagacttttttcaaacccttcttttgaacggtctaatgacagaaatacaaaatcgatattcttgtttttttcttccagttccttagcttttggaagtgcgtttaaacagtctctgcaccatcctgcccagaaatcaataactaaaacttttcctttatgctgatcaagaatctgctgtatggtcacactttttccgtcttcatcttccaatttttgctgtaaggcttcttttgaaaatcctgttttaaggacagccgggactttttgtgaataacttatcccaaaaattcccatcataaaaattaatatcaactttttcatctcgtacaatttcatttgtacaaatctaaacaatggatggcaatctgagattgatttcttcggaattaggaaaaatttataatattgacggactctatgggtaggagagtggaaatctggaaacctccccttcaaaggaggagaatgttgcgtcttcagttgtactatagggttatttctactgatagtttttaatcaggccttttacgactgcaattacattgggcattgctttgttggcggcattcaatacttcttcatgggaaacggcgaaagcaatatccggtccgccaagatctgtgatcactgaaatacagaacacgtccatccccatatgtctggcaacaataacttcaggaacagtgctcattcctaccatatctccgccaattgctttgatcattccatattctgcaggagtttcaaaagtagggccttgcagtgccacatagactccctggtgtattttaatatgctgatcagtagcggcctgttccgctgtggcaatcatttttttgttgtaaggttcgctcatatccacaaaacgtggtccaagctcatcaatattttttccacgaagcgggtgctcaggcatcatattgatgtgatctttcagaataacgatatctgcaacgctgtagtctgggtttacgcctccgcaggcattcgaaagaataagattttgaattcccagcagatgaaaaactcttatcgggaaagtgaccgtttccattgaatgcccttcatagtaatggaaacgtccgctcatcatcagtactttttttccttccagctttccataaaccagtttcccggtgtggccggccactgtagtttgcggaaaatgaggaatgtctttgtactctaaaacgtggatcggttctacttcattttgtaatttccccagtccggatcctaaaacaactgcaaaatcaggagtttcctgaataatatttttgatgaaatctgcagtttctttaattttttctaacataatctaagatgatttgattgaattcttctttcttatcaatcaatacattgataggccagtagtaaacaatttctctaagatagtcaaaagttttcagacgtacgtaatctttctctgtggttaatatcagtttatattctcctaattttttatactccgcaagtatttttttaatatcatcatccgtaaaattatgatgatctcggaactttaaatgtttcacccttttcgagaattttgccagatgctccagaagcggtttcgggttggcaattccggtgatcagtaaaatatcgtaataattcaggttgttatccggaagcattttatcttttccgtatacattttcgtcgtaaccgatggaagaaaagaatactttttgtccatatgaaggttttattcttgagatataatacctttttgtttcctctgtcaactcatcaggacatttgctgaccataatgatgtcggctcttttgtatcctgaacgggattctctgaggtctccggctggaagaagataatccttgaaaaacggatcattaaagtcggtcatcaaaatattgaatcctgccttaatcgctctgtgctgcatggcatcatccaatacgagaacctccagatccatatcgctgatcacttttttggcacccggaacacgatcttcagaaactgcaatgacaaagcggtttttaaaacgctcaaaaagctgcattgcttcatcacctaccattttgtagttactttcgtaattggttacttcgtagcctttggtcagccttccgtagcctcgcgaaagcacaccggttctgtaatgtttggatagaaactgggcaagatacatcaccatcggggactttccgcttccgcccacagaaaggttcccgacattgattatcggagtcttgaatttagttgacttaaaaattcccagatcatacattgtgtttcggatacccgttaccaaatgataaccgagggaaaaaggataaaggtaccatcttttcatacgtttgcaaaaataggaattttcataagcattgatgtaatattctcaaagacttttcaacaaatatttcgttaaattaaagtatttttgtggagttattacaatactttgagatactttattgaattttcttacaacggaaagaattatttcggctatcagatacagccggatgctatttctgtacaggaagaactggaaaaggcgctttctacaattttgcgcgaagagattaaaactacgggtgcaggaagaacagatacgggagttcatgccaaaaagatatttgcccattttgatacggaaaaagagttggatgatcagcttccccgaaggctgaacagctttcttccgcctgatatttccattaaaaggatttttcctgtaaaagatgattttcatgcccgctttgatgcgacatacagaacctatgaatattatatctccctggaaaaaaatccattcacgcaggaatctgcctggcagcactggaaacgttctctggatgttgatgcaatgaatgaagcgtgcaaaattctttttgaatatgaagattttaccagttttgcaaaattaaaaactgacaacaaaaccaatatctgtaaaatttacaaagcagaatgggagcagaacggaactgaacttaaattcacagtttctgcgaatcgctttttaagaaatatggttcgtgctattgtcggaacaatggtagaaataggaaccggaaaactgaaacctgaagatctccgtaaagtaatcgaagataaaaaccgtaatgcagccggaacttcagcaccgggacacggactgtatctggtggatgtaggctatgaattttaaataaaacaaaaaaaacaaataatcatgttatcaatttttattcttatcggtgcttaccgatattacgcacaattagcagaaaggtttggaaaaacaaagtggaagtatggtgttctggctattggtatttatttaggaacccagcttttgttaggttttgcttacgggatgtatctgggtattacagatcctgaatccgcagaaaatgtaaattatacaggattttccgcagtgaatatcgttggctggttgatctctattgttgccgtttggggagtttataaattccttgaaaataaattgatcaaagaaagatctgtaaaaccaatagtcgaaattgaagaaatcgggaagacttctgaataagatctcatatactgaagtggatgcaaaagaatggttaatatattcattttgtaaatggctggtatctgaaactttctatgacgatttgcaaaagttgtaaaggcagtccgggtataatgtcttatttttgcatagaatttttattttaattctttctttcgattcgtacaatgaaaaaacaagatacctgggggattataaaaaggctgttctttatcggaatgaaatttcgttcttggttcatccttacccttatcatttctatatttctttcgatagtttctacttacaggccgtatcttaccatgcaggtggtggataatgatataacaaagcttcatgataaggctttgatgatgaaacatatctatatccttgtgggattggtgtttgctgagacaattttaaactttttcctggtttatttttcaaattttatctcacagaatgtgatcagggatatcagagagcgtttgtatgctaaactgatttatttcaagacttcattttttgataaaaccccgatcgggcagttggtaacccgtgcagtaggtgatgtggaaacaattgctactgtttatacagacggtttcctgatggtattcggagatatcctgagaattctgtttgtattggtgatgatgttcagtaccaatgttcacctgagttatattacactggctatcttacctttgatggtggtcattacgagattcttccagaaaagactgaagaaagctttcggggatgaaagaaactggacggccaatcagaattcttttgtgcaggaaagacttgccggaatgccgattatccaggtattcaacagacaggaagcagagtttaagaaatttgatgatatcaatattacccttaaaggggcattgctgagaaccgtatttattttctctcttttcttccccgtagtagaacttatttcatcattatttataggatttatccttttctatggtggttatattaccatcagtgccggagtggtcattgcattcattcagtatatttctatgctgattcgtcctttgagacagattgcagaccgtttcaataatatccagcggggaattgtaggtgcagaaagagtgctgggattaatggatgaagaaaattcaatgccgaataacggaacagtgaagaaagatcattttgccggaaaaattgaattcaggaaagtccactttgcttatgatgaaaaacaggaggtactgaaagggattgactttaaagtaaatccgggagaaacggtagctatcgttggagcaactggtgccggcaaatctactatcatcagtttaatcacaaggctgtatgacatcaattccgggaatattctgattgatgatgttgatttgaaagattatgagttgtataatctgagaagccatatcggagttgtactgcaggatgtattccttttccatggaagtatttttgaaaatcttgccttcggtgatgagagtataacactggataaaataaaagcaggagcgagagaaattgaagttgatcagtttatcgagcagctacccggcggatatgattatgtagtgagcgaaagaggttcatccatttctttagggcagagacagttgttatctttcctgagagcttatttatcagatccgaaaattttaattctggatgaagcaacctcttctattgatcatgaaagtgaaaagctgatccagagagcaacagaaaaaattaccaaaaacagaacttccattattattgcccacagactttccactattgaaaaggcagataagattattgtgatggagcatggtaaaatcgtagaagaaggtaaacatcttgagctcttggataagaacggatattatgctacactttacaaagcccagcttcgccatgaggtagaaatggaggaagaaaaagaatcataatccgtaaggaatgattccaagatcttttttccaggcatcaccatatttttctgttaacgtttttgcaacagccaggttgttttctttggcctgtttagatatttcatagcttatgatgcagttttggtaaaaaactcctgtatggtatttgtttttaaaatcttcgtggtttttagacatgataccgaactgaataaagtaaggaatgttttcttcttttgcacctgattttggatctttctgttgtgtaagcactgtaatttctgttttctgagcaaacagtaatcctgaaaatggtaatgccataagtaaaagcgctaatctgatttttttcatgagtattgatttgtaggtatgatagagaaataacccagaggttaaatcaacaaaaaagagaatcattctggattccctttttattaataaaattttgaaaacggaattggatttcaatcctgaattttcaaatgctttttaaaactgcagaatacaaaattctgaactgtttcaaaaggagtaatatgatcttctgtaatacattttatttttgtaaaaccagctccaaatttttcagttaatgactcttcatcatactgctgaatatccagtccgctgcatttggtgggaccatttttagaaaaagttccgataatcataaagttatttacattcttttctgcgatatcaatatattttgaaacctgctccggttttgtaaggaaatgaaaggctgctctgtcatgccagatgtcatacatttccgttggttcaaaagcagtaatatctgtagcaatccattttactttgttagcagcatctcccaatctttcctgcgccttttccaaagctttggcagaaatgtcaagaacagtaatgttttcatagccttcctcaagaagaaaatcaacaaggttgctgtcaccgccaccaatgtctatgatgctggcatcttttcccaatcccgaagatgtaataaagtcaagcgatgtctgaggttttttctgcgtccagcttacctggtcaggatttttggtttcatatacgttttcccagtggcttttgttgtcggaagatatcatgattcttttaattgattattgatctcttcaaatttattaattaattcgtcaagtttgccttgctgcttttttatggttcgtggtctcagataaaaccagttgaaagcaatccatgctgaggttacagcataggtcagaatggctgagccaagagtcattcttgatgtgtattcatacatataaaagcatattccgagaaacagcatgatgaaatagagattgagtatggtggtctgcataaacttctgcttattttttaccacatacaaactttggagatattcgttatttgattgagtctgatcaattttgtagaataccataaacattttgttgtaggcaagcaggaaaataaccattcccaaaactacaagtacaattccgatttttgtcgtgatcatttcaggctggtaacggtaccagatgaaaagaatcaataaggaagtggcaattaatccaatgttagcaaagaccagtctgcgcagattctgatttctgaattttttcagtttaccgagaagctcttccatattgggtttattggaagtctgctgcttccatatatttttaaagtcgatattagaatccattttctttaaacttttgcgttaatttttcttttattctgtgaatctttacccggatattggattctgaaagccctacgatatgggctatttcagcctgttttacctcttccagttccagtgaaatgatgatcctgtccgtttccggcagttccgaaatatactggtagagcatttgtatctgagactccatggattcctgctttttctcttccagatttaccggtaaatctgctttggcaaatttcttttccttttcaatctgccggagacagttattggaagcaattctgaaaatccatgttcctacgctggattcattcctgaatttgggaagctgctgccatacaatgataaaggtttcctgtgcaagatcctgtgcaagttcggtgtcattcacatatcccatgcataaacggaatatcctttgccagtagagttcgtatatctcttcaaaaaccattatttcgaagataaaaagttagtaagctggctaagataccaatccttgtcatcatacatgatgaaatgcaatccttttgaagcatactgcatattggcgttttttaaattcctgtactggctttcaattgttggcttaaggttaacaaaaaacgattccagaagaataagagaaggacattgtatattttttattttttctctgagatcggtattgagaaagtcgcagtacatttttgcgaatgtttttcggtctgacttcacactccatccgattacagtttcctgcatagaaggatctgcaaggagacgtgggattgcctgggcctgcatttttcggaactgctcgtcgttcatagcggttaattgagtaatggtagatgaacagtcattattttcttttgaactgaaattgggatcagacattgctgccaggcacggaagagcatcaacaataacgattttacctgcaagttcaggataatcggctgcgatagctaaggcaaggccgcctcccatactgtgtccgatgatgatgggtttattaattttattatttctgatataagctgcgattccattttcccaatctttaaaactggcttctgcttgtggttttgttccggcaaacccagccatcgttaaagtgtagcaagtgaagttgttttcaaattttgcagccgtttcactccatacgtctcctgaagaagcaaatcccggaataaagattaatgactggttaccttttccggttttctttacttcaaatggatatgctgtttgctgtccaaatatgttgcataccgctaaaaaaaataacatgatgataagaaggaatgtaaattttttcatgatttctaaagttttaaggtttatttgtcttttagagacgaatctttaaaaaatgttacacaaaaatttattttttttatgaaaaaaaatatttctccttctccgaaacccattcagggcaaaaccatatagaatttattttataaaaattaatagctcgtattattcaataataaaaattattaataatgaatcctgttaatctaatatccttccatagaatctgctgatgtcaaaataaaatcccggcactttatatttacctttttcaaactcctgataatcacattttcctttcaggctttgtgattgggtctccatctgaaacctgttgagcagtacatattcatcagttacagaaataacatgaaatcctgtttcacacgtcaatccatcaccggaagttagaatagcgtttaataagccgtgaaaattccctgcaattttttcagcagtggcgtcatcattgtttaagtgatacagataagcaagataattcattgcacgcagatccagcggattttcatccaaagcatccaaaaacagtttgattccttttgagagatctttttgtgaaataccttcaccacgataatatttggttacttcttctgctttcttgccgatcttatagggctgatattctttttgaaaggtatagccgaaatacagatgacgatattggctgcctgtaagaagcgtatcattctgttttaatctctttaaaagtttcggataatagaattccgagtttttatcttcgatatttttttgaatggcagcataatccggtgctttgaattccattttctgaccgtgcagaaaagtgagcagtgttaaaaagaataatgagaaaaatgctttaataatcatggtttgtataatgttgttgcaattttttataaagctaaaaatacgaaatatgtagtaatcgaatattattaactgacaatctgtaaaaaaaatgataaaatattgtaaaagtgttactttgtgttaataaatttactaactttattcggaatttgagaagttacccctaacatttgaaggggtaaatggaatttttaactaaaaaaccaaaaatattaatgagcagtagtatccaagatgaatttaaagtcttcaaagacgaattgagaaagttgaatattgaagtacagaaagtagtaaaagtaggaaacggcagtatggatttccatgaggttttctataaatctccaagatatcaggaggtaaaaagcatatatgtccagcgtcataatctggacagtatgattgaaaagtttaaacaggcctatcattaaaatagaaatagcgccgcagagaacctgcggcgctattttttataaagctctgagattttaatccttatccagggtagagatctttttagtatccttcattccgatataaacaatcagcgaaaagagaatacatccggtaatgtaccagtaaaaatattcttcagaaccaattttcttaaaccaaagcgcaatatattctgcagttcctccaaatacagctaccgtaatagcataaggaagacctacgccaagtgcccggatttcagaagggaaaagttcagcttttactactgcgttgatggaagtatagccgcttacaataattaatgcagccatgatcaggaaaaatgcactccatattgaagtggtattgctgagggctgtaagaagcggaaccgtacataaagttcccagtattccaaatcctaaaaggagcggtcttcttccgattttgtccgaaagtgctccaaatacaggttgaaggcaggcaaatataaataaggaaataaaagagaccagtgtagactcttccttagtaagatgcacggtattcactaaaaatttctgcatataagtggtgtaggtataaaatgccagtgttcctcctaatgtaagacctaccacagtaagtaaagctttggggtgtttcagtaactcctttaccgttccttttttcttctcactcatttcttttttattctcaaaagcttcggtttcatggagattagcccgaagatacaacgcaataatagaaagcatagccccgatcacaaaaggaattctccagccccattcttcaagctgggtctccgtcagcagcaatttctgcaaaataagctgaattcctaaggcaatcagctgaccgccaattaaagtgacatattgaaagctagaataaaatcctcttctgtcctgtgtagccatttcgctgaggtaagttgcggagactccgtattctccaccaacacttaagccctgaagcagtcttgcgagtaaaagtaataaaggagccagaatgcctatagatttgtaagttggagtaagcgctatcagtaatgatccaaaagacatcagcagaacggaaagcgtcatagctttttttcttccgattttatctgcaatactcccgaacatccaaccaccgattggcctcatgagaaaacctactgcaaatattccagcagtattcatcagttgtgcattaaggtcagaatccgggaaaaaggaatgagaaaaataaatggcaaaggcagcatacgcataccagtcgtaccattcgacaagatttccgatagatccgcctatgatagccttgattctttggccagtagtgattgaggtcgagttcatagtataattccagaaagttttaatgggattcaagatacaaatttcagaaaaaaataaaccgtactgataaagaacggtttagatattatacattgtatatttaaaatctgtatcctatcgaaagtccgcttctgaaacctgcccagggaccgtcaacttttattctggctccattggcattggtttctactgtatattttacaaacggaatatcaaggttttcgatttcctttttcagctgagcctgcatatcaggagtcaatacataatctgaggtcatggtaaaatccccttttccacttccgtaatgggctccggcaatccagaagtcaagcacaagattctgacttcttgtcaaaaagaattgcactccaaccatcagtccgccgctgtttcctttggtatctccctggcctttaatagggatctggtaggtaaccccacccggacccttataatcataataaaaatcaaaagtattggaagtgacactggagtagcggtaataaggtgcaaaataaaatcctttgccatagcctttaccgatataaaatcttggttcaatggtgaaattggttgcttttactttaagattctggaatcttttttcatcttcatctttcagaaaagcattaatgaaaggcacttttccttccggcatagttccaaaaccgatattcacagaaaaccactggttgatggccctttcataagacagattgatatttctgaatgcatacgccgtgacattggttttgatgatattcatcttttctgccgaactgttggggatttcctgtgcctccaatacggaaaacagaaagcacggaattaatataagtaactttttcatgattttatattttgcagtgtaacgaataatcagcaaaaaacgggctgaatttaacataataattagaatttaaatgaaaattatgaatatttttttaatgagttgttatcaatgtaataaacttaagagatgggttgtcttaatggtacaattcatcttcagaaatgaaaaaaactatatataccattttcttcctttgtggagctttcatattttctcaggagaagaaaagtgatacggctgatatggcggctaccaaagaaattcaggaagttattttaaaatctcagcggaaaaaacagtttgcggataaagcggtttatacctttgataaagaggctcttgaaaaagcccggtatgcaaaagatctgcttcgtacccttccggaattacaactggatccggtagcaaatacgattaccggtacaaaaggaggaacaacattatttcttatcaatggaattgaagctacggatatgcagatccggagtgtggcgcccagtgaagtagtaaaggtggagtattatgatataccgccggcaagatgggcaacacgagctgatactgtagtgaatattctgacaaggtctactgaaacaggatatgtttttggagctgatgtttccacagctttgaatactggttttgtgaatggatctgcctatgccaattatacaaaaggaaaaaataatttcgggttggaatattctctgaatctgagggattataatgacagaagggtaaacagtatctatgattatcagctgaacggtaaacattaccgttctgacgaaaacaggaaggatcatttcggctatactttccagaatatcgctttgcgttacaccagactggttcctgatgattatgctttccaggccaagcttaatatggatattttcagcaggttttcaaaagggacagggcagagtgtattcaatgaagatgccctgaaagaggaacatgcaatgtttaaaaacaatggctcagattatgtaattcccaagctggatctttactattcgaaaaagattggggaaaaagatgagctgagcattaacgtagtaggatctcattatactaccaatacttccgaaacagccagcgagtggatagtaggttcaggtctgtcagtgtatgataatgatatgatgctgaaagcaaagcagacgagcctggtaggggagctggcccatactcatgatttcaaagcaggaaagctttcgtccggatatcgtatttcaaggtcttccatttctaacgatctgaataaccttgccggatattcccaatacagtgttaattatctggagcagtatttttatactgaattttcgggaaaagttgatcaattcagctatcgtattggtgcaggtcttacgaatattcacaataaaagtgcagagaatacttttgatgaatggacttttactccaaaggttattttagcgtaccagattaaaagcaatcagaatcttcgctttacatccagttacagtccggtgagcccgtggagtaatgctttgagcagtaatgtagtacaattggcacccaatgttgttcagagaggaaatcctttcttagaatctcaacaggtattttccaataacctgacctattcttttaacaataaatattttgattttaatgcgggattattttaccgttataccaacaggataatcaatcagtattatattcaggatgatgtgttgggaggctatgcacttacttatgagaatggtaaaaacggacagcggtatggtgtacagcttacaggatcttataagcccttcggaaacagtctgcttgtagtaaaagctgtgatcacgcctacttctgaaactgtgagaacaagtaccggtgctttaattaaaaatgattatttaggaaattattttgtagtttcttcggagtataaatctttttctgttcaatatcaggttaatattccggtgtacagccttagcggtgcgttcctgaatacgaacgaaaaccagaataatatttttgtcagttacaaacatagaaactggacattttccacagggatgtactggataggaatgccttcggaatacaaaacgaaaagtctaccggaaagtctggtagattacagagttcatactcagatcatgaataataaatccatgtttgtattagggctgagttacgatttctccaaaggaaaaaagaccgagatccagcgaaagcttaataatgaaacagctcctgcagcaactttttagatgctcatttgaatgttaataagaaatccccgctcacttgtaggagcggggattttgcttttttatttcttgatgaattttatattcttggtgtctgcagtattttttccactgatctcaatgaagtaagacgctggcggaaggtctgagatctgtacgtttccggattttatatctgacgttttaaccaactttccgtccagactgtaaatatttgctttggaataattatccgtatttcctttaaaaccaataaagtcctgtgcagggttaggataaacagtcagattttcttttttcacggcattgctggttgacagaaatgtttcattcaaagctaatgcagtggctactgtctggttaatgctcaacaatggaatactgatatttccacttgtggaacttagcagcgcatatctgtgagaagcatcataatacgcataagcagtattggtaagtgttcctatagagttagaataagtaacatcaaaagacgaatacagattaaaattctgtgtatattttactctaagtacgttgctgtatgtttgatttcctataatcagagttccatacgcgtcagcaacggcagtcattgtgccgctgaacaatccgttggcggaagatgaagagaaagttcctttggctgtgtcgttttgtgcaggtccataagttagtggatagcttatataagtaccgttgtccacactaaagtttagggtggcctgagggtttacaattcccgtgatttccagtttggtagaagaagctttgtaataaactgtagttgctccatctgtcattttaatagtagaacctggaaaagttgttatctcagtagaattaggaactgaataggtcgtttgtgacgagactcccattgtaagacctgggtttgagaatgtaacgttggctcctgttgcagaattgtttacggttccggttacatggttgtaattaacaacattcccggcaatagggtcattagctgcttttgtaagcgtgatctgcgcagagaacatggcagatgctcctaataaaaggagtaaagattttttcatagtcagaaatttttgttaaaaataattaaaaaatagtattcaaatgttaatttattttgtttttaattgaatatttgaaaaaaccgcctgctgatcgtatcaacaggcggctctgtgcgctaaaaatgtttaagtctaattgctcgttatcattttgcggtaagcataaatatcttcgatggtcaccacgctcatcccttttctgttggcaaagtccacaatttcaggaagtctggccatagagccgtcttcgtttgtcagttcacaaagtacggcatcgtcacccagattagccatttttacaagatctacactgccttcggtatgaccgcgtctttcaaatacaccaccttttctggcgatcagaggaaaaacgtggccaggacttgcaatatgctctgcctgtgcatctgatgctacagctgttctgattgttgtgacacggtctttggctgaaacaccggactctacgccttctctggcttcaatggaaattgtgaatgcggtctggttttttgagttgttgttttccaccatcggacgaaggttgagatggcggcttttttcctcagaaatacataagcagacgataccgctgcattcgcggatcagaagcgccatgtcctgttctgtaattgtggaagcgggaaagatgatatcaccttcattttcgcggttttcatcatctactaaaagaataccttttccctgctgtaacgttgtaagtgctttttcaacacgttctctggagtttgctccgaattgttccaataatttttccatgttattttacttttaaaagttaaaatagtcttcggtacatggaaatgaaatacaatacaataagaatccatagggaatcttactgatcatctcattttcttctcccatccagactttaactgtcggttccggaatttcaccagatcagtcccttcaaaagaagggagtcgcggactgtaaccgccggtagggaatttcaccctgccccgaagaaaacttatactaagttttgctgtatgttgtaatttaaatttttatttcattgaatagtatttaacgcacagaccgctaatttcgggaagttttttgaattggaaaagagattttcaggttttataaggtggataaagagcgcttttaagattattcagaatttatcttcaggcatttcttaatatcttctccattttctttccttttgccagctcatcaatcaatttatccagatatcgtatatttctcatcagttcatcttcaatttcctccacacgatatccgcaaatgacacctttgatcagtgaaacattcggattgatctggggagctttttcgaaaaatgttttcagatctgttttcagatctaatatttcctgaagctctttttcattatatccggttagccagaatataatctcatgaacttctgattttgtacgtccttttctttccgctttttgaatgtaatgtggataaacacttgcaaaaggcattgcgaaaattcgggtattctgcatattgattgtttattggtttcttagtctaatctttttatgacctgatcaagtatcctgttaaactcttccggcttttccagcataggataatgcccaacgccttcaatggttacataatcatagtttttcagatatttccggttgttttccaaatgcgtgggagaagcatctgaattaatagctataacgggtacctgaatctgttttgcaattgttttgaagtctgttttatataaaggccacagagcattgattgccaattcaggttcgttttgaaggaattcgcgctgtactctttcttttacatctggtggagttccttctgcaaataaaaattgtggcagaagttttctacggcgtacttgaagtcttttctgtattgagagagtacttcttcagcttgctgctcagtaaatgattcgtccaggttttttaatgtatctatcagaattatagcttttacagccggaattttcaaagaagcttccaaaacataggctccggacattgaatgtcccacaagaattatttcccgggcatgaacagcatcagcgactgctttaatatcatcggcatatcgggcgcttgtccattcttttctggatgaatcagattttccgtgtccggcaagatccatcaaaacaatgtgatattggttttttaaatattccttctgaccttcccaccacccggtgttgccgagccatccatggatgaaaattaaagttgtatttccgttgcctgattctttataatgaattttctgtccatctgatgagattgcatgtttttccatttcaatgagtaattggtgtattttatttttagcccaatttacaaaaaggctattagaaattcaatggtttaggtgctaaaagcagccctgtatttaatacagggctgcgaaatttattttttatcagttgatctcaggttgactataataatggcatatgatgttcccagcagatcttttatttcacatttgaaaaaaataagattttttaaaaactgctggtgagaaatttcaattctgtattctattcctgtcggcatggccttgcttgcaaaaccttccagattgtctatttcatacatgccggtatttcccatgaaattaaggatttcccttaacgtacaattcatgataaaaacagaaggtacaatggggtagttttcaaaatgacctttacattgattaggtgtaaaagggttgagtaaaacgttaaatttatgttcattttctattgtaatcctgccttcgggaagattttcatcgtaatattccacaggagcatcattgaaatagtctttgtaaaaaagtttgaacgtatcttttgcaatgatatgataatcaagctcgaaagagtagagtggttccccggagtgattatctctcatcaggagtgaagacttaccttttcttttggattccaggaagctttcacagatgatggaagaggaatcggattttttataggaaagttgccttatcctcaccttttcacccataaaataaatcgggtcggtggaggaggtgtttaaaattctgtaaaggttacaacttcctaatgaagataatatctttatcaattttgaaaaattttcattgctgaaatcgtaatctgaaatttcagcttccatcctgctgccattataaataatattttcgggaatggaaatgtacggtacagtttccccgagataagggatgatgttttctttgatgtctgttgttgtcatttgaatgagggattattaagttattcaatctgttttcatttgtggataactttttcatcatcgtgttgtagtttttttgtgcagatgggtatataatggttatttggattttatttaatcgggaataataaataagaatcgttatcacatctgtagtttgtttttgtaaatatattcttaattacttggatataattgttttgtggtatttatttctttctatggtgatttgtttttgttgcaatttataaaaaaatattcataatgaattatgaataaatgttcattattcaaattgggaagatggatattatgaaggtgtaactgtggataacttattcacataacttatccacagtcttttctatagtgaaaatcccgcaaaaaatatttttgttcttaatttgttgaattatagaatgttattgaattgatttcaatgattaaaaaacttatccatagtttatccacaacggtagattggtatataaacagttatccacaaatattaaaatatgtggataactgtttatttacggtgtaagcggttttaaatcaattttttatacatttactacagaacgcttgaaaattacttttagacttatccacaaagggcatttttactatttgtctttataaatattccagaagttaaaatcggtcataggagcatcagtaattccgatgtttcttcccattgttacaatctgtcccctgtgataggtgccatgaagaatagcatgctggatatattcatacttggaaaagtcacattgaaaccattgggattctatctttacatttttagaaagatcatcttcagacaagctttccacataatctaccagtttttgtgaattgttttttatggcattgaaaatgtcctctttgctggtaacttctgttgttttagtaaaatcaaaatcattattttcggaaatgtggccccaccagtattcctgagtttgccagatatgatgcagggtttttaagattgtaggaaagctggaaatagtttcctgattcagctgtttataggactttgtggataaccagtcaatatatttgttgactacccagttattgtactgtacacttttgctgactaatgcttttaggctcataatattatatttattggatttgagaaatgatgctataatccgaaatgccggtcgttatctgtattctccggattgatgagcgctttgttgctgtaggtcgctgcttcaaaatcacggatgtttacagaaagaaaagaaatatccggcagcaattctgaaagcctggtactgatctgttttgaaagaccggctttttgatctgttgtacggccctgcatgatataaccgaatacgtgtaaaaagtctttcttatctgtacctaatctgtaatactgataaggctgaagccttactttgatatcgttgggagcaaatagtcctgttgcgtctgctgtttcgtaaacagcatccattaattcatcgggagttctctgccggagaatatcctgcgaacattctataataaaatgaggcataaatatattttgtggtttgattttgtacgagataaaagtagtaaaagatgttaatagattttcaaaataaaaaccgttctgaaagcaaaacggtttgaaaatgtgtattttttacttgaaaataataattttataggtttgatttcctaatagtgtattttggctgtacaatgtcggtcatgtcaagaacaatatcataagctccatcttcactgataggaaagtcataggcatcaagatcaatagatttaccatcgttattaagtccgaaattgtatgcccagtcattattaaatctgaatttaaaattgcctttggccagcttataatttttcagaaaatgaatatccggatttttgggatctgtctgcaatgggatatcttttccgtcccaaccgttaggagtagcattgccaatgatgccccaggaaggggtattgggattttttttaacttctttcacagttccatcccggaaatgaatgacagcagtgtccggttttccgttttgatctggcttcaatgtgaaggagaacttttcatcaagttgaaatgaagtattgctcacaggtaacaatgagcatcttgaatagccgtcttctctgaaaatgagctgaccatcaagaaatgatatataaaagtttgagtttccgtcagaatatattccttccagcttttttaaattcttaggacttatctttgctggggtaggaacactgtagggttgatcgtataatattttttcgatcttaggaatgataaaatcagtgtgtgacaattctgaattggatattacaatgagacagatatcatcttctaaaaccctgtagtatctggttctgtatccgggaccgccaccatcatgacccaccgttttttttccggaaacatccgaaatctgaaaacctaagccataatgatcattaagataaggtgtaaaagctctatctgttgtttcttttttcaggatagtataattcttgagagcttcattgaatttaaaaagatcttccaccgttgagtacatagctccggctccaaaagggtggtcggttttaaagcgtaatgcttcgtttgatctgttatcagataaaaattcatacccaaatgctttgttttcatccgtaaccttattgaaattaaaaccgctgtgttccattttcaagggcttcaggatattgttttctatagctttatcataattcaggcctgtcactttcttaataatataaccgagaatatagtatccggaattggaataatcccattttttgcccggagagaaattgaaaggcttagcagagatatattttataaatgtttcttcatcaactgtattttcagagcctgtttcattgggaataccagaagtgtgggaaagcagattggcaatggtaatgctgtccccttttggaaagtcaggataatatttggagagtttgtcattcagagataattttccctgttctgccaactgaaaaataacggctgcagtaaacattttggtagtggagtaaacccgataaatgctgttattggtatttttctctttttttggagcgtttttgtagccatagcttttttcaaaaataatttttcctttttcagcaatcagaacagaaccactgaacagaccggcttggtcataagtggcgaataattgttccagttctttggatttctgtgagaaaagagaaacagaagacaataataaaactaagcaggttacaataggtttcatttagctttttataataagacacttttaagtgttatgttgttacatgttattgcagaaatagagatgataattttatttaatttgaattaatgtcttaattccctggatcataaccatagatgcttttcttgtctcaataaaatattttatggtttttccatgttccagaatgatttttccaaaagtgagtttctcatttccatatcccttaaaatttccatacaatccattttctgcatgcataatgagtccggattctaaaactccgttttcggatgtaatcaatttttgagttgtcagaatgctgtaattatctaagtcaataatagtagaacagatcagaagttcttcttcatttaattggattgagatgccaggatatgcatcataaaaagaataattgtcttcataaaattttgtccattgaaaatcatcgtaaggtttaatagtagttctttttatctttgaaatacagatacggtgttttgattgatcgttttttttcattttaataccacatgttttttatttcattcactatttcactggctttgctttcggtgatccagtctaccattctggtttcaatgtctttctgtataagaacaacagaatatgttgaaccactcagagaaaagtgatagcgaaccccgaatttatatttttccacttgaaaatcttttactaaaatctgatcagtttcttttttcaggtaagttttaggttttgtaaacagtttgtttttatatcggacagttactttttcagagtcaatggtaagtatcgtttttccaaaggtattccataaccagatatataggaatagtataaaaaaagctataaaaggaatgataaatgaaatataatttaaaaagaaaaagaacccttcttcctgaatacttataagagggataagaatcagaatagtaaaagagagtaggaacaagcctaaacccaatatgatggtcaataaccaattggttttgttttttattttaatgatggtgggcatttattcaatatcgttataagaattaaccttataaagcagttgaaacttaacagtatcttttttagaattgggatatgtttctttattcacctgtttttcaaattctttcataatctccagatccaggtcatctttaaccgcaaactgaatgtcgtttttcttttttcccaattcaaattgaaccattatttttccttcatttttagaatctttaaacaggctttcaaaaattctgttggtcttttcaataacagatttaatatcctcaaaggaagaattggcctttaattccgaatcgccggacagaagtatgaccttttcaagtttagtttctttgttgcctttatcagtaacatatatttcattgccatttttatatgttttaaaagtcccttccgttctataggttccgttgtcaataggattgctgtaagagtttttatacgggaactcgtccagccagaataattttagctcttccttcagaaagttgacaatataataatggttttcggtctgaatgatgaacaaaggttcctgaatatcaaatgagatggtagaccagtaatattttaattcatcttcattggcttttctaatctgataatttccggaaacctcttttttaaattcattccatatttttttggagtcatccagctttttagccatttttccttcaatttccacatcatcgatatggaaaatcaaactatcaggaattctttttagggtttctatatttttaaatctcttccagagcgttggccctataattaaattttttcccaacaaatcatcattggctgtattcgtaaggctttcggtaagcaatttttttactttttcgttgattgtatcatctgcataatgataaactaccccattgggaatggttattttctcggtgatttgtgctttgacagcattgacgatgaataaaagaaggagaaggatttttgttttcatgggttgtttttaattggagtaaaatacaaaaaaagaagaatctggctttcttatgggtcttgaatattattttgcaaaatttaatgtctgaatggcttttaaaagttctacctgattttcttttttcagatttgtaccatatagattgaatctgatttttcctatcgattcggtcttgaggctgtcgatataaacacctgtaattccttttcccacttgtttgggctccaatatttttgccttatatccatcaatttttttataagttattttacttttgatgaaatcttcctgattctcattttcattgagaataataaataatgtagtatcagcgtctggatttacttttaaaagttcattcaaatcttttctgctgataacaggagttgaaagctgctcaagagaatttgaataaggtccgtaatcataaaaaatagaatcattattttttgtgacgataattccggcattgctatcataagcatccgatttcaacttgctccagtctttaggtacctgaagtgtaaaactgcgaaaatccattgattgtgttttttgagaattatcagtacaagcaaataatgtaaaagcaataaaaatgtgtgaagacatttttttcatggctttatcggagcatgttttagatacggataacatttcttttttagttgtattttaatagtactttctacttgattgctagattcaaaatgtgttacattctttaactttcctattcttatatagagtacttaaaaaacttacgattgttaaaataaaggttccccattcaaatccgtcgtcagcacttcactcatataatcaaaaaaaggacgcatggcaagcaaggtaagaactgcttctttctgaaagttatctgataaaacttctttatctgtaaatttccgcatcaccaggaattgtttttttctgatcagatcaatagccggatgatttttatcaaaaccctgcggtgctgtttttacagagtctcctttaagttctccgaaatattttataaaagttttatcagcgataattttttcaatttctttgctgctgatttcaaattctttacggatgcggagtaaatcattggcttcgggaccccaaaatccgcctcctacaaaactgttgctcggttccagctgaatataatatccacctctcaacatgggttttgaccgcgaatatccaacgccaaaattggttttataaggcgctttgtttttggaaaaacgtacgtcattataaatcctgaaaatatgcattcccttaagctgatcatgctcctgaagttcattgtagatctgagtaaataaaactttattttcctttacaatggtatcatattcagatttgtgctttgcgaaccattcccggttgttgttttcttttagctgggtgagaaattcaaatgcttttttcatattcagatcaggattttccttcgttgatatattcttgataatcttcttctaatttgtcaatttctttgattaaaaagtcataaatatttccttcaaatacttcgtaatcctcctcgtcatatttgtcgtactccactttgatgatgccgttgtcggtataagctctgtacagatttccgctgcgtttgaaaaatagctggcccagaggcttttctttatattcaagagcttcggcgtgtttctcttcaaaacccatccatgaaggcatttcttcatcctgcgaaagtccatatacaaaaaagccatatccgaatttccaggccggaagaacatcaaattcctcaggtcgtttccatatttcttctttaacctcaaaaatcaaggatccgaatgttgtcaggaaatctttaatatcttcgctgaacgtatagcccgtactttcttcatactttgtaatttgttcctcagttgcgggtttggccacagagcccattacgaaaaaatcatcatttaatttctttttcctgtcccagaattcttctttagttgccatgttttttgtttggtttatgccgtcatcattgatcagaccgttattgaacaaatataagggaaagttggagggataaaaaatgaaggaagggtaaatgatgtggcttactcattttcaaatgtaaaaccattttctttgtccatttgttcacgttctttttgtgacattctttttcttaaaactctcgtagtgtaacctcctttcacaatatttttatcgatatacatccaatctgtaatatagtatggattaatctcaatagtgtctcccagttttacttctgttgttgatatgggatctccatctacaattccatagaatttatcatcagaatattgaacttcacttatccagatatgttcacctccggaatcagcagtggtaaatctttctttcagtgcaaaattggagtaatccggattgtggctttctattgcttctttgaacctatataatgagttccgggcattttctatcgcagtattcatttcggtatcttcaccctgcagaatatgaatatcaggctcattatctctttttacaacttgatcttttctttggcagcttaatacgataagacttagaagtagatagattggatatttgcagcgcataatttaatctgatgatattaattcaagtttctaattgtcacttattaatcttataatcttctaatttctgtttcagttcttcagaaaccaggttgttttctatcaggtagtggctcgttattttcaggaaatacctgcattcctttaagtaatctttatcaggtaaagaatgatcttttaaataagtgtttgctctgtcaacaaataatccggcaccttcgaaatctttgcttatgaatagtgttccaactaaggatatataggaaacaaattcatattcaccatcatttccttttaaatagtgagaaggcatctttttgttcatcccctgaaaataggatatgattccgatgtctttcaggtatttctccttttcgataacaaaccagtcatctattatttcgccatcaaaatccatttcaagatcataatacccgatgggttccaggtttttaagatagatttcattttgcacacaaagacttattcttgcccggataataggttcgcggtattgctgttcaatcagatattggtatccctcaaattgaaaagtaatttcgtggcgggcaaagcctcctatcaattcttcaggattttctgagagtattttgtggagcatgtgaaatgcttcatttttgagatgaaatttttcagctctttcagtgagtaatgtttgaagttcctgggcgttcatatcatgattactagtcgtcaaatctgcgaataacaaaaaaatctattcaaacattttttttgttgcatgaggtatgatgaagtacatacttgttgtatttccattgtcgaaattaatatcaagaatatccagaaaataaccatttttatcctttccagaccccatttttccaatcttcatattaaacccttttcttaaataatcctgtccatcactaggatttaatgcaaatgttggatcatcaggactaaatccctgcccgctgtaggccatcgcatgaaatattattcttgttttcaagagatattgatctgctgtttctttacgatcagttttaaaataggcataggatgtttcgaaaagtgttttcaggtcgaaagggtgggttttcaaaaattcatcacccagctgaattactttctcatattccttatctgtattcaattgatataatctttttccaaattcaagatctttatagggcttataaaatttattatctgtaaaaccaattagtaaagccagtacctgcttatctgtgagtgttgtatctattttgttatatctgtctaataaattatcataataaagctctgattttatgttttttgtttctttaagtattttctcaaaatcttttttatactcaaatttatcttgagcaaagcttagaaacggaaaaaaaagaaataggaggaaaattctcatattgatgtttattattaaattatatcttttgcagagtatattctgcattggtcttcggattattatgatggaattaaaagtatgttcgaggtttattatcatcttacaattctaatcttctgcaaaacccctttctcatctttaaaactaaaaatataagttcctctttgtactttggataaatctatatttctgttataataggcaaagcccctgttgatcacttctccatctaaagagtacacggtaaactcaaattgattgctgttatttttattgctgatgataaaaccatctttagatgcgttggtatacactcttgttttggtctcacgatcttccccggctgtatttgaagagagcgcattctcagaaatatcagctgcctgtaagcttttaatagctgatttggttacagaagttgtacttccaccgatgatgtataatttatcattgtatacttccgctgcagcgtgtcttcttggaatcatattggatgttagctgatggaatttattggttgctgtatcaaaataggccagaaacgtctgattattataacctcctgcaataaaaatcttatcaccggataccgctaatgaatgtcctgatatcccggccggcatcgtaatctgatcggtccagcgattggtgttgatatcgtagatattgatcaggcgggatgaggtaccgttgaaaccgccaatgacatacaatttatcatttacaattttgccctttgcttctttggcggtgggcatatccggtaatggatgccatgtgttggaagcaatatcatagtattggaacctgttggaaaaggcagtggttgcagctccattgagtccgctgccgccgaacacatatatttttccgttatggatggcagaaccggcatttcctgtatacgaacggttcacagctcccttcgttactttcagggttgcaagatctacaatttcaagatggctgtttccccaaccgttaaaaatatagattttattatcatacgtctccgaattagcaaattttttaggactgatggtaatattgagaagactccatttgttgtctgtaatattgtatttttcaatataattggccatacctccgctttcctgatatccgttgctcacatagatattatcatctacaattacactgtttgtagctcctctccctaaagacatattggcgagacttttaaaattaagcgtttgtgcatgagccagcagtgaacttaaaaataacaggaataataattttgttttcaatggtatgaggtttagtgtgtttgtttttatctgattttctttataagagtccggactattttagtactgaactttaatagaataaccattgtttaaagataggaaaaaagttgacgagagtttttctagaattgcttttacataaggtcaatgattctgccacttttaagtttgaatggcccctgcaaactgctattttcctgaattgttctatccatagctatatagaagttttcccaatgttcttctagttgatcataattttttgtttcccaatactctccttcatcaacaacattgagacattcgaaatattcttttaaaatctcaagtaattcaattatttttatgtgtatttcagtggatgcaaattgggtcttgcagaattcctgaatgtacaaatctttatcaaactcgaaaattaagggttctgaattttcgtgaggttgtacatgaacacctttggtaggaccttcatagtttacattttcttcgtcttttactcttttcagagttacagattcattttcaaattgaaaatgatcccattcttgaaatgatgaaaactcaattactttttttactaatgtattgtagctttcttcatttttaagtcgtccttcaaaatgaattgttattcccatagataatatgattttaatggcttgctacgaaaatatcaaaaaagaatttaatataaattcttgtagagcatttaaattatgcagtaatatattatgattctatccggattcataagaaaaatgaaaaggtctgcgttttatttctgatgaatttaattattatttacctttttcaagtccatttccgaatataatctatactgtatatttcctgtgttttcatatactttgtcgtataaaacttttgctttccggtattttcccaattcatcataaagtgctcctagcatataagcagcttctatttgatcaggttcattttttaaaatttctttatacatcctttcagcctgttcattttcattatgagcaaaataccagttggctatttcccaataatcagataaaagctttgtttcagtaaatttattttttagagaatcgatacttatttctttgtaatcatttctaaacttgtccatccctgttttctttacatcagccatatgaatatagaaaggatcacaattatttattaatctgatcataaggtctttcatgaaatcatttctgtttttgttagctgtgctgttatggaagttttcaaaatctttctgaagttttgtcattacttcataggaacaagttttaaatgtttcatcagtataatttgttttaccagataaacaagtgcaaaattccttttcaaatttttgtggaaaatcctgagctttaatgtgaaaagaaattgaaacagagaacaatattcctaagagtaattttttttccatatatagctttattttattaatgttcttctgttcataacaatattcttaatcacaataaattgtccgttgtatctgagactttgcggatcgggtataaactcaggtaagcaacagttattattttaattgaatttcaatctttttatcttccataaataactttatccaattcggaacttcattatttcctggaatgcattcgattaaacttttattatttttataattttctatagcctttttcccgaacttgattttcatttcataaatttcattgccattatatccaatccaagcttttgttattatttgcttgttgttttcaatattatgataaagtaaagattttgtgtcttcgggtaaatgatgtataccatcacaccaaaaagtcttcgtataatattttatattttcattttcaatgtttttaaaatccagagaccattctaaatgactgcaaaattctaaattaaacacgggttcattaagattataattaaaagcaccacaattgggacattcaatatattctccattcaatttttcaaactcacattctgcacatctgccatttctattgtttacatgttgaataataattcttgcttcattttggtctacattgaattcgtcaattatttttttttcagcaaataattttaaatcgttttgcatcaaaatataaagatcaagcttttgttcttcagaaaattttagagtaataacttcatttttacatttgttgcaattaattttcattcttaatttgtttttttgttacaaacatccaaatttaaatattcaattaacatttgagaatatctatacgttcaaatttaaatagggagcatataatcgtgcggtagaggggatgaaaatatataaagttttatttagtataatcccctgcaacaatagatttttccattgtacttacgatctcagaaacgggaatcgtaaatatcccggcatttcctttatcaaattcttttttccagtaagaatatccgtcgagttcaagagaatccggctttttgccggtctcacttttcaggctggtgacacttttgttcaaagcttcttctgatagaggcagatggctgaggttttctgcatatccagtagggctggcagggtttttcatcttcaaaccgctgacagaaatatgaatcacttttccgatttcagggtagtcttcaatctttaatatggtaagggtagagcttttttcggtaggacgggttttgtagttccattgctggcctacacggtattggtctttttttgcacagctgaaggacagcaagaataatactgctatgaaagtatagagtttcatgaagggtcggttattagttttgtttttttatttctgaatcagctgctccagcctggccatcatttcatctttttctttcagcattctttcgtacagcgcaattttttcttcgtgaagttttagtacctgttcaataggattgaaaataggattatcatttttctgataaccaatactgtgatcgccaaaagtattcgcaattacatttacagcttcttcctcatcaaagttttgaaacgcttccacaggaattttcaacacttcagaaatcttttgcaacaaaggatcttctacagtttctttctgctccaaaagcgaaatcttcttctggttccaatcttcaccaagatcaaaagccaaagcctcctgcttgatgcccaacatctcccgaaaacgcttgatatttctcccctgatgtatttttttgtcttgcatatttgtgtacgttatagaaacaaatataagtaaaagttgggggataggaaatgggagagtgtgggtattttattcaggttaaaagatgatgttgtgctggcatttgctatccgaagtctcctgattttggaatatttatttttttgcgcaaagtcgggagactttgcgcagcaggtctttaaatactattcataggattttcccaattgtaactatataattgattatttaaaactgcttcaagtttatttcgaatattttctttatcaattttagtctcagttgttaactttaaaatatcataaaatcttttagagtttataagttcaataggtatacctctatcatgtgatttttgaactgttttatttactccactttgaaaatctgatgtagtaacaaaaataccttttggtatatcagaaagaaaaagagcgcccgttaactctcttatttgatcaacctttattttattcttgtatctcttaacttggacaccaatttgctttccttccttttctagaatgacatcaattccaccatcatttgaataacctgttacaatggcttcgtatccgaggtttttaaaaacctgccccgttacatcttcaaataattttggatgtaaactaaatcttgcttcatatttagctagaagatattttgaaatttcattgatcggaacatcaatattgtgcaaatctaattttttcaatagaccagctgtgccatagaaaaattgccatagctgccatactttagcactgacagtcacatcctttattattctccaccaaccacatttattacagtgatgaaagtatgttttacacgaatacttagaaagatcaagctcccacatttcttcatccattccttcttcataacaccagctctttcctaattgatgaaaactataaatttcttttaaatttacatcccaatagtcatctattaaaaatacttctaattcattttgacaaaaaacacatttttgcctatgaggattattatcaccaacttttaatgggctatcaaaatgatcatattcaaagattgccataattattaatatcaggtagtatgcatttacggattattaaaaaataagctgctcaaaatattgagcgattgtggcttatttattagagcaatgttagaaactttttggaattagatttattataaatattttggatttacaatgttcctgaaattattatatttttcaatattaaacaaatatgttttctcttcttttttattgatttgtttatctctgaaataattttcaacagtttctaaggctttattatatttacatctaaaaatttctacagattcaatagattcatctccataatattcaccttcaactttatatttctggagtgctttttggatatcaatttcaaccatatttgcatgatcacatttaatagcttttataacaatccaatcattagtatttccaacttttctagaatttaattttcctattcttttaattggatcttctgttgtcattcctattttaatatagttttttataatactaccagctatataaacatagccggttgctttggttcttttcataaaagcaatgtgtgcagtattacaaactatgcaatgtgaatgtctatctcttatagtatgacctgcatttccacaaggtgtagtattataagcaaataatatatcattgattttcatttcatcttttatctcagaaatactgagaccttttgcatccattatatcacttttgtcaattttatgatattcaatgaactctaataaatttgttttcataataattttgtatttaaagctttagtaacatttttaatataggtaaataacttagaatatataaaactaatacaatcattgtgtggtagttatttaaaaatcttcaaaatttccaaattcatctccaaaatctaatataaatgcttttttagctaaactaagttctattttaaggatatttttaaattcttctctgaagtcttcggatttaaaactattattatcaacatttacatcttttttcaagatgcattgaatataagcttttataaaaggatttgaaaagtaatatctatttgagttttcattgaatcttagaatttcagacctgattggagagcaaaattcatctatatatttttttaaattatttcctacatatgaagaattaattgtttgaataatttctttaatttccgaaattgagaagttttctttgtttacttgtataattgcatgtaacaaatcaagaggattttcattttttcttttgtgaattattttggtggcatgttcataaataattttgaatgaatccgagttttcttctaaaaactcttccattgcctcattaaaagatgttgatagtattttctttcttatagcttgggattctctaatattattaagttcacacataattaagcataaattatgcgttacagcaggtaagccacttgaatatgtacttattctattttttattgcatcatcaaagtcaatgtttaggtacttttctccattagaaatgattctttttaagttcggtatatccattagtggtacttctaattctgcaatacgatttcgcatttcaggatcatattgaactacctcacgtgccgagttgacagcacctaaagctattatttttaattttttatattctatagaagaatccatgaaaactttcataatttgtgccatttgagttttctgactctcttcaatcttatgaaaatcttctataacccaacataattccttcgctcctatatattttgctaaattctgaggagttattggaagttctacagctcgtttttgagaaatcttcgtttcagatttattctcatcttttaaacttgctttaattatccagaatgatagatttaaatcaataccaccaccattagatttagttttacttttctctactgggtaatagatatctagttgattaaatgcatccaaaataatatcatttattgtcattcctgtaatacaattcgttttgatatattttaattcggattctttcagtttgttagctaagagagtcgttttacctacgcctgaatagccatacaatattatttgtttccctggagttttcaaagccctgtcaagtcttctatttatttcatttctttcaacaaatgttatatctgcgggttgacttggtgtaaaaatttcttctaactgataaacagtttttttttctttcataaatcatggttattattcaaatctacacaattctctagactttaaacttttgtttatttcataatctaaattaatttattaaagtattattatattacgggaaaccatattccacaaaaaaaaacgccctacaaagtagaacggtttatatattaaatttgtcttagcaactcgctattacatcattcctggcattccaccacccattggcatagctggttcagcgctcttcacttcagtgataacacagacattttctgaagtctccggattttggagaatattttaaaaggggagttttttaattttgaataataactgcttttgttggtaagtaattatctactttgcttctttcaataatttcaatttcaactttttcgaaatcgtttgtctgcatttgaattttagcagtttcatcatgtttgtatatttttgaatttagaatttttaggatctccataaattcattattcataaatggctcaataaagcaaagactataaacttttccgctggatttataagaaataaatcttggatttcctgcaaaatattcattcctattgagttgtttttgtttgacaaaggattcaatatttttgcctgataatgagtttaattggttaatttcttctgaagttaatgtgtattggaaataatttttcccatcccagctatctgaatagacggttaagtttcctttcttatctaatgtagcgtaagacttaatttcaattttattattcgatattaattcataatcaacaatttttaaatcttgaattatatttttttgtgaaaacagatttatacataaacatataaaaataagtaatgcgaactttttcatgattgattaatcggtttgaatgtgctttttgttgtaattacggttgatattcaaatttacactttaagctcatatatgatatataattgcaaataaaattttaagtaaaaagttctttagattttctatataaaaaaccgctccacaaaagcagagcggttaatatattaaattgtctcagtgacaagatgttacatcattcctggcattccgccacccattggcatagctggttcagcgctctttacttcagtgataacacattctgctgtaagaagcataattgatatgggatgattttctatgtatttgtaaaaagttttttaatcttctcaatcacagtttgtaaaggggttaattcatatccaatatgttcacaatgtaaagattctaaaaattcaggtaaattggaatatatatttacttttaacgttgcgatttttctattttgattgttgaataggcttataaattcatttccatcatcatcaactccatgtttatatcctagaatgtcctttaaatgaatcgttttttttataagtaagaagttatgatagactagattttcgttttgaatcttggctcgtatcaattcataataattcttttttcctaccaggtatatcataaatagaaagattaaaatgaagtaactaaaccataaataatgacctttcgaaatcatattttgatatgcccctttggtaaaaacaaatggcaaggagaatgaaaaaagaaaaagtgtagttctgaaaaaaacaatgaaataatttttgatttttagtgtcattacatttttagtgatttatttaagtaaagtgtgtcaaatatatgaaactttgcaactttttagaaatacgtttttttgtcctataaaatgcataaatctgtagatgaatatcgaatgttgtaaaaacaatcttaaataaaaaaaccgccctataaaaatagaacggttagtatattatattgcctcggtcgctgaccgttacatcattcctggcattccaccacccattggcatagctggttcagtgctctttacttcagtgattacacattcagttgttaaaagcaagattgtatttatttttttacaataacttgcttcgtgagggatttattatttttgaaagttaattttaggtaatatattccaggagaaaaatcagtcacatctaacttaatgaaatcttttgtatttgtaatgaatttaggggttaaaaatcttccatcagcactatataattctactttttcggctttgccatttaaatttacattgatataattggaagtaggatttggatatacaacaaattgtttttcagtttctttttctgatgtacctaaaactgtatacccggtaaagcttctgtatatttttccatttgttcctgctgtgaaaatataattattaactaattcaagagagtttaatctatactgagttgttactgatgaccaatttattccgccatttatggttttgtatatttcaccattttcatttacaatatatcctatattaggggtgtaaaattttgttaatgtataatagccgtaaggaactgacatttgtgtccaacttagaccaccatttgttgttttgtaaaatatagagttatctcccgcaaagtaaccattattttcatcaacaaaatgaaaagagttgattccatctcctgctaattcaatgagttgattccatgtgttacctccatctatagttttatacattgctccataataattcccaactctattagcataacccacaagcgagtttacaaactgaatatttccaaaggcttggtttgatacctgtgtccaactgcttcctccgtttgttgttttcatgacttttttttggttaaaaccaccagaaataaaaccagtattaccatccaaaaaacaaatagaacttatcccttcgtctataatatcatttccattatttaatatttcccatgttgatcctccatcagttgttttataaacatgtcctccatatgttcctccagtagttgcataccctaagttttcattaataaatgtgaaatcactactattaacagaagtgccaagatttaacgtgccaaccaatgtccacgtgtcaccaaaattattggttttgtaaaattgattattagttaatgcaaaaccaacattattattcactatttgtagttgtctgaaatcattgtaggtgggcgaatgttgtgtccatgtgtttcctccatctatggttttaattattcttcctcttgctcctgtagcaaaccctttgttactgtcctgaaagaaaatgccatacattgaagtattgtcaaagtatccgttttggaaaaaaatctggctccatgtaattccgccattagtcgttttataagttgcaccataattacctgtggcaaaaccattattttcatctaaaaagtaaaaatcatacattgcttcaaatgatcctgtaatttctgtccaactttcgccaccatctgtggttttaaataagtcatcgtgttgtcttgatgcaaaaccgacattctggtttatgaaataaactgtcaaaaagttagatgggtatacattagtattataagtattataccaggtgtttccaccatctatagtcttctgtatcttgccgttattacaaacagcatgtccaatcagagaacttgtaaaggccgttttgacaactgttacgtttggaatagtataactcatccacgtagttccaccgtcaagggttttaataatactattcgaacctgatagaataattgtgttattgtctataatatttactgtattaaaagaagtattaaagccagtagatatttgttgccaacttacaccattatctatggtctttaaaatataaccggaatcccctacaatatagccaatcccattcttaaaactaatatcattaccacttaaaatattttgtttttttgtccaggttgcaccagaatctatagtttctaggagttcatttgatgtaattataaaaccgttattgctagaaacgaattcaatatgctttccagtgtttgttgttggcttggggtttaataactcccaattagtctgagaaaatattttattaaaagtaatagtaattaaaaatagtaaaagtatttttttcatttatgattttctttttataacgtttttatgatcaggtacgatcatgaagatataatatttataagcaaaaatagtgtgaatgcaattttagttaattgctaaatctttttagaactttgattcaagtttaaagtttgtataatgtatgttttcatggttttatttagagggccaaatatagttaaaaaactaatacagaaaaaaaccgccctacaaaagcagagcggttagtatattaaatttgtcttagcgacacgctattacatcattcctggcattccaccacccattggcatagctggttcagcgctctttacttcagtgataacacattcagttgttaaaagcattccagaaacagaagctgcgttttcaagggcaactcttgttactttagttgggtcaatgattcctgcttcaagcatgtgtacatactcgtcagttttagcattgtatccgaagtctccgtttccttctgctactttagcaacaattacagaaccttcaccacctgcgttggcaacgatttgtcttaatggctcttcgatagctcttttcacgattttgatccctgtagtttcatcagcgttagatcctgaaagattgtcaagtgaagagattgctcttactaaagcaacaccaccaccagcaacgataccttcttcaacagctgctcttgtagcgtgaagggcatcatctactctgtcttttttctctttcatttctacttcagaagcagctcctacgtaaagtacagcaacaccaccagctaacttagctaatctttcctgaagtttttctctatcgtagtcagaagttgttgtttccatctgagctttgatctgagctactcttcctttgattttcgcttcgtcaccaccaccgtttacaactgtagtgttgtctttgtcgatcgttactttctcagcagttccaagcatatctaaagagatgttttccattgtgaaaccttgctcttcagagatcacctgtccacctgtaaggatcgcgatatcttccaacattgcttttcttctgtctccgaatccaggagcttttacagcagcaattttaagagaacctcttagtttgtttactaccaaagtagctaaagcttccccttcaacttcttcagagatgattaataaagacttaccaccttgtgcaattggctcaagaaccggtaacaattctttcatggaagagattttcttctctactaaaaggatatacgggttttctagttcagctaacattttctcagggttcgtcacgaagtatggtgactggtatcctctgtcgaactgcataccttctacaacgtctacggttgtatcagtacctttagcttcttctacagtgattactccttctttaccaacttttccaaacgcttcagcgattaaagaaccgatcgtatcgtcgttgttggcagagatagaagcaacctgcttgattttttctgaagaatctccaacctcctgagattgagatttaaggttttcaacaacagcagttaccgctttgtcgattcctcttttaagatccatagggttagcaccagccgctacgttcttaagaccttctcttacgatagcctgtgccaatacagtagcggtagtagtaccgtctcctgcgatatcgttggttttggaagctacttcttttaccatctgagctcccatgttttctaccttatcttcaagttcgatttcttttgctacagaaacaccgtccttagttacgtgtggagcaccgaaagatttttcgattactacgtttctccctttaggacctaaagttacttttactgcattagctaatgcatcaacccctctctttagagcgtctcttgattcaatatcgaattttatttcttttgccatgtttgtttagcttttggcgacttgctttttgcttttagcttttgcaattcgcgtgtttaactttaatttttaatttccattgagcctgttccacaaagtgacaagctttttctttaatgttgtcaactcttccaaaagattgtgataatcattttcataaatgtatcctaaatctttggcgagaattaattggttttcggcttcattggatgatcccagagcaatattgatgaaattgacaaattctttatctgaatttctgccgcttccttctgagatattatatccaatagatgcaaatgatcttctgatttgagaggtgagcccaaaaatttcctctttaggaaaacttctggttgaagtataaattttcagtgtcaactgatgacttaattgccatacttcaaactttttaaaatctctcatacattaattttcatgtagaaaaaagccatttgccagaagccaatagcaagaagcttacccaatgattcccaataagtcagcttctcttacgattaagtaatcttttccttctaacttcaattcagaacctgaatatttaccataaagtactttgtcacctacctgaaccgttgtaggctcgtcttttttaccaggacctactgctactacagtaccttcttgcggcttttcctttgcagtatccgggataataatacctgaagctgttttagtttctgctgcgattggctctaccagaactctgtctgccaatggtttaaagtttactgacataatatatttaattttttaattatttctgtcttctaattctctaaatgtatgccatgagacgctgatggctgaaatggcagatttttattttccgaatgtgaaaatttggcagaaaaattattttttacgggccggaattccgaaaagatagctggttaatacaggtaatacaaacaaaagaacggtaacggcagaaactaaaatttccatggtatggctgcctaaaaattgagcgaatgccgtagcagggtagaagtgctcatacagagataggcttagtttaattcctaaaacagcaatcacaataaaagcagcggtttccaggaatgggaatacctgcatcagacgtacaaaccactgcgcaataaatctcatggctaaaattcctatgaatacacccaatgtaatcagaagtaaattgtctgaaaaagcgactgccgcaaaaacgttatctatggaaaaagcaagatccatcacttctacaatggcaactgtagcccagaatggccccaacaatccaattgaatttttatacagccaattggattctttgttggggttttcttccggactttcatcatcacttgtgttttttatttttttgatcaaccagtcaacagaaatataaattaagtacaaccctcccagcggtttcagccaccacacggaaatcagcacagaagcaaaaataagagccagtccgcggaacaaataagccccgaggattccgtatttcaaagctttttttctttgattttcgggaagatccatgacgatggtagccaatacggctgcattatctacggagagaaggctttcgataaggataagattaccgataatggctatcgattttgccgggttttgtaatatgtcattgaaaaggtgtgtaaaatcaggaaacatcattttttaaagaaatagtattttggttaagttttgaaataatggcagccgaaacggtaatgcctatgaagttggtaacagatctggcttcattcataaagcggtctatgctgtataacagtgcaagatctgtggccggaatttttccgaaccggctcaaggtgaacatcagggcaaggaagcctgatccgggaacacccgaagctgtttttgatgcaattgaaatggtgataaaaagccagaaataatcttttggtgtaagcggaatattatacagctggaccaggaaaatacacgagattgaaagatagatgcaggctcctgccagattaaaattatatcccaacggaataataaggcgaagaatttttctgtcatatccctgtgattccattttatcaaagatcataggaaatgcagtcttcgaagaggaagtggctactaccagaatgatttcttctttgatgctgatcagaaaatcccaaaggttaattttaaaataagctgttataacccctaatattccgaaaataaaaaatacactggtaagatatactgtggcaacaatcttacttaacggcagcaaggtattaattccgtagactgaaattccgtaagcgatattacagaaaataacaactggaagaaaaatgtaaacatacttgataagtttgaagaacagatttcttccgacgtctatggctttaaggatattattctttttctttgaaagaccaatcaggactcccgcagatattgatattaaaaggaaaagtacataattgctgatatgtaaaggatttgtaacccttgttaaaaatctttccggaagtgctttatgggaagaaataataattcctgtattggcacccggttttaaaagaagcccggaaccgattcccaataagatactgatagaggtgatgattaaaaaatacagcaccatctggcttacaattttaaaagcatttttggtgctgaaaatgtagcttaccccatacatcaccgcaatgaaaataacgggaacgatcaaaacctcaagaagcatgaagaagtagctgctcactgtttccagatgcttactgacttccggaaaataatagccggttagtgctccgcagataattgctgtgaacacataaagcgtaaggtttcttaaataggagtctgtaaatgttttttgcttaaaaggtttcatcacttactttttataggataagattacgaaattcaaagatataatcttatataataccaagaatcaatgcactcaccaacatgatgatggaggagcccagggcccatttcaatgtatattttaagtgatcagaaaactccacacctgccagtgataccagcaggtaggtagagggtaccagcggactgagaagatgtgagccctgcccgataagactggctcttcccaagatttcaggcgcaattcccaattcatgtccggtcgcaacaatgataggcagtatcccgaaataataagcatcattggacaggaaaaaagtaaacggaatactgaacaaagcggttacgatattcatataacctccccagcttttgggaactatttctatcatactgtttcccattgcctgcataataccagaaccattaaggattcccgtgaaaattccggctccgaaaatcattcccgctacggacaatgcatttcctgcatgtttagaaattattttctgctggtctttcaatttcggataattgatgatagaggcaatacagaaagcaatcataaaggcaattcccaatggaacaatatccaggatcatcaccactaaaagagtaacggtaagggccagattgatcaggatcagtttcgggcggcggagtgccggatcagcttccccaataatatcattgctgttgtagcttgtaaatttaccatgttttgcaattcttattttttctcttctgcctaaaatataggccacaaatataacccacaggatgcctatcgccataatgggaatcatcggaacaaagatttcggtatgtcccagcttcagagagctcattacccttgctgtagggcctccccagggaaggatattcatgatctgcccggcaagcataatgatgcaggtaagaatcagagggttcataccctgttttttgtacagcggaagcatggcggccactacaattaaataagtggatgagccatctccatccaatgaaacgagtgcagtaagaacagcggttcctattgttgtcttaacgggattgtccccaactgcttttaaaattatgttgacaagaggctcaaaaagccccgtgtctatcattaaactgaaatacaagatcgcaaagatcagcataacaccggtcagtgctatttctttgacaccatttttcatcatatctccaagctgtggaccaaaccccgcaatgagagcaatggctacaggaacaatgaccaatgctgtaagcggagtcatttttttgttcatgatgagaatcatgaagatgaaaatcattaaaaatccgagaaatgtaagcatagttatatagattggtgggtgttattgttgatctttttttctccagtcaaaagaatttcggaaaccgatgtaggcgtagttgtctgttctgtggtctcccagctggttaataaatgcaaattcaaatgcggaggctttgctgatttttattccaagtcctgctgtaatcctgttgctgtcgaagatgttttccttggtggcattaacacggacttcattttttaaaataccataatattgtcctgttttccccaaaggaattctcatggaaagaaggtaccttaaccggactttaaactcatccggattgttcagaaaacgttcttctacacgaaatcgatgattaatcaatgtccgaccaatgtgcccggtcagggtaacctgttgaaaaggccttgtttcataccgggttactttttctcttttggaattataagaattcaggacaagaaacattgctcctgctccgggttctacaccgggagctacttcgtactctaaatacgcgttcacaaggaataatcttccgtctccgcccagatcaaatgatctgtattgggaaagtgccgttaaattggttttatcagtaagttttgaattcatgatatactgataccacatattgtagttgtcaatactttgcccttttacccaataattgttgataattattaacaaaaaaacaagtgttaattttatagtaaacttcatataatatttgattaatattctagcttctcaaatatatttattagcataagcggcttatgaatttttcaatcaatgacagtttttctcagcaaactgcattttgagacaaaaagatatttatatttgatgcgtttcaaaataaggtatgggctatgtttttaatcattaattttatttttatattattgattatcaggattttatttaacggtaaaattctggatagcctcatgaagtaccgttggaaatttttactgaggtttcagcatatttttttcctttttatcttcattctgatgacttatttcaccgaaaactacttcctggactcaacccagctggtgataagtatttttttgaatacaattttcaatgtggggatttattatctggtatactattatctggttcccaggttttatttatccaataaatatccggagtttatactctatgctttgatctgctttttggtgtccagccttttcaggattctttgggaacctgccgttttccagatggatttcagcggagagggctatcatataggttttctgtataatgtatacatctcacaggggattgtgattcttgtggggtcttttctgggaattacaaaagacaagtttttaatagaacaggatgtaatcagcctcggagaagagaaggaccagctttatcttgatttgctgaaatctaaactgaatccccattttttgctgaatacccttaataatatatatgcgaatagttttacccattcggagaagacttcggattctattttacagctgagcaggcttctcaagtacattatttatgatagcggaaaagaaaaagtaactgtttcccaggaattttcttcactgaaagcgctagcagctttgtaccagcttaaatataataaccagcttgatattgtaatggatattgaagatcaggaagagtttgatatcgttgaaattccttctgccgtatttcttactttatttgaaaatgctttaaaacattctgccataggggaagatcctaagagctttataaaactgttctgtaaaattgagcgctctgaactgtattttgaaattattaattctgtagggaaggatagaagtaatccggttgaatcagattatcacggattgggtaatgaagcaattattcatatattggaaaaattttatgcagatcagtatgagttttactccggaccgaaatacagtgatcaatataaaattgccttaaacattattataaatggctaatctgactatcgtaaatgtagatgatgaatatcctgcattacagcttgtaaaacaatattgcgctcagcttgaagatgttcagctgctggcttcatttcagaaaccggaagaagcgctggctttcctgaaagcaaataaagtagatctggttgttttcgatatcaatatgccgggaatcaatggtgtggaacttttgcagcaacttcctgatccgccactgtgtattttccttacactggaaactaaatacgcggtgaaagcatttgagctggatgttgttcattatctcatcaaacctgtggattttgagacttttaaaaaagcggtcaataaagcaagggattttgttcagtttaaaagttcagccaataaccggcagcaggaagattttattatgttcaaatccaattatgtcatgaataaagtctttcttaaagacattctctggatacagggtttcggggaatatattgtattgatgacgcccctgaaaaaatatatgattctggagagaatgtccaattttgaagaaaaatttcagcattttgggtttatcagaatccataaatcttatattgtattgtcagatcacatcagttcttataattccagccatgttttccttaaaaatggtgaagagcttccgctagggcgtacttataaaaagaatattaaagcacatttaagttaaaaaagaaagccggaaatttccggctttaaattgttatcaaatgactggattacggacaagactggccagggccgatccataggatacattgtcctttgtaattgtactcgcagcaaaaacgtcctgctgctccgccattgatagatttctgagcatctctgcttaatactttggcatttttcatagttaaaatattttggtttgtacatcctgagcatttaatgtcaatcaggattttgacactggtgtaaaagaagtaagtcaaagatactatttttccttataacgtgatatatttttgctgataatttttataaataaaattttgattatcagttattaacggtttttgttaggaatgtcagagattgagaatataaatagaaaagccggaagcttccggcttttcaaaattgttatcagttgatagaactaaggacagttttgtcctgctccgatccataaagtacattttccgttttcgtcgcgttcgcagcatacgagtctggcagcaaggccgccatggattgttttctgagcatctctgcttaataatctggcatttttcataagtaatattttgtttttttatcctgaacatttattgtcaatcaggacttttgacattttgtgttgatgataaatcaaatataaatatttttaagtcagggtgttatgtttttttagacgcaagcaagatattgatatctttcaatactttatcggattgtttccaaagacatctttcttcctgccatatccatatcctgcttttcgattttccttgttatggtatcaatataataagttgtggtagcacttctgttgctgatgtcatcatttgtttttaccatccagaccggttttccgttgtattctgctttttgagtatcaagaatgtaagccttcattattccttttttctcagatttaggattatagtcaaaaatggaaatttctgcagtatagttttcctttaaaggaagatatcttataagcattgcataactgctgctgtcaaaataattggttgcaggaatttcgatgatctcttttttccggaattttttatccaggtaatagccggtgactttatctttcccggatttaaggaccatatctctgttcacattgtaagaagaatggtaaatgggttcaaagtccgatatttttacaagggtagaatcggtccacttggcatccggagcctgtttcatctttaccgttgttctgatcaggagatccgattggttcagctttttgatttctgtaataatggttccgatttctatttttgtatctgctttttctgcataccagacggcttcagaagtctcatctttgatcagcttcggattaatcccggagtttttcggattcagcaggttttgggcaaaaaaattagcactgcttagtattaaaaggaaaagaatggttctcatgatctttttaataataagtagtgctatatctgttaaaagttacaacaggttggtttttaactctttcctgctgcctgcatcggattgacctttccgttggagcttcctcttacaggtgctccgtcctgtttttgtttgaagagctggaatttagaagtttcagtacctgatccggcgctgctccagaagttattgttcgtatcaatatcagcagtctctctcatcgggtcaagctgaattgattttacttttttatcaaaataatacgtcttggaaactttttgctcattcagtctccatatctgcgcagcagatttatcatataatttggaaccgtcctcaaaagtgaactcaagaataataggcattaccaaacctcctttgttgacaaaatcaatctggtatcctgtaatatttttaaatttctctttatccttcgcatccaaaggaagacttgcttctgttttagtagtgtattccttattattatctaccttttcctggcctctgtcatatctgtaatagaaatcctgagcatccttatcagtatccacgtagaacttaatattcctgtcttctctgtttctgatttttgaaagatcttcaaaactgtttaccaacggcttttctacctgatattttacttcagcagcaacctttggattggtctcaagatcaggaattgctaccgttactttatcaatggcaatatctacaggatctgttccgtagaaccaccctctccagaaccagtcaaggtcttcaccactggcatcttccatcgtacggaataaatctgcaggttcagggtgcttgaaagcccatcttttggcatacgtcttaaatgctttatcaaaaagctctcttcccatgatggtttcacgaagaatattaagtcctgtagcaggctttgaatatgcattcgggccgtactgaacaatattttcagagttgctcatgataggctccagctggtctttcggcagtttcatgtaatctacgatagtccatgccggtcctcttttggaagggaatttattatcccatttttcttctgtaagatattctgtgaaggtattcagaccttcatccatccatgcccattgtctttcatcagaattgatgatcatcgggaagaagttgtgccccacttcatggatgattactccgatcattccgtttttggttccttcggaataggtaccgtctttttcagttcttccgaaattgaaacagatcatcggatattccattccattggcagcttctacggattgtgctacaggatatggataaggaatggtaaattccgaataggttttaattgtgtgggcaactgcttttgtggaaaactttctgtaaagaccataagattctttcggatagaaactcattgccataactttattgttgttttcaggaatcgttacacgcattccgtcccatacaaactttctggaagaagtccatgcaaaatcacgaacatctttggcttcaaaaaaccatgtttttctttgtttggaatgatttttctctgcttttttagcttcatccaacgttacgatttctacaggctcagaggcattttcagcttttctgtatcttgaaagctgatcagaagttaatacctgatcataatttttacattctcctgttccgccaacaatgtgatcagcaggtacgttaattgaaactttaaagtctccgaaaaccaatgcaaattcacctcttccggtaaactgatggttctgccatccctggaaatcactgtatacgcacattctcggataccattgtgccattgtgtacaggtcgttgccgtcctcagggaagttttcataaccaccgcggcctcccatcttcattctgttggaaatattgtagttccagtctactttaaaaacgaatttttctccctttttcaaaaccttaggaaggtcaatacgcatcatggttttattcacggtatatttcaaaggagttcctgaggcatccgttactttttcaagagtaacgccataaccgttatccttcacaggaagctctgttactttaagctgctggtcagtcgttgaagggcgaagaacagatgatgtatcatagcctgcatttctgatgtttgaatgttcgttttcatccagctgcagccagatataatccagatcgtcaggagaattgttgtaataggtcacagtttctgaacctttcagatttcttttatcctcatccagataagcgttgatattgtaatctgctctgttctgccagtatccgtgtccgggagctcctgaagctgtcctgtaaatgttgggcgttggcagaatagttcccagctgctcaaacttattaccgtgattgctgcccgggttattctgaatattttgtgcggtgaaacctgtatatgcaaatacagaaagtgaaagtatggcaacttttagtttcataaccgaaaatgatttattaatgatcaaagataacaataagctgttgaaataatgaaaatatttaacttttaaaaaggaatcctttccaaagtcatttttaaggataaagcgaataccccggaagagacaaacagaatccagtcttttttattcaccttgaaaagattaagaagaatgaacaggatcatcaaaatgacaaatactattacaatttgtcccaactccaatccgatattgaacccaagcagaggtaaagcaatactctggcttttagcaatcattactcttgctgtgttggcaaatcccattccatgaacaagaccaaagatgagtgcgagatagtagttggcccgcattaaggtctgtttctgatttttcataataatattatccaaagaagtcagaacaatagtaagaggaattaaaaactcaacccattctgaaggaactctgaacacatccaggacacttaaagccaatgtaatggaatgcccgatcgtgaatgcggtgacaagaatcaggatttttttccagtcactgtaagaataaacagcaataagtgccagcacgaaaagctgatgatccagagcatccagagaaataatatgctcccatccaaggtttaaataaaaaaggaaatcctgcattttgattaaaaatttttacaaaagtaaacatttcgtatggaggaacgaatcttcttatgagggctgcagcagcctttttacactttacacacgaattaaaagaaaccggctttccgggttcggtttttattaaagaataaaaaggaacagagttagtaaataatggcttcttttgaaggcaccgtctctataactgttgctttttttatatttgctgtaaattaaagttcatgccgggtaagtttttttggagttttcttttattattaacagttgtatttcagagttttgtaagtgatgctgctgtgcatccttatcatgtgggttctgttgaaattaattataattcaaaatccagaacatttgaagtgaccggaagattctttctggatgacatggaaaacggattgggcaaaaaatatggcggagcttttcattttaacgatgaaaaatataaggcaaaactaaatgaagccctgcctaaatactgttcagaatatttcaaattaaaagcggataataaatttttgaaagtaaattacatcggctatgaagaagatcaggagtctgtaaatgtatatcttgagtctgaacctgtagctattcctaaaaaagtagaaactgcagtgagttttctgtataacctttttgatgatcagatcaacattgtacatattattgtgaatgggcaaaggagcagtgaaaaacttacctatcctaaccgctatctctataaacagttctaagaatatatatttagtatattgtaatttcacgcaaagatttcagcgtgtgatattatatttttgaggaagcaaaggaggaatcaactttgttgatttttctaagcggcaccaaatccatgcagcttgttcagcgactttgtcgccttcttagctcacttaataataacaaaacttaatttagcctttgcgttttaaacaataagacaaatttacagtttattagttttccagctgaagcaacgtattgattccttttgcgtgagccaggaggtcaggaaaaaagtcatcataacattgctgaagatgatctttattttttaagaaagcttcaaatacgggtatgtctttatccaggtattttgctttattcagcacattctgaatactgaatttaattccccagtcttcacggtaattatagagccagtcgtcctgctccattttaacaagcatccttttaaagttttcgggaagccattgctcatgcgcattcaaaacactgtaaacatggagggaatgagccttccattctgccagtgaatgaagggaaaggtctttcgccacaaaatgatccatagaaacatccacaaatgcaccggcatatagtcttaccaaaggagcaaaaacttttttggcttcatgaatagcagggtgggaatctgtaaatgtatcaattgccctatgcagggtaataccatcctgaatatttttcgggaaagaaaaacgatctctgttgcggatgaaatcttcgagaaactgtcccacgatctgcccgtcggtaaaagaaagaaaggaatgcgccagataattcataacttaaaggtatgaattaaatgtgaatgtttggtactggtgaatagtgaatagtgaatagtgaatagtgaatagtgaatccgcttcgcttgtgaatttttatccgcattccaattgactattgaattgcgaagcaatattgacattcataatgtaactacattaaatccacttctctggtaaatttttattcacatttcaattgactattgacttgcaaagcaaaattgaccattaacaatctttagtgaatccgcttcgctcgtaaatttttattcccaattcaattgaccattgacttgcggagcaaaattagccattcactaaaaaagcctctcatgaaaatcttcaatcttgctcacttcttcaatcttaattccgaattttcttttcgggattttattaagattggaaacgaatattttttcataacccaatttttccgcctcggtaattctttgttcaatttgtgctacaggacgtatttcaccacttaaaccgatttctccggcaaagcagtaatgctcagaaatggcaatatcttcattggaagaaagaacagaggcaataacggccagatccagtgccggatcgtctgttttgatccctccggtgatattcaggaaaacgtctttagcacccaattggaatcctgctcttttttccagtacagctaaaagcatattcagcctttttgaatcaaaaccggtagagcttctttgaggagtaccgtaaacggctgtgcttaccagagcctggatttcaagaagcataggtctgtttccttccagggttaccgcaacggagtttcctgaaagttcctcaaatttcttggtgatcagaatttcggaaggatttttaatctcttttaatccctgtgagatcatttcataaatcccgatttctgaagtggaaccaaaacggtttttattcgctcgtaacaatctgaaaaggtgattccggtcgccgtcaaaattcagaacgacatccaccatgtgttccagaacctttggtccggcaatctgcccgtctttggtgatgtggcctacaaggaataccggagtattgttttctttggcatatttgatgatctcattggagcactcccggatttgagataccgttcccggagagctttctattaattgtgactgtaatgtctgaatagaatcaatgatcataaaatccggttccagtttttttgcctcatgaagaattttctccagtgaagtttcagtaaaaaggaaacagttcggattttgaatatccgtaagcctgtccgctctcattttaatctgagaagcactttcttccccggaaacatagaagatttttttcttcattttcaaagcaagctgaagcagcagggtagactttccgattcccggctcaccgccaatcaaggtaacggaacccaaaacgattccgcctcccaatacacgattcagctcttcggaaggagtttttattcttggttcctcactcgtttccacttcaacaatattaattacatgttgtttggtttttgagaaaggaggtgttttatgggaaggtttttccaccacttcttccactaaggtattccactctccgcagtttttacattgtcccatccattgagggtactgggttccgcagttttgacagaagtatgctgttttcagttttgccatactgcgaagttataaaaaagcatttttctttcagaataatctgtttgaatttatattaaaaactaatgtgctgaggtagaaatatctttcatatcttagcttcattcaataaaatattaatgtaaaatattattacaatgaaaaaagtatttttatctttcgtatttacgcttttaagtattgttgcctttgcacagggaagctggcaggtagaccagatgcattcttctgttaattttaatattaaacatatgggaatcagctttgtgcaggggaggttcgacaaatttgacggaaaagcggccacaagtggtgctaatctggataatgccgatttgaacttttctatcagtgttccttccattaatacaggagtggatatgagagacagacatcttatcagtgaagagtttttcgatgttgccaaatatcctacgattgaatttaaaagttcttccgtaacaaaagataaaaacaacaactatatcgttaagggaaaactgacaataaaaggagtggaaaaagaaatcagcgcacctgtgacattcggtggcgttacgaaaaataaagacggaaaagaagtaatgggaattcaggcgaagtttacggttaaccgcctggattacggaatcaaatatgatccgaaaggagctggtattgcaaaagatgtcgaagtagcagcttactttgaattggtgaagcagtaattttccaacgatacataatatatataaaggttttccgctcaaatggaaagccttttttattgccaaataaatttttacgcaggttttatagtcgtttgagctgtgtttttatattttcaaaatgtaaataattgctttgtatttctttttcccctaactttgcacaaacctaatctaatgagtaaaaagaatacaaagtacatctttgtgacaggaggtgtaacttcatctttgggaaagggaatcgtttctgcttctctgggacttctactaaaatcacgcggctttaatgtaacgatccaaaaattagatccttatatcaatattgacccgggaactttgaatccttatgaacacggagagtgttatgtaactgaagatggtgcggagacggatctggatttaggccactacgagcgctaccttgacgctcctacatcccaaaacaacaacgttactacaggaaaaatttaccagactgtcattgaaaaagaaagaaaaggagatttccttggaaaaacagttcaggtaattcctcatattactaacgaaatcaaacgtagaattaaaatcctttcaaaacagaactacgatatcatcattactgagatcggtggaactgtgggggatatcgaatctttaccatacattgaaactgttcgtcagcttaaatgggagttgggagaaagtaattctatggtgattcaccttactttactgccttacctggcttcaagtggggaattaaaaacaaaaccatcccagcattccgttcgtcagttaatggaaagcggtatcatggcagatgtattggtgtgcagaacagaacataaaattcctaaagatcagagagcaaaactggctcagttctgtaacgttcctttagacaatgtaatcgaatgtaaggatcttgaaacgatctatgaggttccaatgtatcttcagaagcagaatttcgatgatgtagttttgaaagcgctggatctgaaaagtgataaagatgctgatcttaaagactggaagagtttccttaaaaaattccagaatcctaagaaaacagttgaaattgccttggttggaaaatatgtttccctgcaggattcatacatttcaattgctgaagctttcaaacatgctggagcagaccttgaaactgaagtaaaagtaagatgggtatacagtggagacatcactgaagagaatatcaaagaaaccctgaaaggagtgaatggtatccttgtcgctccaggtttcggagacagaggaattgaaggaaaagttcttaccgcaaaatatgcaagagaaaataaaattccaatgctgggaatctgtttagggatgcagatcatgacagttgaatttgccagaaatgttttaggatatacaaaagcgaattctatggaatttgataccgctactccggatcctgttatttcgttaatggaagaacagaaaaatgttgtagataaaggtggtacaatgcgtctcggagcatggaaatgtgctttgaaaaacggttctaagctatatgatatctacggaagcaagaatatttctgaaagacaccgtcaccgttatgaattcaacagtgattatcttcaggaatttgagaaaaatggtttccttgctacaggtaccaaccctgaaaccggtttggttgaggcacttgaacttcctgatcacccgttctatgtaggagttcagtatcacccggaatataagagtacggtagcaacaccgcatcctttattcagagctttcatcaaggcttgcgaaaagaaataaggtaaatatttatcataaacgtctatacataaactcaggctgattattgtcagcttgagtttattatatagtaacaacgtaaagcatagagttttgataaaaaaacagtatttttgtcagctcaatttacgtacaccagtatgtatattttaaacgtaaaattttaatataaaataaaatgcaacaaaacaacggaatcgataagaagcagatgattagtttcgcggttttatgccttgttctattcggctttatgttctatttccagaacaaacaagcaaaagaagcggagctgaaagctcaggagcagaaaacggaacaagcaaaaaatgccgtaaagcaaactcaggcaaccaatatcaatccaaatgtaactcctaatgccattcagacagcaagtcttggaaataatgaactgaaacttgaattttcaagcttaggaggacaggtttctaaagtagagcttttaaaatacaaagcctacaaccataaaacagacaatgcggatcagcctctttatctgatcactaaaaataattcaaactacggctttcagtttaaagataaaacagggaagaccgttaatactaaagatttagttttctcgcctactgttaatggaaatgctgtaacgctgacagcggattataatggtgctgtaattcagtttatttatacgttacttccaaaatatactttagactttaaagtaagaactcagggactttctaaaattacttctgacaataaagcagattttatctgggattataatgtaagaaacttagaaaaaggtagagcccaggaacaatctcactcagaattttcgtatgctttcaataattataaagattatgattatgatggaagaaccacaatggaagaggaaaaagaaactcttaactggattggcgtaaagcagcagtttttctcttctgtgattgaggctaaaaacggatttactcaaagtaaaggaaaccaggaaaatgttgaagaaggagaatatctgaagaaattcaactatgaaggttttgttcagatgacaggaagtgaactgaatcaggatttcacatggtatttcatgccattggatttaccattacttaaatcttatgataagaactttgatgaaattcttccattaggctggtcgttcatcggagcgatgaaccgttatttcttcatgtggttgtatagcattatcgctgcgtgggggttatctgcaggttgggtaatttttgtaatgacgattattgtaaaattgattctttcgccaatcatgtataagcagcataagctgagtgcgatgatgaaagtaatccgtccggaaattgatgaagtaaatgcgaagttcaaggatgctgatccaatgaagaaacagcaggctacaatggaagtttacagaaaagccggagtgaatcagatggcgggatgtttacctgcattggttcagattcctattttctatgcattattccgtttcttcccgaactttattgatcttagaggacaggggttctggtttgcaaaagatttaacggcttatgatgatttgatcaagcttccgtttaaagttcctttccttggagaccatttgagtatttttgcattagcttgtacgattgttattttgatttatacggtaatgacctcaggaaatatgcagcagcctcaacaggaaggaatgccaaatatgaaggtgttaatgtatatcttcccgattacattcctgttcttccttaatacttcggcttcaggtctttcttggtattattttgtatcgaatgcgattaacatcttaattatcctggtgattaaatatgtgattctggatgagaagaaaatccatgctcagattcagtctaacaaggaaaagccaaaagcagaaggtaagttccagaagagaatgagagagatgatggagaaggctcaggagcagcagaaagctcaggaacagcagagaaataaaaagaaataattcttaattataatatgtaaaagagcagcaattttaattgctgctcttttttatgtgtgtttttatttagaatcattttaaatttccaatcagactgtgagaatttaataattggaaatcagctgttttcagtcatatttcaatctgaaggattgtctgtgatatatcgttggaccgtgctttataagggcttcctggtgtttttttgtagcatagccaaaattagtgtcccagccgtattcaggatgctcttcgtgaagctgtatcatgagtttatctctgtagtttttagcaataatagatgccgcagcgatagataaaactttagaatctcctttgataatgcactgatgtggaatgtaattatagggatgaaatttgtttccatcaaccaaaataagttccggagttatagtcagtttatccaaagcacgatgcatggcatgaatgcttgcattaagaatattatgttcatcaataaaggaagctggaagctctgcaatagcgtaattttttacattgtccttgatataactatccaattccatgcgggttttgaatgttagctttttagaatcattaactaaattttgttcaaaaccttcatctaaaattaccgcagcagctaccaccggaccgcttaaacatcctcttcctacttcatcacatcctgcttcgatgtaaaggtttgaccagttttttattagctccatgaattgtttctatactgcaaaaatataaaattttgaaggaagttattttatgtggtttttattgtttttatagttattgcgagtataatttactgtttttaaatctttgtgttgaagttatgaattaattttgtttttcatattgatgaaataatatgttattttttggtgagtcgttagttttgataactcttgagctagtttttttttaccaattataaaactttaacgttttttttggttgttttgtgaaagtttcacatatttgtaatctgtaaaaataattgaatttgatatgaagaaactaacgacgagtctacttgtattagtattgtcttcatctgttgcaattgcaaatgctcagcagaagaaaaacgatacagctacacagacaaaggagattgaaggtgtagtggtaactgcactaggtattaaaagagaaaagaaagctcttggatatgcctctcaagaaattaaaggagatcttatttctgatgcgggacaaacaaacgctgtaagtgcactatcaggaaatgttgctggggtacaagttacagcaccgtcttctatgggaggttctacaagaattactatgagagggattagctcagttacgggcgaaaaccgtcctttaattgttgttgatggagttcctttagataactcaaacgttaatagtgtagatactcagagaggagctggaggaagagattatggagatgctacctttgatatcaatccggatgatattgaaagtgtaactgttttgaaaggaggaccagcggctgctttgtatgggtatagagcaggtaatggtgctatcatttacactacaaaatcagctaaaagaggtaggactgaggttcagtttaatagtggagtatcttttgaatcaatctacatcagacctacattacaaaatcaatatggaggtggcttagaatctactttgcctacagcaacaattaatggaaagacgtataatattacagactttggtacagatgaaagctggggtcctaaatatgatccaaatttatattatttaggttggaattcttttgatcctgagtttccaaatgagtatatgaaattgaaaaaatgggtagctcctacaaaagatgttgatgacttctttagagtaggtaccacatacacaaacaacttctctgtttctaaatcttttgaagatacaaatgtaagattatcttatacgaatactaaaatcaatggtattgttccaaactcagaaattaagaaagataattttagtttaaatgttacatctaaattatcagaaaaattaaaggcggatgccgtttttaactatgttcatacagcaggtttcaatagacctgaacaaggatatggagataattctgttgcacagaagttttaccaatggggacaaagacagcttgattttgctgagctaaaggaatataagttacctaatggtatgcaaaggtcttggaatagaacatcttgggataatggtacaccaaacttctcagataacccatattggactatctatgaaaatacatctgacgatacaagacatagattttttggaaatgctggattaacatataatttatctaaaaaagtttatgttgcaggtaaagtgtatggagatacatattcacaaacaataacttcaagagtagctattggttctgcagcattacctgaatataatattcaaaaaagaaataactctgaatttaattacgaaggtagaattcactacaatgataattttggtgattttagtttaaatacttttgctggattcaatataatgaatcgtaagtgggatgtattaaatggtaattctgttggagggttaattatcccaggattatataacttatcaaacagtgttgagccagcgcaatcttctaatgcatcttatcatttaggtgtaagaagtttatttgcctcagtttcattgggatataaggactttttattcgtagaagctactggtagaaatgattggttttctatgttaaatgatgaccagttctatccttctgtaacaggaagtttcgttttctcaaaagtattaaaggctgattggttatcttttggtaaattaagagctggttggtcaagaatcgctggaggttcagatccttatatcagaggaacttatgcaactattggaactccattcggaggaagtccaatctattcaatgcctgcgacaaaaggggagccaatgattaaacctgaattgaaaacaacaaaagagattggtttagaagctagcttctttaaaaatagattaggttttgatgtaacctattatgatgtgaaaactacagatctaatcattccattaccaattgatccttccacagggtatggatttaagaggattaatgcaggagaaatgactaataaggggattgaggctatggtaaatgttactcctattaaaagtagcaacttttcatgggacattacttggaactttacaaaaaataaaaacaaacttgttgagttacaaggaaatcttgagaattacatcttgactaatgctccatttagagtacaacttgcagctcaggttggctactcatatggtgtaatcttaggaactgattttgtatatgatgcaaatggaaataaagtagttgatgagaatggtttctacaaagcttctgaaattaagccattaggatctgtacttccggattataatatgggattcagaaactcatttaaatataagaattttggtttatcattccttattgatattcagaaaggtggtaaatacttctcgactacccatatgtggggaatgtattctgggatgctagaagaaacagcacttggaggaaatagagaagctggtgttgttcttccaggagttaaagaagatggaactccaaacgatataagattagatgctccaacatggggaggaacttactatagtactgtagatgcacagaatgtttttgatgcaagttatattaaattaagagaccttaccatatcttatgatttaccaaaatcaatcattggtaatgctcttcaaggagtaagaatatctgcttttggtagaaatctttttgcttggaatcttgctttcaaaggtgttgatcctgaaaatacggcgtatggatctggtaacattcagggattagaaggaggttcattgccttctacaagaatgtacggaattaatgtaaactttaaattttaaatcacaatgaaaaagatattttcaatattaacattggcaggtttatctctagtacttaacagttgcgcagataaatttgacgaaatagacactaatccaaactctactgaaaacccattaccgacgggattattcaataatgctaataaagagtatattgattataccagagatggttgggtatcaggtaggatgatgttgccatgggttcagtattctgcccaaaggcaatatacggaagaagatagatatcaatacagacttactactggaacacagttatggactagatcatattatgtagcacaggattataaaaaaataattgagcttaacacagatcctgctactgccgctcaaatggcaaattatggtgctaatgtaaatcaaattgcagcagcaagaattatgttgtcttatgtatttttgaatttggcggatgcatttggtgatattccttattggtcttatggaaataaagatgctgattttcaggccctaaatgtagatgctaatctacaaccaaaatttgctagccagcaaaaagtatatgctgacattatgaaggagcttaaagaagctgctcaaatgattgatctaacgaaagatgttttaacaagtggagatcaattatttggtaatgatcctgaaaaattaaagaagtttgccaattcattaagattaagagtagctacaagggtaaaaggagttgtttctggagcagaagctcatattacagacgcaattgcttctggtgtgatgacatccaatgatgatacagttggattaacatatgaaaataatttaattaatccttctcccttcttcttgacttatcaaacaagatctgattttgcaatttctaagacttttgtacaactattaaaaggtcaagtaggaaacttcggtgaagatccaagaatttttaaatatgcttctccaacaacagtgaaaattggtaatattagaaaccaaaatatggttgaagctaccagtgcgagccaaatttctggtatgccatatggtgttcctagtactttagctgctagtcaggcagcttcatcaagtttctttggtgcaagtgtgttaaagcctgcttatactgaagtttttatggagtatgcagaagttgaattcttattggcggaagctaatggttggtcacaaagtcattatgagaaaggtgtgagagcatctatggaaagatggaatgttcctgaagctaagattactgcatttatagcagctcttccagtggcaaacaaagctaatgtattgacacagaaatatgtttcattatttatgcagcctaatgaggcttgggctgaatatagaagaaatggatatccaaatcatttattattgcctgggcaaactgctaatcttaatgtaccttcagcaagtggacaaactacctatacatttacttcacttattgctggattaacagatttaccaacaagaattttttatccaacaactgtacaaactttaaatacggctaactatgaagctgcatctaatgctattggtggagacaaaatggacaccaagttaatttgggataaaaactaacaagatattaataacattcatattataccgccttcgggcggtttttttatttaataatatcattgtttgataattaaatggggtaatatgaataattaaattgaattatttttattaatattttataattatagtaatttttttatgtatgtgatttttttaacttattttttttgttaattattgtattttattgctaattgatgataaatctttattttttttaacatttttagttgaattattgaatataatcgacaaatttgtacggatataaaaataattgatatgaagaaactaacaacaagtcttcttgttttggtattgacttcctctatggctatagtaagtgcccaggagaagaaagatacaattaaagcaaaagaaattgaaggagtggtagtaactgcacttggtattaaaagagaaaaaaaatctttggggtatgcatcgcaggaaattaaggcaagtatgttgtcagatggaacaacaaatacaggaaatattgctgcgcagttatcaggtaaagtcgctggtcttaatgttactacaaataataactttggaggatcttctaatttggtaataagaggagtgaagtcactggcaggcggtaatccgttaatcgttattgatggatcacccgttaataatgccagtacccgggaaaactcaattgattatggtaatgctctttctgatatcaatcaggaggatattgaatctattaacgtactaaaaggagctgcagcatctgctctatatggtgaaagaggattaaacggcgttattgtaattactacgaaaaatggaaaaggtaaagatgacggttcgtggggagttacgttttcctctgcgatacaagtagggtttattgataagtctacttttcctgagtatcagacaaggtatggagccggctattctcagaaatttggaacccaggcttctgatggtttgaataatgcaaactttggagcagatgcttcctggggcccgaaatttgatcctaatttactggtgtatcagtgggattcatttaatcctttgtccccaaattaccaaaaagctactccttgggtagcagctaaaaatggaccgattaaatttttcgaaaatccagcctcatatatcaatagtgtaacgttagaaaaaggacaaaaagggaaaaacatcagttttacttatgaaaatatgatgtctgatggattaatgcctaactcgcacctcaataaaaataatttttccttaaaaattaattatgatctaaccccaaagttgcattcttctttttattctacaatgacattacaggatacaaagggtaggagtattacagggtattcaaacaatattgcgaccggtttcaggcaatggtggcaaaccaatgtcgatattaacgatctgcaaaatttatattttgcaaatgtagatccgcatgtagctaatgcatccaataattatggtaatgttacatggaacagaaagtctgcagcaaatggagcacctgcatattggaacaacccatatttccaggcttatcagaattattcttcagacaaaagatatagaaatttcacttatggtcaggtcacatatgacctgctggataatatttctgttaccggaaaagtttcttatgacaggtcaaatcttatggctgagacaaggttggctgttggatctttaccacaggcttttggattgtcaaataactcaataggttctggatatggaagacgtgacatactgcagacagagaccaattatgacttaatggtgaattataaattcgatattacggataatattaatctttcgggagttgtaggaggaaatatacgtagaaattattataattcaatctatgcttcaacagaaggaggattgatagtacctggaatttatgctttatcaaactctaaaaaggcacctctagcaccggatgaaatagaatacacaaaacagactaattcatggtacgcaacggcatcatttgatttctataaaaaattctatttagatgcgacatttagggtagaggaaacatcaacattactaaaaggtaacaatgtttttaattatccatcaatcacaggggcattgattatgtctgaaattctagatactaaaacatggatgaatttttggaaaatcagagccaactatgctcaggttggaggatctgctgattcttatctgctatataataattacaaatccgccggaattttatccaatcaaggaatttataactctattttaaatcaatcttttccaggtcttcaacctcaaaaggctaatgaatttgaggtggggactgaagcacatttcttaaaagatagaataacagttgatttcgcttattataaaacaagaactactcctcagattcttaatccacttcctacgtctgcagctataggatatacaggtaaagtattcaatgcaggtagaattgataatagtggagttgaagtacagctaggtttggtaccaataaagacaaataattttacttggaatattgatgcaaactggtctaagaatcagaataaagtagtagaactatatcctggaattaataattatctcctgaatagttttcagggaggagtttctctaaatgctagagtaggtgaagcttggggaacattgattggtgctgattatacttatttaaatggacaaaaagttattgatcctaacacaggaaaatatttgcaaaacccaaatcaggtgataggtaatactactccagactggattggaggaattagaaatagcttcagctataaaggcttctctttaagtttcttgattgatatgcgtaaaggaggggatatattctcaacagatatgtattatggattgtcatccggtctgtataaagaaactgctgaaggagacttcagagataaacctattattgtaccaggtgttcttcctgatggaactccaaataatattgcaatatcacctattgataacagtggttctaccggatacaaaacacagcctgcaagtgcatttgtttatgatggatcttttattaagctaagagaggcaagtattggctacatgcttccaaaatctttattggcaggtaccaagatttatgatgctaagatttcaattgtagggagaaatctttggataattcataaaaatttaccatatgctgatcctgaagccatggtaggaggaggagttagctcttacggatggtcaatcggttcaatgcctacgacaagagatctgggtattaatgttacatttaaattctaaattactttaaaaatgaaaaatattataaaaataagtttggtgtctgcatgtattggattagctttaagttcatgtcaaagtgatttaacttctctgaatgatgaccctaaacatccgtcggttcttccatctgataacttactggctactgcattatatcagtcatcttattatatggataaccctagtgtaaatttcaataattacagattctttacacaacaatgggcagaaacacagtatccggacgaaactcaatataatttggtaacccgtaatcagcctcgtaatcattttaacagaatgtatgtttacagtattaacaatctgaaacaagcaaaagtgaatctgatgaatgaggtagagacggatgacatacgcaccaacaaattggcaaccttagaaattgaagaaatttttatttgggaaaatattgtggatacttatggggatgttccttattctgaagctttcaaacctgatgagattttaactcctaaatatgatgatgctaagactatttatcttgacttgatcaaaagaatcgatgctgttactgctactataaaacctgcagcggcaggttatagtgatttggtttacggaggtaatatgactaagtggaagaagtttgcaaattctattaaattaagattaggaatgaatttagcagatgttgatcctgcattgtcaaaaaccaccgttgaatctgcaattgccagtggtgttatttcttctgacgatgacgcttacaaatttaaatatgatggaaatactttttccaatccggtatttgataatttagtagcctcaaatagaaatgatttcttacctagtgaattagtaattaatactatgagcaccctttctgacccaagaatggatgtttggtttaccaaagtagaaggagtatataagggaggagtctttggagaattaaatgatccatatactaaattctctcaattaagttcttatttcagaagtgctactacagcatccaatctttttagttatgcggaagtagccttcttaaaagcagaggctgctgcaagaggttattcagcaggaggtacagctgtggatctttatgctgcagctgtaaaggaatctatgagagagaatggaataagcgatgccactgcagatgcatatgtgcttgcacacccttataatccggcaaactggaagcagtctataggtgtccaagcttggattgctatgtttaataaaggttttgctagctggaactttacaagacgtttggattatcctattcttgtgaatcctccaaaatctaatttatcttcagtgccttacagaatgccttattctgatcaggaatatgtattgaacggagctaatgtaaaagccgctggtgataaaattggtggagataaggctacaacaaagcttttctgggataagaattaacacatattttattaacattcatattataccgccttcgggcggtttttttatttccgtatatttgtacttcaaaattttgacatgaaatgcgggctattacatgtggcctatgaaaaataagtatgaacacatgaatattaaagatattatagagcaaaaactttcggaagttattttaaatgtatatcagttaaaagacattaaactggaagttcaggaaaataaaacggaatttgagggcgattttacaattgtcactttcccgttggtaaaacaattgaagaaaaatcctgaaagcattggggttgaattaggagaagctttgacagaacagactgaactttttgaaagcttcaatgtagtaaaaggattccttaatgttaaggttaaaaatcaattgtttgtggataatttcagatccgtaagtgaaaatttttctacaatagaaaagaaaaacgctacggtaatggtagaatattcttcaccgaatactaacaagccattacacttgggacatatcagaaataatttattaggattctcagttgctcagattttaaaagaggccggatatgatgtaatcaaaactcagattattaatgacagaggaattcatatctgtaaatccatgctggcatgggaaaaattcgggaacggagaaacacctaaaacaaccaatactaaaggcgataaatttgttggaaactattacgtagaatttgacaaaaactataaaaaagaaattgcagagctagtagagcagggtgtagaagaggagcaggctaaaaaagaggctccggtaatgaaagaagctcagaaaatgcttctcgattgggaaaacggagatgaaaaagtaagagcgctttgggcagaaatgaattcatgggtttataaaggattcaatgaaacgtataagagattaggcgttgactttgatcaggttcagtatgaaagcaacacatatattttagggaaagatcttattcaggaaggactggataaaggagtgctgtaccagaaagaagatggttctgtgtggtgtgatcttaccgatgaaggtcttgatcagaagttattgcttcgttcagacggtacttctgtttacatgactcaggaccttggaacagctgttgagcgctttaaagacaacgatattcaaaagttgatttatactgttggaaatgaacaggattatcacttccaggttttatttaaaattatgaaaaagcttggatattcatgggctgatcagttattccacctttcttatggtatggttgaacttccggaaggaaaaatgaaatcccgtgaaggaaccgttgtggatgcagacgacctgatggcagaaatgcatgaaacagcaaaattaaaagctatagaacaaggaaaacttgaaggtctctcagaagaagtaaaagtagcttcttatgaaatcattggaatgggagcactcaaatatttcatgctgaaagtggatcctaagaaaaagatgttgttcaatccggcagaaagtattgaatttaatggaaatacaggtccgtttattcaatatacctacgctcgtacgcagtctttgctggcaaaagcagattaccagtataaagaaatcttggatgtaactttaaaccagtttgaaaaagaactgatcatgcttttggctagctacaaaacaattgttgaaaaagcagcagaagcattgagcccagcgttggttgccaattatgtttatgatctggctaaatcttataattcgttctaccaaagtaatattattctgaaactggaagatgaaaatttaaaacaattccgtttaaacctttcagatcttacagcaaaaacagttaaaaaatcattagctcttctcggtatcggaaccgtaaacagaatgtaaaaataaaatcctcctgaaagctcaggaggatttttatatcatttaatcggttttcgtactaagcaattcggatcacttatttcaaaatccccgaatctcgaattctgcattttacgtcttatcatcgggctcactatgcatctgcctcaaactatctgcatacaacttagccggagtccatcgcgcatgtttggaaagcgtgactttatatccctttttataagtgtaaaccttggtaaattctgcaccaaagaagatcagcatacaggagtaattgatccacatcatgatgagaataactgttccggctgcaccaaaggctgaggtaggttttacctggttaaaataaaggcttaataggaattttccgagggtaaataaaacggttgtcagaaatgcgcctttccatacaggtttccagctaatcaaaacatcagggagcactttaaacattaaagcaaatagaagcatcaccagaccaaaacccaccgcaaaattgacaagttctaccaacatataggtttcaaaaccaaaatattgggtgataattgtattaaacaagctgatcagagaagataaaatcatggtgatcattaagaggaatcccagaataaggatcattcctaaagaattcgctctgtccagtaagaatttaaccagtgcttttttgggagcagcttctacttcccaaagtgtattcaatgaatgctgaagctggaaaaaaagcgttgtagaaccgaaaaccaatgatccgactcctaccgctttcataaaaatattttttttgtcaatcaaagcacccgccagcattccttcgatactttttgccacatccggtcccataataccactgatctgggtactgatctgtccgcggatggcttcttcaccgaagaaatttcctagcacccatataataatgatcaataatcccgggattgaaaagatagcataataagcaagacttgctgaatctttagatgcagaagaattgttccattctgtaaatgtgtctttcagaacctcccagaaaaattttgcagttttgatcatattaaaaaggatatccgatggcaatatttaaaacaagattatcttttctccagcttggatctccgaagttaattttatcgaaggcccatctgtctcctttctgatagtaaggaactctcagtggcattgcaagatccagccttaagatcaggatagaaaaatccagtctcagacctactccggctcccaccgcaatttcatttaaaaaatcttttgaaaacttagctcccggtctcgtggaatcgtcatgaagcagccatatatttccggcatccacaaaaaaagctgcatttaaaaacttataaagattagcccgatattccgcatttaattccagcttaacatctcctgattggtcaaaataagaaccttccggtatggttctcggatcaaagctccccggtcccaatgttcttgcacggaaagctctgatactgttactccctcctgagaaaaattgcttggagaaaggtataaactctgaatttccgtatggataagcgattcctccaatgaatctcgttgctaatgaagacttttcagtgaacttatgatagaacctgaaatcattttcaatttttacatactggctgaaaggaatcccaaatattttcctttccttatctttttttacatcggcacccgtaaccaatcctgtaatatttcctgccagatcaagtgtccccttataataaatggtattggtcttaggcagcatagtgttggtataggtgtaagagtaggttggaccgaaaataagctgttttgcaacaactcgctgcatagcaggattgctggcagacttaatctcgtattcttctgtaacatttgctggagaaaccaaagtaatatcaatcactttaagatcatgttctttccttgcattttctttccataaatatccgaatgacccggtgaaattattaagcgtgtaatactgggttctgttttggaattcatatcccaatgtgatattggttctgggaacaaactcactggaagaatgaaaacggaaaggtgccacaattctcggaatagaaagctgtacattcgttcctgcacggaaaatattattcgcattctgagcgcctcccatctggaaatcaaaagccccgtagatcgcagctttaaattgttccgcacccctgaagaaatttcggtgggtccagttaaggtttaattcactacccgcatagttggcagaattggttcttcccaatgcttccagacgaagggactgaattggtctcggggttaataaataataagcatcaaatttgtgacttaaagaatcagatacgataaactcattctttacaaacttgaaaacacccagactgatcagccggttcagggtaaggttatgattggaacggttatacagatctccctgtttgaaatataaagctctgtcaaaaatctttggtttgaatttatgctgtggatcaattacatatatatcatcgaaagcatattttgaaagagaatctttattcatagggatgctgtacttaccgtcttttacatcctgaatattgtagttgggaaatacaatcaccttatcaatactgaattgctgagttgctaaatccggagtattgtctttcagttttacgttaagttcaaccttatggtttttgcttaccgtactgtctgcctgtacaataatattatccggatggaaataataaaagcctctttcctttaatctgttatcaattctttctctttctgctttaatgacatcaaggtcaaaaggtctgccgtttttgagaagggttttatcggcaaaactctgaatttcatgattgaccaatgtagaatctttctgaaacttcactccatcaataaggtatcgtgaacctggtctcacggtatatataacctgagcctttttattttttgaaaccgtatcataggtagctttagcattaaaatatcctttgttttcagagtaattttcaataatatctttattgaattctctgtctacatcacctaataaaactggtttttcacccactttatatttcagccagtaattaaaacctttgtcttttttaggctctttggctatgttatagaaatacagctttgggcgcattcctaaaaatgtagaattgggtttgggagttagattcgcttccagtgcagactgcaattcttttttttcctttttcgaaatcgtatcgttttcaatctttacttcagctcctgtgtagagcatctggccctctttcaaaaacctggtattgctgcacgaaatcaccgttgatgccattccggaaaccaacagatacttacaatatatatggaacttattactcattatttaaattctaccacttggttattttgattctttttcggttttttctctttggatttctggaaaatctcccggaatttgtcataatccaacgtaataataaatccgactccggtttctatgatctgcccctgaagagctacctggtattcatccttacgataagcacgcagcatatatcttccatccttggaaagactgtaatctacagaaacattccctgcaatattggtcatgttttcattctgacgggcctggccttccagtccgaagttacttcccaccgttactttcagtcggtcattcagtaactttttactgatatccacattcagatcggttctcgtatttttctccccgctggaataatcttctgaagaatcaagaccaaaattaagatcgactcctttaatcagacctgccgcaagattattcaattgctgagaaaggattttgctcacactctgtcttgccatggtctccgcagacattcctgctccgctttcaaacggattttctcctataaaacggttcagaagcaataaggcaaatacctgcttattcagttctgattcctgggttctgacctgaacgagtttctggtcaataatatcttttacattggtggacacggcattatttttttcatccgtggtaatatcgaaagtgagctgaggtttcaatagttcacctttcattttcaataacgcattgaaaggaaccctttgtttaaactgattgattgtggaggcactttctccactgatctgctgttctacaaggtcaataggcggagcttctgttttgtaaacggctgtaatatccatctgagccattgtaggttcaccggtccaggtaatagtacttcctttctggatgtcaaatttacgtttcaggaagctcacagaaagatcatagcttcccttgtccacttcatacactcctaccagtgtggtttttcctgacggatctattcctccggttaattctgcctcgccctggagctgtacaaaatcaccattggctttatcaataattaatgaaagttttgcttctttgctgacctcaatattaacacttacatccattcctttgatacggctctgtgcattaagtgtgtctgctttaattgttttattcaaaactacctgatcctggtctacaaactctacaatgccgtctctttcctgtaaagaggggctggattgtggaagaacaaaagtgaaatccgtattgtcagctacgcttaaccttccgtctacttttggaagatcaagatttccacggatatgaagacctgcatcaatggcaagaataccatacataatcgcatcattggatttttcagaattaaccactttaaagtctttggcattaacattcaggttaaaggcaaaatctctgtacgtctgggtaagaatctgcccatccataactagtgcgttaccgtctttatcttttattttgaatttgtcaaactcaattccacggctggtaaaatctatttcatcgctcagatgtctgaaatcacttcctgttttggcaatttccagtccggcatcattgaattttacttttcctaaaatattcggtttatcactggtccctgtaatctttaagtttcctgaaagatagccttccgtattggtaatcgcgttcatggagaatccctgaatactcttcatctgaagctggttgatcgccatattcagatcgaaagtactggatgaggtattgtaatctcccaggatttttacatcattgttatttccggaaagagcgatatcggcatttaaaatattcggtgaagcattgttcacttttactgcaagatttccaacaggacttccatagacaattaaatctgaaatattcaagtcagaagtgaaggtcatttttttagtcacatcacgaagctgagcggttccgttaatagttcctcttgcaagtaccgtatcttttttaataagttccgtaatggtttcaatcttaaaatctttcaacgaaatatttaaaggactgctggggttgttgttttccgactgaacagcaatttcactgctcccgttagataaaataaagttatccgccagaattcctttgctgctgatctgtattttattgttttcagcaacattccagtcagtataattcagttttagaccattggggttaagcgatatttcggtaatatcattcaaggattttgcatttcctgcaatcagaaaccgggtggcatccttttcatcttttgtggtgacattgtatcggattgtgttattggcaacatctccatcaatattgattttatttaaagaaaagcttgagctttttaaggccgcaacgttcaggctgtactgcagcgcctgattttcattcgtaacttttaaagctcctttttcaatagaattttcaccatacaataatcgcggaatctgtccgtcaatttcaattttctgagaatcggcatcatagtttccagccaaatttatggtttcaaaatctttcagatccggaacaaattttctgatcaggtcgtcatttttgattttggccgtaaaggtaaaatgctgccccggatcaattttctggcttttatcaggtttctggaactgataatactgattgatagtttgcgttaaagctccaaaaatctgagtgagcttatattttcctttcaattctgcgtcagcaatctgggaattgaaaataatctgcgtggaatcctgagtagatgatgctttcagattgacttcctgtacaggatacacttctttggtatctgaaaaagcaaaatctttaaggtttagatatccgttcagattatttggatccagactggtgaaatcaccatcaatttttccggcaatgatcattggtttttcatagaaaccaagtttattgacatccagtttgatgacttctccattcacttttaccgttggatttttttcgttataaacgcctgaagcagtcagttgtaaacttgcatttggatctttggagtccaaaataacatgataagcccctttgcgaatctttccggtaagattcatgttttgataacggtaccctttgtagacagcagaagctacgtgtccttttaaatctgcattggcgtttttaaagtcaaaactttctcctttcgctgcaatttgagcagtcacagggccaatatctttattctgaataatttttcctacctgtattccctgaagattggcttttatatcatacagttcgtgattctttttttgcatgtctacctgtgcgataatggctgcatttccgagagtagagtagagattcagatcggtatttacgacctttgtggtgccttttgcatttcctttgatgctaaagtgggaaggaagcgaaatattggatggaattgtatttttagggacaagattgaatatcgttttggcactggaagaaaattcggcgattctcagatcataatataactgattcggattcatcgcattccttatttttccggaggccattaccctcagctgatccagcccggaaactttaagatcctgaatcaaaagatcattgacgctcccttttatattagcattgacattaaggatagcattcggatatttattaaaaggtactgtatttcttaaagtcggagccagattcagaatatctgaaaatccgattttggaatctttgatattggctgaaattttcacagcacctgggtttgaactcagttgatcaatagagttataatttaaaataacctcatcgcgcaatattgttttcggagtttgcagataaaggtctttgaggtaagcctctttttcagcatatacaaaatccgtattgaacttctggatatccagacctctgccttctttaatctctgcagaatttaccgttccggcaaaagtattattctccattttaaagcttctcacttccacattcatttttgaaaaattaaggtggttgaagtcaattccctgtttggttggagcaatggcagtattattataggttgcttttacatcattcaacacgagctttcctaaaagaagtttcatggccttatcctgatcggaagctttggaaacctcaggttcttttgtgtttttcggattggcatttttagcgggaagataaaggttggcattaatatctgccccggaaaggaaaatattcgctacgttgaaaacgttgttttcgagatccagtttattaacctttgtgcttagctctttaaagataacttttgcaaatgttttggtattttcatcaccgtaatcaatattgaaatgggtaagcttaatgcctctcaatccaatattcatcggctttttttcattgagggaatctacttttttctctacctttttggcaacttcttctacaaggtcctgctttagctttaattttaatccgtcaagattaatatcattgacagcatagttgtttttgttaaggtcaaaagtttttacccttgtatcgaacgatttaaaataaagctgaatatcgttcttcgactgctggtcgttgaaggtaacgccaacatcttttaaattgattttatcgagagaaataataaaaggtttggaaggactttcctctttatcactggtcgcaaaagcatcgataatataatcaaaattgaatttgccatccggtttccgtaccacattggcgcgggctccttccatattgacggatgtaatatctgctgtagaattgagaagtttcaacatgtgtaaacctacatccagttttttcactgccagaagggtatcaacgtcctgtcctttgagatagaggttttccataacaaggctattaggaaatccaatgtagactctttcaaggcttaccggagttttgatttttttctccaggtaaacaataagtttgtctttgatgaaattttgaacggcaggaagtcttaagcttaatatcaacagggtaagaagaaccaatattgaaataaaggttattgcaatacgccttaagagttttgtggtgttgattttcagtttcaaatgcgatgtggtttctaacaaagataataatactattttatttggtctttgttgtggtacccttttgcgtatgcaaaaatcctgccttgaccgtctttttatggaatttttagtttgtagttgtcaagtgaatagttgagtaggacgaaccaaggcaagaattgttattgtaaaaaacgccccctttttatcatttttttaatgttgaaaaggttagttagcaaaaatgaaaattcaaatgttagtgtattaagggggcgtggcatggtttataagatagataataaatttttttattcatttccgttttcccattttacctcttctccctgaggagctgctccgccttgtgcggttgtaataggagcagtttcctgattgatatggtaaatgtaagcggcaattttttcagcatctcttccggtaatggttccttccttgatgaaaggtctcatggtaggattgttgggagaaccgttttcaagcatccagaaaacatttttaaacaagcttttttctttaatattaatccagtgagtatcggtaaggttgggaccaatgccgccttttcctccgtctccgtggcaggtaacacaattcgttttgaaaagttcctgtccttctgcaatattatcagcactgtatttggcagattccagattgatctgcggggcacttttttcatactcttcaatggaagctaacatggtttttgcctccttggtatattctacatcaggatgggcgtaatctgtaaaagagaaagctacaagatataccgcgcagaagatgcatccgaaccagaacagaccgatccaccattttggaagagagttgtcaagctctgtgattccatcgaaaccatgatcgataaggatatctttttcttctgtagcggtttgctttttgaaggctgaattccataacttctgataataaggaatctttttttgctccagatattgttttttctcttcctctgataatctgctgaaactttcattctccaccagatctccaatggagttcatgatcagcagaaggataacagcgattaatatcagtgcccagaaaaaaggagaagaaaaatatcctgaatctccggcgaacatttcaaaggccatgatcgttaaacctatcgttgttgcgatatatactgaaattggggttctcgttttcattgcaatacaattttaaatgttactctacgcttgcggtttgtacctgtgttgttttgatgtctgtacctaatctctgcaggtatgcaatcatggctacaatttctctctgctcaagtggtacataggcagatccttttgctgctttttcctttgtcatctgatctttcacgtcggtagcttcagagtagattctttttacaattgcttttgactggttgtctgcccactgattggcagaatcgatctgagcttttgtatagggaacatcaaaagcatttttcatcagcttcattttatccaccatttgtgttttatcaagtttattggtaattaaccatgggaaacgtggcatgatagaacctgcagatgtaatccttgggttatacatatgtttgaagtgccatgaatccgggtttctgcctccttctctgtgaagatccggccctgttcttttcgatccccataaaaatggcctgtcatatatgaattctcctgctttggaatattgcccgttttttccttcaaatcttaccacttcatcacggaatggtctgatcatctgagagtggcaggcgttacatccttcccggatatataaatctctgccctcaagttccagtggagtataaggtttcactgcagtaatggtaggtacactttgcttaagggatagtgtcggaacaatttccaccagtccgccaatcgctactgtaatgaaagctaatattgaaaggagagtaggtgttctttccagccaaaggtgtacgccttcgccttcttttcttgcgcttccgatattggccagtgcaggtgcttccgccggaacttctttctggaatgagcctgccttaattgttttaatcacattaacaaccatcagaatagctcctgaaatatagaataaccctcctaagaatctcattttataataaggaataacagcggttacggtatccagccagtttttccataacagtgttccgtccgggttgaactgtttccacatcaatccctgtgtgaaccctgatatatacataggtacggcatagaaaataattcccaatgttcccagccagaaatgccagttcgctaattttacagaccagagttttgttctccacatgatcgggatcaggtaataaacaattccgaatgccatgaaaccattccacccaagggcaccaatatgtacgtgaccaattacccagtcagtatagtgaccaattttatttaatgattttgttgctagcagaggtccttcgaaagtagccataccatagcaggtaacggcaactacaaagaatttcagaataggattttctcttactttgtcccatgcccctcttaaagtaagaagaccattcagcattcctccccatgatggtgcaataagcataatggagaatccggttcctacggcttgagcccatgccggcaaagctgtatattgaaggtggtgaggcccggcccaaaggtatacaaagatcagcgaccagaagtgaataatggataatttgtatgagaataccggtcgctgagctgcttttggcataaaataatacatcagacctaatacaggagtggttaatacgaatgctacagcattatgcccgtaccaccattgtactaatgcatcttttactcctgcatatacagaataggatttccagcttgtgaaagataacggaacttcaaggttattgaagatgtggagcatggctacagcaatccaggttgccatatagaaccatattgctacatatagatgtcttactcttcttttagcgatagttccgaacatgttgattccgaaaatgatccatgagaatgcaattaggatgtcaataggccattcatgctcggcatattctttagacgtattgattcccataaggaatgtaatcactacacttacaatcatcagctgccatgaccagaaatgaatccaggaaagggtatcactgtacattctggttttaagaagcctctgcatactgtagtaagcaccacagaaaaaggagttacatacgaaggcaaaaattacagcactggtatgaagcattctgattcttccgaatcccatagctccctgtgtattgatcagtccctgaatattacccgaagccaggcttttaatagttgtatcatccgtaccgaataaaaattcaggcaattcaggataaaaaagcatcaatgcagctgtaagccccagcagaaatcctacaagtccgaatgcgatagtcgcatagaggaatgctctgacaatggtattgtcataattaaatttttgcgtctccataaattccaataatgtttaccgaagtgatatttcctttgaaaaaggtttatttttaacctttttatatgttaaaagtaaatatcatgtaacgtgtataatgttttgccaaaggtatttattaactttgttgaaggctaatagataatcttctaaaatataccgaaaactactaaaacagaaacgatgaaagtatgtggacaaaatatcagaaaaatacgtaggagtaaagatcttacgcaggagtatatggcctttgaaatgggaatttcccaaaaggcttattccgatattgaaaattccaaagtgaagatcaatctggaaatactgactaaaatatctgatattttagagatcaggccatccgatatctgcagtatttctcataagtgcggaactgatgcgtttgaagataaataccaaagccttctggaatatatgaaaaagaataacatatcaattcccaaagaatttctataagctgtaatattatcttttaaaatataaaacaatgatctccccggacagagggagatcatattttttgcgaacaaaaaagactgtgtttctagcgtgcctgatgaccatggcattgatgagggaacaaatatttggtttttcaaatttattataatcaatgtggtattaataaataattatgtagaaaaaaattcacacaattgtggataaatatttacaataaatttaattttgtataatatatttgccttaaatataatgctggccctctgaatgaagcatctctactttatttcacttctattttttttatgtgtcaacggccaaggctatacgacccaatggtataatatggacaatggtctgcctcaaaacagcatcaaagacattgtaaaggacagatatggttttatctggctgtccatggaaggcagaatcatgagatacgacgggagtaactttgtacagtataataatttcaagcttaaaaatttaagttttggagatttctatggcagtataaaaaaagacagcatctctgtttttaacacttctgacaaaaatgttcttttaatttcacgtcgaagaccggatattatagctgccaataatacatttgagagtagagaagttttgaaaaataagatctgtaaaagaattgtaagaaatactctcacgaccagatatatatcttattatattaattcctattatgttcagttggatgaaggaacctattactttgaagacaacaaaattgtttatgttgataaaataagtaagaaaagaactatcattaccgttggtttttcccatgaccggttgaaaaaaatgtttgttcacggcgaatctgtattcattagtgatccggcccggaagaaaataatcaggttatacaaaggaacattatcagagatagaagctgattctatttatacagatcaggaaacgagaatgtactggcagcaaatttccggacaggtttttattattaaccgtggtaagatatacagaagtgaattctcagcgggtaagctaaaactcacttttttattggagtatagggacattgataaagacatctccggggctatgttttatgatgaggtggcaagaaaactctatatcggaagttctgttaatggattgaagattctgagcctgtcagatttctcggtttccagaaaaaatctgccctatcaggatgaggtttgctatgcggcaatttcttatggggacaattctgtgctgacacaggaaggaataaaatattcccgcaatacttcagaaagggtgttttctgctccccaatcctatgataagaggtacatattggaggataatgtaggaaatcttatatatcgcgaaaataattccattcatataaggtataaaaatgccggattttcaaaatatgattccatttcttttcaaggtaaagagattgacgggctttataaagatggaaatctgtacagtgcatccatcgtagataaaaatcagttttatctctatttgtttgaccacgataattttaagaaaactgaaaaaattattccatgtgaaaataatatagatgctgttttcagatatgataaagacctcctctatctgggaagcagcggaggaatttatgtatactctttttcccggaataaagtgataaagcagataggtaaaggccttcctgtaaaacaaatcatcagaacaaaagatggaaatatctggttcacgacttacagcagaggaatttatctgatgaaagatcagaaagcagtcagagttccttccgataaaaataattttctgacgaatgctcattatctgttggaagatcagcattccaatttatggatatcttctgataacgggttgttcatgattaataaagatgatctcctgcagtacatgaagacatcccggggtgcggtcacttattaccggtatactaaaaaacaggggcttttgaataatgaattcaatggaagtgcaaacccttgtgctcatgtgctgaaggacggacaatttgtatttccgtctatggaaggatttgtattttttaatcccgcaaatatcagcgtttattatccgggcaggaaagatatttatttggaaagagcaaggataaaaggaaaaatgatccagctgaaggataaactctttctggaatgcggatataaaaatgcggaactttatatagatattccttattattctgatcttgacaatatctatcttcaggccaggctttcagggagtgaagacagtcgatggattaacatcaaaagtgatcggatattccggttagccaatatagaacccggaacttacaatcttatcattcggtttttatcttccgaaaccgggaaattcgtatataaaacacttccggtagaagttgaagcttatttttaccaaaccgtgttctttaaaatcctggttgcaggaattattattttcgttattctggtgatcgtgcagatccggactaattttttaaggctgaaaaataaagtattgaaaaataccctggaccataaagataagcaactgctggaaacccataataaacttaaaaaccaatccgattatcagaaaaagctggtagaaagtatcagtcatgatattacaactccggtaaaatttattgcacttctctcgcaggagctcaaccagtctgaagatccgaaaacacagaaaaaatattttgacagcatttacaaaacctcagagcagctttataaatttacattaagccttaaagaatatacggaactgtataaacaggaaaatacagagaatgaagaatattctatctatgatcttattgaaaccaaaaggttattgtttgaagaaattgcagcccgtaaaaaaacatttatctacaacttctgtgatcatcagctgaagagtaaacttaataaaaatattctcctcgcagttttccacaatatcattgataatgcagtgaaaaacacttcagacggagaaatcatcattacatcagcctctgcagaatcccatatcgaaatcaatattgctgataccggaaccgggatgtctgatgaacagatgacctattattccggattgtttaagaaaaacgagaacgaacatatgatctttaaaaattatggtttagggcttcatatggttgttcagctgataagaaagataaattctgaaataacgtttcataaaaacactccgaaaggaaccctcattaaaatccttattaaaatatgacaaaaaaaatactcattgcagatgaccatcatgtggtaagaatcgggacagctttgatcctggagaaaaattttaatgatatagaagtagattttgcagaaacttatgacgaagcaaaacagaaaattgaatccggaacattcgatctgcttattcttgatattgaacttcccggaagtattctcaaatcaatggtcaaagaaataaaaagcatttcaccggaaacatttattttgatctttacttcctataaagaaaatattgcgctgcaatatattgaagaaggagcaaatggctttctcaataaacagagtgaccctgaacattttgtcaaagctgttgaagttatatttaaagacggatattattatacttctgagatgatgaatgagattttaaaagggaaccaaaggaaaaaagccattgaaaatctttcagagagagaactgcaggtttttaatctccttgcaaaaggaaatgggaaccttgaaattgcaaacacccttaacatcgaagaatctaccgtaggaacctacaaaagaagagtctaccagaaattaaagatttccaaccttgttgagctgctggaaatttacagcgagattcattagagcaattttcttaaagtcataatatcactacagttttgtggaaaaatacgtacagtatctgttccttatttactcatttttcgcagtaggttagtgcttcaataaattttaaaaacaatttcaatgaaaaagatttatgttatgattttagggatttttgcgaacttagccatcgcgcaggttggggtgaatactccaaatccccagggaatgtttcatttagacggaaagaaaaacaatgaggcatcaggtcctgtgagtcccgctaaccaggcagatgatgtagtaatgacgtctgatggccgcataggcatcgggaataataatccggcggcaagtttagatataaagaccgcaggaaccttagctgttccggtatcaggaataaaaattgcggatggcgcacaaaatgataattatgtcctgacttctgatgccaatggcaacggtttatggaaacctgtaaggcttaccgttgtaagaggcaccaatggacctggagtagatattccttttacatttactaacgcattcagttatacaggatcttatatcgatttgcctcctggaaaatggctggtaactgtgcagcagcttattattccaacaggagctgtgttaatcagtgatcaatggatgtggctgagaacaagcttttcagatcagcccaatattgtacctggagacgtggctgatatttcaggagatatttctcaggctccggttttggtaagcgggcttattcaagggccgactgctccaacgcttacaagattttctattattcagggaagtctggtgatcaacaattcatccggtgctgtaaaaagatataaatatattgcaggaaataatgtaattggtggtgcacagacaactgctacctattttcagggatttggaggaaacttttccgaaaatattatttatgcagtcccaacaaattaaacgacaattatcaggattaagctcttaagagagaaagatcaatgattttatatagtgttcagataaaccttggcaaattgctgaggttttttcttgttggttctactgtcaattcccaatttcgcccatggaatgtgaatttctctgaaaagtttttatatatttagcgaccgaataattcattcaatgagcaacgaaaataaaacaggacaaaacgagaatttagttagaggattaacaaaccgacatatacaattaattgccctcggaggtgctatcggaaccgggttattcctgggaatcgggccggctgcagtactggctggaccatccgtaattttaggctatgctttggcaggtatcatcgctttttttattatgcgtcagcttggtgaaatggtagttcaggaacccgtatcgggaagttttagctacttcgcgtacaaatattggggaaattttccaggatttgcttcaggatggaactattggattctctatattctggtgagtatggccgaacttacggctatcggacattatattcatttctggtggccggagattccgctctgggtttccagcttattcttttttgtagtcatcaatgcacttaatttagcttctgtaaaggtatatggagaaacagagttctggttttccatcatcaaggtagtggctattattgcgatgattatttttggtgtatatcttttaataagtggtactggaggagaaaaagcgagcattaccaatttatggaatgacggaggattctttccgaaaggattatttaataaaacagaaagcggatattcaggattatttgcagcaatggcgatgattatgttctctttcggaggactggagcttattggtattactgctgctgaggcgaaaaacccggagaaaacaattccgcaggcaaccaatcaggtgatctacagaattcttattttctatgttggagctttagtaattctgttttcattaagcccttggagagatattacagaaggatccagcccgttcgtaatggtatttcaaaatctgaacggtcttgagttcagcctttttgggaaagtgattcagttcaatactttgattgccaatgttcttaacctgattgttttaacagctgctttgtcagtgtacaacagcagtgtttacagtaacagcagaatgcttttcggattagctcaacaggggaatgccccgaaatttttgaaaaagctgaataaaaatgctgtgccgatcaacgcaattattgtgtcgtcatgctttgcaggaatctgtatcatcatcaataaattagtccctgaaaaagcttttgaatatttaatggcgctggttgtatccactttgattatcaactggctgatgatatgctacacccaccttaagtttaaaaaaacaataagcgcagaaggaatccattcaaaattcccatctattttttacccggtatctaactatatctgcattgcatttctggttttgattttaggattaatgagtattacaggtatggaaattcaggtgattctgattccggtctggctgggctttttatttgtgatgtataaattatacaaaccgaattaggagttaaaacaatatttgaaaaggtgaaaatcatttgattttcacctttttgtttgtggatagtagtgaaattaaacttttaagagaacttcagataagaacaattcgggaggatatcatagtttttccaacttattttttgtacattagtaacaggttatatttcaaattaaggtgaaaatttacatctgatgttgaaattcctgcggacgaaccgaacaccgcatcacaaagtaggcagaaccaaaaaagacacctatggccaatttatttcaaacccttaccaacactgtaaaacattggtatatcccgttaatcttcggaattctgttcctgatctttggtttttatgttttcagtgtaccgcttgcaacgtatgtgacactttctatctttttcagtgtttcattcttattttcaggcattactgaaatattcttttccttacagaacagcaaatccctgcagggttggggctggtttcttgtgagtggattattaacaacggcaataggaatttatcttatcgcaaaccctcagatttctatggcagtacttccgtttgtcatcggatttacattgttgttccgttcttttcagctattaggttttgcctttgacctgaaaagcatgagaataatgagctggggaaatgtagctcttgccagcgcgggagggattatattttctctattgctgatattcaatccggtatttactggaatttccttggtaactcttaccggtgtttccttcatattcatgggaattgcttccattatgctggctctggatttaagaaagataaaaaagattccgggcaaggtaagtcaggaattaagagaccggatcaggtcgatacaggaagagattgatgaacttaaaaaatagtaacgtattatttcaatataaagaccttgtgaaaggtcttccagattatcgatcttaagaactacaggagctacgggagtaaaacaaaccataatgggtataaatcctaattttaatagtaataatgatgtgtttattatttctcatattcctggtggaagtgattggtcaatggacttaaccctgggtaatataggtgtcgttaccaatactcctaccaatactttagatgttgcaggcagtaccagagtaagaaccatggatgtggcagcaggtgctacccttattacgccggtatattcagatgccaatggtgtcctgaataaagctgttgacaatatttatggaacggttattaataacacaattaccataacatcaggtgctacaaataccttgattgcaggtcttgccaataatgcagtatataaagctgtgatcaacgttagtaatagttgtgggcgcattgttattgcagaatattatgtcactaataatgctattagcaattccttctcaatcaatggaattgatggaattttaaacacagataccactgctaaagctcctaattttactgaagtgaacagatttacaacaaccgttgtttggtcaggaatcccaaattgtgctgcaggtgggactaatattgcatttaattatacattaacaatgccttccgccggaacaatagatcttaccaacaatggtgatgcaagcttacagtataaagtgatacttacaagattattttagttttatagaattcaaaaaaatattataaacaaaggctgctttcatcatagagggcagtctttttaatcattatataagacaaatacctaaagttttgatgaagttggttgctgtccagatgtatacattaaaaattggatagatatacatattctgctttccaaaattgctgtaatgtataccccagatagaatagataaattgaagttggacaaaaaacaaaaaccacccttaaaaaggatggtttgtagacccacagggattcgaaccccagatgactgaaccaaaatcagtagtgttaccgctacaccatgggtctctgtttgttttagtggtgcaaatttacagcttttttctttacttacaagaaatttttgaaattttttttaaatttactgtagaatttatttacggaaattatgctgatagacttcaataatctcaatattaacaaattatcattcgatacagaatttgaaaaaaaagtgaaaatatttcttgaagaatggttctcagaaaaaaccggagtaaatgtccagacttcaggctctacgggaattccaaagatttttgaaattgagaaaaggaaaatggtcaattcagcagtgatgacctgtaattttttaggattaaaagaaggggatacggcattgctttgcttgcctgtggagtacatttccggtaaaatgatgattgtccgttctatagaaagaaaactgaagttaaaaattactgatccttctttaaaactgacagaaaatctggaagaagaaattgatttttgtgccatgacaccacttcaggtagaaaattccctggacaaacttcatctgattaaaaatctgattatcggaggtgctgctgtttcagaaagcctgaaaagcaagatccttaagatgaaccttagtaattccaaccgtatttttgaaacctatggaatgtccgaaaccctttcccatattggtttaaaacaattgatgccggagcaggaagaatacttcactgtttttgaaaatgtaacgatttctctggacgacagaggctgcctgaaaatttttgcacctagtgtaaatgctgaagagctggaaactaatgatttagttgaaatcaggagtggaaatcagtttaaattccttggaagaattgataatgtgattaactccggaggggcaaaaattttccctgaaacccttgaagctttagtgaaaaaggatattccgaacgaagcaatatttatgggactgccggatgagagtttgggacagaaattgatattgattattgaaggtgaggaatctgatgaggtgaaaagtaagatttcagaaattccgtttgaaaaaagcttccataagccaaaagaaattattttcatcaaagaaatcccgagaacacccaacgggaaagtaaacagaatggagctgtataaaagtataaatatttagccaaggttattgacatcggatctaaaacgtaaagaaatgaaagacttttcaaaagaactcagtttcaagacgtcccgaagtagtggggcaggagggcagaatgtaaacaaagtagaaactgctgtgaccgtactttggaaagtgaatgcatcagaattttttaatgaagatgagaaaatattaattcagggtaaactgaaaaacaggatcaatgcagatggttttttatttctcaccgtttctgaaagcagaacccagctgatgaataaaaataaagccattgaaaaaataactgaaatcgtcaataaagccctcatcattcccaaaaaaagaacggctaccaaaccttcaaaagctcaaaaacagaaaagactggacagtaagaaaaagctttcagacaaaaaagaaaacagacgtttcaggttttaatgtgtttttccagagaaaactctatttttgccggaaattttaaaaccatgataaaaaaattaatcacacttggagtattctccatttccatgatctcttttgcacagaaattttctatcagaccttccgtaggatatgcctggagaacagcaaaaacaatttccggacttagcaaagaagaaaaagactacgttaaagaccttaaaaacgggttaaattttgatattgctgcgcattatgctgtgaaagatggccttgcgtttggcttgaaatattctaattacagtgcatcaagtgacggatatcttcttggttatgtgaacggaatgcctgtgtctgttcctgtgaccacaaaagataatatcacattctttggagtttccggccttatttcaaatgataattcatccacaagacataaaatatttgcagatcttgcgctgggggtgatatcttacaccacaaaaacaggagatgtaaaaggaacagggagtacttttggtgcagaaatcgattttggctatcaatatgagatcagcaaaaacttccttatagggccaaaggttggcttaagtggcggtacgctgagtaaaatgaagtacaacggagttacttataaatttgatgacgatcagaaagaaggtttgcatagggtttctttgagtgcagctgccacattccgtttttaagtgttatatttgtagtaattacaacatctcattaataatggcagcaacaatttctttatcagcagaaagcagacaatcaggattgttgctgtcgttactttatcttcacacagattcttttctgaaaagttctaaggactttatcaattaagccctgtcaggatccaaggcagggaatcatttcggattttatttattattttttgcggttttctatagaagaaggctgtcttatgtctgtattctacattggattatcggggaataactgcattttaattttttaaaaatgaaaaaatatgtccaatcatattattgtaaccaccggaatttatgatgctataaaagatacactgagaagaaaaaaagtgggcatcgaagaagaaaaaagattgactgaagaactcagaaaggcaaaacaggttctgagaagggaccttcctgctgatattgtaacagtggacagaaaagtaacgttgaaagaccatactctgaattttgagcatgaatacatttttgtgccttcggtaaaagaaaaacttaaaaagaataaatattccatcctctcagatattgctcttgccgtagtaggatataaagtaggagatgttatcagctggcctttcagggacggagagaggaaaatcgaaatcctgaaagtggaaccctgggaaggataatccttactgaatatttttaagttgaatgataataaagcgtggctcattttgggtcatgtttttttataaatagaaacttctaatgttgaagtagaggcactagttttttacacactctaaatttacttttatcagagataaaatctttgcaccttcaagcataaatcatgttggagaaactagcgtccttgcgtttccgaacaacaactatttaagcatttcatttaacaaatgataaaaaaagatgtctgtattacactttcttcaagtgctttgactgcattccgtttttaa

SEQ ID NO: 77 - DNA, 4653412 bp, Chryseobacterium sp. (residues 1,551,139-3,102,276 of 4,653,412)
gttttatctttgcaaaaattttaaaaatgagcaaaccgataactgaattcatagaaaagtattacctgcacttcaacgcagctgcattggtagatgcttctaaaggatatgttgcacatcttaaagatggcggaaaaatgatgattactttggcaggtgcaatgtctactgctgaattgggtaaaattcttgcagaaatgatccgtcagggaaaagtagattttatctcttgtacaggggctaaccttgaagaagatttaatgaaccttgtagcacactctcactatgaaagagttcctcattacagagatttgactgctcaggacgaatgggatcttttggaaagaggcctgaacagagttacagatacatgtattcctgaagaagaagcattcagaagattgcagaagcacatcgtggagatctggaaagatgcggaagctaaaggtgaaagatatttcccgcatgaatttatgtacaaaatgatcctttcaggagtattggagcagtattatgaaattcctagagaaaactcatggatgattgctgcggcagaagcaaacttaccaatcgtggttccgggatgggaagattctacaatgggtaacatcttcgcttcttactgtatcaaaggagagcttaaacctactacaatgaaatcaggaatcgaatatatgacttaccttgctgactggtacactaaaaattcaggaggaaaaggagttggattcttccagattggtggaggtatcgctggagatttccctatctgtgtagtaccaatgctgtatcaggatatggaaatgcatgatattcctttctggtcttatttctgccagatttctgattctacaacatcttacggttcatactcaggagcagttccaaatgagaaaatcacctggggtaaacttgatatcactacacctaaatttatcgttgaaagtgatgcaacaatctgtgcaccattgatgttctcttatatcttagaaaacgcttaagaataaaattctcataagagattaccatacagcgcttcaatttattttggagcgctttttattttaggatttgaaagtagatttgaaaaactaaaactatttaaaccattaagaaaatgaagagcttaagaataattaagtttcatttttgatgaaaaataaagctcatagctaaaaaaacaactttagctatttcttaatactcttaaaacttaaattaccttaatggttcaagctcataataatgtacagttttatcacataaaagattgagctttatatttccagttttccacaggcatctgtgaaatccgtgtcatctgtgggaaaacctatcaattattcaaaaaaatcaatccaaagaattcaccagcacaaaataacgatacgccagaattcccttttccatcttagtaagatgattagggtctttatgactcagcttaggaagaacttttttgttgatggcattcagcagcctgaaaaatgattttttcatatctttatcttttaatgaaacatcattgttattgatacaagttcaaaaatgatgcaaaaaagaaattgatatggacgaaattttcaaacaacaggtatatgaagtggcaagactgattcccaaaggaagagtatctacctatggtgccatagcaaaggctgttggctatcctaaccattccagacatgtaggaaaagcaatgggaggatgtccgaaagacgttcctgcacaccgtgtcatttcaagttcaggagtattatctgttccggaatttcagcctaaattggaagcagaaggaatcattgttgaaaatctcagaataaaaaatttcaaaaaactgttctgggatccgttagctgaattgtaaattttaagtttcggaaacaaagattttttaacgcaaagtttctatctataagctgtactatttttaagggagcaaagaagggaatcaatttcattgatttttttaagcgaacgtattaccccaaagcttcatcagcgacaaagtcgcatctctttgccacctgaaataaaacattcaaatcattaaatactttgcgtcgaaaaactcatacatcaatattacatatcacaaaaaaatgccactccataattgaatatgagtgacaccaatatttttaaagttttaaaccgtgttatttttttccgtccggaagatctttcaattcttttttaagcctttcgttttcttcttttaataaagcaatatagttttgtaggtttttaatgatgtctccagggatattatcataattattctgattagtgattactcctgcagaagatgatctgtcattaaatacaggatggtcattattaatcactactgtaggctcatcctcttcataaatatcctcaactggtacatccagaaaacgggcaagtttatcccactcatctcttacaattcttacatcgccgctttcttttctgctgtagttggatacatctgttgcgataaaatcagctacctgttgttgagtataacctttttgctttctgatgagacgtaatttttctttttgcatgacctacattttatacaaaaatggcaaaaaaggagaagctatacaataaaaaggagaaaaaaatatgtgctgaagaataagattaaagataaaatgaaaataaacttaaaacagaagtgttatctgatttaattgttgaaaattttctttcagatcacttctgattgatcaaaggctatgtgacaaaagaaaagatgtaaaccttcagggttttcataagctgtttataatttttatacaaaaagactgcttcaaaattgaaacagtctcttgtcttatttttcaagctgcttatagcttctctgtataaaatctgtcaggtcttttcctttcagtaagttttgtgaaagcttggcaagatccagtgcgtatttgatcaggttctctttctcttcagcgttctccgtttttaaaatctgattggaaagttcactgtttgagttcaccacaagattgtacatctccgggaagcctcccattccgaacatgccgccgccacctgttgcctgcatttccttcattcttcttatgaattcaggctgggtgattgtgaatggcgcatcactgctgtcaagatcttcaagctgaacggtgaattttgaatctttgatagcttcttccacattctttttcaaagcttctttttcagtttcgttcagttttgaaatgataggttcatcttttttgatcaggttgttcacatgatcagcatctactcttgcaaatgagatgttttccttcgaagtttccagcttctggatcacgtgcgaaatgataggagaatctaatagaagaacttcatatcctttatctttcgcagattggatgtagctgtgctgttcatcagcattggtagcatacagaacaaccagtttgttgtctttatccgtttgtacaggcttgattttttcaaccaattcgtcccaaaggaaatacttaccgtctgttgtaggatataatgtgaatttgtctgctttttcagcaaatttttcttctgtaacaattccgtactcgataactactttaatatcattccattttttctcataatcctcacggttttcgttgattagagaaaccattttatcggctacttttttcgtgatgtaagaagaaatctttttcacggcaccatctgcctgaagataagaacgggaaacgtttaatggaatatccggagaatcaataactcctctcagaagcatcaggaagtcaggaacgattccttttacttcatccgttacgaatacctggttttggtatagctgaattttatctttatcgatatttaaattgttgctcaatttcgggaagaatagaattccggtaaggttgaaaggataatcaacattcagatggatattgaataacggttcctcaaactgcattggatacagctcgtggtaaaacttcatataatcctcattggtcagttcacttggagcaattgtccatgccggtaccggattgttgatgatattgtctacctcttctgtttcagctactgcatcttcaggagcatcttccggcaaaggaagcgtatgcgtttttgttccgaatttaataggaacaggcatgaatttgttatactttaataacagctcacggatttttccttcttctaaaaattctactgaatcttcagcgatgtgcagaatgatttccgtacctctgtctgttttgtcagtagtttcttccaatgtgaattccgggcttccgtcacagatccagcgtactgccggctcatctttataagattttgtaagaatttccactttttctgccaccatgaaagcagagtagaagccaagaccgaaatgcccgataattccggcatccttcgcagaatctttatatttttccaagaactcttcagctccggaaaaagcaacctggttgatgtatttctcaacttcttcacccgtcatcccaataccctggtcgatgatgtgtaaagttttctggtctttatcaattttaacctcaagttttggatttccgtattccacttttgcctcaccaatacttgtaagatgctttaattttaaagtagcatcagtggcattggagatcaattctctcaggaatatttcgtggtcactgtaaagaaattttttaataagcgggaaaatgttttccacagatacattaatatttcctttagtcatcatatttagattttaatttttaaaattctttctcaaaaaaaataccatgcagaagaatgtgacagaatgacatttttttaacctgaaacaagcccgttatgtgaatttgtcgaagaaatatcttatttttagttcttaaaatattttaaaatgaagttgaaatgtacagtctttatgctgctcattatgaccttttgggtatatgggcagaagaagcctttagaccactctgtttacgacagctggcaaaatatcggggcaagaaaaatctcaaatgatggaaaatggatcgcctattctgtggatgctcaggaaggaaattcaaccctttctttatattccgttaaaaataaaacctcaaagaagtttgaaagagcggcaaaagtggattttaccaatgattcccgatttgctgtttttcaaatccgtccgcagtataaagatataaaagcggtaaaagataaaaagcttaaaaaaagcaagttaacaaaagacagccttgcaatagttgattttttaaatgataagacagagaagattcctaatgtaaaatcatttaaaattccggaaaaagcaggttcttatgtagcttatcttctggaaaatctaaaggataaatcctcggatgatgcttctgaaaaagaagatagtgatgaaagtaaggatgaagataaaaatgtaaaaccattgcaactggtagtgcggaatcttttagacggaaaaagcacaacctatgataatgtaatccgttatgagtttagtaaaaatgggaaacagctggtttttataaccaaaaagccggacgaaaagaaagagaaaaaagaaggaaaggattcagatgaaaaggctgcggacaaaaaagatactgataagtcaaaaccaaagaaatatgcattacaaaccgtacaggtcgttgatctgcaaaaaggaactgtcgctacaatttctgaaatggagggagacttttcacaattgtcttttgatgaagaaggaaatcagctggcttatgtaggaacttcatctgcacaaaatgatctggtgaaactataccagctgtattactttaattttaaaggaaataaaaaagaaattataaccaatgaaaatgcacagatgaagaaaaattgggtaatttctgaaaacagattgcctttgttcagtaaaaacggaaaacagctgtattttggtgttgctccaaaacctgttgcaaaagatacggcaatgattgcaaatgatcatgccgttgtagatatctggaattataaagatgattatctgcaaaccgtacagttaaaggaattgaaaaatgacctgaagaaatcctatgctgcagtaatgcagatagaaaaaccagatttcttcaccaacatcgatggagaagatctggatactttacgtctcgtaaacgaaggaaatgcagaatttgcgctgggaattaccagtatcaataaccgtatttcttcacagtgggaaggctctacaaagaaaacctatttcctgatcgataataaaacaggagacagaaccgaaattattaaaaatcttaatggagcagcggctgtatctcctcttggaaaatttgtagtgatttttgacagggaaaaagggcagtggttaagctataatgtgaaaacaaaacaaacccttccgctcagtacaggtttacctgtttcttttgtagatgaggaatttgatatgccggactttccaaattcttatggcattgcatcctggacagataaagatgaatctgtgattataagagaccgctatgacctttgggaatttttcctgaacggctcaaaaaagccaagaaatatcacaaacggattcggacgtaaacataaaataacatttgatacgtatgaactggataatgatattaaaagcctgaaccgcaaatctcctatctatttatcagcatttgataatacatccaaggccaatgggatcttcaaaacaaccattcagtcaggttctgatcctgtgaaaattcagatggaaaatgtctggggatacagaagtcttcaaaaagcaaaaaatgcagaagagtatattttagtaaaagaatcatatacagaatctccaaacctttttgctacatcagatttttcggaacagcaaaaactgagcaataccaatccgcagcaagccaaatataactggggtacggatgaactggtacactggacaaccccgaaagggcacacttctacaggaattttatacaagccagaaaacttcgatccgaataaaaaataccctatgatcgtctatttctatgaaaaactttctgataacctgaaccgttatgtagctccggctcccacaccttcaagattgaatatttcttattttgtgagcaacggatatctggttttcactcctgatatttcttacacagatggtttcccgggagaatctgccatggaatatattaattccggagttgaaaaactaaagcaaaattcctgggtagacggtactaagatcggaattcaggggcaaagctggggaggctatcaggtagcttatcttattgcacataccaatatgtatgcagctgcgtggagtggagcacccgttgtcaacatgacttctgcatacggaggaatcagatggacttccggaatgaacagacagttccagtatgaaaaatcgcaaagcagattgggaaagaatttatgggaagctccggatctttatattaagaactcaccgctctttaccattgataaagtacagactccggtagttattatgagtaatgataaagatggcgcggtgccctggtatcagggaattgaaatgttcaccgcattacgccgtctcggaaagccggtatggcttctgaattataatggtgatgatcacaatctgatgaaacgccagaacagaaaagatattcaaatcagggaacagcagttttttgattattatctgaaaggagctaaagctccggtctggatgacaaaagggattccggccacccagaaaggaaaagactggggatttgagcttacagatgataaacctgattaaaaagtttcggcggagccaaaggctccgccgaaactttttaatccttcccggaaaaaaataatacagaaggataaactgacacaatggcattttttttatgatgagcctgttgagcacttttattatatttaccgccaattataaataacagtatgggaatctttgatttttttaaaaagaaaaataacaatcaggaaaatggaagtactttggttcaggaaatggaaatgccagaggaaaaaatagttgaggaagtggtggaagaagttgtggaaacaatacaggaaaccccttcacaaccggcagaagaaccgaaagtaaatgaagaatatgaaaaaatcaagatttataatgattatatcgtttattctatagcgcttcagctaagaggagagtatactcctatttctgcttttgaaaaagaaaatggtgaggtagaaggctttgcctatatggtgacagaagatgcttatgcactttctccgcagcaggcaatttcacaaatggaagagaagtttgaaaacgaacttcaggaaggtaagatcagatcttatatgatcctgtatcattctcagtttgataacaatggtaatcacaatccggcaacacaggacggagaattcaaggcaatttcacttgcttatcattttgcaggttctgataaagcaaaaacaggacttccttatattttcgaaaatcaaaatataacttataaaggttttgcagagttttcacatgaggaaaataatgaaatcatgaaccatcagctgatagatggcaaggattatttcccgaatacagaaggaattgcagcacctgaaatgaccaatgaagcagggattatcatcagaaaatccaatgttcataatcttgttaatacatggagcggagtttttgggcatcagaatttccagactaaggattacggccagtatcttagcacagttttaatgcagtctaccgtttctgatccggctggagaagctaaaaataaaaccgaatttgaagatgtaagattcaaaaccattgttacagatgaattgagtaccataattccggaagtaaaaacggattataccctggattttgaaacaagatcaatcagagaatgggaaaatgcattgaatctgcaggcaatcgtagcgggtccggcaagggatacttttggagtgtggtttttcgctactgattatgctgagaacagaaatatctacatggcacagccacatcagaaggtaaatatcagtggtattattttcatccttgatgtccataccaacacagatttacctgacggtactaaaatgagtgaagatttcacaacctatgctccaagtcaggatcttcctaactatgcatgttttgattttattggtcaggttgtagattgtaaggaaactgaattgcttgaagacggaagcgttaaaggatatatcctgaaactgaagttgatcacaaatgaggaaaatgaggatttcttcaccattgatgcctttgtaaataaagaaaacatgagatttgaaactccggcaaaaggtatgaaagtcaccggtgcacttcagctacagggaaaaattgctgaataattttttttaatataaaaattcaagaggttgttctgcggaataacctcttttttaataattagttgatgatttaaacgcaaagaaataagtgattcgaaagctgattgtaaggaaacaaagtgtttcgattttgtcgctgatggagctttgtgtgaatgatgcgtttgcttagtaagaatcaattttattgattccatcctttgccccctcaaaattgtaccgcctataaataaaactttgcgttaaaaaaaatgacaacaaaaaaggcaatccgaagactgccttttctatattttctgaaaaattatttgtttttcatttcttccttgatcttagcttctaattcttcagcaagatccggattatctcttaaaacatcttttacagcatcacgtccctgaccaagtttagtctcttcatagctgaaccatgatccgcttttcttcacgattcccatgtctacagcagtatcaagaatttctcctactttagaaactccttctccgtacatgatatcgaattctgcctgcttgaaaggaggtgcgactttgtttttcacaatcttcactttcacgcggctaccgatagcctcatcaccttgtttgataggtgcgcttgcttttctgatatcaattcttacagaagcgtagaatttaagagcgttacctccggtagtcgtttcaggatttccgaacattacaccgatcttttctctcaactggttgatgaaaataacggtacatttcgttcttgaaatagtagcggtaagctttcttaatgcctgagacattaatcttgcatgaagacccattttggaatctcccatttcaccttcaatttcagcctttggtgtaagagcggcaacagagtcaatcacaacgatatcaatagctccggaacggataaggttatccgcaatctccagtgcctgctcaccattgtccggttgggaaataatcaggttttcaagatcgattcctaattttgcagcataagttctgtcaaaagcgtgctctgcatcaatgaatgcagcaatacctcctgccttttgagcttcagcaatagcgtgaagggtcagcgttgttttacctgaagattcaggaccatatatttcaatgattcttccttttggatatccgcctactcctaaggcaatatccaatcctaaagaaccggaaggaattacttctattgtagtgtctacggcatcatcacccagagtcattacagttccttttccgtatgttttatctaatttgtcaagcactaaagcgagtgcttttttcttatcatcaatgttactcatcgctattaaaataatttctcaaaaatacataatttaaatgtcaaaagctaatattatttgtctctgaaagctgtttttagagttaaaaaatgataaaattttactactgatctcattcataacgaagcagatgcgaaatgtggtatggacgtaataaaatattaacaggaaagaggctggcagctatcaaagcctgtaaatgtattgaacttaattgtattacttttattaattgaaatttatcatccaatagaaacttgcatcttccgggcatcctgacttattatcctaatgaaaatttgaattcttagtgatgttcagataatcttccagcactttcatctgatctttgtttcctctttttattctggccttgcggcttaccagtttgtcatacattgtattgaaaagtattttcgattttggaaacagggttttgtaaggaacatcagggatttgtaatcttttacagacttcatcatccagcagaaaccaggtacagcatatgtgaaggtatcttaagttctttctttgaaattcaaactttaagataggattttccagggattcatctaataaagaatgggcaagaagcacagaatctttgtctgaaggaggctgaactgaggtccataaataaaaatactcggtagcttgttttttatcatcaggtagaagctgttccggtattcccaaaagataccctacatatttccagagatgaaaaattccctgttcctcttcagcagaaaaacgatttcccagctttttaagactatgaagaaataccagactgaatccaatgtacgttgccatcatatcccacgaattaatgggctctccccagttttcagaatcccagtctttataatactttttaatggaaagtctggcataagaatggatcagacgggttttgatcgcaaattcatatccttttgcatgaacttccaatgcattatagcgggtagcgtttacccagaaatccaatgtttctgaaagacgtttcactgcaccttttttcagtgcttcagtaacaataagaggtttgttgaggtaggcataatcatagccgccgatcagacaataatccctcaacgaaatcagggagtccaggttgctcctcatgcagagttcagcaccgcttttgagtaaattgtaatcaagccagtcaggaactttctgagtttggctgaacagtttttttacactttcaggaatatcatcagtctctgaaaccccatctctgatgtagtgttcaatttccctggaagcctcgtggaattttttagtgaagtaaacatcttttaccacctcgtcaccgatctcatccgtatgatggaaatagggagcaaatttttcaaagtttttaaaactcacttcagctcctgaaaattctattagctgctttccattgccattttcccaaaaattcctgaaatgaggagcatctttaaaacggggttgtatcatgtttcattcctttacctataaaagtacaagttttatgctgaaatgttttggtgagatttatcaggatttaatgaacttaataataatttgagctcatttctacattttatcaatatctgtcaggaccatgataaccaaatagctcgtatatataaaaacccaaaatcacagcataaattacagataatatggtaatgatgaatactgcaatattatttctgctctgtttagtgagaaattttataaaaccgtaagagattgctcccagacctataataaaaatgtaaaagatgtgaccggaatatatgatttgcaacccccataatatgcctccaatagttcctccgataagccctcctaaaatacttccgatgatggtactgggtttgatttctaaatccctttttgttgcttctatttctgtagaagtaatttctatgatctgttgtatttcatctgaggctaatatttctgaattcaaagtatgattgatgtcattttttgtcattccgtttaaatacaattccgcagcatcattctttatttttgatttttccaattccttcgcaatagttttgtcatatcgggtagtcagcgattgtattccacctttcttttctatgacaatatctaaggcttgtttggcgtcatttgtatatctgtttttatttgaatatacttccattaattctacatcagaatattgagaatttctttcaataagttcattgagcatggtataaattttggccgttaatttaaataaaaaaaccttcccatcgggaaggttttatattactcattgtttatcgctcattattgattataaagaagcagcgtgtacaagcatatctactaacttgttagagtaacccatttcgttgtcataccaggaaacaagtttcacgaagttaggagaaagcatgataccagcatctttgtcgaagatagaagttctcttatctcctacgaagtcctgagatactactgcatcttcagtatatcctatgatacctttcaattcaccttcagaagcagctttgattactgaacagatttcttcataagaagcagctttttcaattctcactgttaaatctactacagaaacgtcaacagttggtactctgaaagacatacctgttaattttccgtttagtgaagggattacttttcctaccgctttagcagcacctgtagaagaagggatgatattgttcagagcagctctaccacctctccagtctttcattgaaggaccgtcaacagttttctgagtagctgttgtagcgtgtacagtggtcattaaaccttctacgattccgaagttatcgtggattactttagctaaaggagctaaacagtttgtagtacaagaagcgtttgataagattttgatatcatcagtaagttccttgtggtttacccccattacgaacattggagtatcatctttagaaggagcagaaaggattactttcttagcacctgcagcaaggtgttttgcagcgctgtctttatcaaggaataaaccagtagattctactacgtaatcagcaccgatttcattccattttaggttgcttggatctttctcagcagttactctgattcttttcccgtttacaacaagatcatttccttctacagaaacttcacctgggaaaataccgtgtacagagtcatattttaacatgtaagccatgtattctgcattgattaggtcattgattcctacaacttcaatgttgtctctttcagtcattgctctgaaaacaagacgtccaattctaccaaaaccgttgatacctactttgattgttgacataatagtttgtttttattagattataaaaattagattgctaaaatttttgaaatcagtaaaaggtctttattgatttcattatgttttttaatggcttcttcaatcggggtatacgtcagatcattagaacgcatccctgccattacattggtttgtccttccattagccctgttacagctccataccccagacggcttgccagaactctgtctgcacagcttggagaacctcctctctgcatatgtcccagaatagctacacgaatgtcataatcagggaatgtctgttttgttttttcggcaagttcatatacgttggctaatttttcaccttccgctaccacaacaatgcttgatgcttttcctgttttttcagcatctctgaatttcgcgaaaagctcatcaatactatcttttttctcaggaattaaaatatccagagctcctgttgccaatccactgtttaacgcaataaaaccggcatcacgacccattacttccacaaagaaaactctgttgtgggaagtggctgtatcacggattttgtcaatggcatccattgcagtattcaaagcagtgtcgtatccgatggtgttatcagttccgaaaatatcattgtcgatagttcccgggataccgattaccctgatcccgaattcttcattaaagattttcgcacctgtgaaagttccgtctccaccaatacaaaccaatccgtctattccaagctttacgcagttgtcataagctttctgacggccttctttagttctgaactcagcagatctggcagactttagaatcgttccaccctggttgattatattttttacggaacgggctcccattttcaggaaatcattgttgataaggccgttgtaaccttctctcaccccgtagcattcgatattatagtaattggcggttcttactaccgctcttaatgccgcattcatacccggagagtcacctcctgacgtaagaactgcaatttttttaacaacactctctttcatcaagaaaaaaatttcgaacacaaatttacaaaaacaagttcagattatcgtagtaactttccaatagttttgaatataaattattaaaagcttctgaagtttataggtttaaaaaaatatcttgccgtttttgtttcagcagcatggatgtcaagatcataccagggcgtaaaatatgggttaaaaggatttgaaatcacatgaacggattgtgccggcgtgaaaccttcacttaataagtacaatcttttttctttctgattcttacagactcctgaaataaaaacaatatgccccggactccctggtgtaatcagaatatctcccgttttaagatcagaattttttgttaccggttttgtctctttatgtaatgaaattgttcctgcataattgaaaatcacatccagatagtttctgaagctttgataagaatcatcaggagctgcaacttttctgaagctgactgaatttccactgacaaaagctctcattccgtttttataatcattccagcttaaaaggtcaccgcttgtaaaatgaaatttaatttcgtcaaatttttttgcattataaagatattcagccctcatgcggataacagcatcagcgcattgctgaagatctttatttcctgtatcaatgtcaaaaacggcttcatgcaggtgctgggtagaaattggtgttccatcatattttaaaatctggcttccataaggcttcagtttaaaattttcaataaagtatccgaaggaatcaggtttttctttaacccattcataaccttcaggaggagaaaatctttcacggatggtatttttattcttattgatttttaacgcattttctgctattaaatgctcattcttatccggttcaggcagtaaacggtctgagaatttttcttttgtgcaaccagtgcaaatgaaaataactgtaattcctgtaataacttttttcatgcgttcttagttaacacaaatatcaccttttttatgtgtccccaataaagattttgaaatcacattaaacgtgttatacttctttacgatcagattcatcccgatatgtacaggatagtgtcggcaactggttgaatgatgccagtaaatcacaacccgaatttgtagtggaaatatgtgatgaatggctccgggaaagtccgacaaaagaaacgcagtatatcgttaaaaaggctttaagaacgataaaaaaataaaagttatccacaaaattgacatgtgaaacttctgttgcgttttacagattgcagattgatagacgtttacataccattttttatctccctttttctttgggagtggctttattaactcattttttacacaaaagtaaggttgaaattattttcaatgttaacggtatgttaactgtaaaaagttatccacaatatgagttttcgattaatggggattctatctgtcaataaattaacaggttaaataattagcttgtaaaaaaagcttgaaatgctgtcttttttagccaaaataaaaagttatccacaatatggaattttagttaccatttttcagtcaggtatttccaatatcttttcgggacgtgctgaatatggagtttcatattttttcgttcaacaatattggttttggtaaaatatcgctgccagagtacctggtaacttttttcttcatcatggaatttttgctgataatgatttaaatcaattttttcatcagggtagaaaaactcagaatcgttgaggtcatatagaaggccgtagtttctccgaaggtcatagatcatccatttctggtcctgatagcggttatgaaaatgttttctgattaaaggaagaacattgaaatcaggatctattttggagaaaaaaacaccatcctgcattttttcaaaacgtacaaaggctgtcattctgtgtctttccctgtctaatgatttacagatctttgaaatttttaaaatatcagaatcgccgaagttttcaagaatattttgtccgggatactggatggactgttttacagctgataaaattaaattttccagctcgggatcttcagataaaaatacttttaagagttgatgaattccgggctttccaatgttttgctccagtttgttgagaactctttcggatttctccggctgcgtaatgacttcatgaatttctgcaaaaatattctcctgatgaaaattttctctgcttacgatctctacatctttataacggtattcaaaaacttcaaatactgcagtaaaaagtccatcaaaacttccatcgtagagtagggttgtcatatattgaattaaaatttaaaatttagttggtttcccattctgaaaaaataaaatgaagtgaagaatcaggtttattgaagagactcttccttcgtcagaatgacaataatgccgttacatttttgtataagaaatttgtgatcatttgtgaaaaacattagtgtcatttgtgtttattgaaactgttcaaaaacattaaaaccattaagaatgatttaagaaataaagtaaagttaagataaatcattctgatttttaagcttaaagcgaagctcatcttaatactctcagcaccttaatagaatcttaatgtttcaaaaaataaacatttaaacagatcattaaaacaaggttagctgttgcgaaaactgattatggaatttggaagagcttccaccaatcagcagctttctgaagtttttgtccgttaagtatttcaggtaagcattgccagcagtaaaatcaataaaatattttgcacggttgacagctgctcccagttttttcaaatgatccatcgttaaaatctgaaaacgtctggcacttataattttctgagctgtttttacgccaattccgggaatccttaaaatcgtccggtattcggcagtttgaagattcaccgggaactgatctaagtttcgcaatgcccagcttaatttcgggtccatttccagatcgagaaaaggaacattcggatctaaaatttcttccgctttaaaaccataaaatctcatcagccagtccgactgataaagcctgttttcgcgaagcataggtacttctgtggttaaagagggcagcctttgatcttccagtaccggaacatacccggaataatacactcttttcagattaaaatttttataaaagtggtccgctaccttaatgatctgcagatcattttcattggttgctcccacaatcatttgtgtagactgtccggccggagcaaacttcggaactttcttaaggattttcttttcatctttatattgaatgattcctttctgaatataccgcatcgggctgatcatatcctgtctgttcttttcaggcgccaataatttcaatccgctttccgtaggaatttcaatattaacagataaacggtcagcatacaacgccgcttcctgcatcagatcatcacttgctcccggaatagatttcagatgaatataaccgttgaaattttcttccagacgaagctttttagccactcttacaagacgctccatcgttgtatctgcattcttaaaaattcctgagctcagaaataaaccttcaatataattcctgcggtaaaaattgatggtaagatctactacttcttctacggtaaaagcagctcttttgatatcattcgaacttctggaaacacagtaagcacaatcgtagatgcaatggttggtcaacagaattttaagcagggaaacacatcttccgtcttccgtataggtgtggcaaatcccgcttgcagaactgtcgcccaaagccccttttttattctttctcgtgcctccgcttgatgagcaggaaacgtcatatttcgctgcatcagcaaggatttcgagcttttctttaaggcggtcaaaattcattcttttggtggtttgatattatttgtatcaatataattttaaatattgttcaaatttagttccaaaattgataaaagtcaaccttttttcatagaagttatcaacaaaaaagagcctcaaaatcattatatttacggctcattaaagtttatatcatgaatcataaaccaatcgaaggtttttccaagcttccaaagcaggggaaaatcgactggctcgtaaacgaatatcttgaaggtaaccaggaatatcaaaatatattacaacaatactggaatgatgatgcagatcttcagaaacttcacgaggaattttctgaaaataccatctccaatttctatatgccttacggaatagctccgaactttttaatcgatggaaaactgttggcacttccaatggctgttgaagaaagttcagtagtagcggccgcttccaaagcagcgaaattctggatcgataaaggtggttttaaaacaaccattatcaatactgaaaaactggggcatacccattttatttttaatgtagaacctcataaactgttacacttttttaatttcagtttaaagaaaaaactatttgaagccactgaagatatcactgccaatatgagaaaacgcggcggcggtattttaaatatcagcctggtggataaaacagcagaaatgcccaactattaccagctgaaagcaagctttgatacggtagattctatgggggccaactttatcaactcatgtcttgagcagttcgggaaaacattgagacaggaagtagctaccagtgaagattttactcaggaagaaaagaattcactgcagattgtgatgaatatcctttccaatttcacccctgactgtatcgtgagagctgaggtttcatgtaaaatggaagatttaaaagatgacagcggcatttctcctgaagaatttgcttctaaattcaagcaggctgtgaccattgcagaaattgaaccttaccgtgccacgactcacaataaaggaatcatgaacggagtagatgccgtggtgatcgctacaggaaatgatttcagggcaacggaagcctgtgcgcatacctatgctgcaagagacggacaatacagatcccttactcactgtacaacggataacggagtattcagattctggatcgatttaccaatttctgttggggtagtaggagggcttacaaatcttcacccgctggtaaaattctccttagcacttcttggaaaaccttcagcacaggaattgatgagcattctggcagtttcggggcttgcacagaacttcggtgcattacgttctctggtaaccacaggaatccagaaaggacatatgaaaatgcatttattgaatattctgaaccaattgggggctaccgaagaggaaaaacagcactttgtgacgtattttaaagacaagacagtaagccatcatgaagtgatcaacgagtttaacagaatgagaggaaactaatgttacagatcattttgcctattatattccttctctttggtttttttctgaagaaaacaaataacgaaggtttcaggagttccaagagatttgccaatatgtttatcattctgggaatttctaccctggttgccaagtttattttaatgtatataaaatcaaaatagtgaaaaagagcattgtatttttcttattgatttccggtttaagtttttcacagcagaaaagtttaaagatcaatgatctgcagccaaaatctgaaaactatgtgtttcctgtgataaactatccgggaaatccaatagcagccaataagatcaatacatttcttcaggtcagtgagctggaatatgtgccgggttctggtggaaacccttttaaactggcttctacagcgaccaattcttactccaactacctttatttctatgattgggagaaattggaaactcctgaaaatattttaacgataggtattcatggtgaagcttcgggagcttacccggaagagtttgcggactggaagaactttgatctgagaacaggaaactttattaatgctgcagatttatttcaacccggttcagtaaaaattgtagatgggattattcagaaacgagtacaaaaaagaatttctgattttcttgtcaaattgaaagctgaaaaaaatcctgaagaagaaactgaagatcagattgcactttacgaagattgctttacagagcatactttgggaagtgtcaaatatttctttggaaaagataaactgacttttgtagccggaagatgttctaatcatgctatgagagcactggatgaactcggcagccatgagatagaattcacttacaaagaattggaaaaatactggagttcttatgcaaaaaatttaattttcggttctgaaaaaacagagataaccagtcttaataataaactgtatcatggtaagattgacggaaagtattccatcaccgttttgatcgatcaggtatatgatgacggctctttttctgcaaaatactggtatgataaaaataaaaagctgattgagtggaatgggaagataaaaggcaatcatatctctatcatagaaaacgattattacagcgaagatgcccatcaatgggttttcaaagcattagtagaggctgatttgcaaggaaagaaaatcatcggaacgtggcaggattataaaacaaaaaaatatttaaccttacaattagaagagttataaaatgaaaacaatcacattagtttttggagcagtttacggaatggtatctgtgatcctgggtgcattcggagcacatgctttaaagaaaatattggctgtggaaagactggaaagttttgaaacaggagtaagatatcagatgtatgccgcttttttcctgctgatcatcgggtatatcttaaaatttgaaacctctgctgaaaaatggacgtccatcttgatgattgcaggaacatctttattctcagtaagtatctatttcctgagcatgcaggattatctgggaatgaatcttaaattcttgggacctatcactccgcttggaggtctgatgatgatcttaagctggggaatgctgatcttatattttgtcaaaaacagaatttaagattgagaataaaaaaagaagacagttcatacaaccattcaatctcttctgtctgagaaattagcggaagaataagagaaaaaggaaggatatgttaaaaatcaagtctgtcactctttaaattttaagtcaataaacttgaacttccgtgtctttttagtaaatttgtcaacctttaaatttttaaataaaataataaaaataatatgaatcttcacgagtatcaatcaaaagagattttatcaaagtacggagtggctatccaacgtggtttcgttgcaaacaacgtagacgaagctgtagctgctgcagaaaaactaactgctgaaactggcgctcaagggtgggtagtgaaagctcagatccacgcaggtggtcgtggtaaaggtggtggtgtaaagttctctccaaacatggataaacttaaagaaaacgctcagaacatcatcggaatgcagctggtaactccacaaacttctgctgaaggtaaaaaagtaaattctgttttgattgcagaggatgtatattatccaggtgaaacagaaactaaagaattttatgtttctattcttttagatagagctgaaggaaaaaatacaattgtatattctactgaagggggtatggatattgagcacgttgctgaagtaactcctcacctgatccacaaagaaatcattgatcctgctttaggtcttcaagggttccaggctagaaaaattgctttcaacctaggtcttgaaggaaatgctttcaaagaattcgtaaaattcatcggttcactttacaatgcttacacaggtattgatgcatctcttttcgaaatcaaccctgtgttgaaaacttctgataacaaaattatcgctgtagatgctaaagtaactttagatgacaactcattattccgtcacaaagacttagctgaattaagagatacaagagaagaagatccaatggatgtagaagctggtgaagcgggtcttaacttcgttaaattggatggtaacgttgcttgtatggtaaacggagctggtcttgcaatggcaacgatggatatcatcaaattatcaggtggtaacccagctaacttccttgacgttggaggtactgcagatgctcagagagtacagactgctttcggaatcatcttaagagatccgaatgtaaaagctattttgatcaacatcttcggaggtatcgtaagatgtgacagagttgctcaaggagttgtagacgcttacaaagctatgggaagccttccggttccattgatcgtaagattacagggaactaacgctgtagaagctaaaaaattaattgacgagtctggtcttccggttcactctgcaattactttagaagaagctgcaaataaagtaaaagaagttttagcataagctgaaatttttaaataaaatagaaaaccgttccaattttggaacggttttttaatgcgtatgagaaacaatattcatgaaaaacttatatattccggaaccatgttctgaagattgggaatctatgtctccacacgaaaaaggcaggttttgctctgcctgtaataaatgtgttattgattttacacaaaaagaacctcaggagattctgcaaattataacggagaagaaagaaaaacaggtctgtggaagattttataatcatcagttgaaaatgcctgatcagtctgaaaaattgaaggaaagcttctttaggtacatcccctcttattttcagaataataaaatagtactcacactattttctttagttttatttttaaccgggtgcacaaaacctaaagaagaggtttgtatgacgacaggatttgtagatgtaatagaagaagattctacggttaccaacaaaaattatgttatgggggaggctatgatagacaatgatacaattgctaaaattcctaaaaaagatagcgctgtagttcacaatcacagtacaaaataatttgttataagtacgatgagtggttgatgattctttgccacaaataaacaatttttttatatataaattcttgcggcattaccgacaaatattgcttcatttgatacggcttaaacctgttaggtttcttggtaatccccataaaaaaacacccggtttttaaggtgtttttatttttaattgttttgttacttatcctgatggctttcgggaaaattggtttctccacttgtaatactgatactggttggcgttaccagctgaattttgtctgtatcaaaacgttctttaatatttaagtaagctttgcttctcacctgtgcaagattggctccaaccttgatccagaatttcacctgaaggttgaatgaaccctgcttcagatcggtgaaaataacttctgcagtatccaacttatctacattgtcaaggttttttatcacatccaaaattcctttttgggctttactgatatcttcgtctgcaggaatctcaaaatttaaaataatcctgcgctgcggagaagctgtaatattgtaaaacggagcattgaaaacaacctggttgggaatataagctttcttcccgtcatcggtaagaattttcgtagttagaaaaccgatttcctgaaccgttccggaatgggttccgatggtaatataatctcctactttaaatgctttatcaattcctatcagcattcctgagaaaatacttgaaacaagatctttcagtgcaaccccggcaataaccccggctactcccaaacttcctataaatttccataagaagctactgaagcccataatttcaagagaaataaaagtacccatcagcataatcagaaatctgaaaatactgatcagtgtaaccaatgaactctctttctggcttttcggaaaaaatttatgaaataattttactgctcctttgcttaaatatttactgctgataaggaaaaaggtaaataccagaattccgacaatcagctttggggttagctcggcaaaggtgatataccaattttccaatactttatacacaacatctacatacctgagtccggttttctccatgagtaaaattttagttaaatatataaattttcatcaaaaaatttgccagttccaaaaagtctactaaatttgtagactataaaaacggaatattatgtcaatcaaattaggagatacagcccccaactttcaggcagaatcatcagtcggtgatattaatttttataactatctgggagattcctggggaattctattttcgcaccctgcagattatacgccggtatgcactacagaactgggatatacagcaaagctgaagtctgaatttgatgccagaaatacgaaggtgattgctctgagtgtagatggggtagaagatcatcaaaattgggtaaaagatattaatgaaactcagaatacccatgtgcagtttcctattattgcagacaaagacagaaaggtttcggagctgtatgattttatccatcctaatgcttcggctacagctactgtacgctcgcttctgattattgatccttccaaaaaagtgagactgattattacctatccggcctctacaggaagaaattttgaagaaatccttagagtgctggattctttacaattggtagataattatcgggtggcaacacctgtaaactgggaaaatggagaggatgttattattcctcccaccatctcaacagaagaagcacggaaaatattccccaaaggtgtaacggaaataaaaccgtatttacgttacacgccacagcccaatacatgatttatttgattttttatagtttagttttaatttgtacgaaaagcgccccagaaataaaatttccggggcgctttcatttttttataagtatttcagtgattacttaacgtcgttgataatctgcttagctttagatgttggaagataaatctggaaacctaaaccaaaagtaattttgttagtatatccaccgcttccgaaacctgcgtttgcatcgtattttactaaaccttccaatccaatgtttggagtgatgaagtaagaatacccaggtccgaatccgaagttaaggccgttagaagaagaacctccttttgaaatagatgttccaccaataccaacgttaccttcgaagaaccatcttccgtggtgaagcaaattatttactccctgctctcccgggttaagatagtaacgtcctaaagcacctacgttatacgtgaaagtagttggtgcatctttagcgcctttgaaacctaaatccacatatcctcccaatgcaatgttatcctcaataaaataagctcctttcggttgaatattaaaatcataacctcctcctttgtttaaaccgaagttggcacctgcaaggttaccccctaccatccaattacctttctgaatctgagcgtttgcagttgctgttaaacctgctacggctaatatccctgttaaaataagtcttttcataatttattattttaataattaaatgtttattattcacgaattatagaaaaaacaataaatgtgccatactcttaattttacgtaatttttctaaataaacgttaagattgtcagagagatatattttatcattttaacatattagttgaagatatgataatgataaagataatgaaataaggtttttaaaatgaaaatgataagaataggtggcaggtcattaattgcataaacgtattaattaaataaatagaagaatgattgaaataataagtccggcaatggtaaatctgataccgcgtttgaaggcctttgtcttgggattaaacatccagaaacttgagatcacgaaaaagaaaagtgaaactccgaagaatacactcaggggtgatatggcatctttagattgagatttgtgaagagaaaccattttgtctaatacgaatggtaattcttttttggtgtacttcgcttttccggttgcactgtcataagttccctgtttaaaataaaggatacttccttctgttttttcaacctcaaggcctttcatcttaagttcctttttcagttctttttcagaaaggttggcagcgatgtttttttcatatttcttttcgctcttcaagaaatcagtatctctgtataccagaaggattccgcttattgagtataccgccataattcccgcaaggaaataccccagatagcggtgtgtaaccctcataaaacttcttgtgtctttaatcttatccatatcttgttttgtttttattttaaaatttcaaagtggaaactgcaacaatgcaatttccactttcatgaaagaattatataaattctagagtctgtatgtcaatgtaaaatagtagtttcttggagtgatcggattcactgagtaattttcgtgaacattgtaatttacgacatcaaacaggttcccgactttcccctggatagagaattttttccaaccataccctacacttatatcaactgttgtgaatccgttaatatcaatcattcttgtctgctgggtttgcccttttacatcattccagccagcttgtctttttcctgtatagaacgctgtcgctcctactttcagaccttttgcaaaatctgtaaaggtataaaatacggaagcatttgcagtaagagcaggagttcttaccaatttttggtcttcaacaaatccgttatcgggagtttttgtatatacagtattattataagaaatacctcctatcagagaaagatattttgtaggatttcctgtgatatccaattccacacctctacttcttatattaccggcatatactttatataatgcaagtttattctctgcaagatagggtgatgtataagcatccctgttgtttatttggtaagcagttaagttaactgcgattgcgttgttccataaatttttcttaatccccacttcgtactgatcaattgttgatgcctttaaagaatgatcgttttcgtcaaaacctgtattaggtgagaatgaattggtatatgttgcaaaaacagataaattatcattaggattatagattacccctactttgggtgatatagcgtgagcttgcaagccactgtttattgtagggacttctgttcccttcagaaaatcctttacttctgtatcttcattttttacatatgaccatcttacccctgccaatactttaaattctttggtaacactgattaaatcctgtgcataaagaccaaatctctttgtagctattctatttcttgatgctctgtaggtttccggcatagttccatcattggaccatgtagatggatcatttaaatacaatgttccatagttagcacttgtaggattggtaaaattgtaaatgtaagtatctgccaggccatagtctccgtctgttccaaataaaactttatgaatgatatttccggttttaaattctccgtttaagttaacctgtaatgaagtatagttttgttcagtataatttcttcctaaagttctaccccatgaaggattaaaatttccttttcctgattcatactgccattggattctttctgttgaaaaataatcttttgtataattctgataggaagccactgcatttaaactccatttactgttcaattgatgatttaaaacaacatctgtagtggcttgttggttggtttggtattgccagttagcacccaaaaagcttctacggtcaacttcagtagctaatctggatactcctgtggttttatcagtaacacttccaatcccaaaatctggagtaaaattatgatataagtaatctccttctacaattaattgtgtgttttcactcaaattaaaaacaaaagacgggttgaaataatgctttttagattctaccatatctctgaaactttcagcatactcataagtcccattaactctgaaagctacatttttacttaaagggccatagatgtcaaacataggtttataagaattccagcttcctccgtttaatccgacagatccaccaaattcaaatcttggtttttttgttataaggttaacaatcccgcccggtcctacgttaccatacagcatagcatttgctccttttaaaacttcaactctctctagcccgcttacttcaggaaaaacaccactgtttacttttgctccgtttttgaagatgttatcatttccgaatataaagcctctccctccaaagctatcctgagatcctcctcttgcagatgtcaaataaataccatttacatttttaataacatcactcaactgttttgcctgctgctgctcaatgatttcatgggtaacaatagcaatcggctgaggattttccattaccgtcagatttgacttggtcgataaggtccttgcctggttaggatttccggttttatgaagattgatatcctcaatggtttgagttctgatagtgtctgcttcagcgtttttcaactgtgaacttgccgaaacagcgataaatagaagacctaaagaaagtaattgtcttttcattttatttttatgtagaacagttttaaataaggcgcaaatgtaagtatttgtttagaatagataaaaataattttatgatttaaatcatattttttgtatggctcatgacaatggattatttctatacctcctttagatcggggaatagagaattttttatgaatatatttgttaaaaattataatatgcaattggtaaaagcagggctttgtgcctttggaatgagtggaaaagttttccatgcaccgtttttaaaggagcatccgggattttttatttctgcggtagtagaaagaagtaaggaagagtcgaaggagaagtatccggaagcaacaatttaccgttctgttgaagagatgcttcagcaggcagatatagaactggtgatcatcaatactcccgttcagactcattatgagtatgccaaaaaagcattggaagcgggtaaaaacattatcgtggaaaagccttttacagtaaatgtttctgaagcggaagaactggtaaagctggctgaagaaaaaggattgttcctgagtgtatatcaaaacagaagatttgaccgtgattttttacaggttcaaaaagtgctggatgaagggaaattgggaaatatcaaagaggttgagatccgttttgacagattccgtaccactcccagcggaaagcagcataaagaaagccctgatcagctgggagccggatcgcttcatgatctgggagcacatcttgtagatcaggctgtacagtattttggatatcctgaaaaattgtttgcagatgtattttctatgaaaggaaaagaatttgcaaatgattattttgagatccttttattctataaaaatgatctcagaataagactgaaatcttcggttttcagcaaagaagggcactatgcttacactgttcatggagatagaggaacttttctgcaggaaagaaccgataaccaggaaaatgaactggtagcaggcgctgttcctgaatatggaaaagtatggacacagcctttgaatgctccggatggaattttaaactacctgaatggtgattctgcaacagaaagaattcttacctcaagtgaagccggaaattatatggattactatcagaagatctatgaacatattgtcttcgggtatgctttaccatctccgggcaaagaagttattcagaatatgaaaatcattgatgcttctctggaaagtgcaaaagaagaaagaataatcaaattataaatgatgcgttatgaattatgaatgaattcaaaatttcaggttcaaggtttaaagtttcaggttgatcgtagttgtgattagaaattttcaactcatttacactcaaaccctaaaacactcaaacgctccgactcattcataattcataatttttaaatcataattattaaagtagctcctgtagctccagccatctcatttcatggttctccagtttttctgaaacggtttccagctctgaagaaagtttggctatcttctcataatctgcttcattgttgagctgatccaaaattttagcacgctgttcttccagttcaggcatttctttttcaatggtttccagttctctctgttctttgaaagttaattttcgttttgtatttgaaggtccggtactttccactgtggaaacaggttctttaacaggttcaggcttcgtagctgtatttttttccaatgcttcttcacggcttctggcttctctgtattctgagaagtttcctacaaaatccctgattttaccgtttccttcaaatgccagaacatgatctacaattctgtccatgaaatatctgtcgtgggaaacaataatcaaagatccctgaaactgctgaaggaagttttccagaaccgttaatgtcggaaggtcaagatcattcgtaggctcatcaaaaatcaaaaagttcggattctgatacaaaatatacatcaggtgaagtcttcttttttcacctcctgaaagctttgaaatcggagaatattgagtttggtcatcaaataagaacaatctcaggaactgtgaggcagataagcttttaccattagctaaaggataaaactcagcaatttccttgatgaaatcaatcacgcgctcatcctctttataggtaagtcctttttgtgaaaaataaccgaaagaaattgtctctcctgtttcaatttctcctttatcagctttttcataaccttgaataatattaagcaatgtagattttccggcaccgtttttcccaacaattcctactttttctccgcgttgaaactgatagctgaaatcttttaaaagaactttaggaccaaagcttttatcaatatgcttgagttcaagaattttatttcctaaacgtttcatttcaaaatccagttccagcccatcttttctggtgtcagttttggctaccttttcagtttcgtagaatgcatcaattcggctttttgattttgtagttcgggctttgggctgtctacgcatccattccagttcctttctgtaaaggttgttggctttatcaatcgtagcattaaggttttcttcccgaatcattttgttctcaagataagtggcatacgagccgttgtgaacataaagattctgatcttccatttcccatataatatcacagacgctgtccaggaaataccggtcgtgcgttacaagcaataaggttatttttgctttgttcaggtaattttcaagccattctaccatgtccacatcaaggtggttggtaggttcgtccatgataagaagggtatgcctgtgctcagctcttgtctctgttaagagtttagccaacgctacgcgtttgatctgtcctccggaaagagttcccattttcgcctcaagatctgtgattttaagctgtgaaagaatctgcttcatttcattctccagatcccaggctttatgaacttccatatcagccaaagccttttcaataaaatcattatctgtggaatggagtgactgatgataattcttaagtgccagaataggctctgaatcaagagtcatcataaattcctcaatgctgagattaggatcataatcgatttcctggtcaaataataccacctggatatctttattaatgatcgcagttccgctgtctgcaatttctttacccattaatattttcagaagcgtagattttccacttccgtttttggcaacaatagctattttatctccttcattgatgtgaaaagaaatgtttttaaacaaaaccttgatgccataagatttggtaagattttcagcagaaacgtaattcattgggaattaatggtttgattttaatttggaattgaaccgcaaaaatacgaaaatgtacctgaaattttctgcaacctcttttataaatcaatatttataattttttaataaacctgagggaagtactgaaaaaactattcagtaaatttgattggctgcaatgtaaatagttcttaaaaaaataataatacaaaatctgattaaagtaatgaaaaaagtaattgtcgacatggatggggtaatggcagatgtgtatcatcagttggtgcaatttgaaaaaagagataccggaagggaagttaatatcagtgatttagtgggaaagccggaaatagaagcctttccaaacggaaaaaaacacgttaatgaagtaggttttttcagaactttaccggtaatgaaaggcagccgtgaagcaatggaatatctgaacagtaaatatgaactttatattgtgtcagccggaatggaatttcccaacagcttaagagaaaagtacgactggctcgcggaacattttccattcattacatgggaacagattgttctttgtggaagcaagaaagtggtctccggagatgtcatgattgacgattatcctaaaaacttagatcatttttccggtcagagattaattttcacccagcctcataatgagttgatcgaaaatgatacttacaaaagggttcactcctgggaagaaattataaatattctctaactctaagtattaaatcatataaattctgggaatttttaaaataattttaactaaagacgggataaatttaataaagtattgggagctcggaatgttcaaaataaataagtttgcgtcaaacttttaacatgaaaatattccatactctattttttcttattcctgccattgcccttaaagcacaggttatttccggaaccgttattgcaaaaaatgaaaatcagccgattccctatgtgaaagttgggatagaaaagagttcaaccggtacaatctctgatgaaaaaggaaatttttcaattgatctttccagtattgatccccggcagaccatcaaaatagaggtgcctggctatgatctttatcaggaaaccgttcagagttttaaacaacatcatcagcaaaaaatatttttaacagaaaaaactaaaaatattaaagaggttaccattaaaccgaaaaaactggttgataaaaattggggagttaatacaaagacgaaaagtgttatttattccgtaaatcccgaatttgataagaaaagttttctcggagaaacagctttagaattcaatgctaaaaaaagatcaaaaattaaaaatatcaacctgaatatcgccagttacgtttccgcgcagcctgtattgatgagatatagtatttatagtgaaaaaaacggttttccggataagaatattcttgaagaggaaattacagttgagctcactgaagatatgatcaaagacggaacatatactctggatgtgaatgatcgtaatatctgggtgcagggaaaattctttattggtatacagtttttaaaagcatttgacggcaggatcaaaataagcgcagctttgttcagaacaggatttataagagagttttatggtgactggcagaaaatgaccattgccgcaccagccattaatattgatgtgaaaatggataaaaacgacagcaataatcagaatgaaaatgattaatgctgatgtacctgagcagctgaaaaatcgatctgtcgattcaatatacatttttcatgctaatccagtgtcagtcttttcaacgaccatgaactgccattgtaaatatcgagatccacttttgcattgatgccgtgtacaattccgttttctgtaaattgccagaagtcccactggtcatcgggagaaggggagggaacatcattataattggccagccataagggatagccgtcaaattcacctttcagaaaatctttatagtaatgatagtacgtgtagatgataggtttttcaccataggcatcttctataattttgcaccacaccttcaggtcttcaaccaactttttgttggttttacgttttgggattttttcaatatcaagaatcggaggaaggtctccgctttcaagttttacattctctaaaaaattattggcctggatcacgggatcttcatcagctctgtaaaaatggtaagctccacggataagatcgtgttttttagcgctttcccagaactcatcaaaatgcttgtcggcacttcggtttcccatggttgcacgcatcaccacaaactccaatggaattgtcttgtttccgatgcttaggctgtcccatttgatatcctccctgttctgatagtgggaaacgtcaaagccataggttttatcaaggttactggctatgattctctggattcttgccgcttccttttcactgttatgaagttttttatgcttaaatttattaaagtacagggcataataataagtaacggtctgttttaaataaaaaccggttcctatcaatgctaaaattaatattgccaatatcacccacctccggaaaaaatacttcttccgtcgggatttgtggactcgtttggcagtttttttggtgtactttctcggtgtcataaagttttgcaaaactaacttttttcactgctaaatgctaaataaaatcagtaaatttgtgtattatggaaacacgcgaaaaaatcatcattataggaggaggatttgcggggctgcagcttgcaaaaacattgaataacaagaataaaaaggtcattgttcttgaccggatgaaccaccatatgtttcagccgcttttttatcaggtagcctcaggaaggatagaaccttccaacatttcttttcccttcagaaagatttttcagcagtccagaaacacacagttccgtatgacagaggtgaaagaaattgatcctgctaaccataaggtgattactgacgaagcagaatttacttacgataaactcatcattgcaacgggctgtaaaactaattttttcggtaacaaagaactggaaggtaaagctttcggaatgaaaaatacccaggaagccatcagcatcagaaaccatgtcctgatgacctttgaaaaactgattattgaaaaaagccgaagcgacgatggtaactggaatatcgttattgtgggaagcgggccgacgggggtagaattggcaggtgcttttgctgaaatgaaaaaagatatccttccaagagattatccttatatgaattttgatcatctgaagatcatcctggtaagctctacagaaaagccacttgcagtaatgagcagtgaggcgcaggaaaaatctgaaaaataccttaaagaccttggggtaacttttctgagcggagaagtggtaacagattatgacggtgacaaagtacatctcagaagtggtaaggaaattccatccaataatgtgatctgggcagcaggagttacgggaaatgttgtaggaggttttccggaggaaaaattaataaggaacagatatattgtagaccgatataacaaaataaaaggttacgataacatttacgctatcggggacattgcctatatggaaaccccaaaatatccccaagggcatcctcaggtagcgaatgtagccattaatcaggcaaaaaatttaggtaaaaatttattaaagaaaaatcagcaggaatggaaagaatatgagtatgatgataagggctctctggcgactattggaaagcacagagctgttgtcgatctgccgtttattaaatttcagggatttctggcgtggtatttctggatgtttctccatttaatgctaattttgagcgttcgaaataagctggccatattctttaactggatgtggagctatatcaacaaagattcttctttaagattaattattataccgactaagaaaaacggaacattacaatgagaattgacataataagcgtacttccggaattgatggaaagtcctttcaaaacttctattttgaaaagagctatggataagggactggtggaagtacattttcatcatttgagagactgggctaccaataaacacagacagattgatgatgagccttacggaggcggagcgggaatggtcatgatggttgagccattggataaatgtatttctgagcttaaatctcaaagaagttatgacgaagtaatttatctgacaccggatggcgttactttaaaccaaaagattgccaatacgctttccattaaggagaatctaatctttctctgcggacattataaaggaatagatcaaagagtacgggatctccatatcactaaagagatttccattggagactatgtgcttaccggaggagaacttgctgcctgtgtacttgcagattcggtgatcagattgcttcctggagttttaaatgatgaacaaagtgctttaacagacagttttcaggatgaccttctttcaccgccaatttatacccggcctgagagctataaaggtctggatgttcccaaaatcctcttaagcggaaatttcgggaagattgaagagtggcgccacgatgaggctgtaagaattaccagagaaaaacgtcctgatttactgtaagcgatcgtcagaattatccaatttttaattatgaatttaattccatttgttaattataaatggaataatatttgttattaatttaataagtgcgaaaaatattaatatttctaattttaaattgaaattttatttctattattccggattttatatattgtctcaattttgattaatgtataaaaactcatcaatagttgaaaaattaatttattatagctgatttcattggtattttttactatatttggactgttttttattggaaattgatttgctcgcttcgaaataaatcaaagaaaatttgaaaaaaaataataaatttacattgcaaaagaaaaagaacataataattaaaagtttagaaattagtgtagatggagctgttctctttttataatgttgaaaatttatttttacccgatcctaaacctgtccataaattagatcctacccggtcaggattaaggaattgggatgaaaagagatatagaaataagcttttcaaaatctcccacgtatttcagctgatgaaggaggataatggtgttctgccatttatgataggattgtctgaagtttccggaaggaaagttttggaagatcttgtggagatggagccctttaattcggaatatggaattgtacattataattctatggacgaaagaaaagtggatgtagccatgttatatgataaaaataaagtagaggtaatagattcagaaaccattactttcttttttgaaatagtaaataaaaacacagaaaattacgacacgacaagagacgtacttttttcaaaaattaaatataaaggggaaattattaatgtatttatcgcgcatcttccctctaaacgcgaaaaagatattaataagcctaaaagagcctttatattaaatgaaatccggcaacggattatgaaaatagtggatgctgataaagagcatgtcatattgtgtggtgattttaacgaaaacccggatgatgaaaatttagtacagattctctatgacaatgagcatgagaaggttttagtgaacccttttcaacaattgttttctacaagaaattattctacttttcattataaatctggattgctgtatgatcagatcattatgtcaagatctcttcttgataataagacgctggcttttcaggatgctcatatatttaattctgaaaaaatccgcagccggaccaggaattttgaaggacggcctttccgtacttatgccggtacacggtatttgggcggatacagtgatcactttccggtttttgtaaaatttaaaaatttacagtaaaaaacataaataataaaaaaagtagaaaatgaaaaattcgagcaacacaagctatcatttggattctattgacaaggaaattatctacatgctgatggataatgctaaaacttctttagcccacatttcaaaaaatgtcggaatttccaccactgcagtgcatcaaagaatcaaaaaactcgaacatgcaggagttattgaaaattcaatttcgttccttaatcctaagaaaattggatataaggtgatttcctacattggtgtatttttggatcagccaagccattatccggaagtggtaaagtctttgcatgatatcaacgaagtagtggaggcccactatactacagggaattataccatattcctgaaagttctttgtaaagacaatgatcatctaatgcagatccttagcaaacttcaaaagctgaagggagtaacaagaacagaaacttttatatctttggaacaaggtatttacagacaattgaaagtataacgacatgaacatagcccaatatttggattctacttacctgaaaacaccagaacaatcaggtatatcccacgaggaaacacttcaaaaagataaacaacttgcgcaggaagccatagataatggaatctttgccgtgatgattcgtccggattatgtatctgagatcaagaaatatattcaggaaagaaattcaaatgttgcagtaggaactgtaataggctttcatgaaggtacttattctattgaagagaagcttgcagaagcttcaaaagcaatagaagatggagccgatgaactggattttgtgattaattacactgcatatctgcagggaaatataacactggtaaaagaggaatttgtacaatgtactaaactatgtctagagcatcataaaattgcaaaatggattatagaaatcgcagctttgactgatgcacaaattgcagatcttactaaaaatatttctacctgggcagaagagaacttctctgaaaacgaactgtcgaaaatttttgtaaagtcatcaacaggtttctatcagactgctgaaggaaaacctaacggagcgacctttgaaggagtagaaattatgctcaataacgccggtaagcttcctgtaaaagcagcaggaggagtaagaactcctgaagatgctgagaaaatgatcaatatgggagtaaagagaatcggaacctcttcagcattggcactaattaaaaatgaaacttcatcagaaggatattaatacaaatccaaataaaataaaaaccatcagttttgctgatggttttttattttttatagctgtgcctgatattcttcgtagaattgttgggtttctttgatcagactgtccatttcttccatggtgaaaacttcaaggaatttttttctgaactccttaaaatgaggaatacctctgaaatagttgctgtaatgttgtctcatttctaccaagcctaatctttctcccttccattcagcactccattctgcgtgttgacgaaccgctaataatctgtctgaaattgtcggttcaggtaagtgttccccggttttaaagaaatgcttgatttcgttaaatatccatggatatccgatagctgcacgcccgatcatgataccgtcgcatgcatacttttgtttatattctaatgctttttcagcagagtctatatcaccatttccgaagatcggaatctcaatattcggattttgtttgattcttgaaatatgctcccagtcagcttcacccttatacatctgggcacgtgttctggcatgtatcgtaagagctttgattcctgtttcctgcagacgttctgccacttcatcaatattaatgctggtgctgtcccatcctaaacgggtctttaccgttaccggaagatgagtagagcttaccacggcttttgtaagacgcaccatcaggtcgatatctttcaaaacaccggctcctgcacctttgcacactactttttttacaggacatccgaaattaatatctacaagatccggatttaccgtttcgacaattcttgcagacatggccatagcttcttcatctccaccgaaaatctgtattccaaccggtctttcataatcgaaaatatcaagctttttacggctcttgatagcatcacgaattaagccttcagaagaaataaattccgaatacattaaatctgcgccatgcatcttacacaaacgtctgaacggaggatcacttacgtcttccatcggagccagcaaaagtggaaattccggcagttctatgttgcctatttttatcatggtgcaaatttacgaaattcttaaaaaacaaaatttttataagtaagatgtggtactatgttttgcttgtgttgttgtgtttaaggtattttatgatattttgtttaatttttattaaatatatttaactgattatcagtatttattgaattttattaataattattttttatatttagtataataaaaattaatgtcatgagaaaaattctattttgtttgatggcaattttggtttcatcaactttttattcacaagtcaatatttctgctacggcgggaacagccacaggaacttatactacgttaaagggagcatttgatgctattaacgcaggaacacaccagggtgccattacaatcagtattacagcaaatacaaccgaaacagcaactgccagtctaaatgccagcggaggagcagtaaattatacgtcagttgctataaagcctgcgacgggagttacggctacaatttcaggtgatattgccaatggacctttagtgaggattcagggaagtaatatcaccttagatggaagcaacacagcttcaggaaccacaagagaccttacccttaccaatacttctgttacagcaccacaggtattaacttttatagcagcttcagctgctgctgccaatacgaatatcacggttaaaaacctgaatattgtaaacggtatcaatacctcttccgcatttataatgtatgatggagctgcaactcctacaggaggcttctttaataatgtgaccatccagaataattctgtgaagaaagcctatataggaatgtatttatttgcagctgcagctgcaggtaacggcggtaacactctggtgacaggaaatgatgtgagtgccaccggagcagatgcagttcgtctttgtggaatttatgtgcagggagcagacggagtaactgtaagtaataacacaattggcaattttgaaactacaaatgctgagattaagaggggagtctggtttgcaactgcaaccgtaaattcttccattacttccaataccattactaatcttggttattcgggaactggcgccggcggagcttcagggataacgataacctccggtaatacaggagcttcagcagtggctaatattaatgtaagcggaaatacgatttcaaattttacttccagtggaacgggaagtctttttgccggaatttatgcaggaggtaccttgacgtcaggtatgaccatcagtaacaataaaataaacgggattaaaaataccaacgtatcaggatatggcgcccagggtatttatcttgcaacaacaagtcttactgccaatacattagttgccaataatgttgtgagcggtgtagcaggttatggatatgcaacaaccggaggagtgaatgataacggaaacggaattgttattgcttcaggaggtggatacaagctttattataatactgttgtaatgaatgtcagccagactgtagcaggaagaccatctgctttaaatattacaagcggagtaaccggtgccggaggtattgatgtgagaaataatatttttgtcaatactcaaactcaggcgggagacagatatgctatttacgccggagccgtcagcagtgttttctctaccattaactataacaatttctattctaccggtacgaatcttggctatatcggaggagcagcaaaagctacccttgcagatatccaggcaggattcggaggaaatataaactcattgaacatactacctgtatttgtatcagccactgatttccatttgtccgctacaggaaatgccactcttgacaataagggaactccggtagcagaagtaacattggatgctgatggaaatacaaggaatgcggtaacacctgatcttggaagctttgaatttacagcaactgtattggcagtgaatgaagctgcgaaaaagaatacggttaatgtgtatccaaaccctgttacagattacctttatatcaataatgacagcagaatcaaagatgttgaagtatataatgtttcaggccaaagaattcttagtgaaacaattaatgctgaaaaaggctctgtcgacatgagacgggctcctgcaggtatttacattctaaaagtgaatggagaaaaaggatcacagtccctgaaaattattaaaaaataatattgagcttattaccaataaaaataatccctgatagtgatatcggggattttttattttgaaaatcatcattactattagaagcttgcttttacctgcatacttccgatatgaatcgtacggtcaccagaatttcttccttcgtaattaaggttcaactggataaatgagttgatagcctgctgaataaatacactccatacctggttttttccaggcttcaaaccatccagcatctggtttcctacaatactgaaattgtttcctgtaaaattattgctgatgaacgagaagtttccgcggatcgaagtctttctgcgttcccattggatggttcctgtaacatcaaaagctttaagaagctcttctccgtccaatctctgtttctgacggaaggcagatgataattcagcctgaatggcgtctgtgaatttataagttgccttaggcttggtttcaaagttattcaaacggtaatctctcgttgtaaataattgtgaagagtttttaatatcatgaaccgagttttcccaatctaccctgaattctttattgaaccaatatccgatattcaggaaatgagaagtctgctcgcgttcttcattactgaaattggcattgatgagattatcgttggtaataaacctgtaatttccattccagcctgatttatcagttggattaaactgtacggaagcaagaatattctggtttttaagaatctggtcactgttcttctcaaaaggattcaggacgagaaccttatcctttttatagaatgagttttgggaatttaatgaaatattaaaattccaccgctttaaaaatccgttttctgaattaaaaacaatggctggattcacaaataatgccagctgtaatttatttttattagacggcaggtacctcacagaatttgtatatacccggatatattgtgcaaggtcggaatattcggcaatttcaaattcgtccagctgctgaacgccatctccgttgtaatcggtccatttataaacaccctgtccatcagttactttaatatattggaattctctctgtgcttcctgtccgtttccaagttcatagaaagcctgaaggcgcatcccatttctgaaaagctgctggttgtataagatgtttccaactacgaaatcattatttcgggttacttcaccttctgcacccgagtagaaaaactttcggtaatgaattaaagcatttaaagtggttctttctgttttgatgatctgactttcagccatgattcccagaatattgttcatattctgaagtctgttgtcacgtaccgagtcattatccctcatgtatacttttgtcaataatttggttctggtgctgtctccgattttcttttgcaaaaagatttccttccagctgaagctcgtgacatccataagctgggtatcgttatacttcttctcgttatgctccatgcttccaccaatggcccagctgcctttcttaccggtaaactccgttgaaactcctccacggatgaatttcgtatcctgaagggtagcattggtactcagataagataaatttcccttggtaaaaaactttcctgtaatccatccgaaatccaggtcatttttaatccctttgtaagaatcctgttcattcagataattgatacggtaatttagtgtagacttgttattccatttattcagaaagctgaaaataaatctgttttgggttctgttattgaactcctgtgtaaggttgaaatccctggagaattccacatcattaattcggtcaaggatatgaaactgcctgtctatgtattgatattcaaaactaggcgttcctttccatgtattctttttgaaacttttatttccgaaaatacgccatgcatatcctatattctgatcagaatcttttgacgaaaataaattgacatcataattactcagggaaatatcagcgcctatcttaccttcattcagtaaatattcagaatttacagaatatacctgtgatttctgaggagaaggaagttttcttaccgctctgtaatctccggcgttaggccctacatattgaaaaacacgtccgttattcgtggtttgtgctattttataatcccccagattagctccgaaataagtaaaagaaacctgataaagtgttaagcttgaatcagtagagtattcatagaaatttccggcggagtttagtttatataaaattttattgacatcatattcggtgaccactcctgaaggagcatacatcaggtcaggattatttccagcctcagcaagaatctgctcgtcttctttagaaagatttaaagaaagaggagcattcttattgtcattttccatgaaccagtttaatcctaccttgaatttttctctctgatgttccagttttcctgtaaacagatatcttgaataatttctgttggcgtagttataggaaattgtgataaaattctgttggaaaataggacggaaactggtaaaagtaacctcaccggtgttgtagttgataatataatcctggttttcaccacgcttcatcaggataccatctatgaaaacctgttcggatccggagatcagagtgataaactgttcaccgtttttacctgtcagacggtatggcccctggttaccttcaaccccctgaaaacggattctgtggaattcacttcgggcaactcctgcagaaatatctaccaaagtcttgttttctttcccgaattctgtctgaaactgaagtcccatactccttctctggtatttggcaaaataattcttagcttctataagatcaaggtggccagctcttaggatagacttttccttaatattgagctgcatatagattttgtcaaactcctctaaagtttgggtataaccatcagcctgaataggaaggttatggtctgaaatacttgctaagatggtaacgtcttttgataaccgtcctgaaatctgaaggtccatggagctctgcacagactgtccctggttgttaccaaaagtaatcccgcggataatggaaccttttgaattaagctctcctaaaaatctctttttatcattcttggcgagtacagcttcatcaataatgatcttgttatgtgttcttatgaaatccagggtatcttttgcgaagatatcctgttccagttttgcagcaagaatactgtctcttttgatgctgtcttcagggatattgggatttttccatgaaaatacctgagcatttcctgaaaatatgcctaaaaagaatacaacgaatagaatgacaaaattccgcaacttttaaaaataattcgtaaaaataattaaaaaatgttaacattaagaggttaactataattaacaaaaacttaatctctttattgtccaaaatcaaaaattagatgtagttttgttatgtaagtaaattattaacaacaaaaaatttaaatcatgaaaaaactttattcgttatttgctacagtaatgttagcaagtggaatttttgcgcaaacagtcttcagtgctacatttgatgatgtaacaggaacaggaggaaatgatggtgcttggagtggaggtattgcatcaagcggatttgctgatggatccagctcttatacaactggcggaaactggacttttactaaaatttataaaggaaacggatgccttaaggcaggtacaagtagtttaaaagggtcaattactactccaacttttaacttaacaggatcagctaccctaacattcagagcaggtgcatgggatggagctagtgaaaaaactactttaaatatatctgcaacaggtgctactctagatcaggcaagcgtaactattgtaaaaggagctttttctaactataccgtaaatattacaggcgctaccggagctgtaactcttacatttgaaggatctgcagctgccaataacagattctttattgatgatattattgtaagcacaggaacccttgctgttcttgatactaaaaacgtaaaatcagccaactttgtaaaaaactctttcgttaaaaacaacgaaattgttttcggatctgatgtaaaagacgtaaaagtgttcaatatgttcggacaacttgtaaaagaagcttctgtaaaacagaacgaagcggtaagcgttgctgaattggcaaaaggaaactatatcataacaggtacagtaaacaaccagccggtttctcagaaagttcttaaagactaatttctttcagataaaaataaaaacagccactccaataaagtggctgttttttttatgagtattctgatttttagatttttatatgatgcatatttcttaatttggtggtactgtttttgatgttttatgattacccattctaaaaataataacgatgaaaaaaatctttactctgtttggacttacattattgacttctttttcaaatgcccagattgtgatcaacgagatctatggtgggaatgcaagctctggtgctgtattgaaaaataattatattgtccttaaaaatatcggaaatacactggtttctcttacgggtgccagtattcaatacgcaccggcgataggtcctttttccgaatatcatactttgccggaccttacgctgggacctgatgaaacttatttgattcaggagtccgcgattgatggaggagtggagaatcttccgacacctgattttattgcaactacaattacaaattttgacggaactcccaataaatcttccgggctgagaatttccagtgtatcaggaaagattgctttggccggaaatatagtacaggtaacagggccttctgcttccaatgtactggattttgtgggatatggagcaaatgcagatcagtttaaaggagatgggccggctccttctcctacagctaccactgctattaaaagaagcctgttaggaaatgatgataatatggcagacttttcccttgaaggaagcgtaaaatcgggatttgtacagaatccttttatcaaagacagtaaagtagtgttcggaactgaggtaaaagacgtaaaagtatatgatacattcaggcgggtcgtaaaaaagtcaccgacgaagctggcttcatcactggatattgcagagcttccaaaaggaacttacatcgtcacaggaaccattaacgatattccgatttcacagaaaattataaaagattagtttttaataaaaagaacagcaaatattaataagctgttcttttattttatagacgtgttttctgtccattgaatgcacaaacagaatcagcaataatttactgttaataccaacctcttcttgctgcgttaataatggaaccgagattgagaatcaatgtatatctgatacgttttccataatccttgaatgaaggttcaaatcctaaagaagactgtatcgggaaatatacttccagaaaatccggaatgattcttactttaactccggtgtcccatataaatttagccggaagatctttatttttatacactcccgcatctgcatatacatggaatattttccatacactagaatccacgttggcagaagtaatccattggtttaccgatcccggcagaaaagatttaaaaccaccatcagcaagtataaactgctgtgaaagaagaccgctgctcgcactttctcctaaaagagtataagagaaagaatagttggaaaccctggatattccataattgaaaaggttattgcgggtatcgtttcttaggaaatatccggcaaacaaacgtaaactgagcttttgtttaggggcaaactcccatctgtagaagccttcagctgttattttgttgaaatcttccattccctgggcactcaggctaaaacttttttcatgaatcatctggctgtcactatagccatatccgatactccagagattgtatttgctatagtcattataaacaatcatttcagggctcaggtctctttcaaaataattataggaaattccgatacttctgctcaccgtacttctcggattctttctgaaactgatagaggaagatatggatgtttttctatacgccagatcataatcataatgaaagtatgaaccggaaacaccgaatgtcagactccggatgatgctttcagctggcagaaaagagtaggatacagctcctgatcctgttaattttcctgttccggtactgtaggttggtgtaatggagtacagaaatttctgatcaaacagagactgattttttaaattaattcccaaaaggaacttatcataagtattgttgaaacgtactcttgggctgatgtaaatttcattgtattccgggttaggaatatcttttaataatttaagtttaattttttttgcattggaaaacagtccctttgcataaagaaagttatccctgtaattggattcggggaaaatataaccgttatttaaagtaatcttatagatgttttctgatgcaggcagagataaaatggaagtacgttcattttcctcagtgtctatccagtattcctttttttctccttctctggtttctgtctgtagttttaccggaatagagatatccgtattttttacaattcttatttgcagggaatcattttcttttctgatatttttcaatttaaaatcaaccctgtttttttgtttgaaaaagcctgaaagataagcagatgatctatttttttcagaaagatctgtcagaaactcttcaggattgattttctttcccgagttttgagagatataattttttatgatttcattaaaactgtcatatcccattttatcagccgaataattgaaaagacttccggtttcaaagctactgacagccatatcattgaaattactcaaaacaggaaaatgctcatcgatcttctgatcaagattctgcagcatgatatactgataagaaagtccgtaacgatcaagaagcttcaccttggaagcatggaacagctttaaaggtttaagaccaaatattctggtctcaggaagtgtgccgagaagtttagtatcagcatagaattttttgagatactgaatttccagataagattttaaaccatttttaaaccagtgatctttttctttatctgcaattactttttcatccaaaacttttttagccatgatcccaaaataatccagatctgtattttctgtatcagtaaatagacggaacctgaatttccagaaagtaatatcattatttccgaaaaagtcttctttggctctgaatttatctgaaataaaaatacttttcggaagaaatcctatgcgttctttaatgaactttaattgcaaaggaagataaaattccaggttttgtttttcctccggtctcaggttatatccaaatttgatatctatttcctctccgtcaacattggtttttatagaaggaaaggctgttgtggaaaccaaaaattcagggtctgaatcaaggtatcccttaaatgaattcatctgaacctgtggaagattaccttctacaaaattattaacaggaatatcaaagttgatggtccagaaagtattgaaacttacctgctcttcaatatcatggtagtttcttttggaaatattgcccggatcaaaatgatccggaacaataaagaaatattttaataaagtattctgagcggaagttccgtatcccgtaaaagttttatcgggaagctgcattttgtactgcagctttaaagaaacactttcaccaggttttaatgcacttttcagaggaataaaaaggttttcatctgagagcgtattgacaggtgtcacttcattttctgaatctttaatattcagttcaagtagtttccctaattgactgctctttgcaaaatgcaaatcattattacggtcttccagttttctgtagactaaagaggtgccgcgtttattgtacgcggaaacccaattcagaagttttatggtttgcaggtcttttccggaatgattgtaataaacaatttcctggctgacttcaaggttctttttgtcaggagacagtttagcttcaatgtatatactgtctgtctgcgcagaaacctgtacaactccccataacaaaataaggcaaatgctgatctttttcaaatattcgtgataaagcccaaatataacttattttgtatatactttataggattttaaccctgaattgcttttttttccaaagaattaatatatgcgttccatccctctgtcttgtaggtgatcgcagaggcttcaggatcatcagatttgtaaattcctcttcctacgataataaaatcagtatgaagtgttttgaaaacatgttcaggagtgttatactgctgtccctttccatctccggaatctgcaagatttatacctggagtgaataataaaagttcttcaggcagtttattctgagacacgccgccaattacattaggatgagatgaagcgatttttaaagcctcttcacgatagcttgctgttgttaatgttcctttggaagacattccaataatagctaccactcccacatttttgaaacagtctaaagattcaaaacctccgataacctgagatgtgacaaaatctgcccaatctgttattttaaaaactccgcttgtaaactgaagctcctgtgtatttccgatatcagcaaattttctgtcttccatcagtaaaaactggtgcttggcagcaattgctttcaaaggaataattgttttttcatattcgaaatcagaaataatatcgatatgtgtttttaaagcaataacatgcgggcctactttttcagcaaactccaatagctcctgagttgtagtaacgtcagcagaagcaataaggtttgattttttcgctaaagctgtttccagcaacctttttgaaactgaatgctgtgcaacctgaagtttctgctcataagaagatctggtttcttcttcgaactggatatggttaccctgaaggaagtcctggattctttttacttcttcatccgacaattctccggtttcctgaagaatagtgcatacttctgaaatattgaaaagagtgtgtactctgtatcctttgctttccaataattgttttcctccctgttctctgtccagtactacaacaatatctgaaaccttaagatcttcctgttctatttcaggaatggtttccagtaaagattttcctgaagtgatgacatcttctaccaaaagacagttttgtcctttctgataaattccttcaatcagtttttttgtaccgtagcttttagcctcttttcttttaataattaatggaatatagctttccagcgacattgcagtagccataggaagagcagcataaggaactccacagattaaatcaaaattatctaacggaagcatttccaataaataattcgcaagattttttaaaattttaggatctgaagccaaaggtctcaggtctacataaaaaggactttcaataccactttttaaggtaaaccttccgaatttgatgatgcctagtttatagcactctaagaagaattcttttttactttccattattttttattagatgttgcaaatttaaggaattgaaataaggcttaaaaatttatcactcatttgtaaataaaaaaccatcccgaatgtatcaggatggtgtgaaaaatataataaactattattttatgatttcggcatcaataacttgagtgcctctgtatttttgctcggcttcccataacaaaaacttatcaacctctttgatgagcttgggaatggtaagtgacaatactgccaggtcgtccattacgccaagtaccggtatggcaaattcaggaagcaggtcgataggagagatgacgtataaaattcctagtaagggaagaataatgtctatggatttcatgggataaattccttttctccacattctgaccattctgaaaatatcagggattttttttacaaaacccttgtggttgatagcttcctttgcaagatttaattttgaatacttcattttgtgtttggatttaataaatttttcaacgctataaatttcacaaatcctgtaccaacaaattataaaatttagttaaagtattatttgataatattgtcaatgaactgatgcacagtctctgtgtcccaatcttttgtagcatcctctttaataaggattcttccatgcttatccagcaggaaagtggtaggaaacaccttaggaagaattttctcagaaatcgggctttgcgcaatatatacaggaacagtataattattttctttcaaaaattttcttacatcttcttctttatcattcatcgcaatcagtacaaaatctacatgatcttttctggagttatacaatttctgaatagaaggccactcttttctgcagggcggacaccaggttccccagaagttaaggaatatacctttgtctttaaagtttttcaggtttgtgctgggtgcattaatgcctttgagctctatatcataatcttcttcacttatatgtactgcattttcaatagttgcaacgggaaagaatgtatcctttagaaaatttcttactccgggtattaaagcaataccagcgataacgacgattaatacaagataaatgatattttttttcatatctctttttttatagcagatctaaaatttcctgaacagcatcttttcctctgtttttagcgtaatatatctgcagatcattatagaaagtgtcctttggatacgcttcaggatcagctttatatttcatcaaaagttcatatccgtattttggacgtgggccccatgaattttttacattcaggtctttatccaggataaggactttaggaatagattccgtaccattggtcagaaactgattaattaagctcttatcgctgtctctaagaaaaacccttacttcattatgcccttcaaaaaatctgaaaacagccggaacggttgcgcttgcatctccacaccatgcttcggaaatgattaaaatctttccgtcaaagtttttggcagcaagttctttcaactgatcttcatccggaacgtatttttttactgttctgtccattctttgaagacccagctcataatattgtttatagtcagcttcctgttggttggcaggatgctctaatctttcttttgcaatctgaagatattcttcaaaagaaattcctttatcccagtaatttttcattaccaaaaagatttatgttaaaaattattgatatttcttgttttgttgatcaggaacagatctgccaatacaaaagccgcaaggctttccaccacaggtaccgctcttggaacaacgcaaggatcgtgacgtccttttccttccaccactacaggatttccatccttgtcgatactgtcctgaggtctcagaattgtggccacaggtttgaaggctacccggaagtagatgtccattccgttggaaattccaccctggatccctcctgaaaggttagattttgtagtaaaatctgtattgaaggcatcattatgttccttacctgtcattttagctccgcagaagccgcttccatattcaaaacctttgcaggcattgatgttcagcattgcttttgccagttcggcctgaagttttgaaaagataggttcaccgattccgacaggaacatttttaattacacatgtaattgttcctccgatagtattcccttcttttttaatctctttgattcttgcaatcatcttttccgccgtttcagcatccggacaacggacgtcattgctttctgtctgagaaaaatctaatgcctgataaggtttttcacagaaaatatctcctacggaagaaacgtaagcgttgatctcaatatctggtaaaagctgtttggcaagagctccggcaactacccagttcatggtttctctggcagaagattttcctccgccacgatggtctctgaaaccaaatttctgatcataagtaaaatcagcatgacttggacgatatgcacctgcaatatggtcataatcctttgatttctgattttcattttcaatgataaaaccgattggagtacctgttgttttcccatcaaagattcctgaaagaaactttaccgtgtcactttcttttctttgtgtaacaattgctgactggccgggttttcttcggttcagctcatattgaaccttatcgagatctaccgttaaacctgccggaaaattattgatgataccgccataagccactccgtgactttctccaaatgttgtaagactaagaagattacctaatgtattgaacatgatacaaaattaccgttttttcttcagataataaagtttcgggattagttctgtttatatgtgtttttgatagtattgataatctttaggacttctcttttttcatcttgagacatttttttccagataaatcctttcttaacatcattcttgtctgaaagctgtggaaaaattcctgcttttgcatcatcaaaaagataagaaggtgttatagctggaattggagtatcaaaactataaggatacttatggacaacattaaaattgaaattccctactttaaaggtgttaaacttttcgtatttgtagtttaaaggtttataaagctgttctttttcaaatcctgccataaaacttccggcccggaaacctggtatatatttccggacaaattcaggaaacgataagatggaaataaaaagcaagctgagcgcagagaaaacaacgatggattttttttgatcaaaatattcgtataacatgacaaagaatatcacaaaaaaaacatccagaaaaaatctgtattgggctgaaaaagccaaaataaatatactttttatcaatattgaaatgcagatgaaggtaatgagctttcgcttttttatcactgtaaatagtatgaaaataaccaggctcagaacaaaaaggatattgatttttgatttaatcccgtcaagtgaaaaccagtttttaatataatcaacggtagaaaattgttgaatttctttataagtatattgcatatcataggttttcatgacggcaaattctgaagatatttttaacacttcaggattaggtttccaagatagtcctaaatcacctatcgctacaggaaagatggggtatccgaatgtccatagatttttaagaaagaataaaaaaagaatggaagtgcctaaaagaagctttttgaaattattcttaaaaataaaaacagagcttaagaaaaccagaactggcaaccatatcattgttggttttattgtgaaaacaaatgttgaaaaggcaaaaaggagagtggtatttttattacctgctatgagttcatttaaaataatcaatgagaaaataatacctggaaggtcagggcttggagattgtgaaaacagcagcagaaccggaagaaaacaaagatgaatccagttttttctttcaacaatatacaatacataaatgatcagtaggactgtgttaatccttaaaaagggatctgaaaaatttgaaaatccggcctgaaaaatatgccagacagacatctgtcctaaggtgaggtctacattggaaattccccttatcagtccatgttctgtgagccattttaatgtaggaatataatatccaaaatgatccaatatataaggataaaatgatccggcgaataggacaacgagacttgcaatcccaattaatcttaagtttttttttgaaaaatgataaaactccaggtagagtttatttctaaagaaaatgaataacccaaagaatatagaaactgattctacataaacattcaatggaaaaaagaaagagacaattgtccatgtaaggcttattatgagaattccggacaggattttaccggtgattccacgaaataaaatccccgataaattttctatgattttcccccagcccattaagaccgggataatgaaaattgaagaaaacagaatcagtaacataaaaaaagattgcttaaaaataagcaatctttaactttattgtgaaaatatttattaacgaggttgtacccttccgtcttttctatcctgagatctaccaatagtatatcctgtagcaccacctacaacaccaccaattacagcacccagtcctctgtttttcttagcaacaagagctccgactgcagcgccacctacagttcctatgacggttcccttagcagctttgctccatccttttttctgagtagttccctgtgaagtaccacttccgttattggcataagtaccgttactgcctcctgatccggaatttgaacttctgtctctgtatatagttcgtgtttctctgatcacttttggtcttgaattatttgcagcagcaactttggctttgctttctgatatactatctgcttttttctgagcttcatataccattttttctttttcaatagccagcttttgtttttctatttccagctgtctggcctgaaattcaagcttctgtgcttccagtgatttctcagcaacgctgtcatctttcttgcaggctgtcattaaaaaaactgataaaaaacctgctaatactatctttctcataattcaaattttaaacaataaagtcaaatgactttgattttaattctattttcaattatgaagccaaattttagttaaggaatgttaaaattaagaatggaaaagggaaataattcatggatttaattgattttgtactattgatgcagggtttaaggcttatttgtaaattttaattcactgatagtttttattaaattcatataagttgattatttttgaagaccaaattacttttaatatgaaaaaatcaatttttacagtttcagcatgtattggattgctggctgttgcaacttcgttttcctccgcggaaatagtagagaataataaaaatggtgcagaattatctgatacagcaccaaaaacgcagacttataaaatccggtatggacttctttcaaaaagcggtactaaaattctttcgggcaattatgacgtaggaagttttcttgctgaaaatatggctacaggagaagtatatgatacttattatagtggtggattccagtcggttccgcaatactatgatggccttcctgcaggaacctatactttttctgccatgcagggtcaaggtggctgggtagggtatggaacggtagttgctactgtttcggatgcgcaggtagattcggatggatatattacagtgtatattccgatcatttgggaagaatagaccttgtgaacccgaaaatatttagttaaatttacctgttcttgaaatgaagattatcaattcatttatataattactattggtttgtgttatttaattatattttgtattaaataaatactaatacgttttatttatataatatttattttcttcaggatgaagtctgattcttagagaagtattcatcattcaatttatttattgtatatgttttcagtgtttgaaaatgtaataataaagatatgttgcaatgattctacaatattctgtttggatttttctaaatagatttttttcatcatttgtgttttttaggcctcctaagggaggcttttcttttatagctttttatgattctacgcatatgtatgttgatccggaaaacgtacttttactacatgcattttcgttccatatttatcaaaatggtttcttgttccgagaagccatttattatatggtaaatatctatccaccaagaattaaatacggtatgtattggagaaaaattgtgaggtattacaaatgattaaacggtaatttcactttttgattattgtctcttttttgataattaacgaatatcctatatttaaaagaaataataattttatgattgtactcataaaattaaaaaaaagactgatttatctttgataaagaattaatagataaaataatttttatctctgatataaaattttttttcatcatttgtgttttttgaggcctccatttctgggggctttttattttaatttatacatcaaagagtactctgccatcaaaggggctatcccaaacaatatagattttgttatcagatcttcgtaatggcgcctgaacaacttcatattttccttgttctgtcagtttttctacaataagattaactccttctcctatttcaccaattgtatattccaagtgatattctttttcattggtttttgtgaaatcttctttattaaaaattttttctgccatgatgatttacttttttagatatattcatttatttaggtataaaagtgtgccaatttggtacttaaaatttttttgtggccgatcaagttattttagaaaaaaaatatgtcctgaatgtaaattttattttattaaaatgtaaattattttttttttaatacttttgcgggagcgttagatttatctgaaattattataggtaattatgaagctgtttttaaagtatcaatataattggtttaaaatactgaattgataaaaatggtgcctcgtaaagaaatgaattttttttcttaaaattgaaattcttggcacgatttttcaatatagaaatgtaactcatgtttaatttgagttttcatggttattagtttttatcctcggaatttccggggatttttttttgtcctaattatgaccttgctcataaacgtactttggtaaatcatttatctttgggtaagataattttatccaccattactttttgcattatttaccaagctcttcgggatcaatgaggagcttgttttatgaataataagggaaattcacattataaataaaaagccataaagattgaataatgcgtggaaaagtaccgttagaacaaaactgtatttaggaatgtgtttatggtaataaatataaaggttatttaaaataatacctccaaagaatgtcattacgatgtagagccagttataataatgcattgatgcgaaaatggtactcataataaggatgcaaaatgctttattgtcgagccttatccatttgcttaaaatcaaataggggagatactgaaatataaaagtttcaataaggggggcaatgaatatggcaataaagtttaattcattttttgagatattttgagacttattgtaattgacatcaaaatgtaagtaggtgtcattaatataattgaaaaagtacccattaagaactgccaagacaaaagaaatcagaaagaaaaggattaactttttcatagtagttttgttggataaaaaatcagttagttaagttattgttgagtctctatttctttaatgtaaattgaaggtgtagtgccggtttttttcttaaatgcaactgcaaatgcctgtacattattatacccaatttcttctgcaatagccggtaatttataagaccggaattttttatcttttaccagtctctccagcacataatcaatacgcaaatcattaagataagaagtgaaattctttcctttatgattgttaatagtttcggataaataggctgtattggtttttatattttttgccaggctagctaatgtaattccgttttttaaaaagagctgtttgttttcaaaaatttctagttctttaagaataaatacagtaacatcttcaggaaccattttagtggttttactttctatttctgcctgctcttgtactgggggttcgggaacttcttttttgagatctgttgattcaaaatttcttttttcaatactttgaattaattcctgagctattctacgttgttcttttgccgttttttgggctttaaaataaagatataatatcaataatagtactaccgacaatatactaatagaagcatgtaaaactgtttttctattattcaaatcattaattatatcttccttttcctgtaaaaggtttggtgtatcatattttttaggaagttctgtggacaaatattgaaactgctcatcaagctttttatctacttttaaaaatttatcaatataatacaattgtttttctttatcatcttcttctttgtaataatctatgagataagtatatacttctcgaagttcaggaaaactgatgtcagtcttttgtacattagaatctaacttagtgtatatttctacaactttttctttgttttttaagccttcataacactttcctaaattataaagtgcagtattagcattatttggattgatttttattatatcgtcatacactttggaaagttttgtaatggcagttttatattttctctgtttaaggtcatattttgctgataataaagagtataagctaatatcataattattcttatttatattggcaaatgcttgtccttcccgaatcagaatacttgcagagtccagtttattaatatcaagataacaacttataagtgctatgcgtatttgattatgctggtactcgtctgttatattatttttgttgtataagtaatatctgaatatttttgctgcctcaacatttttacctatataactattaatataagcaatattcatattggcataagctgtctgtttttcatcattttgatctttagcatatttcaggcctaggacataattatctaatgctgtttttaaattatcatacttataatatagatttcctttaatcaagtaagttctggcaggatataaattccctttaatatcttttgtaattttagctaaactgtcaatgtactttaaagcagtatgaaaatcttcattaagatgtacaaggttatagccttcagctatttcaagagtatttttttctctttttgctttttggagataatattttgctattttttcagattgctggattcttatatgatcataatggtcatagaatatactcttcaagtccttataattgagagattttaaactatcacttattttgttttgagtataaaatatattgctaattataaaaaataaaaaaagatatttgtatttcatcattttgatataagcgctcaaaagtattaatttcaacttaaaaatttgtatctatatcaatagaatatgtttttgtgatgtatgaatttataaatctatgcatctattttaaataaaatattgatttgttagatatagataattaagagtatttatctgagaagctacagtttaggattaaaactgattagggaatgatgatgaaaatctgatattacttcaaatgaagtgtgaaaaggaaataagacaattactgattatgacatatatattattgattttgtcctatgttgccattatataatgactaccaatcaataaaaaacaaaaacctctaaataaattagaggttttttctgaggtacctagcggattcgaaccgctgtagatggtgttgcagaccactgcctagccgctcggccaaagtaccatttttaccattttcaggtgtgcaaatatagtaaaatttctttattcacaaaagcttttaagcaatttctttctttccaagatcttcaatttctctttttgcttgaatttcagcctgataattttttatgttaattactcttgtttcactccatttatcgtgccagccgttttctccgaaaaaagaaagagaattgaaagggaccattcggtaaaaaatacgccctactatttgtaatggtgtgggaggatttccatctatactgatgacttttgttccggtaatatattttgcaacggtctttcccaaataatattccatgaaaaagaaataggagaaatagacaaaaaagtaagaaataataatggaaatggccacatttgtatcattatcaagatcttcttcataaatcacttctccaaaaacaatagtataaaacaatgtaaaggcgaagaagaatacgtaaaatataaactgaataaagatcctatccagaaaataattaagaaatcgtgtgccggtagacgctttatgtctatcaacaacaattaaatattttctcatgttaatgttattagtttttagtttagttttttgaaatttaaaatctgttgacgaggagttttaatgaagcattcgtatcaataacggcagtgatacctgtattgctgagtaaaattttactaggtttaagattgaaaactttaccattcatttttaagcctttataatactctttattaaaggtttcctcgatactttttttcgaagtttcttccagttcctgggttgggatgccatattcttcctcaatcatttttacaatttttccctggaacagaagagaagccgttttctgcagaatattgttggttttcagcttaaatttggtttctgataaaacaatttttctttttgtttcatcatataccggaattcctgaaataatggacgttccttttatgtagccgtctgtttgagcttcaatgattactctgttatctacaccataaactctgatgtccgttacttttactttagaatcacgtacgtcaaattctttgttcaggaaagtttttctagccatattacttgcttctgtaaaaggaatattggctgtggtttgcaagataaatttatctgcaacagcaggtgttgtattaaaattggcaacgctggttacaggggaagaggcagccggtttacttccggtgaaagtttcggaatagatatcaacaccaagcgtagcattgatctgatttccataaaatttcagaggggtaatattaactcctaccgggcttactttcagccatgtattatattcttcagagatattgaaaggctgcagaaaagtattccaggccattagggcgtattgctggaagttcagttgtgttgccatttgctgatctattgttttgcagaatttctcctgttgctcttttaagcttttttcaaccagaggggtaataggaatctgtattcttccataatcaagaacaggtttggttacccatctgaagccattgggacgggtgtttgtagtaatagtccagttatttttaaaagtaactgttgtattgaaagacattaccgtttcaaaagtggtattctgatacgtatatactcctaatgtaccaattcctttttctgcccatatttttaatggaacctcaatcagtaaattctgacttgttccacctaccaggcggataggtcttgttttccagacttttaccttaaactgatcattattattgtctgtataagagtcatcctgataaacaagatctttcacagaagtattgatcatattgctcaactccgaaagagggatggtcacaggcattgtgatactggactttatctttggaaagttgtaagccgccaactgattatcaacgcctgtctgaccaaaagcgctgatccctgctactaaaaataatattttgaaaaatttcaatttgtatgtttttttaatcaacgaaaataagaattttaattttccggtttaaaactcttttccagctcaatgcttgcccctttcatttctccctgcataggaggtgctgttttggtgatttttaatttaatataatcaacctgtggaaagctgctgcgaatttttgtaatcattcttccggctacatgttccagtaatctggattttattttcatttcgctgtgaaggatgtcattgatgtcggcatagcttatagtgtcatgcagatcatcggattctgctgctttccacagatcggtatgaagttctacgttcagaatataatacgttccgataatattttcttccggaagtacaccatggtacgcatatatttttacatcttcaagatatattttgctcattgtttcagattttatgaagcaaaaatcgtcttaattcttcaaagtctgaatttatttctacagtttttttctcctttgtcatcaactcattcaatgactccggtatttcaatccgggtatgtattgctttttccaccgcatcagggaattttaccggatgggctgtcccgaggataaatcccttttgttccggattttcttgcaggtactgtatcatggcagtataggcgacagcactgtggggttccagaatatatccatgtttctgataaacttctgtgatggtgttcatcgtttggtcatcatgaatggaatacgcagaaattttattttttaaggtttcaaatttgtgtccgaaaagctctaaaattcttacaaaattgcttgggttgcctacatccatagcattggatagggtagctacagttttttgtggttggtaattctgagttttaaaataatcaggaatgacatgattagcattacaggcagcaataaaatggctggcaggcaaccctctgaaatgagccagaagtccggcacagatatttccgaagtttccgctgggtacacagattacgggctgttccttatagtgctgaatccactgttttaaagcaattaaataataaatttgctggggaagccatctggcaacattgatagaattggcagaggtcagaaataactgactattgatttcttcgtctgaaaaagcctgtttaacaaggttctgacagtcatcaaagcttccgtttacttccagtgcagaaatattttctcctaatgctgtcaactgtttttcctgaacaggacttaccctgtttttaggataaagaatgactacgttgatttgtggaattttataaaaaccgtgggcaacggcacctcctgtatctccggaagtggctacaagaacagtgacttttttctgctcatctttcagaaaataagacagacagcggctcataaatcttgctccaatatctttaaaggcaagagtagggccatgaaacaattctaaaatggctatctgctcactgatttttaccaatgggatctcaaaactgacagtttccgctacaatttgtttgagtatttctgaaggaatttcgtttccgacaaagtctttcatacatctgtatgcaatttcttcatcggaatattgatgaagattccggataaattcttcgtcaagctgaggaatactttccgggaaaaataatcctttttcctttccctggccttttatggttgcttctttgaaatttattttttccagagaatcttttaagttatagtatttcatttttgttttatttttcttcaatgatttgaattcctgccggatttatttttgagacatatacaaaactttctatttcaatttcatcataaactgatttcatcatgtgagccattttttctgccgattcttttttttctgacagcatgaaaatggaaggcccggaaccggaaatgccgcctcccaaggcatttagttgtaaactcatctctttgatgtggtcaaatttcggaatgagaatactacggataggctctacaatgacatcattgaggcttcgtccaattaatgggatatcgtttttttcaattcctgctatcaatcctgctatatttccccattgttcaacagcactttttaaagtgatatttttctttaaaatctgccttgcatctgaagttttaacttctacctgtggatgtacagcagttacaaacagatcagggctgttcagcggaataatatcaatcgggtttgttgattttaccagggtaatccctccatagatgcagggagcaatattatctgcatgccgtacacctgaagcgagttcttctccaaacatagcaaaatgaaccatttcttcctttgttaacttgtttcctaatagtagattggccccaaaggcggctccggcggcacttgccgcacttgagccgagcccgcttccaggcttgatatgtttatggatgattacttcgaaacctgttttcagattaaaatattcctggatttttaacaggacaattcccgcaacatttccggaaggctcttcaggaagctcgaaagcatcagtatgttttatgataatgtccggagtgtccagtaatctgaattccatctcatcataaggttcatgtacggccattcccagaatatcgaatccgcacaccagattggctacagtagctggtacttttaattttatttttttcatagtattattttaaatagaacggattatatctgcaaaaactccgcttgctgttacatcagctccggcaccggctccttttacaaccaggggttgctcagaatatctcaaggttttgaaaatgacaatattatctttaccataaaggtgaaacagatcactatccggggcgatatgctgtaatccaaccttggcttttccatcttcaaactctgcaacatattttagtattttaccttcgtttttggctttattcaataagtttttaaaatgatcttcatacgttgtaagcttttcataaaaattatcaacacttccttccatgcattcttccggcagaaaactgatattttcaatttcttcaaactgaagcggatatcctgcctctcttgccagaattaaaatttttcttgccacatcttttccggaaagatcaagtctcggatcaggttctgtgtatccttccttctgagcctgtgctaccacttcagaaaatgttctgctaccgtcatactcattaaagacaaaatttaatgttccacttaatacagctttaataaattggattttatctccgcttttgatcaggtcgttaatggttcctataaccggaagtccggcacctacattggtttcaaaataaaaattgcagttgtgatttcttgcggtgtcttttaatgttttatattgtttaaaatctgaagaagccgcaattttattgcaggcaacaatattcacacttctcttcagtaaactttcataaatttccggaacatcagggcttgccgttacatcaacaaaaacagagtttctcagattcctgcggatgatttcttcagcaaattctccagccgaagctttttgcccttgctgattccatgtaaggtaattttcttcagatatcccctgatccgcaaataacatatgacgactgttggaaattcctgcaattctaagatttattaaaaaattttcctttaaataatcattctggttataaatctgctgaaccagttttgagcctacattccctgttccacagatatatagatggatttgcttgatttcagattcaaagaattcttcatgaagtacattcaccgcttttttactgtctttttctgaaatgacaatactgatatttctttctgaggatccttgtgcaatagcccttatattgatgccgttatttccgagacatccaaacatctttgcgctgactccgcttctgcttttcatattttctcctactaaagccacaatggaaagaccggtctcaatttttacaggaaaaactctattcaggttgatatcatcagcaaaagaactgttgattgaatattcagcccgtaaagcatccttttcttcaatagcgacagtaatggaatgttctgaagatccttgggtaatcagaattatatttattttttcctgacttaagcattggaataattttgccgaaatacctggaatcccaaccattccgctgccttccagggtaagcagggcaatatggttcatatttgaaattcctaccgcaacctgcctttcattctcagaagatttaagctgatgagaaattaaagttccctgagcatcaggatcaaacgtgtttttgatgatcaggtcaatatttttaaccatgacaggctgaatggaaggtggataaagcacttttgccccaaagtgtgacagttccattgcttcatgataagatatttctgaaataggcttggcattggaagcaagacggggatctgcagtcatcattccgctgacgtcagtccatatctgaagctctgctgcatgaacagaagctgcaatgatagaagctgtgtaatctgaaccgcctcttcccagtgttgtcgcattatttttttcatcgctggctataaaacccgggcctacgatgatacggttctgattttcattgagaaaactgacaatattcttttcagtacaacccaaatctactttggcgtgagtgaaattactgtctgttcggataaggtctgcggaattcatccacacacagtccagctcctgatgctgtagtcttgcggtaataatttttgaagacagaaattctccgtaagaagcaattttatctttgattctgccggtaagctcaccaagaacagagattccgctgcaaaggtcttcaatatcattaaaatgtttcttcacaaagctcagccatgaactctgttctgcaataggaaaaagttctttcactaagttaatatgtttttcctcaaggttttgaatgatctgaatatacttttcatcttttacagaagcattttcagctgctttgatcaattgatctgtaacaccatgaagcgctgatacaattacaacaactctgttttttaaagattcactttttatgattttttccaccagtaagatattctgagaatgggcgactgatgttccgccgaattttaaaactttcatcaattatttatttgaagttggataaaaagaagtagttactctttgaaaaaagagtacgggtaccggaaataatatgtgaaaatttaccccgttatggggtagttgttgtagttgtgaatgtagaaacagaagatatgcctgaaataagtgatctcagggcagaaatatcagatatgtttcttaataaattcattgtaacggaacaaatgtacaaattattttgaaacggccaactttttactactataaaatttatttccttttttagagatatatttgttgtaattgattaaaaatcttatatttaggattctaactataataaatgtaaccatgaaaaattttaaaaaagtgaatcgcaaaaatctaaaatctatcagtggaggagatgtgaatgattgttttgagtactgccctccggggccatatggaccaggtgaaccaaagtcgtgtgcagattatcacgccttaccaccatgctgtaaaggaagagtactggtcagttttgaatgttctgatccgtattgatttttaatcaataaacaataataatcttatttctaatcttaaaattaaaacgtatgaaaacaattaaaaaattatcacgtgaacaaaagaaaagcatcaccggaggattcactgatatccagattgaagcttgtggtggtgaacagtttgtatgtttccgcggaagtggacaatggggatgctggcggaaaccgggaggaacctgttatgcacccatgctgtaagtattggtatgttaaatcagttaaaaattaaaatgactatgaaaaatacaaagaaattaaacagaaaagagcttgaaagaataaatggagccggcccgtcaagatgtgcaggatgtccgcagaatgctacatttggagatggtccggggtatcagtattcctgtgctgcgtatcaggggctgccagattactgtaagatgtgtgttctggtgagcatagaatgtgtggacggaggagtatcttaaactaaatatttataagataataataaagcactgtgaagaacagtgctttatttttttaacaattgtctggaatgaaccaaaaattattttatgcttttagaaagatcaagcatggcttcaataggctttaatgcttttaatcttaattcttcgtcgataagaatttcaggaagctcatacttcatgcacagatacagtttttccatggtattacgtttcatgtaaaaacattctgaacagttgcagctttcgtcaaaaaccaatgcagggatcagttccttgtgaggagcgcgttttttcatttcgtgaagaattccttcttctgtagcgataatgaatttctggcagtcgtctttttccacataattcagcagggcagaagtagaacctataaaatgagccaactttaaaacagcttcttcactttcagggtgggcaatcagtttagcatccggattgtctgccaattgcttggcaattctttccatagaaaatgcttcgtgtactacacagcttccatcccaaaggatcatatcacgtcctgtttttttagataaatatcttcccaggtttttgtccggagcaaagataattggtctgtctttcggaagggcctcaataactgtttccgcattggagcttgttacgataatatcactttctgctttggtttctgcattacagttgatgtaagtagcaattaaagcatttgggtgctgctcacgcatttttctcagtccttctccggaacaaccgtctgccaacgaacatcctgccatcgtatcaggaagaactacttttttagtcgggttcagaattttagcggcttctgccatgaaatgtactccgcagaatacgatcatgtcagcattagtgtcttttgcctgtcttgccagctgtaaagaatctccaagaaaatcagcgatatcctgaatttctcccggctggtagtaatgggccagaataacagcattcttttcctctttaagcttaagaatggctttcaccagttcttctccctgaggaatagcaatatcttttatatccagaaatccccttacaggaattgcagatttagctttttctaatgtttcggtactcatatcaacctcaattttttattatcagaagctagaggttaggaattagaagttagattttgagagtatttgattacttccatcttctggcttctatcttccagccattaattactgataaaactttttattaaactttctatttcttttttagcggtatcaagatcttcattgatcacgatcttatcaaactcgccggcgtaggtcatttcttctgctgccttcgctacacgggtttttatagtttcggcatcatctgtatttctggaaatcaatcttcgttccagctcttcaatggaaggtggttctataaaaatagacaaggccttttcgccgaagtattttttcagtgaaatacctccttttacatctacatcaaaaataacaacttttccctgattccagattttttccacttcagattttaaagtaccgtaatatttatcagtgtatacttcttcatattctacaaaagcatcttcggaaattttctgtctaaactcatccggggtcaggaaatgataatctaccgcatgaacttcgcttcctctcggttgtcttgttgtacatgaaatagaaaattccagttctggaaatgtttccagtgaatgctttaccaatgtagtttttccgcttcctgatggtgctgaaaatataattactttatccattttttttggtttcgggttacgggttttgagtttggtgttccattcttagaaatgagaaccatgcatctcatacctcgtatctatctttacaatacgtttaacgtttgttctttaattttttcaaggtcatctttcatcatcacaaccagcttctggatttctgcgtgattggctttagatccaagggtgttgatctctctcccgatttcctgagagatgaaacccagtttttttccattgaaagactcgttgtccattacttctttataatatttcaagtgctgggcaagtcttactttttcttcagaaatatcaagtttttcagtgaaataggccatttcctgatagaaacgtgtttcgtcaatattttcaaattctttcaaagatttctgataacgttctttcacgctgacaattctttcttcctcaaaaggaatcacttccccaagatatttatcaatattctgaatattcctgtttaattcttcatgtaaaataccaccttccgttttcctgaattcttcaaatctgtctacagcattattgacaattttagccaacgcttcccattcaccttctgtaagttcatcaggtcttgaggtaatggcatcaggaagtcttaccgccattttcaggtattcaaaatcgggaccgtcagaagctatgtttttaagttcgttgatataagagtcaattaaatttttattgatttttacatcattggactcttcaaggttctcaatattaacgtagcagtctacttttccacggataattctatcgttaagaatttttctgatttcaaattctttttctttgtaacgtaaaggaatttttatattcaaatcaaagctcttgctgttcagagatttaatatcaattgtaattttttttccttcaaaaacatcttcggctctaccgaatccggtcattgataaaatcatagttttttattgttctacaaagataaacatttaagtctatactatgataccatgaaacttcaacataaaatatatgattattcaattttaaattgatttaaaccattacgttttggataaagaagttaagaatattagatgggcttcgcttttagcataatacttaaggaaaatctatggattttcttcttaattaaacttaacagcttaaatgtgttcttaatggttcaaaacaattcgtaaattttttgtatttaaaaataaaaattcaaataagcatgttttcgtaaattagcggggtgaaaaagaaaaatttaatttctgtagtaggccccaccggaattggtaagacgaggctggcaattgatttagcccaacatttcaataccgagattatttcctgtgattcccgtcagttttttaaagaaatgaaaataggaacagctgctccttcagaagaagaactggctgccgcacctcatcattttataggaaacctttctgtggaagaatattactctatcggccagtatgaagaagatgcgctgcaaaaactcaatgaactttttaccactcatgacactgtcatccttgtcggtggaagtatgatgtatgaaaaagctgtgatagaaggtctgcatgatttgccggaagccaatgctgaaaaccaggaaaagcttcagacaatgatggagcaggaaggaattgaaaagcttcaggaaattttacaggagctcgatccggaatatttcaatgtggtggatattcacaatcaccgcagacttctacgtgctatagacgtaatctggcaaaccaatacaaaatattctgaattaattgcagtgtcacaggattccagagattttaatgtgatcagaatcggaattgaagctccaagagaagaactgtatgacagaatcaaccgcagagtggatattatgatggaaaacggattgctggatgaggtgaaaagtcttgagaaattcaaaggactgacggctttacatacagtaggctatgctgagctgttcaaatattttgacggagagtgggatcttgattttgcggtttcagaaattaaaaagaacagccgcaggtatgcgaaacgccagctgacgtggtacagaaaggcggatgatattcattatttacagttgggatattctgaaaaagactttgaagatttgctgaaatggatagaggagcagtttgaaaagtaaatactgttacattattaaatgactttagaagctttgaaaatatagattcctacggaatgacaaactggacgcttagtttatccatacactatgtcattccgtaggaatctaagtttatattcattgtaataaacagaaacaatacaaaaaatgcggctctgaaaagaaccgcacttcaacaaatataatttaatttactacttccaaccgccgcctaaagctctgtataaatctacaatgctgcttaatctctgtctcttaatggaagccagattcaactctgcctgtagggaattcccctgtgctgtaatcacttccaggtaattggctgaacctcctttatataaaagctgtgcacttttaattccgtctttcagtgtagtggcctgctctgtagctttctgttcctgaacttttaaattctcattggaaaccaatgcgtcagcaacttcacccaccgcattcaatacagactgacggaacgcaagaacatttttctctctttgaattttagctacttccagatttgttttcaattgtcttttctggaaaataggctgggtaattcctcctaaaaccgatccgaataacgaagccggaatctggaaccagttatcaaatttgaaggagtttactcctccgttagctgtaatttttaatgccggatacatattggcctgagcaattcctaccatggcattggattctaataaaaccaattcctgctgacgaacgtccggtcttctgctcaccattgctgcaggaagtccggcagaaatgttttgtggtaaggaagtatcagacatttcgatcgttctattgactttattgggaagttctcccaccagaatactcaatgcattttcctggatggcaatattctgttccagctgggcaatcagaagttctgttgcctgtttttgtgcagcagcctgctgtactcccaaagaagtattatcgccgctttcccacattttttgtgtcattaatagcgtattgctggtcagttccagattggatttggcaatagccaattgtttatcaagcatcagcaggttataatatccctgtgcaatggctgctactacctgagtctgaactgcttttgacccttcataagtctgaaggtactgcattcttgaaacttcctgctggtttttgatttttccccagatatcagcttcccatgaaaggttgaaggctgcattataatcctcaacatggcttgagcctaaaaataaatttaagctttgcccgttcatgctgtttttggaaggccttgagatctgtccgcttactccgaaacctacgtcaggatattgcatatattttgcctgtttcagcttttcctgtgaagccgcaacctgctttaaggcaatttgaagatcataattatttttaattcctttttcaatcagttcctgtaaaataggatcgctgaaaaactgtttccactccaggttggcgatgctggcagtgtcggcagttgcagtatactgaaacttttccggaagcggcagctcaggctccgtgtatgccagttttgacacacacgatacagagcctatagccagcgcaaaagttagaataatattttttactcgtttcatagtttttaaacttttaattgaatacaaaacttagagaggtttctattgatgcaaaattgtctttagtaggagaaaatagttagcttttgtaaaccattaagaacaggcaggtgaatagttaatcctttagtcttaaagttttctctaagtttttgtatttcattttgtattagtgactggcagctaaaagttcttcctccatttgttttttcagaagtcttttcttttttctgctcggcattttttcatgcagatactggaatattacatacattactgggatgataaaaattccgaatagtactccggtaagcattcctcctacagtactataaccgatagaatggttcccttttgaagatgcaccctgcgtccagatcaatggaagcattcccacgatgaaggcgaaagaggtcattaagatcggtcttaaacgtaatcttgatgcctggagtgcggattcaattaatgattttcctgcttttcttctctgtacggcaaactctacgatcaggatagcattcttagccaatagtccgacaagcatgatcaatcctacctgaacataaatattgttatcaattcctgccagccctgtgaaggcaaaaactccgaaaatccctgttggaatagtaaggataatagcaaaaggaagcacataactttcatactgagcagccagcaggaagtatacaaacagaatacttaagaagaagataaatgcagtctgtccgctcgttttgatctcttcacgggtaattcctgtccactcatatccatatcctcttggtagtgattgctgggcaacttcttctaccgctttgatggcatctccggtactgtatcctggttttggagttccgttgatcgttacggcgttgaaaaggttatttcttgttaccgtttcaggtccgaaagatctttttaacgtaaccagtgttttggccggaaccatttcacctgatttattttttacataaataccttccagtgaattgatgtctgtacggtaagggatatcggcctgagccattactctgtaatattttccgaacctgttgaaatccgatacaaagctacttccgaaataaatctgcatggtctgcatcagttctgttacagaaacacccagctgattggctttatccgtatccacatcaatagtgtactgaggatttccagctgcataagtggtaaaggcaaaagcaatttccggacgtttcatcagctcaccaatgaactgctgagtggttgttcccaattgttcaaaagaactgttggttttgtcctgaagcatgaactcaaatccggaaacgttaccgaaaccttgtacagtagggaagttgaagaagaatgcattggcatcttttacctggcttacctttcctgttaaagttcctgcaatctgatcaggatctttcatctcaccacgcttgtcataatctttaagtttaatgaaacctgcagaatatggagaagcattagcattactgataaagttcatcccgtcggctacccaaaggtgattcgttgccttttcaccattgatgatcttatcgatctgagccgttgctctgtgtgttctttccagtgaacttcccggaggagtatttaccgcatataatacaaatccctggtcttccgtaggaataaatcctgacggtgcttttttgatcaaaaagacactggctgctgtaatgacaacaagaccgccaattgctacccatttgtttttgattaaaaacttaagactgtagatatattttctggtcatgctgttgaagctggcattaaatgcattaaagaatcttgctccaaaacctgttttatgaccgtgctcaccatgttctccctggggatcattcaggaacattgcacataatgcaggacttaatgtcaatgcgtttactgctgaaattaaaatcgcgatagctaatgtgaatgcgaactgtctgtagaaaactcctgcaggcccttgcatgaagccaaccggaataaacaccgcacacatgaccaatgtaatggaaataatcgctcctgagatttcactcattgagttcatcgtagcatgttctaccggcattcccgtctgttccatttttgaatggacggcttctaccaccacaatcgcatcatctactacaataccaatggccagaactaatgcaaacagtgtaagcatgttaatactgaaaccaaataactgcagaaagaagaaggttccgataattgcgacaggtactgcaatggcaggaattaacgtagatctgaaatcctgaaggaaaatatataccacaataaataccagaatgaaggcaatcactaatgtttccacaacctgatgaatagaagcatccaaaaagtctttggagttatacatgatgatgggttttactcctttgggaagggtagtttccattacttttacctgcttttcaatttccgtaaggatttcgttagcattggatcctgcagtttgtaagatcgcgaatccggcaaccggttttccatccaccctgtttgtagcagtgtaggtgtaagaaccaaattctactcttgcgacatctttcaatcttaggaaagaaccatcactatttgctttgatagcaatgttttcatagtcttcacccttgttcagttttcctttatatttaaggatatactcgtaagtttccttactgccctgtccaagacggcccggagcagcttcaaggttgtgatctttaatggctcccaaaacttcctgaggagaaagattgttagccgccagtctatccggtttcagccagattctcatcgagtaatcccttgttccgaatacctgagcctgtgctacccccgggatacgctgtatctgtggaataacattgatcttcaggtagttttgaaggaataattcatcatattgttttgcatcttcactggttaatcccatgaacataatcatactgttctgaaccttctgtgtggaaattcccgcctgtaccacttcctgaggtagctggctcatcgctttggatacacggttctgtacgtttaccgcggcattatcagcatcagcaccttgtttgaagaaaacgctcagggtcatggttccgtcgttactggagttggaggtcatatacgtcatgttctcaactccgtttaccgcttcctcaataggcgtagcaaccgaacgggctacaacctcagcattagctccagggtagaatgccgttacctgaacgctcggtggagcgatgtccgggaagagggcaatcggtaaattaaagagagacaaagctcccaataataagaggattatggagatgaccgttgaaaggaccggtctttctataaattgttttaacataagaagtttatttttttaagtcttctgtattcggaaaggattataatggtttcgcttttaataagctgtcagaagaaatatttttcggcttgatagaagcaccgtcttttaagttcccgattcctgtgtaaactattttttctccgggtgcaagaccttcagaaataaaataatagctatccgtttttcctgatattttgatcggtcttccggttaccttctgatctttacccattacatagacataagttttatcctgaatttcgaaagtagattcctgcggaattactacagcatttgaaatcagttgaggcatacgcactcttccggtgtttccggttcttaaggttccgttggaattaggaaatacagcacgtacactgatggctcctgtagttttgtcaaactgtccgtctacgatgcttagttttcctttttcaggatatgtactgttatcagcgatcaccagttctaccattggcatatttttcagtttctcttctaaagtcgctcccggatatttattctgaaagccaatgaagtcaagttcacttaaagagaaataggcatagatttcactgatatcagataataatgtcaatggattaggatctgttctggagatgagacttccttttttgtaaggaattcttccgatataaccacttacaggagcggtaatggtagtaaatcctacattgattctggcgcttcctacagaggctcttgcctgtgaagcagcagcaacagcagcttcgtaattggctttggctgttttaagctgtacatcagaaactacttttgcagcaaccagtggctgaagtctgtctacttctacttttgctttctgaatattagcattggcagcttgcagattagcctgtgccatgttcatctgttcgccatagcttctggaatctattttaaataatggctgtcctgctcttacataagagccttcctctacatagattctgtcaagataaccgtctacctgagatcggatttcaacattgttttttccttccaaagcagtagggaattcctgatatgtagtagcgggtgatgtaataacggtataaaccggaagttctggagctggcggcgcggcattggtgccttctgcggccttggtgcagctctgtaaaagaattatacttgcaataagtacaataaaccttgtttttccaggtattttcattgttagtttaatttttaatgaagtgttagatttaagtaaagttcttttgataaatgctgttttttttcctaacagtgttaatagttagttcaaaaaaaattacagaatttttaatgtgcaattaagtcaatcgtttccatagctgaattttttaatgttgcttttatatataagatgaggtgtatgtgtgttaattttactaacagtgttaattgataagcaaaaaatgattacttttaacagctgaatgttatgaattacttcataataattttattttttagttaggaatgaaagaataatttacattaattcagtgttaattttcctaacagtgttaatttttaattcaaaaaaaatttacaaagacttaataaaagccgaaacagtttcgtccaacgtcgtcttattcatcgttgaagggatatcagcggtacgcatcatcataatagagatcattccgtgaacggcagaaaacagggcgtgagacatatgacaggcattgtccggattggacccgtttttcttaataatctcgtaagtacattcatagatcagttcctggaatgatgagaattcttttttcatctgtccttttccacagcattgcattccaagaccaaacatcagctggtaatattccttatttttaaaagcaaagttccagtatgcatccacaatcgcaacaagctgctcttccggagtgtcatgtttttgctgagcttttaacaattctatgtgtaacttgtgaaagccatctaatgaaatttcaaacagaatggcatctttgttttcaaaataatcatatactacaggcgcactgtactcaatagcatctgctattttacgcatagaaagtgaaccccagccttcggttttagccaacgtaaaagcagcctgcaaaatatttgcacggatggattctttttctcgttgacggcgttcatgtagacccatgatatttttttactaacagcgttagcaaaactacaaactttttgatataagttccaaaggatattttgagttttatgggttcacctactttttaaagaaaaattaattaaaggccgggagctggaagaatgggagctggaagttatttgtaaggtcaaataatataataatagaatttgactataactattttggagacttgaaaatcttcctgttccttcctggattaaaaactaaaatgtctgtttcagaacccggctcaattaacaaaagaaataattatctttgccagtaaagaaaaaaggatatgaatactccatcaaatatgctggcattaggaacaaaagcaccgttttttgaacttcctaacccgtcaaaaacgaatgaacttcagtctttggaagaactgaaaggagaaaaaggaacactggttatctttatgtgcaaccattgtccgtttgttcttcatgtgattgataagattaatgaattatacgaagattataacgaaagaggaattgaattcattgcaatcaatgccaatgatattgaaaaatatccggcagattctccggaaaaaatgattgaattccagattgaaagaagatttgattttccttatttattcgatgaaagccaggcagtagccaaagcatatgatgctgcgtgcacaccggatttttatttcttcgatgataaactggatttggtatacagaggtcagatggatgattcaagaccgggaaataataaagatgtaaccggagaagatttaatcattgcttttgaaaatcttttagcaggcgagcctcaggaagaaattcagagaccaagtatgggatgtaatattaaatggaaataattgctggttgctagttgtttagttactggtttttactaataaaaagctgctcttttggagtggcttttttgttgatcgcaatatagttcacctattattcacacagtttgtcactccgtaggagtctcggcacagcttgtattcttttattgtaaacctctgaaaagtaagtctggattcctacggaatggacaaaaacaacgtttagtataaccatacgaattgtcactccgtaggagtctcggcacaactgatctttttattataagtacctgcaaaattttcataagtaagtatggattcctacggaatgacaaatacgaaagcattgtctattcattcactttgtcacttcatagtagtctcagcgtagtttttctattaaaaacttactttagctttagtctccttttcagtctttatatctacattaacattgctatgagaataattcctgatgaactctgaaggagtttttcccgtatattttttaaacattctgttgaaatacgttacattattaaaaccacattggtaactgcattctgaaatagatctgtcctgtaccattaagagacatgccttattgattctgtatctgtttacaaactctgtaaaagtgatctgtgttgcttttttgaaaaaattacagaaagccggcagtgtgaggttggcaagttttgcaacgtcttcaatatcaatttccttgtcataatggtgttctacataggtgaagatattttcaaggcgggctttatttttggaaataatcgtgtagggcataatttctttattcagaagatcataatcctcacatttcgaaagttcaaaaagaatttccaaaagcaataaatatcttttgtagccttctgattccagcataagtttcaatttgggaagcattactttttttactttatggtgaaaatgaatcccgtattttgaaagttctaacagatttttgatggatcgggcttctacttcctgttcaggaaactgaaggatttcttccttaaactgaaggacaatttcttcatgagggtcaatggagttcagcccgaatccggagtgaggaatattagacccgattaatacaagatccccattcgtgtaattacttttatggtagccgacatggcgggttccgctcccggaaatgacacataccagctcaatttcgggatgatagtgatattcccatttgaattctgaaataggagaattattatgaatagtgcggaatgaactcttttcattaggaatcaccctttcaaaagtaactttcatttaattaatcatatttaattcttaaaaatactaattatattaatatagttcaaatattgatttactgtgttaaattatcgttaacacaaatgcttctatcttagccagcaagaagtaacctgaatgaaaaatagtaacatcaaggccgttttatttttaaattattttgtctttgccattcttctgaattctgtaggaacagtgatcctgcaggtacagcagaattttggaatttcaaaatcctcggccagtgttctggaaggctttaaagatcttccgattgccatatgttcattcattcttgcttcatttcttcccaaaataggaatccggaaatcaatgctgattgccctgctgctggtaagcagtatgtgttttataatgccgtttaccaattccttctgggttttcaaattattatttgccactgtaggagtttcatttgccctgatcaaaatatcggtttttacttctattggattggtaactgaaacagataaggaacattccagttttatgggatttctggaagggtttttcatgatcggagtattagccgggaatgttttgttcagtttatatattgacgatcataatccggaatctacacaatggctgaatgtttattgggttctcggaggactttccagcttatcttttatattccttttcttttcaaaactggatgagaaagaagcgaaaagtgagaaaacagatctgttgggagatttaagaaacagtgcaagtctgttcagttataaaaaagtgttgtgctttttattatgcgctttcctttttgtactggtagagcagagctttcagacctggactcccactttttataaagaaattttaaaagtaccgacttctatgagtattcaggcgggagcggttttggcaggtgctttcgcactgggaagattcttgtcgggtttcttctctaaaaaattcagctggatctatgtggtttctttttgtgtgataggttttgccattagtttgcttctggttctgccattaactcacaatattcatatagataccaatactagttggctgaatgcgcctttggtcgtgtatttatttcctctgatgggaggtttgctggcacctatttatccgagtattaattctgttattctggcgtcgataccaaaatatttgcatagtgccatgtcagggttgattgttgttttctcagcaatcgggggaactataggttccatcattaccggttttgtgtttcaggaattcagtgggcagcgggcattttatctgtccttgattcctctttcattactgatcacttcagcggttttcatgaataaattaaaaattaatcctaaaaaataacaatgagtaatcaactttatataaacgatattcaaaccctttttgatgacgtgcagagatctgaaatttttgaggatcagaaaatgatgacggatgcagttcctctgtttcccattgtaaagatcaataaagagtatgaaaaaacgaaagacagtcccggttttgatctgaagggttttgtaatggctcattttgattttctaggagccagagtttctgttcagagagaagatcatcttccgattgtggatcatattgaaaaattatgggacgaactgacccgaacggcatatgaggaaaaaggaaccctgttaaaattaccaaaaccttatattgttccgggcggccgttttaatgagtttttctattgggacagttattttatcatgcttggattaaaagcttccggcaggatagaaatgatggaaaatattattgagaactgctcttatcttattcagactataggattcgttcccaatgcgagcagaactcatttcctgagcagatcacagcctccttatttttcattaatgctggatcttctttttgaaacaactcatgaccaggaaatttatacaaaatactatgacactcttgaaaaggagtatgctttctggatggatggcgaagaaggacttgaaaacaattccagtataaaaagagtggtaaaaacaatagacggagatattcttaaccggtattacgatgcagaaaatgcaccacgtcctgaaagctatctgatcgatattgaagatcatgaaaaagcaacaggagctgaattttacagaaacataagaagtgcctgtgagtcaggctgggatttttccagcagatggttcgcagacggacaaaatatacagacgatagaaacgctgaaccttgcacagattgacctgaactgccttttgtggcatttggaagtgaccttggcaaaatcttcagcacttcagaatctgaatgaaaaagaacactatttttcagaaagagcagcaaaccgaagacagatgatcaatcaatatttctgggatgaaaacactaagatttacaaagattatcacattaaaaaaaacacaaaaacaccgtctgaacatattgctgctctttaccctttattccttggtattgcagatcagaagcaggcagaggcagttgctaaagctatcgctgagaaatttctttatccgggaggacttgtgacgaccactaaaaactcaggacagcaatgggatcttcccaatgcgtgggctccttatcaatggcttgggttcagggcaatgaaaaattacggctttgatgaactggcagaaaaaattaaaaataactggtgttccaacgtagaaagagtctaccagaataccgggaaactgatggaaaaatacaatgcattagatacagaaacaatagcaggcggcggggaataccccaatcaggatggattcggctggacgaatggagtgtatttacaattacaacaaaactgaaactaactataaaaataaggctatgaaaaaaaaatcaatctttttaatcgccgcaacagctacgttatattttaataatgcttatgcccaggaaacaccgcaggattctgcaaaagtttcctccatcgatcagattgtcatcacaggaaactcaaatcctaagaaaaaaatagaatccagtacagcgatttccacattcagttccaaagaaattcagaagcaaaacccgatcagtgcagctgctttattgcagagagttcccggatttgctgtggaaacctcaggaggtgaagtaggtaacaacctttttgcaagaggtattccttctgccggagcctatgaatttgtacaggtacaggaagatggtcttgcggtttttgaagacggcgcacttcagtttgccaatgcggataattttttccgtgtagataattccgtgagccgtatggaagctttgagaggaggatcaggatctatttttgcaaccaattctcccggcggtttgatcaactttattacaaaagaaggaaccaatgatttcagaggtacggcaaagctggaaaccagtacctacggattaatgcgtactgatgttaatgtaggcggagcattggttcaggataaattgtttttcaatgtcggtggcttttacagaacagatgacggtatcagaaaaacaggcttcaaagccaataacggagggcagatcagaatgaatctgaaatatgtttttgataaaggatatgtgaaagtatattataaaaaactggatgacagaaatacattcttccttcccattcctttgatccaaaacggaaacaagctgaaaggatttcaaggttttgatcctaattatggaacctacagctacagagccatcagccagctgaatattccgcaggccggaggaggatttttcaacagaaatcttgaagacggaattcatccgaaagttgatgttgtaggtgctgagtttaaatatgaccttggaaataatttcagtgttttaaacaagacaagatatacggatatcaatatgaattataccgggatttttcccgcgggaggtccaaagctggcttctaaatatgcaacagatcaggtaaaagacggcggacttgggatgagtgactatcaatattctatggtaagcaacggagctgttgtaaatcctgagtttgttcaaaaattaggattctgggcgattgataagcagatgaataattttgtgaatgatctgcagttcaattataaattcgataaaggaaacgttacagcaggtttttacaaatccaattggaaatcccagcagtactggaactggagtaatattctgacaacagctacagacagacctgagcttttgaatctggtaaatccatctcttagtccatctgatgacggatactccaagacttacaacggagtgatggatatgacatttttacagagaaggacacagactcagggaagtttgaatgacctttatgtaaacttagactataacattacagatgctttaagtgtgaatggagggcttcgttacagccatgattattataaaggaaattttgccaatacaacaactgctaatttaaataactccgggttaaccactgatggaactcatggtttcaatacgactacagcggatgataatatgagcgtattaggaaataaatatacctactggaattataatatagataaagtttccttcacattggctgccaattataagatcaacagggagaatgcagtatatgcacgtttttccaatggtttcagatctccgaatgaggaagcgtattacaattatttttccaacccgacaccggataaacctttaaaatcagtaacaaccaatcagctggaagtaggatacaaatattactcgcgtacttttgatgtagcagtgattccgttttattctacattaaagaatctgtcatttaccgatatcttttctgatggaaaatctgaaaacacttttgccaatacacaaaactatggagttgaggtggaaggatatgcccgcttattcaataatattttagaacttaccttcaacggaactattcaaagtccaaaatataaaaaccttgaagcaggaagtgttctggaaggtaatgtagtaagaagaatgccgaaattttatttcaatatttctcctgcagtgaatatcacaaaagaatggagggcttatgtaagcatgaattactatggaaaacgtttccaggacgagaagaatgtacagacattgccttctttcacagaatttggagcaggaatgtcttatcagttagggaaaatacgttttgcagtggatggtaccaatattttcaacaccattggtattacagaaggagatccgagagcaggatcaccaaacggagacggaatcatcatggccagacctattatgggggctgctgcaagagcgtcaatcactttggatttctaaaatctgtttctttataacaacaaaaccgtcggaatttctgacggttttgtattttttatatcctccggtattaagtatcaggctagattccgggtatttacagagccttctcaaatgcttacttcaaaaacggattatactgtttctcaaagccgattgaagtaggatttccatgtcctgaaaaaacctgggtatcattatctaaaataaatagtttcgttctgattccttcaataagctgatcataatttcctttataaagatctgttcttcctatgctgccttcaaaaagcacatcccctgaaatcatgaatttttgattttcgttatgatataccacgcttccgggagaatgtcccggaacatgataaattttaaacttttctccatccagatccagctcgtctccttctttaatatattcgatatctacttttacaggatctaccttcatcccaaatctcacaccgcttgcctgaagcatgtccagtacttcctggtcttcctgatgcatattcacaggaactttaaaagtgtcaaaagcccattgaagcccgaagacatggtcaatatgagcatgtgtcaaaagaattttctgaatcttcagtcctttctcagtaatgaaattatcaatagcctgagtttcctgagcattcatatttcccggatctattaaccaggcatttttattttcgttatagatgatgtaagtattttcgctcgcaaagttgaaaacgaaaccttgaatctgaagcatatctgaatattttttattcaaaaatacgatattattaagaaaatggctatttttcgctatcttcgtcataatgaaaactttgcgaatactcttactttctttgagcggattggtttttgggcaaaatatccaaagtatccagctgttcaatcctcagaccaatgacgaaactcctgtcattaagataggagaacaattggttcttggttttgatgatcttaccaacggcagtcagatctaccggtatacattcaaacattatgacagaaactggaatgaagataatctgttttttacagaatttgctaccggaagtatgaatgcacttctggaccagtttcagtattctttcaatacattgcaggcttatactcattacaaactggtttttccgaatgataaaatccagctgaaagtttcagggaattatgagctgattgtttataaggattccgctgatcagcctcttttcaaaaaaaggttttatctggtggaagatgtaacttctgtggggttaaatatttcaagatttgcagatgcaaaaaatccgaacgttaaccagagggtggaagtgaacgtttctccgaaaggaggagatatctcttccaatgtcaattcaatcacgatgaatgtgatgcagaataacaacccgaatatggtgatctctaaccttaagccgagcagtgttttaggaaatcagatactttttcagcagatgaatctcgtttttccgggagacaatgagttttattattttgataataaaaatatgaatatggcagcagatatggtgcgtgccacagaaataaaagatgatgtcaaccagacttatcttcatcctgtatgggcttttcccctgaattaccaatatcagcctgacgtcaatggcgcatggtattacagaagaaatgacctgggaagagaaagagatgcagaaagagaagctgattattcatgggtacacttttatctggattctgatcctgtggacaaagagatttatgttttggggggatttaataattataagccaacaaaggagaaccaaatgcagtatgattctgccacaaagcagtacgttgctaaaatattcctgaaacagggtttctataattatgtactcgcaactaaagaagcaaacggcccattgaactttggagaagtgaatggtaatttctggcaaacggaaaacctttatcaagcatttctgtactatgcaccgttcggaagaaattacgatggccttatgggatatggagaattcagaactccgattgcgaataagcgttagtgatcttacattacttataaaattacatacaaacgggactatctcttgagatggtccttgttttttgtccatattaaaagaattaatctcttaaaattcggctcagtacttaattttttttaattataatgcacagcatagtgaaaaaaaataattcacaaaattttgattttaattaaatattttaatataaaatttatattactgaaaaattatatttaaataattttctttgttttaaaatcattattgtgttttgtttattgatttataatatcaattgaattttattcattatttttgttgttttattgcgaaaagtttataaattcgtcatcacaatcaaccattattaatatgaaaacgaaatttatcttagtggctagcgttgctgcctgctcttttgtttttggacaaaacacaccatcaaaattaattccgggtaaaagtggcttacatgccgaatttatgagatttgacaaaaatgcaccggcatttcagggaagccctgttttatttgacgaagcatctcagagactgtctcccggacaagcccgcaaactgggcctggaaaaggatgcattaggtttcgaaactcaaagattccagcaaaccgtcaatgatattcctgtagaatacggaatgatggcggtacagacaaaaaacggtaaaattgtaggtcaatcaggaaagtgggttcttaatgtacctaaaggacttgagaagaaagccaatatttctgaaagtattgcactacagaatgctttatcgtttgtaggagcggaatcctataagtggaaaaacaaagaagaggaagattttcttaaaaaagaaaccggtgaccctaatgcaagctatgctcctaaaggtgagttagtgtattattcagatcctgatgatgacaagctgaatgatttaaggctggcttataaatttgatatttatgctgaacaaccattaagcagacaaaatgtttttgtagatgccaaaaacggaaagatactgggtgtagatgcgattattcatgaagtaaatgctccgggaacagccgttacagcatatagcggaacccgtaatataaccacagactcatataacggaagctaccgcttgagagaaacaggaagaaatgccggaacagctgtggaaacctacaacctgaaaaaaggaaccagctatgcttctgctgtagactttacagatacagacaataactggaataatgttaacaccaataaagatcaatacgctacagatgctcattggggagcagagatgacagtggattattattatacaaaatacgggcgtaagagtattgataataataactttgctattaaatcttatgtgcattattctaccaactattttaatgcattttgggatggttccagaatgacttatggtgacggaagctctacaacaaacggcggaaaacctttaacagccatagatgtgtgtggtcatgaaattacacacggtttaacttctaaaacagctaatcttgcttatcagagagagtcaggagctttaaatgaaggtttctcagatatcttcgggaactctatagagcgttgggcaagacctacgcaggcaagctggactctgggagaagacttcagttatgtgatcagagatatgtccaatccaaatgcttacagccagccggatacttataaagggaaatactggaaagatgctactactacaggatgtgctgtaccggggcaaactaccaatgactattgtggagtgcacactaactcaggagtgctgaacttctggtattatcttttggtaacaggaggttctggaactaatgataatggttttgcttataatgtttccggaatcggactggataaagcaggcgctatcgcttacagaacattgacaacctatctgacttcgtcatccaattatgccaatgccagaacttactctcttcaggcagcagcagatctatacggtgctggaagcaatgaggtgacacaggttaccaatgcatggaatgcagtaggtgtaggaggtggaacttctcctgcaggattggtagcatcaacttcaactatttcagcttataccatcagcccgaatccggcaactgacagattcactgtaaactttgaaggtaaagcaggaaaaggaattgtagagttggtaagccttacaggtaaaaaagaaatttctgaaaaagttgagatcactgacggagtgaataaacttaacatccagttaccttccaacattcttccgggagtttacattgtaatcgtaaatggacagaaagcaggaaacctgattaaaaagtaacaccaaataaattttaatatattcaacaaaaaggccgcaagttaattcttgcggccttttgtatattttaaacgtataaattaaaccagatagaaatcgttaagcttttcttcacaaaggatttttaccacttcaatccagcggtcttcatcattcagacatgggatataatggaaattttctccgcctccatgcaggaactgttctttaccttctacggaaatttcttccagtgtttcaagacagtcagaaacgaaagccgggcatacaatagccagattttttattccttttttaccaagattctcaagtgtttcgtctgtataaggctcaatccatttgtcttttcctaaccttgactggaaagaaactatggttttttctttaggcaaattcagcttatcgataacaagctgtgtcgttttataacattggtggcggtaacagaactgatgacttggattatcttccctggaacaacagtcattaaggttacaggtcctggtaggatctgtcttataaatatgtctttccggaacaccatggtaagagaactgaagagcatcgaaattttctggaagcttctctttaatactttctgcaaggcaattgatgtaaatatccctgttgtagaaaggctgaatataattgatcttcacctgtggaaacttctttttccttacttcttcagctttttcaattacagtctccgttgtactcatcgcatattgaggatatagaggaaaaagaacaatttcagtgattccctgatccaccagtttctgaataccggtttcaatgcttggttctgcatacctcatcccgatttccaccggaacatctactaccttttgcagttttttctgaatctgttcagtaataacaatcagtggtgaaccttgatccgtccaaaccgttttataggcttctgcagattttgcaggtcttgttttcaggataattccctgtacaagcagcgcacggaagatccagcgataatcaatcactctttcgtccatcaaaaattcatcaagatattcctttacgtcgtttacagaagttgatctcggtgatccgaggttgaccagtaaaattcctttcttattcaatattctaatttttaattatgaaacagacgttgtaaaatctgttactaattctgctactttagcaaaggtattactttccagtaagccattgctgtcaaatttgccttttatcccttttattaatacctgatgtttatcatctgttactgcgcccagagtttttaaaatcaataacaactcttcatgtcctttttccccgcttgcggaagctgtaatgactgctgtcggtttatcagaaaaaactgttgtggaaacacaccactccaacagattttttaatcttccaggaatactgaaaatatattccggtgtggaaaatatgactccagctgaatctttaatagcttctctgatcttaagaacttcttcaggagtattgttatctgttaatgcagtatcaaaatgcggaagaacagaaagatcatcatagattttgaaatccgcatgatccgcttttttcagtacttgttccattagtttcagattgctggaattttcagaagcacttcctataatgataacaattttctttccggcaggcattttttaactgttttatccgtttacggcttctactttttctactaagtccggaacgaattgttttaaaatattttcaattccattttttaaagtagctgtagaacttggacatcctgaacatgcaccttgcagaagcatttttgccgttttattctcctgatcatattccatcaaggaaatctttccaccatcattttctacggccggagctacatattcatttaagatatcagagattttctgttcatcttcagtataatctctgttgatgattttttcaacagggttttcatgtttctgaggttctatttttgaaatctcacctccgttttgaagatattcagcgataagggcacgaacagtcatcatcacctgatgccattctacagaattatctctggtaacggctacaaagttgtcagaaatgaaaacttccgttgcaaaatcaaattctctaaaaatagcttgagccaaaggaacttcttctgcagcatctttcgattttacttccacaaaaccgtccatcagtaatttgcttgaaacaaacttcattacattcgggttaggagtcatttcagcataaatctgatacatttcttttttcttctgaagatagattctcgggttagccagtaattcatcctcaattacgtttttcagactctcagcaacatgttcccactccacagtatcctgctttgccacagcaacaaagttagccgtgatgaaaattctttccacaaacggataattgaaaagttcctgtgccaatggaatttctgatatatctgaatttctgtccagctctaaagaacccgggatgagattgtagtctgctacaaatttcatcacttttgggttttcagttggttctataagtacggtacgcattttttcgttaaatttgagatacaaaaatacgcattagaagtcagaagctgaagatagagagttagatttttgctatcgctgtaatttagaagttagatacctgaaattatatggcacatatcatattctcaaatcggcttattttcgaattttcaaattaatattatggcacttataaaagaacttttaggaaaagcaccacagatcggagagaatacatttttggcagagacagcaaccattattggggatgttatcatgggaaaagactgcagtgtctggtataacgcagtgatcaggggagatgttaattatatcagaatgggagacaaggtgaacgttcaggataatgcaatgctgcactgtacctatcagaaatatcctctgaatatcggaaataatgtctctataggacacaacgcgattgtgcatggatgtactattaaagataatgtattgatcgggatgggagctattgtaatggatgattgcctggtagaagaaaattctatcataggagcaggttctgtagttactcagggaacccacgttaaatcgggagaagtctggggcggagttcctgcaaagaaaatcaaagatatcaatgcacagttactggaaggagaagtgaacagaattgcggataattatgtgaaatactcttcatggtataaggaaaatgtgaaggatcatcagttttaaagattgtcaatagtcaattcgttgcgcttatcaattatttgataaagacattcactattcattggcgaaaaattcacgattaacaaatataaaagctccgtccccgggacagagcttttttcgatttgatatagaacctttgctttattgttagttagggtcaggtgtgatcaatcttatcttgccattgatacatttcagggatgtaggaggcatgaccatcatacagtctgacacaatattatacttttcattaaaagctctcactttatccgtatactcattgactctcggcaggaaagtctcttctattttctttggataggctatgtattgctgaggcccgccgcaggattttgatcccattggcgtaaatgcccactcactggcatccgtacatttttcgcctgatacttcagattcaatggaagcttttagtttatccagttgagcctgttcatacttctggctgtcttcgtcagcaggtctgtctgcaatatcgataggaagattggtattggcattttttgatgtattacaggaaaccaaagttaatgtagtacataatactattgccgggatatgaaagaataattttttcacaataaacttttttctttttaagaattttcaaaacttatgccaaggtaagaaaatcaaattcatttccgtatttttgacaacgatgaacaatcatttttttgacttaatagaatacaccaacagaagcgtttttttaaccgggaaagccggaacagggaagacgacatttcttaatgattttgtaaggcgtaccaagaaaaagcatattgtggtggctcctacgggaattgctgccattaatgcaggaggtgtgacgatccactccatgtttggactgccgttgagaacctttcttcctactacagaaaggatagacaccagtttggcaaataatattgctgatctgatgccccatttcaaatatcgtaaagataaactgaagcttctgagggaagttgaaatcatcatcattgatgaggtttcgatgctgagagctgatgttctggatatgatggatttttccttgcgttttatcagaaggaataatcaaagatttggtggcgttcaaatgttgttcattggggatttgtatcagcttcctccggtggtgagggatgagcatatcctgaaaatgtattacaattcacctttcttttttgacagccatgccattaaagaaattcccattgttaccattgagctgacaaaagtatacagacagtctgatgaagaatttctggaaatcctgaatgcgatccgtgatggagatgtggataatatcgattttgaccatcttaatgaaaggtatgatcctgactttgatatggggaaagaatcttacgtttatctgtgttcccacaataaaatggcagatgaaattaatcaggaaaaactggcagagataaaagtagatcctcaggtttatgaagctaagcttgtaggagactttaaagaaaatcagtttcccaacgaccagtttttagaactgaaaatcggggcccagattatgtttatccggaatgatatttccggtgaaaagaaatattttaacggaaagctgggggagattatcggattggatgaaaatgaaatccgggtagtattggatgaaagtgaaagagaaattgttgtaaaaagagaaatttgggaacagaaaaaatatttccttgatacagataaaaatatcaaggaagaagtattgggaagttttgagcagtttcctattaagcttgcatgggcggttacaattcacaaaagtcagggattaacgtttgataaagtcattattgatgctggaaaaagtttcactgccggtcaggtgtatgttgctttatcccgttgcagaaccctggaaggaattgttttaaaatcaaaaattacacctgaagttatttttaaagataacaggattttacactttcataccgatacgattgccaatgatcatgttgaagccatccttaatcaggaaaaatatgattacagcatcaggaaagtgctgcgtacgcttgagtgcacttggtttttgaaagaagtggaagagtggaataacctttccattgtaacaaaaaatattgatcatgtcaaaaccaaacagctttatctgcagttaaagcatgaagcggtgaatcttgggaaaatatttgaaaaactggaacggattattttccagaaagtcaataattttattgaacagaaagaagaatggtccgaaattgaaagcaaatcaaaaggtgcagttaatttcttctttactgagaccagaaataaaatattcgatcctttgaaagaattttacgctgaaataaaaggagcaaaaggattaaaacagtacaacgaagaatttaaaagctggctggaagacattgaagaatatctgaatagcttaagagaaattcatcttcttgaaacgaaacttttagatgaaaagaatgataaggaaatcaatctgaaaattgctaaagtcccttctcaggttttgaccttccagttgtttgagcagggcaaaaccatcggagaaattgcattggaaagaggtttggtgaaagagaccgttatcggccacctggctaaatttgcagaacagggattgctggatatttccagagtcatcacttcagataagatcaaggcttttgaagatgagttttacagaaaccctcacgaaactcttacagaatggaaaaatgcactgccaagccattttgaatttaacgaaatcaggattttaattaatcactataattataaaaaagaaaagaactcgtaagagttcttttctttttatgtgaaaatttttcaaaactaaggatacatagcattaatggtattgatatctcctgtagtaaagccggttctgttataagtgaaattgctgttatcagctctggtaatcgttggcagcccgtttttagagtacgaagtcggccagtacatcatcacagaattgatattaaaagggccgatatctgttccggaactgtagatattaaaattataagattgtccgttctggatattgttccacaggatttttacatattgatccctgtctttacgcgtatgctcatgataaagacctactgtatgtcccatttcatgaataactgatcccacagaaatatattgatccagagaaatcgtttgttttcctccctgatatccgatatgtgcccacccatctgatcccgatgagcttccgaatataaattcaacataattagactggttggtacggtaaatccattgagtattggttttagtattatactcattaattgcagtattgattttgtttacgttgatagagcccatattgcttgcaatcgtgtagtaaatcttaccgtttggccaccttgaaaaactggctccgcctttattaagttcattgtcttcggatagctgtttatcggtaagaacaatatctccctgaaaaaaattcattccgttttttctttcataggtaatttcctgactgttcaattgtcctttttttacattgtcaatgttaaaggcattggtttgtgcttcagatgtaatttcatcattatttttactacaagatgagaatgttgcagcaataagaaaaattataagcatagtttttcctgtcagcatctgcttataaaacagactgttttgttttttgatcatattaatatttttaagaatttggtatacgaatataatcaatatatctctttttattgatttatttttcttaaaatataatttttattatcatgatttgaatttttaaaattctatatataaaatcaaacaaaaaagaatcttattccaatagtttttccctgaactgatcaattgtttttattaattacaaaaagtaactaatgcagtttttatgttttaaatttgccttgtttttcagattaaagaaaaattaacatcataacatgaaaaattttgaaatttctgttttggatcttgccccggtaaagcaaggaaaaagcattcacgatacttttcaggacagcttatcactagccaatcacgctgaaaatttaaattataaaagattctggctggcggaacatcacaatatggaaagcattgcaagttcagcaacctctgttttaataggtttcattgccaatggaacgaaaaaaatcagagtaggttcaggaggaattatgcttcccaaccacagttctctgattattgctgaacaattcggaacactggagtctttatttccgggcagaattgatcttgggttaggaagagcgccgggaacagatggcttaacggctcaggctttgggaagaaatccagccatcatcaatgaacagtttccaagacagatcctcgaacttcaaagatatttctccaaagaaaattcggacgcgatggttcgtgcaattcccggagaaggactggatattccgctttatattctgggatcaagtacagacagtgcctggctggctgcggaacttggtctgccttatgcatttgcaggacactttgctccggagcagatggaaatggcttttaaaatctacagagagcattttgaaccatcaaaatatctggataagccttatatcattgcctgcgtaaacggggtagcagcagaaacttccgaagaagctcacaagatttccactactttattccaggcattcatcaatattgtaagaaacgacagaaaaccattcgcgccgccggtagatgacatggatgaaatctggtcaccaatggaaaaatctatggttttacagaaactgagatatacatttatcggagatcaggcagaaattcagcaaaagcttaaagatttccaggaaaggtttgaggtagatgaaatgatgatcaattcacatatctacgatcatcagaaaagattaagatcttatgagattttcagaacggcagcagactcactatccaaagcgtaataaaccatccataattaattggcagatgcttatttttatgagtatctttgcacaaataaaaagtaaaaatgtccgatattaaattaaatactattccagaggctattgaggaccttagaaatggtaagataatcatagtagtagatgatgaagacagagaaaatgaaggtgattttctttgcgcggcagagcttacaacgccggaaattatcaattttatggctcttcacggaagaggtctgatctgtatgccgcttcctgaaaaaagatgtgatgagcttggactagaagtaatggtaagcagaagcagcgatcctaaagaaactgctttcacggtatcggttgaccttttaggaaacggaacatctaccggaatttctgcaggagacagagcaaaaacaattttagctctgatggatgaaaaatccaaacctacagattttatgagaccaggccatattttcccgcttcgtgcaagaaaaggaggcgtattgaaaagagccggacatacagaagccgctatcgatcttaccagcttagccggtttaaaagaaggaggggtgatctgcgagatcatgaatgaagatggtacaatgtcacgtctgcctgaacttcacgcttttgcccagaagcatgatatgaagatcgtttctattgaagacctgatccattatcagcttaaaaaaggaaatcttgtggaaagaattgaagagagaaaagtaaagacgttttacggagactttgatttctatgctttcagggaaacttcaaatgaacagatccattttgccttaacaaaaggcgcctggactgtagacgagcctgttttggtaagagtacagtcatcagattcttattttgatgtattgacaagattgaataacggtgagaagccattgctggaaaaagtaaccaatatggtgaatgaggctggaaaaggagctattattttcatcaacaatgtttccaattctgaaaatacattgagaaaacttcagcaattcctgaattatcaggacgggcaggaacaacatcctactttagcgtacaattacagagattatggaatcggaacgcagattttaaagaatttaggaatcaacaagttcaaagtaatcactcaaaaccctaatattaagcctcaggttggaggttatgatgtagaggttactgagatggtgcaactatagtgaatgaatagccaatagtgaattttttcacttcaatggctgtttacaatacaaaatataaggtttaggattttctgaacctttttttatttttaaactatgactgagcctttaaaaaaacatatccggagttatattgatatttcagatgaaaagctggagaaatattgcagtgctttcaaccttaggaaaataaagaaaaaggaatttcttttaaaagaaggtgagatctgcgaatttgaagggttcgtactgaagggctgctttaaagtttttcatacccatcataatgcagctgaacagatattatattttggcattgaaaactggtggatttcggatatcgacagctttgtgaaccgtattccctcaaagcttaatattcaggctttggaggacagtgagattcttcttattcccaaaaaagaaaaagagaaactgtatgccgaaatgcctgagattgaaagattaatgaggcttaaatttcaaaaatcaattatagcattgcagcgcagaatcattgataacttaagtaagccttcggatgaacggtatgttgagtttttaaaggattacccgcaaacagcacatcgtcttaccaatattcagattgctgcctatctgggagtaacgccggaatttataagcagaatcagaaagaaaattgttagtaaagcataatctttctttatataaaatttaaaagtcccggaagctgtaaatacttcgggactttattttgagtatcttaaaagatgttctttaattcagagtgattccatcaaagtttcggaagccgttcagaaaatcttttaccatcattctctttttaccttccagctgaagttccaatggataatagattccatcctgtgtataaattttaaatccgttctttgagatatccagtgttccggcaggtttaccatgatcagaaagttcaaacttacctccgaatatttttaaacctttttcttcgttttcaatctttaaagtagtgaatgctgccgggtaaggagacattccaagaatgaactggtgaatggtctttgaaggctgctgccaattgattctcgtatcttccttgaaaattttataagcatttttaggatgttccacctgtggctgaggcttctcctgaatggcattttctgcaagcccgtccagtgttttcacaacaagccctgaacccatttccatcagtttgtcgtgaaggcttccggcattttcatcaggtaaaatttctatttcctgctgaagaagaatattcccttcgtcaattttttcgttaataaagaaagtggttgctccagttttttcttccccattgattactgcgtaattgataggagctgcccctcggtaatcaggaagcaatgaagcatgaagattgaaagtacccatttttggcatttcaaaaagtactttaggcatcattctgaaagcaactactacaaaaacatcagcatccagttttctaagttcttccaaaaactccggatttctcagcttttcaggctgaaaaacaggaatattgttttcttctgcatagatttttaccggtgattggtgaattttctgtcctcgtccgcttgccttatcagcaacagttactacacctacaacctggtgatgagattgatggatggcctccagagaagtctttgcaaactcgggagtccctaaaaaaacgactttcaatgatttcatactgcaaagataagtttttgatctgagagtcggaaggtttcaggtttggggttgggagagtatgagagtatgagagtatgagagtataagagtatgagagtgggagaattttatagtataagagtttttagagatagactgcgattacgattacatcatatcatatccaggcatctttcttattactcatcactcattacttattactcatgattcagcgcatacgttctgaagttcagcatccttacctttccggaatctaataggaaaatcagattttccagaatattttctttggaatgataactcagctgtatagacagttcttcaatggtagcagactttttggataatagattaatgatttgctgggaaatattttttccaaagatagactgcttatttttttcacagactgaacattgaccacaattttttgaatttttttcgccaaaataagcaagaataagtttcattttacaatagtcattgttttctacgtaaaatttcatctcttcccatttttggattttgttcctttgaatatgctcaaatagtttccagtaagcattattcacagctctctcatcacggggtttcaggaatttaatactggaaagcgctccgtcgatatattcaaggtaatttttttgttgaagttccttcagtcgttctttaatcaaaggaacgctgatgttaattttatggcttacctgctgctcactgaacattactttatgagtcgtaattccggatatagtacggaaaagaagttctataaaataggcatctttttgtggcagctggtcgatctcatccgctttaataaaaagttcgagtgaagacaggcttttgttgtcgttgtagtagacaatttcctgattatgcagaaagttgagtacattgttaatctttgccttcgacagttttgtaaagttctgtatgctgaggatatttaactgaaatgttttttcaggaagttcaaactcggctacctgaaaaatagagtagaggtaactgataatcttcaaaaattcagctttgttaggagtctgattttttaaaacctgatcaaaattcaataattcctgcctgttccaaagcataaacgcaaaactgtcttttccatctcttcctgctcttccgatttcctgataatagttttccagggatgctgcaggagagtagtgaataacaaaacggacgttatctttgtcaatacccattccaaaggcattggtagaaatcaggacatgattgtcactgttgttccaaagattctgctttgcatttttttctttagttgttaagcctgcatgaaaataatctacgtttttcagctgatttttcttcaggaattctgccagcagctctgcttcttttctcgtccttacgtatacaattccggagtcgttgctgtattttaagatatcaaaaacacgctggaatttatcagatacttcatcagtaaatattttgatattttctcttttgaaacttttttgaaaaacaaatggattcttcagttccagtttatttttaatttcttccagcacttttggagtcgctgttgcagtcaaagcaaggcagggtatctcagggttgttacttcgaaacccctttatattctgatagctgggtctgaaatcctgtccccattccgaaatacagtgtgcttcatctactgcaatgaaggataattgtatttcctccatattttggataaactgtgcattggtaagtctttcaggagaaacatacagtaattttgtaagcccttccttacagcggccataaattgtttcagtgtcatattcatccatctcagaggaaaggtattctgcttctatgccacgggctttaagctgattaacctggtctttcatcaatgccagcaacggggaaactacaaggcaggttccttccttcaatagggcaggcagttgataacataaagattttcctgctcctgtgggtaacagaaccagagtatctttttcattgatgacggcattgataatttcttcctgagaatctctgaagtcggtataaccccagaaatacttaagagtatcatattttagtttttgaaaatcctgcggagaaatcatgttgtaaaaataaggaaagaatcaggacaaaaaaagccacgcatggcgtgacttttatataatatattaataagtttattatttagcttcgaagtatactcttctgttggctctgtttttccattcagggcacttcgttgctggttcacactcaggatatttaaggtctttttcaccttttcctatggcctgaagtttacctgtctgaacaccgtttttaatcagatagttcttaacgttgtttgctcttctttcagatagtttctggttgtaagcgtcagtacctcttgtatcagtagcaccgattacattgtaagaaccacttgaagaattaatatagttgacagcattgtttaggattggagtatttgatggtaaaattctgtcagaatttaagtcaaactcgatgccttccaatttagtttctgtctctactacaggtcctgttgtagctacaggacaaccgttgttttcaacaggtcccggaactgtaacacacttatcgtaaaggtcaattacaccatcaaggtctgtgtcaagagcaactccggcaccatccactcttgctcctgcaggagtatcaagctgtctgtcccaatcgtcacataccccatcgttatcagcatctccttttttacatacttcgatatcctggtttttattagccaatacatcaagtttgtaatagatttcctgaagcgggtcatgccacattaagtgagactcatgttttccaagttttaaagaaacccctaaagtagcgttgaagaagttgtcagaaacctgctcagaacgcttgttgattgcgctgtaagcatcacctccgccatcaaactcatcatcaccggttaccacatacattaatctaccttcaatatcaattcttctgttcactttaaatttcagacctgtaccagcctgcatgaacatagaacctaattggaaaggtttaacttcagtcattagtcgttgtggtccgttacctactttctgatatgctctgtaggcaatagtaccaacacctgcgtatccatgaagagcccatctgtaaggagaatggttatcaactcttctcaatagattggagaagttgatatctcctaagattgagatggcgtcatactgagttctggctcctactgcagttgcatctggtgctgtttttttagtattgaaccatccttgtcttgtttcacctctgtcatattgtaggttgattccgaaagcatgggtaattgctttgtcaatacttacatacgctgaatatccaaaaaggtttttaccgttaccgtttttgatagaggttaaatccgctgactgaagaagcggaacacccaccccggcagaaattgaccaatcattaaatctttttgattgattggtgaatggggaaacgttagcagatcccgaagaaaatgtattaggatattctccttttgaaactgccgttgagtcttgtgcataggtagcagaaggaattgctaatgctaatgcaacaattgctaaacttaatttcatagtgttatttttttaagttaagttattttaaatgattttttacgttaaaaagcgattttgtattaatttttttcaaaacaaacttgttgatttttaatgtgtttcatgccagttgtcctgaaaataatgataaaggtaggtaaaaaaattcgtagtagaaaaaaattaaaccgaaaagaacaattctttccggtttatgtatttgaaattaattcttctttttcttagctggaactttttttactgctttttttacaggagtatcttcatagtctttctttttgatagaatcccattctgaactttctacaaatcttacagtaacttttctgtctgccattctttcagcatctgaagctgatgcaggaattgttgcttcagcagaacctacacctcttgatttcagaacattttcattaatacctctgctttccaaagctcctacaacagcagccgctctttctttagacagtcttaggttgtaagctgcgtttcctttaatatctgtatgacctgtcaacaagtagtttcctccgttttctttaataattgaagctgcaagatccagtttctcattagattcaggtctgatagtagccttattgaaattaaaatagatatctttaagagtcttttctacttctacagcagtttctttattatcttttttagctacaggacaaccgttgttttcaacaggtcccggaacggtaacacacttatcgtaaaggtcaattacaccatcaaggtctgtatccagagcaactccggcaccatccactcttgctcctgcaggagtatcaagctgtctgtcccaatcgtcacataccccgtcgttatcagcatctccttttttacatacttcgatatcctggtttttattagccaatacatcaagtttgtaatagatttcctgaagcgggtcatgccacattaagtgagactcatgttttcctaatttgaaagaaacccctaaggtagcgttgaagaagttgtcagaaacctgctcagaacgcttgttgattgcgctgtaagcatcacctccgccatcaaactcatcatcaccggttaccacatacattaatctaccttcaatatcaattcttctgttcactttaaatttcagacctgtaccagcctgcatgaacatagaacctaattggaaaggtttaacttcagtcattagtcgttgtggtccgttacctactttctgatatgctctgtaggcaatagtaccaacaccagcatatccatgaagagcccatctgtaaggagaatggttatcaactcttctcaatagattggagaagttgatatctcctaagattgagatggcgtcatactgagttctggctcctactgcagttgcatctggtgctgtttttttagtattgaaccatccttgtcttgtttcacctctgtcatattgtaggttgattccgaaagcatgggtaattgctttgtcaatacttacatacgctgaatatccaaaaaggtttttaccgttaccgtttttgatagaggttaaatccgctgactgaagaagcggtacgcccgcacctaccgaaatagaccagtcattaaatctcttggattggttcgtaaatggggaaacattagcagatccggaagaaaatgtattgggatattctcctgttgaaactgccgttgtgtcttgcgcataaccagccataggaatggctaaagcaaatgcagcaattgctaaacttaatttcatcgtgtatttattatttgatttcttttttttgaaaaaagaattttaagtttttgattatttaaccgggcatccgttattttcaacaggtcctggaacggttacacacttatcataaaggtcaataactccgtcaaggtccatatccaaagcaactccggcgccatctactcttgcacctgcaggagtatcaagctgtctgtcccagtcatcacatactccgtcattatcagcatcgcctttttcacaaacaacaagatcggtagctgcattttcaagaacgctggttctgtaataagcttcctgaagcggatcatgccatgccaggtgagataaatgtttacctagtttgaaagatactcctaaacttactgtccaggcgttatctgatcttctagagtttagcatgttatattttgaacctggtgtagaaggatcataatcattaggatcagcccatccgccaccatcgaattcatcatcaccactgatgatgtacatggttcttgcttcaatgtcaataagttttgaaacattatattttatccctaaacctccctgatagaagatcgagttgatatcaatatcctgtttgataaacaatggagttcttcttggagttgtgctccatctgaattcatcgttgtcatgtaatgatgttctgaatccctgtagcccaatacccatgtatccatggaaagcccatctgtatggagaatggttgtctactcttctgaataagtttgagaagttgatatcccctaataaagagatattgttaaattgtgtcgttgcagtagcgattcctgatttaacacctgcagcaccaggaagctgggctgtttgtttcgtttctcctctcatatacataaggcttagaccaaatgcatgtgtgatttgtttgtctacgcttacatatgcattgtacccccaattggtcttatctttacggatagattttaaatcggagtgtaccataaatgcaggacctcctccgacagaaatagaccagtctctgaaacgtctggctttgttgtcaaagggttgtacattagcggagcctgaagagaatgtattaggatactcagtagaagagtttactgtagtagcattgctttgtgcgaaagctgcaattggcaatgacgtagccaataataataaacctaatttcatacaatatgttttatgttttaaataaaatcttttaataatactctggaaaaatccctttcaaaaagatgttttttatgagggatttctaatctttctgatttaaaatttaattcattatatttaatgatatcaatatctattatcctgtcagtatagcctccggatacttttgaatcattaattcttcccatctcaacttctatattcttaatacaatcaagcagttgaattggagaaagatctgtgaatattactgttgcaatattacaaaaaatattggaactggcaaattctacgggttcagacattaaatattcgctgatttgtgaaatgtgatttccagcatcgctgattttctttaaagcgagctctacattttttttttgctctcccaggttacttcctagtaacaaaactaccttatgctgcgacatattggaaaattgattgatttatgagaagtttcttcaaaaatgttttggcaaatatagtggcaattatcatactttgcgctctgtttttcatctttttcattatgatgcttgtattcagtgcgatgggaaatgataagtcggtagcggtgaaaaagaactcggttcttacgattaatttaaagaccaatatcattgatagccctacagaagaggaaatgggattgttcggtataggagcccaaaataaaagtatccttatctatgatgcagtggaggctattaataaagccaaaactgatgataatataaaagggatcagtatagaagcagatgacctgaacgcggggcttacccaaattgatgatcttagaaatgcaattgaagatttcaagaaaagcggaaaatttgtatatgcgtacggaaacggagtatcacagtctgcttattatttaggatctgttgccgataaatattacctgcatccggcaggaatgatcgaattaaaaggtctttctaccgaggttacttttttcaaggattttgctgataaatacggtatcgggatagaagtgatccgtcacggtaaattcaagtctgcagtagagccttttttaagaaatgatatttcacccgaaaataaagaacagctaagcactcttctgaatgacctctggaaaaacacatccaataaaatggctgcttcaagaaagattgataccgctcagttccgaaccattacagacagcttatacggaatgattcctgagcaaagcttacaatataaacttgcagacaaactgatgcagaaatcagaatatgaaaatcttatcaggacaaaattaaacataaaagaaaaggagaaactgaacaaaatttctctggcaagctatatcagttcttatgctgatgatgataaatctggtgaaaaggtagctgtattgtatgcttccggttctatcaataacggagatgagtacaatgatattcattccgagaaatatgtgaagtatattaagaaacttcaggaggatgataaggtgaaagcggttgttttcagaattaactctccggggggaagtgctaatgcttcagatgaaatcttatttgaattgcagcagctgaaaaagaaaaaacctttgattgtttcttttggtgattatgcagcatcaggaggatattatgtagccatggctgcggataaaatttattcagagcctaatacacttaccggttctatcggagttttcggggtaatgccttattataaagatattgcggctaaaaacggaatccgagcagatattgttgcaaccaatgccaactctatgtattattcaggtttaaacggagtgactccttatggcgttaatatgatgacaagaagtgtggaaggcacttataagaggtttgtacattttgtaactcagaacagaaagaaaacttttgagcagatcgataatgtaggaggaggcagggtatggagtggtgttcgtgccaaagagataggattggtagatgaacttggtacattaacagatgctgtgaagttcgcagcgcagaaagcgggattaaaatcatatcaggtagatgcctttcctaagagaatgtcgccgtttgagcaaatcttcaaagacctgaatgaggaagatgtttctgcaagaatcattaaaaacaagatagggaagtccaactatgaaattttacagcagatcacaaacaaaaaactacagtctgaggtgaaaatggaaatgccgtatcagatcagaatcaacaactaactaaatttatattgtatacaaaaatcccggacctgaaatttcagatccgggattttattttttatcagcgttaatatcagcttttccttgtggccattccgtaaatccagaggataattaaagcgcctccgattgaaagaatccagcttctcggattccagaatgaagtgacatctccccaatgcagaatgtaaactcctatagctcctcctacaaatgctcccagaattcccaggataatagtgattaaccatcctcctccctgagttccaggcatgatcattttagcgatagcacctgcaataagaccgaataagatccatgttagtattcccatagttgcaaatttttttagtgttaatatttaaaaatgatttgtttactaatataagggaaaacatgatataaatcatcttttcttgaagaatgagtctacaaattccgtaccattaaaaagctgcaggtcctgcattctttcacctacacctatgtatttaaccggaatctgaaactggtcagaaataccgattacaacacctccttttgctgttccgtcaagttttgttactgctaaagcgtttacttctgttgcggctgtaaactgcttggcctgttcgaatgcgttctgccctgtagaaccgtcaagtactaaaagaatttcatgaggtgcatcaggaattactttctgcataactcttttaatcttggaaagctcattcatcaggttaatcttattgtgaagccttcctgcggtatcaataattacaacgtccgcattttgggctaccgcactttgtaccgtatcaaatgctacagaagcagggtcggaacccattccctgttttacaatcggaacatcaactctttcactccagatcgtaagctgatcaacagccgccgctctaaaggtatctgccgctccgagaactacttttttaccttctgatttgaactggtgggcaagctttccgatagtcgttgtttttccaactccgtttactcctacaaccataataacatatggttttttggaagtgtcaatatttcctgtacctgcatgcggattttcaagcaataatcctgaaatttcttcacgaaggattttatccagttcgtttacacctacatatttatctctggcaacacgttcttcaattctttcaatgattttgatagtggtagaggcgccaacatcggaggcaatcagtacttcttcaaggtcatccagaacctcatcatctactttgcttttaccgacaacggctttcgtcattttttcaaagaatccctggctggacttttccagtcctttgtctaaggtttctttttcttcttttttgaaaatatttttaaaccaactcatagtttcagtttattcttatttatttttaatcactgctgtggcttctacctctataagcacatcatctctgaaaagcctgctcacttccacaaggctgcttacaggaggattttgaaggttgacatataaatcccttacttttctgaattcaggtgtttttttgatatctgtggtatagattaccattttgataatatcttttcccgtagctccatactcattcagaatgttttcaatatttttgaaaacctgctgtgcctgttcttcaatagtatttccaacaagtttcccttccggatccagaggcacctgtccggataacaaaatcattctggaacttccgcagtcaatgcttactgactgtgagagcccttttatgtcgaaaacttttggcgaacttttatattctgcagggttcatttttttctgactgaatgaaaatagaaaagttgctgtgcaggccagaacaagtatctttttcatactttactgattaataatctggtgcacaaagataacaaaaaaactacccaaaatatgagtagttttttatattgtaaacaaagtaacgattattttttcaaataaccatctacttcatcagcattcattactttttcttcgaaaacgtaagctcctgatttagaagacttaaccattttcaccactttagtcatctttttagactgaccgctttgtagggttgctactactttctttgccatggtaagttattatttataaattacttaatttctttgtgaatggtagatctcttaagaacaggattgtattttttcaattccaatctttctgtagtgttctttttattttttgtagaaatgtatctagacattcctggcataccactttctttgtgctctgtgcattcaaggattacttgaactctatttcctttttttgccatgatttattaattctttttaatcaatccgtttctagtagctctttcaatagcttcctcgattccaatcttgttaatcactctcaatccatgagctgatactttcagtgttacgtgcttatcttgctccggaaggtaaaacttcttctctaataagttaatttcaaaacgacgcttcgttttgttattagcgtgagaaacgttgttaccaaccattgcacgctttcctgttatttggcaaattcttgacatatctcgatgttcttatttgtataatatttgagagtgcaaaataacgaagaattttttagatagacaaatcttttggaaaatatttataaataagtggctgattaataatattgaatttttaaaataacagaatccttgggatacagcagataatcagtgctgatatatttcatacaggctttttttcagcaaaagaatttaataatttatctttgtttttaattaatctaaataaaaataaatatgaagaggatttatattttttgttctatgctccccatatccctgatggctcagaattttactgaggtacaaacgggcatgaataatttttattactcagcggctgatgttgccgatatagataacaacggtacattggatattgtggtgaatggagcgatagattctgatggcgatgggaatgtagacagtacctataatgaagtatatcagaataatggaactacattactgccgtttacgggattaggaggagatgtgacacatctgggagatattaggttcattgattataataatgacggactgatggatattatttccacagggctcagctatatggatgttgttaattataaacaataccggttcaaaaataccggagcaggatttataaaagaggcagaattgccaggtaaaatttatgggtctctggaagtttttgattttaataatgacggaaagcctgactatggccttaacggaactcaatatgcgcacggcggaggtttcggaaacagccttgattattataaaaacacaggcaatgattttgccatgacggaaaactgggtggatggaactcagaatggaagctttaaagtggtagatcttaacaatgataatctgctggatcttgtgattatcgggtcggatatcaatggagatgcagtatctaaagtatatatgaatcaaaatggaattcttgtacctacacaggaacttcctcccgtagccgtaggaaaaatagattttgcggactttaatgctgatggctttcaggatattgtaatgattggaagagatataaatgacgaaggatattttgctgttctgatgaatgacggaacgggtacactgacgccacaggtaattccggagaatggtatttcagatgtggcattaagtgtcggggatttaaacaatgacgggtattacgattttatcatttcaggaaataagaattacaatgctgttgtgaaaacgtatctgtataatgtttccaataaccaatttaatgagggaacagtaaccggaattactgagctgggaggtccgggactggtacatctttttgattttaataatgatcatcacctggatattttgttgggtggatttgattggtctgcatctgatctgccttcactgacgaaagtttttaaaaatacttctacatcagtcaatgcgaaacctacagctccgacccaattgaatctgaccaaaaacgttaaccggttcaattttacatggagtggtgcatcagatgataaaaccccggtgaatgcgctgcgctatgaaatttcggtaggttctgcacagggtgcccacgatatcgccagatatgtggtcacaacaccatcatggtttctggagcttgatccggctattcagaatgtatactggagcgtaaaatctattgatgcctcaaaggtgtattctgatgcttccacacagaattttctgggaacagcagaaatcagatcggaaaaacagctgatgatctatcccaatcctgcatcagataaagtttatatcaaaggggagaaggtttcagatgcggaaatgtattcaatggatggaagaaaacttaatatcagtgtaaatggagatcagtctgttgatgtttctcatttaccaaaaggagtatatctattaaaactgaagataaaaaacgaaataaccaccagaaagcttacgattaagtaattgaatcaattctatcttctatcaatgagaaaagccggacgtccagccggcttttctcttttttattgctcaaaacttaagttgtgtcgttcgtgtaaagatttgtgcggtttgtgtttaaaaattacgctttctttgttttctttttaaaccattcaatcaggtagtaaaacaataagaatcctaatgcaaatatggaaaaccttgaaagaaggtctcccgctctcgtataaaacgtcatggtatcatatagatttacctttgcaaataaggctgtctggtcaccatagaaagtatcggcagtgacctctccctttgcattgatatgcgctgaaattccactgttggcagcacgggcaatttcccttcttgtttcaatggctctcagtttagcataagataaaagctgtttgtgtccctctgttactccccaccaggaatcgttggtcataattcctaagaaattagctcctttttttacataatctgttacaaattcaccataaatgctttcataacagatgattggcgccagctttcctttgttgtaaggatttgaaaaagccactctttctttatctgttcccaaagaagccacagttcctcccagattcagcatcgcatctcctaacaaaggttttaaaacattcatataaggaaatatttcaacacctggtaccagcttccctttgtggtaagcctgtactttttggttagggacaagctgaatggcagtattataactgcttacccaaacaccaccattgatctgatatgcctctttaggtaagtcagcaggattataataaaaacggtgcgacgaaattcctgtggcaaaaacagatcccggatggttggataaaaatcctttaatattgttgagaagtaaactcttttcaaaagctgtttcggaaatagaacctcttccaggcagtgctgtttccggtgcaatataataatcaatcctacctgcggaatttttttcagcaagcgctaataaatcctgttctatggtgagactgtcttttgaatatttttcagcataaggatcgaggtccggttgcagcatcagaacattaacctgaccggatggcttttcatcaaaagtattgtatttaatgaccgagataatcatcggcagagcaattaaagctgcaatgatcgctgagtttttaatcaggtcttttctctttcttcctgcttcccaggttcttactgtataaaaaatcaggacattaactaaaagaatccagaaacttcctccggttgctcccaatgtgtcataccactggatcagtttcgggtagtcagagaatacgttcccaaggttcagccagggccatgttaattcccatcccagatggaatttttcaaagctcatccagatggcaatcagaaatcccaatccccaataggtgccttgagcatttttataccagtgatagcattgaaacaccaaagaatataaaagtgaatttaccagtaccggaaataaaaccgccatcagagagtggcttccgtcaggattctttgagccatacagccatcccgtagtaactacattccagatcacgaaacataagtaagataatccgaagaccacccagctttttcttttataatccgaaaattttgaaacaccatgctccatcatcatcagaggaacaagagcgaaaaatataaaaaacggaaccccgtaagttggccatgaaaccgacagcagcattgctgaaataagtgtaagcagaacgtatttcattaaattattttaatacacaaatttaatgtttttgaaatgaatatattagcagttcaatgttaaagaaaatatataaaatcattattgttccgtatacacttttgctgctttacctgatgtttttggggatgggcagatttcagtatgatgaaaatttaattaccatagaacccgttttatcaacgataaaatttatccagggtccgaataagaccatagatattgtgaagattgttttgggcaatattattatgtttatcccttttggatttcttgggtggataattcctgaactgaaaaagctgaaaccattgatatttggttttatctcatgtatcgttattgtggaagcacttcaatattttacaagaatgggaatatttgaggtagatgatatcatcctgaatacttttggggtgtatctgggatgggagttttgcagaatgattgaaaagagatttagctattaagttctttcgcccgtttttcagcattcagaattccctgtttcagaatttctttgaaactgttttcttcaaaagtttttaaagcagcttcagtggttcctcctttggatgcaacatctttaataagttcctcaagattcttttctgagttattgattaaatgataagcgcccagcatagtctgctttacaaaaagtttggaaaggttttcttcaatgcccatttcaatacctgccttgatcatggcatcaataatgtaataaaaataagcaggaccgcttcctgaaagggccgtgacaccgtccagaagctcttcgtcttccagataaactgatcttccggtactgttcaataatctttcaatattgattaactgactgaaagaaattccgttggcagcggtatacccggtaattcccattcccagaagagtaggagagttcggcatggctcttacaaccagcgggtgattcagtagcttttggattttttcaatattaattccggccatgatggataaaaccatctggttttcttttaaagtaaactgaatattttgtgcaaccgtctggaaatcctgaggttttacagcaatgatgattaaatccgcatcaatgtcttttacttcttcgaaagtggaaattttagatttggggaattcttcagctattttggaaattttttcctgatttctgataatcagatgtaggtgttcaggcttgatcagttcatatttcagaaatgactttgaaaaagaaagtcccatatttccggctccaagaatcgctattttcattacgaattgtaaattttttagctaaaataatgattttccggagattggatatcaattgattctgaattaattttgttggaaaatgcaaagacgcaagattttgaataagatgctgttttaagcgcaagaaaatcgaagattttcagcaggagtgaaataaaagtaatatcataaagatctgtgtcatctgagaaatccgtgcgaaaatattattgcataaaatacgcagtattaaattgcatcggagataaaaatccctggggcttaaaaatattcgatacagataattaagaaataaaaaggctgaaatcatatgaatcagccttatgtattttaaataatatttacttcccgctcaagctctatcccgaacttctcctttacagaattgataatttcagtagaaaaatcaaaaatctcttttcctgtagcgtttccggttgcattgatgatcaccagagattgtaatttgtgtgaagcaacattcccgatctgttttcccttccatccacattgctcaatcagccatccggcaggaacttttaccatatctccgtttggatagccctggatattttcaaatttttgtttcaatgcttcaaattgggccagaggaatcgttgggtttttgaaaaagcttccggcattcccgatttctttaggatccggcaatttactttgtctgatattgatgactgccctggaaacatcctgaatagtcggattttcaatgccaaggttttccagttcggatttgatggcaccatattccgttttgatatggtgatctttttgggtgagtttaaaagttacctctagaataacatacctgcctttcccttcctgtttgaaaacagagtccctgtaaccaaacctgcattgttcaagattgaaagttgtaagctcagaattctccagatccaatacctgacagctaacaaaaatgtcttttatttctgttccgtaagctccgatattctgcattggagaagtacccacatttccgggaatcaatgaaagattttccagtccgccataattcttttccaggcaatacatcacaaattcatgccagttttcacctgcttttgcggttacccatacttcattttcattgatgctttcctcggaaattccttttaaatttaatctgatgacaagaccttcaaagtctttagtcagtaaaatattgcttccgcctcctaaaaacagaagctgaagagattggttttttgcgaaaataagcgcctcttttaattcatcaatcgtattgacttcagtaaaataccgggcccgggaatcaacaccaaatgtgttataaggctttaatgaaaaattttcctgcatattttattggtattctttagggagaattttgtctagttgttctttaagttgttgtaactgcttgtaatgtagggtgtctgcataagcgtttacatagatatgtgattttttgggagtccggatctggaacgtttcatctgtcccatccacaggctgttgacttggcgagctttttatgtgatcaagatctgtgattttgactgatgatataagctttttccacatttcggcattaatggcagatgaccattttttatgagtttgattggctgtcatccctttttcagcaaaaacagaatcttctgtggctttgataattctgtaacttccgagattccctccgatttccgatacactgacaaatgtaatttcgtacgggtttttatggaaatcagatggttctgctttttttgaatcacaggaaaagaatgccgacagcaaaagaatcgaaaacaggattttcagatagcgtttttttgttgtcggcataagttatattttacaggctgaattcttctctgtacttctttaaagcttctttaagaatttcagcacttctttttaaatcttcttctttcaaaacgtaggcaattcttacctgcttttttcccagttcaggattgctgtagaatcctcctgcaggtgcaaccatgatggtttcattattaagagaatatttttcaagcagccactgtgcaaatttttcagtatcatctaccggaagttcggcaacacagtagaaagctcctcttggcttaggacagatcacgccaggaatcgcatttaaaagatctaccaatatatttcttctgtgggtatattcttctcttaccgctctgatataaggtccgtcgttctgatgtgctgctgttgctgcaatctgtcccaagagaacagggcttagtcttgcctgggcaaaaagcatagccgcattacggattttgctggaacgggtaaccatacatcctattcttactccacacattgaataacgcttggattcagaatcgatgatgatacagttttcagctaattccgggaactcaagcattgagatctgctgctttccatcatatacatattctctgtatacttcatcagaaatgattacaatatcgtattttaaagcaatttctgccagtttctgaagttcttcacgagtataaagatatccggtaggatttccagggttgcagataatgattgctcttgttttttctgtaatttttttctcaaattcctctacaggaggtaaagcaaaacctgtatcaatagtagaaggtacagctactacgtttacatcaaatgtgctggtaaatccattgtagttggcatagtaaggctcagggataatcacttcatcaccttcgtcacataaagtagagatggcaaagttaagagcttcagaacctccgttggtaacaataaagttatcaggagtaagatctgagaaacctaatgaatgataatattcagtaagggcttttctgtactcgatattaccttcagaaagcgcatattccaatacttttaaatcgatattttttaaagcatttaaagctgtttccggagtttcaatatcaggctgtccgatattaaggtgatatacttttattcctttctgttttgcttgtaaagcaaagggaaccagttttcttaccggcgatggcggcatatgcagtgctctgtttgaaatattcggcattgttcaaaaaatttgtatgacaaaaataggatttaatttctcaataataaaattatgagtcaataagaaaatattcctgaacttttatattcttcgaaaaattcagttattacagtggtttttgatatggatttcctatgtgttttaaataaatgttatgattttgttaaaaataatatttttgtattgttatttttcgttaatttcgctgtaaatgtgattaaaatggtaataaatttattttctagagtggtacctgctattgctctgttttcagcctctgcaatgatggctcagaattatcaaactatgcccgtttcctctggctttacagctgatgtaattgcgaacggtataggctcttcatcaattactacaaacaatgacgtagacggagtttcttacgcttttgtagccaaagattttcagctgacttccacaagtcctgccattacgtatggtatacctgtggacggagttattaattctgtggtggcaaccactccgggattgagctttcagctggcaggtctgaatgccaacaattcgttaaggctggctgcaattaatgataacggaactctgacatttacggcaccgaaagctgctaccaagctttatatgcttgccgtaagcggaagtggtacttcaacggtaagtgtagtggtgaattttaccgatggcagttcccagacgttttcaagtatcagtcttgctgactggtacggaggttccaatttcgccatacagggaataggaaggattaaaaaaccgggggctactcctgcatccggtgatgatgttccttcacctgaaggtggaaccaatccaagattatatcaggctgaattggcaatagacgcagcaaaccaggcgaagctgatacaaagtgtaacggtaaccaaagcaagtggctcaggtatcccgaatatttttgctttttcagtggatgcttattcagattgtatgcctcctgtattacaggcagtttcaggaattacggccaactctgctttagtttcatggacaggtaatgcagccagttatgatgtataccacagtacttcaaatacaataccttcgagctctgtgacacctacttatccaggtgtaacgggaacaagtacaacaataggaagtcttaattccaatacgacttattattattgggtaagatccaactgtaatactgcaaccggccaaagtacatggtcttttgcaggaacatttaaaacagcctgctctactttcactgttccgtatacagaaaactttgatacaaccagtaccggttcgagcaccaacaacaacgctccaagctgctgggcatatctggaaagtgcatcatttgcaggctatggatatgtaactacaacaaataactattcggcacctaatgcttattatctatataattcaagcgctactacaggaagtcagatgttggttgctcctccaacgatcaacctttcagacggaacgaaacgtgtgagattctatgcaaaaacaggaacaacagggactccgttattaataggtactctatcgaatcctgcagaccctgcttcttttaccccaattggttctcctattactttgacatctaaccatacacaatatacagttaatattcctgcgggttctgatttgcagttagcatttaaacatggtttaggaggtacctaccgttctatttatattgataatatttctgttcagaatattccttcctgcgttgagccgacagccgttacatcatccaacgtgaattcaaattcagcaacaatcggatggacagccccatcttcagctcctgcgggcggatatgaggtgtattacagtacaagcaatacagcacctgatgcttccactgttttaaatgcagcaaactctgtaacgtctgcaacaacttctgcaccgataaatacattgcagccatctaccacctattatgcgtgggtgagatctagctgcagcgcaactgataaaagcatctggactgaagttcctgtatcatttacaactacttgtcttccgataactgcactgccttggagtgaaaattttgattcaatgacgaatataggctctgctatcgttccagggtgctggaaacaaactccgggaggaagttcatccagctataactttacttcagcaaatgcttcccagcaagcttataatgatcctaaatctgctccgaattatctgacgatctattatccatatagtaatgccgcttatttatggacacctacatttactttaactgcaggaacgtcatatgaattctcattctactgggtaggagacggctatgcaggctggcaaaatgaagtattggtaaacaatggacaaacagcggccggtgcaaccagtttaacgacatttatcacttctgatcaaacagcaacaggaggaggtaacagcaccgaatatactaaggttactgtttcatatacaccaacaactaccggcgattattcatttggaattaaagctttgaatacaacaacggcgccatattatatgggatttgatgatttctcccttacacagtctaatttaagcacggctgaaacgtctgttaagaaaaaagaaatcaatgtatatcctaatcctttcaaagatgttctgcatgttgcggatatcaaaaatgttaaatctgtaaccgttacggatgtagcaggaagagtggtgaaaactattgataatccaactacagaacttcagttaggagatttaaatgctggtttatatttagtgacaatgaactttaaagatggctcgaaatcaacagtaaaagccattaagaaataaaattttttgagttaataatttctgtaggcagttgcattcgtgtggctgcctttttaatggctttttcacataataactggaaaaaattattatcggaaatgttcataaaattattatacatttgtgccgaaaactataacaaccatgaatagatttaaactcctttttttactgcccatattatgttccggattctcccgggctcagcgaattgataaagaaataatcagcttccagcttttgaaagaaccggtttttcctacagacctttccaacagaaattatacgattaccgtaaaatctccctataatattacaaaagatgatgtgataagaatttcaaaagaagattatcaaaggaaggtggacaattatcagacgaatgttgaaaatgccaagtacgaacatcaggaaagattaaaagactacgatgctgaggtaaaaaaactacaggagaaatacaaactggaatcagcagaatataataaattatctgcagttgagaaaattgctgcaaccaacggagctcctatgttgagattaccttcaaggccaatcctgaatatccctccaatgccggtttaccaacaacctgatctgagagacgccctgattgtagataacaaaattctggcgtcacaaatggatgtgacaggtttttcaaaaggcggaaattatcttgacatcgttattgaaatggaaagaactaacttccaggacaaccaaggaaaaacttttgccaatcagcctacaaggatcgttgccaaacaaggcgatgcagtaaagctggataaaacctatttctcagattttactgaagtagcaagtgttccgactaatgaaatcaatttgaatgcccaggaaaaaagatatcttcagagaacgatggaccgtacaaggaatattattaatgaaaatttcggttatcagacaatcaattccacggtaactctggcgacggtaaagaacaaaggagaatatgatgatctggaaaaagcatacatctacgtgacgaccaatctgaaaaaacttcaggcaaaatcagactacaccccgaataaagtagccatggaaaacatgcagaaaggaattgatctctggaaaaccgctttgacaaaagtgaattacaatgacaaaaaggctgtttacaaccaaaagatcggcgaatacctttattttaacctgatcagattgaatattgctttaggtaattaccaggaagcagagaaatatttaaatgagttgcaggaacatttagtagatatcaaattatcctacgatgccaatcttgaactgaaaagattggaagaaaaaatttataataactaaagaaaacaatatgattaaacagattattgcttcggcattaataaccgcttctgtgtacaattatgcacagacaaaagtgactgaaggaacaaagttcacagtggacgccaatcttgaaacggatgataaactggtactggcagatgattacaactcttatatgttcagcgccatcaatattgacggcctgatgagaaatgttttcccgcataagaaattactgatgagaaaactggatcagaacggaagccttgtggatacatatgtgaaagattatgccaacaaaacgaatggtgtacttcataattaccttggctcacagcagattgatgatgataaatttatagcatttactgaagagtatttcgggaaagaaaacagaaaggaggtatttcagcatgttttcagtaaaaaagaaggcacatttaccaccaaaagcattgcaaaatacagcatcgaatctaccaacaaatcaggaaccacttatgttcttttttcggaaaacggtaaatatgcagcgatcttcaatgacagatatgccaacaaaaaaacagataacgtgaatgatgttctggtcctggatctgagaacactttctccggtttggaacaaagagatcacattaagcaatgattatgttgaaaagtctttgacgctgactaactcagcgaagattgttgtactgagaaaagctgcaggatggaaggaatcctataagctggaacttgtttcgaatactgaagataaagatcttccgtttgatgataaatatattcctgaaaaattatatgcattcagtaaaaatgacagcgattatctggtgacatttggaagaaaaaatgcggcggttaccattggtgcaagtacgtttggaacagtaatgttttatgatatgaagtcaggaaaagcagtaatcagcaataccaatttagccggaagcaaagatatgaatgatgtgaaggtcatcaaaacgattataaaaggagatgaaactttaatggctgtacagcaggaaacggtgacaagaccgatgccgacagcaatgaaccgtttcccagatcctgtgtattcactggatgcgggaatgctgatcaaattcaataaagaaggagaagtaaagcagtttgtggctgcgggaacttctacaggaaaaagaattcatgtggttgaaaccggagataaactttatatttctgctttctatccaaaaggagcattcgggaatacaggattttctatgaaagtctttgatttcaccaatctgaaacctcaggaagtaagccttgattataaaggaagaaactttttccagaactatggctttgcagatggaaatatgattcaatatattccgaatgtcaataaaatgatgttccttcaaaagagcggtaaagatgttcagatgttcaatgtatataattttataaaataattgtattttagaaaaaattaaaatatgcagattcagtcagtttccgtagaagattatatctcaaaaattcctgaagaaaggcaagaggcttttaaaaaactttttgatacagtgaatgacaatcttcccaaaggtttcgaagaagctacaaattatgggatgatcggctgggtagttcctttggcaacatttcctgcaggatatcactgtgcacccgggaccccgctgccattcattaatctggcttcccagaagaattttatagcactatatcatatgggactttattcaaaaccggaacttcttgattggtttgtggcagaatatccaaaacattccaaaaagaaactggacatgggtaaatcctgtatccgctttaaaaaagcagaagatatcccttttgaactgatcgcagaactcagtaagaaaatgactcccgacgactggatcggaatttatgagtcgcagtataagaaataaaaaagaaccctgaaatctatttgatttcagggttcttttttgcgctggaaactggaagtttgaagctggaagttatagttgtgtttttagaatcaatgtttgtcgtttggtgggtatgtattgtaggattaaaaaaagttaattaaatggtgtgcatgtattcatcggcttccggcttcattctttcagctaaaaatgaatatcccagattcctgctttacgctcaagttcaattaaagcagatgcattatcggcaaggacctgataatagtcttttcttacattattgtaggttctctgggcattcagaacttcaaggatagaactttctcctcttttatagctgtaaataattccttccagaatggtttgtgcttctgcaagcattccattgtggaattgtctgagctgtttctgggttgccacatactgttgataagcctgcattacttcagctcttatggcttgttcggtctgtttatattcaatttctgcctgtgaagatgccatttctgctatttttactcctgcatttcttttgttggaaaatttaaggggaatgctaatgcccatttttacagcatttacagtgggagagggtgcaatttcgttgatggcttctgtgtggcgttctgctcctgcactgatgccaaggtctatgacacggttggctttttcaagactgatctggcttctggtaacttctgtattttgtctggcggccagtaaatctgctctttcattcaatgcctgaagaatcaggtcatcaatactgaaattcctgttgaaagcatttaaatctccgctaacctctctgtccataattttgctgtctcccagaaatacagataaactggtgagagcctgctgttcttcactttcagcctgatatacttcgttgaggagagaagctgcttccagcttactttgtttggaagtcacgagcgatatggttcccaacctgtagcggatactgtcggactttgcaagctgttgcatgtttttataagaatcctgttgtacttcaagcaatgctttggattttaatgcattgatataccctaagctggcatctgcacgaaggttcctgaagaaatcctgcaattgcagtttgctaagctcagattggtttctggccagatttaccctagcttttcttttaccgccaagctcgagggtccagccaagtgatgccccgtaaacataacccatattttgattcacaccattattggtggtttccatttccaattgaggatcaggaaacatatttgcggtccggatagcagcttcagcgatacttacattgtatttctgagaagcataacctaaatttttacttccgacaagattcaggtattctccaaatgacaaaagctctttttcctgtgcctttacacttgtgatgcagagcaatacaatggatactatgataaagtgaactctaattttcatctgattctaaattttgttttttgtttctggattcagccataaaataaatcgccggcagtacaaatagggttaaaacagtggagaacatcagcccgtaaacaatcacagttgccagtggacgctgtacatctgaaccgattcctgtagccaatgatgccggtaacaatccgattatagcaaccgttgcagtcattaatacaggtctgaaacggtcttttgcccctttgatggcagcctttttcagttcatatcctttcttacgcagatcgttgatgtgagaaatcatgatcactccgttctggatggcaactccgaataaagcgataaatcctacagctgaagagacattcagagacattccccggatattgagtgccagcattccgccaaataatgccaatggtacaatagacatcaggactaaagcctgtctgaaatctccaaatgcaccatataacaaaagaaacataatggccagtgcgagtggaacaataaatgcaagtcttgaataagccctgttttgattttcaaactggccaccccatttgatctggtacttttcgtggtcgtatctaatatctttctcaattttattctgtgcgtttttcaggaaagatgaaagatcggtacctctcagattaagctttaccgtaagatgacgtttgttcatttctcgggtaatcgtgctttctccggtactcagtttcacttctgctacctgtgacaatgggattttggctccggaagctgaggtcagcattaggtttccgattttatccggagtatcgcggctgtcttccgtgtaacgacaggaaatatcatacactttattgccgataaagatctgagaaatggcttttcctcccaatgccacttcaataaggtcggcaacatctgctacattcagaccatactgagcaattttgtccctgtttgcaatgatctgcagctgaggtaacggcggctcctgatcaatggcaaggtctgctgatcccgggattttattcaaggtagacaaaacatcttctgcaatgcgtctggtttctttaaaatcttctccatatacttttacaaccagttcactgtgagcgccggagattttatccatcactccgtcaatcataggttgtgaaaagcctaccgtgaatcccggcatgtctttataatctgccgcaagttctctgatgaggtctgcttttgtttttccggaaggccattcgctgtaaggctttattccaatagaaacctcgaaatgagaagctgtccacggatctgtgccatcatcattgcggcctgcctgtaccatcatataagtgatttcggaatgtttcagggtacgggcccgcagggtatcactcatttcttttgattgggctaaggatattcccggagacagctgtacctgcagccagatagaaccttcatccagctccggaagaaaatcttttcctacggtgtaagacagaattccggaggatatcaatataataatgattggaataataactcttttgggagcctgcattattttttctatcctttttccataggcagcagcaagtttttccaaccatttattatgatagattttttgtggtttgcggtagatgacatacgctaatcccgggatcagaagtaatgctacagcgagcgcaccaagcagagcgtatccaacagtaaaagccatgggggtaaacatttttttctctacccgttcaaaagcaaacaaaggtagataagcggtgatgataataattgttgaaaagaaaatgggcttggctacttcaatcaccctttgggtaattgttttttcttccagtgcttctttcggattttcttcccgtttcttcagaatggtttccagcataacgatgcttccatctacgataattccgaaatcaatagctcccagtgaaagcagattggcaggaatgtcagtaaaatgcattaatataaatgcaaacaataaagaaatcggaatggtaatcgccaccagcaatgctccgcgccagcttccgagaaatacgatcagaataataataaccaatacaattccttcggtaagggtatgagaaactgtggtgagcgttgtttttacaagatctgtccgatccaggaaaggatggatttttacacccggagggagcgtttctttattcagttcttcaatggcttcatgtacacccgccagtacttgcgaaggattttgtcctcttagtaaaagaacgattccttctacactttcagaataattacgtttccggtcggtatagccaagaattccttttcgctcaaggtttccgtatttcagtgttcctacatcatttaaaaaaacaggaacgccattttgggtttttactacaattttcccaagatcatttaaatcttttaccaatcctatcccacggatcacataggccaggtttccgcggggaagcatacttcctccggcacttacattatttttggaaatggtttcagttacttctgaaagagaaagtccatactgttcaagcttatgaggatccagttcgatctggaactgggtggtaatccctccgaagttggtaacgtcagcaattccggaaacctgtttgatgcggggaataatgacaaatttttgtaaatctgtcaattcacgcagactgtggttattgctttctatgatatagcggtacacttcgccgatgggagaggtgaggggatctaatccaggctgtgcactgtaaggaagctctacatctgtcagcctttcctgaatacgctgccgtgcccagtagtcatcaatgccatcatcaaaaaccatagtgataatggaaagcccaaaggtacttttgcttctcatcacatgcattccgggaagtccgttcagtgatctttccaaagggatggtgatctgctgttctacttcttcagccgccagtcccggaacctgtgtgaccacctgggaagttacatctgcaatatcgggataggcctctatagataatctggtccaggaataatatccgaagaatcccagtaaaaggaagagggaaagcatcagccatctcttctgtatggagagtgtcaataatttcttcataatttttcatttacattattttgcatccggcatataaattccgccttcactcatgatgatttctccgggttttaagcctgctgtgattcttactgttttctgatcggtttctccagttgtcacaaagcgtttgataaactggtttttaccggtttttacccatacatattgagagctgtcctgttgcattaatgctgttacaggaatcatcaaagctttttcagaaactgttgaaaaattaacggtagcgaacatacccggttttagtttccggtccggattatcacattcaataaggaccttgatgcttcgggtatcttcatccaccatttcattgatatgatatacttttccggtaatgtttctgtccggataggcgcttacttttacggaaacctgatcaccaatactgacaaagcggatgtctttttctttcacatcaccggaaatccagactttggataattctgcgataatcattaccggatcagcatctcctttcagatattgtccgtttacaattctgttggaaataatttctccgttaatgggagctcttaccacaagcggacttcctatacctccgcctttgctgttatacacttttaatgctgaagaagcgttggaaagggatgttcttttatttttaagatcggtttccgcttcgtccagttctttctggatgccgactccgtgtttgaccaagtcctgctggcgtctgtaatttttttctgcaagctgtgcatcattcagggcatctgtataatccttctgaactgaaaaataatcggaagaaaggatttcaaaaagagggcttccggccgaaacattctgtccaagctgaataaaggatttggtaattcttccggaaaaaggactggcaatttccgcgtaatgattgggaatggcctgaattgttcctgctgaaattaccccgtcactgtgttcctgttctgtaacggcctgcgttttaatttttttgaaaacagtattgttttccggtattgtgacctgattatcctgaatgactatttcctgttcgttgttttgctgaggtatattatccttacaggagactgcaaagagaattacactgcttaagattgttcttttcatgttcttaaaacaattgagtgctgttgctgatttttattttttctgtattgtttttccgggtgttgagcagttttttactccttgcttcttttttggaggatagagtgggtctcagaaatatgtttgtagagacaatgaagaaaactgtaataagggcttctttaggatatccgagagcacataaagcacctatggctgcagagcaccataatgtggctgccgtattgaggcctcttacggtaaggccgtctttcataataacaccgccaccgagaaaaccgattccactgacaatataagaggtaattcttccggctgcatcaccaccaattctgatggctatcaatacgaaagctgcagagccgatgcatacaagtgtgttggtacggagacctgcattctttttacgccattgtctttcgaagccaataccggctcccaggcagaatgcggtcagtaaacgaagggtgaattcaaaggtattcataacttttcctgtttttataaagcttttcagctgtacgggaaaagtaggtacaactaaagcttttaagattgataattactgtaaggatctgagtccatatgctttattttttactgtgcaaaagtaaaaagggctgaagttttatgcagttagaaaagctttagaatatgattagaaaattattagagaaaataatttcttgtttagagtatcaggaaaagaattaaaatatttatgtattaagtcttattaataagtgaaaactgtacccattgcaaaaggtaaaaaatcaatacatttgatggcagttattttatatgatgaatttcacggtttacagtataaaataagagtttgttaatcccggaaacttctttccaaaatcttttgaacgatatatttttaggcatgaaaaaatcaaatatagcaataccggctacgcttttagcaattatctgtgtacagggaggagcatccattgcgaagcagctttttcctgctataggagctattggtactgttactttaaggattgtactttcagcggttctgcttactttgattaaccgtccgaaatttttaacatttaacagacagaagtggcaatattgtgcaatatacggaatcgggctggcagcaatgaatcttattttttatatggctattcaaagaattccattggggctggctgtgactgtagaatttgcggggcctttatttcttgcactggctttatcccgtaaactgctggacgtagtatgggctttgctggcttgtgcgggaattttactgatcgtaccgtggcataatgatcatgtagatttgataggtcttggattggcttttctggcagggatgttctgggctgtttatatcataatgggaggtaaggtttctaaaataatggacggaaaggatgcggtaacaacaggaatgatattcgcgagtctggtgattattccttttaccatatgggatggtgctgttttcaacctgactccaaccatttttgtgaaaggtctcggtgtggcgattctttcgagtgctttaccattttctttggaaattatggctttgaaaagacttccggctaaaacgttcagtattctgatgagtctggaacctgcatttgctgcactttccggcttggtcttccttgctgaaaaattatcttttttacagtggatttctattgcctgtgtgattgctgcaagtataggaacaactgttttcagcagagcatctaatcattaaaagattttgtcccatgataagattacattggaaaatacagcttattctgcttctgatttcgctttttttcgttggcttgggtatacaaagtattgcagaagaaaaaaagtccggaactcttttattcagaaattttttacatattttaccttttgtgatcagtagtatagtttttatcatcaatatccgtaatcagagcaaaaaaaagtgataatgctttttgagaaggttatgtaatgtcaaatatcacggtgaaaacagtctcattgtattctgatactacgttgatttttgcatggtgaagatgaatgattttttccgtaagaaataatcctattccgtgcccttttttctgccgggaggcttcacttctgtaaaatggcttgaaaatatgctgtaaatcttctttaaaaataatatttcctgtattgctgaaagtgatggtaagagttttggaatgaacgctcacatcgatcaggcaggtatgttccggggaatatttgcaggcgttgtcaatgagattattaaaagcaaccctcagaagatattcatttccctgaataataagctgatgttcttctacagagtcttctatgttcattgaaactttatatcctgaattttcttttattgttttggtataagattccagaagaacttcatccaggcgtacttcagcaaaactgatttcattgggatcataactcgctttggcaagatccattaagctattggaaagcgttaccatatttcgggcatcttccagcgcatatcgtatggtttcctgatattcttctttggttttatctttttcggaagccagttcaagttctgtaatgatagcagataaaggagttctaagttcgtgtgaaatattggctacgaaatgcttttgtgaatcaaaggaattttcaaggcgctccagcattccgttgaagttttgggccagttcattcaattcatccttttctttcgttgttttcaggcgcagctgtaattttccggcggtaatctttttgatctgattcaccatttcactgagtgggctcaatgcttttttggaaagaaatattcctgccagatagatcaggatcagaatactgaaaaaggaaataatactgatggttaaaagatgcgtaagatattcgtatccgtatttgtcataagccgccgccgttacagcataagattttccttcataatgatacaccattccaatgacctgcagatcatttaaaaagaaactgattctttttttccggaatatctgtgaaagcatttcaggagtttcctttacataatctaccttggcatcatcatgataaaccaattgcttattgctatcataaattgctacctgaacctcattcagtgttctggtattgttttgataaagcttatgcatttcctcctctggtaatgaacttctgaaaaacaggtctgctttggcaatggcttcgttctggagttcgctgtaaaaagattgctctctggcttctttggatgaataatagatcgaaacgctgtaaacacttacaagcattgcagtaattaaggtaaaaagcagcgtaagccgggtcctgattttcatccgaatatttttagtttatttccatcattattgcacaatgcctgactcgtaatttttcttcaggataaatcccatgccggccttggtgtgaataagcttggtttcaaaatctttgtcaattttcttccgcaggtaattgatatagacatcaataaaattggttccggtatcaaaatgggtttcccatactttctcagcaatttcacttcgggaaagaactctttctgaattttcaagcataaatttcagaagattaaactctttgggcgttaatttgatcgggatatgatctctgattactgttttctgctccagattcatttcaatcccgtcatacctcagtatcagaaccttctgatgtctctgttgtgaaaagcgtttcagaagtactttgattcttgccaccaattcccgcatttcaaaaggcttggtgaggtaatcatccgctccggcatcaaatccttccagtttatcatcagtagttcccagcgcggtaagcataatgacaggaagatcgggttttaaagctttgatctcattacaaaattcgagtccatcttttttgggcagtacaatatccgttacaatcagatcaaaatgattctgcagggccagtttcattcctgaatttccatcataagccacagtaacctcaaactgagcttcctgaaatccttttgcaatcaattttgaaagtctgtcgtcgtcttcaactaataaaatatgtggcatgagaatattgaaaatgtttgggttgataggaagaatacatcaatattcccacaaatgtaatgaattctattttgtaattttgattccggaagtataatcagatgtcagaatttacaatgcctttaggaaaaaaaatcaaagaaattacagttacaggattttggttctgtttattgatcatattggctcagtgcagcagcaattctccgggaacggcaccgctcaaaaacggagatctgctttttgttaccgcaaaagaatccggactgtccggggctatcaataacgttactcaaaaacaaaagtctgcttcatttgaccatataggtattattgaaaaagaagataacaggttttatgtcctgcatgctgctcctaagggtggttcccagaaacagaatttaaaggattttataaaagatcagaaggaagaaggacagcaagtaattgtttaccgtttaaaacccgaataccggaaagccattcctaaagctgttaaaaaagcacacgccatgctgggaaaaccttataattttaattacattctggatgaaaactcatattactgttcggattttgtggaaagagcttttcgtgaagatcatatttttaaattggaacctatgacctttattgatcccaaaacaggaaaaacgaatgcattctgggaagaattttatactaagaaaaatctgaaagtccctgaaggagagcctggttgtaatcccaatggtcttgcaggttcggagaaacttgaaaggataggaaccctttaaaacaaagagaagctgagatcggcttcttttttttgtgttaaattttaaaaaatattagtctactaatttggtggactaatatttttttatatttttgtcacagatttaaatgcagagcgcgatatgatctgacaatgtttaacccaaaaatgtttagcaatggttacacctaatcccggcctgcaggttttacaaaacaaaataaacctgcctaaaaaagaattgttactggaaatagagttgaatggcaaaatgaaatttgaacatttgatgaacaccatctataaccaattaggcatctgtcatagagtgttatctgctaatgtagagtatgtgaacggatatagttttggttccgtacagttatatattaatgtcaattcagaagactttcagctgcttgaggtctatctgaataaaaataaacttatcaatacgacggtagaatatacctgcagaacatatttttaagtgagattcatatagttttaattacccaaagtgtccggttcttttaccgggcactttttatttaaaagttatttgagaaccaatatagagttgatggtcgctatttgatggggagtattcctctcctctggaaggtgtcgaaaatagccaataaaaaaagcgttcagaatattccgaacgcttttgtattaaataaataattttaaattctctcgatgtcagcaccaatagctcttagtcttccatcgatattttcgtatcctctgtcgatctgctcgatgttgtggataattgattttccttctgctgaaagtgctgcaataagaagtgcatttccggctctgatgtccggggaaaccattgtggttcctcttaaaggcgcttcctgatttagcccgattacggttgctctgtgcggatcacataaaatgatctgggctcccatgtcgattaatttatccacaaagaataatctggattcaaacattttctgatgaaccaaaatacttccttttgcctgagtagccactactaaaatgatagataataaatccggtgtaaatcctggccatggcgcatccgaaatagtcaggatagatccgtcaataaatttctggattttataatgctcctgggcaggaatgtaaatgtcatcattactttgctcaagctggatccctaattttctgaatgtgttcgggataaccccaagctggttccagtttacatttttgatggtaatttcagacttggtcatcgctgcaagaccaatccaagatccgatttctaccatatccggaagcatcgtgtgctctgttcctctaagatattctaccccttcaatggtaagaaggttagacccgattcctgagatattggctcccattctgttcagcattttacataattgctgaagataaggttcgcaggcagcgttataaattcttgtttttccttttgccagagccgctgccatgacaatattggcagttccggttacagaagcttcttcaagtaagataaattttcctcttaattctttagcttttaaagagtagaaatattcttcttcatcataattaaattctgcacccaattcaacaagtccctggaagtgggtgtccagtcttcttcttccgattttatccccacccggagtcggcatataagcttctccataacgagccaacattggccccatcagcataatcgatccacgtaattttgctccgtcttttttgaattcgctggattttatataatcaaaatttacctgatccgctttgaaagtataatctccctgtccgtttttcgtaacttttaccccaaaatctccaagaatttcaatcagtctgttcacatcatgaatatccggaatgtttttgattcttacttcttcgtccgtcaggagaaccgcacataaaatttgtagagcctcatttttggctccttgtggagttatttcaccctgcagtctttttcctcctcttatttgaaatgttccactcattattttctgtttttatgattgttattatgtcttcttttgttgggctggttattgttcttattattgctgttgttcctgttgttattgttattatttcggttgttgttattattggtgtaatagattttacttttttcaagagaatctattccggtaagatccaacctgttttcagacagttctttcaggtggcggaaaatcacatcatccgtcacatgttctttattatagacattgtaagacttcttcatattgttggcaatcacttcaataagagcttctttttcttcccctgtttctagttcgattgctttttctattagctgaagaatactttttccgtaaaacttaaagtcaccctgaagttttggatattccattcttttaggtctttctgccaattgttctctggtaggaaacggatagggagattctacatccagatcataatctgcaagaataaaaagatgatcccaaagtttatgtttataattttcttcgtcgcgaagttgcgggtttctctgacccataaaatcgatgattgccatagccatttcattcctttcctctttggtaggaagttctttacagcgctcaaccaactgttgtataattctgccgtattccggcatatgaagctgagttttttgggtgttatattccatagtatgcaaatatatggattaaaagaaaaattgtttcgagaatcttaaaattttatgattttttaatgaaaaatttaaatgtctttcttcctgatttattattgaaaattaaaatatttcccattcatttgaatttgtttttaataaaattgtatcttgtttaatagattcataattaattattgcgatgaaaaaaacatattttttcctttccctgctggctttagcgtttgctcactcatgccggaacagtgatgaattaacaatggaaccttccaaaaaggaagaggtccacaataaaacggtgaatgtaacgaaccatgacgggcggcctttcagtacaggaaacggttcaggctctgcacaaagtaaatttattgccgggcccggcggcggagtattgatgcagggtttctactgggatgttcctgatggtggcaattggtggaatactgttaaagataagctgacagcgtggtccaatgcgggaattggtgctgtatggcttcctcccgcatcaaaagcacaaaacggagcatactctatgggatatgaccctacagattattatgattttggaaactttaatcagaatgggagtgtggaaacccgtttcgggtcaagggccgagctggaggcattaattaccaaagcgcatgatgaaaatatgcaggtgtatgcagatattgtgattaaccataacagcggcgggcaatccgaagccaatccttttactggaaccaatacctggacggatttttcgggagtggcttcaggaaaattccagagaaactataatgatttttataagaatgcctacggaaataatgacgaaggagcttttggaggtttcccggatctgtgtcatgccaatcctcatgtgcaggactggctttggggaagagatgattctgttgctaaatactataaaaacgtgatgaaatttgatggctggagatttgattacgtcaaaggttttggcccgtgggttgtcaatacatggaactctaaggttggaggattctctgttggcgagctctgggattccaacgtaaatacattggattggtggtccagtaatgccaacagttctgtatttgattttgctgcttattataaaatggatgaagcgtttgacaacggaaatttaaatgttctgaatgatgatatgatgtggaaaagaaacccttataaggcagtcacttttgtagccaatcatgatacagatatcatctacaataaaatgccggcatatgcttacattctgacccatgaaggatatccgactattttttacagggattatgaagaatggctgaacaaagaaaggcttaataatctgatctggattcacaataataaagctaccggaacaacttctattctgtataccgataatgatgaatatatagcaagaagaaacgggtacaatggtaatccggggcttgttgtttacatcaatacttcatcaagctggcaggaaagatgggtagaaaccaattggagcagtcagcagattaaagatttcacagggaattcaagctggtatccaaccactcagggtgataaatgggtgaaaatccagtgcccgccaaattcttattccgtttggtcgcttaatttataagtaatgagtaatgggtaatgagtaataaagctagtaagaggttgttattcagattaattccattaaacattaaacaataacaactctacatcttatttgtcattccgtaggaatcaattcaatgcatcatattgcaaaagaattcttacggaatgatattttctctaaagttacacctgaataaacttttttctctgatgctgatccggcagataacacttctgattggccagtttcattctgtttctcgaaacaagatcgtaagctttgtcactcaaaaacctgggaataattttgcctaaaaaagccagggagtatattcctcctaacagtttggcaatgtgaagtattgctcttgatttaatcagataatattttcccggtttccagaggtacatggtattgaatatttgagtatccaaccccctttcggataaaaactgctgtccgaattcagactgaagggaagcaaacataaactggtctttccgatcccgctcaagaatccattgcacccagaaattacatacaccgcagtctccgtcaaaaaatacaatatgtttattttcccagttttccacaactttatttattaaacatgattcctctctcagtatcttcctttacctttttgaaatattgaataagatctgtacgctgttcatccgaaagtttggcatcctgatgtcctatataataagattcaagcggcatttctttcttttcaaccatttctatacattcatccagtttatgaagctgtctctgaggctcataaactgcaaaggtagaaaaattaaggctttttctgccctcatcaatatgattttttacccaccatgatgtaggggaaatattagcataccagggataagttgtttcattggaatggcagtcataacatgaagttctgatggtacgggcaattttttccggggtattttttattttcagaaaatccatgcctggtgtaagcggcggattggtcttatcaatggggaagaattgaatgataataaaggcaacgagaatgactacaattatttttttcatagcaggtgttcatattttgataaatataaaggtagttaattttttttatgctttggctggaagttgtgagcagagaaaaatttaccggtcagttttttatttaattattaatttcctattcaattatacaaatgtgcagaggatattttttgtctgttataacttccagcttcctatttccttcttctcgctttttctcttacattgagttattctaaatagagcaaagccaacccaatgaatttaaaaaatgattaacttaataccacaattatgtcctggaaattatgcggtaggaagaacttgtttatagtttttaactatcattgaaataaaaattaatagattgtatttattatttaatcgttgtaggtttgtgatgttcttacaacagagaatgtaactgaattaatcaacataaaataaacgacaatggaaaaagatttgaatgacatcagcaaatgcccgtttcataacggaaccatgaagaagaataatgtagccggaggcggaacaaaaaattctgattggtggcccgatcagcttagagtagatctgcttcgtcagcattcttccctctctgatcctatggataaggattttgactatgccaaagcatttgaaagccttgatctggaggctgtaaaaaaagaccttcacgcattgatgacagattcacaggattggtggccggcggattttggtcattacgggcctttatttatccgtatggcatggcacagtgcgggtacttatagagtaggagatggtagaggcggagcaggagcagggcagcaacgttttgcaccgttaaacagttggccggataacgtgagccttgataaagccagaagattactttggccgatcaaacagaaatatggcaggaatatttcctgggcagatcttttaattcttaccggaaacgttgctcttgaatcgatgggctttaaaacattcggatttgcgggaggacgtgcagatgtatgggaaccggattctgatgtatattggggatcagaaaaaacgtggcttggaggtgatttacgttatgctcatggctcagaaggagtggtagaaggcaattcggcggttcttcctaccgatgatgatgcagacggagatattcattcaagaaaccttgaaaatccattggcagccgtacagatggggcttatttatgtaaatccggaaggaccggatggaaacccggatccgattgcagcggctaaagatatccgtgatactttcgggcgtatggcgatgaatgatgaagaaaccgttgccttgattgccggaggacatactttcggtaaaacacacggagcaggtcctgcagatcatgtaggtaaggaaccggaaggcgcaggaatagagctgcagggacttggatgggcaagtacttataaatcaggaagcggaagagatgccatttccagcggtctggaagtaacctggacagaaactccgactcaatggagtaattatttctttaaaaatctttttgaaaatgaatgggaactcacaaaaagccctgcaggcgctcaccaatgggtagccaaagatggtgctgaaatcattcctgatgcatttgatgctgacaaaaagcataagccgacaatgcttacaacagatctttctttaagatttgatcctgtttacgaaaaaatttcaagacatttctatgaaaatcctgatgcgtttgctgatgcgttcgcaagggcatggttcaagcttacccacagagacatgggaccacgcgcccgttatctggggccggatgttccacaggaagagcttatctggcaggatcctattcctaaagtagatcacgaactgattgatgaaaatgatgcagaagcattaaaatcaaaaatattgaactccggattaagtatttccgagctggtttcaacagcgtgggcttccgcttctactttcagaggaagcgacaaacgtggtggtgccaacggagccagaatcagacttgaacctcagagaaactgggaagtcaacaatccttcacaattgaataaagtattaggtgttctggaaggaattcaaaaagagtttaacgactctcaaagcggaggtaagaaaatatcattggcagatctcattgttttagctggtaatgctgctgttgaagtggcggcaagaaacgcagatcaggatgtgaaagttccttttgcacccggaagaatggatgctttgcaggagcagacagatgtagaatctattggatatctggaacctgcagctgatggattccgtaattatctgaaaagaaaatataccgtatctacagaatccttactgattgataaagcacaattactgactcttactgcgccggaactcactgtattgattggaggaatgcgtgcattggatacgaactttgacggttcaaaacatggtatcttcacaaaccgtccgggtgttcttaccaatgatttcttcgtaaatcttttagatatgagtactcagtggaaagcaatgtcagatgataaagaattatatataggaagtgatcgttcaaccggccaaccgaaatggaccgcaactcgtgccgatcttgtctttggatccaattctgaattaagagctgttgctgaggtatacggaagctccgatgcacaaagcaaatttgtcaaagattttgtagctgcatggacgaaggtgatgaatctggataggtttgatctatagaaaataattttttagataataggatcggctgcccgaagggcagccgatttttgatttatcagtattaataaggttttgttggttttacaaaatattgtagggtattgctgttttaaagaaagttaataagttatcctttgggtaaactttaaaagttttaattttgtgagcattaaaaacataaccataaaataataattacactcggcaatttgtgtatttctatatatacaataaatcaatcaacatttacttaacattaataacacaagtatcaaaaaaatctacatgtgctaaaccaggtcactacaatagttgacggacaaccgatcacaatctcaagctgatattttacaagaattaagaatagtaacaaatgttcgaagtgctggtgtcaaaaaaaaaattaattatgccacaatatatagattcatattatcttgttgatactagaaaattagaaattgtttatgattttttttcaaagtattttccattgggagtagaggacttagctatagattatccatttcctgaattttctgattcgccagaaaaaatttttcactcagtaagagaactattattgcatctggaagataacttaggatatgagtatacaatctattttgataatatagataaatcagcaacaattaagcaaataatattacaatatactgatgatggaaaaataatttttggagtatctattattggaaatgatccatcgttaattcaacagattgaaattataaaggaaattaaaaattatttaaattcgaaggatgcttgtgctacagttgaagaaattcctcctataaattcaagtgaatttgttgaattttgtgatgaaaggtatagaatatagtttaatttgtaaagtttatttagaaggtgatattgcagttaagcacccaataattggtttaattttcctgaaaaacttgaatttgatgaatcattaactttggattacaaataaaaacaggagaaacgataattatagtcattctcctgttatgtagacccacagggattcgaaccccagatgactgaaccaaaatcagtagtgttaccgctacaccatgggtctgtttctatgccgcgaaattatagaatttattttaaatatgaaaatcaaaattaaagattcattaacataattagtaagatgacagctttatgtactgatatccaaagaattatttttttaataaattttagaaaaaaaactgtttctatccataaacattagatttgtggatattacttgctcaatttgatgagtaggttttacattaatttattcgaggaataataacttcccgcttccttcttccagctcccatccttcaaaattcagttaaataataaaaccttatctttgcaaaaaaattgggctccaaaagttggagtaacccattaataacatatcctgagcacagcaaaggagtattaaacatttttttatgtcaaacattgttgcaatcgttggacgtcccaacgtaggaaaatccacgctttttaaccgtttattagaaagaagagaagctattgtagattctacagccggtgttaccagagaccgtcactacggaaaatcagactggaacggagtagactttaccgtaattgataccggagggtatgatgtaggtacagatgatatcttcgaagaagaaatccgtaagcaggtacagctagcagtagatgaagccacttctattatctttatgatgaacgtagaggaagggcttactgatacggatcacgaaatttacaggcttcttagaagatccaacaaaccgatttatattgttatcaataaagtggattctgcgaaggaagaacttcctgctactgaattttatcagttaggaatcgataaatactatacactttcttcagccacaggttccggaacaggagatctgctggatgatatcgttagagacttcccgaccacagaatataaagacccatttgaagggcttcctaaaattaccattgcaggccgtccgaatgtagggaaatctaccttgacaaacgctttattggatgttgaaagaaatatcgtaactgatattgcaggaactacaagagacagtatccagactttgtacaacaaattcggacacgagtttgtattggtggatacagcagggatgagaagaaagtctaaggtaaacgaagaccttgaattctattccgttatgagatctatccgttctatcgaatattctgatgtagtgatcattatggtagatgctacacaaggatgggaatcccaggatatgaacatcttcggactggctcagaaaaacagaaaaggaatcgtaatccttgttaataaatgggatttgatcgaagacaagcagaccaatacaatgcgtgatttcgaaaaatcaatcaaagataaaatcggccagttccaggatattccaatcttatttgtttcagccttaacaaagcaaagaattctaaaagctgtagaagtagctatgcaggtttatgaagatcgtaagaagaaaattaaaacttcaaaactgaatgaagtaatgcttccgatttttgaaaatacaccgccgccggctttaaaaggaaaatatattaaaatcaaatattgtgttcagcttcctacaccgtcaccgcagtttgtatttttctgcaaccttccgcaatatgtgaaagaaccatataaaagatttactgaaaatcagctgagaaaagaattcgggtttaccggagttccgattgaagtatatttcagacaaaaataataagaacaaatattataaaaactccggcaagcgaagcttgccggagtttttgtttcaaataaattttcatttcaggcttttcaaggcagccacttttcatatacaagtcttacagggcggtaaccctgtgaaacaagccaccgctgcattgtatcattattgcataatgtataacggtaaattttccggattttatagtttgcatacctttcttcaaattccttattgagggcagaatagattccccgttttctgaactctttttttacatatccttctgaaacgtacagatcatctccttccccaagctcaaaattactgtcatctttctcttcaagataaccgaaaagaaaacctattgccttcccatcggcttcagcaataagaaaagtaccatcattttcttcctcacatgttgacataaaccggagataactttctctgatctggctccagtcagcggtgttgttattcatttctttttctgaaatatggagttcacctaccagttcatcaacaacaggaaggttttctgcgatttttatttttctgatggaataattcataatgatgttttgtttacgtgttggaatccggaagaggaaaattggaaatttgtattgtttaatattaaaccctcgccattaattaataaaacagatttaattagaaaaacactcattcctattctgaacctgaattacttccatcttccggccttatgcttccagttttatcactttcctctcaacggactgccataccaggacgtattatccgaaagcacttctcctttcataaccagggaaagaggatcaatattaacattgtttccgatttcactgtcatatagaataattgttcttgaattgattgtggtctgctttccgatttttacactacctattttcataatcctgtcttcaaaaaggtgtgtttgaggaccacagtcttcattcagcatggtttcatccccaatagaaaccatatcgaattctgtaatatcagttgtattgagccatactctttttccaattttcacccccagaaatctcataaagaacggcagccagaaagtcccgcgcagaaaatcaaggaaaaactgtaccggaagggcttcatagattgttgtaattccttcactcagccataccttcatactgtacatcggcatttcagtttttttataccttcctacaaaaatccatttcagcagtacggtgaagaaaaaagaaggcaaagcaacaattcccagataataaaacggagacagtaagataagataatgaatgtttccttccagataagtacttgtataggcaatgaaaagtacgctgcagataatcaccacagtctgtgggagaataattctgattccttcaaccacagctcttgcaagcttaagtttaaatgatggattataggtaaggttattctgaaaagcatcagatttctgtctggatggcagaccaatcggaggagaaccaaaccagtctttttcatttgaattttgcagttgttcttcagatggagctttgctcaatactccgatcagcatattatctttcagttcatatccctgtggaatcagtccgctgtttcctacaaagctgttatttcctattttggttttcgataaaattaatttctcattccttacatcatgctctcccaaaatgactgcatctgcaataaatgagccttccccgatttctaaaagatgatgggaaacatcactggctgtcgagatttctgaattctttcccacttttgcgcccatcattttatagaatttactgatatagatagaggcaaaaagcggatgtacaataacgagggagagattaaaaatctggtcctttatccattttttataatacataaaactgtataccggatagatgccaggtttcatattatactgtaaaatcctggtcaggatacttaccactccgataaacaataaaatataaacggtagaaagaatcggagcctgccacagataatagaaactataatcagctgaacgctcgtccagataatacagagtataaagtgtgggggctaaaggtaaaacaataagaagaggaaagaaaaacaatgaacaggcatacagtaaagcaaaacggtttctttttctcgcagaagccagcgtaggtgcttcaatttcttcaccggattttactcttaccttttcagccggactgccgttccatacttctccaaatcctatttttcctccttcattaagacagcttaaatcctgaagttccccgaattcctcaataacggtatctccgcatacaatcacggaagatccaagataagcgtgcgctttgatatgtacttttctgatctttaaaatcccattctctacagaagcattgtcaatactgcagccggagctggtattcacatttttatctatcgttacaagatcttcggcagcgataggaaggaggcttaactgagcgctcggatctacttttactccaagaagcctcaggtatttcggatataacggtgtttctacaataaattctgaaggcatcagtcgcttaatcgttttccaaagccaccacctgaaataataccatccccaaagcggataatctccttcttttatttttccgattaccagccattttgtaagaacaataatgattgaatatacaggtggaatcaatgtataaagtaaaacagcactcagtaaagcataatgtaatccgtacccgttaatctggaaataataatagctcagataagggaaaaagatctgaatacttaataaagcaaatacaaccagcagactgatcgtctgggcaagattacaggcaatatactgcaaggttgaaaccctgtgaaacggttcctggcgggatgtcgcctgagtatgcttgtttttgagaaactcagaataaactgacaaaggacggttttcataaatctctttcagtgatgcagtaggaatacctgctttttgacgaagatgggaaactaatgttgccgccagcaaggaatgtccaccaagatcagtgaaaaaatcctgggtgagattgatttcttttcccggaaatacccatttcagtgtctggataagtttttcttctatcggagcttcagaatcaatgttgatttcttcgtttttctgatgaaccgtgaaactttcaggaagaggaagccgttttctgtcgattttaccacttggcattcttggcatttctttcatcagaacaatagagatcggaaccatgtaaggagccaggaattttgcaagttctttacgcatttcattttcatcgaaagaagattcgttgctcatgacggcatatcccacaagttgtccctgtccatttgaatcttcttttacggctacagcagctgaagaaacatcatgcagctgattgagccgtgattctatctcgccaagctcaattctgtatccgcgtaatttgatctggtcatcaattcttccctgaaaatcaataaatccatcttcgcgtatgataacagcatccccggttttgtatattctgtctccgggaagatcttcaggaaatggattggctaaaaacttctgttcagtaagttcaggaagattaaaatatccgttgcttactccaggcccggaaatgaccatctcaccacgttctccccgtggaacaatattcatgttttcgtcaaccacagcaatatgataattgggaagaggaagaccaatggtcagttcctgttgtccattcagttcagtcatattggatgaaactgttgtttctgtaggtccgtagctgttgatgaatactctatagggcttggcccatttttcctgtacctgttttgtacatgcttcccctccggtattgatgaacctgacagcaggaacttcgtcgataatggccagaatactgggaactgcatgaaggacggtaattttatttttggttaaaacatcgctaagctcatcgatcgcttttacagtggtggcgtcagcgatccatatggtggctcctgcaaaaagactgatccacacttcttcacaccacatatcaaaagaaacagaaaatccctgatatacgatatccgtatccctgatttttataaaatcctgctcagagcggattaaatgacaaatgttccggtgggatatcggaattccctttgggtttcctgtgcttcctgaggtaaacaatacataagcccagttgtctggtgtataattgggaacaggtgcaggaaccggatgttgaggttgtggtgcaatatctaaaggcttacaatgaatatgagcatccgtgtcagaaaaataagttttgacattaatatctgtaaaaaccttttttatcctgtcttcgggcatttcacggtctaatggaatgtaagcggcaccggctttaagaattccaagtatggctacaggaagttcaaggcttctcggataccatactccgacacggtcgcccggctgtactccatgatcttgcagttgaagcgcaatggcattactccagctgtccaattcagcataggatatttttttatctttaaatataaaggctgttttgtctttatatttctcaaaggtgggaaccaataattcaggcagaatttcatctttgataaactctgggctgatctttcctaaaatcaggcttttcatcatttaaaatttactaaatagggtacttgggatgttttaataaatatacatatttctcacaatctttcaattcgttttttagttgtaattttgcaggaattaattcaatcaactgaaattaaaaatataattttcatgcttactattttatcgcaacttttttctcttgtcaacgaatggatcaacgaacttagaaacgttaatatccagcatgaccggatgagattcagaaggaatatggagagaatcggggagattgccgcttttgaaatcagtaaaggactggagtacagggaaattgaaattcaaactcctttagatacaataaaaagcagggaaattgctgtacagcctgttattacaactattttaagagctggtgttccgttatttgaaggaatccttaactatctggacagagcagactgtggttttgtggcagcttacagaaaacatgatgccaacgattatttctcaatcaagcaggattatcttacttgtccaagcattgaaaacagacctttgatcgttgcagatccaatgctggcaacaggcgcctctttaattgaagccatcaaagatttgctgactcacggaaatccaacccagcttcacattgtagccgctattgcttcaaggcaaggtgttgagactattcagaatgcctatcctgaggctcagatctgggtaggagctattgatgagcatttaacctctaaaggatatatcactccgggactgggggatgccggggatttgagctacggagaaaaacttcagcgataattttaagaaagattccagaaatctttcattaagtttaacaataaatcaggccgtactttatccataggatgtttggtatccggaagtacggctaattttgcatcaggaagacttcggtaaatatgggcgctttcctcgatagtcaccatattgtctttatctcccaccatgacctgagccgggatatttatcgtagcaaaattattttccaaaggaggatttttacccagatcaatcattagtttagcaatagccggaagaagtgctttccattttgctccatgttgtgattccaaaagccgggcatactgagggattttctcaagaatgacatcaggattaagcattttgctttcctttaaagcctgttcttcagtccaggcaaacttagttcccagagtcataacagaatttatattttccggatttttcatagcatagcaaagagccacatatcctcccatgctatgcccgaaaatggatacatccgccagattatttacttcacaatactccgaaagctcctgagtgtacttttcaatactaataccttctgccggtaattctctatttccatgacctgaaaataaaggggtatgtactgtaaaatactgagaaagcacgttcagataaggcgcgaaaatatcgctgtgtcccagggctccgtgtaataaaagcagatttggcatagctatttaattttctgaaaattagcgaaaagaattgaatggtgaaaatggattaagcagaagtgtgagagggtttgagagttggagagcttggaaatatttttgaatataactcgtatcccgaacctcgtattaaacatcctcagccatcaccaaaacacttaccttattgtctccggcatttagaatctcccatgcaaccgatgaaactgtattgcctgtggtgaaaacatcatcaatcagaaggatatgctttccggtaacaggccgggtgatggagaaagtattgtctgtttccaatctgtgcttcttgtctttcaaagcctgtgctttggagtaatgatttctcctgattaattcatgatcaaaaggaatgtgataaaatttagacaaagtttcagtatataaatgaagctgattgtaaccacgttccttcagtttttttggatgaagcggtacacttaccaaaagatcaggattgtcgtcttggaaatccaggcgctccgttgtccagtctgccagaattttccctgttttttcgcggcttctgtattttagttcatgaataatcttgcggcttaagccttcctcctcgaaccgtatcaatccaaatgcattctcaacaggaaaaaataaactgcatttttccttaatcggattatttttaaaataattgtaatgggtaaaataaatctggctgaaacaaagatcacaaaccagaatctcaggaacaatgatcctgttgcagtgaaggcaacggttaggaaataataaatctaatatcatagtgtgtttttactaagatataaaattaatgtcaatttttgcttcgcaaagtcaatagtgaattattattgttcacgaattttatgagctaattattttatttagcatgaggcattttcgtggctgagtggaacgccatagcgaccgaaaagctattaaatagtatagaaaacttcgttaactccgcgtttagaaaaataacttatccgtgaatttcaacagcaaatctattattcataaaccttaatctcgcattccgaacttcgtataaaaattcacaagtgaagcgcattgacgattcactatttatctattaattctcaaatttcctcctgattttctccacagaactcttcatactcatgttaaaatgttccttttccagccttaccggcggcgcttgtcttacttcgcagtcagcaatactgcaggattcacaggtaacccctacattgatggtttttaaagaaggagacttgataaaacctatttttttgatcgtttgggaattcagtaaaatgccgaggcaatagcttctgttgcttccatctgaaaaagggtttctttgtgaagtggaaatcaccagatagcttattccctggtctttataatgagaaatctgggcgtcagttaaagtttcattttcctttaaatgatcaagatttttcacagcaatccatcttctgcagtaatgctcattggtggcattggcgtgaggagcctgctgatggttgagatgaagctcctttaaaatctggattttatcagaatttttcttttttaccaggcataaataaaataggtctttaatacccatttcagccgaaagaatattcgttagccggtaatagaatgtttcaggagaatgggtgaagctgttaatgagattttcaaaattttccggttcccatttattttgctggaaaaattcagaggctttttcgatgacaggttgttttgaaattaataaagctccggcaaaataagacgcataaaaattattcagaatttcttcaaaactcccgaaatcaagccatgaatatgtgttgggacggttttttaactccagcacattgaaaccgatttccttagcaaggataaatgttttctgatccttttccagtttatgattcagcagtaaaagttttttctcaggaataaaaagtgagcgcagattatccaaagtgccatatttttcaaaatcttcagattgaatcttgtaaccaaacttttctccaagaattttttccagaatgtctgactttaaatttttcccggcctgtaacttgttttccttcgtgaataagcttaccttttcttcaatttccgggaaataattgtcgtacaattcctgaaacgatcttaaaacggcaaagtaaaaccgttcttttccaagattataattctgtgaaatttcaatcagtgcattgataaaagcagttacttttttgggggcatcactgatgatactgatgagattatttttgttgattccgaatagttccaacggaacttccttaaagaaatcagattgcagaatttcattgaaaggagccaggcttttatcaagtttggtagaaaccagatcgtcaaatgtgcagctcagcgcttcagaaagctggatgatcttgtcatgctttggatattttttaccattctcaatttcattaagataagattttgataatcctgtctttacggcaaggtcctgtagagaccagtttcttttctgcctctgctgtttcagttttagtccgaaaactgttttgataaagtcgctttctgaattcattactcaaatataaataaatagatgcgattattcgcataataatttttaaataaatttagcgaacgttcgctatttgtgaaaatttttgtttatgtttgtaacatcaaatcacaaaatcaataagttatggaaaccaagactcagttagaaataaaggctcagaagcagtttgaagcagtttttactccggatctggtagattttctgattgtgcttcatcagaatttcaatcataaaagattagagcttttagaagaaagaaaaaaaacacagcagaaatttgataacggtaaccttcctgaatttttaaaagagacagaagctatccgaaacggaaactgggtgtgtgcaccgctgccggaagatttgcaggacaggagagtagaaattaccggacctgttgatcgtaagatgattattaatgccttgaattccggagcgtctacctttatggctgactttgaagatagcagctcgccggtgtgggaaaactgcattcagggacagattaatctttctgatgccattaacagaaccattgattttgtcaacgaaaaaggaaaagcatatacccttaatgacagaactgctgttttgcaggttcgtccccgcggccttcatcttccggaaaaacatattgaaattaatggagagaaagcttccggctccctgattgattttggaatctatttcttcagaaatgcaaaagtgcttttagaaaatggaagcggtccttatttctatctgccgaaactggaacattataaagaagcccgctggtggaatgatgtttttgtttttgcccaaaattatttggggattcaggaaggaacaatcaaggctacggttttaatagaaaccattaccgcatcatttcagattgatgaaattttatttgaattaaaagaacacagcgccggccttaattgtggcagatgggattatattttctcctatatcaaaaagttcagaaacctgccggaatttatcgttccggacagagatcaggtgaccatgacttcacctttcatgagtgcctattcaaaaagagtcattgaagtctgtcacaaaagaaacgtacacgcaatcggtggaatggccgctcaaattcctgtaaaagatgatgaagaagcaaacaaaaaggcttttgaaaaagtaaaaagtgataaggaaagagaagtgaaaaacggtcatgacggcacatgggtggcacaccctgcattagttgctgtggctaaagaagtttttgaccaatatatgccttccagaaatcagattgataaaaaatttgaatatcatattacagaaagcaatctgctggaaattcccaaaggtgatattaccgaaaaaggagtccggaaaaatatcaatgtaggaattctttaccttgaaagctggctgatgggaaccggtgctgccgccatttacaatctgatggaagatgcggctactgcagagatttcaagaacgcagatctggcaatggctgaaaaatgaagcggtgttaagtgacgacagaacattgacccgaaatatggttctgcagtgggaaaaagaagaaatggacaatattgaaaagtatgtaggagaaacccgttttcagaatggaaaattcaatcttgccaaagaacttttcaatgagttgattttctgtgaaaagtttgaagaatttctgactcttaaagcatatccttttatctagtttgagaataatatcccgaaccccaaaatctaatcaaacaaaatccaaatattatgaaaacaagacaagaacaaatccaggctattgagcaagattggctgacaaatccacgctggaacggtatcaaaagaccgtatacagcagaagaagttctgaaacttcgcggttcttataccatagattatacaatagcgacagaaatgtcaaaaaaattctggaataaactaaatagccaggactatgtggcagggcttggtgcattaaccggtaatcaggcagtgcaggaagtagatgccggactggaagcaatatatctttcaggatggcaggtagcggcagatgctaacttatcaggggaaatgtacccggatcaatcactatacccggctaattcagtacctgctgtagtaaagaaaattaataatgctctgttaagggcagatcaggtacagtctgtaaacggaaacggtaataaagaatatttagtgcccatcattgcagatgcagaagcaggttttggaggtaatctgaatgcttttgagctgatgaaacaaatgattgaagcgggagccgctgctgtacattttgaagaccagctttcctctgcaaaaaaatgcggacacttaggtggaaaagtactggttcctactcaggaagctgtcaataaactgattgcagcgcgcctggctgccgatgtattgggagttccaagccttattattgcaagaacagatgctgacgctgcagatttactgacgtcagatattgatgacagagataaaaaattcgtaacaggagaaagaacttcagaaggattttatgttgtaagaaacggagtagaacagggaatcgacagaggtttgtcttatgccccttacgcagacctgatctggatggaaacgtccaatcctgatctggaacaggcaaaaagatttgcagaaggaattcatgcgaaattccctggaaagatgcttgcttataattgttctccttcctttaactgggcagcaaagctgagtgtggaggaaatgtctaccttccgtgaagagctggcaaaaatgggatataaattccagtttattactctggcaggattccatgctttgaatactgcgatgtttgaactggctctggcttataaagaaagaggaatggcaggatattcagaacttcaggaacgggagtttgccttacagcagaaaggattcagagcggtgaaacatcagtcttttgtaggaaccggatatttcgatgaagtacagaatattgttacaaacggctcttcagctacagttgcgatgaaggattctacagaaactgcacaattccattagtcatttttttccatatttttttgatgttaaaccttctctgttttgggaaggtttttctgcattatacataatcaaaaattgagttatatttggggacgaaaaaattattaaaaatgaatttaatcaaagtactttttattacattaggattaacacttactgcaaatgctgcaaaagcccaacaaaaaattggaagcgtgaatactgatgacatttttgcaagtttacccgaagtaaaaacaataagtgcaactgtggataacctgacaaaaacaaagcagactgaaattgaaaaactgatcggagattatcagactaagctgaaagcagcacaggataaagaaaaaactcttagcgaagccaacaaagaagcagtcactaaagaattgatcgctgcacaaactgaattacaggggcttggtaaaaagatagaagattcgagagctcaggctgctaaagatatttctgcaaaacaaaacgaattgtttacgccattgcagcaaaaagtaaaagaggctattgctgctgccgctaaagaaagaggcatcaattatgtttttgatattgcatctcaggaaaccaataaccttgtttacaacgacggaagtgaagatatcacagcgcttgtgaaaagtaaactgggagcttccgcaacaaccgccaagccaacagggaaatctaaataagaatttatatactgaatatagaaacggaatcagcagagctggttccgttttttatatgtaaaagtgtgagaaagttcagttttaaaataataaatttgagtaaactttcaggagaatgaatttaatgtacgaaaaacagataaaggtaactaaggatcatatcgaccagaataatcatgttaataatgtacagtatgtgcactgggtagaagaagcagctgcagagcactgggatctgttaaaacataaaacagaatatgcaaatgatgtctggatgcttctggatcaccatatccaatataaaaaacaggtttatctgaatgatgtcattacagtaagaacctatcctctggcccctgaaggagccaaacagccgagaaaagtagaattttactgcaatgatgagcttgtggtagattcaaggaccctttggattctgtttgatcctgaaacccaaaagataaaacgtcttgaaagcgactggctggagaagtttttcaattagaataagatgtgaagtaaaacgattttaatttgttaaaatggaatttgagtataaaaagaataaaattttaggcaatttgatactggggtatttttatctatgttttactatctttattactgttatgattctacgtaacattagccgggagtggaatacgctttcattatcaaaaatattttcctctattattccggtttttttgttttcttttcttacttatctctttttaggaacggctctgatcagaagaaagtattacctgcagaacttaaaagaagaagctaaaattgatcctttagaaaagcaaattatcgtattggataaacagagcagaaaaggaagaagaatagatttcaataaggttaaggctgttgaattgtattattcatggaattcaaacgccttttcatcagatctgggatattctaaaattgtgcttggggatcatgctaaacctgttttgattactcagaataatattaatcaatactatatttataaagcttttaagaataaagtaactgtaaacaagtcaagatttgcaaataatttataaagaaatagagtggagtcaatttcttatgctgctggctttaaatttgtaactaacgaagattaattgtcaatcaaaaattaaaaacacatgaagcttttatatttccttacattgttgttaagcattgcaagctatggtcaggaaaacccttactggtttacagatgatattaaaaagaaagtggcagattctacccaaagtcaatcctggcgaagtcagatggcagcaacgtattactcaataagcggacaatataaacctgcactggaaagttgggacacgacttttggaagagtaaagaagctgagcaaggcagatagtctgagatttacagaattaatccccgtcaatgcaaaagattatcttttaaaaaaagcagagagtgagcagattattatcattaatgaagcccatcataacgcgagtcacagaacttttgtatcctccttacttcagggattatatgataaaggttatcggtatctgggactcgaaacattagtgagtgactctgtaaacgttacaaaatttgctgttcttagcagtggatattactccaaagaaccggaattcggaaaccttatttacaatgctttgaaaattggattcaggcttttcccatatgaagcggaaggaaacaataaagaaagagaaattggagaggcgaaaaatatttttgattttatgcagaaaaataaagaggggaaatatctgatctattgcggttatgaacacgcttatgaagggactcataaatcctgggagaaaacaatggcgggaagactatccgatcttaccgggatcaatccgtttactgttgaccagactcagttttcagaaaaaagtaacctgaagtataatgagccgcttttaagattggtaaataataatgttcctgttgttttaaaagatcaaaatgaagaaatatataacgatagtgacaaaaaactttataccgatattaaaatcatccatcctgttacaaaatacatcaaaggcaggccagattggatgcttggagaaaaccgtaaactgtataaaattccggtttctaaaatttcaacatatccggttatggtttttgcttacagaaaaggagaatatgagcaaaatggaattccggctgatatccttgaacttaaaactcccaaagagagccgttttttaatactggataaaggcaattatgatattgttataaaggataaagaatataaagtccttcaaagattcggaaaaaaaataaaataataattaacattaatgatcagtccaaataatatttaaaatcgctgcaatagaaacagtcttttctgtgttaagcggttttgtcatatctttgcagtatgatacgtattacaaaaatttttacattcgaaacggctcacgtactttacaactacgatgggaagtgtaaaaatatgcatggacattcctataagctgtttgtgacagtgaaaggaaaaccgattaatgatattgataaccctaaaaacgggatggtagttgatttcggagatatcaagagtatcgtaaaatctgagatcgtagatgtatgggaccatgcggttcttgtcaatgcactttctccacacaaagaattgggagatgatctggagcagaaaggacataaagtcatctattgcagtttccagccaacctgtgagaatatgttgtacgcgatcgccgctaaaatcaaatcaaaacttcctgaaggaatttctttagcttatcttaaacttcatgagacggaaaactcttatggagaatggtttgctgaagataatcaataatttatccacaaaactcagaaggtgttaaaaacaacaattaacttagaacctggaaaaaaagtatatttcgcttcagatcagcattttggtgctcctacgccaaaggaaagtaagttgcgcgaggagcggtttatacgctggatggacgagatcaaagaagatgctcaggttttatttttaatgggtgacctttttgatttctggcatgaatggaaacatgtcattcctaaaggatatgtccgtgttctgggtaaaattgcggaacttaaagacagaggaattcatatttatttctttgtcgggaatcatgatctgtggatgaaagattatctggaagaagagattggctgtacggtattctatcagaaacaatattttgaaatgggaggaaagcagtttctgctggctcatggagatggtctgggaccaggtgataaaggatataaaagaatgaagaagttattcacgaatcccgtagcacaatggtttttcaaatggcttcatcctgatattgcgatgaagatcgcattatacctttcccaaaaaaataaaatgatctccggagaagaagacaaagcatttcttggagaagataaagagtttctgattatttattccaaagaaaagctgaagacgcagaagattgattactttatctacggacacagacatctgcctatggtgctggatctggaaccgggtgcaaaatatatcaatctcggagactggatttcctattttacctatggagtatttgaaaaggattttgaactgaaaacttttgaaaaataaaacaaaaaaattacctctaaaaagaggtaactttcgaacgggtggaaaacccactcttgtttttaatccatattccggataaatgattgcaataagtttaccaaaataggttttctacattaaaaaattattaaataaaaatactgtatcgctgtaattactttgtagtaagggattaagaaattcaaattatggaactgaaaaaaatattcaacataaaaacggaacaggatttcctgaatgcatcattgaaaacatttcgttatcaatatgaaaatgttgaaatatacaggaaattcgttgactttctgaatgtgaatcccgatgaggtagacagcctggcaaaaattccgtttttacctatcgaaatgtttaaaaaccatcagattcttgataaaaacgtagcagcagatctgtattttcaaagttcaggaaccacacagatgaatctttccagacatttcattgcagatccggaattatatgaagaaagtatttataaaagctttgaacaatttataggaaagccggaagattttattttccttggcttgctgccaagttatcttgaaaaacagcattcatcactgatctacatggtagactatctgatgaaaaaatcaggtaagccggaaaacggatacttcctttataaccatgctgaactttttgatctgttgcataagcttcaggataaaaaggtcattcttttcggagtttcctttgccttattagactttctggattattgtcatgctgagcaaagcgaagaatctttcaattttcctgaaaatctgatagtgatcgaaaccggaggaatgaaaggcagaaaagaagaaatgacaaaagatgaattgctgaagatcttacaaaaaggccttaaaacagataaaatatactctgaatattccatgacggaactgctttcacaagcatattcccttgggaataacgagtatgagtgcccaaactggatgaggatcatggttaggaatgcggaagatcctttagcttatgaaaaagaaggaagaacaggagctattaatataattgaccttgccaatatccattcctgttcatttattgcaacgcaagatctgggaaaaataaccggagataaatttcaggtattaggaagaatagaccattctgatatcagaggctgtagtctgctcgtaagctgaaatgctgaacaggcaatggtgaatagtcaatttgcttcgcttgtcaatttttgtataatgataacaaatataaatagcttataactttgctgagtgaaacgcctttgcaaatatttttagggagttggtaaattaaaagctttgtgaacattgcgtttacaatatttgctgcattatcattaatacattttaccttgtacattttacagtcataacaatgatcaaaatagaagaactcatacacgcgtacattcattcccactgcgattttgaaaaagagattgtactgacgaattattttcaggcagattgggaagctgatatcctgatcattgatgcagaaggcggcagtcacgaaattgaaatcaaactttcaaaaagtgattttaaaaatgatttcaaaaaatcatacctgaataaagataccggcgaaaaatttctgaaacatgataaaatttcctgcggagattatatgtgtaattcttttagctttctgctaccgatgggaatggtagatgctgaacttattccggaacattgcggaattattgaattctatcataatgtggacacatgggaaactgagttttacccgatccgccaacccagaaaactccatgaagattcttactggaaactgaatgataaagatcttttcatcagaaaaatggccctgaatcttcttcagcgcaaaatggaaatcaaaggaaagcatgaagaactgatctttaaaaatccttttgaaatcaaaaagctgaaataagataaaaaaaatttttttaacgcaaagtttaatttcttattgatatgtcttaaggatgcaaaaaaggaatcaatttcattgattcttattaagcaaacattacaattagcttcatcagcgacgtagtcgtagccactttgctgccttgaataaaagctctccttcataaaaactttgcgtttacaaagaatttaaaaacaatttattcaaaatcaaaaataataaaaatcctgccgcctgacaggattttatcattgaatgttatttaaaattaatctgtaatttcagctgtgtctctctgaagtaggaacttataaatcaatcctcctacaactcctcccaaaataggggcaacccagaacagccaaagctgcgacatggcaattcctcccacaaaaactgcctgagaaagtgatctcgcagggttcacagaagtattcgtgatcgggatggaaatcaggtggatcaaagtaagagcaagaccaatggcaagaccggcaaatttaccgttagcccatttgtctgtagcgcccataatcacaataaggaaaaatgctgttaataaaaactcagccaggaaagctgcccccatgctaaaagcttttccattgtaaacagcctcaccgtaaaagttcgtggcgaaatctccgggtttcgagaattctaccgctccggctccgttaaggatcgtatacagacatcctgctgctacaatcgctcccagacattgtgctacaatgtaaggaataagatcttttgccggaaatcttccacctgctaaaagtccgaaagaaacagccgggttaaaatgtcctcctgagatatgtcctacagcgtaagccatggttagaacagtaagaccgaaggctaaagcaactcctaaaagtccgatgccaatatctggaacaccggctgcaaaaacagcgcttccacaacctccgaaaacaagccaaaatgtgccgaaaaattcagcgaaaagtttttttatcatattgtttattgtttaaagtatctcaaatgtaaaatttaaatcttaaagtaaaaagataaatctgaaaaaatatttcaaaaaagagagaacaaaaattacaaaatctgtaatttggtgtaaagtttgtttgggatttatttagagagtattatagtcggttttgaaagatataacataaatgttttatctttcatttgtaattttaaaggttggtgaatgagaaagtttttatgtgtggtctttgtaccttttatttatagtttacattattcccaggcagcaaaaaaagcttttccctgctatgatcttgccactgtattgaaggttgaacctacaccactttataaatctcacctcgatgcttctaagagttttgggctaaagctgctgaaagactccaaaacagtacagaaatacatcaatagcggtaaattccacaaaataaaaaagtcaggaaaagggtaccaggttcagagacttgattacagcaggccctatatggtaaccaaagcaaaaaccaccctggaaaaaataggatctaagttcagtaaggatacaaaaggcggtacatttactgtttcctcaattaccaggactcttgaagaccaatgcaggttgagaagagtgaattccaatgcctcacttgggattagttctcacaattacggcaattcctttgatatttcttacataagattcaacaacgttctgaagtacaatccaaaaatggaaatagcgctggagaaagttttaaaatattatgaaaaggctggtagaatatattatattaaagagaaacagcagagctgttatcatattactgtgaaaaattattaatcaaaaccctcttgcatagcatctttagtttatctatttttatacgactaaaaactatgcttatgtcaacattaaacattgtagattatatgctgcctgtagaagaatgcagagcagcatcaaatgagtggaaagcatccttttctgacttttcaaaacttcaaaaacttattcctaccaattacgtatttaatatttccagagaccaccttgagtggatgaaggggttcagtgattataaagacttttgtgcggcagtcggaatttacagagatcgtttgatccttattttttatcctatgaataacgatggcgggaaaatagatctgaaagaatatccgtacagtttccttactgagcttgacagagacctgaaattacaggaaattcaggaatatacggttatcagaaatgcagttctttctaaaaatctcgaaagcactgagaaaaatatgaacatgggattcccggtaaccagtacgccgattcttgagcaggatatagctgtagaagcaattcaacgttggagaaacgaaggaatggactggttttataaagagagcagagaaaacgaaggaagcggaatcttcagaaaattctatgttccaacagcagacctttgcctttcagatgaaggactggcaggaattacctgttctttcgggatcagatacaatgatatttatgggaagatgctcgtaacgcttatatttatctcttttcgtgaaaaccttagaaatgcagaactgggtgtagataccatctccaatacctatgactgggccaagccatgtccgccaatctgccgtataccggatgtagatgtaggttgcgaattttaaatgatacgctgaggaatggctgaactttataagacaattttattcctgaattatgcactgcttctgtctgttatactgctgggagcagcaaaataccgcatattaactactaaagaaaagcagtattatcattatgctgtttttcttttttttattgagctgctgaatctggcgctgccttatatcttcagtcttaatgatacctcattcctctatcctttatatatcgcaggagaattttttctactggccggcttatttgttagaaagctggattggccaaaatcttttttgggtcttgttggtatactcgcggcaggctttatgatctcaaaatacggattcgattaccctgcaaatgctgatattgcaaaagtagtttccaatatcatgatcatctgtctttccggttttaccctgatccgggaaattaaaaatacgtctttacagaaccgttttcttcttgcagatgccagtatttttttctactattccgtttcggtatttatttttatcatccagcaccagatcgccaacctgtcagaaaacgattattatactattctcagtgccaataatattctttcgagtattttgtactgttcatttttatatacttttttcagattaaagaagtaaccttaaatatcaacctgctgatccttataattgttaccataacagttatagtatcctttattctgctggcttacagaacctttataaccagaataatgaaggaaaagaatgcacagcatgaggcggaagttcttcaccagaaaaaactggttctggaaaacattaaagctcaggaagaagaaagaaaaagaattgcagtcatgattcatgatgatatcggaaaccgtctcaatattctttctttatggctgaataaccttgacacacaaggcgatgagcagatcaaaaaaaatatctatggccagatgtcatcactgattgatgctgccagaagtatttcccattcattatatcccgttaatctggaatcggtagggctggttttatatgtagaagaactgattgcaaatctttcccataaaattaatatctcattgcaggtaatgccgggatatgagaagaaagacctttttgcagaagtacagctgtacaggattattcaggagtttactaccaatgtgatcaaacactcggatgcaacggatctttggatttacattaaagattatccggaaaatacagcagtggtcatttctgataacggacaggggtttgaatatgaagaagtgaaaaaaggaatgggaatcaaaaatatagaatcccgtatcaaatcaatgaatgccacgcacaaatggaaaaaaactttttcgaataaaggaagtcgtttaatcataaaaattccaaaatatcatgagttcccaaatcaaagtagcactgattgatgatgaacagctgatcctcgaaggagtaaaaatgttgctgtccaatgaaaaaaacatatcggtaagtcttaccgctgataatggccccgattttatagaggacctcggaaaactttcaaaagatgattttcctgatattgcccttatagacgttcaaatgaaacctatgaacggctttgagctggtagaaatccttaaggaaaaatatccggaccttaaaattattatactatcttcccattacaaaacctctattctgggctatatggtcaagctgggggtgtccgcatttcttcctaaaaactcaaataaaaaaacttttattgaagccatcacaatggtggataaaaacggggttttctttactgctgaagaccatcagatgctgttcacctatatgaacagttcagccaaaaaaaaatctctttttgaaacagaagatgaactttccgaaagagaaaaagatgttgtaaagctgatctgccaggaattgaccaataacgaaatcggagaaaaactgttcatcagtccaagaactgtggaaagtcacaggcagcgtattctggaaaagataggcgctaaaaatacagtaggaatagtcatctatgccattgtcaacaatatttactcacttgaaaaaatataattggattccgtagaaatacggaattttttatttggtacttttcactctagccagccttgtttttcttctgttattttgaaatgtctctttcagggatcttagtaaaaaaaaacacaaacacgatctgtaataaaaaattaaagtaaagcatgagtggcagcagagtgatttccgtcgggattttctttgacggtacaggaaacaatggggcaaatattctttcagcggataaaccgctgaataataatgaaagctattatggaaccttcaccaatatctataaattatacagtttattcgttggagatgaaaaaatatatattgaaggaattggtaccgtaacaggtaatgaagataataattttgcaatagcaacctgcgcaaatccaccttatggaaacggatattcttcagatgataaacttcagaaagccggggattttgtacaaaatatagttaagaatgatgctgcggaatatcacttttacctatatggattcgggagaggaggaatgctggccagaaccttctgcaatcagcttttgactgattatgcaccggaaaattgcagaataaaatttttaggtgcttttgataccgtagagtccaaaccttttaatacttataatatgagtattgcgcaccgtgtagaaaatgctttgcacatctgtgcggtcaatgagagcaggtttttctttccgcttaccggtttctttgaaaactcaaaagcgatgcaggatcagaaatcacaaaccaggtcatctgtttggaaagaaatctttgtgccgggagaccatgctgatgtaggaggtggatatctggaagggccgcaatctgtatatatttccacagagtttatcaataccgatgatctgcataggtatatttcagaaataagaaatacaaaaacggatacggatggaaataaaatatgggatgcattgctgtcaggatatgaagttgagacagtcaacggacttgcaaaagcttatgtttgccgagatagagtgtataatgagctgtcaaaaatatatggaaagctgatgatggatgaaaccaatacaatatcagctgtgtttagtgccgggaatgaagcttatttcggaacaggctataacaggcattcttttctcgatcggttttatatcaaaatgaaagaatatatcaaagatctgtctgtgaacaaaaagccggtttatgattttggaaaatttgcggattatatccatatttcatcaaactttggattgtacagtgacagttttcggtatagaactcaacgtgaaattaatattgagctgatcaataacggattaaacgtttcaagcagtacctctgttgatcagacgagctgtacgagactttctgcagaacttcacctgccggaagacagttttatagccgactttctctatggaaccaacgtcccgaataatgatatctggatccgttccattttaaaagcaccggaaaagatcacattcagtgaaataaataagtagtgccaacgcttctcagttttaaatttaggttaggagacatctgatggtgtctcctttttttaagcctcacttctatagaagaaattgatttacaacagaccgtttttttatttctgggctattcatttctttttccgtatttttgccggcgaaaattcattattcattactaattataattaagatgctttcggttcagagtttaggattacatcattcaggaaattatttatttcaaaatgtcaatttcaccattaaaaaggatgataaagtaggtctagtaggtaaaaatggagcagggaaatccactttattgaaaatgctttccggagaaattaatttctatgaaggagaagtggtgacagaaggaagtattaccattggtttcctgaagcaggatcttgacttcgtaaaagggagaacggtttgggatgaaaccatgcaggcttttgaacagattaatgcctggaaaaatgagcttgaagaagtcaaccacgagatggcagtcagaacagactacgaaagtgattcttatacggatctgattaataaaatgaccgagctgaatgatcttttgatgaaccatgatgcctacaatcttgaaggtgatatggaaaaagtgttgtttggtttaggatttaaagcagatgatttccagaagattaccgatgaattttccggaggatggagaatgagaatcgaattggcaaagctgcttcttcaaaagaatgacatcatgcttctcgatgagcctaccaatcacctggatatggaatccattatctggcttgaaaacttcttaaaagattatccgggagccattgttctggtgagtcacgataaacagtttatgacagcggtttgtaaccgtactttcgatatcaacaataaaaaggttgacgattataaagccaactattccaaatatctcatcatgagagaagaccgccgtgagaaactgattcaggctaaaaagaatcaggacgcggagatcaagcagatggaagataatatcaataagttccgtgcaagtgctacaaaagcttctttcgcacaatcgcttattaaaaagctggataaaatagaacgtattgaagttgataatgaagacgtttcaaaattcaatatccgtttcgtacagtctatggttccgggaaaagtaatcttcgaagcggtaaaccttggtaaggcttacggtaacaaacagatttttgataatgtagatttcatcgttcagagaggagatagaattgcccttttaggacagaacggacagggaaaaactacactggctaaaattcttgctggagatatcaaagactattcaggaacctggaatcttgggcacaatgttaatatcggatacttcgctcagaatcaggaagaggtattaacacctaataaaacggttctggaagaagctgaagatgcagcaacggaagaaacaagaccaagagtaagagatttattaggatctttcttattccagggagatgctgttaccaagaaaacaaaagtactttccggaggagagagaaaccgtctggcactttgtaagctgttgcttcgtcctttcaatacactgatcatggacgaacctaccaaccaccttgatatccagtctaaggaaatcatcaagctggcattgcagaactttgaaggaacacttattgtgatttcgcacgacagggaattcctgcagggactttgtgataagatctacgagttccgtgacgggaaaatgaaagaattccttggagatatcaacgaataccttgagtacagacaaaaggaaaccatcagggagatttctgcagaaaaagccaagcttcataatgaagtgaaggaagaacctaagaaagttgaggaaaaacctgttgtagttagccagagttcaaatattgtcagcaaggaacagaaaaatattcagaataaaatcaagaaagtagaagaaagaatttctgagcttgaagccaaaattgaagaaatggaagcttcttttgccaaagaaaatccttcagacgaaaccctggagcagtataataaagctaaggaagacttagatacggcattgcaggagtgggaatacttaggaacccaactggattaataaaaatataaatgcttcatcaatttaaaaggatgaagcattttttttgtaacggaattctcttcaatacaacttattatctatagtcattaagtaatttaataaaagtttaagggaacaattaaattattttcataattttgaaccatgattaaagaaagcagaaatttaaagcgttttatctccaggctgttgtttggagtatatttcctcgcgctgctttctcaaagctttcaccatcacgattctgtagattattttaaggcttttcattttaaaaaagtcgagaattcggtgacgaaagccgttactaaagagaaagctggcgactgtctggcctgccactttttggttaccggacatacattagctcctgaagaattcagttttacttttgagcattacagccatgaagtaaaacaaatcatcgccatccaggagaaaatctggtctcagaccaaattcacctttcagcttcggggaccacccgcactttcataattcacagattctagagggtttaaagtttttttagtttaaagttcaatgtttgatgttcaaaggttaaaactgttggaaatcatttgataatgaatattattaacgatttcagtgactaacttttatatcccatcattaatacattttactttttacacaatgtacagtttacaaacaaacccttcccacaatttttaacgaaaaatgtaccttattgaaattaaaagggtacgcaatcaatctatttacaatgaaattgatatattgcctgctgctgatcttttgcggatcagtatttacaagcgcacaaaaaacctatactgtagagggaaccgttcaggatttccatgataaaacattgctggaaaatgcagtgatcaaaatcgggaactttacagccaaaacaaataagaaaggtaaattttcttttgacaaaattccagcaggaaagtatacacttattgcacaacatcctgattgcaatgattatactgaaaatataggagttgatcgggatgttcagctggtgattacactggaacaccatgtcaaagatattgaaaccgttaccatccatggaagccataaaaataatggttcattggtagtgaagactattgataaggcaatgatttcaagaaatgttaccgaaaatttagggaatttattaacaaatatttcgggtgttaatgttcttaaaacgggaaacaatattgccaaacctattatccatggcctttatggaagcagggtttccattcttaatgatggagtgaaacttgctgaacaggaatggggagtagagcacgcacccaatgtggatgttaataatttcgagcatattgatgtcattaaaggtgcatcagctttgaaatatggggccggcgctgtaggtggagtagtagttttacaacctcaggtcctgcctaaaaaggatacaatcatggggaacgtttctctttccggaatttcaaacggaagaggagctgatcttaatgtgaaactagcaaaaacctgggagaatggctgggccattaaaaccaatggaagctataaaaagctgggagatcttgaagctccggattatggtttgatgaataccgggattgagagttcaggatttaactttggagttcagaaaatgacttttgaaaaaggtttttcatttgattattatctaaccaaaagcacagtaggaattcttagaagttcccatgtagggaactcagaagatcttcgcaatgctcttacatcagcacaaccaatctatcagagagattttagttatgatattgataaccctagacaggaaatcgagcatcatattgccaaagtctctgcctataaaaggtttgaaaattttggaaaaattacagctacttatagttttcaatataatcatagaaaagaatatgatataagacgtacagaagctttgagcaaaaaaccggcattggatcttgaattgatcaccaatgatctcaatgtgaatcacctgatagaaagaggaaattggaatcttgaaacagggattaatgctggttatcaaaataactattccaatacccagacagaggcaagacgtcttgtcccgaactatgacagatattatgcaggaatttattctgtattgaaatataaaatcgcacctgagctggattttgaacttggaggtagatacgactatgatcactatgaggtaacaaaatggtatgatctgagtgactggaacaaaacctatgcagcagattattcagattttgtagtaagaattaaccaaaacagaattcttaccaaaccatctttaagctataataacatttcggtaaacggaggtgttgtttatcacccctcagaatattttgatctaaaatttaattatgcaagagtttcaaggtctcctaatgtcgcagaactttttgcagatgggcttcaccattctgctgctattattgaaagaggagatatgagaatgaaaagcgaaacaggaaatcagtttaatctggtcgcagatgttaaagcaaatgtcttaaaaggattaaatatttctgtaaacccttatttcttttatactcagaatttcatcaaccagattcctacgggatatcagaatacacagtggggtggagcttttgtagtatataactatcaacagattaatgcaaaaatgtatgggctcgatattgatgcacagcttaagattacagataatctgacctacaaaggaagtggttcctatgtctatgggcaagatacaacccatgatgtaccacttattttaatgatgcctcctaattttaataattcattggaattcaataagaaagaatggaaaggcttctattttacaataagtaacaatacttatctgaaacagacaagatttcctgtttataacgttccgatcagattattcgattcggacggaaatccttacaatgaagaagtggacatctctacacctccaagtgaatattccctttggaaccttcagacaggggtaaacctgtctaaaaatttcggaattgatttttcagttcggaatgtattcgataagtcttacagagactatctgaacagacttcgtttcttttccaacgaaatgggaagaaactttattttaactcttaaatatcaattttaattacttaaaatcaaaaaaatgaaaaatatttttaaaaatacaactcttatcttaggacttttattcttagctttttctttaagcttaacatcatgtaacagaagtgatgatgaagcagatgaccttcctcaggaagaactttcagatgttctattgagagtaacagatgttgctacaggaactccggttgtatacgactatcaggtcaatagtactactaatccgaatgttaagttaattaatggtcatacttataatgttgaagtaattttcaaaaatggcgatgaagatgctactcaggaaattaaggatgcaaaagatgagcatttcttagtgtataattttcccaattctgatattactttaacacgtacagatgatgccagctctacaagaggagacggaagccgcgtaggattgaaaacaaaatgggttgttaatactgcagtaaaaaatacttctgcacctagtcagctggttcttacattattccatgaaccggtgacagtttctgaagcttctgccgttagtggaaatggggttatttatggaacacatactggtggtgaaacagacgcacaggctaactataatattattaattaatatataccttaatcttgtttggaccgccggaatttctccggcggttttttatttaacaatatttggcgttataagttgattttaaatgggtgattttcataaaaaattcctatttttgcaacctaaaattttaatcaataatgaaggttaccgcacaaaaccatgatgacgtaagtgcattgcttacagtaacattggaaaaatctgactacaaagaaaaagtagagaagcagttgattaattatgctaaaaatgcgcaagttcctggattcagaaaagggaaagtgcctttgagtatggttaaaaaacaatatgaagcaggtattgcatttgaagaaatcaacagacaggtttctgatgcattgaacaactatgttaatgaaaacaaattaagattagttggtcagcctattcctcagccagtaaacgaattcgattacaatgctgatcaattggaagttgcttttgaagtaggatttgagcctgaattcacgatagatttagctaaatatgaagctcctcattacaaagtagaagcttctgacaaagaaatcggtaagagcattgaaaacatgcagaagcgtttcgctgagcaggttcctcaagataaaatcactaaagattcttacattgctttagaagtttctcaggttgtggaagaagatgctgaaggagaacaccaccaccacccgaaaaaccttacgattactgctgaaaacaaagaagctttcaaattggtaaaaggtttgaaaatggatggatctgtaaaagttactaaagaaacacttgcaggtgatgaagaattagctaaagaattaggattcagcaaagaagaagttgagcacttacaccacaatgaagtagaagtaaaagtaaaagacttctattcattaaacttagctgaacttaatcaggacttattcgataaagtatacggagaaggaaacatcaaatctgaagaagaacttaaagagaaagtaaaagctgaattggatgagtatttccagcagaacgctgatgttcacttcgtgaataaagtattggagcaggtaactgagaaagaagaagtaaaacttcctgaatcattccttgtgaagtggttattattctctaaccagaacatccagtctgaagagcaagctaaagaaattcttgaagctgagaaaaaccagttgaaatatcagatcatcgaaggtaaactgatgactgaaaacgaaatcaaccttgactatgctgatgtattggctcaggctgagcagttagtgaaaaatcaattggcaatctacggaatccaccacttaggtgatgaagaaatccagaagtatgctgttgaaatgttgaaagatcaggagcaggtaagacaaatttcttctgaagtagctatggctaaattaaaagatgtaattcttgaaaaagcaagcaaaaaagaaactaaaatttctcacgacgaatttttagaggaacttaagaaatagttatatcagatataaatatttgaaaaccgtcaatttttggcggtttttttatatatatcccacacctgaaaatcatgaatcattaatcaattatcaatcatcactaattgctcattattgatttgtatgtccgccaatattcctatatttaccctttaaactttattataaatatgaaaaagatcatcattccgtttttctgcgctgtacttttttcagtacctgcagcagctcagaaaaaaggggctgcatctgctaaaacagaagccgtaaaatcaaaattgacacctaaagaagtcattgataattatttcaaagcattaggtggaaaagataaactggacgctgtaaaatctaccattactgataacaccgtggctgtacagggaatggaaattcaaatgaccactaagaaattaggaaataaattcaaatctgtgcaatctttcatggggaaagaaatgattcagctttttgacggagaaaaaggatattttgatcagatgggaacgaaaacagatattcctgctgataaaattgctgatctgaaaaaaggaaaacccattgatgcattagcatttgatgcctctaatttccagacggtatctacagaaaaacttgacggaaaagactataatgtattgtcttcagataaaggaaagttttatttcgatgctggaaccggacttttgtataagacagatgcaggcgaaggaaatgcaactattaaaagttatatgacggtagacggaatacagttccctgccgaactggatgccgaaggcggaggtcagaagatgaccattaaaacaacaaaggttgtcatcaactctggagttacagatgctgattttaaataaaaaatcattttctaaaagataaaagccgggaatttcccggcttttttgatatattaatatttttaactcaaatttaactgtcaaacaggattttatgatttcttcaccttgtgaataattggtagttttaagccgtaaataaaatcgaaaaccatgaaaaaagtattatcttcatttgcagtcatttttttaatgtctgcgaatgcctttgcacagaatattcctgtggatccttccgtgcgaatgggtaccctttccaacggaatgaagtactatatcaaaaaaaataccctgcctgagaaaaaagtagatttccgtctggctatcaatgccggatcaattcttgaagatgagaatcaaagagggcttgctcactttatggagcacatgaatttcaatggaaccaaaaattttcctgataataaacttgttgactttctacagtcaataggggtgaaattcgggcaacaccttaatgcgtacaccggctttgatgagactgtttatatgctccccgttccactggataaacccggaaacctggatgccggactgaaagtaatggaagattgggcgtttaatgccacgctttctgatgagcagatcaataaagaaagaggagtggtgcttgaagagctaagattaggcttgggaccggataaaagaatgatggacaaataccttccgaagcttttatacaaatctcaatatgcggacagacttccgatcggtaaaaaagaagtattggaaaactttaagcctgatgttatccggaaatttcaccaggactggtacagaccggatctgatggccattattgtggtaggagatatcaacgtggatgaaattgaaaaaaagattaaagacaatttcagcaaatataaaaatccttcaaagcccagagaaagaaaatctttcgatcttccgaaccataaagaaacgctggtagctgttgaaactgatcctgatgctaccaattctatggtccagtttatcatgaaagatgctgatgcctacaaaccggatgtaaccgttgaacagtacaatcaaagtattatagaaaatctttcaacaacgatgttgaacaacagattgagagaactgatcaattctacaaatcctccttttacttttggatccgtataccatggaggaacttatgcaagaagcaaagaagctttccagggatttgctatagtaaaagaaggaaatcagcttaacggactgaaagttttactggaagaagtggaaagagcaaaaagattcggatttacgcagtctgaacttgacagggcaaaatctcaggtactttccaaccttgaaagatcttataataacagagataaaacagaaagtggtatgctggtagatgaatatgtaagaaacttcctggagcaggaaccaatccccggtatttcctgggagtatgaagataccaagtctttcttaccttctgttactcttgctcagaccaatgaaattatcaaaaaaatggtgaaggacgatagcagggtaattgtgatcaccggtcctaaaaaagacaatgtaaccatgcctacagaagcaatggttcttaatacatttgatgctgtgaaaatggctgatcttaaaccttacgaagaaaaagctgcgatcaaaaatttaataaaacctttcaaatctgaaggcaagattgcgaaaacagaaacggatgcaaaattaggaacaacaacctggacgttaagcaatggtgctaaggtaactttcaaaaaaacagacttcaaagatgatgaaattgtgtttacagcaagaagtttaggtggaagttctctgattcccgatgccgattacaacaaaacacagtttgcttttgctgcattaacggaatcaggggtaggcggtttctccaaagctgatcttaccaactatcttgccggtaagcaggtaagtgtaaatcctatggtgacatctctttttgaaggcgtttcgggaagaactacccaaaaagatttaggaacagctatggaacttatgtacgcatattttacaagcttaaattataacccggcatcttttaatgcatacaaagaaaagcagtcggcaatgacgaataacctgttatctaatcctcaggcttatttttctaatgaacacgccaaatttatgaatcagaagaatccccgtttcattggcgtattccctatggaaaaagattgggcgaatacggattataaaaaagcatatgatatctataaggataaatttgccaatgctgggaacttccagttctatttcgtaggaaatattgacgaagtgaagtttaaaaatgaagtcctgcagtatattgcaagtctgccttcatcgggaaaagcaacaatgtttaaggacacaggttacagaacgatgacaggagattataccaaggtgtataaaaaaggaaaagatccgaagagtatggtttctatttcttacagtggagaaactccttacagtgaaaaagaagcattggctttatcagctcttggagaagtggctactattaaagtaattgaaaaactgagagaagatgaaagtggtatttatggtggtggtgccagaggaggtatgaacagggttccttatggtagctataacttcagtataagctttccttgtggaccggaaaatgtagacaagctgacgaagagtgctattgcagaacttcagaaactgattgacaacgggcctgaacaaaaagatcttgacaagtacaaggaaggagaatataacgataataaaacggatcttaaagataatatgttctggatgaatgctattgccaagaaccagttagacggaagtgataaatacgatatcttaaattatcaggataaagtaaaagcccttacggtaaaagatcttcaggatgtggctaagaaatatcttacaaaaggtagaattgtagcgactttaatgccggaagatggctgggaaaaagctaaaaaagaagaaccagcaaaagtagaagctgtaacagtaaaagcaggagcagctaactaatcaactttttacttacaataagaaaaccgcagattggtctgcggttttttgttatttaattccatccttacaggttaagaaccatattcttttttccattcatcagcagcttcgctcagaacggtataaaactcttctccgtattttctgatcagcggagtttttaagaacttatatacaggaacctgaagctcttttccaagggtacaggcatcgctgcatacattccattcatgataattcaatgcggtaaaagcagaatattccgtaacacggatcggatagaggtggcatgagatcggtttttgccagtctacagcaccatcttcgtacgctttttcaataccacatttggtaattcctttttcatcgaatgtaacataagcacattcgcggttttctaccataggagtaacatacattccgtcgtgtggatcagtagtccatgtgccttgctcttcaagggctttgattccctcttgggtaagataaggttttattttatcaaaaatactgtccaatatttcaagctcgttcttatccaacggagctcccacatctccttccacacaacatgcacctttacatttcgaaaggttgcaaacaaattcttcggaaaaaatttcctctgaaatcaatttatcgtctatctgaatcataattttttaaaataaatcaaaaactgtacccgctttaaaggtcagtaaactaataataataacccatacactggcttctcgcatccagtatttgggtaaaaatctcatcatcctgctcagaataatactagaaggaaatgccagcagcatcaggtattcatagcttttattcatatacaggataatggtgacaagctgtgccacggaaaagaccagcagaaaagtatacttatatctgcttatcgggctttttttattataatttttgaaatggtcatatacggcataaataagcatcagaaccacaggaatcaatggcagaagctcggtgtaatctgttaccggtttcatttttccaaatggaaaataatcgatattccatgaagtaaactgaacgaaatacatgacagaaaaatagctgaatgtaatcaggacaattcccaaaaggaacctgaaaagattcagccctattttggcagaagttgcaatcacgtggatgatcacaaaaacagccattggccaggtagtgggaagaaagataaaattcagcgctacaatagcccccaccagcacatatgattttttcctgacatcctcatctgcactggtcagaagaagaagtagaaaagagttggtaagcagtgaaacggcaattcctatatccagatttccgggataaagtccgaaaataaaaaaagtatacaggaataatggaagatgggtctggtaattaagcgcaatactgtgaaaacaaaaatatcccaaagcaattcccagaaaagttattccggcaacaatagcttcgtaagtgttgaaattcagtatgttaaatattattactactaaaagaagaaaaccaatataaacaggaattgaaaaaatattgctttcttttgaaagtaatttaaacattttttataaatttgtacaaagttaatttaaaaaaggaaaataatgacgtctttctttctattcttaagcaaagttttcaaatggtctttcggtttctttgatgctttcggtaatgttttaaactggattctgtttatagtttgctgtgtactattcacttattggtgctatgtactggtggttacacttggtggcgacaaagataaagactattattctccaacggaaggtaagcacccttactacgatccgaatatctacaaaaaagaaggttaattaattggttatatagtaaaaaaccgatcaaagcatattgtttgatcggtttttttattactaacgattaaaattttctttttcttagtcgtgaatcggaagtaccagaacaggaatacttgaacttttcgttattccttttgttaagcttcccacgaatacatcatatattccgcttctgccatgtgatcccatcacaatataatctgcatttttagccttggcatgctccagaataatatctttcgcaattccttgttttaaaaggtgctcacaatcgatatcatgggcaaggatcctctgctcaatcttgttaagctgtaccagctcttctctgatctcattggcttccacttccggaaaatattgaaatcccatatcgccgatggcaaagccgatatctgatggcgctacgtggatcaggtaaattttgccgttaagctgttttgcaaattttatggcaccgtctaccagttggtctgtcttgtccccaaaatctacgggtaatacaatatttatcataacctctaattttgttatctaaagatatgaaaaatttgccagactctgatgttaaatacttataatattcggatatcaaggattttttcttcttcaagataagcttccagaatatcgttttcctctacctttccaaccccttttggagttcctgtgaaaataaggtctcctactcgcaacgtaaagtattgggaagcaaatgcaataatgtcgtcaaagttgaacatcatgtcttttgtattgccatcctgtaccttttctttattttttaataatgaaaactgaaggttttccagactgaaattctcttttttaaagaagctgcttaccacagcagaaccatcgaaacctttggcaagctcccatggaagaccttttgatttcagttcgctctgaagatctctggcagtaaaatcgattccaagaccaatttcttcataatgtttatgtgctgtttctttctggatgtatttccctccctttgaaatttttaataccacttcaagctcatagtgaatatcattagagaattcaggaatgtaaaaatcatttccttttagaactgccgtatccggtttcatgaagataacaggattttcaggaatttcatttcctaattcttttgcatgctcactgtagtttcttcctatgcagattattttcataacttaattaatttactttacctttaaaatatccttttccttctgctatgtattttctgggcccgtatccttcttgaattttaagttcggtatagccgaagatactgtctcctttttgataagattccttatccagaacaactttactgtccagaactttataatattctcccgtattcagaaaatcaaaaggtttgatattatctgtgtaagaataaggggaaactttatagcggttctgtaaaatatcgatttgataaccaccaccactaaagccatctccaacagaaaatgtaatgttcagtgttggatttctgttaatataacaactataatactcaaagcttgtgctatctgatgttattttgaaatcattggttttatcctcaccgttctgactccaaagagtggcctgtttctgttgattaaatgctttaaaaataggtttttggctcaaactgtgatcaatttcaacacttttccatactaataagaactttcccgttatgaaaacaagagagccaagaataatgatgagtacaatttttccaatccttttgatcatagttttttaatgcgtaaactcattcccgcaataatagcatttgaatttgtggctcgtcagaaaagaaattccgaaaaagctggtggcactgtcatccctgtaaatatgattggatccacatttcgggcagacaaaatcaaactcaggatcttcaatggtatgttccacttccagagaatattgttcattgtctttataatcctgaagaatttgccgggctttttccacatcttcttcaaatacctgaagctgtatgccgcctaccgcctgtgacagaagccaatctgattgaataagctgctcattggcaataaaactgttaatcccgttttcagccagaatttgtttgtccctgttagcttcaagggcagtttcgtaaaatttaaaacgtaccagatcagacatttttaaaacctgcttgataattgaatttttgtaaaaatctttttggtatacagcggaaaatcagcattctgaagccatccgaaataccctaaatctttctggaataccgctttcactccctgacctttatatttcccgaagttgaaaacctcttccattttctcattatatccgataaatccggcaagatctgcattcttgttatggaatgtaaattcacttaacggcgctatttcattcggaatatcatcatattttccgacctgggcatccagaacttcaaacgttgccattacatcagcttcggcagagtgtgcattttccaatgtttttccacagtaaaactgataagctgcccctaagttcctgggttcctttttatggaaaatagtctgtgcatccaccagtctgaatttattcagatcaaaatccattcctactcttaaaagctcttcagccagaagcggaacatcaaatctgttggaattgaaacctccaagatcacttcctgaaatcatttccataattttagcagcaatatccctgaaagtaggagcatcttttacatcttcatcataaatgccatggatctcactgcattctttaggaatcggcatttcaggattgacgcgccatgttttgctttccctggaagcatccgggtttactttcaggatacagatctcaacaattctgtcttttccaatgttggttcctgtggtttccaggtcaaaaatacaaagcggtttatggagttttaaattcatgtcggtgattaataatttgaagtgtgttttattttaataaattattttaactgtccctgaaaaatgagagacaccaatatataataaataacaagcatcggaattcctactacctgaaacagggcaagaataacaattcctcctgcaagtaatactactttaggatagttgtcttttaattgttttgatttgaacttcatcgccatcatcttgatcgggctgatcagaagccatgaagtaagaagggtaagcagaaccagcagcaattcattatcaaacaaaaagctgaaatttccggtttctttaaaggcataataaagaccaaaaagtaaaacagtgtttgtaggggtattcaatcctttgaaataataacgctgctcttcatcaagattgaagatggcaagtctcagacaggaaaatacagtaacgatgatcccgatatatttgatctcaaatggtagatgaatcccgagaagttctgcaccaaacggttcaagcgctttatacatcgtaagtcccggaattactccaaagcttaccatatccgcaagggaatcaagctgaaggccaagattggagtttgattttaatgctctggctacaaagccgtcaaaaaaatcgaaaaccgaggagagaataaggcagattgccgttgtctgataatctcctaatattagatgtattgcacctatacagcctgcaaataaattagccagggttaaagcattggccagattattctttataaaatccataaacacaaaattacagtttttaaaaattctaactcaaaataatatgaactaaaaaacgcattaaaatgattttgatgtaaatttgccccatgaaatttttaaaaggatttagaaaacaggaagttttggcattggtttaccggattttcctggcctatgttttttatcagattgccagacttttattctggtattttaataaagatctgattaaggttgactctgtttcagaatatataaagctggctttccatggtacagctttcgataccacagcgattctgtatgtcaatacattatttatactccttagtttattgcctttggtgatcaacaccaggaaaacttttcagaaaattcttttctggctgtatttcattaccaacgggattgcctatgcgatgaatttcggggattttatttactataaattttcacaggcaaggcttacttcagctgtatttcaggtagctgagcacgaatccaatgtttctaaggtactgatgatttctatcggacaacatcctttcgtactgatctggtatgtcattctgatgatcatgtgggttttcctttataaaagagtaaaggtagaagacacaaaacctctgaagctgctgccttatttcatcacctccattattactttgtgtattactgctgtactggttgtgggaggaatcagaggtgactttaaacacagtacgagacctattaatatggtggatgcgacccgttttgtaacgaatccgctgcagggaaatatggtgctcaacagtacattctcctttttaaggactttaaataccaataatttcaaggaagttcattttgtgagcgaaaaagatatagaagagtatgtacagccttataaagtatatgacagaaaagtaaaaaatcgtcccaatatcgttatttttattgtagaatctttcagtagagaatattcgggagctttcaataaagataaaaatatcaaagattacgtttcttatacaccgttcatggacagtctggcaagccagagtcttatttttccgaatacttttgcaaacggcagacagtcaattcatgggatgagcagcgtattggcgggaattccgagtcttacggatgcatttacgggatcaccttattccaatcagaaaatccagtctattgtttctgtatgtaatgaccttggctatgacacttcgttctatcatggagcgccaaatggttccatgggattccttggtttcggaaatatcttaggatttaaacattatttcgggaaaacagagtataaccatgatgaagatttcgacgggatgtgggcggtttgggatgaacctttccttcagtattttgcaaaaaatgtaggaaagaaacagccttttatgactactgtgtttacagcttcatcacatcacccttttaaaatccctgaaaaatacaacggaaaatttaaaaagggaaaaatagaaatgcatgaaccgatacaatatacggattatgcaataaagaaatattttgaaacagctaaaaaacagccttggttcaataatacgatctttgttttcacgggagatcataccaaccaggtctattatccggaatatgaaaaagcgatgaaccgttatgctgttccgttgattttctattctccgaatcctgaataccagcttaaaggagtcagccaggaaattgcacagcaggcagatatatatcctacattggcagacctaatagggtataaaaagcctatcagaagctgggggagaagtctggtgagcgataagaaatatcctttcattgttgtgaattctgacggaagtatggagcagttcatgatcggaaattatatttatcgttttgacggaaaagaaatagtaggggtatatgataaatctgatctgggccttgaaaagaatctggttaatgagattaaaaatccggaagtagagctgggaaagaaaacagcaaaagcctggtatcaggattatatggacagagtgattaacaggaaactgtattagggcgaaatggcaaaaaggtaaaaccgtaaaatggcgaaaacatcacaggctgattgaaacttagctttttcgcattttagcgactttacgttttatatcctctttatgctttgtataataaaagtttttgtttgttgaaaattaatttatacatttatcaatacgtagataagaatattgtattacaattaaaactataagaaatatgaaaaagatattgttaacgttcgcactttctttatgcggtgtgcttacatttgcacagatagaaggtaagtggaaaacgatagatgatgaaaccaaacaggcaaaatctattgttgaagtgtataaaaaatctgatgggaaatattatggaaaagtttcccagctgttaataaaaccggctgatgccaactgtacactttgtaaagatgacagaaaaggaaaaccgcttttaggattggaaatcatcagaggattaaaaaaagacggtgatgagttcacaggaggaaccattacagatcctaaaaccggaaagacatacaaatgtaccattacaagaagcggtgacaaactgaacgtaagaggttacttaggattgtctttattaggaagaacccaggtttgggaaaaagctaattaatttaagtttaaaatagaatttacatggcatttcagaaatggaatgccattttttgtggataaaattttgaacaaattcttagaaaccttgaaaaaccacaagaacaaagctgggagcagggaaattcattttaaatccagttaatattatgactttacattgaaatgaaaaggctttttattatgtgtataataaaaaaacactatttttgtagtctaaatttttcaagaaaatatggcagaatatacttttcgtgaggtaattgcacaggcaatgagcgaggaaatgcgtaaagacgaatccatctacctgatgggggaggaagttgcagaatataacggtgcatataaggcttcaaaaggaatgctggatgaatttggtccgaaaagagtaatcgatacaccgattgcagaacttggatttacaggaatctctgtgggagctgcaatgaacggtaacagacccatcgtagaatttatgacattcaatttctcattggtaggaattgatcagattatcaataatgcagctaaaatccgccagatgagtggtggacagtggaattgtccaatcgttttccgtggacctactgcttcagcaggacaattaggagctactcactctcaggcatttgaaaattggttcgccaactgcccgggacttaaagtggtggtaccttctaacccatacgatgcaaaaggattattgaaaactgcaattcaggataatgaccctgttattttcatggaatctgagcagatgtatggagataaaatggaaattcctgaagaagaatactacttaccaataggaaaagcagatatcaagagacaaggtacagatgtaactttggtttccttcggaaagatcatgaagctggctttacaggctgctgaagatatggctaaagaaggaatttcagtagaagttattgaccttagaactgttcgtcctcttgattttgataccattttggaatccgtgaaaaaaacaaacagattggttattttggaagaagcgtggccatttggttcagtatcttcagaaattacttatatggtacagcagaaagcatttgattacctggatgctccaatcaagagaattactactcctgatgcacctgcaccttactctgctgcattatttgcagaatggttccctaaacttgaaaaagtaaaagaggaaatcaaaaaagcgatgtacgtaaaatagttatagaaaaaaacttccgaaaggaagttttttcatttattatattcatgaagaaaaattcttgacgtcataaaattagtataaatttgcgcctttaaaataaattaagctgatatggcagaagttacagaagatggctaccacttcgacataaaaagactttcctttattggagttctggtgtctctgggaattgtttttggagatattggtacctctccgctttacgtaatgaaagcaattgtgaatgcaagatctcaggggagcaatatgcctttcaatgaatacatagaaggtgctctttcctgtattatctggactcttaccctgcagaccacaataaaatatgtgatcattgctttgagagcggataacaaaggtgaaggaggtattcttgctttgttttcactggtaagaaaccttaaaaaaggatggttgtacctcattgcaattattggtgcagccgcacttattgcagacggagtcattaccccatcactgacggtaatgtcagctattgaaggtcttgaaatttataatccccacactcccgttgttcctatcactatcggaattctgattgccatttttgtggtacagcagttcggaaccagctttatcggcaagtttttcggtccggtgatggtggtttggttcctggtattaggaggtctgggagttatgcatttgagcgaaaattttgaaattttaagatctttcaacccttactatgcctataagcttattgttaattctccgagtgcaattgtgattcttggagctgttttcctttgtacaaccggagcagaagcattgtattccgatttagggcattgtggtgctaaaaatatcagagtgagctgggcatttgttaagatcatgcttattctgaactatcttggacagggagcatggctgctgactaattataataaacctggattctctgtggtaaacccgttctttggaatcatgcaggaatggatgattatcccgggagtaatcttagcaacagctgctgcaattatcgccagtcaggcgttgattacaggttctttcaccatattctcagaagcgatgtcccttaacctttggccaaatcagaaaattgattatccttccggagtaaaaggacagatgtatattccgagaatcaactggggacttcttatcctgtgtatcattgtcgttctgcatttcaaggaatcaggaaaaatggaagctgcttacggactttccattacagtaacaatgttgatgacaacggttctgctggtattctggttattgaagcacagagtaagcaaggttttgatcctgtttttcgcattggtgtacatggctatcgaactaggtttcttcagtgccaacatcatcaaattcatggaaggaggatggattaccgtggtattggccggctcaataggagtttctatgtatgcatggtataacggacgactgatcaaaacaagatttatccagtttgtgaaaattgaaaaatacgtgtctattcttaaagacatgaagctggatgaaaccattccgaaatatgctaccaatctggcttacctgagcagagcaaaaagaaatgatgaggtggaatcaaaaattatttattccatcatcaaaaaacaacctaaaagagcagatcattacttcattctgagcatcgtaaatcaggaggatccttacactttcagatataccgtagatgaaattcttccgggaacagtatataaaatcaacttccttttaggatttaaagtagaccgaagaatcaatgactatttcaatatggtccttaaagatttaatggcggacggaaccattccttcaagaagcagccatccatctttaagagctcatgacataccgccagatcttaaatatgtgatcatagataacacctatatcaacgatatccttttaactgttaaacagaagattacgcttaacatttacaactttgtgaagtatatcggaagtgacgactttaaggcatggggagtatcttcgcataatgttgaagtagaatctgcaccgattacagaacttacagtttacgataataagatcgagcaatcaggatatttccgtcataactcgtagctacttgtatttaaccatactatctatttaaataaaattcaataaatttgtagataatttttttaatggatacaatacaaaaagaaaaaaatatagctttgatcaaggatgttttgagaaactacttattagaaaaagggttcagaaacacacctgaaagatatacgatattggaagagatttataatatggatcatcactttaatgttgatgatctgtatcttctgatgatgcagaaaaaatatcatgtttccaaagcaacgatttataatacgatcgaaattttccttgatgcaggcttaattcgtaagcatcagttcggagaaaagacattgacctcttcatcttatgaaaagtcttattttgacaaacagcatgaccacctggtgatctacaaaaaagactctgataaagaaattgaagaaattattgaattctgtgacccgagaattcaaggaatcaaagaagccattgaagaagcatttggcgtaaaaattgattctcattcgctatatttttatggcactaagaatgactaattaatgagaatagcactttttctgttactctttatttctacgctaagctttgcgcaggataaaaaccctgtgaagagagatccctatttacaggctccttcacccactcagcctaagcaggtgagacctgaagataaggtaaagatcatccatgcggacgagatcaagaaaaaccctgagaaatacgacgggaatcaatattttaccggcaatgttcagattgaacatcagggctctattcttacagctgatgaagtagttctttacaatgaagaaaacttcgtaaaagcaataggaaatacaaggcttcaaaatacagacggttccgtaattacagcaggagaaatggaatatgatgccaatacccaaaaaggtgttgccagaaaaaatgtggtccttaccgatccgaagcaaaccatcaaaacagatattctgtattatgacaggctggctaatcaggcttattttaatacaggaggaacaatctcagacgggcagaacgtaacctatgccaaagtaggaacctattttcttaatacaagggtagtagatcttaccggaaatgtaaaaatcgaaacccctcagtatatcatagacggacccaatatcaagcagaatcagaatacaaaaattgctgatttcatcggtccgacaaccattaccagcaagacgaatccaagaaacaggatctatactgaaaaaggtacttataaaatggataccaaggaggcttatttaaccaaaaactccaggatattttataacgagaaaatccttaccggtgatgatatgtactataaccagatttcaggattcggtaaagcaacgggcaatgtaaccctggatgatcctaaagaaaaaagatatataaaaggaggatacggagagattttcgagaagaaagactctgcaatgatgacgaaaagtccctatgctgtaaaagtaatggaaaaagactccatctattttgctgcagaaaaaatcatttcttaccaaagaccggattctcttgatatcaaagtgaagaaaagctatctcagagcctttaaaaaggcgcgtatttataaatccaatgcgcagggaagagcagactctatcgctttcaatgaaacagacggaattatgcacatgtataccaaccctattctttggagtggtgaaaaacaggtgaccggtgataaagtagaagcttattttaatacccagacagaagacattgattctttaaaagtaatcggaaatgcttttgccatcagtaaagtagattcactgaacctgaaagatgaattcaaccaggtgaaaggtaaattcatgacggtatactatgaaaagaacgcgattaaagaagcaagagtagttggaaatgcccaatcaatagtatatgtggatgataccgatcaggaaaccaaaaagcctgaaaggataggaattacactttctacctgcggaattatcggagcattatttgaagaaagggcattacagattatttcctgcagtatcggagcggcttcagatacttatccgatgagtatgatagaaccttcaaaaaggaaatttccggactttaactggaataccaaagacaggatcagaaaatggcaggatatccttgtagacagcccgaactacgaagaaatacaatatacagccgataacgaactcttcgataaagctcagaaagcaattgatgacgaaaaagcgaaagaagaagctaaaaagcctaagcggacaagaaaataaatcaaaagaccagtagttgctggtcttttttgtggattaattttagcgtttaatgaatcttttatagctttgctgaaatttttggagacaatggaaatgcataaagacttttttatatatcaggcacaaaccacaaaatttgctgcaggttttgaggtagagaaagctgtaggaagctatatttatggtacagacggaaagaaatatcttgactttgtggcaggagtttctgccaatacgctgggacattcacatcctaaaattgtagatgccattaaagagcagacggataaatatcttcacgtaatggtgtatggtgaatatgcccaggaaaagcctgtagcattatgcagattgcttgctgaagctactcctgatcctctggaggtaacgtaccttgtaaacagcggggcagaagctattgacggaagtttgaagttggcaaaaagatatacgggaagagaagaaatcgtttcctttaaaaactcttatcacggaaatacccatggcgctttaagtgtttcaggaaatgaaacccataaaagagaatttcgtcctttgctgccgatggtgtcttttattgaatttaataatgtagaagatcttgataaaatcacggagaaaaccgcttgtgtaattctggaaacaattcagggagcagcaggatttttggttccttctcaggactatatgatcagcttaaaaagaagatgtgaagaagtaggagcgctgttgattctggatgaaatacaacccggattcggaagaaccgggaaactcttctcttttgagcattttggaattgttccggatattcttgtaatggggaaaggaatgggaggaggagttcctgtaggtgcttttatgagttccagagaaattatggaaacgctttcccattcaccaaagcttgggcatatcactacttttggtggaaacccgttaattgcagcagcaagctatgcaactttaaaagaagttctgaatagcggactgatgaatgaagtggatgaaaaagaaaaactgttcagagaacttttggttcatcctaaaatcaaaaatatcaacggtaaaggcttgatgctggctgtcaatctcggaactcctgaatataccctggaagtagctaaaaaatgtatggaaagaggacttattgttttctggcagttatacagaaatgaatatctgagaatttctccgcctcttacattatctatggacgaaatccgggaaggatgccagattattctagacattctgaatgaaaattaaagataaaatctctccggaaaggagagattttttatgttttgcatggtagtttttagggcttgaaatctggcaaaataaagatgtaaaacctctgataaatatcatgctgattctataaaaaagtaattgtttttttgcgtaataaaaaaattaatttatatattgcgggacgataaaacaaagattatatggcgaaacataaagtccattacgaatttccaatgcactgtttatcagagattttatatgaatatctggcgactgcagagggattgtctgaatggtttgcggatgaggtaacagagaaaggcgatgatttcttttttagctggggcggaggacctgctgagaaggccactttgatcagatataagcctgaaggtttcgtgcgtttcagatgggaagaagatgaaggaactaaaaacttctttgaaatgactatcgtaatagatgatattacagaagatctgtctcttaatattacagacttctgtgaagatggtgatgaagacgaaaacgcaatgtattgggaaaatcttattgaaaacctcagaataaaattaggtgcagcataatgctggactttattaattgataaaactgatgaacgatttatcgttcattatttttttgtaaataaatcacattaaaaattggaaaatcaatattttacatcagacgaattaaatgtaaagaacagagcttttctctggggagactcagtgaaggtttctttctttgtgagaaatggtggattgatcatggacgaagaatgctattttttcctgatggcttccatgagaaagatgagaatgaatattcctttaacttacacgctggagtttttccagacactttttcagaaagatattattgaaggtaaaggagtagataacggaattatcaatttccaggtgttcagaaataatgacggattgacattggcaaaatcttctgtttcttatttttacgaagtaaccgaaatggctgatgtgctggctgtacatcaaagacctctggaattggacctgatcaaggaaattaatgttaataacaaccttttgagcaatatccgggttcactgtccggaaaatatttacggagcaatttatgcccaggaaaacgatcttgacgatgtgattcttctgaacccaaacaaaagaatagcacgtaccacagccggaaatcttctttttttagaaggtgatgtgatcaaagttccaaagcagactgaaggatcatacatttctcctttgatggaaaattttgttacttttttgcataagaataaccttgcagatatccaggaacacgagattattgcatttgaatctcagaaggctgaagaaattttaatgatttctgatgagaaaggtatgttttctgtaggtaagataagaaacaagacttttgaaacttcccgtttctcagaattgatagaaagctggaagaaaagttttaatcagtaaaaaattgacaaacccggtaaacaacaaagttccagaagtcctttaccgggttttattctgagtaaatcagaaattgtttctttttatttaatattcgttgatgatctcaacaaatttctgtgcgatttctttttgccccttttcactggtaatataattcctgttctcagaattattgataaaaccaagttcaaccaatacggcaggtgccttggtttctcttaatatgtgaagattgcgctcttcaattttgcgggcattgaattttttgtaaatttttccggccagttccttggaaacatcagaattctgaacgtacacttcaaatccgttgtcagttctttctttttgaggcgagctgttaacgtgaagggaaataaccatttcagggttcagtttattgatctgatctgttctctcagcaagagtagggaaactatcggaatctctggttagaataacttcatatttgtcctggctttcattgatcttccggatttctttagcaacacttaatgcaatatttttttccagaatttcaccataagtagccccaaaatcatttccgccatggccggcatcaatgacaatgtattttttattgataggagtaaatgataaaaaagcggtagaaaatattgacaaagcaagtaatgtaatacctttcatatcagtgattttagtttttcaaagaacggaaaaactttctttaaaattggttaaaagaatcttaaattttgttaattatcagattgatacgaaaaatatacggtttagtttaatgaaatgtcttcaggagaattggcccagagaaggaattctcctccaagattctgcatgatagatttccagagtgtctgatcgttgggaagtgtgtaatcaagattatatacatctactactgtccacatttttctttgaacttccgtatccagttgattaggcgaccatccggaatatcccgaaaatattttgatatgctcaatactcagttcgctgcttaaaactgcattaatgatccgctcaatatcttctgtaaggtaatattcatcggtaatatctgtatagatctcagtaactcttttgccttttacgatgaaaaataccttgtcgttttctacaggtcctccgtcatacacctcaattttaaagtcaaaaaaatctttgaatttgctactcatctggctgttctttttattcaatatcaaaccaaatgcaccactttcattgtgttcaataaccaatactaccgatcttgaaaaaatatcgccggagatgtcaggtgtcgagattaatattttacctttgtatgagtgattcatactcaaatttaataaaaaatatttatggaaaacctgcacgacaaaagaaaagtgtacgagaaatcccaacttattgaaagtgagatcaaacaaaatccaattgaacagttcagagactggtttttggaggcaaacgagagtccggcgatctcagaagctaatgctatggcggtttctacagtggaagaagatgggtgcccaagaacaagaatggtccttttgaaagcatatactcatgaaggatttattttttacaccaattataacagcagaaaaggaaaagcaatagaaaacaatcataaagcatgtcttcattttttctggcctaatctggagcgtcagattattatcaaagcagatcttgagaaggtagcggagaatttaagcgatggctattttcattcaagaccgaaaggaagtcagctaggagctgttgtttcgccgcaaagccaggttatacccaacagagagtttctggaagataagttaaaagaattggaaaaagaattcgaaaacactgaagttccaaggccggccaattggggcggatatctggccagaccttatgaaattgaattctggcagggaaggcccaaccgtcttcatgacaggattatctaccagctggaagatctggactggaaaatttcaagactggcgccgtaattggaatcagaggttggaaactagaaactagaagttagaagttagaagttagaggtagcctatggagatcttttaagaaattagatattcttatatcaatagaagcgggctttaacccgcttattatttgtgcatagcggtaaggcttcatcccaaacttaataatcataaacgcttaaaaaggcttaacggtttaaattcctgacaccacttacagaaataaaaaaggctgtttcttagaaacagccctgaattttttgtaatctgaatgattattttttcttagcacctgaaactgcatttgataaatcagctccagccttgaatttagcaacttttttagcagcgatcttgatcggttttttagttgcagggttaataccttgtcttgctgctctctcagctactgagaaagtaccgaaacctactaaagaaacttttccgtcttttttctttaatgtagtagttacgttaccaatgaaagattctaaagcagctttagctgcaactttagtgatacctgcatcttttgcgattgcgtcgattaattcagacttgttcataatttttaatattaaagttagttcgtaattatagcaaatataatactattttctaattgtgcaatttttttattaaaacttgtgaaaattttttacgtttaagtaaaatcagttaaaatatgataattccacttttcacagaaaatctacgttacaggttgctaaaatcatgccaaatgcttatgtatattgactttagcaaaaagttaatattatttcctctatttattaaatcctaaattgtgtgtaaacaattaatttttttgaccatatgattattaaatttacaagcaattttcatatttcttgtgttttgtaaaattaaacccctgtgtttgtgggagtttttaaatgatagtaaagtcctgttttattaatttttattaataaatttgcaacatgttaatagaagttttcaagtctaagattcacagggtgagagtaactgcctctgaccttaattatatagggagtattacgatagatgaagatcttatagaagctgccggtctggtagtgggagaaagggtctatatcgtgaatgtaaacaacggagaacgttttgatacttatgttatcaaagggaaaagaaagtctggggaagtatgtctgaacggacctgctgcaagaaaagtacagaaagatgatattatcattatcattgcgtatgcacagatgacaccggaagaggcaaaagacttccagccgaaaattgttttcccggatgaaaaaacaaaccttcttacgtaatacatggagaaaacatcaaaaagtccggtaaaatcaatacttacaatagtaatatcgcttgcttttgcaggcttttttttatggctcgccttaagaggactggattttaaagtcatccagaaatcagtggcaaaagccaattacctatgggtactgtttgcctccgtatttggacttcttgcttattggttcagagctattcgctggaaccttatgctggaacctatgggacaccacatatcgaattccaacgcactttggtccatatcattcggttatctgatgaatcttaccattccgagaagcggggaagtagcaagagctacagctttatatggagtagaaaaagtgcctgtagataaatctttcggaactattattctggaaagggtggtagatctggtctgtatgttgggattcttgattctgacagtgatttttaaatttaatgcgattctttctttctaccattttgtaatggataaaaaggatgagaaagagaaatttgttcctaatttttttgaagagcaaatgatgaaattaggcgtaagtgattttgactcgttttatttatatgttaaaattgctttggcgatattggctttaattgctttagctcttctttataattataaaaaagaacaacttatcaattttggaaaaggaattcttcaaggattaacttctatatttaagttaaaagaaaagggaaagtttatcctttatactttgggaatctgggtttgctactatctggccgcttaccttgtctgttttgcgcttcctgaaacatccggatttacctttgcagacggtttctttatcattgtagtgggaacattgggaatgataatccctgcaagtggaggaattggagcttataatcttgcaatgaagtacggttttatggcactttttatttcagtagggaaaagcgctgacttcggaggtgaaatggggcttacttattcctttatttctttaccgctgcagattgttattatgctggtaatggggcttatttccattcctatgctggcaaaagcaagaaatgctgctgttgcagataagagctttgaaaattaaattcaacctaactgtttacatcatacaaggtccaatttttcaattggacttttttatgctcaattttcccaacctaaataatttcaatttactgcctttcagtttccataaaatatgaatgctcatcttctcctacaattttaaaccccagacttgcatagagatgctgagctttattggtttttaatacacttaatgatacggttttccctgctagtgaagcttcctccaggatgtcagacaagatcttttttccaagtcctttaccttgttgggcaggatcaatttggagctgaagaacctcaatgttggtaaaggttctgcctacctttaacagtccgatgggttggtggtctaaaagaataatatgggccttatcaaactcatgaagaaccctttgaagggttgtttccctgtctgtagaaagcccggaagcttcatagtgaggattcatggttttcattctgagattgagaagaaaatcaatatcagtttcatcagcttttttgtaacgcaggtcaggaatcatagtcagagattagtgttttattttaatgcaattttcagtcccatttcttctttcatatacagcagaacctcagcatttcctctggcatcatctaccggattatgagtatgctctgtttttcggaggtgtttccattgtgcaaaagtatctttttccaatccacaatagagatcggaaagtctcctggaagaaaagccaaaaggatttcgtccggtaaaatgatgaaaataccagcagataaacatccagtcgaaaccattattatcactgataaaaataggtctccctctggaatttgtattaatccactcttcaaaggcaagcattactttttcaggatcatcgaaatgcatcgtttcttccctgctgaagcctgaaactgccagggcctccggattgaattgttcagaaatcggtttcagttttccataaaaggtagtatccagttcttcattgacgagcaccgcaccgaaacaaatcattgaaaaatcaccaggaatcggtccgtccgattctatatcaaccatgaagtagctcattggaaatagtttttacaaaaacgaagatattgaaataagttgaaggagagaatagtaatgtaaggtcaggggaggagctggaagttactattgtatcgtagtgaacctctgtatttttaattttaacttttgttttaaaaacatttcaatcaaaaacttcagatattttacgtctgacaaaaaacttccctcttccagattaccccaagcctacactagctcaaaaaagcttctttttccaatttttatttttgttccgggaatcagctccaactcttcgctggaatctgttattttactattattgatctgaactcctccgttttcaattaatctccgtatagcagatttgctgaggtcattcttaagttgatgacaaagttccacaagggaaattttgttgtcaatactcaaagagttgatagggatggattggtattctttttcttcaaaatttttattctgaaactgagtaataaaaaactgttccgcctggtttgctgcagtgctattatgatattgcgtaataatgttttttgcaatgatttttttaatattcataggattttcaccctctgccatcctgaacagaagctctgctttttcttgcggggaaaaatcagtggtcaggttgataaattcttcaatcaaggcatccggaattgacatggtttttccaaacatttcattgggttcatctgtaagcccgataatattgttcagggatttgctcattttttcttttccatcaagacctctcagcaatggcatacacatcacaatctgagcagacatctgatggacttcctgaagctgccttcccattgtacagttaaaaagctggtctgtgccgcccatttcaatgtcacactcaatttttacggaatcatagccctgaagaacaggatataccagttcatgcatggcaataggcgtattctcagtaaaccttttattaaaatcattacggtgcatcagctgagctacggtgacctttgaaagcagctggattacatctgaaaaattaagtgtatccagccagtctgaattgaacacaatctttgttttccgaacatcaataattttggaaagctgattgatataagtctgtgcattatgttgtacctcttctgcacttaagggttttctagctttattttttccggtaggatcaccaattcttgctgtaaagcttcccacgactataataatctgatgtcccagatcctggaattgcttcagttttttcaatacgaccgcatgtcccagatgaagatccggagcggtaggatcaaatcccagtttgacagaaagttttctgttttctttttttgcctgattaagcttttcttcgagaccgttttccggaaggatgatgaccgcattttcttgtaatgaatgaatcatgttgaatagttttaaaatgaaaagcccggacaggtactgtccgggctctatatatacgtagattattttattggattacagatatagaaagtcttcccgaacgatagtccggagtgtaatattcactgaagaatggaagacgtagtatactgttcagatgtttcattgtgatgtcaatatacaggatttacctgtggagccaatatttaaaccattaagacgcattgcagggttataacaagatttgttttaaaagaaaaacttaaccatccatcaatcttaatggcttaaaataatggttcaaaacaattttacttgcgatttctgaagctaatttcatgccataaatccctttacagcaaaatagaagatcagaatgtacaaactgtattttattattttcttcattagtttgtatgaatttaataaagctgggtttatactctgtttttcggtatatgttttcataagaagtagttttaataatgaattaaatgttttgaatataaatttttgatctgctctttccatatttccaggtcttcagaacttgcccggtctgccttgtcgaaaaataaatgtctgatgatttccagcccggaataaatgaaaatgccatgatcggaagttagtgtaagcgccttatccatccctgtcttttcatattcttcagatgattttccatgggtattgataatcattgttgatttccctttcagaagtcctttctgtacaccctggtcataacggtatgcaaaaccatagctgaacacacggtctatatagcccttcatcatagcgggaagccctgtccaccagatgggataaataaaagtaatctgttctgcccacgaaatatgatcctgttcagtttttacatcatcagatacttttcccatacgttgtccctgcatatcagccagagaaaggacaggatcaaaacctattttataaagatctctcacaataatctcatgatgttgggatcggagggtgtcaactactgtgtttaaaaaattatgatttaaactgttttcattagggtgtgcgtaaatgattaaatgtctcattgttttgatgatttagattaatgagacaaaggtataggagtgagcttttcaaaaattgtaagaaaacgaaacggcctatccggactttggattacagatatcctgctggaatttcagatattgtgcaggtgaaatgttgataaaatgtctgaaatcatggatgagctggctctgatcataatacccgcattcatcaatgatggtaaaccattggactttattctgttttccggtctcctgttcaatgattttgatggcttttaaaaagcggttgtaccggttaatttcctttaaggaatatccaaactgttccttctgttttcgctgaatgtttctctccgtttgccgggtctgttctgcaatgacttttattggatttaaaagatcactttcaaaactgcttaacagtttgccggtcgtgtcctgatattgaagataaggtttgcagaattcaagaatgtaatccacctgtgctgtggtggaatgtaattctgtcagctgatgccacagttcagtaaagcagttttcttccagcaattcgtcaggatgtcttacagattgttcaatagatgctttcccgaaaaacctgtagaatgcatcatctttgaaattggccactaaaatggagcagccggcgggaagtgtataatcaaaggcttgcctcacaggaccgaataccatacatttatcaacacttatacttgtcttttccagggtagacatggtggcactttctccaaaacagaataatagaatcgtctggtaggtgggcaaaagtgttttagtgaccggtctttcagctgtgttttcagcaagataaaaatgcgtgaatatagtttcaaattcttcaggaactgaaattctgaactcattatattccggttgtaattgcattattcagaaaaattaaaaaagactttttatcattttataattggtcaaagttactcctttaacgttgacctcttgttcctggactgcccgaaaaccaattttctcaaaaaacggcctggcagttttgcttacctctgctgtcagttgtttttcacgctgccggagtgcttcattttcaacctcctggtaaagaattgatgcaatgcctttttgctgctcatctttgtgtacaaaaagaagatcgatataatttccctgatcaagagtacaaaaacctgctattttattttcgttgagagcaattataacatactgatctatgatcactttcctccatctttcctcattttcagctccggatttccatgcttcgagctgttgaggtgtataatcttttcgacacactgcatctattgtggcagcaaaaagctgtagcatttccggaagatctgcttctttgccttttcggatgataatattatgcttattggatatattgctgttcataaagcttttgctgttctttattgagtagtggataaaaaagattcatctggagaagcgtataatgctgtatcgcttctttaggactcagtttcaggataagcctgttatgggtaagccagttatctgcaatgataaaaatttgctcggtaaggcagtctacaataaagcggggaacatctttctgaaaaatatgactcttctggagatctgaaaaaatcagttgaaactcttcttttctgctgaaattgatgccctcgtacctggattctatttctgggatctgattcatgatatctataaaactgataaatataaagcggtaggcataaaaaatttcacaagtggaaaaggtaaactgataaaggtcttccagggtcttatattccttctctttcatatggttcagaagctcatccatttttaaagttagctctgaaaaaaaaattttaataatgtcttcagaatgcctgaaatgataatgcagatttcccgcactgatattgagctcagctgcaatatgcctggtagtaatattattataccccttatcattaaataactccagtgctttagacagaatcttatccttggtcttcatagttcaaagataagaatatagagattgaaataaatcatatttttaaaattagaacagatgttctaatgtggtatatttgcagtaacaatcttatcatcatggaaggaaaacagaaattcgattacgaatcagcggaaaagatcgaaacagaaaagaaaacggatccgcaggaagtggtatcaaaaatcctgcagatcatccttggagttatcatggcagtgcttcatatataatgaaaagaagaatttcatattggtttttgctgggacttgcagcatggagtttgattatttttctgaggcggacaggaatttatattcctgttgtcaatgattattttacagattgtattactgttccgatgtattgttatctgatagaatatctgatgaatcctgttttaggttatgattggaaaccagacctgaaatttgtacttacttcagtcctttatctctcatttttgtttgaagtgctctgtccggcgttatccggacattttaccggagatttgtttgatgtactggcttatagtgccggcggaatggtgtattattttagaaagctcaagcctttggaaacaagataaaataaagccggtagcttcacatcgtaaagaagctgccggcggtgctatagtttttatcctgatttgtaatacttaataaaggtgaaggtttagttactgccgcctgcccggtttgattcttcaaatttcacctgcttggtagctcctttcacattattgtttccaaacttgtaggtaagagaaagatgaacatttctggtaatccctttgtactgaaaatcgatattataagaaggataatactcaatccctttttcacggttggtgttcagaatatcgttaagatacagattaaccaacagctttttttccataaatgccagtttcatacccgtatacaatgaagaactgttgtaataatatgaatttccaaccctgttaggaagactgccccaaagccccagcataaaagtgactgttttctctttattgaggaagaaactgttatcgatattaagattggcactgtatcctgcgggagcagtcaagatcgaaggatcatatgattttgattttgtataatatccgtttacaaataccgtagattccagccatttcagcttgttgtagttatagctgatattgatacctgcctgatcttcattgtaaaaatttttagcgactgtgtatctgtaatcgccatctaccatttgtactctgtcccagctatctttattgtaattgtaatataaagtgatattgagattattgttcagaacatatccgaattcaaaattatctgaaaacgtaggtaaaaggtaaggattaccggtgctgtattcatactcggaagtgtaatatttgaacggattcaggttaccgaagtacggacgtgaaattctgcgtgaatagttaagagaaaatgaatgattctcgttcggtttataactgatgtaagcagtagggaaaaacttcccgtaattgatctttgcagaggtatcgtcattcatggaaatcccctccaatcttgtatactcatagcggagaccggcttttgcatcccatttttcactgattttaaaattggtagaaaagtaaacggcataattttcttcattataaaagaatgtattggttctgcccgggttaagatcatactgaccattgttgatattgaaaaaattaaattcagaatcatttttaatcttagtatattttataccggattccgttttgattttagcgaaagttttttcaaaatcagcctgccctgaataaatgcggtatttactgatgggattggccattgtagaaatcgtttcagaagtaatggtattggaaaaatttctggcattggaattattcagcatcagattggcagtaatattcagcttacctcctgcgctgtcaagttttgtttcataaaatgccgtagcgttatggacatccctgctgttccggtttctgaagttggaaagaatattcagaaatccttcatcattggaccttacagcctggctttctcctttttccaaaggattactgtgcgaataattgtaattgattccgataagatttttatcattgatcttgtattcaacctttgcatttccccctttatatttgtagttattgagattttgagtatcccggttccagtaatctttattgttgctggcggaaaggtagttataggtagtataataccagtaattatctcctacggaaagattggtgctcagagacagcttttctccctgataattaaaagtagccccacttcttgctgatactgtaggtctgccccagaaatagttacctgaagtctgaacagatccgttccagcccagattggtgttctttttaagtataatgttgatcagtccgctttttccttcagcatcatattttgcaggtggcgtggtgataacttcaattttaagaatatcatcggaacgcaatgttttcaggtagttgatcagctcctggccattaagattcagcagtctgtcattgatcatcactgctacattactttttccggcaatgcttatagcgtcatcactggtttttaccatgggtgttttggcaagtgcctctatagcatcaattccctgagaggcaacagagttttcaacattaaagaccagacggtctacttttctttcaaataattttttctttgcagtaacggtaaccccttctattttctgttcagtgacaggtgcttctttgatttgcagatcttttctgtgtgttccctttaccgtaattttttcactattggtttttaccccgtcttttatgatttcgaataaatattctccgtcttctttcaatggaattttaaacatccctttatcgttcgtgatggctgaaaacttcacctcatttttggtaatcaggacttcggtttccaatgccggtttattgtctttgtctgtaataattccttcaacactctgcgcaaaaagaaaagacgaagaaataagacttaaaagaatggtaatcttccgattcatattttttagtttatatacaagacaattgttttgtctttgatattacatcggatggtgaagaatctttttattgctggtgcatattgagactttattttaatatttttgtacctgattcaacaagatattttacttccaatgtacgacaagcttttacaaaatatccgttcaggacatgactttagccatgaagagacagaagctgtcaaacattattttgagccggtcgcattttcaaaaaatactgtaatagaagaagccggtacagttccccggtacctttattatattgtgtcaggatacctgaggattttttttactgatcagaatggaaatgaagtgaccacgcatatcaactgcccgccgggattttttacttcctatcaggattttatcagcggtacggtttccgaaaacaatgtggaatgtatcacagattctgagcttctcagaatttcaaaagaaaatctggatgctctgatcagtgaaagcaaggcaatgaaagatttcagtatctctgtttttcagcagtcgattgcctataatgagaaccgttccagagaactgtcagtactcagtgctgagcagcgttaccttaagcttatgaaagattatccggaaattattcagaatgttcccgtacaatatatcgcttcatttttagggatgaagcctgaaagcctcagcaggatccggaaaaaaataattaactaacaaaagtcaagtggttccggtaaagagaaggtgaactttgcagcattaaaatgaatgcaatgacaaagaatcatgtaagtcttgtttccggggcaaacggacatcttggaactaatttagtcagatttttattgaaacaggggattccggtacgggccgccgtaaggaatatcaacaacagaaaaccttttgaaggactgaactgtgaattggtacaggctgatataacagataaagcttctttcgtaaaagctctgcagggtgtggaaaccttttattcagtaggcgctgcttttaaattatgggctaaagatcctgaaaaggaaatctatgacgtcaatatgataggtacccgcaataccatcgaagctgctgcagaagcgggggtgaaaagaatagtgtatgtaagttctattgccgcgcttgattatacaaacctgcctgccagagaaagtaatggctataatccggaccgaagggatatgtactataattctaaaaatgacggtgaaaagctggcctttgatctggctgcaaaaatggggatagagctggtttctgtaatgccttctgccatgattggaagcgaagcatttttaccgctaaatgtttcttatggagtattaaagctgatcctgaacaaaaaaattcctgtagataccaaaattaccctgaactggatagatgtaaaagatgttgcagaaggatgttatctggctgctgaaaaaggacgttccggtgaacgttatattcttgccaatgaaaaatgtatgaccattaccgatactacaattcttgccaacagactttatcctgaactgaaactggaaattccgcgttccgtacctaagggaattttgtttgctattgctgcccttatggaatttacagcaaagctaagtggtaaaccgccggtgctcacccggaaagatattgccatgttttcaggattacagcaggattttgatatttctaaagcaagaaatgagcttggatttaatcctaaaggccctgaaaaggcagtgaaagaagcattagattttcttataaaaaatcctgaattgctgaaagaggtttgaagaagcctttttttttattgctgttccagtttgatgatcggacctttgtaaaagcgggtcagatcatacaggtctgtaaaatgctgctggagatccgggatgaccttaccgtcaaattccttcacattacattggttttctgcaagcaggtacaaagattgattatccggtttcagatactcacagaggatattatcctgatgcttttctttattgagaatttctgtgagaaagatcccatagatcaggaactggttaaaattgctggaatccacaatataattcatgtcctgcttcaggagtttttcgtaatcagaaaggattttaagaaaattttcggcatgaacagttgtcggaatttcataaaaaaggtctataccattgatgaaaagctgtgttttggcttcctcatgatctgaagaatatactttggtaaaccattggaaaataagcaggagttcctcctgggtaagttcttcaacagaatcctttattttttctttaattgtttcaagggtgtttcttgcttcaggctgaagaaatttaagaatattctcttcttcacggctaagcttattgtacaaattaattttggcaatagttggattggttttgatgaaataaagttcttccgccatagttatttaccaaatagtctttaaaatggttatttaaagatacaaaatatgcctcaactttataaaaaaaataatatgtactgaatggtacagttatttttacgtttcaagggtacagtaaaatttttatctgtgtctttaaaaatagatagacttatctattttttgtttagatttgtaaaaatttttcgatgaaaaaggaaaaagtgcgtgacagaattatcagggttgcctcagatctgttttataagcaagggtttaattctacaggaatcaatcagattattgcagaggctgatattgctataggctcactttacaaccatttttcatctaagaacgatcttctgcaggcgtatctgatcaaacaggaatcggattggtttgaaggttttgaaaacagtacatccaaaatctcagatcccaaagaaaaacttttaaccctgattgattacaggaaaaaactacagcagacttcaaagtttgccggatgccattttattaagattgtttctgaaataggagaaggcaatccttccgtatctgattttgcccaaaagcataaagagaagcaaaaggatttgatcacagcccttgtaagagaatatggaatgcaaagacagatttcagatcctgatttgttggcagaaaacatttttttattaatagaaggagctgtggttacttccacaatcaggagacaaaatgattcttttgatcaggtgaaaaaaattgttaagggcttattgccttaatttttttgacttaaaaaaatagatatatctatataaaaatgaaatgtaactatttgaaattattggtaatattattaggtcagttattgataattatggatatttttatcattaacgtatctattccatctatacaaagagacctgcgtgtcggcaacggggaaattcagtttatgattgcagcttatctcatcggatttgcctcttttttgattaccggcggcagattgggtgatgtatatgggagaaagaagatctatatgatcggattaacagcttttatgctgagttcggtggcttgcggaatttccgtaggggcgggccagctggttgtttcaaggtttattcagggggtaagcgctgccatgatggctccccaggtactttcaatgatacaggtactgttctctgatcatcaggaacgtacaaaagcaatggggtggtatgggattaccattggagcaggaactattctgggacagttccttggcggatatttttcctcattaacaatgatggaagaaccctggcggcttatttttctgatgaatattccggtatgcctgccagcgatctttcttagtctgaaagtattgaacgaatctaaaacacctgtgaaacagtcctttaatatgagcggtgttgtaatgctttctgccggattgttctgtgctgtctatgcattaacaatgtctgaacatgcgggaattcaatttaaaaatgttttattgatgatggtttcagtaattattcttttgattttcattaaaaatcaaaagaaaagaatcaggaatgaacgctcttatctgattgattttgaattgttccgatataaaaatttcaaccttggaatcctggccgtttcatcattttttatcatgctggattcctacttttatattctttcacttttttttcaggatggattaaaaataaatcctttaaaagcaggtgaaatcattgtatttcaagggttgggttttattattgcatctgtcatttctgtaaaattgattttacgatatggaaaaaaggccctggttgcaggactgatgtttattattgttattcttatttttcagctattcttattcagaacggaaacaagttttccacttttctgtctgttattgtttcttcatgggttgggagtaggttccattattccttcgctggccaatattgcgttatccggcatgtctgaaaaattgataggaaatgcctcaggggtgtataatacctttcagcagattgctgccatcataggaattgttgctattggaagtatcttttattcttttcttggagagcaacctgcaatacagcattatcaaaaagctttttcggtaaccttgctgatcaatattttatgtttgatcctggtcattgcttctgtatttaaagttcctgatcatgttcttccggaaatggctaaaaaagtacattgacttatattcaaattcaggaaggttattttaatgcagaaataagtaacatcataggcctgcggagttcttccttcatttccggaatttcttttatcatctcttggctgggttcaggttctgtgacttctttgatggtgaagccatgttttaataaagtatttaaatatgacgttaaagtgcggtgatatttgataacattttctcccagaaaagtagtgtttctttttccctccagaaaataacggtccacaggccagctgattttttctccgtttttatcatatatccagtcctggccgccttcagctgtgaaaacagggtgttctactgagaaaacaaatgatccgccaggagtaagccatttgtaaatattatggaccaaactatcgaatgattctacataatgcaaagtaagtgagctgagtatcacatcaaatttttcagcagggtagtcaacatcttcaagggcttttctttcatattgaatcccttctagattgttgatttctttagctttggataacattctttccgaaagatcaattccagtcacggattttgctccgttttccatagcataacggcaatgccaaccgaaaccgcatccaaggtccagcacattcttcccatgaaaatcaggaagcatattttttaaagtatgccattctccggctccttccagtccgatttgagagcggagcatcttttcatactggtcaaaaaatgacgggttgtcgtatttattttctttcataatagcagagaatttatcattacaacatttcttaccgaaaataagagctatgtaaatttacaacaattatatcggaattctgagaggctctgactgaaaagcaaaagctgaatgtcccgcatccagctttatatcattgtttcccgatcaggaattttttagttcgtttccgtatactgttttaaattatcaagaattgcctgccagcctcctttctgcatttcttccggattttggttttcgggatcgaaagctatattcagatgggtttgtccgttattttctttaaaatcgacatgaacctctcttccgtcaggcatagtatatgtaaagtttttaccttcatttatttcattataaacagcttcaaaatcgaaaccgaaacttccgtctttcgcttccattctggctgtatattttcctccgactttcatatcattggaagcggaagggcactgccatgaaggatctgcaaaattccaccgtgtgatatgttccggattggtatagtaatcccatactttttgtgcatcggcattgatggttgcggaaactgtgattttatgactcatgtttattgatttaatgttaatagtaattcatcaagtttttcaagcgttgcaatcattccctgctccatgcccatttcgataatggtttccagatcagttaaggattcatagcttacaatggtttctacaagagtattttcatttttatctgtgaaagttactgtccattctgcctgtggaagaccggtgttgatctctcctttttcattgcagaaggaatcgcttgaagtatatgaatctattgggttgatcttatgatagcttacccaaccccaatattctgttccgttaggttccaccatggcataatgccaatgtcctccttcacggaaatccattgattttgttttggtggtcagaggtttcggggcaaaccagcggtcaagaagttcactttttgtataacagtcccagaccatttgtctgttggccataaattcacgtctgatagtaagagtgttcttttctttgtctgcaagaaaatcgaactgaagatgatgtttcatgatagtatttttatagtttgtttttgattttatgttgtcaaattttatttctgctggcttttcaatgtggccagtaaagtgtcaagctgttcgaagcggctttcccagatttttctgaactgttccagccaatgatctatttctttcattttatcaatttccaacaggtaataaatttctctcccctggtgattttgggttaccagttcgcactccgtcaggattttcagatgttttgaaaccgcctgtcttgtggtgtcaaaatgctctgctatggcatttggtgtcatggcctgtactgcaatcagtgcaataatggcccggcgtgttggatcagctatagcctgaaaaatatctcttctcatcaataacaatttttaaatgaaaccatatggttgcaaatatatgtgcaacttttcggtttcgcaaattttttctgaaaaatttattcctcagaaattaaaaatgataaaatagattatgtaagcgttttgtaatcagtagtttgattattaaaaagttattttttgttttgtctcatggctttaattaatttttcattccgtttatctgctctttcattttgtaaagaaagtgcagcccaaatggcagcagggagccagccgatcagagtgatctgtaaaatcagacagataatcccagtgaaaatttttccacggacaataaaggataagaagggaagtaagatagccagtaacatgatttgagttttaattaaactgatttttaacgcgattgaggatcaaaataggctttaaaagtaagaggatcttccattttatcctcagcttcttcaagatattcaagatactcttcctgatgttttcccatataaacaagcacaatggaaaggttgataaagaggtttttgtcttgagaacccagatttaatgccgtctttaagtactccagagccttttcattctcacccatatcagaataaacagcacccatattgattaaagcagaagtattttcaggctcaataagcagaatttcttccagctctctcaccagcagatcgtttaaagtatcccaatgatcttcattttcccatcttttagcctgaagtttttttacgttttctaatcttagtgttatactgttcattacttaaattacaaatgaatactattggttttctgcacaaatttagctctctctgcgacagatattttaatttttaacagaattaaaaaaagttatcctttaagtccatccaatattgctgctttcaggatttcaatgttgatctctttcaaagctttgaatttaatgcaatatcctgtaacactggctttacctattttttctccataagtttcaggtaaataggttttatcatcaatattcataacatagacagagatacccgtcgtattggcactcattccaatctgatagaagtccctggttttcccatcggcatattgtaatgtataaaatccatatccgatattgggattggaaaccgttttattttgactgtttttccatccagaaaccatagctggcattcggatataagctccagaatgatgcggttgagctcctgcacatcattacgttttttcaggctggctattgagatagtcctggatttgtttttgaatggtcatggataatatttttaatttattatatcaaagtatatttcatctatagaaatattattactaatttgttctaaagtaacatataaattaattttaatataatttaactccatcaagccctcggcaaaagagttgtaatggtactttttatcaaaccctatttcaatttcggcctctatctcttgttcaaactttataattacatctttgtttgacatttcatatacatagaaattttctgaattaccaaagaaaactctatttaattttactttaccattggcttttaaatcaggattttgtttttcaaaccaattgcaaatttctttgacttcatatacttcaaaactttctttaattttttctaaatataaatttttgtcaatattgatgttcaaccactcggaactaatggaatttatatgttttgaatgcttttctatgaaatctttaatattactaaaataataaatttttgtctcaaattttttaatttcttctaataataatggatgtaaattattcttattattttcatcagcaaaatctttagcattattacttataaatataacactatccttatatggatacattttaatatattctataattgattcccataaaactgcatctttaaagccgacaccatttattctaaaaggtcttttcttattaactgctctttgtattattttattaaacgatgaattttccaattcaaaaatttcattatattctgaaatctgaaatttttccaataagttatctttgaatattttcttttgcttttcaaaatctatatcttttgtctcgattggtccttcagctaataatctacttaattcgaagtttgttcttttaaagacatcatatttttcttttaattcttcttcatatagcttttcaatttcttgtaagactatatttaataaaactaaattagagtgagttttttctatataatcaaatatgacttcaaaatcttttgaattaagaaagaaatcagttctaagtatatttgtgtcaagaataatatccataaattaatttttaaaacaaccattttgaatgataagcatcagatctaatgtggaaatgtgggaaactattaatgtagaattgattttaagtttactaagtgactaatttataacaaaaaagaacagcgattgctgttcttttgtactttattatttttgatttactgaatcagttcttccaatgttttatccgttttcatcagctcaccctgtgggatctgatgatgaagataagtgaaaagcaaattggttacccaattgttttcaatttgatgaacagagtatgagcatattaaaccaaaatcatcagaaatataagccggaaggtcagaggaacctgtagttttgaagacagatacaaaaatttcctttctgatatcactgattctgtcttcaacctcctcatcagcaaccttctcttcaacagtgtgataggctttcatccatgcatcagaaaatgctgccgaatccctgttatcaagaatctcatcaatcttttcgggagtaataccggtaagtgccgttttcaaagcatcattaaaaatggcttccagcttattgattttttctgtcataatttgaatttatattctatccgaacgctcttttcaataaactttccacttttggctcgctgcctctgaaggctttatataattccatcggatctttggttcctcctgaagaaagcaagactttatatttcgctgcaatctcaggattgaaaattccgttttctttaaaatactggaaagcatcagcatccagaacttctgcccatttataggaataatatcctgcagaatatcctccctggaaaatgtgtgaaaaactcggactcatagctgtttctgaatgggaaggataaagacttgttgcttttgtgtatttatcttcaaactcttttacactttcattttccaattctttaacttttgtatggtagttcatatccagaagtccgaaacccagttgtcttaaagtctggtaaccctccatgaagtttttggattgctcgattttttcaattttttcgtcaggaagaacttctcctgttttataatgttttgcaaaagttttcaggaactcaggctcatagcagaagttctcaagaaactgcgatggaagttccacaaagtcccattttactgaagtacctgacagggtaggatattgggtatctgccatcattccatgaagtgcgtgcccgaattcgtggaataaggtagtcacttcctggaaggttagtaagctaggtgtgtcttttgtcggtttactaaagttgcagacaattgagatgtgcggacgtgagttttcaccgttttgcttatactgatttttatagctggtcatccatgcaccggctcttttcccttttctcgggaaataatcaacgtataacaaggatttataagttccgttttcttttacttcatacacttttacatcttcatggtatttcgggatatcgtttctctcttcaaaagtaagcccgaataatttacctgccagtccgaatacagcatcctgtacctggtttaacgggaaataaggcttcagttcctcatcattaagatcaaattttgccttacgaagtttttcagcatagtaggcgtgatcgtagctttgcatctcctcaattccatcggctttggctaaagatttcaattcttcaatttctttatccgcatagggctttgctttggttaaaagctcatttaaaaaatcaaaaacttttaccggagattttgccattctttcttccagaacgaaatcagcatagtttttatatcctaaaagttcagctttctgctgtttcagatgaagaagttctttaatcagattctgattatcaaattctccgccgtcgaaagattttttaccattggccagagccagttcctttctcagttcacggttttcagcataggttataaaaggaatataacttgggtattgtaatgttactacccagccatcaaggtttctttctttggcttcttcggcatattgatctatgatggcttcgggaattcctgcaagatcttccttattggtgatatgtttaaaataagcattggtagaagccagtacattttgtccgaactgtaaagattttacagaaagatccatacttattttctttaatttttctttgtcatcctcattcaataaagctccgcttcttacaaaacctttgtaggtttcattcaaaagcatttcctgctcttcattgagattatatttttccttttcatcgtatacctttttgattttgttgaaaagggcttcattctgagatatttttgaagaatattccgttaagatcggcgaaacttcctgagcgatctgttgaatttcgtcactggtttccgctgaatttaagttgaaaaaaatatttgaaaccacatccagctgttccccggaataagctaatgcttcaataacattttcaaaagtaggtgcttcaggattgttgacaatagcatcaatttctgcttcagatttttgaatcagttctttaaatgctggaagataatcttcatttttaatgtcactgaatggtgccgaatggtatggagtgttaaatttttctgttaaaatattcatttttcgatttttattataagtaaatgtaatgattcgccgggaatcacggctgaaatgctcaaaaataatgccttactggcaagttatgacaaaaataccttatctttaattaatcttgtcatatggaaagaaggagtgatgtgggaatatttaattttgggaacagattaaaatcatcattaaataatataaccttaaatatatagactatgaaaacactcttaaaaattattggtatcatcatcgtgctggttcttatatatgctgtaattgccgtgctggctttcagtaaagattatcactatgaaaaatctgttgttatcaatgctccgcaggataaagtatggccttatgtaggcacattaaaaggatataatcagtgggatcctttttccaaagctgataaaaacattgttattacctactcaggaaatggggataaagtaggcgattcctatcattggaaaggagataaaaatgtaggagaaggagagcaggctatcactgagctggttcccaaccagaaaatggctacaaaacttcattttataaaaccttttgaaggagatatgaaggctaatttcgtaatggttcctgaaggaaatggcaccaaagtaacatggatgattgataatgagctgactcctatgatgaagatcatgaaaccgctgatgaacggtaatatggacaaaatgtttagtcagggactcggagatctgaaaaaacttgcagaaaaataaaatgaaagccttgtaaaatctacagggcttttttttattttaaatccttttactgattcgattgagaagaaaagttattttatgccatgtcattgaaaattattttaaaaatattatctttatataaagaatcgattgtatggagaagattgtatttgaaaaaagtgatatcagagactttgtgaaaatgactatcgcagagaaaatagaaaagcttaaaaactttatcgaatttaccctggaagcaagccgtgacatcaaaaaaactcctaaatatgacagtatgagagaagaaatgcaggaggagatctaccagatgcagcgacagctgggtgctttgaatgatcttaaaagaaatatggcaaaagtactgaatacagctacccaaagagttcagcttggttcgttggtgatcaccaataaggcccggttctatatttccgtatcattgggagagttcttttttgaaggcgacagattctacgccatttctccggaaagcccgatggctaaaaagatgatgggaatgaaaccaggtgatgagtttaccctcaataaaatccatcagaagattgtagaagtgctgtaatgtgaatggtggattttccttgtaaacagatagctataattctgataagcacggcttcatattttattctcatttaatataatagttgttttaaatacagcagattgaattccatgttgtaaatttgcaggtatgagtaaagcaaccattttaaaagaaattatagaggagaggagaagtattttcccgaaagattatactgacacagaaattccacaggaagttttggaggaaattttgcacgcggcaacattggctccgaaccataaacgtaccaagccatggcgttttaaaatattcaaaggcgaagaaaaagctaagctggctgcagaaatgcaggcaatctataaagcaacccaacctgaacagctttttctggaaaaaaaatacaatgacatcggtttcaaaattaataaagctgatgtagtggtttccattattgttaatttcagcggaatggttcctgaatgggaagaaatagcagctacctcaatggctgttcagaacatgtatcttacctgtaccgccaacaatatcgggtgctactggagctctcccaaaattgtagatcacttgaaagactctcttactatcgaagaaaaccagaagtgtctgggacttttctatatgggtagtttgtcttaaaatagccctggtcgagcggcatgtctgagctctttttcttgtaaagaaaaaagcgagcagcgagagcaggttcccggctcctgagaaaaaataatcagaaattctaaaactttttgtccggagctttttactttcaacttttttactatctttgcactcttaaatatttaactgggacgagttcccataaaattcaaacattatgtcagtaaaaatcagattacaaagacacggtaaaaaaggaaagccttttttccacatcgtggttgcagattctagagctagaagagatggtagattcatcgagaaactaggaacttacaacccaattactaatccagcaactatcgaattgaatgttgattctgctgtaaagtggttaaacaacggtgctcagcctactgatactgctagagctattctatcttacaaaggtgctctttacaaaaaacacttacaaggtggtgtagctaaaggtgcttttgacgaagctgaagctgaaaaaagattcaatgcttgggtagaagctaaagatgctaaagtacaaggtaaagtagaaggtttagctacagctaaagctgatgctaagaaagctgctttagatgctgaagtaaaagtaaacgaagctagaatcgctgctgctgcacaagctgaagctgatgctaaagctgctgaagaagctgcaaacgcacctgctgaagaagttgctgaagctacagaaggagaagctcctgctgctgaaactgaagaaaacactgaagcttaagaacaaaccctgttatgcgtaaagaagattgctattttttaggaaaaatcacacgcagacatggacttgcgggtaacgtaatccttaaactggataccgatcaacccgagctttacaataaattggaatcaatattcgttgaaatcaacggattattggttccattttttattgaaaaaacatcatggagcaagcttgatgctctgaatattgcattcaaaaactcttctgaagcactggtagatcaggttttaggtaaaagcgtttaccttcctctttccacattgcctaaactttcaggaaaacaattctattaccacgagattatcggatttgaaatttttgatcaggatgatcataactgtggagtgatcagatccgtaaacgatcagacggcacaggtgtatttcattacaaatctggacggaaaagaagtggtgattcctatgatcaaagactggattcttgaagttgacagagaagaaagaaccatcaaaatggaacttcctgaaggtcttattgatgtttttctgattccttcgaagaaagacgaatagttttgcgataagctattctttctcacttttctcattactcattttattactgattattcattactcatctttaaggcgggtaaaagatattcctgtactattttatcggcttgctgatgagcataaggtttgttatatgccctggctgtaatcacaatcacaactggaatctcagtaaacataatgattttatttcctccgtttccgctggattgaaatgcttcaaagctgctatttccagcagtgtaaacttttctccagaataaatatccgtagccttcaaaatcagaatgatctgtaaaataattggtgaacgatttctttacccaatctttatataaaatagtttttccattccagaccccgttatttttatacagctgtccgaattttgcaaaatcgagagttctcatgcgtaatcctcctgccagtgaaggcttttgctgtggagtgaattgccattgataacgggtgattccaagaggctgaaacaactttttgtctgcataattttttaaaccttcaggaactgctttatccagaatatctccggttactacaacgcctgcagtgaaataactccattttttccctatttcattcccggacattggcagatccaatgcaaactttacccagttatccgttggatacatattttcttcattgccggaagattcggaatcatcatcatttccttcaaaaccggagctcattgtcagtaagctttttatagtgacattgtctttttgaacagagtaatttttaaattgctttaagtcataaaactcttttaaatattggttttcgctctttaaatacccttctttgaccgcaattcccgttaacgctgaagaaaaagatttgcctactgatcttgtatcctgcagagaatctctccctgaaccgttaaaatattcttcaagaagtagttttccgtcttttatgattacaattcctgtcagatctttaaatctgttttcagcaattttcctattcagggttctgatgatttcagtattaattttttctttggaaatcttccagccgctgttgggcagaacaggttgaagagcgatctgtttttccggaatgttttgggaaggaacagtgaggttaatctgcccttctgcaatgacaggtcctgttttgatgttgctcactttcagataaggacggatttcaatttttaaaatgtgatttcctgcagtcagcgcatcaattccgtcatgagccatgtaaaaacgcatccataaataccttccccatgagtcttcattcttactgctgagaagaggaatccgtaatgctgttttgaattttttattttccggggtaccggctccagtgttaagattttctgtgtagatgagttttccgtcaacatagaatgaaaactggtaattgccgtttttcaacaactcatctacagtcaagctgggttcaagctgatgaagataattaacaagtgaattgtcgaaaaaagcgtagatacccaaatccccattttcctgaaatagggaggaagtaagaatatccggatctttaaggttttccagggaaatagctttattgagaaaaataattttcccggaatattctttctggaggagattttcaattttttcaggattgacaatattgccgttttgcccttggtaaagacaaaatataaaaataaagatcaataatagaaatggtttcatctcaaagaagtatttaaacaaaaatagtaaacttcttcagggtaaaatagaatgaaattaacattactgcttacaaatcaaatctttaattgaaaagttttctgaattctcccggcgactgatttgttttttgtttaaaaagtttgctgaaagactgcggatgttcaaatcccagctcataagcaatttcacttacagacagactcgttgtgctcaaacgttctttagccagatcaatcaatttattttgaatatgctgttgtgtattttgctgcgtatgcagacggagcaaagttcccagatagttgggcgaaatattcatttgctcagcaatacatttcaccgatggaatcccgttttcaagaagattgccgttttcaaaatatcgggaaagaatatcttcaaacttatacaggagttcatggcttgatttctttcgggtaaaaaattgcctttcataaaatcggtctgaataaatcagtaacaattcaatctgggcaataatcagatcctgcgtgaatttatcgatattggccatgtattccctttcgatatttttaaggatatcaacaatcactttctcctctttatcagaaagaaaaagagcttccttcacctgataactgaaaaaatcataggattttattttcttggttaatgaggtattccacagaaaatcaggatgaattaacagtaaaaagcccgttggttccacttctacatcaggatcaatctccagacttaaatactgttgtggtgaaacaaagcacaatactcctgaatcaaaatcgtattgctgctgtccgtaattgaatttcggactgacattttttttcagaccgatagagtaaaaattctgaatccagcttaattcttcattttccacaacatagcggaccttgctgtaatctatgaggctgatcagcgggtgatcaggattcggaagaccacagaaagcatgaaaatctgaaatggtattaaaacgaacgggctgtttcataatagctaatttagttgtttttgtaaaaagtttaatgaaagacttcggctctgttttgattaagcagagccgaagaatatcatagtaaagctagatcgcagttgaaactgtcaggttttcccatttttcagcatctttctttaaaatatcaatcttattgttcagaaactccatggttcctactcctaataataaatgtacaggaggatttttctctttgctgatctggatcagaacatcggcagcttttaccggatcattcggctggttgccattgatttcattaaggtgggcctgttcagaacttcttgctgcttcataggcctgaatcggacttgaaggggttttcacagagtctttattcaagaaatcggtacggaaatagccgggataaacaacggtagcatgaactccgaagtcttttacctcttccgccagcgcttctgtaaaaccggcaacggcgaattttgtagagcagtagattccccagcccggaaaatttcccgaataaccgccgaccgatgaaatattgaagatatttcctgatctttgctcacgaagataaggcatcgcatttctgatcacgtttaaggttccgaaaacattcacagcataattttctctggcttcctcgtcggtaagctcctcaagagttccgatctgtccgtaacctgcattgttgaccactacatcaagtcttccgaaatgatcaactgttttttcaatagcagatctgatatcattgttgtctgtaatattgacgctgagaggaaggaaattttctgaagtttctccgattgaagagaccagggattcaacggtacggctggttgcagcaacctgaaacccttcggataataatttctttaccaactcgaatcctaagccttttgaagcccctgtcacgaaccatactttttttgtttccattgtaaatatttttttgtttaaatgatggtacaaagatggaaagtcaaaaagaggaaaatgtagccgaatcggggaatgatgtatccaaatcgtgaatgatgatttaatccgggaagactttaatagtttttcagaatattcctgtatttcaaaggtgtaatgccgaggctttctttaaagcaccggataaaatgactctggtccgaaaagccgcattccagcgcaatatccgttaaagaagaaggagagtggagaagtttcattgacttattgatttttattttccggatgtattctcccaggttgcaatggaaatatttatgaaaatctctgcttaaatgaacaggatggatattcagggtttctgaaattccggtaagtgtaaggttttcagcagcgttctcgtgtaaaatctcattaatctgatttacccagacaggttttctttctttacttcctttttcttgagtcagttcgctgaaaagatgcaacagaagctgattgacggaagattcaaaagaagtgtcattcattttggtttctttgaataactgccagatcaggagttttaaagccggattttttatggcaaagctgccttcggctttatttttcgggatatcaaactgatcaaaccaatcttgagtaatttctatgtggaaaccccgtgtaaaaatatcaggtttaatattataatgtggatcttcccaatgatgatatagcaatgttccggcagagcagccgtaagtttctttccggtttccttctgtcatattcccctgaagcagaaaggtaaagtaagcgttctcatgataatgccagtctacatagggatgtgtatattccgtatcagtaattgtcaatccatctaaattgatcatctgatgggtttccccaaaatattcgccgtttcgaagagtattcataatatattctgttttaaacggtcaatctgttcatacattttattaaaaaatattttcctttcccggtttccggattcattcagagattttgagtttttgatctgatgctcaaaatagctcagtgaatcttcacaggttatcttgtcattggtcatcatatatccgaacatactgaaagggacaaaaaaagaacactgttcttcatttttgaataaaatactgttgtttaaaatgaccaaatcattcacatagatctgaaaattagttttttccagcgttttaatttccaggctttccaatagttttttcagatcatccaggataagagctgcttcatttttcttcagtaatcccatttcattataaaacgaaatctgtctcaaggcactcataatggtagtgtcattccagatttcagttacgttttgtttatcataaagctctttcagcatttcattttttacagaatgatattccattttaaattcatggaacggacttaaaaacttatcctgattcagcagattcatccagacataaaacttgaaacgggacaggatagaatctgaaatggtatagaaaaaagggatgtcttttgcagaataaaatactttggaatcagcaatattctgaaaaacattcagaatttttaaagagttttcaaagtaattcaaaaggtcttctgtggtttttacaggctgtgttcttttgacaaccaactggttttctgttcccagaaactgatccagtgagatctgataatatctggcgagttctagcgcttcttcaaaactgaatttagctttcatagaagttcttctgtgcgctgcatcgtagctgatattaagaatattggcaatctcatcatttaaagatttttcacctatttttcttcggatttccttcaataaagcctcctggtgcatagttttgcgattttcacaaatgtagtgttttttgtggagaacgtttttgattttctgctttgaaggctggaagcctgaagctggaagaagggaagtattgaaagtcaaaaaaataaatagctgtttacgacatcaatgggatttataatcactattgctatttatcacttaaagtaacttcccgccttcttcttcttcccgcttccagcccgcttatattagttaacacttcatttcgttatctacatatttgtgattttcgcaaacaggataatttttttaattttttttcacattcggaactgtaccttctgccgataattttgaactgtaattttaaaataacgaattatgaaaacacgaattttaataacagcagttcttttagtccatggtctgatatacgcatcagacagtctgaaggttgattctttgaaaccaagattaattgcagcatcaccctcaaagaatgtcaggaatgtcaacgggattttatttaaatattttgatgaggaagatcattttaaaccaaagaaagtaaatggcttaggcatgggattcaattttgtgggcattttcttgccgccattgatgcttttcaatttacagccaccaggaaaccatgattatgtaattgttcctcgtaaaaagatgaataccattaacggactgcagttgtcaatcatcaacatggagcctactgtcacaaacggactggaaattaatgtatcgagtaatatcaatacgtatgcagtgaccaatggaatgtctgtttctccgttttttaatgtgcatcacgagatgaaaggtgtttctgtagcgccattagccaatatcgggcagaaatgccggggaattcagatcgggttgtataatcaatgtaaggatttcagaggaatccagattggcggatggaatgagaacggaaggagaaaacttcctctaatcaattggaattttaagaaacagaaagtaaataagaccctgcaggagagtaaccaaaatcagtttaacccttaaataaccgaccatgaaaaattataaactgatcttatttttattgatgttatctgcacgcattttttcacaaaatacaatgaatgataccttaaaaacaaatattgaagaacctttcgattataaaaaatattatgattgtgattttggagaagggaatgttttgattgtcattaaaaaaggaaatgaatttacagatcttacggatttaagaaaatccggaaaaggttttgccattaaaatggaagctatttatagtatggaatttgcggatggacagagatatgagtcaagtgtggtgaaaagtattacccaggacagtatttcaatcacgaattttttcaatgagaatgctgcgaagcttgcaggacagccctttaaattaattacttatcctctgtcatctttgaagtatgtccgttttattgatgacagaatgttgtccttgtatagcaaaagaaatatccagaagaacttcaatatgatggtgaagaaaatggaccgcgctaaaatgtgtcctgcagtaattcaatttaaagatagaaacaatgaaatgaaagtctgtcatttctatctgacctcttagggctatgatcttctctatgagaacaacggaagagtatattatatggaaggtaaaatagaatggaaataacttttgaagagagtgcattttcagcctgtactctccttttgtatttatcatcattaagtttaatgacaatattgatgaatacgttgaaaaaagcaaaagcaatggcacttgtactgaagaaaaaataatatttttgtaatatagctcggatgaatgatgaaaataaaatgtttaatactgttttttattattggaaatctgttttttcacgcacaaaccaataatttagaaaaaaatactcatgaaacacggtcttataaagaattggaaaaagaattctacagcagtcgtttcggagatgtaaacagtaaaagtattgcagaaagttatcttaaaaaagcaaaatctgaaaaaaatattactcagattgctgaaggatacgttatgcttcattttgaagagaatctgcccaatgcattaaagtatcttgacagcttacagcatattaccaggaattattccaaagaaaatatatatccggccagaatctatctcttaaaagggaatctgtatttcaggaatgataatcttcagtctgcactgaacaattatattttaggattgaaatatgccaaagaaaaaggaaataaaagacagattgccatggcacatatcagtattgcctatcttaataattatattgggaaacatgctgagacagccaaggttttaagacattatgcgtatgatgctgattatatgactcaggatgagaagaacggtctcaagttaaacctggctgacgcatacatagaaatcaataagatggattctgcctatatccttataaaagaaggcttactggattctaaaaagaataaggatgtttaccgctatcaccagaaccttggaatgttaggatattatcatctgcattcaaaaaactatcagaaagcgatcgatggtttattagagtgtgaaaaatatttctttaccaataataacggttctaaaaggaaccagcattatacttctttgtatctggggaaatcctacgccggtctcaacgaaaaagagaaagcggtagagtatttccggaagattgattctatggttcttaaaaccaattacatttatcccgagctgagagatgtatatacttacctgatcgattattataaagaaaacaatgataaagaaacacaattgtattatgtagatcggtttttaaaggtagatcatgttctggatacccagttcaggtatatttccagagaacttcccagaagatatgatactccggaactgcagcaggagaaagaaagtattactaatgagcttaccaaaagaaaaagtttattttatattgtactgagtcttctgttgatatcacacctgttgtttatcaacgtttattttaaatataaaaaatccgaaaagaactataaaaaaattgcccaggacctgattcagtctgttaatgaaaataaaataggcaaaaacaaactttcggaagccaaagaaattcttcctgaagtttctaagttagaaaatacagaacattctgaggacaaaacaccaagaacgatttccgaagatattgctcaaaccattttaaaagaacttgaaatatttgaaaacaaagatcagtttttgaataagggaattacgctgggaagtcttgctaaaaaaataaaaacaaactcaaaatatctgtcggaaattatcaatacctacaaaggaaaaaactttgccacttatcttaatgatctccgtattgattatgccatcaacagattggccaacgataaaaaattcaggtcttataagattccatttattgccgaggaactagggtataataacgaacaggcgttcactttagcgttcaaaaaacgaaccggtacaccactttctatctatctgaaagaaattgaaaatatgtcttctaattaggagtaatttattgattttcatttgtttgaatttataaattcatgattttaaatatatagatttatgaatctatagagcattcacttgtatcattcttcctcttttctgcatctttgcttcaggtaaaaacacaatgtttcattttgtatgtgcacattacaaaatatcaattccgggttgccggttaattaaaagaactttataacaaaattattaacgaactggtaaaaatgagaaaagataaccagtaaaaaacaatagctaaagaatgaagtaattgttcatagttcagagatgtaaaagagtggtgatcatttgaaaaatcattgaagtaattaaaaacaaaattcgcagaatccatccaaaagtgtttaaaagtgtagtatagtttaatttggattcgctgacctgtagttgatcatgaaattattgcttaaaaactaataaccatttcaatacataaaaactaattccatgaaaactcagaataaattaaaatttattctttctaaaagtgataaggttgagtgattcactccggtcagatgcgggtttatcttgaagttcaggacaatattgagtggaaatgtatccttacaatgaaaaagattgagcagcagaaaaaggtaaatttcctggactgaaagtttaaatgcttgttaaatgatttttaaagacggcgcaatcattaagttgcgctgtttttttgtaactttgcagacattaatttttatataaaaaatttatcatcaacaaatgaaaaagcaaacgatcaaagaaatcctgagggattacaagaaagtattacatcatgacattacagtttacggatgggtaagatcattccgtgctaatcgctttattgcgcttaatgatggttctacgattaataatttgcagatagttgttgatttcgaaaattttgatgaagcaatcatcaagaatatcagtacggcttcatccctgaaagtagtaggtgaagtggtagaaagccagggagcaggacagtctgtggaaattatcgctaaaaagattattattttaggggataactttacggaagaacttcagagtacaattcttcagcctaagaagcacagtctggagaaacttcgtgagcaggcgcatttaagattcagaacaaacctttttggagcagtgttcagagtacgtcacgcagtaagctttgcagttcactcattcttcaaccagaaccagtttttctatatcaatacaccggttattactggtgctgatgcggaaggagcaggagaaatgtttggagtaaccaactttgatctgaacaatatgccgagaactgaagaaggagagatagattttgcacaggatttcttcggtagaaaaacaaaccttacggtttcaggacaacttgaaggagaaactgcagctatgggattgggaagaatttataccttcggacctacttttcgtgcagaaaattccaataccacaagacaccttgccgaattctggatgatagagccggaagtagctttcaacaaccttgaagacaatatcgaccttgcggaagatttcttaaaatatgtgatccagtatgtattggataactgtaaagatgatcttgaattcttagacaagcgttttgaagaagaacaaaagtcaaaacctgaaaaagaaagagcaaaagaaggtcttatcgaaaaacttcagaatgtagtggcaaaacgtttcaaacgtgtaagctatacggaagctattgaaatcttactgaactctaaagaaaataaaaaaggaaaatttgcttacccggttgaaaaatggggaactgatcttcaatctgagcatgaaagataccttgttgaaaaacatttcgaaagcccggtagtattatttgactatccgaaagaaattaaagctttctatatgaaactgaacgatgacaacaaaaccgttgcagcgatggacgtgcttttcccaggtatcggtgaaatcatcggtggatcagagagagaggcaagattagatgttttaaaacagaaaatggcagatatgcatgtagatgagcacgagctttggtggtatcttgataccagaaaattcggttcagtaccacatgctggttttggtttaggactggaaagattagttcttttcgtaacaggaatgacgaacatcagagatgtaattcctttccctagaacgccaaaaagcgctgaattctagaacaataaaaaaagccttaatcacaagttaaggctttttttattctttaatagtttattatgttgggataagtaatgcaaaaatcatgctaaatgcgttttttatcaaataaatttattaaattcgtagaatatgttatgttaaaacgtaaataaagaatatgcttaaacaacacttacaactcaaattaggacagaagctggcccctcagcagatccagttgatgaagcttattcagcttcatactcttgaatttgaagaggagttggaaagagagttagaagaaaacccagctttggaaattgcgaaagaagattctaaggaagatgattattcttcccttgaagacgcttatcaggatgagggtacagaaagcattgaaacagatttcgacgtcaatgaatatatctatgacgacgaaccaagctataaaaccgcatccagcaactactctccggatgatgaagaatttgataacgagagtcttttaacggaaggacagtccttatatgattatcttacagaacagattcacctggtgaatatcagtgatgaagatctgaagattgcagaatatcttatcgggaatttagatacggacggctatctgagaagagagatcaaatctattgttgatgatctggctttctcacagggaatttacactactaaagaaagagtggaggatatcctggaaaattatgttcagaaacttgatccgccaggagtaggagcaagaggactgcaggagtgcctgttattacagattgaaaagaaagtcagctcagataaagcagtttctttggctgccaacatcctgagacatcagtttgaagctttgacgaataagcattataacaaaatcatccagaaatacgatattgaagaagatgatctgaaagatgctctggatgaaatatcaaagctatccccaaaagtaggagggaactttgatacacagacaattacgatcaatcaggaaattatcccggattttgttattcaggtgaaagacggtcaggtaattcctatgctgaacagcaagaatgcacctacattaagagtttctgaagaatacaaagacattcttaccacatattcccacgataaaaactcatcagaacacaagcaggcagctttatttatcaagcaaaagctggatgctgcaaaatggtatatcgatgccattaaccagcgtcagaatacattgttgcagacgattacagccattgtgaaatttcagaaggattatttcatcaccggagacgaaaaatctctgaaaccaatgatcttgaaggatgttgctgatattacaggatttgatatctctacgatttcaagggtggtaaaaagtaaatatgcagatacacctaacggtattgtatatcttaaagatctgttctcagacagcttaacgaatgatgatggggaagaagtttccaccaaggaaatcaaaacccatcttcaggaagtgattgataaagaaaataagagaaaaccgcttaccgatgatgcattagtggttattctgaaagaacagggatataatatagcaagaagaacgattgcaaaatatcgtgaacagcttaatattccggtagcaaggttaagaaaagaactttaatcagataataaaaaggtgaataagcttattcaccttttttatttcaaaaataattctgaggccattaagaaatcagaaatacctgatcgctgatctttttgaacagactgaatgtattaacctgttttcggtattcattgttttcccaatatacttttccattcttataatcattcagaagtacaaagattcctccattgatttttaagaaggcaatagcgggaaaactgagttcctccatatcctcccagtgatcaagtcttacgaccatacattcaatatcaaagtcattttgtaatatattataaaagctgtagaagttataatcttcgattggtaagttataatcttgtatttttcttgcttttttatgctgctgtacaaatttctttaacaaaaaattaaaagatcgtaaatactcacattttttaatcataaatgttgaaatttttaataaatatagtatgcattctctgttacacaattctttacattctttatactgattttgtaaggaatgttttctttatttttataatgaaattcaatagtactaatattctttttacttactcctatccattggttgcccttaaggttataaagaaaaaactgattataatgaaacatattttcaactttgttaataataatcagtttgtttttatcctgcggatagaaggtaatgtgggtttttccgattttataagactggtcttccaggaaattgacatgctgtttccgagtataagcaagaagtttagatttcaccagtaaaagcctgtaacgtgtattggtgattcttttctctatcttcctccggattttttttataggataggagatattgttagatctgtaatgaattccccgaggtgaaatggaaaatttaccctttgtatcaaacggatctataaagaaataaggattgtctttaagattgataagatgaatcagcaggtactgtttttcagtcaccgtattgaaaatattaccttccacccagtgatgggtggcatcggagtaaacgaactcctgaacgatgtttttgtgataatatttaatttctttctgaagttcaagcttccggacaaccagtgtgaagctttcaatctcagtcgggatatcagtgatatctttggtatgaacaagattaaattcaaaattacattcgtcaaaacaaaaatggcgggtattctgaagaatatgtgcatagtccttactctttttgaaaagattgatgcattgctcattgttcttcagtagagtgaaaaatccggccggatagtttttgtgaggtgagattacatcatatttcttcaatattttctctgtgataaaataccgtatattcccgaagataatatcaatgtcacaatatccccagaagtcgtattcctttaaatagtcctgaaatatcaggccataggtaggcttaaaatcacatagtttgtaaccgtccagaatgctgatagaaagattcagcttttcactggccattttactgaattcggcgagactgctgatcttggtaaaatgcacattcggtaaatgaaatggcgcttccagattggtaaataataaaaaatcaacatccggattgtatttgcagctgtataaaaaatgattgaaatactcaggccagcttttgccaaaataacagtttattaatgcgattcgggtcattttacgtcagttttttaatattcagcaatgagtcatagctcttgtgtaaaaaataatacagaatagactcgtggatattcggttttgaagcaaacattctgttgataaacatatgaatatagcttaccatcaatgatttaaccatttgctgagattgtagttctttaatctccgtaatataacgggcggtttttttagttcttatatccagaatttcagaaaactcatgtgtacccgtaagaagctccagggtctgatgcctgtgattcctgtatttatctttcaaagtctgtttagaattatcatccagcaagcttccatatccattggcaagctgttgcaggatgtctcttttttccgtcatcgtatatccgaaatcgtcaagaatatggttgatgcctgctacggcagctttccagactggagtttttgtgtatccagtttctttcagtaactggcagacacattcactgtcgaagtaaaaaatactttccatctgatctatcgtagtttcgccatagcgttcaatttccctattgtaagtatccagcataattttatgaataatcatttcccgggtcagatatttgtccagtaactggtaaatttggctggaaagtgtatgatcctgagatgtagtcagaaacctcactctgatatgcatgtccggatcgctgtaacggataaagaaccatttttttataattccttttctgacaagtcccttagcgaatttatagatggtatctttaatgatctggtccgaaacttttgtgctgcaatagatcttatagaaaagccattcgcttccgggaatgaaatttcgcacaaccgtattttttacaggaaaaggtgttagttttgatttcttttgactgcttacattatgccaggggataagaaattcattgctgtgaggattcccgtttttatctctggttaccgttttatattgatcggaaaggttttccagcactcttatctgtttctcttttaccagatgatcaaagagaatttccagcgaaagagaattgttggtaaataccggaagttccatatctttttcggtaaaaatacagacctcaggaatgtttttctcctttaaatactctttgaacacgtgaatatcaggtttctttcccttgaatattttctgatcatccaacagccatgatgctctggaaaggatcacattattgatcataattctgggcagaaattcgtaattcacaaacattccccagttccagttataagacggtgtcatatgttgatactgaagatcacacagaaaatgatacatcggtactttatgcaggttgtaattatgtgccgatgaaagacttgggattacttctttattatgctttttggaacggagaacaattctgtcattttgcaccgaaatcataaggtcatccagataaacaggctcgctgtctgcgtggtggcggttaatgatgggaatttcatattttcttagatgaggtctgatggtaatattcccgactctcggctgaggattgtgtaccacttcagcaatgatctgcccgtcatagaacgattcttcttccaccaaagcttcttgtaccaatttctccagatgttcatccatatggcaaaaacgtcccagataagtggaagacgaaggtccgtcactgaatttatgaaagataacaggttttccctcctcatcttcatagatgtgtgcaagtgatgacattgagaacgggatgtttttattctcctctgaaaatgaggaaacttcttcctgcgtaatctgtattacattctcattgttttttaaggcattaataagcttttctcctaaaaactgattccatttcagggatccctgaatgacattggttgtgttttcagacttaaactggattccatccgtcagatttgggttgtcattatccgaatgtaatggatagttgactcccgataacgggtcaagggccaacaatatcggaatttcctgctgatcatatcttgcaataaattctttcttaaaattctctagcgaatcaatattgtcggctgctccgatctgaaagactgttgaaagtaccttttttaaatctttaaaaatatttttatccagcctattgaatgttttgcccttcagtaagtcggtctgaaggatattttttttgtggtttttgattcctatggaatttaagatctcagaaatctgatcaaccgcaagaaatgtagtattggttttattggctttctgtacaatttcaaatatggtaattaaactgcggattaatgctgcatcttctttgttttcttcatccgcaggaatgttcagttcttttaaaaactgatagataaaatcctgaaaattcttgtcggtaacctttggtgaaagctcactgataagaatttttgagtctataagatcattaacatagtcgaaactgtcctcataagaaatgtcctggtttactaatatttctatgatggcagaaagcttcaagccgctcttacaggcttttatgacagaattcaggtatttgtttttttcggtggaaataatttcatacttcaacccggaatcccgtatggtgggctcaatatagcggtatttatttttggtgctgtagatcgtattgttggtatagaaatgacagacttttctcacctgcatattttcctccagttttaccgtaatatcatgcagcagctgcatatccagtcttgcaaatatcttatcctgatccttatccagaatgatttctgtacggtcactccattctcccttacttattccggcattggttccgaaggggatggttctgaaatgggttcttagccagtatttcaacagtgattttttgatcttatccgctttttctccggacagttttttttcttcccagttgatgagctgttcatacaaatccggtgatgacagataaatggtattgcgaaagctttctgtatggatatcctcttcccactgatcaatgcttttttgtggaagaagcggtgttcttagcaggtaaaagctcagtttttctatatcgttgtatttcatcctatattcattaagtaaattttatcccaatcctttgctttttcgggatactgataatccagcaataccattcctacccccgaaataccttccaatagccctgtatgttctacccattcgtcatttttaagatcataagggaatttggctcctttttccagctggtccagagtaagagacatccagtaattgtgtgcttctttcagctcttcgttttgaaatattctgtagaatttattgaatatatgtgaaattcccgcggttccgtggcatattcctgtgtctatgcagtcatttttctgactgtaaaatactccggatttgtctgcttttattttcgatacattcaatataaggtgatagcacattgctttcaggttttcatcctgcaaaacggtatacgctttccagagtccgattgcaactcccaggtcgccatagcaccatgccagtctctcggataactgtttttcacctgttgcaatattaagttttgaaggaaatatgtgctgtgcctgtttattttcttcgtaaagttcattgagaaaggtaacgcttccactgatcagttttgcacaggtttcttttttgcatcctctgtgatagcattcggctaaaaaagataggatagaaggctgtccgtgggcaagaccaaggtcaatgatgttctcttcttttactatatgatcaatccagaagatggattggtttctttcatgtttcagttggtctatatgagacactattttatctacggcatcgaatttcttaatttcaagaaagtaaatccccaatccgatcaggccggtaaataaatcgtattcttttttatctgcagcggcagaaagcagttcaagaaaaaattcaatagaatcttcttccagaccgtcaatatcttcatctgtaataatatcagcattgtgcaaaagcctcataaagtaaataatggctaagcttccggttgcaaatgatgagtaagaagcttctgaagccatatcaatgagatcctcaattttttcaatctctacatcattgttgtaaaataatgagtagtatccgtttcccaggctgaacgtgatgttttcacctttatcctgattacatttttctgaaatttgggctaaaaaaaagtcaattttatctttatacatattggcttaatatttcaatagctgttaaggaatctttatgtgaacgtgagatattgttaaacataaattcattatatccgtagagttctttaaattccagcaatttttcgtgaaagaaacttccgtctcctacaaggcttatattgcttatatcattgttggtactctttttagcaacattaatcgccttacgttttgttttatggcagcatccggaaaaagtaagtaccatggacggctcttttccgtgttttgctttatattctgttctgaagttttgcagctcttccttaagataatccttatttgattctccatgaaatatggatcttgcaaaattgagatcgttctccaaagcaacttttaaacctgagtgtgatgatcccatataccatacatccggaatattccctttgtaaggaggaatgatgagatctttttcaagaaattcactttcatctcttaaaaagctgagtgtagattccagtttaggaagaaatgaagaaaaatagttttctttatctacatctacattaaaatatttaagatcatattcaccaaccagaccttttacaaatccaaggtctaatcttttgggatataaactggataacagcttataattgtgagccactctgaatgggctttgcaagggaagaataacgcccgcaattcctattttgattttttcggttaatcctaataatatgggaatcagcatttcaggagtagaccacgccatgtcatgggcttttgaaaagtagttttcggtaacccaaaacctggaaaaacccagttcatccgctcttgtagcatagtcgatgatatcgtataatgatttcttagaattgttgagtgagttttctcttatgccaaattctaaaaggcctatttttaatttatttgccataatagagctattaaaagcagctaccccttacggagtagccacagttttttgtaaaatgtttctgattaggatacaggacaaacacaaaggttagtagatctgctgcttcccgcagtgcaagtccagtgtgaacaatcgaaaacagatgttactagctcttttccagcttttactgatttcatttcgtcagaatttaattgagataacttctcttttttaagagttaacttctttgtaagctttttgctcatggttaaaaaaaatttaatttgtacctactcgttagcttttcggtttccgcttttttatcaattaaattatatttttaaaaatttgatgacagatgtattgatggcatccggtttttcaagcggcacataatgagaggcatctggaacaatcagcagctgtgtgttagggatactgctattgatcattttggtatgttcttccctgatcacatcgttacttcctgcgataatcaagaccggatttttaatcccttttagctgttctgtactgatatgggggtgctgaaccattagtttgatcagcctctggttaggggcatcttttatttcaagctgttttttaaaagtatccagcgttttgggttctataccttccggatttgtattggctccgataacaacaagcttgtttacaagatcaggatgattaatcgtaaacagtaatcctgtaattccgccgtcactccagcctaaaatattaaatttactgatgttaagctcttttgttatggctaataaatcatcagaaaatgtttcgtacatgtaatcaccagtggaaagatccgtacttcttccttgccctcttgtatcgattgcgatgactttgaactgctttgcaagatcaggaatctgcttatagaaatctgatatgctgccattgtttccatgaagcaggacaagcggttctccgcttccatattcttcataatatattttagcgttcttaatatctatatattttcctgatttattctttccatagattgtttttctggcctgctctttattattgtaataatccaccagcgcctgttcttcagtgctgttttctgttttgcttatcgtgttgggagcgctcccgtttttatctttgaggtagctgatgtctatattggagatgaaacttcctttgccggtttcccattttccctggctctgataacggaaaagcaggtcattggataaggttttttttgctgagattccgaatacgaaatctacattatcctgaggtacactttcaacgagctgtaaggtaatggccagttgatcgagatcactataaatgagtttatacttttgaagatctatcgtttgccatcctgtagtacctgttttgtaaataatgttttcatataggagagattcctgcggaatattgtccttgacagaatagatattcagtttcaaagtaatttccttgaattttgaactcggaatgatataaaaattatagctgttaagttttgtccatttataaatgttgaatacctgaccctgctctatagtaggaacatttttatcaaacattttagagaaagtaagcataggccgttttgtgttgccaacaatttcatttttttgctttttccctgttaggttgatttcctgaatcgcattggtttttttacttaatttgatatgggcatctgaaataattgcctgcacggtaacttttttatcgtcatagccgttggattcgaaaataaggtgatcgcttttcttggtatcttcagggatttctattgagtagttcccatgagtatctgtaatggtgctgatatttacattctcaagacttactgaacagtaagaaattgcctggttgctttcatcggtaacttttccagatattttttgagagtaaatacttatactaagcaatagtgcgcctagtaccgatatgattttcatggttagtttttttgtaaatatattattttatttcaaattaatcacattttgaggaaaaaaataagaaaaaatatttgttaaatatattaatattgttgaattttcatgctgtattttaaattaattctaataatttgtgactttttaatacaaaatcttaatatttggagattgtctgtgtgtcgtatttgtcactgatttgtgttttaaataactctacttttcttgagaagtagagttatttgattttttcacaaaaaattatagcttatttttgatattgataatgccggaaatggtcaatcttgaattgttgtggtaccggggcattttaataatggttcttaatgttttccagcccaagttccctcatcgaaatctctcgcatctccacctttcttattttcccggaaatagtcatggggaattcatctacaaatttccagtattttggtactttataatgggctattctgcctttgcagtattcctggagctcttctgcagtgatggtaaatccttttctcactttcacccaggccatcacttcttccccgaatttttcactgggaacaccaataatctggacatcaagaatgttggtataggtatataggaaatcttcaatttcttttggggaaatattttctccgccacggatgatgaggtcttttatccttcctgaaatagtaatataaccgtctttatccattacggccatatctccggtatgcatccagcgggcgtcgtccagtacttttttagtattttcaggatcattccagtatttcagcatgacagagtaacctcttgtgcaaagctcaccatgttcaccacgctttaatgttctgccgttttcatcaataatttttatttcaaggtgatcctgaactgttcctacagtgctgacctgtttctccagcggtgtccctattaaagtttgggtagatacgggtgatgtttccgtcattccgtagcagatgctcatttctttaatattcatcaggttttccaccttcttcataatttccggaggacatacggagcctgccataacaccggttcttaaacttgaaaaatcatagctgtcaaaatcttttacggccagttccgcaataaacatggttggtacaccatacaaagaagtacatttctcatccgaaacagcttttaacgtgatttcaggatcaaaactgtcattgggaattaccatacaggctccgtgggcagtacagcagatatttccgatcaccattccgaagcaatgataaaaaggtacgggaatacagacacggtctttttcagaatattttaatcggataccgataaaataaccattgttgagaatattatgatgggaaagcgtaacacctttcgggaaaccggtagttccggaagtatactgaatattaacaggatcatcaaactgtacatgttcttcaaagctgtgaagcacttcatccgaaatttcctgcccgttattgacaaaatgttcccagttttcatcaaagaatatttcgtgctccagggttgggcatacttcttttgcgtactcaaccatttctttgtagttgctggttttaaagcttaaagaagaaaaaataaagcgaacttcggattgattaagtacataagttaattcatgagtccggtaggccggattgatattcactaaaatagttcctattcttgcagtggcatactgcaaaagtacccattcatagcggttggaagaccagatcccgattctgtcaccagcttttgctcctaaaaacaatagagcttttgcaacagcggttgtctgattataaaattcctggtaagtagctctgtaattctgatgaacgcagactaaagcttcctgatgggggtatttttcgaccgtacttttaagattggctccgatggtctgtcctaataatggaatctcagatgttccatacacataagataagggcatagtttaagatttggtggaataaaattaataattatatcccgaactatgcctatggatattaattttcctgagaatctatttctttaagctgtttcagatttttatcaagctttttaataatggtaccatataccagtctgtaataaagccagatcatagaaaccgcgagtaatgtgcttacggcaattccaacaataacaatggtaagattggagccgctgggctgtatattctgggaatccaatatataaaatataaaagcgaccagtacaaacgtgaatattaacagtaatacaatactgatcagaataaaagcattgacagttgttttgaatttaatgatccgggtaataagtcccttcagattttcctcgatttttattttccggtaattctgatagaatttcagcacgaaataagccgtaatcagcaagcttaagatttttatagccagataaacatgaccaaagttattttctgcttcaggagcttcctgtgcccctaatctctccagcattttacggaaactgtccgactcttcttccgggaaaaagtaaaacagtcccagtactgaaaagaacagtaattctacgacactgatccagaaaatgtatttcacataattgcgtgactttctgttcaacatctgaagaatctcggtgttgtcatatttatgctgtacaggttgttcctgccatgttttcttaaagctgtctaaatcaaattcaggcatatttttccatctgttctttaagggttttctttaatctgttcattttcacgcgtgcattgacttcagtgattccgaggttctctgcaatatccttatatggcagatcgtcaagatacatcatgacaatggctctttctacattaggaagagtcttgattacagtatacaaaagtgatacctgctgctgtttttcatcatcatcttccacaaaatccctgtggttgatgtccagctcattcgtaggaaggcttttgcttttttttctaaagagggtaatggctgtattgagcgctacacggtacatccatgtggaaattttagaattccctttaaaagaatcgtaacttctccagagctgtaacacgatttcctggaaaagatcctcttcatcttccagagaattggtatacaggcgcgatacttttataatcagtccctgattatctttgataagctgcgcaaattctttttctctggaatccatagatatataatggcacgaagataataataaactggtaattagggaaaattatcatgtaaaatagtaaagaggtgaaaaaacggaaaaaattgatcaatcaatatcgtttgcatggcactaagacctttagtcatttcaccatttgcttttttaccacaaaatttgcgtacctttgcctccgcgagaaaatcggcctgttgatttcccgttttacgggaggtaggaaagtccggacaccacagagcagcaaagcggataacatccgtcacccgtgagggtaggacaagtgcaacagaaagcaggtacagttcggctgtagtgaaaccaggtaaactctttgcggtgcaatggtaagtatatcggttcttttcagtaatgaaaataggggcggctcgtcctgaaaaccgaggggtaatcagctcaagtgttgcagcaatgtaacacgcagataaataacaggcgcttctccggaagtacagaatccggcttatagattttctcgtgattttttttaagctggaagtcagaggctggaagagtgacgttttttaaacgcaatgattgtaaaactccatcttcatgcttcctccttccaactgatttattcgctttccaattgttttttagaatccagtaattcttttctgtccttatcagaaagcgtaggatatttaagattcatcttttcaagagtatcaatgataatctgaatggcagctactcttgcaaaccatttgttgtcagcaggaagcacataccatggggcatgatcttttgcggtctcgttaattgctgtttcataggcttccatatactgatcaaataatgctctttccggaagatctcctgcagagaatttccagtttttttcctgctcgtctattctgtctagaagcctttttttctgctcgtctttggatacgttcaaaaagatttttaccacagttgtgccgttttgcgaaagatgtttttcaaaattacggatgctttcatatctgttttcccagaatttactgtcaaagtcttttactgaggaccacgttttttcactcaggttatactcaggatgcactttgcatactaagacgctttcataatgtgaacggttgaaaattcctatcatacctttctgtggcagtgccagataatgcctccatagaaaatcatgggaatattctttcgggcttggagttttaaagctcgtcacattacatccctgtggattcactcctccgaaaacatgttctatcatactgtcttttcctgccgcatccatagcctgtaatacgaccagcagagactggcttccgtcagcatataatttttcctgcagctcacggagcttttctttctcctgaatcagcatctgctctccttcttcttttgtaagctttcccttataagaggtcgaagttttttttattgaaaattttccgtttaccttaaagtcatctgagaaattggtgtccatatatttattaagattaaaagattttgttattaaaattcaataggggtgggttttagcccagccatttaaatgtaaataaatgtttaattaaaacgtcaatacatctattaccggctattacctatcatgcgcaacctaatccaacataaatgtaataaaaaaaccgcctcaatagagacggttcctttattttttgagtagagcttactttgcagcagcttttttagcaagttttgcagcttttttctcagctttagcagcttctttctgctcagcaggagtcaatacttttggttcaggagcgttagcatctacgttacctttgatgtagattacacttctgttgtttgcagggtcgttagagaaaacctcgatcattttgttgaaaggtccagggatcgctgtgttgtatccaactttaatcttagcagatttacctggcatgataggatcctggctgaattcaggagttgtacatccacaagaaggctttacatttgaaaggatcaaaggcttgtcacctgaattcgttactgtaaagaatcttgttccgtcagcgttaggcttgatagttccgtaatcgaaagtcgttttatcaaatgtaatagtttgtgcagatgcaagagcaaatgtcccgaatagtgcaattcctgcaattagttttttcatattcttgaatgttaatatgtttgttagataaattttgtgaaacaaagttaaaaattattttaattcatgcttaaaaatttttttctttagactatttttgcaaattgcaagccaaagaaatagaatttatgcagatttcagaaaagtacaatccacaggaaacagaacagaaatggtacaattactggctggaaaataagtttttccattcagaacctaatgacaagccaccctataccgtggtcattcctccgccaaacgtaacggggatattacacatggggcatatgttgaataatacccttcaggatgttctggtccgtcgtgcaagaatgcgcgggtttaatgcttgttggattccgggaacagatcacgcttcaattgctactgaagctaaagttgttgctaaattgaaatctgagggagtcaataaatcagatattacccgtgaagaatttttaactcatgcctgggattggaccaataaatatggtggaaccattcttgagcagctgaagaaactgggatgttcatgcgactgggacagaacccgcttcactatggaggataagctttcacagcaagttattaaaagtttcgtagacctttataataaaggactcatctacagaggctacagaatggtcaactgggacccggaagcaaaaaccaatatttccgatgaagaagtaatatttaaagaacagaatggaaaattatatttcctaaaatataagattgaaggttcggaagagtttctttcagtagctaccacgcgtcccgaaactatttttggggatacagccgtatgtatcaatccgaatgatgaaagatatgcacatttaaaaggtaaaaatgtaatcgtaccgatcgttgacagagtaatcccgattattgaggatgaatatgttgatattgaattcggaacaggagctttgaaaattactcctgcacatgatatcaatgactatgagataggtcagaagcatcatttaaaaatgattgatgcacttgatgatgacggaaaccttaatgaatatggtttacattatgctggtaaaaacagatttgatgtaagaaagcagatcgctaaagaacttgaagaaaaagatcttttgcttaaagcagaagattatgtaaataaagttggaacatctgaaagaacaggtgccgttatcgaacctaaagtttcagtacagtggttccttaaaatgtctgaaattgccaagccggctttggatgtcgtaatggatgatgaggtaaagttctatccggaaaagtttaagaatacttataaacactggatggagaacatccgtgactggaatatttcccgtcagctttggtgggggcagcagattcctgcttattactatggagaaggagatgaagactttgtagtagcagaaaccaaagaagaagctttggaacttgcgaaacaaaatacaggaaattcaggtctgacggcagaaaaccttagacaggatgatgatgcattagatacatggttctcatcatggttatggccaatgtctgtatttgatgggctacttgatccggaaaataaagatattaattattattaccctacttctgatcttgtaaccggaccggatattattttcttctgggtagccagaatgattatggcaggactggaatacagaaaagaagttccgtttaagaatgtgtattttacaggaattgtaagagataagcagagaagaaagatgtcgaaatctttaggaaactctccggatcctcttgaattaatggataaatacggtgcagatggtgtacgtgtaggtattctattgagttctgctgccggaaatgaccttctttttgatgaagatttaatgcttcagggaagaaatttcatgacgaagatctggaatgctttccgtctgatcaatatgtggaatcacgaagacaaaccagctgctgctacagataatcaggctattgaatggtttgaaaataagctgaacaaaaccatctttgaaatcaatgatcagtttgagaagttcagaatttccgatgcactgcatttaatctataaattaatttgggatgatttttgcggttggtatcttgaagcgattaagcctaattacggagaagggatttcaaaagaagtttataacaaaaccatctatttctttgaagagctgatgaagttacttcatccgttcatgcctttcttaacggaagaattatggcagatgatctcagtaaggaaggtagatgaggctttggtgattgctcagcagaaagaggcaggacagtttgatgaaagcattattaaaaactttgaaactgctgcagaattaatttcaggggttagaaattaccgtcagacaaaaggaatttcgccgagagaagccgctgaaatttataccaatgcttctgaatttgccaatgaagctgtagtaagaaaactggctaatgtttctgaaatccactttggacagaaaacagataaaccaagctttacattcctggtaggagcaactgaagtttctattcctttaagtgaaaacttagatttaggagaggaaaaagctaaaactgaggaagaactgaaatatctgaagggattcctggtttcagtagagaagaagctttccaatgagaaatttgttgcgaatgctaagccggaagttgtagaaggcgagcgtaagaagcaaaaagatgctcaggataagattgcgatccttgaagaaaaactgaaaagtttgtaaaatatagacaataaatttgtcagaaatctcaggctgggtacagatgaaaattgtatccagcctgatggtttaaaagaataaatacaatgacacatatagaaaacataaaaaaactattctcgaaagattttgtagaaagtccgttactggaaagttttgaagtgggaaagatctatctttccagcggaaagctggtggcctgtgatcctttgatcactaatgatatgcttcctttcactacagaatttccaaaaggagatttctctgtgatgctgcacaaagaacgagaaagtaattgtgtggcttatgccgaaattatattcagcaattctgaaattaaagaatggaagctggccactacggcagggcagcaaataaaagatctggaagaaggagaggtgtttggatatccggtagaaagcggtatgggatgttttatggatgttgatacccaaaacagtctcaatgaacttgaacaaagactgtatcaaaataaaggaggggattttatgggaatttatgaagaatttttccatgattacttctttgatgaaaacggagcgatagatcagtatgcctttctgaaaccggcaaaggaacatccgggaactatttttgcttttgaaacaggatatggcgagggtttttatgcaagctatgttgcttatgacaaagatcatcagcctgtgaaaataattactgaatttatagaaataagttaaattaaaattagttattttagagatctaattttatcaggtataaattttaaagctaatacaaacacaatgaatttctcatcagaacaaccccgtattattgttgtaggcagctcatctatagatttggttcttgaaaccgaaaaactccccttacctaacgagactgttttggctgtgaagtccgatagttatttcggtggtaaaggagccaatcaggcggtagggacttccagattgggagccagtgtatactttataggatgtgttggaatggaccctctgggccagcagatcatgagaaatctggtaagcgaaaatgtgaatgtaggatttgttcatgaaacagataaagaagctacaggaactgcttatgtaacaacttcccatgggaatgcagcgattgtggtggtaccggcagccaataaatatctcagcaaatcacatatagatgaagctgacaaatattttcacaccgcagatcttatactggtacagcttgaggtttctatggatgtagtggaacataccgttaaaaaagcaaaacaatacggaaaaaaagtaggattatatgcttctcctgcaatgagagtcagtgaagaaattttagaaaatgttgactttattgtggctaaaagcaatgagttatacattattttcggggaagaaaagcgagaagacatccttaaaaaatatttcaataaagtttttgtgagagatgataccaactccaccatttattttgatggtactgagatgaagtattacagaaacgataaagatgaaaccgtttataaaatgggaatgggagatgcatttacctcaggatttgctattgcactttgtcatgggaattctattgaggaatgtgtaaaattcgggaatgaagtttcttcaagagtctcaggagggaaaggttctcagaccggactgccgagaatctcagatttcttttcataaagctatttacgacatatcaaaaatctgaaacttaacataaaaatatcagtaaaatgtccacttttatagtggattttttcttttatactatggaaaaactaatattgaccacagaagatcatatttccctgactgcccatctctttaaaccgcaaaaagatcatggaaaactattgctgatcaactcagcaacaggagttaagcagcaggtgtacttttcatttgccagctatttcgctgaacaaggctttaccgtaataacttatgattacagggggataggactttccaaaccgaaaaatatgagagggtttcatggttctatgaggatctggggctcaaaagattataaagctgtcacccaatatatcaagacaaattttaaagaatacaaaaaatactgtcttgggcattctgtgggggcattgattttaggtatgaataaagattctgaaatgtttgaagaatttttttttgtgggaacccaaaatgcttttgtcggaaaccttagagggataacaaaagtagaagcctatctaggatttggaattgcacagccagtaactacttcattgttaggatattttccggcacattggttcgggcttggagaaagtctcccaaaaaattgcgcatatgactggagaaccttaattttaaacaggaaatcaaccaacagactgttggagaaaattgataacttctcaaaaaatttgacgcagaaagtatttgtagtccgcgctgaagatgatatatggctgacagaaaaaggcgtattaagcttattgaataatacctatcctaatcttaaacccacttacagactgatcgctgtttcagaatctgataaaaaagaaataggtcatatcaacttttttagaagttacaacagtaaactctgggatattattttaaatgaactgacagataaatgaaaagtacaatagataacaccgtagcatttgtaaaagaaaaattagaaggagcagaagcaggtcatgactggttccatattgaaagggtctggaagctggctgcccaaatagcagaaacagaagattgtgacaaagaagttgttgaattatcagcacttcttcatgatattgcagatcctaaattccataatggtgatgaaaccattgctcctcaaatatccagaacgtttcttgaagaacagaatgttccggaagaaacaattaaaaaagttttatttgtaatagaaaatatttcttttaaaaacagggaccaggctccggtaaatccacctgttgaacttcagattgtacaggatgccgaccgcattgatgccataggagctatcggaatagcaagaactttcaattttggaggttttaaaaataatctgatgtatcatcccgatataaaacccaaactgggaatgtcaaaagaagaatataaaaaatctgacggaacaaccattaaccatttctatgaaaagttattgcttctgaaagatatgatgaatactgaaaaaggaaaaaaaatggccgaagaaaggcatgattatatgctgaatttcctcgaccagttttataaagaatggaatgtggattagaaaattggccacaggtatagataaaataaagagaagaagtatctttgtaaaatatgacactcattatttttataatattcctggcttgtgttctttctttggtcctgtttaaggtcagatcaggaagtatcgccaggtgggcgaagctgtttcgtattgtaacagttgttttttcaatttctgtttttacctattggtttattaagaaaagtgctgtggcatttgtggataattctgtaggactgcaggtggtcaacaaacttccacagacattggatttttatctgatcaatgtgaataaaacagatcaaagtacagttcttgaaccgaagcatattggaaaaatacgtccggaatattacagaatagagtacctgaaaatggataaatccgatgaatattggattgcaggatatctcggaaagaaaaatcttgtatacttttctcaacattctgtaccgaataagaatatcgatcagattgtagaagtgcagaattacattaatcagagtatgaaactgtctgatgcagccaaaaaacaggtagatgcctataattatgagaatacaaaactgggtatctggataacattggatttcctgcttctgtttctcaatctggtattgcttctcagaaaaaataaataaaaaggtaatgagttcttatgctcattaccttttgttttctattaaggataatccagaatctgcatgatctgttctttaaattcttcaggacataatttgataagtttatccttgttctgtttactgatttctttgggattaagccattcacttttattggagttcagactatggttgtcatatactctttttatggtatgattttcataaaaaatatattcatcacccagccagttattggcaatactgattgtacaaatttccttttccatgatttatgttttaaagtataatgtttagtgaaatacattataccctaatatacgaaacttttcgttaataaaaaggaaatttgttacaagattaattaaaatcagcaagtttaaattcttatttctgcagcaagcttttatattaaatatattaaaaaagtgttcctgtactttcggtcgccatttgcggaatatgtatatcagttccccattcctcattcacttttttgatgaaataagcggataataacggagaggctttctcgatattctgatgaacaaaaaaataaagattttgcagaccctcttttttccactttgtaaggtgtttcaaccaatcatccagtctttcatagtcactttctgcattagctcctacataacggataaatgcattaggagttgtaagacgcatatggagcatgtctcttcttccggcagtatctacaataatattggtaatgttatgggcttcaaaaagctcacatgttgtattaaggatttcctcatcagtaaaccattccgtgttgcggagttctatagctaatggaacctcttttggccattcttttacgaatttttccagtctgtcataatctttaggcttaaaattatcgtgaagctgaaggaaagccattcccagcttttcatcaaaattgatgacagcggaagcaaaatgagttaccggatcggtaacatcaatcaatcttctgaaatgggaaactgtgttggtgatcttaggaaaaaatttaaaatttgccggagttttttctttccaggtttttacctgatctggagttggcatcccgtaaaaagtagcattcagctctatagaattaaactgggttgcataataggttagttcatccttagttcccttaggataaaatcctttgagatccgttttattccatttagcacatccgatagagatattttccagtccttttttatttagagccagtatctctttcgttctgggatgatctttaggtaatgtgaaatctatttttgaagggtcttctacttgtccgaatttcatatctgtagttttggtattaaacaataaacacaaatataaaccaaaaatcccagagcgtttggcgatttgtgtggaaagtatttaaacatcaaagattagtgattatgaaattttaagaaataggacccctttgaaaggcgccaagaatatgacttttcacattttgtttagaaaattttttaacacttttactacgtttctattaagttttttttaaggaaatattaaacattctgttacgtaatgttaattctgtgttaccacatttcatttttactagatctaattttacaccaagtttatagcgaataaaaatatgaagaaaaaaatcatctgtgcttttgctctgttatctttcgggtttgcattttcacaggaaaccagttctaaaatttttggtagattaaagggaatttcttccgaagttacagtgaaggtagtacatattcctaccaatagtacctttgaaacgaaaagtaacagcaaaggtcagttcagcttagataatcttcagccgggaggcccttataaaattgaaatatctgacggatcacaggtaatctatgaaaatccgaatctgcagctttctttaggaaataacgacttgcctgtagtagatgtaggaagtaaagagaaaacaattgatgaggtaaaaatcacttctaaaaagaccacagcaaaatatggagtaggaatcagtcaggctcagatttcaggtcttccgaatattaaccgaggcattcaggatgttaccaagctaattcctcagagtgccaacaactctttcaacggaaccaatttccgttataataacgtgactattgatggctctatcaataatgacgctattggtttcagcccttcattgggagggcagacagggacttccggaatgcccggaagcagtacccgttccaattctataagtctggatgctattcaggatgtgcaggtgtatattgcgccttatgatgtaaaactgggaaatttccttggaggaagtattaatgccgttacccgaagcgggagtaacgatgttacaggctcaatttatacatatggaagaaatgctgcaattaccggtagaaacagggtaggagataattctaagatgcctaaggattttgaagactttatctacgggggaagagttgggttaccagttgtaagagataaagtattcttgtttacaaacctggaatataccaaaagaacagatcctgtattctataatgccaatgatccgggagcattggtgaatgaacaggttgcccagcaaatatcagacttcgtacgcaataaatacggatttaatgttggaagttttaaccagtataataacttctctgaaagctctaaactttttaataagttagattggaaaattaatgataaacatactttatccattaaaaacaatactgtattttcacaggcgtccaatctggaaagagacggagcaaacttcagattctccagtatggatttcgttcagaaaaacacagcatctaccactacacttgaattaaaaagccgttttaatgatcaatggagtaataatttagtcttgggttattcttctattcatgattacagggaccctacttcgggaaatgcgatgtttccacaggtggagattgcttacaatggaggaacaatcctgctgggtaatgacagagaagccactgttttcaatatgaagcagaaaacttttgaaatcacggacaaccttacctataaaaaaggaaatcataccttcctgttgggaactcacaatgaattatacaatatcaactacggttttgtaaatgccctgaacggaagaatttcctataaaaacctgaatgatttttataacggaactcctgccagaataagaggaacttatcctttcaacggagacagcagacagaccctttttgataatccgtatgctcaatataaggtgaatctgctttccctgtatcttcaggatgagatcaattggggaagagtaagactttcaccgggagtaagagtagattacacagacttaccgaataaaccgcagttaagtccattagtaagcaattctcctcaggatccaaacgctggaaatacttacaataatactccgttaaaccagcttaccaacaactatctgaataagccgacattctcgccaagacttggatttaccattgatcttactgagaacaggtctatggtgctgagaggaggctcaggtatttttgtgggaagaattcctttcgcatggctaggatatgcttattacaatgacggggtaggcttcggaagttatgactacaattcaccaacacctgcacagcttgctgccaacggagatccgttgaacagtgccaatttcccgaaatggcagaattcttcaaaagttcaggtagaccttattgacaataattttaaaatgccaagagtttggagaagctctttagctttcgattatacgctggccggatataaattaaccttagaaggaatttatacgaaggtgctttatgacctgaaattccaacaggtaaataaaacagataatgtgacgtattacagctatgatgtgaatcatgaaatgccgatctatacaaccaatatcaacagtaatttttcgaacgcctatcttttatccaatacaaaagaaggatatcgttacaatttaacagcacagctttcaaaatcctatgatttcggattcaatttctttgtagcctacacctacggagatgctaaagatattaccaacggtatccggaactcaatggaaagtaactggcagatgaaccagtctcttactcctaacgatccgaagctcacaacatctaatttcgccatcaaaaacagagtagtggccaatcttggatatgcctttaatatctctgatatgaacagattatacaccaatgtatattttaatgctcaatcgggaaatcctttttcatggggatttgtgaacagtaccattgccaatacaggacaggctgccggacttgcgtatatctttaaagatgctgcagaagcctccaaatatatagttcctataaaagatgcctcaggaaatgttttggtaactgctcagcagcagattgctgattacgaaaactttattaacagtaacgactatctgaaatccagacgaggtaaattcacagaaagaaacggagattttactccatggaacattcaggcggatatcagaatcatggatgaaatcaaattgagcaagaaatctaagaataatattcagatctcattgagtatcatcaatttcaccaatctgctgaacaaagattggggtaaagtatattttgttcctaatactttcaactctacagcaagtgtcgggttgacaaaagtaggaaatgtagcagcaggactgccttctgcaggagatcctacctacaacttcaaaacaccgggactgccttatactattgatcagtttgcatcaagatttcaggcacagcttggggtgagatataatttttaacaacgcttttacattttacttcataattcttttcaaaggtccggattttctttccggatcttttttattaatcaataaatgatagattgctggctcaaaattacattttacctttattaaaattaataagtacattaacgcaatcatctgtgaaaatccgtgtgatctgcggttaatcaaagactagtatatataagtggtaataattcaataggaacgggctttagcccgtttttataaaataaacatattcatcggctttagccaaaacttattaatatcatagtaagatctgtgaaagtctgtgtaatcagctggcgaacaaattaaattgacctcattcaaatctattatgtgataaaacgacaaaagcacaccttgcggtatgcttttgtaaatatagcgtgtttattacttgatctatgcctcgcagcttgagcatgatacaaagttaaccatcatttcttttgaaactgatgaacttctttggtagtaaagtgttttaactccttttttccatgcttcaatataaaggtagttaacatcttttacaggcattgtagaaggaatctgaagattcagggactgtgcctggtcaatatattgctgtctttgtgctgcctgagagataatttccattggagaaatttctttgaatgttttaaatactgccttctcttcaggagtaagctcattcaggtgctgtacagatccatggttgagcatgattgttctccatgtttcctcgttatccagtcctttttcttccagtaattttgcaaggtatttgttcttacgcataaagttccctttagcaagacctgctttatagtagttggaagcaaaaggctcgattcccggagaagtttgtcccaaaattgcggaacttgaggtagtaggagcaatagccattgttgtggtatttctcaatccatatcctttcagtacttctggttcaccatagatgttggcaagctctcttgaagcctgctcagcctgttctttgatatgtctgaaagctcttgcgttgaactgagttgcttcaaaactttcaaatggaatcatatttttctgtaaatatgaatggtatcctaatactcctaatccaagggctctgtgacgcattgcgaaatttcttgctccctgtaggtaatagttaccctcagttttatcaatgaattcagataaaacagcatccaggaagtagatagcaagctttacagcatctgtatccttccattcatcatatagttcaagattcatggaagacagacagcagatgaaagactcttccatagtagatggaagcatgatttcagaacaaaggttacttgcatttaccgtcatccctaaatctttataaacctgtggcttatttctgtttacgttgtccgtaaagaaaatataaggaagacctttttgctgacggctttccaatactcttgcccagactttacgcttttccatatcaccgtcaatcatatcctgcatccagtaatccggaacacatactccggtgaacaggttctgaatcgggctaccgatatctttaatagataaaaattcttcaatatctccgtggtcaatatctaagtaagcagcaaaagctcctcttcttacccctccctgagaaacaacatccatagccgtatcgaaaagcttcatgaatgaaactgctcctgaagactttccgttgtcagttacagctgttcccctgtttctcaattctccgaaataccctgaagtacctcctccgattttagtctgcatgatcacttcacccattttgtgggtaattccttcaatactgtccggaatgtgaacgttgaaacatgagataggaagacctctctgagttcccatattagcccatacaggagaagagaaactgatccatcctttcgtgatcatttctttgaatgccggttgaagttcaggtttgtataacctttttgcagcagcagttgtgattctgtcgattgctccgtctaccgtttcacctttcaacagatatcctctgttaagcatctgctcagactcttcattgagccaccatatatttgaattttgctcttccatagatgttatattttcgaattccggaatgaagagatcactccggaattttgtttttttattgtattgattgtaaaatttctactttgtgggaaccgttcagtccgctttcatctcttaatctctgaaattctttaaaagacggaacattcaaaacctcatgctgaacttcttcattgatgtagtttgaataatgtacaaaagtaacaccatcttcctttacaaaaactttatactcaaaggtggaagaatctaaatttttgaaatcttccagaaacttttggatattagctttattgtttggaacaaagtcggagtttaccgtataagttactattacattaatcattcccttaatatttgtgctttatttaatgaactgcattcttgataataccagaaaagaattgttcctgatactgactgcactgacgctcgctgcgctcgcgcccggattaaaacaaatcgtttgctgtaatacttttatcgtgtttcgtatagtctacaggtcttttggcaaagaaatcatctagtgaattggcaaaaacttcctcctcgaaccataccatcggtctgtattgctcaggagtaatgttgtatcttgttttcatgttgattttcttcaagctgtcatctacacggtatttcataaagtttaacaggtcttctttggaaacgttgtcgatttctcccaattcaaagatccagctaaggatgtcgccttctcttgcgatagactcatctaccagagtatagatatcttcaatatcgctgtctgttaataagtcaggttgttcttcacggattttgttgatcaggtaaattcctgcattggcgtgaatctgctcatctactgaagtccatgcaatgatattggaaacattcttcatgaaacctttgaatcttgtgaaagaaaggatgatggcaaactgcgagaaaagagaaacgttttccactaaaatactgaataacaataaagcggaaacatattctttcggtgtagcagaattagcatgctttaaagcatttccaagaaactcgattcttccttttacggcaggaatttcgataacgttaaggaactcgtcgttatatcctaaaacctctaataaacgggaatatgcttcagaatgacggaactcgcattctgcaaaagtagatcctaatccattgaattccggctttggtaagtggttgtataaattcccccagaatgtctttacagacacctcgatctgtgcaatggctaacagcgcattcttcacagcatgcttttcgtgtggttccaactgcgaatgaaaatcctgaacatctgcagtaaagtccacttccgaatgtacccagaacgatttgttgatggcttctacaaattgaagaacctccgggtattcaaatggcttatagcttactcttttatcaaaaattcccatattaaatatctttataattaaataatttagatccttgtggataacgttccggaaatacttaagtttttgtttttctgcagcttgtgaattgaagttatccacttttgcaaatccatatttcttgtaaagaactaatagcaaagttcgaaaaaaagaactgattttgaaaggggtaaatactaatcggctgacttttagccggaaaagttttccacatttacatgaaacagcctcgtataataggctaaacagcaatcttgaggataaatacattgaaatgtgaagttacagttaaacaattttgtataaagtattattaataaagggttaatttgttaaacaaaaaaatatttgaataaatttttattcttgtaacaatttgaaaatatgatctacttattgggtataaaaacatacatcacttaatgttagtaattcaggatttaaataagtcatacgatacaggcaaaagcaaacttcatgttcttaaaggaattaatctgaatatttctgaaggagagtttgtttctattatgggaagttccggttccggaaaatctacattacttaatattattggaattctggatgaaaaagattcaggaacctacgaattggacggagttcccattgaacatttatctgaggtaaaagctgcagaatacagaagccggtttttaggatttatttttcagtctttcaatcttatcaattataaaacagctttggagaatgtagcacttccactgtattatcagaatgtgccgcgaaaagaacgaaatcagaaagcgctggaatatctggaaaaagtaggactggctcagtgggcaaaccaccttccaagtgaactttccggaggacaaaagcagagagtagccattgcaagagctttgattaccaatccaaaggtagtacttgcagacgaacctaccggagcactcgattccaaaactacccatgatattatgaaacttcttcaggatatcaataatgaaggaaaaacaataatcgttgtaacccacgaacctgatgtggctgcacagaccaaaagaaatgtagtcctgaaggacgggattattgaaagtgatgagtttattaagcagattgtactataagtgaatagtgaatggtcaattttgcttcgcaagtgaattctacaatgaggaagacaaataatttataatacacacaaatgaatatgaaaaaaaataaaaatgtttttaaatctgaaccattataagcttgatgtatatcaatcagccagagaattaagaatagaatgttacaaggctttatctaaaattcctgatcatgaaaagtttaatgtaattgaccagatacgaagagcttctacttcagtggtattaaatattaccgagggatgctcaagaagatctgaattagaaaggaaaagatattttgaaattgccagaggttcggttattgagttagattcttgttttgatattgttgtagagtgtaagtgtattaaaatagaagaattaacaaaaattggtaatttaataaaaacagcatttatcttgttaagtaaaatgttgaaaagtgattagaatgtaaaaattaattaggttcgtaactgaagtctgatgaagggtaaattgacaacaaggttgattgacttcgaagaaaattgagagcgcagctaattgacttttttacacagtaaaaaaataaaaaatatgtttgacctagatcgttggcaggaaatattcagttctatccggagtaatgtacttcggacggtgctttcagggtttactgtagctttgggactgtttattttcatcgtcctttttggaattggaagaggacttcagaatgctttttctgaaggatttgcaggagatgctaaaaatcttattattttttccacaggaaaagcctctttagcttataaaggtcttcagtctgaccgaaatataacaatgaataactcagactatgattttttaattaatacggataaggaaaaagcgggaccttccagtccgagatatagtgccagtttaatggtcaaatatggaaaagaaagtggtctctatcagattaatggtgctgaacctggtgaacaggtcattgaaaacagaaaagttattgatggcaggtatattacagcgaaagatctggaaagaaaattaaatgttgcggtcattggaagaatggttcagcgggacttgatcaaaaatggaagcccgataggaaaagaactcgacattaacggaacaatgtataaggttatcggagttttttccgatgatggtggagatagagatgagagacatatcacagtacccattaccactttacagcagatgaagaaaggatctgatacagtaaatatagcttatataacatacaatgagaaactgactccggatcaggctattaagtatggtgatgagcttaaagataaattaaaagcaagaaaaaatgtttctcccgatgacgagaatggtgtccgtgtctggaataacgccaaaaatatgaatgacacctttacattcatggcggtacttacagcaattgtaggatttatcggactgggaacattacttgccggaattatcgggatcagtaacattatggtatacattgttaaagaaagaaccaaagagatcggagtaagaaaagctattggtgcaaagccagctggaattgtagggcttattgttcaggaaagtgttgtgattacagttatatcggggcttgttggagtaggagtaggagttttgactttaaatcttatcgggaacagccttgaagagtttttcattaaaaacccaagtgtaggctggggatccatcattatggcattcattgcactgattttctctggactgattgcaggatttgttcccgcatacagagcctcaagaattaaaccgatagaagcattgagaacagaataatttgctataaacgaaagttgaaaaaagcaaaaaagaagataaacagattaatgggattcattatttataacttataatttagaaaggtgaatatcatatttaaaaaagacacttggcaggaaatttattattcattgaggaataataaactccggacatttcttaccatgattggcgtaggatggggaatgtttttgtatgtgagccttcttggagctgcaaaaggaatggaaaatggttttgataaactattttccggttttgctaccaattcaatcttcctgtgggcacagaagacgtctattccgtacgaaggatttcctaaaggaagagaagttcacctgaacctgaatgatatggaaatgctgaaaagaaaagtaacagccatagattatatctcaccacaaaatgccagaggaagctttaccggaacaccgggggaaagcatgtcaagaaacgggaagaatggaacctattcgcttaccggagattattctgtaggaaacaaaatttcagaaaagaaactgatcttcggacgatacatcaatgatgctgatgtttccgggaataaaaatgtagtcgtaataggagaagaaatttataaaaatttcttcgattccaagaaaaaagaaaacccaatagggaagtctatcaatatcaaaggactgttttttaatgtaatcggggttttccgtgtaaaaaaaggaggaggatttgaaaatgaccagactgcttttattccactttccacgtatacgaaaatgtataatgcaggagaccagatcgacatgtttgctattgtaagcaagcctaatgcaaatgttaatgcagtagaagaagatgtaaagtacgctttaaagacaaagaataaagtgtcccctgaagataccaacgctttcgggagtttcaaccttgggaaagaatttaaaaaactgacaggttttcttacaggaatgcagctgctgactattatcgtgggtacactgactatccttgcaggagtaatcgctatttcaaatatccttttgatcacagtaaaagaaagaaccaaagaaatcgggatcagaagggcattaggtgccaaacctgctgaggtaagaaatcagattttgctggaaagtgttgttattacgctctcctcggggttgataggttttatgtttgggatttttgtgcttatgattcttaatgctgttactcagggccaggactcattcccattctataatccgacagttaactatggaaatgtgtttgcggcaatggcagtaatggtggttttgggacttgttatcgggatgattcctgcacagagagctgtgaagattaaacctattgaagcattaagaacagagtaattaatttgaaaaatgaatcaatttgaaaataaagaagaacgattgatcaatgaacaatcaatcttttaatttttcaatttatttaataaaaaataaactatacatatgaaaaagaaattcacttggaaaaaagccatttatatagtgttggggcttttatttgcagtggcattattctcagggattggctatcttataaaatctaactctaacgaaggtgaggctttccttacccgcaagcctaccgttcagaatatggatgataaggtaatggctacagggaaaattgttccaaaagaagaaattgagatcaaacccaatattgcggggattatagataaaatcttagtaaaagaaggagataaagtagaagtaggccagttgattgctactgtgaaaattgttccaagtatctctgaagtaaatgcagctcagcaggaagttcagaatgcacagatccagatcagcaatgcccagatgaatgtaggaaatatgcagaagcagtttgatatgcaggaaaaactttataagcagggagttgcttctaaacaggagtttcttaattcccaacagcagttattctctcagcagcagactttgaaaaatgcacagcagcaattgaacaccgctcaaaaaagattgcagatcgctaaaacaggagcaactcccgaacttaaaggtcaggggttggcaactaccgagattcgttccaaagcttcaggtaccgtacttgaagtacctgttaaagcaggaagtcaggtgattgaagccaataatttcaatgcgggaactaccatctgctcggtagcagatttaaatgtgctgatctttaaaggcgaaattgatgaggcacaggcaggaaagttaagagaaggaatggatatgaatatcgtaatcggagcattacaaaataaaactttccctggaaaactgaccatgattgcccctaaaggaaaagataatgcaggaactattaaatttccggtagaaggtaacgtaagtaatcctaataatgagtatattagagcaggtttttctgcgaatggtgaaattgtcttgagttcccagaaaaatgcattattattggatgaatctttagtgcagtatgaaaagaaacaaggaaaagatgttcctttcgtagaaaccaaacaaaaagacggtaaattcaaaaaagtatatgtgaaactgggagcaagtgacggaatcaatgttcagattcttcctggatcaaatattacaaaagatactgaagtgaaagtttggaacccatcagataaagacaaagaagagctgaaagaaaaagccaataaaaaataataaactacactatacacttttaaactgtaatcctggaggaattctttttctccgggattttttatgtcaaaatttttaaaagagttaattcctatatttgaatcaaataaatccatggaaaatgtgtcgatacgctgggaaaacctataaatcacattatgcatgttttaaatgccggaaatcatttaagcaggcagatagtagtgatattttagctgcctgccagaaaactcttatagaggaatgccccggaaagaataacgaaattaaatattggtctgacaatattcagaaaataaaaactgaaattattggtaacaggtttgaaataacagtataacggaaaagaagtttaaactgtcttatctttgaaattccaaactactatacccatgaaaaaagactattggattctcgttctttttatcattgcaaaatttgctcttcaatattcattgataagtcctgaatatgaacttcacagggatgaatatctgcatctcgatcaggcgaatcatcttgcatggggatatctttcagttccgcctgtcaactcctggatagcgtggattattaaaatgttgggaaactccgtattctgggttaaattctttcctgctttatttggagcaatgacaatagcccttgcctgggaagttgttgaagaactgaaaggaagtctttttgctaaaatacttaccgcatcaggtattctattctctgtgcttcttcggataaatatgctattccagcccacatcactggaaattttcctttggctgtgtctttattacagtttgattaaatatttcaattcccaaaaagttaagtggatttacataggagcagtcatttttggaataggaatattgaataaatataatattgcttttgccgtccttggactcattcctgcatttctgttaacaaagcaaagaaaaatctttatgctctctcatgcgtattgggcagcgcttttggtgttaattattgtttttcccaaccttttatggcaatatcagaatcattttccggtcattcatcatatgaaagaactttcagaaagacagcttgtgcatgtagaccggatggattttatgaaatctcagattctctttttcataggtgtcatttttgttatcatagcgggctggggagcgttattgttgtataagccttttgagaaattccggtttttcttttggagttatagtattacaattaccttgttcttattttttaaagcaaaagactactatgcaataggactctatcccgtttatattgcctttggtgcagtttatcttggacatctatttgaaaaaggatggaagaggtttttgaaacccgtcagcattctgattccgatgcttttatttcttcccttatataatgtagcctttccgaataaaagtcctgaatatatagtctctcacccggatcagtataaaaaattggggctgcttcgctgggaagatggaaaagatcattctttaccacaggattttgctgacatgcagggttggaaagaactggctcaaaaagtggacaaagaatattccaaactggtaaagaccggaactacgatggtcttgtgtgataattacggacaggccggagcgattaattattattcaaaagtgggtgttgtagccatgtcatttaatgcagactatatcaattggatagatttaagcaggaaatacaaaaatgtaatcagagttaaagatgcttccgaagcaggaaaagaacttaatgaatccggttccttttttgaagttgcggaactaaaggattctattaccaatccatatgcaagagaaaaaggaacagcgattttcagccttcagggggcgaaaataaatatcaataaaagaattcaggaggaaattaacgaagttaaaaatgaatggaaatagtttcagtataaacgataaatgatcacttgtttacggaataaaactaatagataaaaagtattattgcaactatattgcattaattaattttgctttacctttgtattatcaattatcaattatcaattatcaactatcaactgaactatggaaaataaaaattttgatgttatcataataggaggaagctattcaggattatctgcgggaatgtctttgggaagatctttaaggaatgttttgatcattgataatggaaaaccttgtaacagacagactccacattctcataactttgttactcacgatgggaaaacaccgtcagaaatttcaaaactggcaaaaaaagatgttgaaaaatacaatactgtcagtttctataacggaaccgctgtgaaaacacaaaataccagcgacggttttaaaattgaaacttcatctggtgaaaaattcaattctaaaaaacttattatagcttccggagtgagggatgtaatgcctgacatccccggatttgcagaatgctgggggatttctgtgatacactgtccatactgccatggctatgaagtaaaaaatgaagtcacaggaattctctccaatggagatatggcttacgaattttcaaagctgatttttaatctgaccaaaagccttaccttgtttacgaatggaaaggcttcccttactgatgaacaaataaagcaactggctcagaataaaattaatcttaatgaagatgagatcgaaaaaatagagcatgataacggatctgttcagaaaattattttcaaaaacgggaaagaggtttctttaaaagctttatatgctaaaattccttttgaacaaaatctaaatgtatctgctgacctgggatgtgagctgacggaacaaggtttcattaaagtagatgcaatgcagaaaacaaatgttccgggagtatttgcctgtggagataacgtaaccatgatgcgttccgtagccaatgcagttgcaaaggggaattttgcaggtgtcgtggttaataaggagctttcagatgaagaattttaaaaacattttagtatcattaaaacaatcataatgttagatttattgatgaatgttttcattttttagtgtttaaaaatcatttttgctatagagaaatctcgacgaaaattccgtacatttggggtgaaaatttcaaaaactaaaagtaaaatggatattattttcgacctgattgaaaaggaaagacaaagacaaacccatggattagagcttatcgcatcagaaaattttgtttctgaaaacgtgatgaaagcaatgggaagtgtactgacaaataaatatgctgaaggatatcccggaaaaagatattacggaggatgtgaagtagtagatgaggttgaaactttagctatcaacagagctaaggagcttttcggagtagattatgtgaatgttcagccacattccggttctcaggcgaatgcagccatttatcttgcagttttgaaacctggtgataaaattatgggaatggacctttcaatgggaggacaccttacccacggttcagcagtgaacttttcagggattcaatataacgtagtttcttacggagttcagcaggaaacaggtcttattgattacgaccaaatgagagaagtagcgttgagagaaaaaccaaaaatgcttattgcaggtttctcagcctattcaagagatttagattatgctaaattcagagaagtggcagatgaagtgggagctactctttgggctgatattgctcacccggctggtttagtagcaaaaggattattaaattctccattcgagcactgtcatgtagtaacaactacaactcacaagacccttagaggcccaagaggaggaatgatcatgatggggaaagactttgaaaatacatatggtcacaagactccaaaaggagaaatcaaaatgatgagccaggtgctggatggggctgtattcccgggtattcagggaggaccacttgagcacgtgattgctggtaaagctgtagctttcggggaagctctggatgttcagtttgaaacgtatgcaaaacaggttaaagcaaatgctcaggcattatcaaaagcaatgatcaacagaggttttgatatcgtaagcggaggtacagataatcacctgatgctggtagaccttagaaataaaggagtaaacggtaaagaaacagaaaaagcattagtacttgctgatattacatgtaacaaaaacatggttccttttgatgacaagtcgccatttacaacatctggtatcagattgggaactgcagctatcacaacaagaggattgaaagaaaatgatatggatactatcgcgggactaatttctgaagtagtagacaatatcaaaaatgaagaagtgattggatctgtaagaaaaaaagtaaacgaattaatggaaggtaaagctctgtttaactactaacagactttccgatatcatataaagaatgggcagactgctcattcttttttttattgaatggaaaagaaatcttatactttcgaggaaataaaacagaagctggtcaattactgtgtttaccaggatcgctgtcatgctgaagtggaacagaagatgagagaattcctgctcatagatgaagcgaaggaagaaattattttatacctgctgaaagaaaattatctgaatgaagaaagatttacgcgcagctatatcagaggtaaattttacatcaaacattggggaaagaccaaaattaaaatgaatctgaagcagaaacagatttctgaaaagttaatcaattcatgttttgatgagattgatgacgctgattatgaaaaaactatcagaaagatgtttgatgattattattctaaacaaactggcttgaaagaatatcaaaaaaaaaccaagactataaaatatttgatgagtaaaggttttgaatatgagaaaataattgatatttttgattaaatatttaatgaattacaaaaacttgacgtatgacttttaggaaaaaaataaaaagttcattgaaaaagattgatatataaagatttaaaaattattttaaagaaaaacagcctaaataagaatttttatagataaatatctgctttataaagagcttttatggtatgatttttgtctgtgagtttagctgtatcataaatgaaattattagatttcataaacataacatcaaatttatttttgatttcagcatattgaaataaatttatttatttttgtgtgattgtgccaaaattatctttgattggataatcagatattatacattaattaaatatgaacaccaatacagacaatgtacaattctcttagaaaaacaatatttggaggggataatgttgtcaatctctcagacgtaagatatcttcctcgatggataattcttgtaatagacattattattctgatcatatctttatttctttccacttacattatcgcaaaaattaccaagcaggaatttatataccacgatgataaaagtttagtttttgcttttattattctggtgaatgctgtttttatgtatgtcttcaagacttatgccggtattattcgccattcaacatttatagatttatttaaacttctgatatcgtgcttttgcacaatgctgactatcggaattataaatctttcctatttctggatcacaggaagtaagtttatacttactccttatctgatactttactttgtaatttcttttatgggattattccttttcagattatatgtgaaagagtttttccatattgtaagggagtacagaagaagtgcactgaaaaaaaggattctggtattgggaattgatgaacaatctattgcgattgcccgtgctattctggataatccaagtttgccatatcaggtagttgggtttttaactcagagaaccgattctaaaagagcgtctctgttaggaaaacccatttatgagaaggaaaagatagaagagcattcaaaagatgatcttatggttgacggtgttctcattgttaaagagatgatggccagagatgagatgaacgcctgggtgaatttgtttttagaaaaagatctgaatgtttttaaagcaccctctgtacagaagttaagagacagtgatcttggcgggtctattaaaaatcttcaaattgaagatttgttaaacagaaaaccaattaaaattcagaatgagaaagttaaaagcagacattttgataaaacggtattggtaaccggtggtgcaggatctataggaagtgagattgtaaggcaggttgctctttttaatccttctttaattgtagtattggaccaggctgaaacacctctttatgaaattgaacttgaaatgagagagaaatttcctcatatcactttcaaatttgttttaggagatgtttctaaccatcacagaatggaatctctgttccagacgtataatttttcaatggtataccacgcagcagcctataagcatgttcctttggtagaagaaaatcctcatgaagccatttttgtcaatatattaggttcaaagattgttgcaaaattatccagcaagtataaagtaaacaggttcgtaatggtatctacagataaagctgtaaacccaaccaacgtaatgggagcttcaaaacgtgctgcagagctttttgtacagtcgcttcagaatgtagaaggtaatgtgaccaagtttattacaacgagatttggaaatgtattaggatccaatggttctgtaattcctcattttaaaaagcagattgaagctggtggcccggtaaccattacccacccggaaatcgtaagatatttcatgacgattcctgaggcctgtgagcttgtacttcaggctggaacaatgggagaaggaggcgaaatttttgtctttgatatgggggagcctgtaaagattattgatcttgccaaaagaatgataaaattatcaggattcgaacctaatattgatatcaagatcatctatacaggattaaggcccggagaaaagctgtacgaagaacttctgagtgatgatgcaaaaacacttcctactcataatgacaaaattatgatttctaaagatccttcaatgggatttgatgatatagacaggcttactaaagaaattaccaaggcttccctgcgaagagataaagtggaagtggtaaggattcttaaaacaatagtgccggaattccgaagcaataattcaatttatgaagctttggataaatagaaaaaatataaatgtatatttgcacaatttaacaaaataatgaaaggaaaaataatagcattagttttggtgtcctctttagtgatttcctgcaaagtgaaccccaatgctaagaatgatttaaattatatgcagaatatagaacaggtagcaatcaatgcatctgctaaaaattcagcaaatacaatccaggtaggagatcagttggttattctgatcactgcgaaagatatggatgttgtaaaaccttttaatcagaattattcttcctcagaacttatccaaaccaatacaatagccggaggaaatactcctaatcaaggaacaacagtgttatcaggacctacttatatagtagatgcaaatggagatattgacttcccaatattaggaaaactgaatacatcagataaaagtttgactgcttttaaagatgaactgagggaaaaaatgacaaaatatgttattaatcccacggttaatgtgaggctctcaaattttaaagttacaatacttggagaagtcaacaggcagggagactatactatagcaaacggacaggcgaccattttaaatgcattaggtatggctggtgacttgacgcaatatgggaaaagagaagatatattggttatcagaacagaaaatggtattgtttctcatgggcgtgttaacctacatgatgctaatttaattaactcgccatattataatctgaaacagggggatgccattattgtttcttcaaacaatacaaaagatgttatggcaaaacaaaatcccaatacaggtctttacctgaccgctatttctattgcggttacagcagttgccgttgtagtaagtttatttaataagaaataaagattgatggataaccagagaacttcacaatttttggaggaagaaacaaaattaaataaggttagtattaatgatgtaatcaaaccatatctaagaaaatggccatggttcatttttagtgcaattatagcattagtaatcagttattttgcaataaaatttattacgccagtttattacgtagagactacattacttataaaggattcaaaaaactcttcatcggctaatgatttaggcgttctttctgatttatcaggtctgggagggatgaaaacaaatagtatttctaacgagattgaaatactgaaatctaaaaaattaatgcgtgatgttgttgttaatcataatctccaaacaaccatcattgctaaaggcagaatcagaagtattgagctttacaaagaatcatcacctattgatgtaaagattgtaaacgaaaaatcatctaaaggctcaactaattatataaatgtagaattaaaaggagaacagattttaatacagtatgatgggcttaataaagaaattatatccagctacggtagaatgatcaatcttccttttgctaatataattattactaaaaataataaattcaacaaaaaagctgcacaaggagcaaatacaaataaattagaactaaaaatttcatctgttgaagcaaaggttaatagtttaactggtgctctaaatgtaagtctagctaataaagacgctactgtacttcggttatctataaattatccacaaacttcaaaagctgaagatatcctgaattctttagttgttgcttataataatgatgctattttagataaaaacttggaatctagaaaaacgttggatttcatcgaggatagagtgaaaaaactttctgttgaacttgggcaggttgaaaatgaaaaagaaagttttaaatccaagaataatcttaccgatcttgaggttgaagctaaaattaatttagagagttcagccacagctcgtggaaaacaattggatctcgatgctcagatcgaattaacaaattctttaatctctttcatttctaaacagggacaatatcaggctttaccttccaatattggcttaaatagtgctgaagcagcttcagggattgcatcatataatcaattgatattacataggggaagattattggaatccgcaactccggaaaacccaacggttgtagaaataagtaagcaaatcaacgtacttcgaaactcaattgttgagacacttcaaagaaataaaacaggattggaacttgcccgaaatgaatatgttggagaacagaataaagtttccggaaaaattgctaaaattccatctattgaaaaaatgtttagaggaatagaaagacagcaacagattaaagaaaatttatatctattattgctccaaaaaagagaagaaacagcaattgcgcaatccattacagcacctaaagcaagagttattgatcaggcttatgcttcagcaaatcccgttgctcccaaaacacaggttattctgctggcagcattatttataggtcttcttataccatttttaattatttatttctcagaattattaaataataaaattgtcactaaacatgatttagagaaattagtacatgcaccaataattgccgaacttccaagtcttgaaaagggagattctgaaatcgttaaaatgaacgatattactcctatggcggaagcattcagaattcttattaccaatatgaacttcatgctttcaaaagagaaaaaaggaaaggttgtatttgttacctctacagtaaaaggagaagggaaaacatttacttccgttaatctagctcttactctggcaaaccctaagaaaaaagcaattatcatagggtccgatatcagaaaccctcagcttcagagatataatccggcaagaaaagggcttgcaggacttacagagtatctttataatgatgagacgaaacttgaagatattattcatgtctcatcttttaatccgtatctggatgtaatttattcaggaatgattcctcctaatccgacagaactgttatccaatggccgttatgagactcttctggatcaactgaaggaaaaatatgaatacattattctggatacagcaccattgctgcttgttacggatactttccttattgctgaactttctgatgttactatctatgtatcaagatctaaatacacagaaaagtctttattagaatttgccaacagcaatattgatcagaaaaagatacgaaatgtgggatttgtacttaatgatgtaagcagggaaaatttaggatatagtaacaaatacggttatggctataatcagcattcagaacaatcatggtttcagaaaataacaaataaatttagttaatgataacagcatataaaatagcggttataggtcagggttatgtaggtcttcctctatctcttgagtttgccaatcactatcctgtatttggttttgatattcatacacagcgtgttgaccagcttaataacggaagagatataacgcttgaagctgatgttaacaaattaaatgacagactgaaaaaatataaagaatctaagggctctttaggctataaggctacaagccggttatctgatatctctgatgccaatgtattcatcgtaacagttcctacccctattgataaatataatgccccggatctgactccattaatttctgcttcaaaaatgttaggagagattattaaaaaaggagatattgttatttatgaatctaccgtttttccaggatgtacagaagaagaatgtgtaccggttcttgaaaaatattcaggacttaagtttaacgaagatttctttgtaggttattctccggaaagaattaatccgggagataaggtaaatacactaacaagtgttaaaaaagtaacttcaggttctacaaaagagattgctgaacaggtagatcaattatataagaagattattactgcgggaactcataaagcgccaagcattaaagttgcagaagcatcaaaagctattgaaaatgcacaaagagatgttaatatttcttttgttaacgaattggccttaatttttgatagagtaggaattgatacccatgatgtattggaagcggcgggtaccaaatataattttcttaaatataaacccgggttggtaggaggacattgtatttcagtagacccttattatcttgcacacaaagctgaacagctgggatatcatcctgatgttattttatccggcagacgtgtcaatgattccattgcaaagtttgttgctgctaaagtagtaaagcttcttatcgcaaaaggtggagtgattaaaaattctaatgctctgattttaggagttacattcaaagaaaactgtccggatgtcagaaatacgaaagtagtggacatctacagagaacttactgattacggagtaaatgtagatatttacgatccatgggcaagcaaagaagaagtaaaacacgaatacggaattgatattctggatgctctttatgaagggaaaaagtatgattccttagtgattgcagtatctcataatgaatttctggaaatggatctggatctgcttaaaaaagaaaatgctgtggtctttgataccaaagcatgtttagacagaaatctggtcgatgcaagattataaaagatcatgagctatgatatcatcatcatcggtgcaggtttggtaggattggctacagcctatcagactatgcttaaaaatcctggttctaggattcttattttagaaaaagaaaacgatgtggcattgcaccaatctggacataacagtggtgtgatccatagcggtatttattataaaccaggaagtcttaaagctagaaattgtattgaaggatataactcagtgattaattttgctgaaaagtatggaataagatatgatctttgcgggaaaataattgtagccacctcacaggaagaattaccacttttagataatatttataagagaggagttgaaaacgggctacaaaatttaaagtatctttcaagagaagagttccgtgaaattgagccccattgtgaaggcgtaaaagcaatcaaagttccacaaaccggaattatcgactatccgggaatagctcaaaaaataaaagaactttttgaagaattgggaggagaagtaagatttaacaatgaagtaaaaaatatcattgataaaggatctgaaattattgttactaccaatatttccgaatttaaaagcaaaaaactgatttcctgtgcaggattgtattcagataagataaccaaaatgaccaacaaagaaaatgatgtggtcattattcctttcagaggagaatactataaaatcaaagatgaaaaaaaatacctggtaaaacatcttatttacccggtacctgatcctagctttccttttcttggtgtccactttaccagaatgattgatggtaatattgaagccggtcccaatgccgttttggctttcaaaaaagaaggataccatttttttgatttcaatttcaacgaaaccatgcagaccatgctatggcccggatttagaaaaattgtagcaaaatacggaaaaacgggaatggaagaaatgcaccgttcactctctaaatctgcatttacaaaagctctgcaaaaacttttacctgaaatacaggaaaatgaccttgtaccaggaggttcaggagtaagagctcaggcttgcgacagaaatggaggattaattgatgattttgacattgtgaaaaacggaaatatcattcatgttagaaatgctccttccccagcagccacatcttgcctttctataggaaatacaataagtgagcttatcatgaattaagaaatatacctatacgtgtactcaaaaactcaaaaactaaaatatgaaaattcaaatggttgatcttaaaggtcaatatcagaaaataaaagaagacatagatgtaggtattcaggaatgcatagacagtacagcatttattaacggtcctgctgtaaaagaatttcaacacgatttcgaaagatatcttggggtaaaccatgttattccatgtgccaatggaacagacgcccttcaaattaccatgatggccctcaacctacagcctggtgacgagataatctgccctgctttcacttatgtagcgactgcagaagtcattggtcttttaggattaaagcctgtaatggtagacgtaaacgcagatacttttgatatacagctggaaggtcttgaaaaatatcttacccccaagaccaaagcaattgttcctgttcatttatatggacaaagtgcagatatggaacaaattcttaaatttgcagaaaaacacaacctttttgttatagaagataatgctcaggcaatcggctcagattatacgttttcagatggtaccgttagaaaaacagggactatcggacatattggctgtacttcattttttccttcaaaaaatctgggttgctatggtgatggaggagctttgatgacaaatgatgatgaattagcctccaaaattagaatgattgccaaccatggccaggaaaagaaatactatcataaagttttaggttgtaactcaagattggataccattcaggctgctatattaaaagtgaaacttaagcatttggatgagtattcagctgcccgaaacagaatggcagattattatgataaaaaccttaaggggattgctgaaattcagattcctaggagagctggaaattctacacatgtatttcatcagtatacccttagagtgaaaaatgaaaaaagagacggattacaaaaatatttggcagaaaagaatattccaagtatgatatactatcctttgcctctttataagcaggaagcttttcttcaatatgtagaagatggctttagtcttccggttacagagcaactttgtaaagaagttatctctcttcctgtccatacagaatttgaccaggaagtgctggatattattattgaagaaattaagaattattttaactaatataaaagcagatatgtctgatttttttgcacacgaaacagccattattgacgaaggatgtcaaataggaaacggaaccaaaatctggcacttttcacatcttatgacaggttgcattttgggagaaaaatgtaatattggacagaatgttgttatttcacctaaagtaattttgggaaaaaacgtgaaggttcagaataatgtttctatctatgaaggagtaacctgtgatgatgatgtctttttaggaccttcaatggtttttaccaatgtaataaatccaagaagtgcagtaaacagaaagaatgaatatctgaaaacacatgttggaaaaggggcctccataggagctaatgcaactattgtttgtggacataatattggtcagtatgcttttattggagcaggagctgtggttaccaaagaagttccggattatgcattggtagtaggaaaccctgccagacagatgggatggatgagcgaattcgggcacaggcttcagtttgatgcagaaaatattgccgtttgtgaagaaagcggagaaaaatacaaattagaaaataataaagtttcaaaaatttaaaacatacaaatgagtgaaaaaataaaatttgccgtagtgggctgcggacatatcggaaaaagacatgccgaaatgatctcaaggaatgatgaatgtgaactagtaggattaattgatgttaaagataaatctgtccttggaattgaaaattataatgttcccttttttgcttcactggatgaattcctgacttccgggattgatgtggatgttgttaatattgcttctccaaacggattccattttgagcagtcttacaaagtaatagacgctggaaagcatgtggtagtagaaaagccaatggctctgaaaaaacaacatgctgaaaaacttatatttcaggctttacataagcataaacaggtttttgcggtaatgcaaaacagatattcaccaccttctgcttgggtgaaggaaatggtagagagcggaaaacttggtaaaatatatatggttcagcttaattgctactggaatcgtgatgaaagatattataaacctgaatcatggcatgggaagcttgatctggatggaggaacgctattcacacaattttctcactttatcgatattatgtactggttgtttggtgatattactaacatccaggcaaaatttgcagattttaatcatgcaactcttacggatttcgaagattcaggttttgtgaactttgattttgtaaacggtggaatgggatcattaaattattctacttcagtatggaatcagaaccttgaaagctctatgaccattattgctgaaaatggctctgtaaaaataggtggtcaatatatggataaagtggaaatttgtaacgtgaaagattatataatgccggaattaccccctacaaatccagggaatgattatggagcatacaaaggatctgcagccaatcatcattatattattgaaaatgtagtagatgtattgaaaggaaggaatactattacaaccaatgctttggaggggttgaaagtggtagacattatagaaagaatttatgctctgaaaaaataataattgtttttattgttaaagcaatagttgctgaaattatataaatatgctaaacagtttggttactttcaacaaaaaattatgaatgataaatcgtttgaatagttttgaattttaaaaatattttaaatagtgtaaaatcgaattcttttttacaaaacgtagcaatactatctagtggaactgttatcagtcagctgatagtaattgcggcttctcctcttctttcccgaatgtattctgttgaatcatttggtattctttctgtttttacaagttttactgtttttttggcagtcctttcaaccggacgttatgagttggctgtcgggcttccaaaagaggatggcagagcttcagcaatatttaaacttattatttatattgctatttcaatatcattattatactttgttttgattcttttattgaaaaatgtttttcatatccatgataaaacacagtttctctcaaataatgaggtatatatagctcccttgtatattttttttggtgctgtttattctgcattggggtattggaaccagagaaataaaaaatataaaaaaattactttttcaaatgccatacaagtaattacttcttgtttattcagtgtaatattcggaatattggggtacaaaaatggaatgattgtagggatgatattaggcgtctttagttctatactttatttacttttaacagacagggaattaagaactttcttaaaatctcatcataatgagttaaaaaatgtagcaaaagaatactcttcttttcctagatatatgattatttctgatatgtctcttgctgcttgccaacaatttatcccaatattattttctgttttatataatactacaattgtgggttttttttcaatggcaaataggatgatcagactgccaaatatagttattactacttcagtgggaaatgttttcagaaatgaagctattgatgagattagagaaaaaggtaattgtaaagacctttacagatctactattaaaaaacttattttaatgtcatttccgatatatttagccatattcattatctcacctaagttattcgtttttgtttttggtgccaaatgggaggttgccggttattttgcgagaatcttgtccgtaatgcttttgatggagtttgttgttactcctcttaataccttattttatgtagtgggtaaacaaaaaatattaatgagactacaagttgtcaatgctttgttggtttttatttcaatttattcaggctattatttcttttcagattattatatttcactgatattattttctggagtttctatcttatcaaatattattttcttaatttttacaaataaattatcaaaaggtgtacattgaaaaagtaaataaattacaagtcgtttttttggttctgatgctttatgggtatgaactggtatctttttttcccagtttgctgaatatggaatcatcaagacctgtatctgtagcatacagaatatttgtttttttattggccagctgggtaattcttaaaaataaaatcagaataacaaataaacaccttttaatatatactttttggttcctgtatttattacggttgctttatgattcagcattgacttcaaaaatgatacagtctcctattgtagattattgggctttctctgtagggatcattggctgctcattggcatgtacaacaaatttcaatcaaaatacaatcatatcagcacgaaaatgggtggtaattgttttatatattgttaatttatggggactgtataataacatcacacaacctcaaatagtaccggatgatgttttgataagagcagatgccaatgctgctctcaatactgtatctttcggtagggcagctggtgttatgttctttgtttgttttactatatttttagaaaaaaattcaacctggcagaaagttttactaggcataggaatgggcgtcagccttttcaacttgtttatggccggttcaagaggtcccttgttacagttagtaatagttattattgtatttttattaagttccagaaaacttattaagccgaaatatattctcttatttgtaattatggtagtaatactgatgaccctttttcctcaatacttaaacatttcagaattagtttttgaaagatttaaagaaacaggcttttcttctaatgatagtgaccggtatagagcagaattatttaaatcagcctggaatcagtttcttgatcatcccatctttggtgactcgattgaaactgtttttgaaggtacttatccccataatctgctgcttgaatccttaatgagtattggttttgtaggaggaataatgattattataattaccataatagcattcattaatgctattagatatataaaaattccctattataattggctgggagcaattttattgatggacgtgatttcatccaattcatcaggatctattgccaattatttattgttctggccattattggcatttaccattaatagccatattacaaaacaacaaaacggaaaaacaatacagacatgaaaatattaatgctgtgtgatgcctactttatcaactttcagtatcaggaaaacttaattgcgaaaagctatattaaattaggatatgaagtggtagtgataacaaatacaaatgaaaaaattcttgactttattaatgatattcatgataattcacttcctgaaaaaattgaatatgataatggagttaaaatttacagagagccttatagtataaatattttacaccgggtaagacggttcaaaaatgttaaaagaattctggagcaggaaaaaccagattttctcttttctcatgatatacagtttaatatcggagatttggtagattataaaaagaaatataataccaggattattatggattatcatgctgatttttcaaactctggaaaaaattggatatcaattaacattcttcataaaattatacgaaaaagatacttctataaatataaaaagtatattgataaaatatatccggtagttcctgccagtgaagaattcctccataaaatctatgggatttcatataatgagatggaacttctccctcttggctgtgaatacgatgaatgtgaaaaatttagaaaagaaacggatattataaagcttaggagagaatatggtatttcacccaatgatattgtgattatcacaggtgggaaatttcataagttgaaacgtacagatttggctgtaaaggcagtaaaaaaaataaatcagaaaaatgttcatatgatagtattcggtacagcggataaaaatcatgaagagtacttaaaaactatgctggaagatgctgaaggtgctaatatacattttacaggatgggcagatagtaaaaaaatttatgaactaatggcaatttctgatattgctttatttccggccagccaatcagtactctggcagcagtcaataggaatgcatttacctcttattgctggcgatgctggagggcaggatatgtcttatcttaatcagaataataatcttataaaaatagatgctcctgatattaatgaagattttattaaagaaattttgttagatttaattctgaatcctgagaaaattgtatcaatgaaaaaaggagctgagaaaacagcgaaagagtatttagattattctattattgcaaaaagaactctaaattaaacagttgtcagataaatcttatgaaaatactacaaataagcagtgaagtaaatatcggatctgtaggcagaattgccgaacagattggagaaaacatcctgaatgaaggatggaaaagctatattgcttatggaagggaagctctttccagtaaatctgaggtttttcagatcggaaataaactggacatttataaacatgttattttaacaagacttgcggatagacacggatttggatctggaagagtaacaaaagaacttattgagaaaataaaaaaaattaatccggatattattcatttacagcacttacatgggtattttgtaaatattgatatattgtttaattttttaaaagaagccaatttgcccgtggtatggacttttcatgactgctggtcttttacaggacattgtgcctattatgagttggtagaatgcaataaatgggaaacacaatgtagtgaatgtccacaaatttcagaatacccaaagtctatatggaaagataattcaaaaagaaattatcttgataagaagaagctatttacctcagttccccgtatgaccattgtacccgtatccagttggctcgaaggtgaagtaaaaaaatcttttcttaaaaattacaatgtaagaactattcataatggaattgatattcaaaagtttgtatatatcgaaaatgattttaaacaaagatataatattgaaaataaatttctaatattaggagttgctagcccctgggataagagaaaaggattaaggtattttatagaattatcgaaaatcttgtctgatgattacagaattgtattggttggattaagtaaaaaacaagttgaagctctgcctgtaaatattattggatttgaaaggacaaaagacgtaaatgagctcgcccagctctattccgctgcagatgtgtttgtgaatcctactttggaagacactttcccaactaccaatttggaagctcagtcttgcggaacacctgttattacttttaaaacaggaggttctccggaagcggtcagcgccttaacaggaattgtagtagaaaaaggtgatgtttccgggcttgtaatggctattcagaaagttcgggaaaatacccgtgctttttattctgaaaattgcagaaaaagagtcttggagttatttgataaaaaaaatgccttcaaaaattatattgatttatataaagaattaataaccgagaattaaaaaaacgaataaatagtaaagccaaataggtatgagtttaactgtaaaaatacgatctgcaatcaatgcaatgaccggaaaaattactaatgtaaaaagaaatataaatataaaccataaatggtatggtaatgattacagtggcttttatgtatctccgttaaagcttactgaaaaatcggttatctactcttttggggtaggtgaagatatttcttttgacgaagctttaatcaaggaatttggatgtaaagtatttgcatttgatcctactccaaaatctatagaatggattaaaaatagaaatattcctttagaatttacttttttcccctatggtatagatgatcatacgggagtagttgaatttttattacctaaaaatgataatcatgtttcaggaagtgtgattaatcagatcaatgtggatgaaaagaaaactgtaaaagcaccaatgaaatgtctgtcagatattgttaaagaattggggcattcctatctagatatagtaaaaattgatattgaaggttctgaatacaaggttttagagagtatattgtctgctccggtagagatagatcagatattaatagaaattcatgaaaggtttttttcagatggaaaagataaaaccaaagagcttcttaatatgttggaccaaaaaggatttaaattatttgggatatcagattcaaaagaagaattgtcttttataaaagtatagttgcttatttcttttttaataattgtaaacagaaaattatgaaaagtttattatcatcattatttttactgttgatggcttgcacatcaacttcacaagttaaaaataaccagacaaaactctattacgcattgggtacaataggaaacaaggctgacaattattttaaacagataggggcggttgaagtgggctttttagatgaaggacagttcatttccaaaaccggagataagtactatctgaacaaagaattgctggagaaagaaatcaatagaggagttcccgataaaaatgcaaaaggtattgtttatatagacttagaaatgccatttgaagatatgaatggtaaggataaaaatcttgctatgaaaggcatgaattattgccttgaagtattaagatatgctaaaaaagcaagaccaaatataaagtggggcttttatggattcccatttaccagtgtttggggaccgaataaggaattttttgatgaacaaaacaaatttgcgctcctattgaaagaatgtgatattttttttccgtcactatatactttttatagtaatcctgcagcggttcttgctaatggtaattacctggaaaataatctgactggaagtataaaattaggaattgcttataaaaagcctgtttacgtttttatgtggcacagataccataacagtaatgagaaagatggtatgaaggaaatttcagataagatatggcaggaacagatggaaactgttgcaagtcaaaatgtaaatggtaaatttgtagatggaattttatggtggggagccgatgcctatttttatgagagacctgaagcggaaaatatgagaaaagaatttaaaggaaccctcaataactttatttctcataatgatgagtcgataataaggaaagccaagataataaaagacgttttacaaagtaaaaaatgatgaataaaagaccatatcagatctgtacaaaaactataatggacactacagaccctaacattatttttaatgaaaagggagaaagtgattattataccaattttaaagaaaatatagaacccaactggcatacagatcagcaaggatacgatgaattgatgaaaattgctgatagaatcaaaaagacatctaaaaataaagattttgattgtattattggtctaagtggcggattagacagttcttatgctgcttatatagcaaaagaagttatggggattcgtcctttgatttttcatgttgatgcaggatggaatacagataaagctgtggggaatattgaaaaactgatcaatggtctgaatctggatttatatactgaagtaatcaattgggaagaaatgaaagacctgcaggttgcatttctgaagtctcaaatctcagatcaggatttaccacaggattatgctttcttttctgccttatataaatttgcaaaaaaaaataaaatcaattacgtacttacaggaagtaatttttctacagaatgctgcagagagcctgaagaatggggaggctttcccgggattgacaccactttggtaaaagatattcattcgaagtttggtaaaagacctcttaaaacatttccgttggttgatattctttcctataaaattctctacaaatacgtatatggaatggaagtattcaaacctctgaatcttgttccgtttcataaaaaggaagccgaatctcttttagtagaaaagtttggttgggaacctttccaacataagcatcacgaatcaagatttacccgtttttatgaagattattggttgccgagaaaattcggttacgaaaaaagaaaggcacatttttcttcactgattcttaccggacagatgaccagagaagaagccttggacagagtttcaagacctgaactttcagaagaattcttacagaaagaatttgaatatgtcgcgaataagttagaccttaccaaagaagaactgcaacagatcttcgaaggaaaaaacaaaacatataaagactataaaaataaaatgggcattatcaaatttggtgctcagactatgcagaagttgggcttagaaaagagattattcagatgattacaattatcgattacggtgtaggaaacatcaatgcttttgtgaatgtttacaaaagagtagatgtacccgttaaaattgccagaacaaaagaagatttagaaggggcccaaaaattgattttgccgggcgtagggcattttgaccatgcaatgactcaactgaataattcaggaatgagagataagcttgatgatctggttctcaatcaaaaaataccagttattggaatctgtgtgggaatgcagatgatggcaaacaaaagtgatgaaggaatcatggagggccttaaatggattgatgctactgttaagaaatttgacgaaacaaaaattcagcaggtaaccagattacctcatatgggctggaatgacgtgaaacctgtgaaagatataggcctttttgaaggattacaggataattcaatattttatttcctccatacttattattttgaatgtaataatagtgaagatattatggcggttacagaatatggaggagaatttgcttctgctgcccatcatgaaaataaattcgggatacaatttcatccggaaaaaagtcaccattatggtgagattttgttacacaattttgcaaaactttaagagtctatgttaagacccagaattataccttcccttctgatacaagataacggacttgtaaaaacagtcaattttaagaatcctaaatatgtaggagatccaatcaatgcagtaagaatttttaatgaaaaagaagttgatgaacttgctatatttgacattgacgctactgtaaaaggactggagcctaactatagtttgattgaaagaattgccaatcagtccagaatgcctctttgctatggaggtggggtaagaactgtagaacaagcccagaaaatttttggacttggaatagaaaaaattgcactttcctctgctgttcttcaaaatcctcagttaattactcagattgcagaaagagtaggttcacaaagtgttatcgttgttttggatgtaaagaaaaaattgttcggtggatatgaagtttacactcacaatggcaaaaaatccactggaattaatccttttaaatttgcagaagaagctcagaaactgggagcaggagaaattatcatcaattcaattgatcaggatggtgtaatgaaaggctatgatatggggttaattgacaaagtaagagagaaaatttcattgcctcttacggttttaggaggagctggatctttaagtgatatcaagcaggtaatagataagcacggtattattggtgttgcggcaggaagcttattcgtatttaaaggagtttataaagctgtactcattaactatccttcctttgaagagaaagaaaaattaagacacaaataattattaatcatatgaaataattcttctgagattgctgcttgtttccctcaaagctttcttgaaaattatcaatgtgacaaggaaaaaaaatactatgcatataaaagataaaatacttcttattacaggcggaacaggctcatttgggacagctgttttaagaaagttcattaatacagaccactttaaagagatcaggattttttctcgtgatgagaaaaaacaggatgatatgaggaatcagtttaaaaatgataaactcaaattttatataggggatgtaagagattataacagtattgaacctgcaatgagaggagtggattatgtttttcatgcagcagcattgaagcaggttccatcatgtgaattttttccaatgcaggccgtaaagacaaatgtagaaggaacacaaaatgttattgatgcggctgcaaggaataaagtgaaaaaagtgatctgtttaagcacagataaggctgcctatccaattaatgcaatggggatttccaaagctatgatggaaaaagttgccgtagcagcatccagaaatttggaagaaactgttgtttgtcttacaagatatgggaatgtaatggcttcaagaggatctgtgattccattgtttatcaagcaaatcaaaaacggagatccgataacggttacggatcctaatatgaccagatttttaatgtctcttgaagaagcggtggagcttgtattatttgcatttgaacatggtaattccggagacttgtttgttaacaaagccccggcaggaactatcggtgatctggcacaggcattaaaggaaatgtttaaggctgaaaatcagattaaaataataggaacaagacatggtgaaaaactgtatgaaacgctatgtacccgtgaagaaatgttaaaagccgaagatatgggaaatttctatagaattcctgctgataacagagacctgaattatgcacagtttttttcagaaggggtagaggatatctcaaaaatagaagactatcattcccataatacagaacagcaggatgtggaagggatgaagaaactgttattaaagttacccctgatccgtaaagaagttttaggagaagatttactacaatatccagattaataaaaataaaatctaatgaatgtacctgaggttctcataggaggaaaatattcggatgaaagaggaagtcttttctttaataatagctttgatgcatctgaaattaaaagaatttactatatagaaaatactgatccgcagtttatcagaggctggacagggcataaggttgagcaacgctggttttcagctttgtcaggaagttttactataaggttaatcaaaattgacgactggtctatgccttccaaaagattagaaattttagaatatcatttagatgccgataaaatggatgttctccatgttcctgcaggctatgcaagtgctattcaatccggagaaaaagaatcaaaattattagtaatggcaaattattctttaggagaaatagatgatgattatcgtttccctatagattatttcgaaaatttataaaatgaaaagaataggaattacgggacagaatggatttgtaggatctcatttatataatactttagggttaaaaccagaagaatttgaaagaatcgaatttaaaaaggaattttttaataacccggagaaattagaccattttgtggagcaatgtgatgttattgtacatttagcggctatgaatcgtcatccggatcccgaggttatttttgaaaataatatcaatttagttaaagaattgatagcttctttagaaagaaccggatcaaaagctcatgttctgttttcatcctcttctcaggaagaaaaagataatttatacggaaagtctaagaaagaaggcagagaattgttttcagaatgggcaaaaaaatccggaggcacttttacaggtatggtcattccaaatgttttcgggccatttgggaaaccaaattataattctttcattgcaactttctgccataaacttactcacggtgaaactcctggtattgatattgacggagaagtcagacttatttatgtgggagagctagttcaggaaattatagataatatatataaaggtcaaaccgatgaattgtatgaagtttcccatacttctgtcaataaagtttcagaagtactggaaaaattaaaccactataagcagctttattttgaaaacggagaaattccggaattaaaaaccaagtttgatttaaacctgttcaatactttcagatgttattttgatgttaaaaatcattatcctgtgaaatttacacagcatgtagatccaagaggagcttttgtagaagtaattcgtttaggaatcggggggcagtgttctttctctacaacagttcccggaattacaagaggaaatcatttccataccagaaaaatagaaagatttgcagtgattaagggacaggcgttaatacagttaagaaaaatagatacagaggaagtactggatttttatctcgatggtaatgagcctgcttatgtagatatgcctatctggtatacccacaatattaaaaatataggtaatgaagagctctatactattttttggatcaatgaaccatttaatccggaagatgcggatacttactttttaaatgtctaatatgatcacgataaagaaaaattatattgagtatatttttattttttttctgacttttgggtatatctttttctactcactcgcagttccttttaatgccccgaatacactattttcggttccttttcgtgttattctgctctttataagtttttacatcatttatgtaaactttgacacgataaagaaaaggaaaaccaacattgtttttacgattcttttttggttgttctactttataaaggcagtttatagctttaaaacagatacttatttacagaaaacattaaataatgaacagcagatttatataagaattattggtttgaatctgataccctatattgctgttttaagtatcagtttttcaaaagaaattgtggtaaagctgaacagcttaatatttaattttttattaattatattaggaataagctgtatatataccataattgtcttccaggcttttgaaaaatcaagtgggatatttgcaggatattatattagtaccggacattatggcttatctttattgataatatcagtgtattattattttctttcatctcaaaagattaaacctgttttagggatacttataggggcctttactgtatttagttcctccgcaagaagccctatgctggctgcttttattattttatttataatcttattgtatgttaacaaattgaaatactggttgacattaattcttgctacacttctttttattataggtatatatgctttaaataagacatatttagctaattttgagtttgttgaaagaatgtatagtgctatttttgaaggaggaggatccggaagatcatattacttagcaaaaggctgggacgtctttaaaaataatatactttttggaggacgtattttatttgaagatggactgtatccacataatatttttgtagaagttctgatgagtatgggggttgtcggaatcattctgttctttttttattttaaagatttatggaagttcaggttgaattttattagtaagaatagatactacttaccatttattttgttttttatacaatattttgttcttgtcctgacttcctacagtctctttgccaacttggaattctggactttttcaacggtatttatatcaataattttattttgtaatgatgaaaaaattaaaagtaatgacagtcgtgggaacacggccggaaatcattagattatcaagagtattatcagcattagatgcatccgaagctatagaacatatcattgtccatacagggcagaattacgactatgagcttaaccagattttctttgaagatcttggattaagaaaacccgattattttctggaggcagcagggaaatcggctacagaaacagttgggaatatcctgatcaaaattgatccgcttttagaagaattgcagccagatgctttccttgttttaggagataccaactcatgtctctgtgcaattccggctaaaaaaagacaaattcctattttccatatggaagctggtaacaggtgctttgaccagagagtaccggaggaaacaaaccgtaaaattgttgatcatacatcagacatcaaccttacctattctgatatagcccgtgaatatttgttaaaagaaggattacctgcagacagaattatcaaaacaggatctccgatgtttgaggttttaaatcattatttaccacagatagaaagctctgatgtgctgaaaagattaaatctggaagaaggaaaatattttgtagtttcatcacacagagaagaaaatataaactctgaaaagaattttctgggattgatggaaagccttaatgcaattgcagaaaaattcggatacccggtcattgtttctactcatcctaggacgagaaatatgattgataaaatgaagatatctgtaagacctgaagtacagtttctaaaacctctgggttttcatgattataatgcacttcaaatgagaagttatgccgtattatcagattcgggcacgatctcggaggaatcttcgattcttaatttcagagcgcttaatatcagagaagcacatgaaagacctgaagcaatggaagaagcatcagtaatgatggtaggtttgtctcccgaaagaattttacagggactggttcagcttcagcagcaaaaaacaggtaaggaaagaaattacagaccggtatcagattattctatgccaaatgtttctgagaagatggtaagaattatccttagttatacggattatgtaaacagagtagtctggagaaaataaaattatggctaaaaaagtactcatccacagtattgtttttgctccggatgctgtttctaccgcttatctttataatgatattgcatataatttaaaagagaacggctttgaagtagaagttctttcaaccatgccgcattataacaaggttgatcagagcaaaacaaaatttagaaaaagatttctaggcctttattattccagtaattataaaggtatcaaagtatatcatgtgcctcagaaaaaatatgagagtgttcttttaagaggatttatgatgatttactggcatttactatcgttttttcttggaatgcggattaaaaatgttgatgttatcatcagtccttcaccacctcttactattgcggtagtatctattgcattggcaaaactgaaaaaggcgaagtttatctataacgttcaggaaatttatcccgacttttttgtgaaccagggcaaaatgaaatctcagtttgttttaaatattcttaaaaagcttgaaaagtttgtttataaacactcagattcattggtaacgattgatcagaattttaaaaatacattgattccaagagttgaaaaccctgataaaattgagattattgctaattttgtagatacggaactttatcatccaatagaacatccggcagttaacgctcaattatttccggccagtgataatttgaaagtaatgtatgccgggaatattggttttgcacaggactggattccgcttatagaaattgcaaaaaaaacaaaagcgatgcctgtcagttattttgttattggagatggagcctgcagatcatggcttaaggcacaaattgatacatataagctggataatataagtttaattgattatcaggcgagagagacgatccctcatatgattaattatgcagatctgcattttatctttatgaataaaaaattggaaaaagatggtctcccctctaaggtctataccattatggcctgtaaaaaacctttactggtaatcagtaataagaatacaccgctatatgatttgctggaaaatacagatgctgcgtttttgattgaaaattcgtcgaataatgttaatgaagagttatttaatgtactgcaggacgcattgaatcatagaaataagctgaagcaaatgggggagaaaggatttaatatggtacagaaagactataccaaagaaaaagttactgaaaaatattatgaacacatcaacagtgtaataaatagctaattaaaaaacaacgatgaaaataataataattactcaggaggattcctttgttgttcccaaaaatatagaaaagattctgcgtctggagaatgtggaacttttaaaagtaatagatattgactctaattacagtctcgttaacaagaaatcttattttattaaaggttttggattactgcagaccgtaaaaatgggtatgaaagtaatctcggccaaggtcttgaatagtatagatatcctcacgtcttacaaacttgctatccaacccaaaagtctgaaagcagtttccggacgatacaatatacaatttgaaagaataaaaaatcctaactcagcagaattcttagaagaagtaaaaactttacagccggaccttattgtatcctactctgcacctgtggtatttaaagaaactttgttgaagatccctaagcatgggtgtatcaatttgcattgttcatatttaccccattatgcaggagttatgcctagtttctggacactgtataaaaaagaaaaaacaacaggagctacagtacattatatggattcaaaaattgataatggagccatcttaaatcaacaggagattcagatttctcctaatgaaactatgttttctttaattttaaaaagtaaagaaatcggtggaaatctaatgtgtaaaaccattcgtgatattcaaaattctaatattagcgttaaagagaattttgctgaaaaaggcagttattttacctggcctacggttgaccaatttcaagactttactaaaaacggaggaaaattaatatgaataagtatgctgtgcttagtatggatgtagaagaatggtatcatctggactattttacaaaagaagaatgtgagttgaatcagtcaactttagatggattagatatttacctggatattttagatcaatatgatattaaaactaccttttttattgtaggagaacttgtagaagttttaaaagataagattaaatatataaaagctaaaggccatgaaatttgtcttcactcatatgcccataaaagacctcttcagcttagtcttgacgggtttagagaagacacaataaaagggattgattcattcagagaatttacagggcttgaagtagatggatacagagctccatgttttagtttagataggcctaggttggagattttaagagaattaggcttttcatttgactccagtaaaataaaatttgatgcccatgacttatatggaagcattaatcttgatgattttgaagagtttcacccaacgatatataagaaagagtcattttatgagtttgaagcttctactgtagaagtgctgggaaaaagtctgccggtttcaggtggaggatatttaagaatttttccctgggcactgacgaaaatgctcctgaaaaaatattttaaaaaaaatcaacattatttcttttatatccacccgtttgaattttctaaaaattataatattactgttccggaaaatacagattttaaaacaaaagtcagatttaatcagggaaggaaaagcgttgaaaataaaatgcataaactgattcaattgttgaaagagaataactataagtttgttacatttaaccaaattgttaaaaatgaaggctaagttgctgttgacaggagcaagcggatttataggctcacaaatatataaagcgctgaaagaggattttgatattacggctatttcttcttcttccttgggagaggattatacaacgcttaatcttttgaatgaaaatgagtgcaaaaattttttcaaaaataaaaagtttgattttattattcatgcagcagcaatagcccacggcaaaaataaaaatgatacaatgaaggtgggggaagccaatcttgtaatgacaaaaaatatttttaattctcttgatgtaaaaaatacaaaggttatttttttaagttcggtttcggtatacagctttaaaaacaataaagaaataatttcagtaaatgatcagccattaccggttacagaatacgggaaaagtaaattaatatgtgaaaatttgttaaaagagaaaaaacctgtatcattgcatattttacggttgaccccagtttatacagaaaataatttaaaagatttaggaaaaagagtcttcctgcctgtattgaagttccctttcattacaaagcaagcaagaatatattcattatgccatgttgatgtagtagttaatgaagtaattaactcaatgaatacagatcacgattcattaaagattgtaaaggatcctgaagatcatactcaggaagagctgttgtcattttttaaaatagaaaaaccacaaataattattaatcagaatgttgttaaaccattgttttttatattaagattgatccccgtttcgaagtcgaatattataaaggatatgtttactaagttattttattcggccttatatattaattaattttacttttgatgaaagaatttatttatttagtgataatcttattgctttttttggctgaattgatctatttcaaaatagctgataagtacaatattatagataaacctaaccatagaagcgcacatacgcaggttactttaagaggcggggggattatatttccgattgctttcattctttttagtttgttcaattttaatgaagttgtaaaagattactgggcttttggcttaggcatgcttgctatctgtatcattagttttatagatgatgttaagccattatcaaataaactaaggcttacggttcagtttatttctgttgttttactgttggattttataaatgcattcgctttgatgccattttgggtatggtccatcatgtttattgtgattgtaggaaccctgaatgcctataattttatggacggaatcaatggaatgacaggattatatagcctggttacagtttgtacacttatttatatcaatagaaatatttttcaatttactgacaataaatttatatactatccggccctggcctgtattgtatttctttttttcaattttagaaaaaaagcaaaatgttttgcaggagacgtcgggagtatgggaatcggcttctggataatagggcttattaccctattaatcatgaaaactcaggattataaatacatattattattatctgtttacggaattgaagttgttttgacaatcattgaaagaattatgctgaaagaaaatatttttgaagcacacagaagacatctgtatcagcttcttgccaatgagaaaaaaatcccccatttattgataagttttgtatattcctttttccaactgctggtaactgtttttttaatacattcctctttcccgttatggatcgttgctctcattgtgtttttacctgttggaggactgtatctgttattaaaatggagcattaagaaacaatataatctgtagatttttttagaaataaattatgaaaattaaagaaacaccgcttaaagactgctacatcatagagcctactatatttgaagatgaaagaggctacttctttgaaaagttcaacgaaaaaaaattcgaggaactgaccggaatgaacggacactttgtacaggataatatttctaaatcttcttatggagtattgagaggattacaccttcaaaaaggagaacatgctcaggcaaaactggtttcgtgtcttgaaggaagtgtttgggatgtggctgtagatcttagagaagattctcctacatttggtaaatggttcggaatagaacttactgctgaaaataaattacagctgtatgtaccgagaggctttggacatggtttttctgtattgagtacccatgcggtattttcttataaatgtgataatttttacaacaaagaatcagaaggcagcgtaaaattcaatgacccagatcttaatatcgactggaaagtagatgaaaaagatgccatactttccgaaaaagaccagaatgctcccggatttaaagaaaaaaacttttaaagtatattcctgaaaaccacttttataaagtggtttttattttttaatcttaactctctaatattttgtatctttgcagactcaaaatcaaaacgatgcgtacaaaatctgtagggaagaagaaaatcaatgtagtcactcttggatgttccaagaatgtatatgattctgaagtattaatgagccagctgaaagccaatggcaaagaagtggttcatgaagaccgtggggatattgtggtaatcaatacttgcggatttattgataatgcgaaagaagaatctatcaatactattcttgattatgttgaggctaaaaacagaggtgaggttgagaaagtattcgttaccggatgtttatctgaaagatataaaccggacctgatcaaagaaattccggatgtggatcaatatttcgggacaagagaccttcctgtactcttaaaacaccttggagcagattataaacacgaattggtaggagaaagattaacaacaactccaaaacattacgcatatcttaaaatttctgaaggctgcgacagaccatgttctttctgtgccattccattgatgagaggcgggcatgtttcaacccctatcgaaaaactggtttcagaagctcagaaactggctaaaaaaggaacaaaggaattaattcttattgcacaggatcttacttactatggtttagatctttacaaaaaaagagcattgggagaccttttaaaagaactggtaaaagtagaaggagtagaatggattcgtcttcactatgctttcccgagtggttttcctgaagatgtgctcgatattatccgcgaagagcctaaagtatgtaattatatagatattcctcttcagcacatcaattcagatttgttgaaatcaatgaagagaggaactacccatgaaaaaactgatgctcttttaggaaaattcagagaaaaagttcctgatatggcaatcagaactacacttattgttggatatccgggagaaacagaagaaagattccaggaacttaaagactgggtaagagaacagaaatttgacagattgggatgttttacttattctcatgaggagaatacaactgcttatgttttggaagacgatattccacaggaggtaaaagaggcaagagtagaagaaattatggaattacagtctcagatttcttgggaaaagaatcaggataaagtaggtaaagtattcagatgtattttcgaccgtaaagaaggaaattacttcatcggaagaacagagtatgattcaccagatgtggataatacagttttggtttctgcagaaaatacttacatttctattggtgaatttgcagaggtcaaaataacctccgcagaagaatttgacttatatggagaattagtatagctaaatgcttattaatcaattgaaaataaagctggtcgaattaatccattaacgaaaattaacatagaattttttctgtcccttctttttattgtattgaaaaccaaatgattaatattatatataattaggaatatttaattttttatctataaagcatataaaatcaaaaattatatcttaaatttgcgcagaaagcaatatttttaaatcatgtattgtcaataagttaatcattaaaatgaagctaaaattccattggaatagttatttgatcgttttttagtttcaatataatgttcacaagttgggatgcatcctttttggaaatattgatgaaaaaaatgtaattaaaaatctttaaaaacttatgaaaaaatttttattaacagcaattatgcttgttggcctttcggctctttctaaggctcagcaggggcgagtggggattaacacaaccacaccagccgcaactctagacgtagtagcaaatactactgataatgctagacctgatgccttactaatccctcgtttaacaagagcacaattattagctaaagatgcagcttatactgctgctcaaaatggagcacttacttttgttactacaattgacggtactgcaacccctaaaactacaaacgttacagcagtgggcttttattattatgatggtcagactacaaatacatggattgctttaggtggtggaggtacagttacacctgttgttcctactgtaagaacttcagcgacaggtacagacttatctgcagctgatttagatggctatgtatttcttacaaccaatgctgatttatcaacaattcctgtaactgcagcaactaagggaagaagtattacccttgttaaagtgggtggaggtacacttactgtaaatggtgcgagtgcagcttcagttaactctatgactgttaacggaagaggtcttggttttgtttatgatggaactgcatggcaatcatattcagctcaataatttattaattttacacagatttagtcatgaataaaaaaatattattagttcttgcctcttctttggcaatgtttcaatatactaatgcacaggttagaacaaatggttttgccagtggaaatatagctgggcaaggtgcctttttagatgcttcaggaagtaccggaggttttacggatagcgttaatgatggaaaaggacttgtttttcctagaactaatctaacgactttcacatttgcaactccagttactgatgaagataacttcccaactgcttatgatggtatgatcgtttataacactgctactggaacaacagtttccggtattgctactagtgttactccgggatactactatttctcgaatcctacagggggaactgcaaacggatttgctacttctaccggtagatgggtttccctttctacttcaccaaaagtaactgtaggaacaacagaaacaactacaaatactattatcaatactacagccggagataaacagctttatgctattaaaggaactttcacggcaagtggtacttctacagctgtaaatatccctgcacctgccggtatgtctgcaatgtatggaattacaatctataaagctggtacaaatacagtatatgatagaagcctgtattcttatacaattgctacaactgcaggtaatgcaattactggttctcctagtatgtctgtagtttatccttctggaacatatgattatgtactggaatatttaaaatagaaaaagtattaattacatattaaacaacccgatgagaaatcattgggttgtttactttttagagagaagcgttctattagtaattgatattaaagaatattgatttaatttttacatcatgatattatataattacaatcaatctgaaatttaacaatgtatcaggctgttaaaatctaattcagaatattgaatatggtaggcttaagcagcttattactgtcgtttttcttagatttagaatttaagacttttatttttttttaggtgttttttaattcatatcttaacattgttgattttgtaacttattgattattagtttgttttaaatagatgctttttaaattatgtgtgaattagttaattatgttaactttttaagcttttttttaacgttttttaacaatatagtttaaacgccctatttatagggttttgcaaggtttgttaacattttattagttttttgttaactgtttttaacatatggagtagggttttataaagattcctgatacatttgctccgtcaaaaccaataaaagttcaaaatgatgaaaagattcattctcgtaatcataatgatgatttcaaccctgggtgtttattcttttacgaataatgccttagatgcgaaaaaaacaagttatgcatcgtactaccacgataaatttaacggtagaaaaaccgctagcggagaaatctttgataattcaaagtttactgcagcaaacagaacgcttccgtttggaacaaacgttaaggtaacaaaccttagaaatggtaaagaagtaatagtgagaattaatgacagaggaccttaccattcatcaagatctttagacatgtctaaagcagcgttcgatgagattggagatatcaatcgtggtaccattccggtcgaatatgaaattgtcgattaattttatgatttaaattaaaaaaaagccagctgactcagctggctttttgtatagataacctttcttatatatccaattccaccaaagcaggacaatggtcagaatgtaatgcttcctttaaaataacagctctgctgagcttatcttttaaactataggaagtaaaattataatccagtctccagcccttattcctttctcttgaattttgtctgtagctccaccaggtgtaattatccggttcattgttgaagaatctgaaactgtcaataagttcacattcattaatgaagttggtcatccactccctttccataggaagaaatcctgaaacatttttcaggccaaccggattgtgaatatcaatagcctcgtgacagatattgaaatcacccgatataatcaggttggggatttctttttttaaattcttgatatactcaaggaaatcatagcaaaattgcattttaaaatccagtctctcaatattggatgcagaaggaacatagaccgaaatagcagaatatccgtcaaaatctgcacggataattcttccttcattatcatagctctcgattccgcagccgaactccacatggttgggttttatttttgaagcaattccgactccgctgtagccttttcttactgctgagtgccaataactatgatatcctaatttttcaaggctttcgatgtcaatctgatcgtttccggctttactttcctgaatacagatgatatccggatctgcagtcttcagccagcccagaaaatcttttgtaaaagctgccctgattccattgacattgtaggtaattaatctcattagttttctataaaaattttaaagttttcattgtacttcgacgggataaattctgtgatggcataatcagccacttcgtgaatataaaaaggatcttcagaaatgatctgctctgcttcttttctggattctgcgttggcgataataatccctcccgttctgggttcttttcttcctgaggcaatgaaacgtccggcttcataatgtttgtcaaggaaaatattgtgctgtggaataagctgctctaccttttcaatagaacttttataagtgagcgaaatgatgaacatgatttaatttttacgaagatatgaactataaaaaagaggcggaaaaaatcgcaagattttttccgcctttaaacccaaaattaaataaactatgaaaaaaactacttgggttctaaaatactgataggaataatacactcttccagtgaaattcccccatgctgataagtttctttatagtaattaacaaaatgattgtaattcttaggataagccaggaaagtattgtttttagcaaaaatatacttcgagctcaggtttccttttggaaggaaaagtttttcaggattggtaattgcccatacatcactgtcatcataagttaagcttttaccggttttatatctgatattcgtagaggtttctctgtctcccaccactttacttggttttttaacgtacactgttccatgatcagttgtaatgaccagtttgtatccgttttctgcagcggcttttataattttcattaatgaagagttttcaaaccagttgaacgtaagagaacggaaagtcttatcatcacggatcagctgatctacaatatggttgtcagtcttcgcatgggaaaggatatcaataaaattgtaaacaattaccagcaggtcattgtttttatgctggttaaaatcatcatagatctttctttcaaaatctgcattcagtactttaaggtatttcatagattttgatcctaggccaattctcttcatctgatcttcaagaaagtcacgctcaaactcatttttgtttccttcttcattgtcattaaaccatttgtccgggaaacgtttttcaatttcagatggcatgagtcctgcaaagaacgagtttcttgcatactgtgttgctgtaggaagaatactgtagtaataatcttcagatattttattgtaatattttgtaaataaaggttcgataaccttccactgatcataacgaagattgtctaccatcagaagaagaactttctctttttcaacctcaggctttactttctccttgaaaagcgtgtggctcatcatgggcttatccgaatctgtaagccagttttcataattcttctcaataaacttcgcaaactgaatattcgcttcttctttctgagactgcagaagatcagcaaattcattgtcggccactttatcaaacttgatttcccagctaaggattttcttatagtattcagcccattcctgatacgttctcaaataagaaagttccatagaaaggtttctgaattcctgctggtactgtaaaatagttttctgttcaacaagattatcctgctgaaggtttttctttaaggaaagtaatatctgattaggatttacaggcttgagtatatagtcggcaatctgtgagccgatagcctcttccataatatgttcttcttcgcttttggtaaccataacgatttttaaggcattatctttttccttgatcataggaatggcctccaacccggaaatacccggcatattttcgtcaattaacgttaaagcaaatttctctgaatccatgagttccaaagcctcgttcacattgttaacaggtgttacctggtaacctttcttttctaaaaatacgatatgaggtttaagtaaatctatttcatcatcaatccataatatcttttctgacataatttattttttacatggttattgtatcaaaatgttgaccaaatccttttaaaatctcacaaaatcgaaatattaaaagttaaatattagttaaatggaaatactcgggcagatttcacatttttatcccatttaatcactgttttgtatatactccaaagccttccaatactttatctttattaagattatcgtgctttctctcaaaggtaatcctttaatacaacagctgcaaaccgtttgtaaagaaaatctgaattgatgagcaaataactgagaaaatttttaagactggttgaagatattgggttaaataaaaagtataaggaatgcttggcccaatttttaatggtaatttaatagagggcccaattttaaaatgcctaactttgtttactaatattgaagtttcaatgcagaataagctaaaaatcatcaacgatcctgttcacggatttataaaaattccacacgaaattttatttgacatcattgaacatccttattttcaaaggttgaggagaatcgggcaaaccggtcttttgaatctgatatttcccggcgctacccatacaagatttcaccatgctctgggagcaatgcatttgatgtttacagccctggaaacattaaaacagaaaggagtgaaaatctctgaagaagaggaaaaaggagcgatgctggctattctgatgcatgatattggtcatggtccgttttcgcatgcgctggaaagtatgctgatggacgactggcatcatgaaaatctttcgttactgctgatgaacaagctgaatgaagagtttgaagggcagctttccatggctattgaaatgtttcaggggaaataccacagaaaatttttcaaccagctgatttcttcccagctggatgttgaccgtctggattatcttaaaagagacagtttttttaccggagtatctgaaggaaatattaatacccaaagaataatctccatgatgaatgtctgtgaagaaggcgagttggtcattgatgcaaaaggtatttattccattgaaaattttctgactgccagaatgtttatgtattggcaggtatactatcataaaacgtcggctttggcagagtttcttttggttaaaattcttgaaagagcaaaatatctggtttcccagggtgtggaactgcccgcaaccgataatctcaaatattttttatacagggaaaaaagtgctgcaaccgatgaagatatagaaaggtttaccaggcttgatgacaatgacgtgatccaggcaatgaaggaatggcagcattcagatgattttgtgctgtcatactggtgtaaatgtgtaattcagagaaatttgcctaaaaccattatttcgtcacatccatttgatgataaaataattgacgaaaaaataaaaaagagtaatgaatttttcggaatcgataatggtaatgaattggttcatgaaattaaaagaaaactgctgccttatcatgcagagaaacagccgatttatttgttgcagaaaaatggtaaaagaacaaggctgcatgagtcggaagatcagcttttatcagggttgatggtgaataagacaacccgctatatccttatgtttccaagagatatctccggaatggattcttaaagaatattaaaatttacgatctgaaactaaaacgtgtttgcaaattatagaatttcttatctttgcagaatatggaattcacagcttcgcaaattgcaagttttattgacggaaaaataataggtgacgagaatgcgcttattacaggagtttcaccaattgaaaatggggaatcaggacatctttcttttatagcacaagatcggttttctcattttttggatagctcaaaatgttctgttatcatcgtttcggaaaaacttctggagaaaaatcattataatcctaccttaatcgttgtaaaagatgcctatctttcttttcagattctgatgaatttatatcaggaaatgcaggggagaaaagaaggtattgaaaatggttcttccattcacgatacagctgtcataggagataaggcctatatcggagcatttacttatgtttccgagaaagctaaaataggggaaggttcacagatctatccgcatgtatatataggaaaaggagtaaaaatcggtaaaaactgtaagatagacagtggtgccagaatttatgattattgtattattggggataactgtgtaattcattcaaatacggtaattggcggtgacggatttggtttccagccaacagccgaaggcttcaaaaaaataccgcagcttggaaatgttattattgaagacgatgtagaaattggttcaaactgtagcattgacagagcaacaataggttctaccgttattggtaaaggaaccaagattgataaccttattcagattgcccacaatgtgaaaattggtcagaacaacgtaattgccgcccaggcaggaattgcaggttctactacaattggtgactggaaccagattggcggccaggtaggcgttgtaggacatattaaaataggaaatcaggtaaaaattcaggctcagagcggtgtaaattccagcgttaatgacagggagacattgtatggttcgccggcaatcagttataatgactatttgagaagctatgttcatttcagaaacctgcctggaatagtaagtagaataaataatcttgagaataactcaaaagataatactaatgagtgatatgcaaaaaacacttcagcaagaggtaactctttctggaattggtcttcacacgggtaaagaagtaaaacttaccattaagcctgctaaagaaaatacaggttttgtttttgtaagaacagacttggagggacatcctcaggtagaagcagatgtaaattatgttgtagcaacagaaagaggaactacattagaaaaattaggggtaaaaattaccacttgcgagcaccttttagcagcccttgttggttgtgatattgacaacgcaattttagaaatggatgcctctgaacctcctattttagatggatcttcaaaatactttgtggaagctatcgaaagtgttggagtagcagaacagagcgtagcaagagagtatcttgttgtaaaagaagttcttacttacagtgatccggctacaggttcggaaatcacgatcattccttcagatacttatgaagtaactacaatggtagattttgggactaaagtattaggtactcaaaatgccactcttaaaaatatttcagaatttaaagacgaaatctcatcagcaagaacattcagcttcctgcacgagttggaaatgcttttagatcacggtttgatcaaaggtggagatatttccaatgccatcgtatatgtagataaagatcttactcctgaaactacagaaaagctaaagaaagcctttggaaaagataatgtatccatcagaccaaacggtattcttgataatcttaatttaaactatcctaacgaagcagcgagacacaaattactggacgtaatcggtgaccttgctttggcaggtgtaaaaataaaaggtaaagttatcgcgaacaaacctgggcactatgtgaatacccagtttgcgaaaaaactaaaccgccagtggaaattgcagaaaaagaaaaacgttccggattttgaccttaccaaggagccggtattcgatatcaacggcattatgaagcttatgcctcacagacctccgttcttattgattgataaagttcttgaactttcagactcgcatgtagtaggtctgaaaaatgttacaatgaatgagccattcttcgtaggacatttccctaaagaaccagtaatgcctggagttcttcaggtagaagcattagcacagacaggaggaattcttgtgctggccagcgtgccggatcctgaaaactattctacctatttcatcaaaattgataaggtgaaattcaaaagaaaagtaattccgggagatacgctgatcttcaaaattgaattaatagagcctatcagaagaggaattgttcatatgcaggggtatggatatgtaggagatactgtagcagtagaagcagagcttatggctcaagttgcaaaaaataaagttgattaaatgattcatcaattagcagccgtagataaacgtgcgaaaatcagcaaaaatgtaatcgtagaacctttcactaccattgcaggggatgtagaaattggagaaggaacatggattggtccgaatgttaccatcatggatggtgcaagaatagggaaaaactgtaggatatttcccgggacagtaatctctgcaattcctcaggatctgaaatttgatggtgaagatacccaggtgattattggcgatgatacaacaatcagagaatgcgttacggtaaacagaggcacaaaagctctgggatatactaaaataggtgctaactgccttattatggctacttcgcatatagcccatgattgtgttatcggagatcacgttatcattgtaaacggttgtggtattgcaggacacgtggagatcggagattatacggtaatgggaggtttatcagccgttcaccaatttggtaaaatcggaaagcatgtaatgatttccggaggtactctggtaagaaaagatatcccgccttacgtaaaagtagccagagagcctatgtcctatgcaggtatcaattcggttggtttaagaaggagaggatttaccaatgagaaaatctttgaaatccagaaaatctacagagctattttccagatgaagatgaacgtttcccaggctatttcccatattgaaaaagaaatgcttccaacggctgaaagagatgagatcttacagtttattcaaaactcaccaagaggtatcgtaaaaggatacggaaccggtaaagagagtaactaagagaaatgctaaaaagcaaatttgcaaatctgcctgtttgcttgccagccaacacaatttaagtaaaaaaagataatatatattaatggcaacaagtaacgatatcagaaaagggctatgcatcgaatatagcaatgatatttataaagtaatcgagttccttcacgtaaaaccgggaaaaggacctgctttcgtaagaacaaaattaaagtcagtgacaaacggtaaagtaattgataatactttctctgcaggacacaaaattgatgaagtaaaagtaatcactagaaaattccagtatctgtatgatgatgagaacggattccacttcatgaacaatgatgatttctctcagttatacatcaacaaagaaatgattgagaattctcagtttatgaaagcgggtgaagaagtgactatcattttgaaagaagctgatgaaactccactttctgctgaacttccacaatcagtataccttgatgttatcgaagctgatccgggtgtaaaaggaaacacagcaaccaatgctcttaaaaacgcaatcgttgaaacaggagcaagagtaatggttcctttgttcattgaaccgggagacagaattaaagtaagcactgaagacggcagctacttagaaagagtaaaagaataaataaaatttacataaattcggtttgcatcagcactccgaattttgttttataagaaaatctattgttatgagattccattctccgcaaaagcttaaaaccattgcagatttaataggctcagcatttatagggcctgaagattttgaagtattggggaccaatgagattcacatggtaaaaccaggtgatatcgtttttgtgaatcaccctaaatattatgacaaagcattaaactctgcagccactattattttaattgataaagaagtagaatgcccggaaggcaaagcgcttttggtttctgatgatcctttcagagactttaataaaatcaatactcatttcaccagaatatataattttactgaagaacttcacgatgttgaaataggagaaggaacaaaaatccatccttctgcagtaattggaaacaatgtgaaaatcggaaaaaacacccttatttttccaaatgttgtcattggagaccgtacagaaatcggagataatgtgatcatccagtccggtacggttatcggtggagatgctttctattacagaaaactgaatggtaattttgaccgtttaatttccgtaggaaacgttgtcattgaaaacaatgttgaaattggaaacaactgtactattgacagaggagttacagattctacagtgattggggaaggatctgttttggacaaccttattcagatcggtcatgataccgtaatcgggaaaaaatgccttattgcttctcaggtgggaattgcaggatgttgcatcattgaagacgaagtgaccatgtggggacaggttggaattgcatcaggacttaccattgagaaaggcacagttcttttagccaaagccggagtgaacaaagacctcaaaaaaggaacctatatcggcctgtttgcagaagattttaaaggctatctgaaaaaagaagtaaaactgagaaatctcaaataaacaattccaaaggttttatccgaaatcaaagaaatttgagtaaatttgtgagcattaataaaataataaataaattaaaacaacaataaaatgtcaattttagtaaacaaagattctaaagtaattgtacaaggatttacagggaacgaaggaactttccacgctggtcagatgattgaatacggaacaaacgtagtaggtggtgttactccgggaaaaggaggtagcgagcacttaggaaaaccggtattcaatactgttgctgacgctgttgaaaaagcaggagcaaacgtaagtatcattttcgtaccaccggcattcgcagcagatgctatcatggaagctgctgaagcaggaatcaaagtaattgtatgtattactgaaggtattcctgtagctgatatggtaaaagtgaaatcttatatcgctgacagagactgcagattaatcggaccaaactgccctggaatcattacttctgaagaagctaaaattggtattatgccaggtttcgttttcaaaaaaggaaaagtaggtatcgtttcaaaatcaggtactcttacttacgaagctgctgatcaggttgtaagagcaggttacggtatttctactgcaatcggtatcggtggtgacccaatcatcggaacaacaacaagagaagcgttagagctatttattaacgatcctgaaactgaagctgttgtaatgattggtgaaattggtggaggtcttgaagctgaagctgctagatggtacaaagcaagcggatctactaaaccggttgtaggcttcattgccggacaaacggctccgaaaggaagaacaatgggacacgctggtgctatcgtaggaggtgctgaagatacagctcaggcaaaaatggaaatcatgagagaaaacggtatcaacgttgtagattctccagcagatatcggtgctactgtagcaaaaattttaggataacataaaaccacagcatatgaaaaaacttttattagcctcagctttgaccctttctgccttatcctttgcacaagtgcaatggaaaagtacaagatttggagtaacaggaggtttaaattactccagagtatctaatgcccataatccttcaggccctagatacacattccaggctggagctttggcattaattcccgtaggaaaggcaaaccagttctttattcaacctgaagttcagtactatggtgctggagaaacaggaaaggataaagatgctaaaggagtaagcggttatgacgcagtatatgcaaataactacctgagtgtgcctctttatttcaaaggctatttttctgaagcagaatcagaattctttggattgataggcccaagatttaactttttgctaagtcagaacgttaaagacgctcctgtaagcagaccttattatgacccggatgttaccgatcctaaccagccggcaggcgtaaatggaaaggcaaacagctttaactggggacttgggctgggagtaggatatagctacaaaagacagcttgaagttgctttaaaatatgacttaggtctgggagacacttaccctggtcttgctaaagaaaccaaaggtactgataagaaaaaatcagagcaggtaattgcccttactttaagctatatattcaaatagaaatatttcagaataaaaaaatcccggaaacaaagtttccgggatttttatttttatatctgtcggtaaatcgaacaattttcttagcttttttgctattttacgatttcgccattttggcatttaacgatttagtagctagcctttaatccatttccaaagctcttttaaagtagccttattgccgtacatcaaaattcctacacgataaatttttcctgccaggaagatcatgaaaatagtggttgccagcagtagtacaatagataatgctatttgccagacagggactccaaacgggattctggcaatcatagccaccggtgaagtaaatggaataatagacagccagaaacctagcggaccatcaggattattcattaaagaaaaacttccatacattcctaatgtcaaaggtaaaattgcaaataacgtaaattgttgtgtctctgtttcgttatccacagcagaaccgattgcagcataaatagagctatagaagatatagcctaaaaggaagaaaacgataaatacaaagatgattagcgggaagttcagttccagtaagctgtgagaaatctgagtggcaagctgtcctacatccagtttgtcagccagttcttcattccctcccggaatatttttctgaataggagaaaaacctgtatttaataccagtgcaccaattactgacattgtaatccagatcacgaattgtgtcagtgcaaccattgttaccccaagaattttacccatcatcagttcaaaaggttttacagaagaaataatgatttccacaacacggttattcttttcctcaagcacacttctcattacccttaccccataaataatgatgaacatgaaagtgacgtacatcagcaccatactcaatccggatttaacaccaaagataagatcagaatcctccttattgttatccgtaacattgatggtttttaaggtaaagcttttatccagattattcaattgaacttcctggatacccagctgcttgattttttcttttctgacaacattgctgatatcagatacaattctctgcttcgtgtcaaatcctattttgctgttgatgatcagtctggtctcattttcaagctgatcaaaattctggtttttcaattccggaagaataaggatgccgtccagagattcattacctttcaaattgttaatcttggatttttcgtcagctgcagagacaaaaacgtaatttaatttttcattggatttcagctggttggtaaacaatccgcttttatccaccacttctataatgctatgtgattcgtttgctttaaacattaatccgatcacagccccgaaggcaatgatcataataggagcaagcagggtcaatatgatgaaagattttttcttaacctgtgtaagaaactctcttttggtaattaaaaaaatattattcataaaaattaagaatggttacttacagcattaataaacacttcattcatactcggaattctttcgtcgaatgatcttactttacctacctgtaccaggtcaaggagaatattattctggctttcttcatttttcaggtcaaaggaaacaaggttgttttcattcgataaattgaaaatctcatacttatttctgaaattttcaaactgatcgttattgacttcagaaagcgtaattccgaaaatatttttcttgaatttttctcttacatcaaaaactcttccgtcaatgattttcttcgaattgttgatcaaagccacataatcacacatttcctctacactttccattctgtgggtagaaagaatgatggttgttccgttatttttaagatcaatgatctgatctttaattaaattagcatttaccggatcaaaacctgaaaaaggctcatcaagaatcaaaagatgaggtctgtgaagaaccgtaactacaaactgaattttttgagccatccctttagaaagttcagaaagctttttcttccaccattggtcaatattcagtttttcaaaccattttttggcttcgttcaaagcatcacttttggtcattcctttcagttccccgaaataaaggatctgatcaccaactgtcatgtttttatacagccctctttcttcaggcatgtagccaatgtctttaatatggttggggttcagtttctgtccgttgataaaaatatctcccgagtctgcctgggtaatttgattgatgatacggatgaaagaagtttttccggctccgttaggccctaaaagaccataaatactggcttttggaacatggatgctgaaatcatccagggcgaccttttttccggcattataggtctttttaatatgttcagcttttagcattaaattgttctttttacaattagtataaaaaagttccgaaagttacggaaatattaaaacagaattaatgtaaaagaaaaaatcctgatgattatcaggattttaatttattgtttcacgatttgagtaactttctgcgtgttgtcacttaatatataacggatcatatattttccgggtttcaatttttcaatattgatctctccggagttcatatttaccgtataattggcaacctgcatacccaaaatagaatagaaagtcacacttttgattcttaaagaagaatcttttgccttaataataaggaagtcctttgcaggatttggataggcaagcaatacaccatcatccgccttttgagtgatggaacccggctctctaagctgagctttaaaattgttggaaaatccaacaaaagtgcctacaaatagaaataaaagtaaaagttttttcatcaaatttataatttctcgaatatatataacaaatgtaatacattctgcaattgcatacaatagttttttgcagaacttatattaaatttgtagaaacttattcaaaaagtattccaaaatgatacattcaagaaatagaagacttagagttaatgaatctatcagaagtctggtaagagaaaatgtgcttacaactgatgattttgtaatgccgatcttcgtaatggagggcgaaaacaagcaggaggcaatcccgtctatgccgggaattttcaggcgcagtatcgatttaacagtgaaggaatgtaaggaattattttctttgggagtaaaagctgtcaatttgtacatgaaagtatcagaacatctgaaagacaatacaggaaaagaagcgtggaacaaagacggattgatgcagaagaccatcaaggctatcaaagatgccgttcccggaatgattgttatgccagatgtagctttggatccttactcgatctacggacatgacggaatcattgagaacggaaaagtgctgaatgacgctaccaatgacgcgctggcaagaatgtcagtatctcatgcagaagcaggagccgatcttgtagcgccaagtgatatgatggatggaagggtacaggttatccgtgaagcattggaagaaagcggatttacagacgtagggattgtaagttatgctgccaaatatgcaagctctttttatgggcctttcagaagtgctttggatagtgctccgaaggacaacatggaaattccgaaagataagaaaacctatcagatggatttccacaatacccgtgaagcattgaatgaggtatttaaagatatagacgaaggagcggatgttatcatgatcaagccgggactgccttatctggatattgtttccaaagtacgtgaagccattgatcttccgatcgcagtatacaatgtaagtggtgaatatgctatggtaaaagcagctgcccaaaacggctggctggataatgacaaaacaatcattgaaagcttaacatgcttcaaaagagcaggcgcagatatgatctttacttattttgcaaaagaagcggcgatcttattaaataaataagatgatattcattcaaataaaaatccggctgttctgatcagaacagccggattttccattattaattagttcattattttttataaccaaccctttctgccatacacatatgtgtcatcgaattgtttatcactcataaagagatataaaataccttcaataaaagggataatagaggcagctccaaaagtgacaacgttaaggaccagctgaataatagcttctttcttatagcccagataaaatttatttaaagccagccagccaacaaggattcccaataaggcagcagggattttcttttctgaacgataagggacaccgctttgctggttctgtacattttctgtttttgtgtaaccgtaattttccattgcctagtattttgtaattgattgatatgttttacaataagtagtttaaaatgataaaaagttacaagaagcaaaagagtggaaagccaaaattgcaaattcatttaattccccttttgctatttaccttttcgcctttttgctttttcgcctatctgcgagtttatatttttgatatatttgccctatgattttacgaggagaaaacttaatcaaggaatacggtcctaaaaaagttgtaaaaggagtttctgtacaggttcaacagggagaaattgttggtttgctgggtcccaacggagcaggaaaaaccacatcgttttatatgatcgtagggttggttaagcctacttcagggaaaatttttctggataagcaggagatcactaccgatgcaatgtaccgtagagctcaaaagggaatcgggtaccttgctcaggaagcttccgttttcagaaaattgtctgtggaggaaaatattatgggagtattgcagctgaccaagctttcaaaacgtgagcagcagatcaaatgtgatgaacttattgaagagttttctttacagcatgtccgtaaaaacagaggagatcttctttccggaggggaaagacgtagaacagaaattgcacgctgtcttgctacaagtccgaactttatccttttggatgagccttttgccggggtagaccctattgcggttgaagatatccagaaaattgtaagaagccttgttgataaaaacatcggaattctgattactgaccacaatgtacagcagactctggcaattaccaataaaacgtacattatgtttgaaggaaagatccttaaagaaggacttcctgaagaccttgcgaacgatccgcaggtacgagaagcttatctgggtgagaacttcgtgtatcagagtattttagataagcctaaaaagaaaaaatatgcctataacatctgggcaggaaactttgattcaaaagcacagctgcagggatttgtggatgaaaattttaaacattttgatgacctgagactcatgtatggcttcgaggatatcagttttgcttcattagccaactctgaaattgaacatatctttaatgatatcgtagataaaaatgccaataactcctttgttttccagaaaaaagaaatcaacagccaatattctttagaacaggcagaagcagagtctaaagaagccagcagaaaagaactgcactaccttacgacttatatgtatgaaggataaaatataaagcatttatttgctgaacatgataataaaacgtacctttttcttttgaaagcggtacgtttttcatttaaaatgatttctatggctaaaccttttaacagaaccgttaccttaatcggaatttataaacagcttgtcccgttcatcagaccttaccgattaatgatctacggaaccctgtttcttacatttctcggggctctggcagcacaggttaacccgatagttttgaaatacacggtagatgaggttaccgaacttacccatcttccacacccgatgtcagaagggattcatattcttatcattatttccgttattttattgggaaaggaactcttaaacatttttatcaacttcggacagaaattttatggggaaaagatcaggatcaatgtcagttctgtattggcacaatcagcaattgataaaatcttgacctacagagttgcctattttaatgacgaaaaccacgaatccggaaagttacagatcaggatagaccgtggaatagaaagcctgacaagactggtgcagaattttttcattgatatcttaccattattttccaatgcaatcatagcactgattattatgtatatgcagaatgtgtatgtggggcttgtctccactattattgttccaatctacttttatattagttctctgcaggctaaaaaactgagcggggtccgtcgccagcttagaaatcaaagagaaagaaaaacgtcaggacttctgaacctgatcaattcgattatggtgattaaaagttttgtccgtgaaaaatttgaaggaaagaaacaatatgatcttcagatggaactcatggaaagccagatggtgactagaagaaccaactttatttatgatggtttaaaaacctttattgagcagttcggtgtggttttgattatccttttaaccgtttatctggttcttgatcagcaaatgactattggtgcgatcatgcttcatattatgcttttcaacaacgtttctgcaccgatccgccagcttcacaggatttatgatgatatgaatgatgccatgatttatgccgaagggtatttcgatattttaaatgctgatgaagaaactgaaccgaacggaaattttgtagaaagagaaatcaaaggaacttttgaattaaagaatgttgattttacctatcccaacggtacaaaggctttacataatgtttccatgaaaattgaaaacgggaaaacaacagctttggtaggactgagtggtgcgggaaaatcaacagtcatcaatcttttatgcaaattttaccttcccgattccggagaaattcttttggatggtgtaaaccttaatgaatatgataatacttttctgagaagtgatcttggattggttcttcagaaaaatcatattttccagggaagtattgaagataatatccggtacggagatatgaatgcaagttttgaagaaattcaggaggccgcaaaaaaagcttatctgcatgagcagattatggatcttcccgaaaagtatcagcatgatgccacgcagctttcagggggacagcagcagagaattgccattgccaggctgttccttaaaaatcctccgatcatctttctggatgaaccgacagccagcctggacgccattgctacggaacagatcaaaaactctctggatgccataaaagaaggaagaacagtgatcattatttcccattccctgtcacagattctggattctgatatcatttatgtaatgaaaaaaggaagagtggtagagaacggaactcatgatgaactctacaataaagaaggtacttaccgtgaaatttttgatgcctccgcccgcagccttaatctcgataaactggtgaatacttttaaagaaaattaaataaaaaactcagccttaccgctgagtttttacattttttagaattatttactgagctttttcagaaacctgatatgctccaacatcagctccgaaggcaatattgattctgttgtaactgttaattgcaataacagccatggttaaatctaccatttccgtttcggaaaagtaatgacttacctttgcatacatttcatcacttacttctttaccatttaaagccgttaaagtttctgcccataataacccggctttttctttatcagtataaaaggggcattctctccaggcgcttaccagaaatattctctgttccgtttctcctttcgctcttaattctttggaatgcatatccaggcaaaaagcacagccgttcatttgggaaaccctgaaatacatcagttccagaaatgaattgtccagtgaagagttctgtacctgaaatcccatgttgtgaagggcatttacagctttgtttcctatcgcaaatgcgttgattctttgtgacataatatttgtttttgattaattatgtgacaaatgtagaactgtattttcctgaatttttttacaaatgataaataatatgaagaaagaagtttgaagctagaagttactattaggcagattatatatattcggtcttcaataacttccctcttcctgcctccagctttctttcctctaaaacttctgtgccctgattctgcttaaggaaacctgggtaatgccaatataatctgcaagatctccaaggctgatgcgttgaataaggtcaggtctttgcttcataaaattatggtagcgtttttttccgtcatcttccagcatctcgctgattcttcccatcatattgaccggagcctttgaatatagtttgctgaacagtgtttctgctgtgtgatactttttacacaatccttcaactacgtctctatgcacacgaagaacttcagtaggttccagagctacaatcatatattttgacggctgtcccgtaagaaaaccacttagttcagcgaagaacgcattttctgcaaaaaatgtcatgatgaaatctttatcaccattatcaaaaaacagttttactaatcctttttcaataaaatagaaatatctgcaggtttcatcagctttgagcagaaaatctcccttcctgtacgttttagtttcaagatgagaaacaagttcgtccatgactgtctgttccggtttcaaaattttttctatagactgaacaaaatgagtatgaagcataaagaaagtatctgtttttgcaataaataaatttaataaaaaaccagtcacatttataagtatacctcaaaaaagaattttagctttgttacataatgaacgatcactatcttaaaaaacttgatcgggtaacggctatccttacccagttacagtcgaaacctgttgtacgcgcacaggatctggctgaaaagttcgatgtaagtataagaaccatttatcgcgatgtgaaaaccctggaaaatgcaggcattcctattgttggagaagccggcaacggatattctttaatggagggttataagcttcctccgattatgtttaccaaagaagaggtcttaagttttattactgccgaaaagctgatgcagaaattttcccatcagagcctaggtactcattatcaggccgccatggagaaagtacggtcggtattgaaatattctgataaaaatctgatcaaaaatatagaaaagcagattgatgttttcagctttcatacagattcgggcgactcactgaaaaatgtgattcctattattcttgaaagtatcgcagagaaaacgcagctgattataaaatatcagacggtagacggaagggtgaaccatagaactattgaaaccgtcgggatgttttttgaatttaatttctggtacatcatggcgttctgtactttaaggaaagatttcagacagtttcgtattgaccgtatccttgaaatttcaaaaacgcagaatacttttttacaggaatatggacaggtaaatgattaccgcaaaaaatcaaatggaaataaagaaagagctaaacttctggtagataaaaaggtcatgtctcacctggtgaattctaagaaatattacggactcatagaagaagtagaaaccgaacaagggatggaacttacttttgaaacagaatggatcagtgacggtttcccccgctggctcattacttttgcagattatgctactgttcttgagccggaaagtcttcgcacaagattgaatgaactgctgagaaaaatgacagaaagacatcagtaaaaccccaacagatagctgttgaggtttaaagacttaattgaggcaataaatgaaatagcttgaagcgaaaaggcaaaattgcaaataagcagatctgttgtgtcgctaaaaatgatagtagttggtataagttgaagaaaacacaattaataaaatatgcagattttcttacaattaaggctttttgcaattttaccttttcacttttattagaatctttcccagaagaatggcggttcaatacctaaagctcttaggtaaacatatccctgaccgcggtggtggatttcattgtcaatgaaataaagaatattttcatacaccgggaattcatattgtccgaaaaggttgaatacttcctggaaacgctcttcagaaatctgattgaaatagtgattgatcacttctgtttcttcatcccatttttttaacagctcttctttagaagtaggattgaagccttcttcattataaccttccatatttccttcaatgattccttttaaagctggacctgcaatgctgatcatctcagtggcaagttttgcaaaaggtctcatccctccgacagaaaattcaaataattctttttcaggaaaagcttcgattactcttcttgtaagatttctgtgtccctgccagtcttttaataactgatctgtggtcataaattgcttagtggctgtggctgtagttgtcataatattattgttttttgtttgttgttgatacaaaggtaagatggagtaatgacaacagtttgtcaataggatttcagggattaaaaaaatatttttttctttgctaaaaatatcctggcctacttttccgttaaaaagaaaggatattaataaagaaattgctattattagaattatgaagacgtatattttgcctgctatcaccacttttttattagtatcatgcaataagattgaggagaaaatagaccagactgttcagaaaacaaccgaaaccgtacagcagaaagcacagcaggctgtagaagaaacagtgaaaaagacagtcaatgaatctgtgaattctctaattaattccgaagacgttaagtttaatactgtttttccgggtgcaggagcagacattatttccgaagagaaaggaaaaaagatcaaaattccgggaagaccggaaggttatatctttaaatacaaagcggatattgctgttttgctgccgtttttagaagcgcagcccacttctgatgaaagtaaatctgataaaactgcccgtaagattgacggacaaagtattatagataaaataagctttctgtcaaaattcctgcctgacaatacctttgatgccaaaattcttgaagatattaagtccgataaaaacatccggtattataagctgaaaagatttcctaacagtagtaccattatctacaacccaaaaaatcagaccatcatacaatacgtagaggtaaataaataatttggatatggccggtttctcccggccattttttattcccattcattgcagaccataagcgaagcaacctcagcccgttgaaaattacttatcagaacaagtaaaatcatatttatttctgatgttaagtaattgatttttttatacaaataagatgatattgatttattttttttcatgttattactaaatcacttgatgttttgtggattaattatttttttaacgaaatggtatgattttagcaaatatgaaatggaattattatcatatattttatttttatgattaatgttgatttttttattagatttattgaatacttaataatcaacatgaaaaagaatttatttaatggtaaaatttatgcattagtattaagcggagctggtgctatgggatatgctcaggacagcataaaacaaaataaaatagatgaggttgtggttaccacgggtagaaccaagccaagaaccatcattatctcagctattcctatagataatatttctgctgtacaattaaaatctacaggacaaactacttttgacaaagctttaacctatgctgttccctcttttaattcatctcaacaaactgtttctgacgctacggctcattttgacccggcagacttaagagggttagggccttccagaacattagttttagtgaataataaaagaaaaaatcaaagtgctcttatttatgtaaacgatacgccgggaaaaggtgaagtaggtacagatctgaaaagtattccttcagcagctttacaaaacgtagaggtcttgagggatggagcatctgcgcaatacggatctgatgctattgcaggcgtaatcaatattattcttaagaacagtgttggaaaaagcacggtcaatcttttttcagggattacttcaaaaggagatgggtttaatatcggagcagattttaatacaggaatcagggtagcaaaaaacggaagcctgaatcttacattaggtttttcatcccaaaataaaacaaaccgcgcaggttctgttaccaaagatgaactttttggagtggataatgcctggacgcaggctaatcccggtttagggatgatcattgggcagccggagacaagagtcgccaatatgtttgtaaattttgaattgccaaccagtgaaacgggtaaattttatgcttttggtggtacaacctacagaaatgggaccagttacggtttgtatagaacaccctattgggtaacttccgattttggtttgttaacaccaaaaggacagccttacaatggatttcagccggaatttaaaacagatgtatatgattataatttaacttccggatggaaaggtatgtttggaaaatggagttttgacggaagtgcaacatttggttctaatgcagtagattatgtggtaggaaataccattaatgtatctttgggagcaaattcaccaacccgttttaaagcaggcggccatcagttcagtaatattatagggaatatagatatcagccgggattttggctcgtttgttttaggtgccggagctgaagtgcgcaacgaaaactatcaggcgaaagcaggagaagaagcatcttacataggaagtggtgcggaatcatttccgggactgcagcctcagaatgaagtcaataaaaaccgtcagaatatcggggcttatataaatgctgaatgggatgttaccaaaaacctcttgcttggaggaactgtgagatatgaaaacttcagtgattttggaaataatgtttcctggaaaggaaatgcaagatataaattgctggatgataagttagttttccgtggatctgtttccacagggttccgagctccttcattacaccagatttactattccaatgttcagaccaaaattaccgggaatacggtagctaatcagggtacctttaataatgactcccaaattataagatctgatcttggtgtaccaaaattaaatgctgaaaaagcctttaatattaccggaggattagctgtaaaaccttttaaaaacctaactattacagcagattattatagaataaaaattaaagaccgggtgcttttttcgggagatatcggttacaaaaccggtgctccggggagtccggatctgaccaatcctgtggaagtcatattgaataataataaaataacttcccttaagttttttaccaatgctgtaaatacagttactcaggggatagatttcgttgccaattattatacttctgctattggtaaaggaagattaggaattattgctgctttcaattataacgaaactaaaatagtagataatattgccgttccgcctattttggctcaaaatggttactcagaaaacttttttgacagaaaggaacaatccagaattatctctgcaagaccaaaaacaaaaaccatcctcagtctttcatatgatatttcaaagtttaattttaatcttaataatacttactttggttctgttacctggcagcacgctactgatcctgccaaagatcagacgttttccggtaaggtaattacagacatagttttaacttataaaatcacgaatgattttaaagtttcaggagttgtaaacaatttatttaatatatatccggatgtaatagacagcaaaggggatgtagtaacagatttgggaggaaggttcagatatccatgggaagtaaaccagtttgggtttaatggaaccacttttcagctcaatgtcaattatactttttaatctgaaagaaaaagtaactcaaaagacataaaacctgcctatgcaaatattaactgacattaatttctaatgtcagttttatttttttcagatcggatagggatctattactacattttactttttacattgtataaaaaaaggtattttagtcctatgaaaatttatacaaagacaggagataaaggtcagactgcattgtacggcggaacaagagtttccaaagccagtgcaagagtagacagttatggaaatatagatgagctgaattcattcattggaatagcaaaaagtcatattgaagatgaagaagtgctgagacaactgaaaaagatccagtttgatttgtttacagtaggctcagaagcagcaacgcctgtggataagctgatgttggccaacggaaaatcacgccttccgatcatcatttcagaaacagaaattgaagaacttgaacaatggatggacgccttcgatgaaaagctggaaccgcttcagtattttattcttcccggaggaggaaaatctgccacttttttacatgcagcaagaacaatctgcagaagagcggaacgttcattggttttcctgaatgaatctgaagaagtacgtcctgaattgatcaaatatttaaacagactttcagattatcttttcgtgttggctagatatatctcaaaacttaacaacgaaccggaagaatactggaacccgaatgaaagataaagcattacttttcatcaacggagatgctccaaaatcattacccgatcttaataattatggattgatagcctgtacagacggtgcttttcactatttgaaaagaatgggatttcccatggacagactggattttatatccggggattttgactcgcattccggttctgatgaaaatatttatgacgaaaaatttatccacactccggatcagaatcaaacggatttttataaagctttggatataatccttgaaagaggcggaaataaagttgatgtttttggtggaagcgggggagaacaggaccattttctgggaaaccttacagttgcctacgcattcaaagatcgtatggaacttaaattttatgatgaatattcagaatattattttatccccaaaagctttaaagtagaaggagtacaaaataaaatgatttctttatatccctttcctgtagcagaaaatattgtaacaaaaggcttaaactggccgttaaaaaatgaaaatttatccattatttcaaggattggaacccggaatttcgccgttgaagacgaagttgttatcggatatgaaaaaggagatctgttgatttttataggaacggattatttataatttactgcaatctatcaactggctttagccaaaatttaacatttgaatacattcatcagaatatcagtttttactatttcattatgctgcattttatcctgtaaaacacagcattttgaaactccggaatatggaaaaaatgaaactgaaaaagtaattcaccttaagaaagtaaccaatttccggactgtaggaaatatcaaaaatacggaaggaagaacattaaaagaaggaaggttttacaggagtgcccatcttcataagcttaaaaagagatcttttgaccgttttgatgaattgggaatcagagaaattattgatctcaggaattcaaaggaaatcgctcagaaacctgatcagattcctgcagaaaacacatataagaaatattcagcgtttgaagatgaaggcgatcagctgtcccaggcaaaaaaactggtccttaaaggtaaagtgaacgcgtctggtgcggataagaggatgatcgatttttaccgtgaatatgttacggaaaatcccgaaaccataaaaacgattattaccgaagtgttggagtccaaagcccctgttctttaccactgtactgccggtaaggacagaaccgggattattacagcgttgatccttaccattttgaaatttgataaagaaaccatttacaacgattatcttttatccaacaactacagaaaagaccttgttcagaaaagactccgccttgccaacaggttacatttcctctatccgaagatggatttacaggtactggaaaagctgagttgggttgaaaaaagataccttgatgctgcttttgaagagatcaataaaaagtatggttctgcagatgcttatattcagcaggtattggggatttcagataccaaaagaaatgaatatattcataagtttacctattgattatcaggagcaaatttttctgagattcaatatcaggtgttaatttaaaattataataattttaacacctaaaaatgaaacttttttagcaattttgcatttcttaattcacttgtttagaaatgaaaataaagtactcggaacttattgatcagacattatattttcctacggaggaatttaatgtttctgagaacaatttgttgtttcacgatattccgttgatggatgtggttgaacaatttggcaccccgctaaagattagctacctgccgagaatttctcaaaatattcagaaagcgaaaggctggtttaaagaagcttttgagaaaaccgaatataaaaagaattatacctactgttactgtacaaaatccagtcatttcaatttcgtattggaagaagccctgaagaatgatatttcaatagaaacatcatctgcttacgatatggatattgtaaaatctctttatgagaaaggtaaggtagataagaatattgaagtgatctgtaatggttttaaaactgatgattatctggctaaaatctcagatatgatcaatagcggatttgaaaatattactccgattcttgataattacagagagctggataagcttacggaaagtattgattccacttttgatatcggaatcagaattgcatcggaggaagaaccgaagttcgaattctatacttcaagattaggaatcgggtataaagatattattccatattacagccagaaaattgcagaacacccgaatgcaagactgaaaatgcttcatttctttatcaacacagggattaaggatacagcgtattactggaacgaattgtataaatgtcttcgtgtatatgcacgtctgaagaaaatcgctccggaagtggattcactgaacattggaggaggtttcccgatcaaaacttctttgaatttcgattacgattatcagtacatggtggaagaaatcgtttcccagatcaagaaattctgtgaagaagaaggagtagaggaacctaatatttatactgagttcggaagctttaccgtaggggaaagcggggccaacctttataaaatcatttctcagaaacgtcagaacgacagagaaaaatggaatatgattgattcttctttcatgaccactcttcctgatacatgggccatttcaagacacttcatcatgcttccgcttaaccgttgggaagatacttatgaaagagtgttccttggagggctgacttgtgattcggacgattattataattctgaacagcataccaatgcgatttatttacctgttttcagtgatacaaaacctctgtatatcggattcttccataccggagcttaccaggaaacaatcggaggatatggcggagttcaccattgcctgatgcctcagccaagacacgtcctgattcagaaagatgaaaacggtgaattgcaatatgagattttccgtgagaaacaggaaccggaagatgtattgaagcttcttggatataaataattttatgagccacagaaatgggctttagcccgtttacaatcaataaaaaagtcaattggctttagccaaaacttatacaaaacaaaagctctcagatttttctgagagctttttatttaaaaatattttgaaattttatccagttctaattcttcataatcagaaactactgtgtctgccaaagtgtaatcctgattttttgaatgtgggcttctataagctgcacaaaagatttttgcacggtgtgcagcaagaattccattggtagaatcttcaatcaccatacagtttttaacaggttctccagccatttcagcggccagaagaaaaacttcaggatgaggttttgattcctttaaatcggcgccgctgattttcccgctaaaataaggttccaacccgaatttctcaaaaaccatattgatcgttaccattgtagcagaagacgccagaataagttttatcccattctcatgataatgctcgatcagttttcttactccgggaattaaatcaaattcctcatcattgtaaaaataatccttgaaatgagatcttttgattcctgcgattgtttcgtaagtctgatctaaattaaattcattaatcaaagtttcagaaactcttttggtagaagctccggtaaaagaggtatacagttcttcagaaactgctatttccagttcgtcaaatgttttgaaataggcttttctatgcaatggttctgtgtctactatgacaccatccatatcgaagagaacagcttttaaaggcatatcaggagttttatacaaaaataacttttaaaatttaaacagtaaaggatttaaaattgaaaagtcaggataaggttaaaaattcataacaaaccgttcatcacttataactcaggtactattttgtatctttgtggaatcatttaatctttcaatcatttaattttttaattaataattatatatgaaaacatacgcaggaattcccgaggaaaatgcaacgctagagaattcgaaagtaatgttggtaactgttccttacgatggaacttcaacatggggaaaaggagctgataaaggtcctgaattattcttaaatgcttctgaaaatatggagctttacgatatcgaaacacaaacagagccttaccttcagggagtttacttagcaggagaagtgtctgaaaattcttccccggaagcaatgacggaagccgtttatcagaaaaccaaagagcttttgaacaatgaaggtaaattatttactctttttggtggggaacactctgtttctatcggttctattcgtgcggtaggagaaaaatttgaaaatttaactgttctgcaattagatgctcacacagatttacgtcctgagtttcacggttctacttcaaaccatgcctgtgcggtttttgaagctaaccaaaaacataacttagtacaggtgggaatccgttctatggatgctgaagaagcacaatatttgccggaaggaagagtattctttgctcacgaaattgctaacaatgagaactggatcaatgatgtactggagaaagtatcaggaaatgtttatatcacgattgatttagatgcttttgatccttccatcgctccttctacgggaactcctgagcctggtggattacaatggtatccaacgttggaattattaagaaaagtatttgaaaaatgtaacgtagtagcgtttgatattgtggagttaatggattctccaatggctaagccaactgctttcttatctgcgaagttatattacaaaatgcttgcttattacgatatttataacaacaactaatattccgcaagaatcggattttttctgccgtatattctttggaaatttgtgaggtaaaatcataatacaatgtccacacaaagtcagatagattataacagaattgccaaagcgatagaatatatccggagcaatttcaggcttcagccaagtttggaggaagtggcagagaatattcacttaagtccggctcatttccagaagatctttacagattgggcaggaacaagtccgaaaaaatttttacagttcatcagtcttgaacatgctaagaatttattgaaggaagaaaaagcaagtttgtttgataccgcctatgagacaggactttcaagcaccagcaggcttcatgacctgtttgtgaagatagaaggaatgtctccggcagaatataaaaacggaggaaaaagcctcaatattcattacagtttttccgaaagccctttcgggaatatattagtagcttctacagaaaaaggaatctgctatatggcttttgaagacgataaagaaaaagcattcggggaactgaagcaaaagttccctaatgcttcttttattgagcagcaggatgctcttcagaagaatgcactgtccatattcgataaagactggacaaaactcaatactataaaattacacttaaaaggaaccgattttcaactgaaggtatgggaaagcttattgacgattcctatgggtaaactgtcaacctatggaagcctggctgaaaaaataggaaatcctaaagcatccagagcagtaggaacagctattggaagtaacccggttgcctttctgataccttgccaccgcgtgattcagtctaccggacatctcggtggatatcgttggggaagtgaaagaaaacagcttattgtaggctgggaaggatcgcatatttattcctgaaataaaaacatgttagtaagtttcggctaaagccgatggattaactttcattttattaaacggactaaagtccgcttctattgatataaaaattagtgtcattagtgaaaatattgatgtaatttgtgtttaaataaaagccataaatatattttacattctaccttttacaaaatacagcatttaaataaaaaaaccgatgatgagtctttttgaagaaatatccgattatccactcaatatccttccacacgatggaaccgttcattactacggcaaagttttctcaaaagaacaatctgatttttattatgattatctgctcaatcagattccatgggagaatgatgaggctgtaatatttggaaaactgattttaaccaaaagaaaagtagcctggtttggagagaaagcatttgaatatacgtattcgaaaagaacaaaatatgccagattctggactcccgaattactggaactgaagaaaaaatgtgaagaagtttctggcgaaacctacaattcttgcctgcttaatctataccatgacggaagtgaaggcatggcttatcacagcgatggtgaaacagaccttaagaaacatggagccattgcttctttgacctttggagcagaaagaaagtttttatttaaaaataaaacaaccaaagaaaaagttgaaatatttcttgaaaacggaagtttattaattatgaaaggaactacacaggatcactggcttcacaggcttccacccactacaaaagtgaaaactcccagagtaaacctgaccttcagaaccattgaagactagtttttaagagaaattttatccataacgtttgtcactccgaagaagtcccaatgatgttttatctaatggaaagccgtttacccagactttggaggattacgcttatcatatccatcaatagaagcgggctttagcccacctggacaaaagaaccaattcatccggctttagccaaaacctaaaataaaacttcagatcttcaaaaaataaaaagctgttcagacgaacagctttttcaatttattttaaaacatcagcttcaatggagctgtcattatacactttgatgaatgctttggtataatcttctttattggcaaaattcggattatccataaacttctgcgggttgaccgcgaaaagcgggaaccatgtactgctgatctgaatctggattttatgtccttttttgaacgtatgaaccacatcctgaagtctgaagttaacagccgttttctgattaggaaccagcgcttctcccttttctttcgtatttctgaaccttgcaggcataatttcacttcttaccatctgatgatagtttccgtagataacgccttctttcttttctgcaggtttgaaatcttccggatatacatcaatcagttttactgcaaaatcggcatctgtagaagtggaagcaatattcagtttagccataatctctccggcaaatgtaatatcatcagtcaatacatcggtagtgaatgttaatacatcaggtcttcccacagcaaatctctggtcttccgacatataatttctcggagtgaaaccattgaaatcttttaaatgatcagagcttaaaacaggattgtttggatcactgtaatattcggaataaccttgtcctgatgatttttttaaggtgttatccgctagatagaaattcactttctgagcattttttggagggtaagaagcaaattctttccattctttagcaccggtgtcatacatcagcgcttcgggaagtcctgcatcttctttagtattgcctttcagataatggttgaagaattttgtttcaatatttttctgataataggttgcaatactatctccaaaataggtttcactgtgaaaatgttttccctgctcctgagaccagccgccatgggaaaatggtcccattacgatggtgtttttggctttagggcttgttttttcgatggttttataaatattcagcgggcccgaaagatcttctgcatcaaaccatccaccaacagtcattacagcatgattgatattttttaaatgaggaagaagacctcttttctgccagaattcatcatagttggtatgattcataatttctgtcatgaagaagttattcttataatacttttcatatccgtctttcagggtacccatatctctgtagaattttaatccgtcctcagaagtttgcttgatgaaagaatccatataccatgcctgcttttcaggttgtgtcttctgaataccgaaaacaggaaatgttctgaaatagcccagcataaatcttccgttgtgaagaaaatcgtcattccagaaatcagaaataggtgcctgtggagaagaagctaccaaagccggatgctgtgacaaagttcctacagcagtataaaatccgggatatgatgtcccaaactgacctaccttaccgttgttatctttcacatttttcaaaagccattcgatggtatcataggtatcagtactttcatcaacatcttttttggttttacgttctacctgcggcgtcatattggtaaatgtaccttcactcatatatcttccgcgtacatcctggtacacaaaaatatacttgtctttcataagataggtgttagggcctacctttgttttatattcactttctccgtaaggagcaatgctgtagcaggttctctgcatcagaaaaggatatttgttcttgttggatatatctttcgggatatacacggctgtgaaaagtttcacgccatcacgcatcggaatataaaattctttcttggtgaaattgtctttaacgaaagtatctttctgttccgttttctgagcttttccaagaatgaaaaaaagaatacataatactgaaatatggattttcataaaaaaaatttgctgctaatttaaaaataaaaacagttttattcgtaaatcttgtttaaaaggttgctgtaagaaccaccccgtcaaaaattctttgaattttcaccacccatccaaaagaggggaatattacgtcttcaggtgtaatgaaattaagtttattcatagaaatagccgggaaatatccggccattatctaaaactatttataaaagtgtattattgctttattgcgtcttttttcctgcaaacttattcagtttcatgctgatggagaacatgatgtaccgtttcaggataaggtcttcacggtcttcaaaataagaatcagtgatggttcttctcacgctctgattttgatttaaaacatcatagattttcacttttgcggtaaactgctttttatagaatgaatatcccagactggtattccagaagtagaaatcctttttaaatcccggtgcaatattggaattggtattgtattcaaaatcatttccaaataccaatctcccttgcagcatataattggtcagctccagctttaaggattgattggctgtatttacatttgtcacattataattggtataatttgaaaaactgtatccaagtctgtaagaaggcttaatggtcattttatccttgatttcataggtgaaattaagtcccggattaagactgtatgagttgctggtaaaagcctgtccgtctataaaaccattattgtaagcatacaccatgctgaatcttgggttgatggtaagcttgttgtttttccacttcagggttttgctgaaacctccgcctgcgttgatgtttttatttccgcttacattgctgtaagtaatcacttgctttcctgtattatcataggtggaaaaattgatgatgtcattatttctgtacgtaaaaccaatattgaaatagtaactgaggtcttttaccttattataattattgaaatacaaataaagattgttgatccatgtatttttcagatcagggtttccctgataggtaatcaatggatttgactcatctttgtaaggagtaagctgctctgctgtaggaatattgaagttggagtagttgtaaacactcagatattttccttctcccatctggtagttaagatttacattatactggggcagtacaaaatttttctgcatatcatattgctgcccgttataaatagagtttactttcatgtctgagatatcaagattcatggacgcccagaaattcagtttctttttattaagctggtaggtaaactcaggagagatctgattgattctttgcttcatattgttggataaaagctgattgaatttagtgtaatctccggttatattatcaaagtcatttacatttctcaaatttctggcagacctggtttcatactttacttcaaaacttacacttgaagaatcggaaactggttctgtatatccggcagtgaaattaaaactgttgttctgatttttatttctggctaactgatccctgttgtctacggttggtccactgggttgatagaacgtgttttgagactggttcaggttatctcttttcgattcagagatggaactgctcatattcgctgaaatcgaacggccttttttcctgaattttcttgaaaaatagagataaggattaaatgaattactttccgaatcattacttgaatacgtattgctttcattcagaaggttcccgttatttaaagttgatgagcgtgaattattaaaattaaaactgctgttttttgtgaatcttggagaaagatagatgctggtcatggaatccagtttaattttggctgaagtatcaaaactgtattgcctggattcattttctccattactttcagaattggtctgaagcgtataattggggagaagggtagaccttgaaactttggatcttgtttccatattggaatcggaatgcatcagactgaaggaatcaagatcagcatctttccccaatttgtcactataatttaacccaatggttgttgacctttgaattccttttgtactgcctccctgggtgtaataagtcatatttcctaccgttgagacagttcctccctgcatcatccaggcattccgtccgttacccatactgtcaaaaacctcatctctggaaaatccttgtgaattgatgttattggaagaagctaacagacttatttttgtatctcctttaaaatagctggccagcccgcttgcttcatatcgcttgtcggagccgtagccaacagtaagcctggtcagcaaacctttatttttcttttcgtcaatcgtaaagttgatggtggtattctgcgatttggctgtttttccgctgagttcttcctcctttgttttggtagtggtaaactgaatatttttgatgatatctgccggtaagttctgaagggcaattttaccatctttatcaaagaagggtttaccattaatcatgatttggtctacatcttttccattcaccgtaatttttccctcattactgatttctacaccaggaatctgcttcagaagctcttctattttgctgtcaggtcttactttaatggcagcagcattgaactcaattgtatcttttttaatttttacgggagatacggtgatctttacctcatcaatagcatttaccagactttgtttttccagctggatatctcccaaggctaacgactgttctattttttcaaattttttggtgtaagaagataacttttcagcatcaattttaagaatagaaggttcttttacatcatcaattttcagagagaattttccctctttattggtagcggtgtaattaacgatagatgaatcttttacttttaaaaggtagacggtcgcattttctatcggtttcttttcagaatctgatacttttccgtcaatgtgtagtttttgggcgtgcagtataatgactgtgaacatcaaagtcaatagcaacagagttttcttcattagtttttttttcagagccgtaaaaatataaaaacatcccagttttgggatgtttctatgcgttttttgtgaaattttattattttttaataaaaattatgctcttaaatatcttgaataagcatatccttcctgaccgtctgcagttttcactttccaccagtcatcagaagtctgctcaataagcgttacagatgatccttttgaagctttacctactacggcagcttcagtagaaggctcctgtctgatattaaggttagactcttccgtagctactgttaaagaagctcctgaagcaagacctgcaacctgaacatcaatattgatatctgaagcagaataagtagaatcgatagctcccagagcattccatacagcatctttagccgcagtattggatgcatttccggaaacgtatagaattccgtcctgctcctgaacctgaagattagaaatccctgcagactgtgctgccgaaactacgcttgaatatttatcttgtaattcgctcatctttaattattttacgattagattgttgttatactttccgattttcaaagcatctacagattctttgatttttcttgcttgtaaggcagaaacatttcctgtaagggtaagctgtccgtttacaacttctacttttacagaagggaaatcttttaccgcatcctgaacttttttctgaacagcaggatctacagcagatgctgtttcaaccggtgctgcaggtgcaggagctgctaccgtagacatatccattacgtcttttactccgttgattgctttcagttttgcaatcatcgcgtctttagactgctgatctgcgaaagtaccgcttaagtgtgccacaccttcttttacttcaacagaagcattgggattagaagttactatagttgtagcctgagtctgaagatcggcatcagaaactttctttttacaagaaatagcaccgaaagatacagctacagctaatgcagccattgcaatagtttttttcatattgtatatttattttaatgttgttatacactcaaatgtaataataaaatttgtaccaaaagaataaaaattcaataaatgtttcttaatttttttacaatattttcgaaaccaggtttttaattttcattgattaaaaacttaatgtaaaattcacctctattgaagaaaatcttctgccaattgaaaaaccattatatttgcgcaaattgaactatatatatgaaaggacagaataaactttttatagcaattatcattgcactacttctgggagtaggaattggaggtgtggtacacgtaaactatccggatagtgcagaacccttttctaaaaatataaaactgctgggaacagtttttatcagattggtacagatgattattgcaccattggtttttacaacattggtagtgggtattgcgaaaatgagtgatatcaaaatgatcggaagagtaggaacaaaagcaatgctttggtttatttccgcttctctggtttctctttttatcgggttgatgcttgttaactggctggagccgggacatgtgacaaaactacctattcaggatgtggcttctgcagatgaacttcttaaaagcagcaaaagtttttccatggaagattttgtaaagcatatgatccctaaaagtttatttgaagcctttgccactaatgaagtattacagattgttgtatttgccgtgatgttcggcgttgcactggctaatttaggcgaagaatattcaaaacctgttgtaaaacttttcgatatcattgctcatgccatccttaaaatggttggatatatcatgtggtttgctccgcttggagtattgggagccattgcagcagtagtagccaccaacggttttgaaatctttaaagtatatgctatttatttaagagatttcttctttgcgatagctgttctttggctggttcttttactggtaggatatcttatcttaggaaaccgtctttttgatctattaaaaagaattaaagagcctttgttgattgctttctccactacaagttcagaagctgtatttccgaaattggtggaggaactggagaagttcggttgtaatagtagagtcgtatcattcatattacctttaggatattcattcaatctggacggaagtatgatgtatatgacgttcgcttccatctttattgctcagatttatggaatcgaaatgacgcttggacagcagatcacgatgcttttggtattgatgcttacttcaaaaggtattgcaggagttccgagagcttctctggtaatcattgtggcaacgtgttcaatgttcgggattccgccggaaggtattgctttgatcttaccaattgaccatttctgtgatatgggtagaagtatgaccaacgtgttaggaaatactttggcaacttcagcggtttcaaaatgggaaggacagttaactgagccattagacaaaatttaaaaacaattcatgagtttaaataacttagacaatcataaaagccatattcttgaatatggctttgctgttatcaataatgtgttttcaaagcaggaacttgaagaaatagatactgttctgcaaagtatagacacttcaaaagaaaatttcagaaaatctgaagatctgttcgccataagacagtttttaaaagaagttccggaaatcaaagacctgattttcaatgaaaatatcaggaaagtggtcaaggaaatattcggggaaaaatattttgtggtcaaaagtatttattttgacaaacctgagacttccaactggtacgtagcctatcatcaggatctgactatttctgtagataaaaagcttgaactccctggttttggcccatggacaaccaaacagaatcagtttgcggtacagcctccggtgaatgttctggaaaatatctataccatcagaatccacctggatgatactgatgaaaataacggagctttgaaagtggttccaaaatctcacgcaaaaggtatttacaggcctgaaaccatcgactggcctgtagaaacagaagaaatctgcaacgtagaaaaaggtgggattatgctgatgaaacctttaacgcttcatggttccaaccgaacgacgaacgcgaagaaaagaagagtcattcacatcgaattttctgatattgaacttccggaagtcctgcaatggtcggaaagaatgaattgataaataaacccttcttcaaaattctgaagaagggtttactttagcattaatcacaggaaatgacttcaccgtatgggtcatttatattctcgttatgataagataggaataacagggcttcttttgggttgggattccagaaggatgtcggtgtggagactttcatctttgttttcagtatatttccgatcatgctatccttacttccaaaagttgtaaaaggagtaatttcctgaatttttgatgtatcatctatttttactttatagatggcaaaaggttgcttaggtttgaatccactgatctttgataaatcagatctagattcagtttgggtttcatcatagcaacgggtaaactgtaaacccataaacctgaatttgtttttatctatgtaggtaaaagcctcggaaagatttttaagctgtaaattttcagcttttgtgggtttattttccagttttgattttggagtacaggatgaaatagaatacgtgttattgtatttatttaaaaagatcagatatctttcatcagggagtacattaatttcacaagctcccgaataggaatttccaatcaggccacttacattaattgttttgaatgcttttcccttataggttttttcaatttcaatatctgctttataggttctttgctcagtgttttcgtcatatactttcaaaattctgataatacctgcaaaatcagaattttgataattgtatgctaatgtttcatatacacatttacaggctgaaacgtttatgacacttaaaagtataaaagatagtattaataattttttcataattgcatttttatttcgcagaaatttcatcgataaaaatatacgcatcgcctccagctccctggtgccattccggaagttttccaaaatagtaagcttttactttgatatatcgggcttcagtagggagaattttagttgagaaatctttgatctggactttctcatctttaggatcaatatcattatcaatagttttcagaagaacaaaatcttttccgttcatagaagcataatattctacttttttaggcatcagaatccatgctctgctgtcctgaagataggtagaagacaagttggtgatctgctgaggtgatttaaaatcaataatggcttcaaaattttgtccctgatatccgtgccattcaccttttctccagttcacatctcctctgattccgtcaataagagcaagatttccggtagcactgtattgaggtgttacttttgacaggatattaatatcccaataattgggtcttctgttaaaataagcggttgtgacagaacttttctcaccgtttctttcagcataagccattacctgagtcgttttagtaatggagaacggccctttgtaagtgctgaaagtctttcttttattactgtcactttcgtccatcgtcatataatataccttgtcatttggattcagtggagtgatctcaactttggtagaaaaatcaaagattctgtcggcagcaattaccggtgaggctgtctgttctgtatattttaaatctttaacaggttttacgttttcgaaccctagtttcttaagttcagcacggcctgtagtttttgtaatcgtccttgtagtgccatcttcaagatgaattttaatttcgtcaaaataaggagtggtagtttcccattccggtaatcccggagttacagaataaattcccatggagcttaaaacatacaaggcactcatctgtccgcagtcttcatttccgataagcccgtcaggtgtgtttttataaaagttatcaaggatgtatttaattttagcatctgttttttcaggtttgtctacgaaattgtacagataagcaatatgatggctcggttcatttccctgagcatattgtcccatcaaccctgtaatgtctacctgttctcttcccgtggttttatcaggagctgtaaagatggcatcaatgaactgctcgaatttttctttccctccatgagctgcgataagccccggaatgtcctgctgtacggaataagagtaatgccatgagtttccttccgtataattgttgttgacttctctcggatcaaatggctcataccagtttccgttttttcttggctgcatgaaacctgttttcggattgtaaagatttttccagttctgagaacgtttcatgaaatactgataatcgtcttttttgcctaaaatttttgccatctgggcaatgcaccagtcatcataagcatattctacggttttggaaacactttcatgctcatcatcaatgctaatataattattctgtttataagcattcaaaccgaaaatatcctgcatggcagaaccttttgcagcctgaaatgccttctcgtaatcaaatccctgaattcctttagccatagcatctgcaatgacagaaacggagtggtagccaatcatacattctgtttcattggaagccagttcccataccggaagttttcctccctgctcgtattgtttaatgaaggtattgataaaatcagcagttctttttctgtcgattaaagtcattagcggatgagcgcctctgaaggtatcccaaagggaaaataccgtataataatcaaaaccattggcagtgtaaagtttgttatccctgcctctgtactttccgtcaacatccatattgatgttcggttgtgtgaaaacatgataaagagcagtataaaaaacagctaatttgtttttatcatcagactttacttcaatctttgaaagttctttgtcccagtcagattgagcctgtttttttaccgtatcgaaatctttcgtctgtccttctgccagcatattcttttctgctccttcataaccggttggggaaacagaaacctttacattaatcttttctccttttttaacattgactgaaaacgccagggcaagcttggttcctgtaaaaagattgttttcctgttttccgttaacttccttttttgaaattttcatcggctttgaaaattcaattctggcataaatatactggttggttgcccacgcttcacttcttctgaaaacctcaatagttttatcatcaatgatttttacctcaccttccaatagtttatctctgtggttaaggtccaggataatattggcatttcctgcattgttgaaagtatattcgtggtagccgactcttttggttgcagtaagacgaacatcaatattatttttatctaatctgacagcatagaatcctgccgttgctttttcatttttatgcgaaaattttgaagaatattctttactgttcagactgggatttcccatcgtaggcatcagcatgatatctccgtaatccgaaactccagttccgttcagatgggtatgagaaaaaccatagatcacagaatccgaataatgatatccgctgcatccgtcccaactgccgtcaattcttgtatcaggtgacaactgtaccatcccgaacggaacaatagcacccggaaaagtatggccatggcctccggtcccaataaacggattgacatattgagaataattctgtgcagaaataatctgggtaatccctatagaaaatgcaataagcgcttttttcatgtttttattttataaaaagcgaagatattgaaaaacagtaaaaacagagctaacaaatcatttggttttaggccataaaaatattctaatacttaagttgtttcttaagattcacgtcattctgaatggaacgaagtggaatgaagtacagaaaatttctacacttctccttcaaaaaaatccctgaggtacgcctctttgtctttgtctgcccgttcggaacccagatattttttccaggaccgggattcatgatagacaatacccatttcccatacacagtacgttggcagatgggttttgtttctgtcccatacttcaaatttgccggaaccatcataatatacgctttcccacagttcattttcatttcgccatgtgcagaccagcaaaagatagttttttccgcaacggtgcataataacaaatccgagatcatcaatgtttttaaaattttcgtcagcattgtcaatgcacttttgggcattttcaatgtcctgttgagaaatttcagcaggatcaccggccaggtcataccatttgaattttgtttttccaacggtaaaaattccttgtgactgtgcatatttggaaggataggacgttgttttcataccaattatttactgaagcttattatggtatcaggacataaaacaggaataaaaaatttttaacgatctgatttatcacctgatattatagattttattgattctaaattaccgaaaaaaatgcgtaaatttgtaaacaatttatatttatatgttgacgaaagaaaaggttcaggaattccttaaagaaatagaagtagacgatttggtgaataatcttcagattatgggtgatgatgtttatattgacatgactgctcattcgcctgcaatgcacgaaaagaaaaagctggaagctgccatgaaacaggcctttgccagtgagtttggagaaaacgttcatttaaaacttaaaatcgtttctccggagcctagtgaaattcagcaaagtcagatcaaaggaaaacaaattccggggattcaaaatattatcgctattgcttccggtaaaggaggagtaggaaaatctacagtttctgcaaatatggcagtaacgttagctaaaatgggctttaaagtgggattgctggatgccgatatctatggtccttcagtgcctaccatgtttgatacagaaggggagaaaccaatctctgtagaagttaatggtaaaaatctgatgaagcctatcgagaattatggtgtgaaaatgctttcaataggatatttttcaggcgctaatcaggcagtagtgtggagagggccaatggcttcaaaagcattaaatcagatgatcagagatgctgcctggggagaacttgatttcttattaatcgatcttcctccgggaacaggtgatattcacttatccattattcaggaagtaccggtaacaggggcagtgattgtaagtacacctcagcacgttgcattggcagatgttagaaaaggtattgctatgttccagatggaaagtattaacattccggttcttggtttgatcgaaaatatggcgtattttacaccggaagaacttcctgacaataaatattatatctttggaaaccagggagcacaatatttggccgaagatcttggaattcctgtattgggagaaattccattgatccagagtatcagagaagcaggagatgttggaagaccggcagcacttcagaagggatctaaaattgaagagatttacacagaaactgccagaaagatggttgaaagcttagtggaaagaaataaaaaccttcctcctactgaagccgtgaagatttccacaatggcgggatgctcgccaaaagcaaaataataataatttcaataaaatttgaaaaaaccgaattgaactgaaaaaatatggaaacaaacataacgcacgaagatacagtaacaagagtaatggaagctctggaaagcatcagaccatttttgaataaagacggaggtgatattgagcttattgatgtgaaagataatcaggtgtttgtgaaacttttagggaactgttccgggtgttcattgaatttttcaaccttaaagctgggtgtggagaatacaattaaacaacatgctccggaaatagaaaaggtaatcaacgtagagtaaaattatatctgagatattttaaaaagacaggcttttttaaggcctgtctttttatttgcattaatacaataagtttggccagaaagcttaacccaacctgacgggtttttaaaacccgtcaggttgggatgatacaatcagttccaaatgaactttttcattagaattaacactgatgaggtctaattaatccagatatttaacaaaatatacttattgttttacaaccttattttccactcccgtaatagaaacatccggttttccggattttgttcctgaagtccgataatagaccatattgtcaccatcttccatagaaattttgtccactttatcgatgtatactttattacccgttcctgaaaccataattttctgagcacttcctttgactgttaaagtattgccacttccttctacttcaacaacacctccattaagagaataattgagtttatgccctacaccttctacatgtacaaccttactaccttcggttttctctacgccattgacagattctgttgttctggattgtgcgaaaactgttcctgttcctgataacagcaaagcaagaatcccggcaattttaatatttttcattgtgaattggtttttgttgggttaaatatagatataaaatgctttcttaatgcatctcataagttaatcatttttaaacaagagtctttacactgtatatttattatagattccaataaaaaaagctccggaaacccgaagccttagatagaatgatatattgtactatatgattactttacaatgactcttttgatttgtccttcagatgtttttacaagataaacaccggcagaaagattggacgtatttattgttaatgcatttttttcctttccaataagttttccggacatatcatacaattcgtaatcttgttttctgttgaagtagagcgtatttcctttattcacaggattagggaacacattgaatgtcgcctgctcagcttttatctcaccagtaccaagtgttgccggcgaagctacttcaaacgttgatagcgttccactgatttcattggcaacaatcacgtagcctttattggttgttgtattttctggggcaatgtagataattccttcagggccattatcacctccgtaagcggatgtagaacgggaatgcttataatcggtgaaagtagggttgttaggatctgtgatattatataccataacaccgccggttctttccagtgtgatgaaagcgtaagtctgtccgttaatttttcctagtgccactccctctggttcaggtcctttcgcccggcttctgtttttaattacattcgactcattatccgcattgaaaattaaaggatgattggcggcaatatatctctcaaactgatctccgctgtcataaacgatctgtttggtgtctgcattgaaaatagagaatgagcgtgctcctaaagctgctatttcttcaaactcagcatctccatccgtatttcccgtagcagatgaaaccctgaatcttcccagattatgtgaagcttttaaaattgttgaattcgggaacaatacaggatccaaaatataactgtttgcacctacagtagttctttcactgaaacctgaaagatctttttcatctccttcattggctgttacaatataattggtgtttcctaccttataattctgtacggcatcaggaacataataggcttttaccggccagttggcaataactacttcaccgttattgtcggaagcatcaaaaccattccccggcaggctcatgtcttttttacccaatccccagattcctgtgatggttttagtgatcaggttaatttctgccactgcattattctcctgaagtgttacccaagctttctggctgtctgcactgatggtaacatattccggctccagatcctgggaaagcgtattgttggttcttacctttcttaaaccagtcgcagttaatgcagccagttgagattcaaaactgttgaaattaagggttgtcacattagtctgggaaagatttgcaatacctcctgaaatatcaatgatgctgattgttccttcaggatctactgtgtatgcatcatcaggctcaccttcgttggcagtaacgacttttgttccgtcaggggagaatgttaccatatccggtaaagcgcccacagttacctgtttcaggaagtttccgttaatatcaaagaagactacagaaccgttttgctgaggatctgcattcggggaagctgctgcaataattccattttttacggcaatacttgtaattccgccgtaaggagccatgttgactgtttttactacagacagcatttccggattactgaaatcgataatgtcaaaaacatccgtaatggagctgattgtaaataaacgttgtgtggttgcatcatgaactacaatttctgtagagctgttattgcttcccgaaggatcaaaacttccaagataattgagttggatctgatgcgaaggagcaggtgccggtttatcattatcgataatataaacggatgcagagttgtctcctgaaattgttgctccaacaggattttcaaggcttaccacaaagtactcggcctcctgttctgccactgtatcattaataatcgggatattaacagtgtagctcgttgtagatggagtaatgttaatggtctggttagctaaagtaaaatcattagcatcagccgtattgaaaggggccggttttacaaccaggtttacagttgatgccgaaggattgttaatattgattttaaaagcaaggcttcctgcattttcattgactttaatgaaattcttttccagagaaattgttgttcctgcagtagtaaatgtactgtaagtaaccgctgtaattccattatcactgaaatcttccactgtattaggcttcagtgccaggtaatacgtttgtcccggcaccattccggaagtaggaatcactgtgatcgtattgttgctgaaagttgtagtaaagggaacttgtgtacctgaagaatttcccagacggaaatcgataaggctttgtgcattagaatcgttgatcacggaattatctgttaaccttatattttcgttaaaagataacgttggatttacagtagttgaagcattgttggtattgttggccggaagataagtaactgttggcggcgtggtatcaataccccctgcaggagtagcatctaccgtaaagttatcaaaacggttatttcctccggttccgcctcctgttgcggagaattctacttttaatttaaaatcaggattgttgttagctccctgaatggcagaaaaatcaagagtaatcaattggggatcgttatcctgaggatttacagtctggaatggtacaaatgtaatcccgtccgttgaataagaccatgtctgtgtccctgctccctgtgcggatcttctggtagtgaacttaacaattatattattgtatcctgttgtaggtaaattaaactgtaaggctccaccaatcggattattgaatcttaagtgggtgccggatatatcaccgtttcttgcatttaaattctgcaaactaaaattctggcctgtaccaccagtaaaatcaattacactggttcctcccgctatggcagtaagagaaccattcaccaaagtggaagatggtgaggtaatagctgctgcagaagtattattattaaaattccagtaatgaatcagtgtctgtccgaaaagtccgctctgaaaaaagaatgcggcaatcacagaccctttgagtaagtagttgttgatcattttttgcttttattagataaatgcaaaaatgaactttatgtttcgcaactattttaatggaattttaagaaatgtttaaaaaataggtctattccgataaaagataaattatattcaaagagtatttttataattcagctattttcctgacttgcctgaaaaatttaaaacctttcctgatttatttccttccagaggatgtttctgcatataaaaatatcctgaaacggcagttacaagcaagagtacaaaaataaccagaacaattctttttaacatgtctctcatatcgctaaatttttaatatctctaatttctaaagtagatgtagggtaccctttttgtgttacattgatcattgctctacccacttcctgtaaagttaaggattttgattgaaaaaatacgggaaaaatccaaataaaaggtttaaaaaaccattttacatttaattgaccttcaataggtttcataaatccgggacgaaaattataagctcctttgaaactcattcttttcaaatcattttctgttctgccttttacacgcgcccacatcagctttccgctctccgtactgtctgtaccagctcctgaaacatagctgaaaaccatttcaggattctggtttaacaccgcttttgcaaaatgcagagtggtatcgtaagtgattttagtgtagtctttttcattcatccctatactgctgattcccgcacagaaaaaacaggcatcataccctttcagcttttcatcatgaagatctattgtcagaaagtcagggacaatatattctttcagtttagggtgtgattttcctgatggcttccggcttatgcttagtatttcagaaacaccagggttgtcaaggcattccattaaaacaccttcacctaccattcctgtagcacctgtgagaattattttgattggcttcattgttttgctattgatattggtatgacggatagggatgaagttttactttaaagtttttagataaaagataaaagataaaagataaaagataaaagataaaagatgttcctttaaatatctgaattcaataggggagggctttagcccgccttaacaaatgagctaccttccattggctttagccaaacttaatatgagaagagagattgcttcgtcgcttatgaactatgttcgcaggccttcagcctgttcacaatgacaaggcaatcaggaataaaagtctctgaaaataaaagccagctcaaaaatggctggctttcaataggtttgtaaaatgttattttttatcctgcagctgactgtaaatattatgaatcaatccatctgctaccgagattttcggaacaaaaattctgctgatgtcagaccaggacatgacattgttgaaaatactcaatgcatgtaccaatacatctgcccggtcttctctgaggttgtattttgtcattctttgttcaacagagagttcattaaactctttatacgtttttttcaggtgagacagagacattggttttccgtctttggttttgctcatggagaatactttgttgatatttcctcccgacccgatagcgacaataggttttttgctaacgatatttttcttgatttcgtccttcatctctttccagttatccattgtcacaagattattgagaagacggatcgttccgatgttgaaagatttttcgtaaaccatcttaccattttcgtagaaggtaagctctgtagagcctccgcccacgtcaatatatagataggcgaattctttgtcaaggccttctgcaacatgattttcatagatcagggtagcttcttcatcaccggaaatgatttcgatattgattcccgatgtttcttttacctggccgataatttcattgccgttcgaagcatcacgcattgcactggtagcacaggctctgtaatgatctactttgtatattttcatcaggtcactgaagattttcatagaatcaatgaccattttttctctttcaggcccaatctttccaatggtaaagacatccattcccagtctcaggggaattctgaggaggttcagtttgatgaattcaggttttctgttattgatctttacttcattgataagaaggcgggctgcattactccctatgtctatcgctgctatcttcattttttgcttgttttagcttttaaatatttataggtttctatctgtgaacggcactcttttttatcatttcttacatactcattactcagctttttatctaaaattctggctttcacattatccctaagctgaatatcaagaatatcttttaattctttcttaaggtttttgtctgtaattttagcagcagcttcaattctgtaatccaggttccttgtcatccaatctgcggaagaaatgtacatatcctcggctcctttattataaaaatacataactctggcgtgctccagatattcatctacaatactgatggcttttattttctctttgaattccttttgattgacggcacagtagattcctcttacgatcattctggttaccactccggcttttgcagcttcatatattttttcaatcagtgcacggtcactcattgagtttacttttacgatgatttctgcttttcggcctgccttggcttcctcaatttctttatcgatatggtgaacaatcttttcacgcataaactgggggcaaactaataaatttttacatgttttcaaaaccggaaggtaatcatctttcggttttttcagtacattgaaaactttattgatatctgccatgatgcctcgatcggctgtcatcagcaaatggtctccatatattcttgctgttttttcgttgaaattccctgtgcttacgaagccatactgaatggttttgttatgggctctctttttgataacacaaagcttggcatgcacttttttattgggaagccctatcagaacggtaattccttccggttccagcatatctttccattcaagattggattcttcatcaaatcttgcctgaagttcaagcattaccgtcacttccttaccatttctcgcagcatagatcaatgcattgatgatttttgagctgctcgcaaggcgataagcggtaatctgtattgattttacatccggatccatcgccgcttcacgaagaaggtcaatcaccggattatatttatgataaggaaatgtaagcagaacatcttcttttaagatgacatccgtcactctttccccatgttcaaaggcctgatgggtaaaggaagttctttcctccggtctctcatacttttcaaaaacatcaggaaaatccataaaatgtttgaaattatgaatttttcctccggggatgatactgtctttcttagttaaattcagttttctgataaggagttccagcaaggctttatccatatctttatcaaaaacgaaacgtgtaggcttcccttttcttcggtttttgagtcccttttctattttttctgcaaagttggttctgatatcattatccagatccagctcagcatcttttgttactttaaaagcattggcggcaaattcatcatacccgaaataagaaaatatatggggaagattaaaagtgatcacatcttccagcagcattacatttttttcttccggatcttctgttggcagcaatacgaaacgtcccacaaagcgggaaggaatttcaatgatggcataattgctggagtactgccagtctttttttctcatcgctacacccagatagagacttttgtcccgtaaataaggcatgggagtattttcatgaagaagaatgggaattacattcgattctaccacttcatcaaagtattgtctaacaaattctttctgctttgcggtgaggtttttagcatttttaataaaaactttgtgatcagccatttcggcctgaatttttttccaggttttatcaaagttcagctgttgctttatcaccacttcattgattcgctgaaggattttagatggcggctgatagaaagattcggcaatcactttttccttgaaatccatagcacgctttaatccggcaacacgcactctgaaaaattcatccagattattggagaagatgccaaggaaacgtattcttaaatgcaagggaactttttcgtccatggcttcctgcaaaactctttcattaaaggccagccatgtaatatctctaggattaaagtgtaatgacattctgaatgtgtatattttatcaaaaataataattagtgaagattcttcctctatttcttaggttaaactttgattaattttgaagatttagtgaattattctttttaattattgtgttttattataaagtagttggttttcagtatatttatatcatgaatagcctggttttgcccgggatgttttatttttttgagaatatttcaaggaattataaaaactttttaaccatgaaaaaattgataaccatacttctgctgcagttatctggattgatatacagtcagtatgtagaggttctgaaaaaaggacaaccggagaatttatcacctcagaaatttatgattcctttacagaatcatgagaactataaatctgcatttgtagggcagtacaaagcacattatcccaacacttatctcgggcacttatttacagccattgctgatgaggcaaaaaactcaggggcaaatgcttatcacattgtgagttttaaagaaggagattctcaaaatgaatctgaactggtattggatacttactccattcaggattctgatatcaaatatcaaagtacactgattgaaaagaataaaatttatattatcggagaacctgttataaacagtggaaatacttcaaaatttaaagtaaacggggagaaaaaagaagtaaaagacaatacatttgccaccatagctctaaaggaaaacgaagaagtgaaaatagtaaaaggagggattacaggaatggcagtctgggcaaaatggaaaccggaacagtttaataaattctacagcttttcaggaatgggtatagatggtgcaggttttggatctaatggaatgggtgttgccattaatacaggaaggatataccctgtagatcctgatctgggatattttttaattcaggttttaaaagagagcaaataaaatctcagattggatggactaaagttgacatatctgtgctcagaaaaatgatattttttcctgaaagcaacttcaaaaaccccattataaagaggtttttatttttattgtgtcattttgtcataattcttcaaatggtacagatattgagaaattgagagtgtaaattaaattttaaaatagaaaaaaatataaaatattatgagtaaaataattggaattgacttaggaacaaccaactcttgtgttgctgtaatggaaggtaaagaccctgttgttattcctaacgcagaaggtaaaagaactactccttctatcgtagcttttacagaagatggagaaagaaaagttggtgaccctgcaaaaagacaggcggtaacgaatccaaagaagacagtatactctataaaaagatttattggaactcattttaaagaagatgctcaggaaatttcaagagtaccttatgaagtggtagcaggaccaaatgatactgtaaaagtaaaaatcgacgatagagaatatacaccacaggaaatttcagcaatgactcttcagaaaatgaagaaaactgctgaagattatcttggacaggaagtaacaagagcggtaattactgttcctgcatacttcaacgatgcacagagacaagctactaaagaagctggtgaaattgccggtcttaaagtagaaagaattatcaacgaacctacagctgcagcgttagcttacggtcttgataaaaaccataaagatcagaaaatcgcagtatatgaccttggtggtggtactttcgatatctctatccttgatttgggagatggtgtattcgaagtattatctacaaacggtgatacccacttaggaggtgatgacttcgatgatgtgatcatcaactggatggctgatgaattcaaagctgaagaaggtgtagatttaaaagcggatgccattgctcttcaaagattgaaagaagctgctgaaaaagctaaaattgaattatcttcttctcctcagactgagatcaacctaccttatatcacggctacagctacaggtcctaagcacttggtgaagactttaacgaaagctaaattcgagcaattatctgcagaccttgtaagaagatctatggagcctgttgccaaagcattaaaagatgctggattatcaacttctgatatcgacgaagtaatccttgtaggtggttctacaagaatcccgatcatccaggaagaagtagaaaaattctttggtaaaaaaccttctaaaggagtaaacccggatgaggttgtagcgattggtgcagcgatccagggaggtgtattgacaggtgatgtaaaagatgtattactacttgacgttactccgctttctttaggaatcgaaactatgggatctgtattcactaaattaattgaagcgaacactacaatcccaactaaaaaatctgaagtattctctacagcttctgacaaccagccagctgtaagcatcagagtagggcagggggaaagaccaatgttcaatgataacaaagaaatcggtagattcgatcttacagatatcccgccggcaccaagaggagttcctcagattgaagtaactttcgatattgatgctaacggtatcttaagcgtatctgctaaagataaaggtactggtaaagagcagtctattaaaatccaggcttcttcaggtctttctgacgaagaaattgaaagaatgaagaaagaagctcaggaaaatgcttcagcagatgctaagaaaaaagaagaagttgaaattttcaacaaagctgatggattgatcttccagacagaaaaacaattgaaagaattcggtgagaaactttctgctgacaaaaaagcggcaattgaaacagctcacacagaattaaaagcagctttcgaagctaaaaatgttgatgacgtaaaagctaaaactgaagcgttagatgcagcatggatggcagcttctgaagaattgtacgcagctggacaacagccgggtgcagatgcaggtgcaggagctcagaatcctggtggaaacgccggagctgaagatgtacaggatgcagacttcgaggaagtaaaataatgattgtttaataacaattaatataaaatatagaaatccctataagcatttgtttatagggatttttgtttttatattctgatttctttttttagttggaatgaatttccttgacttaaaaggaaatgtgtgctttcatctagactgccgaaaaacaattttatttatggaagtagctggatttatccggaatggcaagtatattatgcgaaattctgaaaatcatagtttaaataagtgcagctaaaatgtacttatgagtttgattttcagtaaataattatacttgtacttaagcttttcaataaaatggatatttttgtaccgcatactttagtttatgaaaagcctaaaatattttttcttccttttattagctttattagcatacaaccaatattattctcaaaataaagttttaattgatactttgtctaagtatgactatttagaattagaagaaaaattctacaattacaaaaacaacaataaaattaaagaatctaaaataattgctgaatactatttgaaaaaggcaaagaaagcaatgattattaataatattgctgaagggtatgtgttcatgcagtataatcaaaatttagctgtctccctaaaatacatagatagtttagaatccattagtaatagactgcatgataatagatatcctgctcgtatttatctgctaagaggaaaattgtattttgattatgataatgaaaaattagcgttggataattttgtaattgcgttaagccatgccaaagaaaataacaacaaacgacagattgctatcgctgatcttcaaattgcttatctaaatggatatattggaaaacataaagagactgtgaaggtactggaatactattacggaaatcctgaatttttaactcccgaagatattgaacacattcaaataagtctggcagatgcatatattgatatttatgagtatactaaagcattgaaattaatagaaaaaggactaaaagatgcatcaaaaaataatgaaataaaaagatacaacaagtatttaattttgttgggcagatataatttggaaactaaaaattaccccaatgctatatccaacttagaaatttgtaagaaatattttttaaagaataatcttgattttgatgctaattataccatgttgtatttaggagaatcatatttaaaatcaaataaaaaagataaagctgtagaaaattttgttagaattgattctattattcaaaaaacgaataatacttttccagaacttcgtgatgtttacacttttcttgtagattatttcaaagagaaaaaagacaaagaaaaacaactttattatattgaaaggtttttgaatgttgataaaactcttgacttccaatttaaatacatatctagagaattaccaagaaaatatgatgcccctaaactcttaaaagaaaaagaaaatattatcaacgatttagaaaaaaagaaatattttttgttttctggtctaggtgttttgtgcctggcactagttgctgtaggttttttcttttatagatctaaaaagtcagaaaagaaatatcgaaaaattgctcaagatttaataaaatctattaatgagaagaaatcagaaatagagaaaaaagaaaaaaaaagagattttccttctaaaatcgagcccacttcaaagattaagaaatctgtaattagaaatatttcagaggacactgtacaaaagattctcaaggaattagaacgatttgagaataacgaattatttttacgaaaaggtatcactttaaacagtctagcaaaagattttaaaactaattctgcttatttgtctgatgtggttaatacctataaagaaaagaactttgcttcttatctcaatgatcttcgaatagattatgccctgaacagattagtacaggataaaaaatttcgttcttataaattaactgttgttgctgaagaattaggttataataatgaacaggcttttgccttagcttttcgaaaaaaaacaggaaccattttgagtacttatatcaaagaaattaaccagtctcaggaataattcatcatttttataaaaatttcgtgtaaaataatattctttattgagagaatgtgttgggcgtgattgccacaatggaactggaaaatgaaagttaaatttttacaggaagaaaattggtaggttatcagtaataatgaattatctgtttctaagaaaagtaatgtgccggtatctattgtgatttatatttacaccgaagtttttaagtgatatttttgtaaaattgtaatctaattataagtagcaaatgaatttgaaattatcctttattttggttctgttttttgtaaatattaatgcacaatcaaaaaatgatttaaatcctaaagaaaaagaatacatttcaaagtttatatatcctataaaaacttttaatcctgacgaaaaagatggcagtgatttgctcatcttaaacagactcattggaaattctaaaatagttggattaggagaatctacccatggttcgagtgaggtatatcaaatgaaatacagaataagtaaatatctgatcgccgataaaaatttcaatgtcttttcactcgaagccaatatgcctgaaagctttttaatgaatcaatatattcaggaaaaaaagggaaatcctaaagatattctaaagggaatgtatttttggctttggcaaacagaagaaactttaaattttgttgaatggttaaaaaaatacaatgaaaatcatgattcaaaagttttttttgatggttttgatatgcagtatgctaaaggagcaatagatcagattagaaaaacatatcaggaaaatcagttgcccgagcaagagattaatgacctggaaacagctttaaagcaaaataacagaggtttcagaacgtattctaaaaaaggccagaaaattatatccgagtatttgtttttaataaaacaaaaaggtatctcaattaaaaatccagatgaaaaattgcgtttcctgcaaaatgtagatattattagacaatacattcaactcaattttattaggagagacaaattcatggcggagaatgttaaatggttaaaagaaaactatttgaattctaaagtaattgtttcagcgcataattatcacattgcaaaattaaattcagatagaatgggttattggatcaatgaaacttatgctgacgattttgtaaatttcggatttgctttttatgaaggtacttattctgcaagtattgatgggaagattggcacctataattcagaacaggcttgtccgggaacattagaatataagcttaattcactcaatattccaatttttattctggatctaaaagcaatcagaaaggataataacaaacttggcaattggatactgaaagatattctatttcgcaaaacaggatcaggtacagataaaaatgaatttttaaaaaccaatgttgctaactcttttgattatttgatatttataaataagtctacaaattcaaagcttttaattagtaaatcaaaataaagatattcagccaacgtgatttaaaatatgtatttgtctgaatgtaaacactaacatttaattataaattaacccggcagcaaacaaagtttgctgccgggttttattttacaggatattcattgtacatcagaagtatggtgcaaattttagttatcttttttatcctccagaatcattttaccccagtcattgatatgatccagtaaagggataaatgaaacacccagatctgacagactgtataccactttcacgggaggttttgtcccgaagactgtccgtgttattagctgatctctttccagttgtctcaactgaatactcaaggtagtttctgtaataaaagaaagctcttttttgagctcaccaaaccttttatctccgttttttaaatggcagataataacgcctttccatcttcctccaatgagatccatgacgaaacttacagcacagggataagatttttcatcaacattgatataaggcgtctcacattcttttttcatttttttaatagtatctatatggatagttatttcatgctaatcgtgcaaaatttatttttacacaatattaatcagaataataaaaatagaaaaaatgtaccagttagcacaaattaatgtcgccagaatgatcggagccaacattgaagatcccataatggaagagtttgtaagccatcttgattcggtaaaccagttagcagaggaaagtgatggatttatatggagactaaaagatgaagaaaacaatgctacaagctttaatccattaaaagatgagcaggttatcatcaatttatccgtatggagaaatatagaatcgcttgaacattttacttataaaacatttcacgttgagttcctgagaagaagaaaagaatggtttcaaaaatatggaaaagcttactatgcactgtggtggattaaaaatgatgaatatccggatatagatgaagcattgaagcgcctagaacatttacaggagcatggtcccacttcctatgcatttaattttcagaatgtttttcaggcattatagctgtaatgtaagaccttttatctgatatttttatggggtaatggtgaaaacttttgcaatcagcatgttaataaagctatctttgtacagttcagtattttattgaaataaatgaaagaaagatatattgcttttctggcgcttgccggaatcatatgcttactaagttatacttctaatgaccctacaggatatactgtggaagagcttcgtacattgtacagcagcggagatcagagtaagtggccggttcctcatttatttgatgaagctaaagaaggttttcaggacatcgggcctttgcctgagatgagttttcctgaagataatccctattctgaagataaagtggaactgggaaaaatgttattttttgatccgagattgtcaggaagcggacaaatttcctgtgcaagctgccataatccggaaacaggatggtcagacggaagcagggtttctgttgggcacaataagcaggccggaaccagaaatgcaccttctttgatcaacataggatatgccaaatcattcttttgggacggtcgtgccacaactttggaagagcaggtgaaagcacctattgaaaacccggtagagatgaatcttcatatgtcgatggcagcaaagaacatcagtaagattgaagaatataaaccttattttgtgaaagcttttggaaatggcgaagtgacagaggagaaaattacaaaggctattgctacattcgaacgttccctggtaagtccgccttcaagatttgatcaatttgttacagagaagaaagatgctttaacagattctgaaatcaacggccttcatttatttcggaccaaggcaaattgtatcaattgtcacaatacaccttacttttctgatcagaaatttcacaatcttgggttaacatactatagaacgcaatatgaagatcttggaagatatttagtgactaaaaaaaatgaagatataggaaaattcaaaacacctgcgttgagagaagtttctcataacaaaccttacatgcataacggacttttccctgaactggcgaacgttgttatgacgtacaatgcgggaatgataaaagaaattccaaaagaaagccagcttaatgattctaaatttcctcacaagtcaggaatgatacaaaagctgaatctgacagatgacgaagtttttgatatcgtagcatttttgaaaactctgaacagttacaaatacaaaatgcaacctccggtgctgcctaagtcataaaaactcttccagtcggaagagtttttgatttcttggaatcaatcgtttttatttaatcaaaagataatgctgttttcagtatagcatctgatattgggattcgtatctggctgacttttatccggaatgaactggaactgacgtattaaacatctgactattaatgattttattaaaatttattaatgaatgattagtgtagttttaatttgtatatttgattttatttagaataaataaatataaatctaaagaatataactataatttaaccatttaattcacatttccactaaaaactatggaacaacaaaacaaaagaatccttactctggatgtaataaaaggtataagcgtcattggaatgatcattattcataccttactggtgtatgccaatgtaaaatcacaatatgaaacagcaattggcagttttattgtttttctgggaaggggaacctccattttcctgatctgtatgggaatcaccttcatgacttccagccaccagagtcttaaaagcgcaatgaaacgaggtgttttacttgtattggcaggtctattcatgaattttatgaaatttatgatccctgtatttttgggttttgctcccgataattttatccagaaatacgggtggaatgcacctattgagcagcaatatgtttatctggtattgctgggtgatattttacagctggccgggatgtcattgctgttcgttggttttattagggaatatgtgaaaaataaatatgttattcttgctataggattattcgctgcactggtatccagggaagtaagcggaattaatatagattaccctgtcattaattatattttagatcttctctttaataatgactatccggcttatgtttattttcctgtatttccatggatatcttttatcatcatcgggatgtttttcggtaaatggttccaggaactgaactatgacagcaaaaaactgttcagaaatatgctttatgtaggattggtatttgttgccattggagctcctttggtttttttctacagtgaatacaactacaacggcttttaccatatgggacctggaggcgtagtttattttgcaggctggacattaatttttctgtggatcatctatattcttaccgcaaaaatcaatgaaaacaaggtcattgcagtactaaaatactgcagcaaaaatttaacatcaatgtacatgatccaatggatattaatctcatggggaaaaggaattttcggatacagacaacatgaaataggctatgtatctgtacttatcgtattgtatattattctcaccttttcagtacagactctggtggatatcataagaaagaaaaaaacattaattaatttcaggccggtatcccctgataaaacatttttgaagcagtaattcctgattttattttttaaattataaaaaaccacagtacaagttactgtggttttaattgtcttaaagaatttccacttcttccgggaccacaaaaagaatggtacagccttgttcggatttcacagaatgtttaaaattaggcggagtatacaggtaatctcctttttcaagtcgggcacctgcaatatcggcatcaccttccatgataaaaagttcttctccggcagggtgattgtgataaggatagctggctcccggttcaaattttaaaagaatactggtagagcgttttttttcaggatcaaattttaatgattttacaaaaataccttcatagtgaatccctttttcaattaaaggctgccattctttttgctctgtttttacgatgtaatcgtggatgttggtgttcatgatctataaattttaattgttattgatattaaactgatctaagctccatacgtatctggaaaaagtactcaatagaaatgctccggcactgaatgcaaaaaccgaataatccagaggttctttaatgccataagaaatactcatagcaacagcgaataataaagtaagaatagaagcgcacaaagctgtttttttcacctgatatcccagaaggagaagaattcctattgaaagttcagctgtagtagacaatacggcaatagcaggtgcccaggattgaggtaaaaacgaatttgtatcagcagtatactctacaaattttttccagccggaagacttggctccccaaagactaagtctgcttgcgactgcagataaaaatccaaaagctaaagctattcttaatagaaaaacggccatatcctgttgagttttcatacgtataatttttttgttttaattacagtacaaagttcagcaaaagccgttgcctaaagaatagacaattccgggaaaagcatgtaatatttaatgaagaaggatggacgctggaagctggaaatgatgatgtataaaacaattctgaacgagcctcaaatgctgtagagaattcagtatatggacatttagctataaattataatacagctttaatcacatgcttcatcagaatcgattgaatatcgattcacttctttgctcacttaagataaaacgaatttgaaaataaatctttgcgttataaattcagagtacagatttctccaacttttaagactgattcggaatttaattcagacgcaaagttttaagaaggtgatatcatatttttaaggaggcaaaggtagaatatcaatgaaattgattctttctaagcaacagggtaggcatattgcttcatcaatggattactgcattttttgcctagtctcaactttttacccgatatccatcctgatttcttttaaatttcctttactgttttctgatagtctttgggagagcgtgaagtatgttttttaaagaaattcgaaaaataaaaaggatcattaaagccaagttggtaggcaatttcttttacggtcagtttttcatacatcaaaagtctcttggcttcagaaatggtaaggctgtagatcacattctgtgcggttttattggtgtgaagctttgaaacctcattcagcttggcttcagtcgttcctaaaagatcagcaaagtctgagacctgataattgtttttaaaatgatcccttacgctttcaaggaattttaagaataaagcatccggtttccagatttcatcaccattggcaattttactgcggttgatttctaccagaagcaattctaccagtgagtgggttgagatcagatattggtaaggctgttcctgaatctctttttcaatagtattcagggtttcagtaaaaaatgaaggatgccgtacagtgatcatttcattcattccgaaatgacagaagagtccgttgtggaaaataagctcaatatcactgtcgcttttacagaaaaaatccagggtaaattccagggctgtaagctccccttcaacagattttagttgatgaaactgccctgatgtaatggttacagtctgaccggtcttcagagtaaaagtattttcgtcaatcaggatttcagcacttccctggctgcaccagaacaaggtatatctgatgacccggcgtggttcaggatatcctggctggttggagtattttcttatttcaatcattttgggaaattggagcttatcattgactaaattacaaaatgtttcaatatcaataagaatatggaattatattattagagaaaatatctaaattcgtatagattttaaataaaaattcagaatgaaatattcaaaaattattatcgttgtaaccctgttgttatttcagttgggtacagctcaggaaaaagcagatgttgtggtaaataaagctattacggaagctaaggctggtaagaaaaatgttttactgatattccatgcttcatggtgcaaatggtgcaagatgatggaaaaaaatatggattttcctgaaaccaaacctatatttgacaaaaggtttgtcacagcatatatagatgtgcaggaaagaggagataaaaaaagccttgaaaatccgggcggacaagagctgatgaataaatataatggcgaaaatgcaggacttcctttctggctgattctcaatccgaagggtgaagttctggcggattcttttgatgccaaaggagagaatctgggctcaccggcaacaccggaagaagtagctactttcattgccaaaattgaaaaatcttcaaaattaaataaagaagaagctcagataatagagaaagtatttgtgaagaaataaagaatataagtctttaaagaaattaatttccagaagatatcattttcttgtaatactcaatttatataaaaggacgaaaacaatgttgtgttttcgtccttattgttttttaattattttccaaaatacatctgatcctgcttctgctgttcattataaatgatctggaaacttacaggcatatattgataaagaagtttccagtgctggatctttgcgtgttttttgaaactttcaaaagatcttacaaacagattttcaatcatggttcttacataggaattcccgtttctgtaaagccagtccatcagcttgatgtgatgggcaatgatattgatcttcgattcctgcagcaggtttttcagataattcacggtagcctgcatgattccggcgaaattgtcctgtacagacaactgtgtgatttcattgcgaagtggcggatagaaaaattttaagtattcaacagctattttttgattaatagtttgcatttgtactttcatcataattaagaatttttcaaacactttgtatggcagcgaaatgtataccaaaatttaaagacaggctgcaaaaacaaatactcctacaattacagcgatgtgggtgagtaatatctctgcattgtgtctgttagtcgtggttttccaggttttccagtctgaaattcttctgattttatttttcataatctattgattgtgagttatttttatttttgtttaatttaaacactttgtaatgaaacggataaaaaatgtaacaaaacctttatatgccgtgactgtaaatttgtctcgaatacactttctgaaggttggcagaaatatgactaaaaatcacttttctgtatccctcactgcagaacgcagtacaattgtccagagaatagataaaagtggtctcaatagcattcttcaataccgtatctccgtcagtgtaaattttgtccattttctgtaagcttctgaagagcaggtttctctcattctggcggatcatatttttaatacgctccgtgaaggtacggataatgctatatgagttttgaattttgatttcttttacttctttttcaaaatcgggaaccacatcagtgatttcctttacggcctgtaaatagttcataatatgatattttaatttggattgtgttcaagcattttgatgatggcaccaaagatgaaaacggttaaaaaagcaaaaaagagcagatgataaggtttcagccatttgggagtttccgggcctttgctttttaatcttccgagcttgtcgagtctgtttaaagtctttaagtccatttttctatgttttaaaatcatgatgccaatggtattccgttgaaaataaaatgtgatgaatatgttgatagctagtgttttgtgattttattgccagattttttaaacaaaaaaacgtgtcaaaatgataaggtttttatcaatttggaaaagtggaaggcaaaagactatgttacctgccataacaaatgaccgactgatcattcccctcccttggagggatggcggaaattcaaagaatttttgacggggtggtcaaaagagagtactacaaaatgacattttttaagtttcgcagaaaggataagaatgaatatctttgcagtccaaatattcagaaaaatgttttcaaaaataatagtacacagagtcggaaataagattaacggagattccctgacactttcccaggaagaattgaagctggaagaaggaatggcagagttgcttgaagattactttttaggatccttcaaatcggaagaaacttttcatttttacagtgacacttatcttgtgaataatccggtttacagtgctgtttccgaaatttttgatgataaatccaaatttatctgggaatctgagaatattgccaaacatctttttgaagctgcagaaaacccaagggttcagagtggtgagcttttcatcgtactttttgaagatgaaagtgatcgccctgacaaagtggataaaatcgggatctttaaaacagagaagagagaatctttcctgaaaataaatcctgcagaagaaacatttgatattgaaaaagatcagggtatcggtttatccaaaattgataaagcggctttgatctacaacaataataaagaaacaggatatgtactttctgtggttgacaacaacaagaacggggatatgtattactggttcgaagatttcctgaaagtaaaacagcgtgatgatgaatatttccacacgcaggaggctttgatggtgtataaagattatatcaccaaacaacttcctcaggaatttgaagtttccaaagcagaccaggcagatttcctgaataaatccatcaatttctttaaagaaaaagaagaatttaagctggacgaatttgccaatgaagtactgggtgatgaacatgtaattgaaagttttgtgaactttaaaacagattacgaacaggatatgcaggtaaatattgctgaagaattcccaatcagtgaagcagccgtaaaaaagacacagagacattttaaaagtatcattaaattagataaaaacttccatatctacatccacggagaccgacaaaagatcgagatgggtgaggatgataaaggaaaatattacagactttatttcgaaaaagaagtataaaaaagaagtctccggttccataataatatcataactttattgctgattacaaaataacagctatgaaatttctgatcattttctggggaatctttctcttttttttctgcgctccttttcctattttattgtatatgttgaatgaggagctggcaacagaaccgagaaattcattagcggtaagctatgggtatctcggtttttctttgttaatatggggatatgtgattattttctttatcaataagcttttcattacaacttttaaagagaaaaatacgataaagtatattcttcggaacggaattccaagagaagccaaaatcattgattataaactcctcaaatacattgctaagaaaaacatgaacctcattcaggttacgctttcatttcctaatctcagcaatacgttgatagaacataaaacgatgtttcatgattctaaaccatacgaaaaaagatttgatgcaggaaacaaagtaaaagtactgctgaatcctcaggcatcaaaggagccttactttattttaagcgatcagaaagtgggattcaacacatccggaatgatgttaagaatcgtatttcttgtattactaatttcttatgtcattggcttatactcttatttctattggagagagtcctttgattttggctggaggtttctgacactcatgcacccgattcttttcagcggggtgatgaccattatatatgtcttggtttttcagttgatttttggcagacttttaaaaaatacaaaagaagaacgcattcttttttcaggaagaaatgctgaagccaatatcatcagtgtaagtgagacaggtcttcttgttaataatcagccacaaatcatgtttcaggtaagttttaaagatttcagaggaactgaacatattgcggtctataagaaaattgtcagctttctaaagctctcttccattcctaaacagggaactattgagattatgtatgatgagaatgacccaaagaagattatgattcccagaggggtttagggagtagaaaggtgaaatagcaaaaagagaaaaccgctaaatatgataataagatatcagaacaattaaatattttttagatgtaaaactctgttttgtaattgactatttaacatataaaaaaatacctgaattcatttttttaataaactcatttttgtttaaataataaggtgaaatcaattcagttttatacggaaaatttttaagtaaaaaatatgtttttttcagataaacaactacttaacataataaaaaataacctatagataggagttagttgtatacatttgagacttattaaaaaaaacatatttatgaaaaaattaaaaaaaatgactcgtgaacatcttaaaactgtaaaaggtggagaaaaacaagtttggattgcagaattttgtggtcaaactgctactacaactcaagattggacggcagaacaagcaaatcaatggcttgctaatcttgaagcaaattactgtaattaatatttgtttcctattaattattgcacttatggccttataatgttataagtgctttttttttgcaatcaaaaataattctatgtattactataaaaaattatttcaattattaactttattttttagtgtcttatttttttctcaattgcataaaaaagatagtctgcgtggtgaatttacctatttattaaaagctaaattgaatacatcaactcctgattatagacacgaagaatttttttcattacagataggtaatgaacgtgctttttttgcgagtattcagtcactgaaaagagattcagtattccaagcacttccaataaaaactttagaaaatggagcaaaactgttaagttcgaagggagtatccatcccaaaaacaaaattttcctttactataatacaatcaaatgaaaatatacagtattttaacttagttggaatgtcaatactcacctataaagaaccgatcattaaaaattggaaattgagtaatgatacaaaaataataaacaccattaattgtaaaaaagcggaagttacctttaaggggagaaattggatcgcttggtactctcccgaaattccattaccctatgggccatataaatttagcggattgcctggattgattgttaaaataacagataataaaggagaatatgattttgagcttgtaaaatctacacctgcatttaaattaaaaggtaaattaataaagataaacgaaaatagatataatgaagcttttgaaacgactcgaccgaaatttgaaaaagcgttaaaagatgctaatgcaaatttaattggtgtacttcaaagctctgaaaccactattatacaaggacaagaaataataaggcaaagacaaaaagaaagggaagaaaacaaaaaatacgaaaacccattagaattagaaaaagattagtaatagctaatttttttttaaatgaaaaatatctccttatgcattatcatagaaaactaatacaaatattgattttactttatggtatgttattttatgctaaatcatataagcaggacactttacgtggtaaatttacctataagttaaaggctaagtttgatacacgaaccgacaatccatatcaagaactattcactttacaagtagttaatcgtcgggctttttttgcaagtgctgtatctctgaaaggagattcagtaatggcaaattcaggaataatggcaaaaaaccctgatggaagtataactttaggatggaaagaaggtatatcgattcccaaaacaaattttcactttactataatccaatcaaatgataaaatccaatattttgataaagcttttatgtcattacttatgtataaagagcctgtaataaaaaattggaaacttatagatgaaacaaaaataattaacacaattaattgtaaaaaagcagaagttacttttaaaggacgagattggatagcatggtatgctcctgaaattccatttccttacggtccgatgaaatttagcggattacctggattaattgtcaaaataacagatgataaaggagattatgattttgaacttgtaaaatctgtacctacttctaaattaaaaggtaaattagttaatattagggaaagtcgatatattggagctacagaaactacacaagcaaagttgaaacaagcaaaacagaatgtagaatctaatgtcgctggtgtactcgctagttatggaacaactattatacaaggacaagaaataataaggcaaagacaaaaagaaaaggaagaaaacaaaaaatacgaaaaccccttagaattagaaaaagattagtaatagctaatcttttttattttttaaatggaaatttataatttccatttaaaaaaataacatctttactagaattgaattagaaaacctgaacttttaaggatgcaaattagctgtttttacctttttgcccttttctcatttcccttattcgctatctttgtgttcttagctaaatcatatgaaaacaaaaattgtcgatctgacaaaacctatccaatacaatgcaggagatccctggttcatgagggttaaaattaaacataaagctcaccgaaaatcacattggctgattcgtctggcattgagacttccatcaagactttttcctaagaactggacaggatgggcagatgataccatcaaaaatatgggacttcatgctactactcacattgatgctccgtggcattacggtcctgttgtagagggaaaacctgccaaaaccatagaccagattccgctggaatggtgttatggagatggtattgtgatcgattgtacccataaagaagattttgtagccatcaccgtagatgatctgaaaaaagatcttgataaaaacggaattaccattcaggaaggaaatattgttctgatcagaacggatcgtgacaaaatgatgggcactcctgattttgtggaaaaaggaacaggaatgagtaaagaagctacagaatggctgattgatcaaggtgtaaaagtcatgggaatcgaccaatggggctgggatcttcctctgaaatatatggctcagaaagccaaagaactcaatgattctgaattcttctgggaaggtcatcgcgtaggaatcgaaaaagaatatttacacatagaacaacttaccaatcttagtgcattgcctccatgcggatttaaaatctgtgtatttccgcttaaaatcgttggtggctctgcagctccggcaagggtagtggccatgatgaatgaatagaacataaataaaaaaagaaagagcaaacctgcattgcagatttaccctttcaaacattatcatttttagcgttattgtttattgagctaagcttttttcctgaaaaataaagccctgttatattcaaaattcattctggcaatattcagtacagagattccctgaggacattccacttcgcaggcttctgtattggagcagtgcccgaataattccgtatccatttgggttatcatatccagtactcttttgtttcgctcttcttttccctgaggaagaagtgccatatgggtgatttttgcagaggtaaacagagctgcacttccgtttttacaggtggcaacacatgctccacatcctatacaggcagcagaatcaaaagcttcttcagctgtctgatgggtaaccggaattgctgtagcatcaggcgcctggcctgtattcaccgatacaaaacctcccgaagatataattctgtcaaaagcagaacggtctacttttaaatctttcttcaccggaaatgcttcagcacggaatggctctatcaaaatcgtttccccatctttaaatgatcgtaaatggagctggcaggtcgttgtattttttaaaggaccatgggcaataccattaatcatcataccacattgtccgcagattccttcacggcagtcgtgatcaaactcaacgggttcatctcctgcaataatcagtttttcatttaaagtgtccagcatttctaagaaagacatgtggggattcaatcctttcaggtcgtaagggaccagttttccttcactttttctgtctttctgtctccatatcttaagatgtaaatccataattttctgtttttatttgtaacttcttaccgttggctgaatttcttcaaagattaaaggttccttaatcagttcaggttctccattttcacctttccaggcccaggcagaaataaattgatattccgcatcatttctcatcgcttctccgtccggagtctggaattcttccctgaaatgagctccgcaggattcgttacgggttaatgcatcgtagcacatcagttctcctatttcgaaataatcggctacacggccggctttttccagttctgtattcatttgatctccctgtccggaaactcttacatctttatagaattcctgttttagttttctgatttcctgaatggcatacttcagaccttcttcatttctggctagtccgcaataatcatagaggagttttcctaatgttttatggaaataatcaacggttttgcttccttttatattgatgaaatcgttgatctgatctttaactgctttttcagcctgttcaaattccggagtattcggtgaaatttttccggtatgaatttcatccgccagataattggcaatggtgtaaggtgcaatgaagtatccgtcaactgaggcctgcagaagagagttggctcctaatctgttggctccatgatcggcaaaattagcctcgcctaaagcaaacagtcccggaacggtggtcatcagttcataatccacccaaaggccacccattgagaaatgggcagaaggggagatcatcatgggttctttataggcatcatatcctgttattttcagatacatgtcaaataaatttccatatttttccttgatcttctcttttccctgttcctgtattgcttttgaaaaatcaagataaactgcatttttcaaaggtccgattccgaagccggcatcaattctttccttggcagcacgggaggaaatatctctcggcgcaaggtttccaaatgcaggatatcttctttcaagataataatctctttcattttcaggaatatcgtttggtgctctggtttcaccttcttttaatggtacccagattcggccgtcattacgtaatgattcagacattaaagtcagtttagactgataatctccggattgcggaagcgaagtaggatgtacctgaatccagcttggggaagccattaaagctccctttttatgggctctccagatagcagaaccattacagcccatcgcaagagtagacagataataaatctttccgtaacctcccgttgccaatattacagcatgggctgcatgtctttcaatatctccggtatctaaattccttacgataattcctctcgctttaccatcaacagtaaccagatcaagcatttcatgtcttgaaaataattgtacagagccttttcctacctgcctcatcaaagcctgataggcacccagaagtagctgctgtcccgtttgtcctctcgcatagaaagtacggcttacctgaacccctccgaatgaacggttgttcagatatccgccatattcacggccgaaaggtacaccttgtgctacagcctggtcgatgaggttcagagaacattctgccattctgtagacattggcttcacgggctctgaaatctcctccttttaaagtgtctacaaacattctgtagacactgtcaccatcgtttttataatttttggcagcattaacacctccttgcgctgctacagagtgcgctctccttgggctgtcctggaaacagaatgatttgacattatatcccatttctcccagagatgccgcgattgagctacccgccagacctgttcctacaacaatgacatctagttttttacgattggcaggattaacgagtcttgctttctttttataattttcccatttatgttccaatgggccttgtggtatttttgaatctaaaatcatgaccgttctgtttaatgataagtaaagaatacataaattggcatcaatgcaaagcctacacagataatgattgaataagcaattccgatcgttttgaaccaatgtacaaacttaggatgatataatcccagggttcttacagcactgtgtatcccatgaaccaggtgataacacaaagcgatcattgatacaacataaatgataacgtaccaccattctttaaagacatttacaaccagaatgtagagatctttatttccgttctcatctaaaggaggagttccgaacttgtagatataccagaaattctggaaatggatcaccaggaaaatcaggattaatgttccaaggattcccatatttctggaagcccatgtactggcccttcctcgtttgtctgtctggtaatcaccacctgattttttatttttcaaggtaatgattaatccgtcaatggcatgcaggataatactggcatacaaaacataagaaactattttgataatgatatttcctgataaaaaatgcgaataggcattaaactgaaggtgcgcctgttcttgcggaagaaaaagctgaagatttccaaggaaatgaatcaacaggaagaatcccaaaaagagtccggtaaggcacatcagcatttttcttgacaatgttgataacatatttttgatttaatgattaataatatcctaagactttcatccacaatcctcctataaccatataaatgatcagtagaacaattcctatctcaagacctctgagccaccatgctttaaggtctacatagccgcttccgaagaataccggagcaggaccgtgaccgtaatgagtcaataccccgtaaatagaacccatgaaaccaagcatcatcgccagtagcataggaggaattcccaaagaaacccctacacccagcaatgctgcatacatggctgctacgtgtgcggtggcactggcaaagatatagtgactgaagaaatacacgacaataataacagggaaggctacctgccagctcaatcctccgatctgaactttgataaggttactgaaccagccaatgaatcccagttcatttaaagagcttgccatcatcaccaatacggcgaaccaaacaatcgtatcccatgcacctttttcaccttttacgtcctcccaggttaatactgaggttaacagtaataacgttaaaccaatgaaagctgttgttgtagcatcaattgaaagagctcctccaaagatccaaagtgccagcaggataaagaaggctaatagcatcagccattcgtttctggaaataggtcccatttcttttaatttctcagccgccatttttggagcatcacctgtttttttcaattcaggcggatataatttgtacaataccaaaggaacgacaaagaatgctaccgccccaggaataaaacctgctgcagcccatgacatccaggtaatatcgatgccaaggttagcggcaaatttctgacacatcgggttactggctgtcccggtaaggaacatagaagaagcgatgaggttcatatagtagctgtttaaagtcaggaatgatcctaattttctatgggtttccggcttttcaggaaccgaatcaaaactgatggccatagatttcatgataggataaataattccgccacctcttgctgtgttacttggaatagcgggtgcaagacaaacgtcggcaagccctaatccgtaagccagccccagtgaacttttcccgaaaactctgatgaataaaaaggcaatacggttccctagtcctgttttgataaaacctctggcaataaagaatgaaatcccgatcagccagattactttatctccaaaaccggaaagcgctttggtaatagattttccggcatctcccggagcaactacctgcgtaagggcagtaaatccaatggccatcatacacatggttcccatgggagcagcttttagaatgattcctaaaatggttgctgcaaagatggcaaacagatgccaggcattctcagcaacaccttccggggcaggaatgaaccatatgatcaacgcaacaacaaatgtgatcgctacgtttttaatattaatttctttcatgatactaactgtttaatcgtttaaaacctactctgtacctgtacaatgaatagattgttattgtattgtgatgtgttttctacctgatgtttgtagcggtcaaactgtactcccagctgaattcttgcgccataatttttcagaaattccaatccgaacatcggtgttatggtttgtcttgggttggaagccattctgaaattggtgtcaagatattcgtaccggcaggaaagttcgaaggcactgagatttttatggttgatttcatatctcagattcggaaggaaataaacaccgcggatcagatattgatcagggttctcaggccgtagctcaggagcaatggaattatacagtacgtggttggtggcctgtttgccttccagctgcatgtccaggctccatttcggatcaaaatgaatcagtgagctcagatcaactcccaaagcatatacttttttgctgaaaacctctccgatacctccatttaatcctacattgaaattatattttttagataatccgaaaacaagacgggtagaatactgttttccgttgtcattatcattgatctggttttttccgtttccattcactactgaaacagcatactggaaaggaatttctcccagctgaagctgtcctgtagcagacattccgatctggaaacttgtccagccaagttttccgaattccgtatactggttagaccagtctaaagatttaatgatatctataggataagtctcttcaataccgaaccatggtctgaactgtcctacggtaattgctaatttgggattgaatgtgtatttgaggtaagcattttcaagaactctgcttttgggatcatttttaaagtctgcaaggttggccaaaacgacaacttcagtacgtttgctgatctgcgcccgaacctggaccctcatgtatttgagcatgaaattattgtcagttccggatccatcggtatgatgaagtccgtttacatcaacatctttagtcatccctacaagataacgtgcctgaaaaaggcctttgatctgcagctgcggatattttacattatcttcttcctgtgcaggaggtgtggtcttcagagaatcctgattctgagcataggcagatagtccgcaggccagcatgcaaaggatcaggcttttctttttaatcgaaaaaaaggccatatctattttgtttttttattgtgaactttattttatcacaagcttcaactctccgtcagatttaaatgaccggattgtacttatgatgctcagtactctttcatccgcaggagcagatgtataagtctgttaagcatctttttctgataaaatattactttaatcctaagaaggtgaatggagcagattccttaaattctgcattggattttccgctatatgtgcggtagttactaaggtcaagtttcattactttaccttttgggcttaaatcaaattctttaagatctacccagaaagtatttggagtaaagactgtttcaaaataatataccagattcttctgatctgaaacagagcgccatcttgtagacgaaatattaggttctgttgcagaagtgattccgtaaggaacagaacagtttctgatcacactgaaaacactggctaccgctgttcgggtatctgctgtctgaggaatcgcattgatgtagtaagaagctcttacaaagcggtctgcagcgcggttggttcccggaagcataactgttcccggaatacctttccagtaattgttaagcgccagctgctcttcgaaaataggagaattggtcatcacagtataagagggatcgtggtgaattaccagctttccgccaatatattcaaatacagcgttgtctcctgaagcatcggaaatagaaagatggacggttgtaaatctttctgtccccggaatataatcacttacaataacgaatggttcttttcttgaaaattctacagcttcttttacggtggcaaaattatcaagataatattgagcccataatgaaatggcaattccctttttgcttccttttccatcaaatttcggatattcggattctcctaaccaaagcaggttggccaccagtcctttttcattcatgccgtcagctgaagcaatatcccatgaagagcttacaagacttccgtatttggcagtccatttgacagatttaggacctaccagcccatttcggtctattcctttcggtaaaacccataagttgacagggatttcatcccgccagtccatagaacgggcagtaataacggtattctgaggacctttgtatactactcttgtacacgcttcagaaggattccataatcctatagaaaggatcagagaaaataaaattaatgggaactttttcataatagtattatttgaatttaaattttatgttgaatctgttgtgaataattcaatgtattttattcatattcattatttggtgatataaatttagcgaaatttgtttaaataaagtaattatttaggttgataatatgtaatttatgttatgaatcatgcctaatgaatgataattggatggttggatatttttttgtatattttaatgatatgatataaaacagttgaaaaaataagaaatattttaatgactttttcctttactttttcattgttttataatgtaacaatttgatgtattgtgctttaaaattaagtaccacaaaatgaaaagctgttaataaaaatcgttatatttgattaacagactgaaaagacatatgaattttatagaatgccatgaagagcctatccatattccgggttctatacaaagttttggctatttgattggcattgatgcagagctccataccattactttttttagcaggaatatttcggatctattcaaaatcgggaactcagaggagcttttcggaagaaaacttactgattttcaggaaagttttcagggcattattgattcagaaatctatacttcactggacaagtttaccagacgtagtaatgagacttatttcgataaaatttttatcaacggtaaagaatatcacttttctgttttcagaagtgaactttatatctttctggaattcgaagcggtactgattaaccccaataaacggatttccaataagtatgataacttttacatcatcgataatgaaaaggaactctggaatcatcttctggaaaccctttcaaaagtggtaaactatgaccggatgatggtctataaattcatgatggatggttccggaaaggtaattgctgaaaagaaaaatgagaatatggaaagtttcctgggacttcattatccggaatctgatattcctaagcaggcaaggaatctttatctgaaaaaaaggaagcgaatcttcagcaatgtatatgcagatacagttccggttctgagcaaaagcccggatcatattgaccttactttctcagcatccagagccatgtcacctgttcacggacaatatctgaaaaattccggtgtagcatcaagcttcagtgtttctattatcattgatgatcacctttggggtctggtaacatgccagaatgtggaacccaaacatattgaccttgaagacagggtacaagccggtatttttacggctcttgctgcgaatgcatattcctcttttaaatctaaaagcgaactgaattaccgtctggagctgaatgaaagaatgtctcagctgaaaactgagtttttaaaacataatattttgtttgattctcttattgaatgtaaagaagagatcagaaacttacctgaagcagacggaattgccattgtttcggaagaaaatgttataacagatggcagcacacctgatcttgaaagtattaacaggatcgtaaaatgggctcttgatactaccactgaacgtatctatgtgagcaggagctttcttaaagatcgtggtgaagagcttgggctttccgaaaatgcagcaggaatcatcatttattttatcgaaagggagaaaaatgagatgctgatctggttcaggaaagaattcgatgaacatatcaactgggccgggaatccggagaaaacaataagtgttttttcgcagaacggagaagaaaaacaaatgatctcaccaagaacttctttccggatttttacagaaaatataaaaggacattctaagagatggaattccagaaatataagtgctgtacagactgtaagagaccttatcctggaaacgtctcataaaaattataatgcgatcaaaaggcttaatgatgagcttaaaaaagtaaatgaagagcttgacagtttttcttatactatttcgcacgatcttggtacaccgctcaccgtaatgaaactgaatgcccagatgcttttgggaaatcttacggatgattccgggaaaagcaaaaccaagatcaatacaattattgaggaaatcgacaatatggctgaaatgatgcatgatgtgctgcagctcagccgtgcaaaatacagtgaaatccagcttgaaaacctgaaaacggttcatacgattgagaaaatctctgaaaatgccaagatgacctacggaagtcctaacagtgaaattatcattaaggaatgtccggacgtattggctgataaaacacttcttcatcaggtgtttctgaacatcatcaataatgcagtaaaatactcttctcataaagacgttcctaaagtggaaattgaaggaacagaagacggacagaccattatttacagaatttctgacaatggaattggtattcctgaagaagaaaagcacaagatgtttaagatcttcaacaggatggataatgccaagaaatttaaaggaaatggtgtaggcctgtctattgtacaccgtatcatgaaaagaattggaggaaatgttgattatgaaagtaataatgaagggacttcctttattttaacttttaaaaagccttacatttgagaaacttttaaaacgttattatggtaacagaatatcttaagcagaatacagcagactatcacgatgcagcagaaaaactttttaattctgaaaagattttcaataagactttcacattagaggattacaaaaaaattatccataccaattatctgatgcttcttcacagtgaagataaaatattcagcagtctttctgataagtatgcggaaaaacttcagcttgattcacgaaaaaagcttttccttatcgaaaaagacctgaaaagcctttccctgaacaatcggaaggcttcttatcatcttgaatttgacaatgaacatgaagcgcttggagccatgtatgtaattgaaggttccactcttggtggaaacgttattgcaaaacagctttcgaaaacggaaggtttcgatgaggtaactttcaactttttcggatgctatcatgaaaatacaggaccaatgtggaagaactttaaagaagttctggatacggaagtgcctgaagaaaactacagtgaagtgctttccggtgcgaaaaaactctatacgtttttgctgaacgtcaattaattcatttaattctaattaaattcctgaaagattgcgcaatttttcaggaattgttaaatttggggagtttcaaatttaaacttaactaacaaaaaataatttaaaaagtaacaatatgaaagtaactgtggtaggtgcaggcgctgtaggagcaagctgtgcagaatacatcgcaatgaagaacttctgttcagaagtagttttggtagacattaaagaagggtttgctgaagggaaagcaatggatttgatgcagacagcatctcttaacggatttgatacaaaaattacgggtacaacaggagattacagcaaaactgcaggttctcatgtggcagtaatcacttcagggattccaagaaaacctggaatgacaagagaagaattgatcggtatcaatgctggtatcgtgaaagacgttactgaaaacttagtaaaacattctccggaagtgatcatcatcgtggtttctaaccctatggatactatggcttaccttgtacacaaaacttcaggtcttcctaagcacaaaatcatcggaatgggtggtgcattagactctgcaagattcaaatacagattggctgaagctttagaagctcctatttctgatgttgacggtatggtaatcgctgctcacagtgatacaggtatgcttccattattgagcaaagcgacaagaaatggtgttcctgtaactgagttcttaagcgatgagcaacaaaaatatgtcatcgaagaaactaaagtaggaggagctacgcttaccaaattattaggaacttcagcatggtatgctccaggtgcagcggtttctgtaatggttcaggctattgcatgtgaccagaagaaaatgatcccttgttctttaatgcttgaaggtgaatacggacaaaatgatatctgcttaggtgttccggctatcatcggagctaatggagtagaatcaatcgtaaatgtaacattgactgctgaagagcaattgaaatttgctgaagctgctaatgcagtaagagaagtgaacggagatcttaaattttaatatttacccgctttaagcgggttttaaaataaataaaatccggctgtttcaattttgaaacagccggatttgttttatgaatattgagtgtgaaagtttcggcgcggccggaggccgcgccgaaactttcatttaaaattatagatatataacttatttcattgtatccacgaagtgggttacagccttcacaaattctttatttttttcatagtacaaaagatgtccgccatcaatggaaattactttctgattaggaaacctgaaggttttataatgttgagttccgactgctttatcatttttcccggcaatgataagtactggagcacgaatgtccttagtaatgggggcataatcagcatagtattcagggaagtctttggattttgagattactgccattccgaagtcgatgatgcggggatgaagagaatctattttatccatttcttttatggtttcgatatcttcggtaaggaatttatacccgattcttttttttcttaatgcactgctgattttggagagctctgaagaaaggctgtctttgggaacagttctgttttttgcctgtagaagactgtttccatattcaatctgttctttgacggattcatcattcagaaattgaagcgtaacgttggccagaatgattcctttgatatgctgaggatatttttttgcataattgacggctatgattccgccaaaggaatgagccagtaagaataactttttcaatttcagatgcagtctcaattcttcaatatcctgaatcattttatcaagatgatagttatctgatgtatcggattcgccggaaccccgttgatctatataaatcatctgcatatttttttccagactgtttcctcccatcagttcaaaagacggataaccctgtccgggaccgccgggaatataaatacaggcttctccttttccggagattttatatttgatccttacatgatctgaggtttcaaagtaagcttcaaatggtttattctgagcggaaacgagattcagagaagtgaaaaaaagaagtaaaagaataattgttttcataccattataacaattataaagggttatatattactaaaatacccaattatcttccttttgccttgtctcctcttaaggtcataacagtgctggtcacagctgctaccagttttccttcagtgttggttatttcgcagtgataaacagtgatggttttaccggattgtattggtcttgcatgagccgtaagcttatctttccaggttggacggaaaaaattaatcttaagttcaatactggtaaagctttcaccttcattcatcagggtagagtgggctgttccgatggccgcatctgccagttcacaaagtagtcctccatggatagttccctgttggtttccatgtatttcatgatccgcattaatggagactttggcttctccggaggcaacatcagttatttgaaatccaagtgtttttgaaatcgctgttggatagatctgataggttgtaaattcatctacattttcaccgttgactactttggtaaggtaatccagaataggaatttttgtcatggatacaggatatttttacagataaatatacagatctttggatgagaaaatcggggggtaacgaaggtatttgttttttctattaaatgctaaattcctgatcagaccatttttcagagttccgaaattttctcaaacaattcagggtagttgattactaatccaatttcatccaccgaaatttcagctttaaaatcggtttcaatattctcatacagatatttattaacatctgtccgtgtatattgctgctggaccggtctgatatgatggcttaaaacatcgatgtaaataacatcaatcttctgagaaccgttctctgaaagttttaaattgttgatcggtaacgtattggtgaaaggagtcagagaaatgtctatgaacttgaaattattaaattcagaatgtacaacaccgttgactttccattggttttgatttctttttcctgaaaaagttcttttaactgtattgatctcagattcaatcagaaaatcctgaacagtccagtctttatcaattagaattttataatttaaagcatatattttattctcgtggaagccaatgattttcgattctacagtataacccttatcgtctgaatataaattaaaatattcaagggattgataaaagattcctttccagattaatgtcttcatatcatattgctttgagtgttgtggctttttgaatggattttaatgtcagcgggatactcttctgttccggatcctgcttaatgtttctcttgcgactcccagaaatgaagccagctgcgtgagagatatacgctgaatcatatgaggatgatgggtttccagatgttcaagtctttcctgtgctgtataaagcttgaacaaattagaaaattcttcctgtctggaggcaaactggcgaatacagtgacgtcctaatgtctcaatttcagggactttagcagcggcttcaaacaattttgttttatcaaaaataatggcatgaagttcctcacaggcaatcatattaaactctgatttttgaccgcttccaaagctgctgatattggtagtgatttcgttctcaaagaaaaatccggtatttttaatatcaccttgtatttcataataacttttgcaatatcccttttcaatataaaacaaagaattacatatatctccttcctgtaacatcagttcattttttctgtaagttctttctgatagggcagactgaagcgtatgccagctttcatcggaaaatggtgtgagtgatctgatatagtttagaagattttgcatgatatcagagcgatcttttttgcaaaaataataaaattaaagaagactatttgtacaattaagtttagaaacggattatataagattgataaaaatacctttattttggtatagagtcagctatataaagattcattttatcaattttcagaatattggtatccttcgtgtaccaacctacaaatttttcatattctgctttattattaatgagccagctattaaacgcttcttgatctcctatctgaaataggtaataattataagcattaaatagattgttatcatccaatattttttgatagtttaataaaacatttgatggattatttttgtatttcagatattccctcaatgcttttattctgatatctgacaagttgtccagattgatttcttttttatcgacagtagcgagtgcaaaatatccgctgtaaagaagacagaaaggaagaggatcagtaggtttactgtcttttttaatagtaataaaggcctggcaaaaatcaactgttgtacttttatctttgaattttactgcttttttatacccgtcatataaaagttgactcatttcctggcttctggaagtggtgcgttccagatttaaaaatatttcaccataaacaagaccgtatagtatattattagaatttaagaataatttggctactctgtaatagtttgatggatatgccggttctgcctttattccgctttggtagctttcaatggcctggtctatttttttttcaagttcaaaaacaacccctctctccagataaagttttccggaagacggatacttttttaatccttcatcatacgtctttatagcttgttcagggttatcggcataatcataggcattgccgagaagggcaaaataatagtcatctatattgggataatctttgattttttctaacagtgatatggcacttttatagtcttcttttcggatataggcaagtgcaatttcatacgggtaggtgtaatcttgtggatcttttttttcacattctctaaggatagcgataccctcatcatatttttctttatcaataagtttgacagcgtcataaacttctgcacatttaaatgtctttttctgtgaatatatgaatgaaaaggtagtgagtgcaactataaaataagtttgtcgtaacatgagttttttgatattagtcctaatgcaaatatgcatttttttaaactaaaaagagcggaaaaaaccgccctcaacaaaattttatctaacaagtatgctttagatataaacacatccgcatcctgtttcccattcctggcaaagacgcatcggttcatgacagcccggattaccgccgccaccgccggaaactctgtaacaggtaccatcactgcaataataagaacctatagttggcggacaattgccctcgatatcacatattgcataaggggtgtcacctccgctgatcaggactagctgatttctctttaattttttcagatttttcatagtaatcatttttaatttgttgattactaatgtataaattttttaacacaccagcaagtgttttaattgaatagaactagagattaatgataacgatctttctattctacatctaaagtcatgaaaagagcaatttcttctgcattttcatacaatctggtgttcagtccggtaatattgaatcccattcttctataaaactgtatggccggataattggtattttgtgtttccagttcaataactcggcagtttagttttcttgcttctttaatggcgtttttgatcagcataactccgattccttctcgtctgtgtttttcatcgatcagaatattttcaatataaaaactattgttccacgttctttgctcacagataatccaacctgccagttcttcattgataaaagcaccaaaagaatttccctgtgcaatgatggtgttcaggtcctcaaggtcttcaggagtggtttcccagattttagtataaggcaaagacttttcttttaaaataaactcaaatgaaccttcaaattcaatagaagagactgcgtatattttgtctgttatatagccgttatgcccccagctcaaacccgggtcggaagttaatttttgtaattttcttatttccacatcagatatttttaagcttattggatttcggtgcagatttctacaagataattgttgatatctttaatgtaagccgttttttggccccaaggctttacagcaatatcttcataaagaacagccccgttttttattgctttttctaccaaagcttctacattgtcagtagtgaagcctaattccattccaaagggtttgtctcctgtttttgcagttaaaaatccttttttgatattggaacctgcaaggctgacagacgcgaatgaaagagtagtttcaccggtcagaagttctccgtagtctttttcaggagtcatgaactttatttcagagccgaaagtatttttgtaaaaattcatggactgttctacatcttcaacatacaggatgacatatttgaatttgatcataatttgaataataatggttttattttttattgataatatattcttcatccaccatcagctctgtatgaggcccttgtaaaggatattctttgaaacttccgaaatgaccgaagtgaagagggtatttttgagcaagcaaacgtactttacttccgaaagaattgatatcaaccttttgtaaggtatcttttttctgcctgccgttggtgaaaaagagcatcaggttacaatgatctttaaaatcaaaatcgttatagtagaatacattaagattttcttccctgcatatgtgcgacaaatcattaataagatcttgcttatactgcaaaggcagattacagtcaattctggcagcataatgttctgcattactttttttgaaatccgaacccaccatctggataaaacggtgttctatgtttcggaatttttctctttcaggcgggtagcttttactggattgaatggtaaaaggaatttcggaatctaacaatacagcattttcacgtatcaataattcttcgatttctaacgcaaactgaaaatgaaaatcaaaaagcatatggtcaccaatattgatgatcagttgattttcattaatatttaagtataaataagtttccttaaagcccgcttttaattcttcgagtttcaggataagatcatctgtattttcaacacggactcttgctgccaattcggctgggttatcggcgtgtccgccatatccgggataaaatttgaaaaattgaaagtcatataaattttccggaaatctgaaataccagtatacgcctaaaatcattggttattaaataatttaaaaattaaaaaactgtataaatcttgataagctggagttgaattcaattttttcataatctttatcaggattatatattttaatatcaaccttatttctgtccttgattgcaagtccgaaatgagttttaagatttgaattaattcgttccaatagtcccaattggagcattacatctaatattctttctccatccgcaaaatcttcgtaaatagcaacgggaagaggttggtagtcaggagtagatttaatataaagagaaaaaaaataaggatcaaggtctccgaactccatcccaaacataaagggaacttcaatctcctgttttgtcattacattttgaaaatagcaatgataaccatgaagaaaatatctccattttcctacttttccactctgagttcttctacttcgacctttgaaataattaaaagcaagaaaagggaaatctttgtttagctttatttttttcttttcaaaaaataaacagaccagttcttcgccaagttttctgtagtcttttgcacactgaacaaaaaataattgattggcaattatctcttcttttgtaatcagtttctttatttcaattttaggctcattcgaatgaatagctatttgaaaatgagggagatttttcgttaattgttcaccataatcctctctgatatggatgataggataatcaaaaactattctaattattttttgtcgtggaatatttttgaggtaatcaatacaaggaagctcttgtatagatctggcagttattacatgagtggttctttccaaagcattaaatcaatgattaattcaaatttaaataaaatttcacacttcaaaactttcaaaacccttaaatttgtggtcaataaaaattttacttggatgcttaggaacatttcaattgcggcagctactttattgtccgtagttacaatcaatgcgcagaagaacagaaacactcaactggaaagaccaaaattagtcgtagggctggtagtagaccagatgcgttgggactatctgtaccgtttttatggtaaatacggaaatgatggtttcaagagacttttgaatacaggatactctttaaataatgtacatattccttatgttcctaccattacagctttggggcatacatgtatctatacaggatctgtaccggctattcacgggattgcgggaaacgactggacagataaagaaacgggtaaaggagtttactgtactgcggatgagagcgttcagccggttggaactaccaatacaaaaacaggaagtcattctccgaaaaatctttggtctactacggtaactgacgaattgagactggctaccaacttccagggaaaagtagtgggtgtttctttgaaagaccgtgcctcgattcttcctgcaggtcacacgcctaatggtgccttctggtttgatgacagcacaggaaatttcattacaagtacatggtacatgaatgatcttcctcagtgggtaaaatcattcaatgctcagaatcttccggaaaaattagtggcaaatggctggaataccttacttccaataaatgaatatacggaaagtgcacctgacaattcgccttgggaaggtctgttgggaagtgccaaaacgcctactttcccttacagcaacttagcaaaagattatcaggctaaaaaagataatatccgttatacacctttcggaaatacgcttacattgaaattggctgaagcttccgtagaaggcgaaaaattgggtggagataatattacagacttcttagccatcaaccttgcatctacagactatgcaggacataaattcggaccgaattctattgaggtagaagatgtttatatcagattagaccaagatctggcagaattcttcaaatatcttgattccaaagtaggaaaaggagagtacacggtgttcctttctgctgaccatggaggcgcgcactctgtagggttccttaaagagcataaaatcccgacaggtttcttcggagaatatgcagaaaagaatctgaaccagaagctgaaggaaaaattcggagctgataaactgatcaacgccatcgataactaccagatttattttgacagaaaagtattggcagacagcaagcttgaactggatgatgtaagaaactttgcagtgaaagaaattgagaaagatccgacggttttatatgctgtttccgtagataaagtgcaggaatccagcattccggaaccaatcaaacagagaattatcaatggaatcaacagacagagaagcggagacatccagctgatctctcacgattctatgcttcctccatattcaaaaacaggaactacacacagtgtatggaattcttacgattcacatattccattgatcttcatgggatggggagtgaagcagggagaaagcaataaagaatatcacatgactgatattgctcctacagtatcttctttactgaaaatccagttcccaagtggaaatgtaggaaaccctattactgaagttatgggtaaataaagttgaaaattatatgagtcgtcctaaaataggttgacataaattaaacaatatttaatccggagagatattttatttcttcggattttttatgcactttatctggagtttgcatattaaggcttagatgtggtcttttagtattataaagataaatactttcttttactaatgagtttaccccactacttgagaaactattcttaatttaaaggctatactgtagtctttttgtgtgcgcttttctctttttaatacttgatctttcataaataagtcgattagttgtcaacttatttcaggacgagacaatataaaataaaaagccgtttcaacgctggaacggcttttattttggttatgatgctcttatcatttgctgaatttctttctgaaattttttattttgtcttcgtacctttacaatgaaatacaggagtacagccattataaagcttcccaatgcaacagaacctattatgatggaattatgataagatttcagcttttcgctttctaaataggtttctctattatgattatcaataatctgattaatggatttcagttcgttctgctttctcctgaaacgcatttccaggtattttttgttatactgctgatagagattctgttctcccagagcaagataattatcagctaactctttgtagatgccttcgttcaaaataatatctccagtatttttacacaggttttctgcttttagcaaaagattgattgctgattgattttcatgtttttgcctgtagatttcagcaattcctttcaaggcaaatgcttccagacttttagcatgatttttccgggcatagtccagagactgaacaaaagcttcctgtgctttatcaatttgattaagattaagatagcagtatccgatgttatagtataccacactcatattagcgtaggtggttttcccggaagatactttttcaaaattctgtatcgaaattagaaacttttccagggcaatttctgaattagactgactcttgtaaatcattccctttatagcataacttcttgcagtttcaatatatttgaaaggagttttttccggtattctggccagatactgattggcttcgttcaatgtttctaaactcttattgaatagttccatctgctgatattgaatggcaacagaaataagaacacttgcctggcttttgaaatcgttggttttctgcgagagttccttagcttttaaaatatactttaaagattcctcgaagtttcttttggcaatattcgctgtggaaagcagcatataaatatcaatggatgtaatgatatccggatttttccttaataattgttctccggttttaatggtataatcggggttgtcataaatttcaagccgggcttttcttattaattcacgatccggtattttctgagctttcataccgatacaaaaagacagaaggattgaggttgttattttaaaaaagagtttcatacagttttacttttactgatttcctgaatatatgtattaggagacatcccggtaacagacttaaagaccgtggtaaaggcactgtgtgatgaaaaccctgaatactctgcaagatagctcactttataattgagaaaagtagaatcattctttaataattgtacaatatgattgattcttagtttattgatatagccgttaaaatttttctccttgttattaataacttctgaaaggtatttcgtgttaacctccatttgagaggaaagcatggataacgacatatttttattcaggtaatgaccggatttttcgaattcttcaagtttgcgaagaatctcatcttctttttcccttgatattttggtagaaccggaatcttttgctgttgaagtagccttctctggaatggcagattgagacttgcgactgatctgtttttcaaagaaatcaaattgtttttttaagtctttacctttacttttaatacttaaaaaataagcgaatagtccccaaattaccaaagacaaaatgagcgctaacggccagaaggatttaacaaatatcagtttttgaaattcaatatttttattctgactggtttccacaagttttacaagataccgtattccttccctagaactggcatctgtttttgtctttagatcattgcagagtttattgtaccggtgatactttgtatcatcatgaagtgcataatagctgcgggataatgactcatagattttaatttttaaattattgaaaggcagatcttcaatcagtgaaagtccggcttccagcttttcaacagatgctctgtaatcctgcttcagaaaataatattgagaaaggttttcataggcaagacctaatagaaatggctggtttttctgatgctcaagatcatcaataatactttttataagaggttgatattcgataagtttattttgtttcagcagataggaagaacggaaaatcctgttttccagttttaatattttattttcttcattctgaccgctgaggtattgattgcttttgtcaagattttgcagcgctgtgggataatcccggttgatctctgagttcaaagcctgaagctgatacagttttgcggtagtaactcttagagccgcatcgttacttttaagaagtttctgatcagacaggagataactgataattctcttagactgattgtataaacccagattctgatactgatcagcaaggttataatcaccgaagatctgcataaaataagatagattattgtgcagttcaggatcttctttttgagcaaaaatatttacagattgtacatagtcacctttcatagcaaaagcctgggaaataatattctgaaggatcattttgtgttctgtattctgatcgctgacaagaattccctgagtatagctgatgcattcatcagaattctgatagagtttcagaaatgccttatctgccaggatagtaaagtcaggaccggattgtgcattggtgataagggaaaagaaaatgaaaataacaaggagaatttctttgctatgatcaaataatttttgaatgaatactgggttgtttgtgtttttttgaataattcgggtaaaatccatattcaaaataatattttattatctgattgattattaatattttaaaaattatattcttttgaaattcacgaattatgaaagtcaatttctttgggtgtggtaaatattatattaatattgttttcaccaattaaaaaatctaaatataataaaatatgaaaaatttttacaaaatgtcaatgaaaatattaacagcttgcctttttctgaaattgggtattgtgaaagctcagcttactgtaataagtctgggaaattataatgtaggagctgtttcagataatggagtggtaagcttgcatacaagtgcaggagctatatataaatggaatgcatcgggaggacttgtacagataggttcaatatcaaacggatatcctgctgcgggcagaaccatagtgtcgaatgacgggaccaagatctcatcttccgttacaaatgctgcaacaggtttcaatgaaatctcgacttatgatgtagctacggcaacatgggtaaacaggggagggctggttcctaccggctgggatggcagtgtgagttctacctgggggatgacagctaatggcaatacaattgtgggactgggattccttacggcagctaacgcacatgctgtgaaatgggatgaagtaaacggaatggtagatctgggaagtattgttcagggacgaagctccagggcaaacgccatcaatgcttcaggaacggtaattgtaggatggcaggacgaatcaaacggtaccagaagtggtgcgaaatggcaggatggagtggaaagctttattacagataacaatggaaataatgtcggagaagcgggaggtatttccgcagacggaagtacgatcatcggttcagccaatcctaatccctatgtttggaatgcagtaagcggacttacttatattacgcatcctaatgcatcattcagtttcaagggaggagcaacaggaatttcagcggatggaactaaagttattggatattacagagcattcggagcacctccaatgtctggcgagggttttatatggacctctgtcaccggaagagttaatctgaatgattatgcggtatccttaggaattgccaccaatggagtaacgatgggacttcctctggctatttctcaggatgggaagaaaattgccggaatgggtgtgaatgcttccaatcaaatggtagctttttatctggatacatctgaatatttatctgtgactgatgtggtgaaagaaaaaaacagcatgggtatttatcctaacccggttactgatattctatattttaaagggacaggaaaaatagagaaggcagaaatttataatttggttggacaaagagtgaaatcattcaatactgtagacggacaaattgatgtctcatccttgtcaaaaggagcttacattctggaatattcagtgaagggagaaaagcaacaggcttataaatttatcaaaaaataacatatataaatagtaaagtagtgggatgaatggctgttttcaatattgaaaacggctgttcttttttgtttacatacccaaaagataacatttttaaggcgaagcacggttttttggtgaatacacataaaaaactatctttgcaaaaattttggtttccagcattttggaatgaaaagggaatcgggtgtaactcccggactgtccccgcaactgtaaatcgcaacacaagtttctgcaaaaagccactgtttaacaacgggaaggggcagaatgcgaaagtcaggagacctgccaggattataacaaaaaacatattgctttcggaggaaaagtaaaaaggtatggatataaaaagatctttagtactgcttttttcatcttatggttgttttctttttggacaagagaaaaccattgacactatttatatcttcgacaatcagatgaacagggtgaagctttttcatcccgtaaaaataatttcagcagaggatgctgagaagaactccagcaacctttcggaacttctgagatttcaatcacaggtatttattaaggaaaatggccgaggcgctgtttcttcaccttctttcaggggaactaccgcccagcagactgcatttgtatggaacggaattaatatcaattccaattttctggggcagggagatatcaataatatcgcattgttcgggtatgatcaaatcggaataaaagctggtggaggaagtgttgtatatggaagcggagccattgggggaagcattcacctgaataatacccttgattttaataaaggctttcatggatctctgttttctgaagcggcttcctttaatacttataataattttataaaaggttcttacagcaatgataagttcagttttaaagcttcaggaaattattctgtaagtgaaaatgattataaggtaagtgaccttaactacatcaacagaaacgggaattattacaatacaacgttcaatgtaggcgcatcctataaaattacgaacgatcataaaatttcatggcagagccagttttttgattcttcacaacattatcctgtgtatgaggaaacaggaacaaaaactaaatataaaacgcagagcgtaaggagcctcctttcctgggactggaacaaagcaaagttcagcaactccttaaaagccgcttatacagaagaaaatttccagtacttcggttcgttgacccaacctaaatccagcagtggaacagggaaaaattatatctttaaaaatgattttaattatttcctgaattcaaaatggaattttaatctaataggagaatttcaggtcaataaaggagaaggatataagaacgggatatccaatgtcagcagaaatataggatctgtttcaggattattacgatattttgcaacgaaagatctgcgttttgaaggtggatttaaaaaagattttgtggaagatgtaaaatcaccattaatgtattctttctccggaaaatggagcgctgcaaaatggtatgatgtgagcattaacgtctccaaaaacttcagatatccgtcatttaatgatatttactatgagccgggtggaaataaagacctgagaccggaaacctcaactcaggtagatatgactaatgagttcaaagtaggagatttcaggcttagcttttctccttattatatgaatattacagaccttattgtatggctgccaactgctaaagggtactggcaggcttttaatgttaataaagcagaatcttacgggctggaatctcagctgtcattcagcaagcagttgggaaatcataaaatccgggcgaatgcagggtattattatgcaaaatctattgataaagaaaccaacatgcagagaccttacgttcctatacacagaggaaacattaatgtggattatgaatatggtttctttaaattttttacccaggcactgctgaacggggttacctacaccacaagtgatgaaaaaagatcagaagctatagatccttattttcttttaaatatgggtgtttctgcaactctggcaaaaaaatatactttaggatttaaagtgaataatctaaccaatacatactataaaaccgtttctttctatcctttaccgaaaagaaactatagtgtgtatgcagcaataaatttttaataattaaaattgaataaattatgaaaataactaaacttttaactgtcttatttgcagtggtactattgtttaatatttcttcatgtacaagtgactctgccgagtttgacgtttccccgatcacttaccagaacggatattttatctctaatgaagggaattttaacagccagggagctaaagtaacttttgtgacgagagatttaagccttaagcaggatgatgtatatggttataacaacaataaagagatcctgggtgatgttcttcagacgattggccttaacgggaataaagcttatcttgttttgaataactcaaacaaaattgttgtagtagaccgttatacatttaagaaattgggagtaatcacacaacagcttgataatccgagaggaattgctttcgctaatgattttatctatgttgctaacactaatttcagtgcaaatactcaaagtataacaaagtataaagcttctgattattcatttgtaagcaaaattaacatgactgaagtttctgataaaacggtagaagcgggaggaaatattttcgtacagaatgcttcatcggggtatggaaacaagattacttatattaatacttccaacgacagcaaaactgaaattaccgttccgaatggtcagattggaaatactgtttcttacaaatccaatgtttatacaatttcttcaacagctacagattcttatatctataagatttcaggtaccggaacccttacaccggtaattacactgacaggaattccaagcgcaaccaaccttcagattgataatgataaattatatttcagctcagccaataaggtgtacacaacaagtttaactgctccgacagttccttccagtccattattaacagctgcagatggtggtccttattttacattgtatggatttaatgttattgacggaagaatttttgcttcagacgtaaagcagtttacacaagaaagcgaaatggttatatactcagcagctacaggaagtaagattgttactgtaaaaacaggaggtatcggtgctaacggaacttttgtaaacccataataatttattacttcgaaaaataattttttattttttcatcatttgtgtttttttccggccggtttcttcgaaaccggccggctttgttttcacagtaagcaaaaaaatccggcgggatggaacatcacgccggattttttatattttataacttggagttatattgtcaatcccagtttttcagcttcagctatcacaaactttgtagcttcttccttttcattgggtatttcaccctccaggatagcttcctttactttttcctttaaaataccgatttcacggcccggtttaagattgaacatttccataatctcttcaccggtaataggcggctggaagtttcttacctgatccttttcttccacctccttgatttttaccgccacatattcaaagttttttttgaacttctcctgtttcctgcagtttttcgtggtaatatctgccttgcaaagggtgaaaagatcttccagattttctccggcatcaaacaaaagtcttcttaaagcagaatctgaagcatcatcagtaatcagagcaataggtcttgacgaaagctttaccattttctgaacatatttcatgtcacttcccaacggcagttttagtctttggaaaagtgttttaaccatttttgagcccaaaaactcatgtccatggaacgtccatcctgttccttctacaaattttttggttggagcttttccaatatcatgaagcagggcagcccaacgcagccaaaggttatctgtattcacagaaatattgtcaacgacctccaaagtgtggtaaaagttatccttatgtgtttgtccttccacttcttccacacccttcagttcaatcagttcaggaataaccagctttaaaagaccagtttgttccattagtctaagaccaacagaaggcttttcagaaagcatgatcttgttaaactctaccatgattctttccatagaaacaatcctgattctttcagcttcctgctggatagctttcagagagttttcctcaattttaaaatgtaaagtagaagcaaaacgtaccgctctcatcatccttaaaggatcatcagaataagtctgcgcaggttccagcggagtccttaaaattcctttttcaagatcatcaattccattaaaaggatcgatcagttctccgaaattcgttttatttaaagagatagccatcgcattgatcgtaaaatctcttctcttctggtcatcttccagactgccgccctccacttcaggcttgcggctgttttctgtatagctttcctttctggctcctacaaattcaagctcaagctctttatatttgatcatggctgttccgtaggtcttgaatacggaaacctttaatttcggatctatgtcctgagctacattttgggcaagctcaataccgctttgttccgttacaaaatctatatccgtagaagcttttctgttcatcagaaggtcacgtacataaccgcctacaatgtatacggactggtgattcctttctgctgcttcagaaatgattttaaaaagttttaaattcttattttgattaagattaattttcattgttaataacagtgtcaatttctaccgatgttacccatcaatcataatgagcatacattctactaatttttccatcttcattaaaaaacatgacttccacagcatgtttatccataatcgacttataaaataatgctaccgaatctactcccgccgtggaatggatcagatcaaaatgaaggtccggaaatttatccagtgcctttctccaatattcacggacagcttcttttccttttaatgaactttctcttccacctgtagccatagcaatcataggagtggtgatctcaatatcatccgcgtaatgggacagaatatcctctaaattatgagaattccagacattgacccacgtttgagcaaatttttgatgatccatagcaaatagtttatgagttgagtttgcaaagatagaattaaaaaaaagaaatcctgccaagatgaactgacaagactctaaaaataaacaggtaattctatattgattactctctcagaacttttatcctgttgtcattccatattttgattaccgaagaacctgaatattttgaaactttttctctgtcttcttctacagcataatctacaaggtctatcatttcctgggaaatatcagaaaatttcaagggacttttttcaccactgaaattggctgaagtagataccagaggtctgtttaattttgtaatcagttttttgcagaaatcattttttacaagacggattccgatacttccgtcttcagcaagaagctctttaggtaaacctctcgggttttcataaacaatagttaccggcttttcgctgagatcaataatttcccaggccatttcaggaacatctaccagatcctgaagtcttttctcagactccacaaggatgatcatggatttattcttttcacgctttttgatttcaaaaattttattgacagcttctatattggtcgcatcacaaccaattccccagatggtatctgtagggtaaagaatcgttccgccggattttaatatttcgataatatgctccataattgtatatgagttcaaagagtggctaaaggtaaaaaatctgtaaattttggacaaaaaaatagggtgtaaatatagtttgtcagtttgattattatgacaagacggaaaaattataatccatgaaaaaatgaattaaaataagttatgcgcttaataggttcaatataatcaggatgtagtatttttttgaaatcttttttggtaagatgttgtgaaatcaagacaggaaaatttgatcttgaaccttctttaattaaagtataaagaatagcgttgcttttaaaaaatacaatggttgtctgttcataatctttacctaaactgtagagatctgtcggttcattaaggaaaatcagattcccggaaatctttgaaattctgtaatgatatttttttccatattcgatgattctgcttttagcttcttctttaggaatttcaaacttaatttctttcaaatgtttttcggtgtatttacaatacagtacatatatgctaaaggtgaataaacttataagaattgcacactcgaagctgttactaagagaaaaatctactttttttaataacaggagagaagctattgccaatgctgaaaatccaaaatagatcgaaattgtatcaaacttatcgtatgaactttcttcataaactaatttttcagtttgaatactttcagtaatttttaaattttttagagatctcatgggacatcagtatgagagtttatgattcttaaatttagattttatgaataaatataatgagccaattattaaaaatgtaatagaggctatccacaaaaaataacctttttccaagctgtatattcttcccattcttccattttctgcagccagaatttccttccagaaaaaaaatgttcctgcaattaaaaaagctattgcagccaatatcatagaaattaaaaaatattttttataacagaatatcactgcaataaagaaccaaatattagctgtccataccagaaattcaaatagacccccgcctaaaaagctaatcggacctataagaaaagtttcaaatgatttataatctttaatctctcccatatctcaactttaaaagctgtaaaacaaaaagaaattatgaaaattaacaggctggcaaggggaattcgttttcttacatccatcccaatttcgataaatacctttcctcaataatactcaggtgatgataattgtgtcccacgatcagttttccgatggtttctacagaaatttcatggccattagctatacctgtgttttgcagagcagaaggttgaagtgtttccagtagaatctgtgaagactttcttaccagcttgtattcttctaaaagagattccaggcttctttcgtctgcaaaagattgatcagcgtattgattttcatcaaatcccggcagattgttttttttctcctctggcaaatgctaatatcctgtattggaaaactctttcggtatccgataaatggagcagaagaccttttaatgtccattttccttctgcataagcgaaggtggattgttcttcagtaaggttggaataaattccgatagttttgtctgctgatatctgcagttcgtttaaccaatctcctgatggaatctgatctaaatatctttggatgtacttttgaaattcggtcatattatttttgtttttagtagtaatttagggatacgagttttcgagactcggggtttgttagtgcgtataaatatgaaaattatttattgctcattactcattactcattactcattactcattactcattactcatgattcgtccattcatagaaattcacggaatcataaagctcaaagccgcaggctggatacaattggtttccgatatcattgctttttcctgtttccagaaggataccacaggcttttgaagagcggcataattctttagatgcttcaatcaattctttggaatagcctttacctctgtgtttttcatttatgtagaggtcattcagcaaccagtagcgctgcatccttgtagatgaaaatataggatatagctgtacaaaacctgtcagtttatcattttcttccgcaacaaaaatttctgaatcttttctttcaagcctttcctgaagaaagtttgcagctgcaggaatatcagaggatttatgataaaatatcctgtactgatcaaataattctgcgagttgtggtaagtcagaaacaactgctttccttgagtttttcataatatcagttggtgttataataaatgagaaggattattaaaacccttctcatttaatgtattgtatgttaagaaaaagctttctcaagatctgcaataagatcttctgcatcttcaatacctacgcttaaacgaacaaggtcgtcagtgattcccaattcagcacgtttctctgcagggattgaagcgtgggtcattaaggcgggatgattagctaaagattctactcctcctaaagattccgcaagggtaaatactcttactttttctaagaatttaatagcatcttccttcttcccggatttgaaagtgaatgaaaccattccccctgattccttcatctgagattttgccagctcatattgagggtgagactccaatcccggataaattactttatcaactgccggatgtgtctcaaggtattttgccacagcaagaccgttgtcagaatgtctttgcattctcaaggccagcgttttaattcctctcaatacaaggtaagaatcatgagggcctaaaatcccaccgcttgcaaactgaataaaatgaagtttttcccccaattcagcatctttggcaataagagctccggcaataacatcagaatgacctcctaaatatttggttgcagagtgcatcacgatatcagcaccaagatcaatcggtctctggatataaggtgttgcgaaagtattgtctacagccactaaaatatcttttccttttgctatgtctactactgctttgatgtctaccagtttcatcaacgggttggttggggtttctacccagatcagttttgttttatctgtaatgacatcagctattttagaaacatcatcaaaattcacgaacgtaaatttcagctgatatttttcaaaaagtcttgtgaacattctgtaagttcctccgtaaaggtcatctacagcaatcacttcatcccctgggtttaataattttaaaacacagtcgatggccgcaagacccgaaccgaaagctagacctctcgctccgttttcaatacttgccagagagtcttccaatgcctgtcttgtagggttggcagctctcgaatattcatatccggaatgtactcccgggcttttctgtgcaaatgtagaggtcaaaaatacaggtacatttacagaacccgttgcagactcatggtgctgccctccgtgaattacttttgtattaaaattcataattttttgctttagacttgagcatcaaacaataaagtatattgcttaagcggattgttttattaaaatttgctctagctgaatacaaaaagcttaccgcttactgtctgcagcttgctgcaattatatttttttacttaatagcggatttcacagcaaactcttctgcaatttcttccatccactgtgctacatcctcttcgccggttgctctctgataggtgtttcctaaagatattaaaatctggtggataaacatcttcatttggtctacaggcatttctttggtccaaagatcaattcttagcgcttctcttgtcttgtcatcccatacagaaatcatggttgctttggtatcctgtttttcaataccgccatcctgggcattccatgtaatattttccgggacatgattttcatcaagctctacatctatcgtaatctgagtctttctcattttttctattttttctgaattctaaattttctttatttaagtttcggtttataaccggattgattaaaaattgtggtggcatccattttcagaaaatccgtcagctttgtttcaggcttttctttaaggtatgctttgcagatctgccatcctgtaaaaattccgatctgtggtgaagattcgttatcaatttccgtataaaatttcgagaaaggtcctggtgagatgaaacgttctccaagtctcggatcatctccgaaaatcaggttgctttctacaaaatagttccagatgttggcttcattgctggttgcccattcatactgctttttggtataatttattttcagataatcaggaacgtcaggaagaaaagcatcctggagaatcattactttcccgttcagaaccatctgatctatgaacttctgatgatcaggagattccgttacaatcttttctgcaaaaagctgtgatacttttggaaccatattctgtgggttcattgatttttgaaaatacagttccagccctttataattaggatttccatcacccataaaaccggtgacatctataaataaaaggtttcctttctcgtcataaaatatcggatcctgaaccatctgtaaggcagatgaaaataaatatactttcggatttttaaacttcgggaagtaatatttaatatgtgaaaacaagctctgaagttccttttgaagatttgcctggtttatttttccgattgcttccttgtagatttttatctcttcagcatcagctcttcttttttcaaaatcagcatcagaaacagttccctgaaaccatggaaatttcgacttaaactgatccaaaggaacatccggattataaaattctttggaaatatctgtgatgtcaactttttcagctgtttcttttacttcaaccttccattgattttcaggttcttttttgcaggaaataagtccggcagctaaaacagaagaaagcgcaatatatctaaaaatcttcattatttttacatggaatttaagtttacaaaaataaggattaaatacacaattcatgatgaaaattaaaatatttacagccctgtaccttattttcatgatatcttttttctatgggcaaaagcttgaacttaaagataaaaactttgaaaaagcagtactcggaaattttgatctgaataaaaacggatcactggaagtttccgaagctgagatggttatgaatctgtttctgactcagaaaggaattacctcggcagaagatcttcccctttttaaaaatgtgaaaatggttgttctggatgataatataattcctgatattacaatccgtaaactggatcagctggagctgttctcctgtacaggatgtaaaatttcttcattcaaagcagaaaacctgaaaaatttaaggtcattatatctcgataataatttgttggaaagtatttcgctgatggagattccgaaaattgaccaattaaccttatctttaaatcagttaaaaacaattgatgtgacccggcttaaagtattaaggaaacttaatctggaacataacaagcttcaaaaaattgatattacaggaaatgaggtcttgcaaacgctgaatataaccgggaatacaataaatgaagccgacataaagaaaggtataaaaacagatgttaccatatttagagacggagaataaaactaatcattatgaaaatagaaacggatcgattgattttaaggaagctggaagatgaagattttgaacgcttatttcttatggattccaatcctgaagtcatgaagtatattggtgtgccggttttaacggatatcaatgaatcaaaaaagatcatcagtatgattcagaaacagtatgatgagaatggagtaggaagattgggagttgtggaaaaagaaagcggacttttaataggatggagcggattgaaactgcttacccatgaaaccaatggttataaaaatgtgctggaactgggttatcgctttcttcctgaatcgtggggaaaaggctatgccatggaatctggaaaagcttctcttgattatggttttaatgggctgaatgccgatgttatttatgcctatgcacattctgaacacgatgcttctaatcatattttaagaaaattaggctttgaaaaaaccgacgagtttgaggaaccggatggaatttgtttctggtacgaactgaagcgcgaaaaatacggtgaaaaatgataataataagacaggaagaaaaaaaagacaatcaacaggtttttcaactgacagaagaggctttcagagaaatggaacatagtgatcatcaggagcagtttctggtagaaaagctgagaaaatcagaagcctttatcccggaattatcattagtggcagaagatgaaaacgataaaattgccggacatattctgttcacaaaaataaaaattgtcaataattcaaaatcttttgattcacttgctctggctcctgtttcagtgaggccggaatttcagaatcgggggcttggaggaaaactgattctggaaggacaccgtattgccaaagaattgggatatgaatctgtaatccttatcgggcatgaaaattattatccgcgttttggttacaaaaaaacaagtaattttggcatttcttttccattcgatattccggaagaaaacgggatggctgtagaattggtaaaagacggattaaaaaataaaacaggagtggtgaaatacccgcaggaatttggaatagactaaaaaaatataaacaatgcaaacacaaaaagtaatagatcatattgtaagctggttaaaggattatgctacaaatgctaaagtaaacggatatgtaatcggggtttccggaggagtggactcaggagttgtttctactttggcagcaatgacaggtatgaaaacattactgatcggaatgccgatccgtcagaaagctgatcaggtagatcgtgcacagaaccacatgaatgaccttaaatccagatttcccaatgtagaaataatatctgtagatctgaccccagcgtttgaagaaatctataaaacttttcatgtaaataatgaggtgtatcccaatgagaatctgacttttgcgaacacaagggcacgtctcagaatgcttacactttattactacgggcagctgaacggacttcttgtttgtggaacaggaaataaagtagaagacttcggaattggtttttatacaaaatacggagacgggggagtagatgtttctccgattgctgatctttataaaactgaagtatatgaactggccaaggggttaaatcttatcaaaagtattcaggaagctattcctacagatgggctttgggacacggaaagaacagatgagcagcagattggcgcgagttatccggaactggaaaaaatccagaaagaatacggaacgaaaacggctgacgattacgaaggaagagacaaagaagttttcgagattttcgacagaatgcacaaggctgcgaaacataaaatggatcctattccggtttgcgatattcctgaggagtggagagcatagaaatagtatcatattaaataacagctatgaacggaaaaataagatcggttttttttatatgtctgggacttcttttcggaatgtccgtgatgtatgtctacaggaactttattgaagataaaaaagttcagtcagattctgtaaaaaaagaaacggtgaattatgaaagtacttcttccaatggaaattcatcttctcaggtttctattgatcagcttactgaagaaaaaacggtgatcagctatgtgaaacaaaatcacaggcttccggactattatatcactaaaaatgaagccagaaaacagggctggaatccttccaaaggaaatctttgcgatgtgcttcccggaaaagccattggcggggataaattcggaaacagggaagggcgtctgccggatggggaaaagtactttgaagcagatgtaaattaccattgcggcggaagaaatgcagaccgtatcatctatacccggaatggtgatgtgtaccttaccaagaaccattataaaagttttgaaaaacagtaatgcgtaaatagcatcaggtcattgcttcgtcgctaagcttctcgcaatgactagtgcataatttgtatttaaggggtgataagtcgtaattttgaaaaataaagtattgtatgagcagttcctgaaaattctgcaaaaaaatgcaaaacttttttaatcaataaaattggaaatttagttcaatatgaagacagtatatatagattttacagacataggtgattatgaagatttttacagccagctcaaggaaaaaattcagcttcctgaacattttggagataatcttgatgcactttttgataccatcaccgggagtctggaaatgccgctccatttagaattcgtcaacatgactgtagatcagcttgagatttttgaagacctgctgactactctggaagatgctgaagaagaagtggaagattttagtttcagctattatctggagcaatatgaagacgaagatgatgatgtagaatctgaagaataataaagtaagaaaggctgttccaatacaggagacagccttttttctatatttattctttgacttataaacctaacaggttttgaaaacctgttaggtttcttattttatttcactgtaacgtttattcaggactagccgatgtgaactttttgcttcacagcctgtcagagtttcaaacctggcaggaactaaaaatcaggtttcacctggttacaaaaacgtagaatcaaaataaaaaggaagcagatctttcactgcatgcacttttacaacctcttcattcatgcttgaaaaataaaggtcaatattttcattctgcttggtttcgtactcaattaagctctggcggcatgctccacacggaggaataggaggatttttttcatgaaattctttcggacctcccactacaaaaatcttttttattttcacattcggaaagttggcagctacccagaatagagtggttctttctgcgcaaagtccggaaggataagctgcattttcctggttgtttccagagtagatttctccgttttccagtaatacggagcatcctaccaaaaactgggagtaaggtgcgtaagcattttcacgggcttccttggctctttcaaataatttattttctatatcactcagttcactgctatttttaaaatattcgtaactgatctctatgtcttttttcatatattgtcaactaaaaaaggggggtaaaattagttctttttaatgaagtgggcaatattttattcttcccgtaaaaagttcaatttttttaatattaaaaaatgttatatactccaataaaattcagaaatgttgagttgaaaaacagatgggtaatgtcacctatgtgtatgtattcatgtgaaaacggagaggctaatgacttccattttgtacattatggaagcaggtcacagggcggtacaggtctgctgattgttgaagcaacaggagtggagcccaaaggtagaattaccaatcactgcatgggtatatggaatgatgaacaggcagaaaagctgcagagaatcgtagaatttgttcataaaaattcagaaagtaaaataggaatacagctggctcatgccggaagaaaaggttcaacatggaataacatacagatttccatagaagaaggctgggaaaccgttgcgccaagtcctattccttatcacccgaccgaaagaattccgcatgcactcactaaagaagagatcaaaaagcaggttcagcattttaaaaaagcagcaggaagagctgtaaaagccggttttgatgttattgaaattcatggggcacacggatatctgatccatcagtttttatcgccgctttccaatatcagaacagatgaatacggaggaacttttgagaacaggatccggtttctgattgaaattgtagatgctgttaatgaagaattaaatgaaaatacagccctgtttgtaagaatttcaggaacagaatatgctgaaaacggctgggatatccagagcagtgtggagctggcaagaattttaaaagaacacgctgtagaccttgttgatgtatccagtggcggaaatatccatggggcaaaaattcctgtttttgacggctatcaggttcctttttcatcacaggtgagaaatgaagcaggagtgaacaccggagcagtaggtttaattaccagaatagaacaggcagaagaaatccttaagaaaggagatgctgatctgatctttgtggcaagagaaattctgaggaatccttatattgctgttcagggatcttttgaaatgaaggaagactgtttcttccctcatcagtacaccagagccaaaatctcttcttagttcccggataactttcaaagcaacagcaatggatattgacgatttcatgtttacctgtcccagtaaaaaattcctgggagtagaatgcctgggatgcggtgcacagagagcaatcgtattggtatttgaagggaaattcgctgaagcttttcaaatgtatcctgctgtatataccttattgttgttttttcttacgctgggtttgagtttcatcgataaaaaaagaaaatacagtaatattttaatgattttggtaggtgttaatcttattattatgatcattggctacctatataaacattattaattaaaaaagagaataatgtaagtgtttgattttaaaagggaaatatagagcttgtctgattttgtattttgagttaaagcgaattatttagaaaaatttcaacaaaaaataaaattcattagattaaaattcttgctttgttttattgtgctgaattttagaaatgtcgtagaactactacaatttatgaatcagtgcctcaaaaactttttaaattagaacatgaagtctatctttgttacataaatcctatatcagggatcagtcgttaatgattaaaatttaagaatatggcaggaaattcaagaggaatcttaaaattcaatggaggtgaaggtcagaagttattaaagcttaactatagcgtatcaagatctacagacgtttcaggacgtgtggcatctgacccgtcaaacgcattgatcaaagtaacaattgaagcaacagagaaatctgatgttttagagagtttattaaacagcaaatataaacctacaagcggagaaatcaactttaacaaatctcacgaagaaggaacattgatctctttgaagtgggaaaacggatatgttattcagcatgaagtagattttgatgctattgacagcaacaatatgctgatcagctttgtagtaagtgctgaaagtatcacctatggaaattcatcttatgatgggctttggccaatgagctaagtctttcatgagccgtaaataaaagactgtccgtaataagacggtctttttttaccttagactatattctgcgggatttttgtttatatttttaaactcccgttctgccggataatcgtttagaaaattaatcaaatcactaaaaaatatgtcaaatacacctggaaactcacaagcggcgtcttttcgtccgacgcagaatgcagatggtatttccgaaaaccatcatacaggtatcaatcgtttggtgaaactttcccttgttatagaagggaaaattatcaagtactataaacatttcaagcttaaacaaagtaccagaaaacaccatgaattcacactgacactggcgcatgatacactgggagacagacaaacccactcattggaagaagctaataaatttcttggaaaaagacttacagcggttatttcctataaagatatagacaacagcccggaaagaacttttgtaggggtgattacgggagtaggattcagccaggaaaaaatgagcctgggaaatattgtgcttacaggatacagtcctaccatcctgcttgatggtgctcctcatattcagagctttggaggttcacagcctgttaatatcggaattattgcagacgaagtaatcaaacaggggattgataaaagccgttttgatatcagggttgatgccaataacttttctcagatcatctacagcagccagtatgatgaaactcactataactatctggcgagaatggctgaagcgtatggtgaacagttctactatgacggagaagttttacatttcggaaagttgccggctcagaataaacctattacccttacatatggaagcagcgccaatgatattaaagttgaactgaaagctgtacacaccaaacctcaattctatgggtataacagcaataaaaacgaaaagctgacttcaggatcaacgcccatcaaacacgtaagtgaccttgcaaaaacagcatacagccataacgaaactatctataaaacgccggctttgcaagtggctcctattaaagcaaccacacatcttgacgttgaatactctcagaaaagtgcttcaggaagtgaggcggtaaatgttttttccgtttcaggaaacacaaccgttccgtttcttcaccccggttgcgtagcagatgtgcagatgcgtaaacaggattctaatgaaacctcttatttcaccaggatcatgattacagaatcagagcacgagattgacacgataggtcattacaaaggaagttttgtgggaattgccgcagatacaggatttcttccaaagccggaatttaccattcccaaagctgagccacaaacggcaactgttatttccaatacagatccggaagggcagggaaggatacaggtaagatttgactggcagaccaatgataccactcattttatccgtatgatgagtccggatgcgggaggaacagatcagattacccaaaaccgtggctatgtcgctattccagaagtaggagatcaggtaatggttaattttgtacacagccatccggacagacctttcgttatgggaggaatgttccatggaggagttgccttgggaggaggtgttaataatcatttgaaatccattcaaaccagaagcgggatcagaattctgatgaatgatgaagaaggaagcgtaacgattctggatccaagcggaaatacctattatatggatggacaaggcaatatcagcatgaaagcacctaagaattttactttaaatgcaggtgataatatcaatatcacagcaggaaaagaaatttctataggggcaggagcaagcattaccagtaccgcgaatgacaacattgtttccatcgcaggaaaagatatgaaacttacggcttcgggagatattacagaaacttccgataccagaactgaaatgattgaaaaggaattcaagagacaatctgagacttccaatgaaatagcaggggaaatttccatgttcagcgagttggaaaatatgaccatgcaaagcggaaaaatcgtggaattcaacagtgctgaaaaatcaaaacttttctgatatggcaatcatcaaaacagcaaccaacctgcgcatcacagtaaaagattcttatcatctgagcgttggaaaaaaggttgaaaaaatagcaaagaaaatcaatgtggaggcacataaggagaatctggttttagcaagtaacaagaagattatgtcccatggccataagtaaatataacatactcattctttttattatatgctgtttctcattaacgaattgtcagaataaaaaaatggaagaaaaatacacatggctgggaaccgtttctgctccgcaggaatatcccatggaagtatatgaaggagcgattattgccgatgatttcacttatccctttgatgccatctggggaacacagaataccggctggggaaaagagggaggtaccatgaacgtgaccaccgaaagaatgaatgctcctcataagctggaattcacatggtattccttagtggaaaaaaaattctataccgggaaatgggacctggataaagaaaagatcaaaaaacttttggatgaagggtttgtagaccaggacaccaaaaagaaagctacttaccattcttttgtggtaggattggctccgaagggaagagtcgtattgtggatgaaaggtcccggaaaccagaaagaaataggtgctttccaggcacatgatactgtcattaccaaagaaaaagcatacgataatgcccagtacatgttgaaagaaggctttgcagatagaatgctgaaagacccgtcctacaaaacattcaagccggaagttcgtgagaaaattgaaaaagaaggatatcctgatgcagacatttataatgtgtacagagaaagatacaactggaaaccttccgtaattctcccggaaggagccacctggatcgatttcgggtttactagctataacggagaacaggaaaatctttttgatcagagtttaaaagataatacatacaaaagcagagctctaccaaaattctgcggtttttactggaaagataaaaacaacaacaggtatgcggtatggatagacgcttttgatgacaaagaaatatttgatttgtttcagaaaacaggaaaagataaaaacattgatctgaccattaaagtcaatgaagacaatacaaaggttttgatatccattgactctgaaaaagacaaacttccggtaacaaaagcaaaaataagagtatctcgaaagatagaagaataggtttcattcagtcaatttaaaaacaagaactatgcacaacaatcaatttggaagctatacaccaactgtatccaaagaggaggtactggatattaccattgggattttttttgacggaaccctgaacaataaaaccaatacagacgaaagaaaaaataacacggatgcccataaaaaacatggtgggaaatcatcagacaatacaagctacaataatgactggagtaatgtagcccgcatgtgggataactatgataaaaacttcggtatttatatagaaggtatcggtacacaggataaagaaggagatgctacactgggatatgcttttggaacaggggaaaccgggatcagatcaaaagtgagaaaaggctgcgaggaaatcgtaaaaaaggtgaaaaccattaaagcagaaaaaaaagctgataaaattgcagttcttacctttgatgtgttcggattcagccgtggagccgctgccgcacgtaactttgtatacgaaatcgggaaagcaaaatataaagccacttcacgcaccgtcgccaacgaagctgtttcggtgaccacctattcagatgatgacgggaaaagtgtggaggcagaagaacttccaaaatgggggcatctcggtcttaaactcgaagaagcaggattaaaagttgatgtgttgaaagtaagatttctggggatttacgataccgtttcttcctattcaaaatacctgtcaccaatgcccaatttcagtaacgatgttgaagaattaagcctgaatgacatcggaaaagcccagactgtggttcactttatcgccactgatgagcacagagaaaactttgatctcaccagagtacatatcggaactgaaaaaacattccccggtgtacactgcgacgttggaggagcctatgaaaacggacaggaaacgtgggaagaagttgaaacatcctggacaaccagttccaaattagaagcattaaaagcagaactcgtatcagaaggttggtatgaaaaagatatgctcaccattactcccggattctatttatcattgaggggaacccgttatctgctgaaaacttacagctatattcctctacattttatggctgagtacggcattgagaaaaatcttcctatcaccttgaaaaaaatgactgatgataaatactccattttgaatgatcagtttttaataggaataaaagaccgtctcagaacttatgtgatgggaaatggcaagccttatgccttcaaacattttaaagcgctgcgtgatgcttatggtggaaacgaagttccggaagaccgtcaggatgcttatcagaaagaagtaaaagaacagaacgatttgagattccttcgtcttcattaccttcactggtcagcaagaagagaaggaatcggtatggatccgagaccaaacagaacaagagttatccactagaatcaaattttaaaaagataccatacaaagaaagaaattgaagaaggaacatttttatgcagaaatataacatacataccgttcagaaagatgaaactttaaaaagtatagcctcactgtacggattggataaagacgcattaaaactcttccataacaaccattgcgctgttaaggacatgatcctgatcaaccttaacggacagaaagagctttttattccgagaactgcagttgcagataaaaaccttttggtaaaattcggaaaaggaaacagccttattcttcggccggaagcttcagtgcggagatacagtgtggtcattaccattgaaaaaggagaagataaaagcgaattaaaatatgaaacatctgttcgctggctgaaaacagaaaaaggaaatcatttttttgagatagacagaacatcaaacctttatctcaatgaagaagaggtgaatgaaattgccgatctgctggcttacagaacatctaaggttttatacccgttacagatcagtaccaatgaatatgggaaatttgaagccgtagaaaatgctgaggtgtttttaaaaagatggcccgctgtaaaagaagaactgtataaagaatttgaaggcgaaaccgtagacgaatattgcggaaagattgaaaaagtaatcagccggcctgaagccatagatctttacctgaaaaatgattacttcatccgtactttgttttttggaatataccaaagctatggtctggaatatagaactgagatgagaacaacctttcctgtagtagataatgctattgaacccggatatagaatcgcactggaaacagatccgctgaaaggagaaaccggcctgattactatagaaggatcaggaaagttatatgaagaaagagatattgatgactttataagaagatcgcccttttcattgattataaatgatgcacctgtaatgaatgaagaaggaacctttagactcataaactatatgaaagaagaaacttcacttccgaaatctctttacctggaatgcagtattatgctgcaggaagaaaaaaagatttcagtatcagtttcaggaattgatgaaaactaaattaccatttcactaaagataaaattaatatggcagaaaaacatattgtagtacagggagctctatgcaaatgccagttcggacaggttccggacaagctgaaagtacttacacaccaaaaagaatatgccaatgataaaagcgcttccaaaaaactgatcgttaccacgaaagaaattggagcagccacatttgaaaaaaatacattcggaaactgtaccaaaatgggtagcccgccgccgccttgcaagattatggttacagaatggcagaagttttatgataaagtacagctcagcaatggcggatatatcattgtggaagacagcaaggcagtatgtgccgttgccggtactccatgtattgagatcatagaccacgggcagcgggcggaagccagccagcaaaattttaaaaatgccgacaaagatgttcagcagcagattaatccgctggtggattccgaagaaatgtataatgcgcagccttcaggaggagggcaggatggtgcaatctaaatgataatacaatggcaaaaggtataaaaaaaataaaggttacaagtggattatattatcccaaaatgtctgtattaggacaaaggattaccataaaaccggaccagtgggtgtactttggcgttgaagagtggctgccgggcaccacagatgcagacaaaaagaaacctctgacctggatgagacaggacagcaacaggcaaaatattgtcaatcaggtaacctctgctaccgggtataaatttttaatagacaaacagtattgcggaagctatcacttttatattgaagccagcctttcaggagtcagagataaaaaaaataatacaggaatatttgtaagaggctggtgtgagcccaggattgtaagcagcaggtggtctatgcagaagaacagcaaaagcattaaaaacaataagaaagttgattatatttcctatggacataatgttcatctgaacctcatgacggaaggcctgaatggaaatatactcagtatcgagctttggaatcagcagaccgcaaaagcagacaaactggtatatacctacaataatgttcaggtcatagatggtgaagtcaatcttaagatagaaaacacctttgcctggatggcttatgtggacaacattcagaatgtagaggaattctatattaaagtaaaagatgtggcatccaaacagtacattaaagataagcttggtgatgatcttcatgccatctatctgaatgtaaaaaataaagtcgccactaccaacaccaacggagcccagaaccagacaccgactaaagtgtataagccggatgtcaattccgttagactcgaaccctgtaaatttgaagtcatcaagattactgaaaatgaaacaaaggacggcaaagccagcaacacaaccgttaaagtctttgataacgggaatggtgtcaaactgataaaatccgccgctttacaggaacatattcagagaactatctactataagtttgattctacagttattgataaagacggggaagacgtcctgaataatgtgctcaaatttcttcttgaacacaaagattccacaatgaatctcagtggctatgcctgcgttataggaaaagaaaattataacaaagggctttcgcaaagaagagctgatgttgtcaaaaaattctttgcagacggagggttagatccaagaagaattatctcagtaggaaaaggggaagtagatcctaccgatgataaaatgggaagagataatatcaaatacaaaaacgagaaagactacgaaaataaccgtagagtagatatttcatttatattcaatgcccatgatgcacagactatcagttatgaagtaaccgcaccaagtgtttctacaaagaaaaatctcgtcattgatattacaggttttcaaaccaatgaatgcttcagggacagtaaaggaaaacataaaaaacagaccctgatggtagacgtaggacaggcaatagataagggagacactgtgaaaacatttaatacacctacatttacatatggtgtatattccaacctttccagagttaacgcttttccagtggaatatatctggccttcagcatccaatccgaatcagtttcatttgcatgtgcatagctgccggtatttcagcaatgaaaaaagaactacagtactgatcaaggcttatccggatattaaatgggaacttgctcttgagtttttggtgaatgtatccaattataaagcagccaatatgccgcctggatctgtttatgcaaaacaccaggaaaaatccagacaggcaggatacaacagaatgaggatgaatgaaaccggaaaagttccgatttcaatagggctgggcatatctgccgaatgggatgcggggagagaaaagagaagttttaccaatgaatttgcagatagaatcaaactggtagccagaatgattgccactgcagtcaatattttacaaaatgcaatcaactatgcgcaaagtgcggcaaaagaaacagcaataccggttggtttcaatatcagatatccgaaatttacggttgtcggaaaatggtatctggaaagagtaaacgaaagaaatacacttagcgttattggtgaagtaggctttggatttaaacctttaattggagccgaagttgttattgatatattgggagcagccattgcggcggcttcgtatggagcaaccggaaacccggcagcggcaagaattattaataagtttcgtggaggattagaaaaattaggtgcttcagtaacctttacagcaacattttatggggagctggaaataatggtagatgccctgaagattgacagtatcaacgggatcaatatgcagggaaaaactaccattggaggaaaaatgggagccactattgaactcagtgtaagcgttgaggtaggaagagtaaaagggacaaaatcgaagcctattatgacatttaaagccgctgcaaaagcagattcttactttggtggagatattgtactggattctgattctaagggattattcatccagccgatcctgaaattttcaggagtagtactttcagtagaaatagaaggagaagtaggctggtggaaaagcaattttaaagtagaagaaaaagttataaaagaagaaactcattatttggaaaaaaaatatctaacttaaattgacttatgcataattttaaaaaaccattatattctgtatatccgagaatgtactgctcgggaaccatctacgtaaatgatgttcctgtgatagactggtacggagacgaaacaaaagaaggaggattcggaggagatacaatgatcaatcaggccttgcttcagagcggaaaatataaagtaaccgggaaaatgtatcctcgtttaggaaaaaatattttggatgaagatgatatgatgtccatcgatttcttctgtgcagagcttgataactggaaggcttcacgatttgcgtttcatcctaaaatagaatctccctgggatggtttgagtgacaatattaaatatcctcattttgaaataaaaggtgaaatagaagttgagctcccttttgtacttgatggatggcagaactcggtagatctgaaagacatcaaaaaagaagatcttttcagcgatgttttcaaatattatcaacagattagaacagcattgcaaagccacagtgccggaaagtatctggaaatgtcacaggataaaatgaagctgcaggaacaggctttatactatacagaagaacggaagaaaagttttttggaaagtgcaggccaattatttgcccagaatttagaggtggaagaacttcatgaaggagatctgcagctcgagatcatgggacatggaaaattagtaaggttgatgaaaaaagatggctcacaaccattacagtttaaaagtccggatattgaaaaacaaagcaatatagaaatggaggtgaaacttcatatgagaacaaaagaaaaaggtttcagtattatttaatcattgaaaatgacttttttaggatattttacagcagttcttgtcatattttcactctataaaggatatcaagttttcacgaagtttgcagccaaccgacagcagctaggaaaaaaaggaggccttctggagaaagtcttccttatttttatcatttcagtcattatgatttctgtcaatgcaatggcatttgtactttcatttacttttttttgggaaaaggcttacagaacatttgatgagccgcaatatgtagcaactgttgtggggtataaaaaagaaattacaaagtttaagaacttttcaacttccacctatagagacaaagtgattttctttccgaaagtagaatatactgatgcaaatggaaaaaaagtaataaaaacactggatattacaactgattacccacccgctatgggacagaaatcaaagataacagataaagtagggaaagatagtacaaacacacttcagctggattgggtaatgtttgctgcaggatgtatttttacaggatttgcagcatttttcgcgtcattaatttctacatacaccacatcatattccatgaaaaaaagaatgaccttgtccttcaggattgcattattgcttattttcattaatatttcctgtatagtattcatatatttgaaatcataaagaaacagaagtatagttaaacggattatagtaatcatcaaaatataaaataatatgaaaaaagtaagagttctgatattgatctttgtagtattgatcaatatctgttgtggaaataaatcatttgatttgtcaacggtttcattaggtgatgatgcaaagaagtatgattttgaaaacaaagatctgtttctgaaagatgcagctaagccagacatcattcaatattatgctgatgaaaataaagggctgtcttatgaaaatattccattagataatacaatgggaacaagaattaccgtatacaaaggaaaagtaggtgctgtggacaccaatgctgccgaaaaatattctttggaatttgtagaaaaaatagtaaaaaagaatggaaatcctactgcttctattacagataaagcaactgtagatgctaagctggtaaaacctatttttgaaaagcttaaaaaactttctccagaaaaagtgtcatggaatcaaaatgagaaaaattcctttacatatcctacttctttcttctgggatgacgggaaaaattattccatattaagtatttctattgaagatgatgggagaataagaaataaatacatttctgtgacgaaagatgcatatcgtaataatgcagtttttggattgaaatatcctgcccctcctgcttctccatggtataagtatatgaactaaaatcttttccatagagaaaaaaaaatgagacatcattgacaagaaaaatactggagtaatattcagatatttctacctggttttagaacaaaatagatggaagtaaaaaagggaaaaccatacattgcatatagtattttaggaataatagctgcaggctttatttactttattctgtggattattttcaaagatagaatgccgctgcatgaatatgcttctgaaatttccaataactatgacagttacgcagagaaagcgattgttttttttcctttacttttttttgttttcatctttattgttttaatgaagcctactgcttcaaaacgttttttacgcctgcaggcgtcacttcctacttcaaagattcattctgtggcaaagggacttgcagagatagaaggaacattggtaatgaggaatcctttattctcaccggtgaataatgaagtctgcatcgggtattattataccattgaagatattgacagagattctgatggtaaagaaagttaccggacgatccacagagaaacgcaatgtaacacttttcagattacggatgataccggaacgatagaagtggaacccgaaggaattgaactggttttattaggcgaaacgaatataagcagccagggtggtaaaagatacaaagaaacccttataaaagacggtcagaaaatgcttctggtgggatatgttgattctaaaaacggaatacctttcatcagaaaagacgattattataaagttctcggaattacgtcatcatcaggaatcactgtgtggaacaaataccagccattgctgaggtcatttatgtttacctgttccatcatccttttaataattatttatatacttacacaataatgaatcagacggtcgcaatcatattacttattctattaggagtagttatcatcagctttttgatcaatctgtataacaagttggtgatgctgaaattcaacgttgataaagcctatggaaatatcgatgttgtgctgaaacagcgtgcagatgaaattcccaatctggtaactgttgcaaaacattttatgaactatgaagaaaagattctttcccgccttacggagctcagaactttttataataacagtacggatgctgataaaagaaccgagattgctaacgagacctcaaaagcgctatcttcattctttgcggtttcagaaaactatccggaactgaaatctaataataattttcttgaactgcagaaagggatttccgatctggagaacaaaattgctgacagaagagaattttttaatgacagcgtgaatctttataatattggaattcatgaatttcccaatgttatattggcgaaaatgttaggatataaagacaaaacgttactggaaattacaaacgaggaaaaacagtatgacggggttcagttttaatacctttttcggattggaggacaaaatagttcaaaacccggagattgccattttcggagcgatgttcattcctctgttattgtccctcccggttacagtgatgggatggatattcagaaagcttaaattcaatatgtatatcattcatgtactattgtatacactgctttttacatttatattcggagctatcaccatatttgtacttttttttattacagacaaaaatggagtgaagctggcatattgctggcttatggtatttataggaatgttctttttcagcctgatcaatgccaataccattaccaaaatgtttagcgattggtctaaaataattaaagaaagacagaaacaggaactttagaaaaagatgaagagtatgaaaaaactaagagttctgatattgatttttgtagtattgatcaatatctgttgtggaaataaatcatttgatttgtcaacggtttcattaagtgatgatgcaaagaagtatgattttgaaaacaaaaatctgtttctgaaagatacagctaagccagacatcattcaatattatgctgatgaaaataaaggactgtcttatgaaaatattccattagatgatacaatgggtacaagaattactgtatacaaaggaaaagtaggtgctgttgataccaatgctgctgaaaaatactctctggaatttgtagaaaaaatagtaaaaaaacatggaaatcctaccgcttctattacagacaaagcaaccgtagatgccaaattagtaaaaccaatttttgaaaaactgaaaaaactttcttcggaaaaagtatcatgggatcaaaatgagaaaaattcctttacttatccaacttctttcttctgggataatggaaagagttattccatcctaagcatctctattgaagatgacggaagaataagaaataaatacatctctgttactaaagaggcttatcgtaataatgtggtatttggattaaaatttcctgcccctccggcttcttcatggtataagtatatgaattaaaacagtcagtaaaaataaaaaatattttccagatacttgaatcctgttttttctgtttattattgataaccggacactaacactaacattatgaaaaaactgaaatatgtattaataccagtaatctgcctgagtcttgcatcatgcggccagcagaaaaataaagaaagtgagtctttggttgaaacagcgggaagtacccagactgaaccattcaatcttgccaagctgaaagcaggacaaaatatcaacgatattttaaaatctgccggcgcaacagaaaaagaagctgtacgcaccaatgaagttactcttatcggaaatgaaagactggctttttcatcaaaagaattattacatttcaatgggatagatctggaaggcaggaacaataaaaatacaaataaagtcattttacatttcggaaaagtagaccatgaaataggcccgcttgccaatgaaaaagaagacgaattagggatgtatcagctcgatatctatactgaacaggaaagaacagcacttctggaaaacctaaacaaaacattacataaaccgagcttcgattctatacacgaagggtttgaatcagaagtaaaagataatgagatcattcagactcataataagttcagacaggaagtagcgatctggaaagataaagatatgctttactattactgcgaaaccaaaatagataacagaccggacgaataccgctgcaatctgtttgtattcaaaaataaagaatggaaagaccttctcaaaggatccggatatcccgatctggacaaaatctctttataatattcgccttattaggaatttaaaaacaaaaaatgccggtcttcttcagaccggcattttttatatgatactaggatttcaattattttacaaggaactgcattgtcacctgatcaagctttaaaatataaattccctgaccaagatttctggttttgatagaatttccatttctgaaaggctgatcaatcgtctgaagaactttcccctgaagattataaatttcagctttctttaccttctgaagatctccttttacaaaaatctcctgattagtaaccgggttcggagaaattttaaaactctcagaagtagtttctgcagctgtattttgaaccattcttgcactggatcctgaatagcatgtccatgaaaggtcatcaatagccactctgttacttgttgaattgttaacaagacttaccactacatttccggaaatgttgatattactgatggttgtggtgacagcagaagtactgtaaggaatagttcccacggttgttccgtttacttttacgtcaaaagtaccgttagttccggtaaacttaagctgtgtcgtcaccgttaaagaaccaataccattagcagaacttccggaagttaaagaaccgtttcttaccgttatagctttattattaagagtctgatccgttcttgaatccgttgcagtccatgagataccgccattgctccatgttctggtagaataagtagagctggctgccggaatcgtttcaaaagtttcattggcacaactggttggtgtagtgcttcctgcattggttgtaccggaaactgtagaactgtttgatgatgaatttcctgccgcatccttcgctaccacataaaagctgtaagttgtagaaggagtaagccctgaaatggttgttgaagttgaacttgttgtcgtttgcagacttccgttcatgtaaacattataagctgttactcctacattatcggtagaagcgttccatgtcagagaaatactgccagacgtttttccggaaacagttacacctgttactgtagcaggcgcttgggtgtcaccggaaggttgctgggaaccccagataagattgacataattcggattatcaataaacgggtttctgtttccctggaaagcataagaggcattatttcttttgatttcagcctgagaaaccggatcctgattatgccatgcaagcaaaacattcagctcccatgtctgtaatcccggaaatgcagaacttcctaacatatttcctgatgaaaaagtagaaagcttgctttggtagcgggttacaaaatagaaaatcatacgggccacatctcctttaaactcatcaattggctcaaatactgtccctgaatatcctgaagaagcagaagttccaagttttgaaccattctgtgaagtaaaagaagcacttcccacctttccgaaaggataattacttctcattccgtttactttcccgtctgtagctctgataaagtgaatatcggcaaccattggagaagcctggttgaaaagactttgaggaacaatgtgctctctgttataacaattcccttcagtagaataggtaccacactggtcagatcccggagtataattataagggtcaacacctgaaggtctttctgaataaatatccaggatcgttccgtcattttcgtagtccttgtcaatatcggtggttttatatcctgtccaaagcccattgtagcctttatcaacatgtccgttagtgataatgctgcttaattcagttttcagtgctgcgccacttagtccgttggcagaattgtagtaacctgcaggagcctgtgcatgggcaagtcctgcaaataaagaaaataaaataatttttttcatattaattaatataagtctcagcaagaataccacatttttgtgaattaaaaaattacaaaatcgttaattttaaatgcactatatgtaatgcataatgagtggtaaatgataagtgatgaatgatgaatgatgaatgatgaatgatgaatgatgaagtttcgtgtgagattcagtttttgtattttgaattatggcttttctataatttatcctttacttcaatattggatattcaataggaccgggctttagcccggtttaaaataaaccgttttcctttgctttatccgaaactataaataatagaagactatatccacggttatctgtgcaaatctgtgctatctgcgggataaacaaaaattacccataagccgtactttctatgaaataaaccgttttcctttgctttatccgaaactataaataatagaagactatatccacggttatctgtgcaaatctgtgctatctgcgggataaacaaaaattacccataagccgtactttctatggtttatcctcaatattggatattcaatagaggcgggctttagcccggtttcaaaataaaccgttttcctttgctttatccgaaactataaataatagaagactatatccacggttatctgtgcaaatctgtgctatctgcgggataaacaaaaattacccataagccgtactttctacggtttatcctcaatattggatattcaataggagcgggctttagcccggtttcaaaataaaacgttttcctttggctttagccaaaacttaaataatgaaagtaattttcaacaatcatccgtgcaaatccatgtaatctgcgataaaaacctctgccattatcccatcaggaaattcctacttataagacatgaaaaagccggtacaaaagtaccggctatatataatggatgacttaaatttattttctttgtggcggataatttttcataatctcagccatgatttcaggaatctgtctctgttttgcttttggagaatctacagaaatcccgcttccgataccctgccagactaatttgttggtttttgcatcaataagatctacaattaaagctccttcattataatttgttgtccatgttctgttcatgccaacaccccatccgaatggtccgccccatccccacattccgtaaggtgaagacgagttgatatcagtaatctttttatgatttgcttttacattgataataagatcaggattttctccggactgaagtcctttgctctgaagctgtctcgacagttcgttcaatactctgtctttatcaatatcattcagttttagatcatcaattcttattttataggttttgtaagaattgaaattggcggtttcagcataatcggaacgtacctgaaaagggctacaagaagttaagcctaaagtagcagatgccaacaaaataaaaatatattttttcattttatttattttttttatcacttttaatgaatgtatcagtctttttatcgtacccgtaaggacagtgtctgcagccgcttttacagcaatagcctcttttcagatggaatttttctgtaaaaaccttgtacccctgttcattatagtagaagtcttcaccttctttgatgtcatattgggccataagttaaatgctagtcaaaaaactttttatatttgttactatgataattgtatgccaaaagcctttaaaaaaattaaaaattaatggcatcgcgctctttccctttatcttcattaggaaacccgaagataaggaaaataatgtattgatcaatcacgaaaaaattcatttgcgtcaacaattggaaatgctcatcattttcttttacatcttctatgttatcgaatattattattggttcttcaaacttaaggacggctatctggcttacagaagaatttccttcgaaaaagaagcttacgcaaatgaaaacaacctgaattatctaagaaaaagaaaattctggagcttcaggaaatacctttgaaattataaatgatgaatgatgaatgatgaatgatgaatgatgagttgcgtgttttcgggattcgcggtgtggatctaggtttggaaatctgggctgggatttggttaacgatcacaatattcaataggagcgggctttagcccgtttatcaaaacaatctaaattcatccggctttagccaaaacttaaattaaatggtccttatcttattatacaaaattcgtacatacttaacacgatcatctgtgtaaatctgcgttatctgccgagaaaaaaagaaaactcacacaacactaaatcttttcctaattttgcaaagaataatcttgagtcgtaaaactgaaatgctattaaaacttcccacagaacctgttcctatccaggaaattcccattcagaaaaatattaaacttttcattaaaagggaagatcagattcatccgttgatttcaggcaacaaatactggaagctgtttcacaatgtcaaccactatctggaaaaaagtcctgataatccgtatattattactttcggaggggcattttccaatcatattgcagcggtttcagcagtagggagcctggcaggtattccaacactgggaattatcagaggagaagaactgcagcataaatggcgcgataacccaaccttactttttgcaaaaagaaatggaatgaacctgaaatttgtcaccagggaagaataccgtcacaaagaaaaactgacagaattccttcagcaggagttccctgaagctttgatagttcctgaaggaggaaccaataaagaggctgtaaaaggagtgaaaatgatgctcaacgaacaaacaaaagattttgactatctttgcaccgcagtcggaaccggaggaaccattgcaggaatttcaaaattttgtgaagagaatcagaaagttataggatttaaagccgttgacgatgcttcactggagaataaaatttttgaattaactttaaagcataattttgatctaatagattcatgttttggaggttatggtaaaataaatgacggaaacgtccgttttatcaatgattttaaagaaaggtacggtattcctttggagccggtttatacaggaaagatgatggagaagatttttgatttgatcgaagaaggatattttcctgaaaacagtaagattttgtgctttcacactggtggattacaaggcattgaaggagcaaatctgctgttggaaaaacagaatagaaatttaattatataagtaaaattgaaaaacatgaaacacttagtgttccatctttcattttaaaacaataaaaaatataagatgaaaagacttttcctatccataagccttttagttttatcaaaattttcagcccagacttgggcaaccgaagatcagtatattcagaagtttgctaaatatgccgtagaagaaatggaaaaatataagattccggcttctattacccttgctcagggattactggaaacagggggcgggcagagcaggctggcactggaaggtaaaaaccacttcggcataaaatgtaaagaagactggaccggtaaaacgatgaaacataccgatgatgcacccaacgaatgcttccgtgtgtatgaagatccaagacagtcttatgaggaccattccatatttttatccaccagaaaatactatgcaaatcttttcaaactggatatgaaagattacagagcatgggcgtacggtttgaaaaaagcaggctatgctaccaatccccgttatgcttcaattcttatcactaaaattgaaaagtacagactatacgaatatgacaatacgaactccaatgaagtattgtacgccgttctgaaaatgtatcctgatctgaaggatgacagaacgtttatggcacagctggaaccttcaaaagctggtaaaaaagctaaggaaccggttaccgtagaagttccttacaaacagacttcttatgcgcagcagcaaaaaagagtggaaagaatcaaaacgaaagctgaaattcttaattccattcttatcaaaagccatccgaatgacggcctgaaatatatcattattcctgaagataccgatgtgaaattcattgctaacaaattcaaggtcagcgaaagcagactgatgaaatggaatgagctggaaagtgaaaccttgaagaaaaatgacatcattttccttgaatctaaaaattctacaggaaatacagctacttataaagccgaatacggagaagatatgcatgatatcgcccagaaattcggaatcaagttaaataaattgtatgctaaaaacagaatggatgaaggacaacagccatccgcaggacagcttatttatttaatagataaaaaaccacgaaactaatttaatttttgttgagagtttaccgttgacaattacatgccaacccgcagctgtcaacagcaacgaagtatatatgaagtatcaaagaagttcggctttgtttgatgaagcctacaaatacattccgggaggagtcaattctccggtaagagcattcaaatccgtaggaggagtgccagtttttatgaaatcagcaaaaggtgcttaccttactgatgtagatgacaatacttacatcgattatatcaactcatgggggccggctattttaggacatacacatcctgaagtactggaagaactgaagatacaggcagagaaaggattctctttcggagcacctacagaacttgaaacagaaattgcaaaattcatcattgaaaatgtcccgaatattgaccagatcagaatggtttcttcaggaacagaagcatgtatgagtgctatcagactggcaagaggatatacaggtagagataaaattgtaaaatttgaaggctgttatcacgggcattcagactcattcctgatcaaagccggaagtggtgctgccacgttcggaaatccaaattccccgggagttactgcaggaacggcaaaagatactttattagcccgttataatgatattgaacaggttcaggatttattccgtcataaccagggagaaattgcagcggtaattatagagccggttgccggaaatatgggctgcgtattaccagaaaatgatttcttacaaaagttgagaaaaatctgtgatgaaaacggagctttgttaatctttgatgaggtaatgaccggtttcagattagcattcggaggagctcaggaacttttcaacgtaaaagcagatttagtgacttacggaaaagtaatcggtggaggacttccggttggagcattcgcaggaagaaatgaaattatggaccaccttgcaccaaaaggtggagtttatcaggctgggacattaagtggaaatcctttggccatgagagccggattaaaaacccttcagcttattaaaaatgatcctgaatttttcaacagattagagaagacaactgaaacattggattttgaaataggaaaaattctgaacgaaaaaggaattgctcacagaatcaacagaaaaggttctatgatgtctgttttcttccatattaaaagtgtttccaactttgatgaggctcaggaagctaatcattcattgtttaataacttctttcaccaaatgcttcagaatggagtatatcttccgccaagcggttatgaaacttacttcatcagcgatgccatcaaggataaagaaattgatatgacactggaagcagtaagaaagtttgagtattcaaataaataaatataaaagaccggattttacatccggtttttttgtgcagactgatttgaattggaaagtctgcagtataacctggattcctacggaatgacaagcgttgcgggatactctttgttgtagtgtagaaagataaactgagtctttttagcaagtaatcaccacaaagcataaatcatacagattttgtaataaaccatacactttgttcagaacacttctttttaattttgccataaacagattggaaatgaagacctcagaccctaccatctcccgcaaggattttatccggaattcagcattggctgttgcgggcttgactttaatacctaatatcatgaccgcatcacctttttttaatgaaaacaggatttcagcaaaaggaaaaatgagccttaaaaatgttcgtctggaaactggttttgcatatgagaatggagaagtggcttctaccaaaacagacctgttctgtatagaagttgaaaacgggaaaattacaaagatttccccaaatcagccagatgctaaagcagtagatttaaaaggattgttaatgcttcctgcattcagggatatgcatattcatcttgataaaactttttatggggagcggtggcaggctgttagaaaaaggaacggtggagtgaaaggaatgatcgaactggagcagaaaatgcttccggagatgcttaaaaattctactttcaaggctgaaaaattaattgaattgttgcagtcgaaaggaacttcctttgcaagaagccatgtaaatattgagcctacttccaaacttcagtcattaaaaaacctgcaaagggctttagaaaataaaaagaaaggatttggagctgaattggtagcttttccacagcatggggtgttttacacggattcagcgccttatttgaaagaagcggcacaaatggatatcgattttatcggtggggtagatccgttcaacattgatggagatattgaaaaagtagttgattttaccgttcagcttgctacagatcataaaaaaggaattgacattcacctgcatgaaaccggagattccggattgaaaacggtagaatatctgattaaaaaagtaaatgaaaatccttctctgaaagggaaaacctatttaagccattgttttgttcttgggaaattagaaaccgtaaaacaagaagaaattgctgaaaaattagccgatgcccaaatcggaattgtctctacaattcccttcggaagactgatcatgccaataccaacactctacaaacataatgtcacggttcttacagggaatgacagcattgtggatcactggaatactttcggaacaggaagtgtccttcagaaagccaacttaatggcccaactgtatggatattcaacagaattctcattatcacgaagtttaaagctggcaacaggaaatatccttccgctggatgataaaggaacccaacagtggcctaaagccggagataaagcagattttgtactgatcaatgccagctgttcagcagaagcggtatcaagaatttcagaggtggaatcattggtacatgatggaaatgttgttttttaattcaaataagaattaattaaataaagatataaatataatctagttgtgttttttttgaccacaaaaggtatagaagtgaatgcggactgaaactaatgtaagagtgaaggtaatgcttttatccttttgtggttatttttagttttctctcacaatttttagtaattttaggagaaaatcaggcagagtgggttatcatacagatcattttccggttttaggaattcaggaattcagcgagaatcagctgaagggctgtaatctgttatttaatgaactttatggagcgcgttctattgatgagccccacaagcatgacttttttatcatcaatctttttgagcacggagtaggctcacataccatagattttacagaatatcaggtgaaagactatcagattcatcttgtttttccagatcaggtacatcagtgggtgattgaaaaagaaactatcggatatcagctgatgatcagcagagattggtttgaaagttttctgccgtcgttgaggttttcagcttcttattaccagaaccatccggtgatcaatctttccaaacaggtctttgaaacttttctctatgaattccgggccattcagaaagaactaagcggggaaaaaatattttgggaactgattcagaaaagaagtgaaataattggtttgctagtgagtaaatccgtggagggtgcttataaagattttgaagtctataactcgaatcctattatttcaaggtttctgcatcttattgacgaacattttaaaacggaaagatcagtttctttctatgctgaaaaactaaatatttctgccaactatctgaatattgtctgcaagaaaagtctcaatgcttcggcttcttctctcatccagaaccgtattttactggaggcaaaaagactcctgaaagtttctgaaatgtctgtgaaggatattgtatatgacttaggcttctacgatcatgccagtttttccaaattctttaaagcacagacggggatgacaccttcccagttcaaagaataatctgtacaaaacaagacataattgatacaccggttttaccttcagcacgggttaattttgtattgttaaaatttaaatcatgcaatttccctatcaattaactgcaaaaggaaaatataccctgaaaaatgtccgcctggaaactggctttgaatacgaaaatgaagaggtcattggaacaaaaacagaccttttcagtattgaaattgaggacggaaaaataaaaacagtgaaagctaatgatcactcttctgaagctattgatgctaagggatatctgatgcttcctgcttttaaagatatgcacatccatcttgataaaacattatatggacttccgtggcaggctctttctccaaaaagaaagacggtaaaagatatgattgcttatgagcagcagatcattcctgagttgttgaaaacttctgtaagcagggcagagcagctgatcagcttactgcagcattacggaactcattttgtgagaactcatttcaatattgatcctacttcaggattgaaatcactggaacatcttgagcaggctcttgaaaataaaaaagattccttccaagctgagctggttgccttcccgcagcatggtgtttattatacagaatctgcacctttgatgaaagaagccgcacaactgaaaagtgtgaaatttattggagggctggatcctttaagtattgacggcagcattgaaaaagtaatggattttacggttcagctggctttagatcatcataaaggaattgatattcatttgcacgaaacgggagagtcgggaatgaaaacaattaattacctgattgataaagcaatcgaaaatcctgagcttcagggaaaaacatttgtaagtcatgcatttgccttagcccatctttcaccaaaagaaacagaacagattgcagaaaaactggctgcagcaaaagtaggaattgcttcttccgtgccttttaaaggaaaagtaatgcccattccaaccttgaaaaaatatggggtaaatgtattggtcggaaatgataatgtacaggattactggagtacattcggatccggaaatatgttacagaaagcgaatctgattgctgagctctatgggtacgccacagaatatgcgttgtcgagaaccttacagtttgcaactcaaagtattcttcctctggatgaaaaaggaaatcagcagtggccaaaagcaggtgatgaagcggcaatcgttctgacggatgcttcctgttctgcggaagccgtttccagaatgtccgaaataaaagccctgatgaacgacgggaatttattctggagaaagtaattgaagtatatattttttatacacttgttttttttaatgccatcagagactttctggtggcattttttgtagtcgcaggtatcgagattacgcgtttcggttttcgagtttggattcgggttttttgttttttttttgttatcaataggaacgggctttaacctgtttatataaaaacgaattcatccctctggcttttgcttaaacatatcagcaaacatctgtataaatctgtgtcatctgctgtaaaaataactgttcatattgctattccagttttttcaatatgaacacccgttcacattgaaaccggcaaatttttataacaccagggaataatgaataaaaaagccttcggaaaaatgttccgaaggctttttaaatttaaatgaaattaatctaactactatattgttttataagttgaagttggtccaacctgcataccatgtatctgtagcatcttttacagcacctttgtaggttacttgtgtaaaccaggtagccaatttaggattagtaaatgaacctccggttaataatggagaacctgcagtaggcgtgaagtttggtgtagttcctgctggagcccatgcaccggcaagttttacatcagctgtagaagcaaggattgtatttcctttagcattgaaccatgttgtaagatctgccaatgtatatgttgtaggagtagatgtagatggtccgaattttaaaggagttgtatttcctgccaatacgttgttttcaaagaaaagtttattacctacaatattgttatctgttggagaaccttttgtagcatcgatgaataaaccaacagggaatcctgtaaatacagagttgaatactgagatagaagagtttcttctgatctgtaaagcattctggaataacgcgttgatagaaccaggagcagcagagttgattggcccgataatcgtcatgttagagaatgtagcagatgtctgaggcgctaaagtagaaccgttggcatcattatcagattcaaatgcgttggaacctgaaacgtccgctacctgagaatctcttactgcgataccaaactgtacatttcctgaaaatccgttatctgtatcgaaatcatcatcaagacctttataagaaataaggtgagaacagtttaccgttcccccgaaccactcaaagctgtcatcatttgcataagcaacttctacataatctactgtagttccgttacctacaccaccgaaagtaagtccgttgatctctttatccggtaagaatgcatatcctgcatattcaattcttacatattttaatacaccactgttgtcagctgcatttgttcccccataaagtccaagaccttcagagttgttgattcctccttcaatttctccaactccgtttgcaccaccgaaagaggcgttggtaggagcgtttcctaaaattactacacctgcccagtctcctcttttaggacttggtttttctgaagtgaagataatagggttggcagcagtaccttctgccatgattttacttcctcttgtaatgatcaaagcaccgtttttatcagcttcacctacaatctttgtacctggctcgatcgttaaagttgctccgttagttacatataccagtcctctcagcttatagattttattggctttaagtgttgtattggaagtgatttttcctgaaagaataagattttcagtttctccgtttccgttacctccattttgaataatggtaggtccatcttcttctatatttctacatgcggtagttgatactaaagcgccaagcattaaagaatataaaacgaactttttcatgttataaagaattaaattatttttattagattatttgttgagtgaattaaaaattgtatcccagtgttaaactgatattggttcctgtaagtctttcaatggcaagagcatctttgctgtcatacttaccgttgtcgttcaggtcatggtagaatttggcacgacggttcaggatatctgaaacattcagcttgatctctcctttgttgctccataattttttagcaagctggaaatcaagaagaggtcttggtgcttcccagattggtggaacctggtcatttcctacatacaggattcttcttccgatcatattgaatagtactgtagaagaccatcctgatttctcagtatcatactgaaggcttacgtttaccgtatatggagactgcccttgcattggtctgtcaatcttggtagtttcgtcagttactctgtttttgattaatgctacgtttccacccagcgtaaagtttttaagagcacttacaaaatccagtttttttctggcttccacttccaatccgtaagcatcagctttatctacattaagataattaaaggtgttactggttcctacccctgattggttgaaatataattcgataggctttttgaagtttttatagaaagcagctactgagaaaatctcaccgtttctcgggtaatattcccaacgaagatcagcactcgtgatttttgttctttcaatagatttgttaccaattacggttgctccaaggtcaaaatcataataagctaaaggtgaaacctctctgaattctggtcttacaacagtttgcgaacctgcaagacggatgttcattttaggatttaccttgaatgttaagttaacagcaggcaggaagtctgtaacacgtgtatttacaaaacggtcatcgcttttcttcgtgcttccaaccaactggtcaaagttttcaactcttaatccccaaaccgctcttaaccatggtgtaaagttattgtcaaactgtaaatatcctgcgttaaggattgtattggcaatatatctgtactggtttcctgcaatttcatcgaatgtaaatcctccgttagttccaaaattctgaggattgaagatcgtttcaaaaggctgggaaaggagtccctggttgaagttttcaagtcttacagagaacggtcttgaattatatattctgtcttttacctggaacaaataacctcctttgatcgtttgcttctgtccgaacattgtaaatgtcttggaaacatcacctccggcattatataaatagtcgcttagcgtagaatagaatacacttcctgacttttgggaaagaccattggaaatcaatgctaaataaggacttcccggcatgttggtatattggttatactgcaaacgctgcagcaaaggaatatactgatcaagaatcccgaagcttccgtaccagttgatggtcaatccgccaagagcatcaattttatggttaccgctaagggttgagttgtagaaagtagtttctttaaaaccgatctcccttgccatgatgtttgttccgttgataggatcaaattcaaagtcctttcctgttctgaaggacatgtggtttaccgtattgttggtaatgatattctttaaggaaattttgttgttgttgttcagctttaaagcaaggttcaacattccccctaaaataatatcattgctgtatttttctgtaaaataatcgaagttggtatcagcaagctggttgttgatggtaaagaaacggttggtagattcagttcttcttttgttgttactgtagtttaaaacagcaattacccctaaatcttttccgaaaatttttgtattaaaaccaccgtcaagctgtaagcttaagttttccgggtaaccgatactgttgtaccccaagttctttgtataccctttaccgatctccgttttttgtgcctcggtcagaatgctgaacgcattttttgcaggcatattggtaggaagttttctataaccgtcatctatacctaagaagtcccattttccgcctttctgcatatggaattcctgtcccatagtagctgtgtttcctcctacacctacctgaacgttgaagaagtttttattaggaatatcctttgtatttacctgaatcaatgctcctccccattcacctgtatattctggaatgaaagttttgttgataacaagggtttcgataacgttggcagggaaaaggtcaaaagagaaagtctttctgtcaggttccgtactggatagctgaataccgttcagcatcgcctggttataacggtcagataaacctcttactacaatatattttccatcaaataaactcacccctgaaactcttttcagaacttcaccggtgtttctgtccggacttcttttaatcgcttcaacaccgataacctgagaaactacaccggcattcttttgtaaaccgatggtagaggctatggtttcttttcttgcatttgattttatgacaactccctcgatttctttttctttggcagatggcttatccagaacgatatcaagatgcgtgttaccttcatttttgataacgacctcgctgatctcttttctgttatacccgttggagcttaccgttacaatgtaattggtaccaggggaaaggttgatagagtagtatccggaaatgtcagtggtaacttcctgaccatttacttttacttttactccttctataggagtgttgtctttctcgtccaataccctaccttccagaatctgactttgtgcaaaagcatagccagcagaaaacaaggcaagtagcataatgctcttgtggagttgttttttcattttacttcttttacttctttttcaagggcaaaataaaggctaagtttttaagaaaactttaggagaatcttaattaattatgaagtttgtattaacggataaatgaattttatagttatcgatgtttaatttatataattataatttttgttttaatgttaattattattccttatattcgatttgtgtatatataattgttaatttttttattgattttataatttcgatttaaaatactattttttaataattagttaacatttacgggatagatgaaatcaatggaaataattaattttgtgggaattcttaaactagaagatgagcaaaaaaattcttttaatagacgatgaactggacattttagagattctgtcttacaatttggaaaaggaagggtatgatatctatacggctaccaatggtaatgaaggtatagaaaaagcaaaagagattgttccggaccttatcttattagatgtcatgatgcctgagaaagacggtatagaaacatgtcaggaacttcgtaaagtgaaagaactacaaaagacacttatcgtgttcctttctgcaagaagcgaagaattttctcagttagcaggttttcaggcgggtgccaatgattacattgtgaaactgatcaaaccgaaaattcttatctctaaagtaaatgcattactacagctgacctctcaggtttctgacaatgctaaactcatcgaaatcggagaccttgtcattgataaagataacttcagagtttccaaaagcgggcagcaatttcttctacctaaaaaagagtttgatttgctttaccttttggcttccaatactgagaaggttttcaaaagagaagagattctggaaaaagtctggggcaatgatgtgattgtaggagaaagaacgatcgatgttcacatcagaaggctgagagaaaaactgggaatcaatacgattcagacattaaaagggatagggtataaactgatcgtttaattatttaaaaaccttaactttacgttcaatcattaaaacgttgtaaaattgaaattttacagacttaccctcgttgcctcctgtctgctgacactggtaatgttccttttggtagtcgtattcgattcactgaaagatatctattatgagacccctttgttcaaaacgggtcttttcatctgtattgtcctgatcttcctgatcaactgtgtagtgctggaactgcttttcaattattatggaagaaagcaggtaaaaggtctttccggatttcttccgcaggaaatcgtacagaatcaggacgaaaatattaccatcaaagaattaggcgaaaggttttcagatcttaaccagcagcaggtatcagagattgatatgatgaaagagatggaaagctaccgtaaagaatacatcggaaatgtttcccatgagcttaaaactcctttattttccatccagggatatgtggaaaccttaagagacggcggagtggacaaccttaccatcagagataagtatctggaaagaattgataaatcggtagaaagactgattgccattgttacagatctggatatgatcaacaggctggaggccggcgaaatcaatcttaccgtttcgaaatttgatgtcaatcttctgatcaaagaaatcttcgaccttcttgaccttgaagccgaaaaaagaaatacaacattacagattcagacccttcatccacagatctttgtggaagctgataaacagaaaatttcacaggttttcattaaccttatttccaacgccattcattatgccaacagacaggaagcaaaagtgattgtaaaaaccagtatcctgaaaaataaggtgctgatagaggtgatagacaatggaatgggaatcaaatccgaaattctcccaagaatctttgaaagattttaccgtgtggaaaccagcaggagcaggagagaaggtggctccgggcttggtctggctattgtaaaacacatccttgaagcacacaacgaaaacattaccgtagaaagcgtttacctggaaggtacgaagttcagttttatgctcgaaaaaagtaaataattccggcaaaatgtaagaaaaaaaaatattttaaaaaatcctgaaatatttttttgtcacatgtcatttattatatatttgcaacagagatttatcataattataaaggcaaaaaagtaatttaagaaactgatatggtttacaaaatccgcgtaatattagatgcgaaagaggatattttccgtgatgtcgaagttaagggaaaacaaacgttatggaacttacatttaggaattaaaagtgcattcagtctgcagggagatgagctttctacttttaatctgttggaagatgacggaacgatcgtaaaaagtgtcccattggaagatatgagtgatgatggtgatggcgagatcatgtcagatgtttacattgatgaggcttttgaaaatgtaggtgacaaagcacagttccagtatgggcttcttgatctttgggagtttttctgtgaacttgtagaggtaatagaagaaacaaaaggggttaattatcctataaccgtatacagatttggaaacgttccattaaaggctcctagcaaaaacggaggtgccggaggtggcaaaaagaaatcagcaatgccattggtagatgatgaattcggttttgatgacgatttcgtagcaggaggaaactttgcagatgaagacgacagtttcgatgacgaggaagaagaagactacaatgatgatgtctttgatgatgaggatgacaatgatgatgaaagatagtcagcacaatatacaggccccgggttttgacccggggcttttttatggccaaataaagtgaacggccattctgcttttaatgattttggctttttacccttttaccccaaaaacaatccttacttttgttaaaaatagtttaatgaaaaaattaattttgttagctgtaattggtctgggaattgtttcctgtaccactcaaaaaaataccagaaggatgacagaactgccaaaagattggaaacataacacaaatatctacgaagtaaacataagacaatatactcaggaaggaactttcaaagcctttgcaaaagaaatgccccgactgaaatccatgggagtaaaaacactttggtttatgcctgttactccgatagcgcaactgaataaaaaaggaagcctgggaagtccttacgcggcagcagattatacctctgtcaatccggaattcggaacactgcaggattttaaagatatggtgaatgaagcccacagattgggattcaaggtgattcttgactgggtagccaatcataccggctgggatcatgtgtggacaaaaacacatcctgagttttatctgaaagatccggatggtaaatttcatattgcctccggaatggatgatatcattgaacttgactacaaaaatcaggaaatgcgccaggcaatgattgatgccatgaaattctgggtaagggaaaccaatattgatggcttccgatgtgatcttgcctcttgggtggaagttgatttctgggagcaggcacgccccgaagtggaaaaagtaaagccgcttttctggctgggagagtttgacgaactggaaagtccggagtacggaaaagtatttgatgccagctattcctggaaatggatgcataaatctgccgactattacaaaaataatgaaccacttcaggaactgaaggatctgttgagacaatattccaatatcggagatgcttcaatgagagcatggtttacgacaaatcatgatgaaaactcatggaacggtaccgaatatgaaaaatacggagtgatcacaaaacctatggcagtattctctgcaacatggaatggtgttccgttattatattcaggccaggagcttccgaatatgaagagactggaatttttcgaaaaagatgccatcaaatggacaaatacctaccaggttgctgatttctataaaacattattagatttaaaatcatcaaatcctgcattaagaggaggagatttcaatgtgaccacctatcttcttaatacaacagccaatgacaagattctggcttatgtaagaaaaaacgggaaagatgaagtattggtcgtcctgaatatgtcaaaagaacccgttaatttttccattgaagatgagcacctgtcaggaacattcagaaatgtttttgataagaccagaagggacttcagtcatggaaaagacttcagtttcaaagtttctgactatgtcgtatttgaaaagtaagcaataaaaatctctgaacttccggttgaagcaataattattaacaattagtcttttagggtactcatttcccttcctctggaggggtggcaaaatcacagatttttacgggtggtttatctgccctacaataaaaatccaccattacaatgaacaaacaggaaataatcaatattattaaagcgaaagcagctgacaaaatccagtattttgaaaaccttatcgcagaaacacgggcttccaataatgacaccaaaagctctatgggagacaaatatgaaacaggaagagaaatgcttcagcaggaaatcaataatctgcagagacagctcaacgaagtattgaatcagcaggctgtattgcagaaaataacttcagattcttcggagaaagttcagaacggagcattggtgaaaaccaacaaaggattattttatatagctgcttccatgggagaaattatgtatgaaaaacagaagattatgacggtttctgcagaatctcctttagtaaaggcgatgtttggcaagaaaatgggagagacatttaccattaacaatattattcaggatattgagcatatctggtaaatcaatcttttaataatatgaaatgtaaaaatctacttctccttgcctttttactggtaggtctggtgttcaatgcacaggttcgtgccaccgtttcgtcaaaaacatatgatctggaaacagttaaatttactgtagatggctttgtgtttacacttaatgcagacggatcaattgctgattttaatgctcctgatctgaatggtaagctggaatactatgatgaccaggtttttgataaagtaaaatatgggaaacttaaaagcattggaaacgttaaagtagattactgggaagattctgcattcacgaaggaaaaagccggtaagttgaagagcttaggtaatatttcggtagactattgggaagattctgcctttacgaaggaaaaagcagggaaggtaaagaaaataggtaatcttgccatagattactggccaaatgatgtgatagataacagcaggctgggtaaactgaaaacaataggaaatatctctatcgactatggaacaaaagatattattgatgaaagtaaatttcagaagcttataaaatttggcccggttagactggattattcaaatgatagatttattgataaaaacagatatggccaattaaaatcaatcaatggaaacaatgaagaaatcagcgtttccgtattataatatttcagctgtttaatcgcttgaaaatataatgtttacactcatttaatagaaaagagatatgcaccttataaaaagcatccataggttgggtgctttttttttattaaatttggaacttaaaatctcattcaaaaatgcaaaactacctggaccttttacagcatattttagacaacggaactgataaaaccgatagaacaggcaccggaacaaggagtgttttcggatatcagttgagatatgatttgtcaaaaggatttcctttggtaaccacaaaaaaagtgcatttaaaatctattatctatgaactgctttggtttctgaaaggagataccaatatcaaatatcttaaagataacggagtaagcatctgggatgaatgggcagatgaaaacggcgatctgggacctgtttacggggcacaatggagaagctggagcggtgctgatggaaaagtagtagaccagatcaaagaagtaatcgaccagatcaaaaagaatccggattccagaagactcattgtatcagcatggaatgttgcggagattcctaatatggctttggctccttgtcatgccttatttcagttttacgtagcagatggtaaattatccttacagctgtatcagagaagtgcagatgttttccttggagtaccgttcaatattgcaagctatgcgttgctgctgatgatggtagcacaggtttgtgagctggaagtgggggattatgttcacagctttggagatgtccatatctataataatcactttgagcaggtaaacagacaactcgtcagagagccgagagcccttccgaccatgaaactgaatcctgatgttaaaaacatttttgatttcgatttcgaagattttactttagaaaattatgatccacatccagggatcaaagctcctgtagccatttaatactcttatatcactttaattttttattacttctatttattttacattaatagaggcattgtctatgcccataagctggaaaatcagaatataaatactttagcataccttcttttggcaatagtttcttaaatttgaaagaaacaaactcggttcattcgatagatccattgaccgttatgagatcaccaattcaaatgctaaaaataaatcatgaagtatttaaaaatcaatatagaagaaaatgcagatattgaagcgctgaaaaatgctgtacagcagctgaaaggagtggcttcaacagaaatagtggatgacgaaaaccctgaaagcgagctcaaaaaagcctttgctaaaacaaaagaacagcttaaaaagggagattatgaaactttagtcaatgatattttcgatataatcattaaaaaataattctaaaaaataaagtagaccgatgagaaaggccattttatcaattgctatactgggaattttattttccgcaaatgtatcagcacaaactgaaacttcaggaagggaaaaagtatacagagctacccataccaaagtgacagaactaaagcataccaaactgaaagtaaatttcgattaccagaaagaacagatgaacggagaagaatggcttaccgcctcaccttacttctatgcaaccaacgaacttactcttgatgcaaaaggaatgctgattcatgaagtatccctcgataataatggcaaaaaatctcctttaaaatacgaatacaaagacgatattctgaaaattactctggataaaacataccagagaaatcaggattatacagtttatatcaaatatacagcccgaccgaatgaggtaaaacaacagggaagtatggctattaatgatgcaaagggtctgtatttcattaatgctcagggaacagagccggacatgcctacacagatttggacacagggagaaacagaatcttcttctgcatggtttccaaccatcgataagcctaatcaaaagaccacacaggaaatttacatgacggttccggataaatacgttaccctttccaatggtattctgaaagaatccaaaaaagaatccaacggacttagaactgatcattgggtaatggataaaaggcattctacctatctgttctttatgggagtaggagaatatgccgttgtaaaagacaaatggaaaaatattccggttgattattatattgaaaaagaatatgagccgtatgccaagcagatctatggaaatacaccggaaatgatcgactttttctccaaaaaactgaactatgattatccatgggcaaaatatgcccagatttccggaagaaattatgtaagtggagcgatggaaaatacgactgcaacactccacggaagcgatattcttcaaaagcctggacagcttatcgatgaaaatacttgggaagataccattgctcacgaattgtttcaccactggtttggagacctcgttaccgcagaaagctggagtaatcttacagtgaacgaatcttttgccaactattccgaatacctttggaatgaatataaatacggaaaagaccaggcagattatcacctgatgacagatgtgaataattatctgcataacccagccgattttaataaaaacctggtaaggttcaattatgaatcccgtgaagatgtttttgacctggtgacgtatcagaaaggaggtggaattttaaatatgctgagaaactatctcggagatgatgccttctttgccggaatgaacgattatctgaaaaccaatgaatatcagaatgcagaagcccaccagctgagactttcttttgaaaaagtgtctggtaaagacttaaactggttctttaaccaatggtattttggaagtggaaacccgaagattaattactcatctacatttgagcctgtgaaaaaacaggttgctgtaaccattaatcagactcaggaaaaaccatttgaatttcctctggctattgatgtttatgacaatggaaaacctaaaagatacaatgtctgggtaaatgcagaagcaaaaaatacatttaattttgatgtttctaaagctccggatcttgttaatattaatgcagatggggttttactggctgatattaccgataccaaaactccggaacagaatctgacgcagtttaccaactctaaggaatttaaaagcagatacctggctttaaccggaataaaagatcaggttggaaaaagccctgccgcaacaaaattgttagctgctgcactgaaagatcctttcttcagagtaagaataaaagctttgaatttaatagaccttaccaatcctgaacaaatgaaagcattgggtgctgaagttgaaaaactggcttccagtgatccgaaaactttaacccaggccgccgctattacagctttagggaaaacaaaagacaagaaataccttccattatttgaaaaaggagtaaatgctgtttccaatgcagtgagaggaagctcaatgagtgcgattcttaccattgatccgtcaagggcaaacagtctggctgacaaaattgatatgaaaggtgcttcagaagaattgcaggcacaactgcttcctgttattgtgaagaacaggattacttcccagatagaaaatattgcgcctcttgctactttttatccgtttattaaattccagaacccggaattaggaaaagcggcagaagacggtttcaactggatcatgacttccgataatctgaaagctacggaaagtatcacaaaaatagcaggatatgccaaaaatcagatggcggataatccacaggctaaaatgatgatggttcagatgctgaaagatggcctaagtaaaaaaatggaactgctgaaacagaatccacagaacgcagtaagcatcaacaagcagatagatgttctgaataaagctattgaaaactataaataaaagaagcagccggtaaatttaccggctcccttctttttattgctgaatactaaactgtcagattatcatttaaaatacattgatttttaacgatgttataaaaatcagtactttttcctgttgttttttgcgttatctttcataaattcgttcaaaatttagacaattatgagttttggaattgaagcagcgggctattatgtgcctggtttatatttggagattaaggatttagcagaaaaaagaggaatagaaccggcaaaattggaaaaaggcttaggtcttcataaaatgggactttctgatgtccatgaggatgctgcaacctttgcagcagaagcattactgaagcttatacaagattatcatatcaatccgaaagaaatagcaagagtgtatctgggaacagaaagtgctttggatgctgcaaaacctacagcttcctacgctgtacagatggtagaaaaagttttggaggaaaaatttggaaccagatgtttcagaaactgtgatgttcttgatatgacttttgcctgtgtagggggagtagatgcattgcataatgctctggattttgtaagagtaaacccagataaaaaagcagtcgtaatcgccagtgattacgcaaaatatgaattggcttcttccggtgaatatacgcagggaggcggagctgttgctcttctggtttcatcaaaaccagatctgcttgaaattgaaaataactggggtgttgcttcagaaagtgtttttgactttttcaaaccaagaagattgtataaaaaggaagatctgaacggagctccggaaacttaccctgaaaaaattgagatttttaccgatgaacctgtttttgacggacaatattccaaccaatgctaccaggacagaataagagaggcttaccaacattataaagagataacaggaaaggaaaagccttatgaaaactgggaatatattattttccacttgccatatgcctttcacgggaaaagagtatttactgaaatttacagtcttgagaacaatctttcctatgaaacggtagaggaacagaaagcggttgccaaatccgaaagctatcttaaattaatcaacgataagattgaaaaaacacagagagcttcttccgaaataggaaatatgtacacagcatctatatttatggcacttctttctgcgctgcagacagcttttaatgaaaatgaagaactttcaggtaaagaaattggttttgtagggtatggaagtggttcaaaatcaaaggtttttgcaggaaaggtttcagagaactggagaaaggtagtggaaaaatggaacttattcgaaagtttgaaacaaagaacagctgttgattttgaaacttacgaaaaactccacagaaagcaattgaacctatctgtaaataaagattacaaaggcttcgggttggtctctgtagaagcagaaaaccctgttttaaccggagcaaggtattatagttatcagaattaagataagtgaaatttaatatttaaaggcattccattttgggatgctttacttttttattaatataatcatgcaggaatattttgtgaattttacagttgtattatctttaattttaatggtaaggcaggtaaaaaaatacaacaaatgtttgcggagattccacaggctttaattgaatttgatatataatatattaacagttttttgaatgaaatcccacatatgcatcacgaaacaggaattctccgattgcagaggtctgttttttatataaaatttaagaaaaaggtctgtttttttctccatttctgccaaaatcaatacttctttttgtttatattttacgttaatatgtggaatttaaatttatttttttaactatttattttaaattgctgtatattgattttaattttaaaatttattaaaattccgttaatatataaattaactcattttttgttaattttttaaatacaattaaaatgattttccatcattttttgcgtatggatgtaaatctctcctttctggaagcctgttttcagcatttaccgaattgatgttatagatatttatcgacatatttgtcgcttgaatatattaaaatctgttaatatgaatgtgaagttacatgtattaagtgcaggagctttgttttttttaggacaagctgcttttgcacaaaaatctaagaatgattctgttctgaaggagaataagatcgatgaagtaatcgttactggataccagaagaaaaaagcagatgaaattacccaggctcaggctgttgttggtggtgatgaaatcagaagaaactctcctacaacatctatcgggaactctttacagggtagagcttcaggggtatttgtacaaagtacaacagggcaaccaggtgctgctgcgacaatcttggtaagaggagttgccggtgtaggtggttcttcggaacctacttacgtagtaaacggaatgtatatgactgctagacagttcagtgcaatcaaccctgctgacgtagaatctatttcaattcttaaagatgctgctgctacagcacagtatggtgcgagaggagcaaatggggtagtagttgtaacaactaaagccggaaaggctggaaaaactcactactcatttgaaactaagtttggtttcagtgaaaagctgagagacaaaaactacacgatgatgaactcaagagagttgatggattttcagaatcaattgggataccttggatttaaaccacgatctcagcaggaaatggataggcttgcggcttatgatcacaactggcaaaaagaccttttgaagccttcaagcattcagtcttacttattcagcgcacaaggtggttccagagagagtactttttattactctttaggttatgactctgacaatggaattatcagagatatagatggccttaagagatatacaggtaactttggatttacgaataaactgagtgaaaaacttaacgttggtatcaacattggggttcagtatcaggaaacacagaatttcagagacagaaacaatacacagaacccatttggagcaatgtataaatacgctccatatgagccgatttataatgcagatggaagttataaccagaccatgagagcaggttctaacgttgttgagcagatccgtaattatagattagacgatcagagactaagaattccggtaaccttatttgctgagtataaaattattgatggtttgaagtttaaaaccaacttcaatggtctttatgattggtacatgggaactcaatggctgaaaaaaggttcaaacttggatatcaccgttaataaagttcctacaggtgcattaaataaaaactcattctatacatttaactatacctggaataactccattaattataaaaaatcatttggaagccataactttgatttcttaggatttatggaatacaatgataacttcaacgaaacaatgaatgggggtgcctatggattgaaatcttctcaattaagtgttccttctattacaacgccttctgatagaaatacatttactggggttaaaacaagaaatactctatttagtttagcgggtctattaaactatgattatgctggtaaatacttggtaactggatcattgagaagagatgcttcatcaagatttggtgccaataaccaaagtggtgtcttctggtctgcaagtgctgcatggaatattgccaaagaagatttcatgaatggaggctttattaatgatttaaagcttagaggatcatatggtacaacaggtaatgatggaacactgccggattactataacgtaaccaatgttagctatggattatatggttctaatggagctttatatccgggaacatccagcagttttattattggtaacgaaaatcttaagtgggaatctaatgcaattactaacttaggggttgatttcacaatgtggaacagaagaatccgtggatccgtagaagtttacaaaaataagagaaaagactttgtacagttagtacctttggataaacaggaaggaggatattaccaatatatcaatgcaggagatatgtctcagaaaggtcttgaggcagaattaagtgttgacgtgatcaaacaaaaaaatttccagtggaatttacatgctaatatttccttccagaagtcagttcttgataaattagcaaatgggcagacagaaagaaatttaggagatacttatcttaaggtaggtgaaacaccatatgtattctacaatgttagatttgctggggtagatccaagtaatggtaacgcactatactatgacaaagcaggaaacattactgatgtttacagtgcttctaatgcagttccacttactgataaatctccattcccaaaaagttttggtggatttggtactaccgttcagtacaaaggacttgatttcagtgcagactttgcattcaaattaggtggatatacctataataacatgtacgctgctgctgttgatccaacattggctgttgctggtagaaatatggcacaggctgctgctcaggtttggcaaaatcctggagacacaggagtattccaaaaagtagactctaatggtatgcgtgactccgatcagtggattgaaaaatcagattatctaaggttgagatcacttactttagggtatacatttgataaagcgttccttggagaaggatctccaatcaacaagcttagagcatatgtacaaggacaaaacttatttactgtgactaagttccacggcgaacctgaagtttcagtaggatctggtgaatctacggcattatttgtacctggctcatataacctttatacttatccagctgtaagaacaatcttggtaggattgcaattagaattttaatttttgaatagctttatgaaaaagaatataataaaaataagtttagctgcgttaaccatgtttgtttcgttaacgtcttgcgatagaaatttagatcaaacatcttcaattaatgaagaacagaaccaggcaatgaccagacctgaatcatttagacaggctatggatggagcttatacagctcttaaaggagtaggatactataatggagatactggtaatcagcttatcatgggtgatcttactactgataatttagttcgtacggcttctggtagaaataccaattctgcagcatctaatttcgagttttcttcagataactcacaaacaacaggtttatacagtgccgcttatcttgtagttagtagaactaattttgttttatcatatatcaataacggagtgttatcaggtactcaaaaaacaaatattgaagctgaagcaagagcattaagagctgcagctcattttgatattgtaagagcctattctcaaattccgactcaatctgcaggagctaaaaatgcaacgggaatttattattcagaaaactataatccttcgaatacaacatcatctagaaatctaactgttgatcaggtatatgataaaattatagcagacttattatttgctgttgataatatcacgcagaatgatgcggataaaggaagattaagcaaagctgccgtatatggattgttgtcaagagtaaacctttatagaggtgattatgccaatacaatcaaatatggtgagttggcattggggctttctccaagtattacaacattggataactttaccagaatctggaaagaaaacgaaggtttatccagaattacagatggtgttttgttccaggtatcaaatgcaccagctgaattgaatacagtgggagttgcatataaccagtctgtaccaagcattagatctgaatttgttgtggattatgatctatatactgcttatactgctaacgatatcagaaaaggagcttactttacgaccagtacatatagtggacaaaaatacaaccacgttacaaaatatgctggaaacggagggccagccaatattgtgccgatcaagtatcttagatctgctgaagtattattgaatattgcagaagcatattacagaacagggaatggtgcacaggctcttgttttactaaacaagctaagagctgaaagatatacttcatttacacctggtacagaaacaggacaggcgcttttagatgctatcttgaaagaaagaagactggagcttgcattcgaaaacgacagatggtataccttaaaaagattagggctttctgttcagagatcaggtaaaggagatctttttgacggtacaggaacgccggctgttgcacagaaccttccagccggaagcttaaagtggcaatggccaatccctatcactgctattcaggcgaatcctaatattaaacaaaatgatggttactaatcattattaaaaataaccccggagtttttacttcggggctttttttatatagactgttttatcaccattctgtcctgataacttttcggagttactccctccagctgcttaaatactctggtgaaataattcgtatctgaaaatcctgtctgaaaagcggtttccttgatgctggtctggctggccaacagctcttttgctctattgattctttcctgtaaaataaaatcattcggagaagttcccagctcatctttgaacattttaaagaaattggatttgcttacataagccagcttcgcaatactgtcaatcgacaatttctggtgcaggtttcttttaatataatccactacaaaacctattctggatttattcttaacaatatttttttctaccatgcttcttgcctgggtctgcatcagtctgatcagaagttccttcagtgcaaaatcggccatgatatccttttgagaattatcatccatagcaattctcataatattgttagtagcagaagcaagcgctttattattaaacagaaaatactcatccagctgaatattccattgtgaggcttcatccactttgggaagatgataattcagatagttgagagaatcttcaataaaatcgggatttaggcttaaagaaatacattgtgtaggtgtttcatcagcctccggaaaatcaatgaccatggtttcccctggtgctaccagaatgctttctcccggataataatcaaaataactggttttattatccagcttcatgtgttttttacctctcagcattgctgtaaatgcaatattttcaaagtgcagtcttacgtcaaaagcagccttgtgggtctcataaatattgaattcacaattgtttagattgaacttcgtctggttttcaacaagactcaatagttggttttccttacgtaattcaggagtatttaataaaatcttactattgttattcatttctaaatttttttctaaaggaggtaactcaaatatagaaaatttgacagtacgttgctgttaataaaatactaaaattaaacccgctgcactattttacactttttttatacgattgtgctatactctttcaggcttctcagtgtaatttggcattaacgaaaaataaaaacaaactaatatgagcactattacagaaccaagatctgcgacacttttacagcgtcctcagtttaaaaacagatatgataattatatcgacggaaaattcacgccccccgttaaaggacagtactttgatgtagtctctccggtggacggaaaaaactttactcaggtggcccactcttctaaagaagatttggaattggcagtagatgctgctgcaaaagcatttcagagatggaagaatacctcatctacagaaagaagtatcatcctgaataaaattgcagacaggatggaacagaacctggaataccttgcaacagtagaaaccattgataacggaaaggctgtaagagaaacattggcagcagatttacctctggctattgatcatttcaggtattttgcttctgtgattcgcgccgaagaaggatcacataatgaattggacaaagacaccgtttccctaatcgttcacgaaccgcttggcgtgatcgcacaaatcatcccatggaatttcccgatactaatggctgtgtggaaactggctccggcgttggcagcaggaaactgcgtggtcttaaagccggcagaaagtacccctgtttccattatggttttaatggaactcatcggagatcttttacctgcaggagttgttaatattgtcaacgggtttggagcagaactcggaagagcccttgtaactaatccgaaagtcgctaaagcagcatttaccggatctacagcgacaggacgtctggtaatgcagtatgctacagaaaacatcattcctgtgaccctggaattgggaggaaaatcacctaatgtcttcttcaattcagtaatggatgcagatgatgaatttttagacaaagctatagaaggagctgttctttttgcccttaatcagggagagatctgtacatgtccttcaaggttgctggttcaggaaggtattgcagatgcttttattgaaagagtgattgagagggtaaaagcaatcaaagtaggaaatccgctggacaaaaccgtgatgatgggtgcacaggcctcacagattcagaaagataaaatcctttcctatatccagctgggaaaagaagaaggggcagaagtgcttgtgggaggtgatgtcaatcatctgggagaagatctggaagacggatactatattcagcctaccatcttcaaaggaaataacagaatgagaatcttccaggaagaaattttcggtcccgtactggcgtttactactttcaaagacgaggaagaagctgtgaaaattgccaatgataccatctacggactgggagcaggagtctggacaagagatgcgcatcagctgtacaatattccccgtcagattgaagcaggtagggtatgggtgaaccaatatcattcttatcctgcaggagcacctttcggaggttacaaacaatctggaatcggaagggaaaaccataaaatgatgctcgaccattaccgtcaaaccaaaaacatgctgatttcttataacaagaataagctaggtttcttttaatattatttaggacgtgcccgattgccttggcttttcccagggcaaacggtcgggctatccagggctgcacttcgtttcattccgcaccggctcgttcctcgccgcccttactatccttcacgcaggaaaagtacctgtttagaaatgaagatacaaactaataattccaataactcaatccaaaaaagaaaatatgatcccaaagacaatgaaagcggcggtagttcagggctacggccaacctttaaaaatagaagaggtacccgtaagagaacccggcagatatgaagttttggttaaagtaatggcctgtggagtctgtcatacagacttacatgctgtggatggcgactggcctgcaaagccgaagatgcctcttatccccgggcatgaaggtgtaggtattgtagtcgcatgcggacccgaagcttttgtaaaagaaggagatgcagtaggagttccgtggctgtacagtgcatgcggatgctgtgattattgtatcaccggatgggaaaccctttgtgaagcacagaaaaatggaggttatagtgtagatggcggatttgcagaatacgtcattgcagattcaagatatgtgggacatttgaaatctgatgttaactttttggaaattgcccctattttatgtgcgggagtaaccgtttacaaaggattaaaagaaacagaaacaaaacctggtgaatgggtcgctatttcaggaattggtggactgggacacgtggctgttcagtatgcaaaagcaatgggaatgcatgttgctgccattgatgtagcagataataagctggaactggcaaaaaaattaggagcagaccttgtagtcaatgcaaaaaacacagatcctggagaatatttgcataaagaagtcggcggaatgcacggcgcattgattactgcggtttcacctattgctttcaaacagggaatagatgtgctgagaagaaaaggtaccattgctctgaatggcttgcctcccggctcttttgaacttccgatttttgaaacggtcttaaagagaatcaccgtaagaggttccattgtcggaaccagaaaagatttacaggaagccctggattttgccaatgagggattggtaaaagctaccgttactcctgcaaaactggaagatatcaatgatgtattcgataagatgaaaaaaggacaaatagatggcagaattgttctggatattgccggctcaaattaaatgatgatgtgttgtggttcccggtaaatattttaccgggattttttatacatttttaagttaggttcactctttatcacattaaatagaaaatggaaacaaaaatatcaagactttcagcaactgagcaggcgcttgaagtaattcgtacacttgaagaacaatacggccccctgatgttttatcaggcaggaggatgctgtgaaggtacccagccgcaatgtttcgaaaaaggaggattttttcccagaatgaacgacgccatgatcggaactatcaatggacacgaattctggatagatcgtgacctctttgaatactggaaatattcacattttactctggatgtggcagacggcttcgggcccggaggattttctctggaaactccattaggaaaaacctttaaggttcattacaggcttttcactcctgaagagtatgaaaacctggagcctgtaaagcgtagtgaataagataaagatttaaggcttttgagcaatatagataagctctctttcaaattcatatttgcctcttgaaattcctctttttaaaatgaaatattgactaattcctattactaatgcgattattgcgagcatatgatcctgtcggtctccttttatactgacaaaaacggcgcccaagcaaaaacatacgatgacgatccagttaaaaatctgaaatcctgatgggaaaaattctataaccacggatgatttaccgttcttatcagaaatagttccatgaaatataggattgcttctgtttatgtcaaataatcttgctcttcttttgattgtaaagctgttgccatcaatcattccgcggtattcaaaccgtgtgggaattgtagcatctttttccagtgatatgaaagtagtattggttttataagtgactttcattaatctctgtatgagttcagtgctgttgatatcgagatcaacagtgagactgttatataagccaatgcttttgagaagtgagttcaagggttaatagaaaatagttaaatgtaatcagacttttacaaacctactgacaaacatagccgcgactatgtctcccacagcattcagcactgttgctaaaggatctaccaaagttccaatgatcatcaccgcaggaatggcttcctgaggcagcttataaacagaaatcatcagcatttccccgatgtatccaccattaggaattccgcctgcgacaatactcacaaaaacggttattcccaaagctaaaagcaggttggcagggtcaaagaaatctcttccaatgatcaggaaagccacatagatcttaatgatagaagacatggatgatccgtttttatgcagggtggttccgatgggaattaccagattggcaatagaattcgggatccctatttttgatgcggcctgtaaattggcaggcattgttgcaaaactgctgcaggtgcttattgctgttaaagtagggtagatcgcattcgtccaaaagcttttcactcctttttgtccatttgccataaacgcataaatagagaagaaaacaaggaagtaaattatccctgcaatataatatagccccaaaggtttgccataaaatccaaaaagctgaggtcccaaagttgctacctgataagcaaaataagcccctaatccaatgggagccagcttcataaccaatagaaggagctctttcattacttcatatccggaggcaatgaaaaccctgaacggtaacccgtcttttcctgtctttcttgctgcaaatcctgtcagaaaagcaaatacaagaagagccagcatatttcttctggaaaaaagctctgtgaattcccctactgtaaagaaacttacaattctgttgccccatgtatcctcattagcggcttcagaaataatctcagaacttccggagattcctgaaaccgggaaaagataaactgcacaaatagtgaaaacagctgctgtgagaataaagaataagaaagtaagcgccatcacaaggatgatctttccgaatttggactgctgttccaaggaggcaatagaattggataccgcaaaaaataccaaaggaactacacttacaaaaagaagattaagaaaaatatcacctaaaggttttatatattccacaaagctgggagcaacaattccaatgatgcttccaacaatgattcctaaaagtaaaaatatgattccggagtagtttttcaatacatctttcatgtagagcattttatcaaagataggtttatttttaacattctgttatacaattttcaaacctaaaattcataaatttgagtaaacctcatttctatggcttatatagattattataaaattttaggcgtagataaaaacgcaacacaggatgatatcaaaaaggcctaccggaaactggccagaaaacatcatcctgatttaaatcccggcgataaagaagcagagaagaaattcaaagagctgaacgaagccaatgaagtcctgagtaatcccgaaaaccgtgctaaatatgataagtacggagaacactggaaacatggcgaagaatacgaaaaagcccagcagcaacagcaaagacagtatcagcagcaaaactataacggaggattctccggtgcggattttggcgaaggagaagatttttcagatttcttccagagcatgtttggtggagcaggtggaggatttggcagaagttcaagaggaagggcctccggaaaattcaaaggacaggatatacaggcagaactgaatttaagcttaagagatgccgcaaccactcaccagcagacttttgatatcaacggcaaaaaagttagaatcaccattccggccggagtgtatgacggacagcagatcaaactgaaaggacatggaaaccctggcgtaaacggaggacctaacggagacctgtatattaccttcaatatcccggcagatccggattttgaaagaatcggagatgatctgaaaacaaaagttgtgattgatttatacaccgctgttttaggtggagatgtaaaagtacatacccttacaggaagtgtaaatctcaaagtaaaaccggaaactcaaaacggaattaccgtaagattgaagggaaaaggttttcctgtctataaaaaagaaggtgaacacggagatctttttgtaacctatgaagtgaaactgccaacgaaccttactgaaaagcagaaagaactttttgaacaactaaaaaattcataagctatgagtgaaagaatatcacgggaagaactcgtaaaaatatataatatagaagtcactttttttgatgaacttgtagattatgggctgctgaacattcagattgaaaataatattcattacctgatgtatgaagaccttcctgatctggaaaaatttgccaactggcattatgatcttgaaataaatcttcccggtcttgaagtgattaataatatgctgaaaaagctggatgctctgaagcgcagaaacagggaactgatgaataaactttctgcaataaatgatcaatatgaagatatttaatgtagttttgtagcttttaaagcaaatcctacaattatgaatgaagaaaaggtgattaccctaaaaccggacagaaagacttttgaagatatttattttagcggtaatcagggaagtctgcttttttcacctactacaaaaagtaaaacgattgccaccattgcagcggcagttattgttttcatcgtttttctttttaaagatcttttaagtaaagaaagtgtaggaattttatactttttaagctttatttttttgctttgtgctgtttttctatcggtaagtgttaataaagtttcaagatggaagaaacaggtgaatcattatttaaatagcctggaaaaatgcaaagtgtatgaaatcctttttgacaagaacttttttacagtaaatatcgatggggaaaaagaaacaagtgaatggaaagattttgagtattttgacagtaatcatgaatttatttctcttgaaggaaaatacagttatatgtttcccagaaaagcaatgagcgaaagagaatacagtcttctcaaaaatatattgaaagagaaagtaaatatcaacccataaaataaaaacggagcaaaattatcttgctccgtttttattatttataaattagcttttttgccttttagcaattttgcttatttactttcttccagccatcccatttccttcatccattcatcattgtagatttttcctacatatcttgaaccgtggtcatgaagtaaaactacaattacatcatctttagtgaactgatctttcatctgaaccagtgaagcaatagcacttccggcagaatatccacagaaaataccttcttctttagccagttttcttgcgtagatagcaccgtctttatccgttactttttcaaagtgatcaatcacagacatatcatagttttcaggaatgatatcttccccgattccttctgtaatataagtgtatgcgtgatcataatgaagttcacctgtttcatggaattctttcagaatagaaccataagtgtcaaccccgattactttaatctccggatttttttctttaaagaaagttccgcatcctgtgatggtacctcctgttccggctcctactacaaaatgcgtcagctttccttcagtctgttcccagatttccggtgctgtagattcataatgagctgctctgttggataagttatcatactggttgacataccatccgttttccgtttctttagccagcctttttgaaactgaataataagaacggggatcagtaggctttacatcagtaggacaaacgattacttcggctcctacggcacgaagaatatcacatttttcttttgactgttttgaattggttacaaaaatacatttgtagcctttgatgatcgctgccagtgccagtcccattcctgtatttcctgaagtaccttcaataatggttcctccaggttttagtctgccgtctttttcggcatcttctatcattttaagagccattctgtcctttacggagtttccgggattgaaggtctctactttcgccaatactaatgccgggaaatcttcacctaacactttgttaagttttaccagcggcgtattacctatcgtttcaaggatattgtttgcgtatttcataatgttttatatgcggcgcaaagataaggcttttaaaattatctgcgctgtggataacatgtggataagttgtggataaaactgaaatcatctaaaagacaatcaataacttccaattatcaattatcaaattagttgtacttaatcgccttcaccggagaaattttactgatcaggtaacttggaataatcaaagccaatcctgatataataagaattccgactgaaatagatataatggcaattggattaaggtctaccggaacggtgcttacataatagttttccggattaagcttaatgattccaaagaatttctggattaaaatcagtcccaatcctatagcatttccgtacaaaagcccaggaatcataataatcagggtataattgatgaaggttgctcttatctgtgaattgcttgcgcctaatgttttcagaagaccaatagaatttgttctttcgataataagaatcagcagaaccataataatattgataaccaccacaatcagcatgatgatgatgatcaaagcgatattagtatcaaaaatgctgatccagtcggtaatctgcgggaatttttcagtcgctttttcagcgtaatttttgtaaccgatcagcttctcaatgtcaggaaaatctttgtcaatatcattaacgttcttcaggaagatatctataccgccgatttcatcaggtttcatatcctgaatttttcttgcatgattgatgccgccaataacaaattgttcatcaatgagcttgatatcagttctgtaaattccgatcactctgaatttacggtaaagtggtttttgatcggcttttaaaaatacggtaacaatactgtcatttactttaagatgaagatcattggctactttctgtgaaatcgcaacatcattgttgaaccctttctctgtcactttcggagtagtcccggcaataaggaattttttaaaccttaaactgtcaaaatcttttccgattcctttaaatatgattccggcgaaattgtgctcattacgcataattccggttactgttacatatttctgaatgctttctacatcaggaagttcttttatctttgcaatgtttagtccctgattatcaagaacagaagtattgtaagaggaatttgaccgtgtagatcttaccgtaatgtgtccgctgaaatctgccagcctctctttgatagcttttttggaaccaaaaccggtggctacggtaattaaggaaacaatgattcctagtgctacggaaagcctgccaatgaagatgataacccttgaaaggttatttttgttatctttggaaaatgctatttttctagagaaatataaaggaaatttcaagcttatgaatttagatttcaaaattaaaaatttacttctgatttgcctaatttttttaggagtattcaaccaatattattctcagactcaagttcaaccggattttaaaaccggtgcagatcagcctgaaatttatttgccattgctgaaaaacaaaacaataggaatcgtaaccaatcagaccggcttaatgagtgacagaactcatctggtggattttctggtaaaaaaaggaattaaaatcaagtctatttttgctcccgaacatgggttcagaggtgatgctgatgccggggcaaaagtgaaaaacggagtagatgtaaaaacaggaattcccattgtttctctgtatggtaataataaaaaaccaaaaccggagcagcttgccggaattgatatcgttgtttttgatatccaggatgtaggagtgaggttctatacttatatttccactttgtcttatctgatggaagccggtgcagaaaataatgtagagattatggtgctggaccgtcccaatcctcatgacggatatactgatgggccggtgttgaagaaaaaatggtcaagttttgttgggttgcatgaagttcctgtagtatacggacttaccataggagagtacggaaaaatggtcaatggtgaaaaatggctgaaaaatggtgttcaggctaaatatacactcatcccgatgaaaaactatcataaaaagcagcgttatccgatgcttgataagccttcccctaatttacccaatgataaagctatcaatttatatccaagcctttgcttttttgaagggactcaggtttctgtaggaaggggaacagatcttccgtttcagatttatggctctccatggacggaaaatcttccctatcagtttacaccaaaaccaagctatggtgctaaagatccattcctgaacgggaagctgtgctatggtgaaaacctttcgaattaccctaaagatctaagagaattaaatcttgaatgggtaatcaaagcatataagaattacaaaaatccccagcaggatttcttcctgaaaaatttatggtttgatactttatcaggaactgatgaattgagaaaacagatcattgccggaaaatcaatccaggaaatcaaaagctcatggaaaacagatctggaaaatttcgaaaagatcagaaccagatatgtggtctatgaagattaattaatcaaaattctggggcggatttttatcatttctgcccttgtttaatataaatagtcccacagtcagtccgacaacacctgcaaaagcagtcattaatgccctttgtaatttatcaggcagatcattcccgatataattcatcaaaaaaaggatcacaaaagtgatcgctaaaatgatcatatgattttttccaaatagcttcattgtcttattttaatttataagagatcattacgcctcctctgtacggaatgatttcaccacttttgttgaattcttttgccgaatcatagcgcaatcctgtagagcgatcatatcctttataaaatccctgagatgttccaacagttccataaatatcaagattccatcgttctgataactgaaactgatatcctgctgtaatacccagcataatattaaagcccttctgataaagattggtgtttaaaaggacatctccattatccttataaaaatatccgctatgccaataactccatttttgaagattataagctgcaaaaccaatattcgctcctaagtaccagtttttaaaagcttctttaaaataatatcttccttctacggaaagagagtagatctgtaattcatgtcccgcaaaagatttccatggtgaaatgaaaacatctccctgcagggtatatttgggactgatctgtttttccagtccaaggtttaaaataccaatgggagcaaataaagcatttccttttatgtataaacttttatcctgtcctccttgttcctgttcctgcgcacttaatgtacttactgacaggaaagctaaaatgcctgctgctaataatttatatttcatccggtatctaatgtttattttatttgctttaataattcgtctgccagttgagaatccttattcccctgaactgccatatttttagacatctcagcatagttttttgctgtttctttatttccggtaaggtaatagagtttggcaagaatataagtgttttcagaagtttctcccctcataacagatttttctgcccattcagttgcttttttcaatgatgacggtgttttcacatggtctgcaaatatccaggctgctctcagaagttcattcggatcaaaagtatctgagtttttataataatctaaagctgctttttcgtattcaggaaaattgctgttttgctcatagtagctcagcttggtctgattaagtttcttagcggcagcttcttttccaactaatggttcggcagctttcatgaaatagtcatcattgattttcttctttttatcatcaatagactgttctactatttttcccaatttcagctgagcatcaaattcattgtaagtttcttcaggaaggaatttaataatctcggcttttctggatgcaaaaacaggataattgatatcttctgatgattttacgaaataaagaagaaaaccaatctcgtcctttgtgagttcttctgttttctttttattctggaaatatctttccgaagcttttttggcaaattcataatctgagttggcattaagtttcatgatattgataagaaattccgggtctttttcaccaccggcaaagcggtccttaagagaaccttttttatttcctggtgaattgatatcctgagccatagctacaaacaggctctcttccatataccctgtatttctggaaaccagctcaccttcaccgttcaggaaaagataagtaggataggaacgtactccgaatttagaagcaatatccctgccttctcctttttccatgtcaaatcttgcattaatgaagttggtattgtagtaatcactcacggacttctgggtgaagacatttttttccatcattttgcacggtccgcaccaggaagcataggcatcaataaaaaccagttttttttctttcttggcttttgcaatgatatctttgaacggcagttcctgaaacgttatagattcctgagcagagacagcgatggcgcaaaaaatagatatcccggagatgatcttcttcattttcaaataagatttgtaggcgaagataattaattttcaaaatatagcgagccgaatctgcggagcaaaccatgatattaactaattttaagacttatagatacttctgattcttcagacttttataaaagtatgaggatataataaagcagtatagtaaaactattttttcttctttatttttttatgctcgtttccccatagttccagctgatccagaaccggaattaattttttgccaatttccgtaagttcatattctacttttgtgggcacttcagcatatactttcttgctgatgagttcttcctgctccattttttttaactgcaaagtgagcattctttctgaaatattgtggatcttatctttcagttcagaaaatcttaactttccatgtttaagatggtagcagatggagagaatccagcgcccgctgatgagattgacggcatatatttcagaacagctgtactccagcgtttttttattttcattattggtagatgattctttaatactcatacttacatttttgttcgttccggacaatcatttgttcacttggaaaacagaatatagatcagttaaatttacaaataaaaacaggagatgtactgcctgaaagtagttttatcacctatgtagaacaaaatatttaaattaatatgaattttgatagaattaacagtgatttaaaatatagtattgataatgttccttattcattagaaattgatgaaaatttgtttttgaataatccggaaattattcaagaggaaagaaaagaatttgtgaaagctcatccctttaagaagccggatcatattattgtgaaagatatttttattcccggttcagaagatggatatcaaatcagacttcatatttatcaggctgaacatttcagacctgatagagttcttctttactttcacggaggaggttatgtttttggattgcctgagcaagtggatgatcagatgttcgaaatagcagataaactcagtgcaaccattatatctgtcgattacaggctggccccccaatatcggtttccgatccctgtttcagatggtttcgatgctttacaatggattataaaacacggaaaacatttgggaatcaatcctgatgatattaccatatttggagcaagtgcgggaggacatttggcggcggccgtaactcaaatggcagcagaccatactattcaaaatataaaacatcagttcttgctgtatcctgttattcataacaggctgaatactccttcaatggaagagtttaccgatattcctctatggaataaaaattatgcaaagacagcctggctgcattttcttggggaggaaaataaagataaaagcattccatattcagacctgacctgttacaacaatttttcaagtttaccacaaactactattgttgcctgtgaattagaccctttgagagacgaggatatagaatatgctcagctcttatacaaggcaggagtgaagacagaactatggctgattccaggcgctttgcatgtgtttgatctctttaattcttccataaaagatgaatataataattttatgctgagcaggctgttcaaataaaatgtatgaaataaaggtcatcatacttacaacagttttctattgtagtgattattgtaggggttgctaaaaactgacggttaacggatatttaaaatatataaataattcactttacagtcctgaaatctttgttatatctttgcaaacgaataatttatatgtagaggaatccgtaatttatagaatttgattattaattttaagcacgctttatccaaaaaatccatttatattaccgctttatctgcctgcttcattgcagtggcagcatttgccgttttgagtcttctgattaccgaagacagccgtaagaataccgacgattttgccaagaaaacattcttccgaaagtatgaatctatagaacatgaattcagaaatattgaagattatcagtatctccttcgtgcattgatccagaaagacggattgaaaaactataaagactattcttcggttttaaatgacctgaacaaaaaaagaaatctgcttccttacagctggtattattatgaaaatgcagcttccggtaaaacagaaagtaataatccgttatccggtatttttaagaaaacaaaggataaagggcattctgttgttctcaaaaataatggaccggggcattttaaagatcttttgacgactcaaaaggacagtatgtattggataagctatgattctttggtcctgcccgataaaagcagattatattatggttctaccgtaagtcttgacgaccttcatcaatattttatcaatgttgacaaaagttccaatacatatgcctatgtttttaccaaagaaggaatctgtatcacccatccggagaagaaatatatcgggaagaatattttcgactttacagatatcaaacccaatgatacactgacccgccaaactgaagcagggtataccaagggaacagccatttcagaatatctgggtgtagaggtgacacggtttataaaaccattgaagaccgataattttgacggatacacagttgtgaatcatgtaaattttatcattgatgagaacctcaataagataaaaacttatactgtttatattttcctggcagcgttattccttattgtaactgtttttattttatttcagagggcgaccagtcttgcttatcaggaaaaagaaaaaatacagtcggagaagaatttactgttgatagaaaacgaaaaaatgcacaaagccgaagtgatcaatcagcttcagcagcttaaaaacaatattaatccacattttcttttcaattcactgaattccctttatatgctgattgggatcaataaagagaatgcccggaaatttaccatgaatctttcgaagatttaccggtatctgattgtacctccgaaagaaaatattgttccggtttctcaggaaatcaaatttatacagcagtatatggagcttctgaaaagcaggtttgatgaagagatgaagtttgaactgattatcaatgctcctgcaagcctggaaaaaaggattccgtatttatcccttcagatcgccacggaaaatgcaaccaaacataatatagcaaccatagaccaacccctggaaattatcattattgttgatgaagacggaattacggtaaagaacacctggcagcctaaaacagacccggtacagggtgagaagttcggaattgattatttgaatcagatttacgggtattttaagaataatcttcttcatatttctgtagatggtgaatatttcatatgttttttgcctttattgaagtgaaaataaaaatccattcactcccgaaaaatcaccattcactccctaatattatatatatgattcatgatacctatagctttgcggctgaaactaagatatttactatttggaatgaatcggactattttaatgaagaattacaggctcgcactgtatctcggtcttgctatggcctcaccaatggcagtagcacagaaaaaagataaagatacggtaaaggtcaacaaagaaaaaacggataagacagaaacctcttcctccaagaaaaccaaaaagattgaagacctgatcaaaaaaggaacctataaaaaagggctttttaataccattcaggtaaaaacggatatttattttgagattcctgacagcttaatggggcgccagtttttggtggtcaataagctttctcaggtaccgatgcaggtgaatgaagcaggtttaaacaaagggatgaattatgaaaataaagtcatctctttccaccgtgatcctatagctaaaaaagtatgggtgaaaactgttgtacctaaggtatcatccccaaaaaatgatgccattacaaaatctgtaaaagacaatttttcagaatctgtcattgaagtctttgatattgaagcacaaaacaatgactctacagctgtagcgattaaagtcaataaagtttttgacggaaatcagaaaagctttaatgatgtattggccaatgtaggattgggaggatctgtgaagtcaagcctttcttatatagaaggagtaaaaacttttcccaagaaccttgtggtaaagtctcaattgtctacttctgtcaatgaaggtggcgtagatcttccggtaacattaggagttaccaccaatctggttctgctttctaaaataccgatgaaaccaagagtagcggattcaagagtcggatttttctccgaaaaacactggtcatttaatgacaaccagcagaaaatggatgagaaattcttcattaccaaatggaatcttgaacccaaagatgaagataaagaaaaatacttaagaggtgagctggtagagccaaagaaaccgattgtttactatatcgacccggcgacaccaaaacaatggcgtgagaaaatcatcgccggagtacatgactggcaggcggcgtttgagcaggcaggattcaaaaatgcagtgattgcgaaaatgccggatgagaaagatgaagattttgatattgatgatgtaagatattctgtgattacttacgccgcttcgccaaagtcaaatgcaatgggaccttctgtagtagacccgagaagtggggaaattatcgaagcagatattatctggtggcataatgtaatgacttctcttcatgactggatgagaattcagacagggcctattgatccaaaagcaagaggaaataaattcagtgatgaacatatgggtgaggccatccgttttgtttcatctcatgaagtaggacacactttcggactgaagcacaatatgggagcatcctttgcttttcctgtagaatcgcttcgctccaaagagttcacagacaaaatgggaggtacagctccttccattatggattatgcccgttacaattatgtagcacagccggaagatggagttacagctatcactccgaaaattggcctttacgataaatatgccatagagtggggctaccgttggtatccggatgaattcacagagaaaaaagcgctgaaaaacttaattgaaaaacatcaggatgacccgatgtatttctatggagaacagcagagctatcttgaaaccattgatccgcgctcacagtctgaagatttgggagatgatgcgatgaaagccagtgaatacgggatgaaaaacctgaaagtggttatcaataatcttttacaatggacctatgaagatggtaaagattatacagatgccggaaaactatatctgggagtaatcgggcagtgggatctttacacaggtcatgtgatggcgaatgtaggaggaatttacctgaacaatacagtttttggaaacaaaaagaaagcttacgaggcggttcctgcagaaattcagagaagagcggttgattatcttgttaaaaatgctatcaaccttccggagtggttattctttaatccgattacagaaaaaacgtacccggtaaaagattcgccaatgggaccatttgagcagacgccgtatacccttgcaagaggaatgcagtatgcgaatatctattctttatttatggatgaccggttacttaggctgcttgaaaatgaattaaaacatcagatgtccggttcaaaagaagaaatctatacggttgagaatttatttgatcaggtaagaacagccattttcagtaaaaaaggaagtcttacgatgcttgaaaaaatgactcagaaaaattatgtggatgctttgattgtttcggtaaacaaattatttgagaaaacggcagtgaaaggattgaaaacagatgataacctgaatatcccgaccatctgtaattttcatgaagatgatcacggtttgagaaatatcaattattcatctatgaaaagagtatctgaggttactacatacaagagagcagaacttcagaaagttctggatttattgaacagaacaaggtacagaggtgatgatgcttcgagagcacattacacagatttaatcattcgtatacaagaggctttaaacaaataaacggcaatgaaaaaaactctaatacttttacctcttttggctgctaatatagcaatggcccagcaaaagaaaaccatcaccgggaaaatagaagatgccaatacatcccatattatcagcggtgcatctataaaaatcgagacacagtctgtgtctacgaaaacagaactggaaggaattatcgaaagtgtatcagtaggtacagtgactgataaggacgggaaattcatactggaaatccctgccgatacaaaatccgtcttggtaagttttccaggctatgaatccagggtcattcagcttaatgaaggacaaacgaattataccatcagactgacttctgaagtttcagataaaaataaaatccaggaagtaattatcaccggttaccagaaaattgaaaagcgcaagcagacttcagcggtttctactgtgaaaatggacaacatcagccaggctggtgtggccagtgtagaccagatgctggcagggcagattgctggtgtggcagtaactcccgaaaccggtgctcctggcagtcctgcaaaaatcagaatcaggggtacagcttctctttccggacctcaggatccgctatgggtaatcgatgggcttccgttggaaggaaatgatgtgcctaactttactgataaagacaatattgaccagcttcagaacttctctattgcaggtttgaatcctaacgatattgaagatatcaccatccttaaagatgcggctgcaacggcaatttacggagcaagagccgcaaacggggtaatctccatcacaaccaaaaaagggaaaaaaggaagcttaaaactgaatttctctgcagatactttcgttacagcacgccctgattttgataaactaaaccttttaaatgcttctgaaaaagtagatctggaactgatgcttgccaaacgtgcagatcttacttaccgtgcagataaaggagaagtgatgagaattctgactcagaacaaccagcttgatgttttcagaaacggtggttttgacgcgttgaattcattcacccgtcagcaaattaacggtttaagaaacaacaatacagactggggcaaactgttgtacagaaatgccatcaacaaacaatacggattaagtgtttccggaggaagtgaccgtgcagattactatttctccctgggatactatgatgaagaaggaacaactatcgggacaggttttaaaaggtataacctgactttaaaaaacaattacaaattaagcgataagttaaatgcaggaatctctattttcggaacacaaagtgaacgtacatcttttgtaacggatgctgatgcttcaataaacccggttaactattcaaggaatgccaatccttacatgaaacctttcaatgcagacggaagttacaattatgatagagatatggatggttttgaagaccgttatattcctttcaacttccttgaggaaagagaaaataccaattattcgctgaaaaataactctttgaaaggtattttagatttagaatataaagcttcaaaaagtttaaggtttacctctcagttagggattcagtatgatgccaacaaaacagagaagttcgcagcagagaatacttacttcaccagaaaaatgaaagaaaatacccgttattacaaagacggtaaatacaattactttctgccggctggtgctgtaaaacaaaactgggataatgatttcttccagtacaactggaaattgcaggcggcatacagcacaaagatcaataaacatgagattgatttgatggccggtacggaaatccgtaaaacagaagataatacaacgattacaagagctttcggatatgatccgaagaccagaagagctacggccattgttttcccgaattcaagttttgcagcagataaaagatatgaaacctatcgcgaaaatcctccaatagagaatgcttatgcttccatgtttgcaacagcatcttatacttacgaccagaagtatacattctttggaagtgtgagatatgacggaaccaatcttttcggggtaaataaaaaatataaatatcttccgatctgggcagtttcaggatcatggctggtaacgaaggaggattttatgaaaaatatttctgccatatccaaccttaggcttagagcatcgtacggtcttcagggaaatatcgacagaaatacatcaccattctttatcggtgaatataacgatgcaaccattcttccgggaggaaaagaagcaattattaatgttctcagccctccgaacgataaactgagatgggaaaaaacaaccaataccaacttagggcttgatttaggattgttcaataaccgtgtaagccttaccgctgatgtctacagcagaaaaggtacagatatgatcagtatgaaggaaacccctcttgaaaccgggttcgaatatacgatgatgaactggggaagcttaaccaacaaaggttttgaactggcaatatctaccagaaacatcaatcatgataatttcaagtggacaaccactatcaactttgctcataacaaaagcagagtgctgagtgagcagccgcgtgataactcattgcttccgtcaagagaaggacttcctgtaaatgctgtttttgctttgaaaactgcaggaatggatgaacatggaaacccattattctggaaaggtgatcagaagatttcagcagcagaattctttaagttatatgatgtgtatgcagattttcttccgggacagcttgttgatacaaaactttcaaatgctgagctgagaagcctgtttacctatgtaggagacagagacccgaaatttaccggagggattatcaatacctttaaggtaagtaactttgatcttacaatttctgcgacattcaacctgaagcagaccgtaatgagaacaccttcttaccgaggaatggaactggacaggggaagaaactatacaagagatatctacgaagcaggaaattcacttccgggcattacgagtcccgatatggatgctaatcctgatggatggatggccaataaatggtttgccggaaaccgttcaaatgcgtacagcttattggatgtttgggcgaaagagatcagctacataagaatcagcagtatccgtttaggatatacgctacctaaagaatttaccaatcctatggggatttccagtttgagactgagcgttgaaggacgtaacctttttgttttcagtaacggatataaaggatatttcgatccggaaacgtatggtaatatttatgcacagcctatcaccaagtcggtaactgtaggatttaatgtttctttttaaaatttgagaaaaatgagaaaaattacaacaatcatagcactttcagcaatcagtttaatcaatatcggatgtgacaggtttctggacattcagcctgaaggaaaaattattcctgaaactaccgaagattaccggaaagttcttacctctgcctattcaaaatatcctgttcacaaatctctggtagcccttcgtaccgatgaggtgaatattgatgataattctacggattttatctcctaccgtgagattgccatgtggaaagattcaaataatgatcaggcctctacggaatttccatgggtaagcttttattctgtgaacttctatctgaatcagattattaatgaaggaagcaaaaccatgcaggattctcctgagaaaaaccagattttagcagaggcttatgcgcttcgtgcctatctgtattttgatatggtaaatttatacggaaagccatacaacagtgccacggctgctaccgacagaggggttccaattaatcttgaaattgaccttgaacaggtattgaaaccatcatccgtacaggaagtgtacaatcaggttcatgcagatatgaaaaaagcagaagatctgatggttgagcagaagcagccactgggagtcaattacaggttctcaaaaactgcattgctggcttttgaagcaagaacagctctatacgaaggagactggaacaaagctttaaactatgcagatcaggtactggcggtaaaagcagatcttgctaatttaaataccgtaaatactccgcccaaccattatgcttccccggaatctattatggctttggacaatacctgggataactctattaagaatttatcttttgcatctccggagcttatttcttcatacaatactacgaccgacagaaggcttggcatgtattttgaaaaaaacggaagtaagtataaagtgatcaaaggagggagtttagaatttaaagtgtctttcagaaccgctgaactgtactttataaaatctgaagcattattaaagttaaataaacttaatgaagctaaagaagtacttctgaaagtagtaaaaaacagatacactccggacggatatacttcagtacaaaatgcagtgtcctcaatggattctacagcatttatgaactttatccttgatgagagattcagagaatttgctctggaagggcagagatggtttgatttaagaagagccaatcagaaaaaaataagccacaccatcagtggtaaagaatatattcttcagcagaatgatccgcgatataccattgaatatccaatgagcgcgaagaagaataaccctaatttataaaacttcatatcaaattcaatacagaggaaaccgcttgaacttaattgtttcagcggtttttttgtacttttgcatcgttatgaaaattgccattatagaagatgagctgctggctgtgaattatctgaaaaatcttttggatatacagagcatagtccctgttacagagactgttattcttcgttccaaaaagcaggcaattgatttttttgagaaagattcagcagatcttatttttatggatatccatcttggtgacgggatgagtctggaaatcttcgaacaggtagaactttttaccccggttattttcattactgcatttgatgaatatgctatgagagtcttcaggcattttaccattgattatcttctgaagccttttgaagaaggggatctccataaagctttacagaaatttatctccataagaaacaatttcgaccctgaaccggtacttaaatctatttcttcattaagccagacagaaggtgaggtgatgaaacgcttcatggtaagagaagggaataaattaaaatcaatagacgaacataacactgcctacttttttgcctccgggaaataccttttcctgactactaaagatcatcagacttatatttatgatgatactattaaagatattattcagaagctgaatcctgaaattttctttaaaataaaccggaaatttattgttaataaaaattcggttacggaaatcatcaaacattcaagccagaaagtagaattgaaactttctcctgaaccggaagtgaatacagaagtttttatcagtaaaccgcagattgccgagtgtctgaactggctgaacacttaatactcattttaaggggttaacaaaaaacctctgaagaacagaggttttgaggtgctttataaatgcttagtactaaatcatcttcatatatctgagatacgcttctataaccggcttattaaaaatggcgggtctgatatctgaaccttctaaaaaacgttccgtattgctgcttttaaaataataggtgttttcataagcttcaaccagcgattttccttcgtgaacatcatcagaaaacaaataaagcagtgcatagacaggcgtttcatgatttcgtttccattgttcaaaccaggtttcaaaatctaaacttttcatttccagtccgcagtaatcggtgatacggacacaaaaatcggtaagagacagatcatgctccggtaaaggattcagattaaagttgagtccaattgcctccggattctggctgatgtgagcaatagatttgcagacataatctacagtgattacttcatcttttaatcccattaccaatggaaaagcttttagttcaatacaggaacgcatcagtgaactccaccattgatttaatggagtggcaccggtttccccatggcaaactacaaaccctaaacggaaattgatcaggggaaggcctttggcacgggctttcgaagccatactgtccattacccatttgcttctgatatatcccatatctcggcatacggcaggtaagttttgttcaataggatcatcctctgtcatccatgtttttcctgtaaagcttcttccccagctgtaaactcctatagatgaagaaatgatcaggaattttgttttttcatgaactgccagatgtaatatatgcgccatgccgtcaacatttggttttttgatgtgttcgtaaggttttacatagcttacatcacttcccatgtggtaaattacctcaatgtttttaagaagatattcatataatttttcatcaattcccaatttgggctgggtcaggtcacctaaaacaattctgattttatcctcatactctgttttccatatcagtttgaattttaaaaaagtacttttaatacgttccagacccaacgtttcattctcagcccttacaagacaataaatgacagcattcggattccggggaatgagttcttccaaaagatgggaaccgacaaaacctgtaacacctgtcaggaaaattgtagaaggattagataaaatcttaggatcaggttgtatggtaatttcaaaatcaaaaggaagttgggcatcctttataagctgttgtcccacaagacgggctttctgttgctggctaagctgattttgtgccagccgggtttctgcttcctttacaaaaagagatatggttgggaactgatacagctccggaagtgatattcttttctggatgttaaatggtaaaagggcgtgcagatgtcctagcatcagagaatgtccacccaattcaaagaaattatcattttcatttatttcatcaaggttcagtaaatccatccatatttcctttatttcctgtttaagatctgaggtatctactttttcctttgccttttttgcggattgctgtaagggaacatgaagcttgctcttatcaatttttccagtaatagtcaagggaagtttgtcatacaaaataattttttcaggaagcatataagttggaagactttgtttcagtcttgcacggatatcttccgcagtgatacgttctttgtctgtttcataaagttccagaaatgcaacaagaacaggctgtccctggtctgggcgatgtacttttacggccacattcgcaacctgtgccagttgtcctatatgatgttcaatttcttttaattcgattctgtatcctcgtaattttacctgctcgtccagacgccctacaaactcaatgttaccatctttccgcaagaatccccgatcgccggatttgtataatctgtagctgattccgtaatcagactgcatccattcaggtgcatcaatgaatacttctgaggtttctgccggcttattgatgtacccttttgctacctgcctgccaccgatataaatttctccggtaataccttcattcacatactccatatcttgattgagaatatgaatatgggtaccctctaaaggttttccaataatatgaggattggtatcatcctgaaaatgatgggtgataacacctacggtagtttcagtaggaccatatacgttaatgagacgtactctgttgcaccagttttttactgtttgttctgacggtacttcacctgcaatggaaagggtatggagctttccgatgggaagatttattggtagtgtgctcaatacagccggaggaagaaaaggaacaacttcaatctggtgatcaacaataaagtccagcaaaggttttccaacaattttattatcaggatacagaacaacggttgctcctgtaaacaaaggaatccaaatatcaatgatagaaacatcaaatcctgctgaactgaactgaagtgtcctgtctttagcagaataaccccaaagttttgtgaaagatacaataaaagcataaaaagcctcatgatgaatttctacaccttttggaattcctgtacttcctgaagtataaataatataggctgtctgcttcatatctatatcatcggggctgattgtaatccgatctccggcaggttcattaattccgtggctcatattaatcaattgagcctgtgtttcttcaaatttgtcaagataggaatcttcagtgatgacaagttcagcttgtgaatcttcgatgatcattttaatcctgttttccggcaattgtccatcaataggaatatatgctgaccctactttcagtacagccagaaaagcaacaatacgttcagtagattgtgacatgcagacagcaatgggagttcctttttttaattgtaaggacagaagataagcggccagttgatccgattggagatccagttcttcgtaggagaggcttttactttctgaaataattgctgttttttcgggtaaagagtgacttacttctttaaaaatagaaattacatttttaaactgactttgttgaatgctaaattcattatcagcattttcgggaatgattgaatgtttcatgatttgttttttgggattggtgttgttatgattatttataattgtttatgtttaaatataattcaattatcttaaataattcctttttgtgtgattaaatgtttttaattttcttatttagatgcgaaattgtcggttataaggaagtcggagagattaagaattgtaattttgattcagaagatagtatggaaatccgaaacgattagcaatgaatataagaacaaaaaaacctctaaaatgaattagaggttttgaagtggtttctccaggaatcgaaccagggacacatggattttcaatccattgctctaccaactgagctaagaaaccatttatgtttttgtttattacttcgttgttttaaagtgatgcaaaagtataacattttatgataccgcgcaagtattttgttttatttttttaaagaaatatcctgatatagcttatttttgatttcaatgtactgttcatcagtattttgatagattattatttttttcagtttttcttatattttactttttcagatgataataatttcccattgcaccttagacagggaataaaaagcttgactttagaaatgcaaaaactgtagaggtatttacagaacccaaacacagtctctagaaacagtcctgtgtgatgaattagaagagaatcggaggtaaaattgtatggaatgctgaaagtttactttatactagtctagcaaaatatagagctatcatttcagtattcagaaaacaattattacagaatatctgatttaaaagatagattgatgagagttcagggaattatagagcatgaataaaaaaaacaaaaaaacctctgattaatcagaggttttaaagtggtttctccaggaatcgaaccagggacacatggattttcaatccattgctctaccaactgagctaagaaaccattatatttttgtttgacttacttcgttgttttaaagtgatgcaaaagtagtaagttttaatatacaaagcaagtattcatcgtactttttttgaataaagttaaaaacctactgattatcagccggattattttcctgctcctttctgatctgttcgctcatctcttccaataccggttttatcgtgttttccggaagatcactgattcggatatacatcaatccatcgatcgcatcattaaagttgggatccacattaaaagcaattacttttgcgttttgtttgatgtattttttgatcaggacaggaagtctcagttcaggctcaagatcatcaataatcttatccagcttatttaggtcagattccatttcctcaaagaagatgtttttatccctgtcacgaagctttaccttatactcattccttggagtgatatattgagctacagcagaatcaaaataattggagcgcataaactcaatcatcagagactttgagaattccgagaacttattcgagatgctcacacctcccataaggaatttatggtctggatttctcaggcatacatgtacaattcctctccataaaagaaagagtggaagaggtttttgctgatattcctggcaaatataggcacggcccatttcgattacttttttaaagaaagggtggatgtcctgctcaaattcaaataaagagcttgtataaaagcctttgatgccatatttcttcattacctctctacccagtgccattctgtaggctcccaccagttttttctcaccattgtcccaaaggaaaaggtgatgatagtgtttatcatattcatcaagatcaaaaggaaggttacttccttcacctacagcacggaaggtaagttctctctgacgtccgatttccctcatgatagaagggatttcctcataagtcgtaaagtagatctcgtaatttccgttactgaacagcattttgtcagttcctctcaatttatcaacatcatttatgatatcttcaagaggagtttcgtcaataatattctgaacaatattttcttccttcaataaaggaaattttacagataagttcttaagattgatactctgggcaagagattttcttttctcataataagatttcatcatataaaccttacgtttcagaaactctcccaattcctctatcgtttccatatcatccattgcctttacggtaatggggcgcccaattctgattctgataggtttttccctgtcattcatcatttctgcgggaagcatcagggtttgtaaatttggatgaagtttggctacctgataaaaaagccggctgtttttggcatggaaatacattggaacgacaggtactttagccattctgataagcttaagtgctgttttttcccattccttatctaaaatttctccgtacggattatttttattggaaacttctcctgccgggaaaatacctacgcagcctccgttttgtaaatgcttgagtgtttcacgcattcctgaagaactactgtaagcatcttttctgttttcaaaaggatttacagcgattacatacggctccataggtttgatcttttccaaaaggaaattccccattaccttgaaatccgggcgaacctctgtcaggatcttgcacatcaggattccgtcaatagcacccagcgggtgattggaaaccagaataaacggtcccgttttcggaatctttgccagatcctcctcaaaagctacgtagcttaggtttctttctctcacaaatgagtcgaaaaagtctttgccttccttgtcttttaatttatcgtataatttatttacttcatttattttagcaatgctcatcacagcagatgctaccgggttcttaaggaacccgattttgtttaagccggaagctttgatcagatcgtttttcgaaattaaactcatgtgtgtttagtcgcaattaatattattgtgttaccatttgaagagtattcttggaaatttgttccaataatacatttttttcatggtaaaattgatcaatgtgatccttcttcgcatttcttactgtgaataaagatacatttttaattgcttcggttttaaaaattttttgaagctcttcgttgagctcatcaatatgattaaacttgtcttccaggcacaatgccagggagattgcagaattctgcattaaggaaactttaattttatatttggataaatatccgaaaatcaaactcatatggtcttccgcaatgaaggaaaagtctcgtgtagagattttcagaaggtcctgattttctttaagaatataagtttcctcttgttggtttttttcagaagcgcctacttttgttccctctttggtaggatctacgaaagattttacataaaaaggaatatttttttgctgtaaaggctgcaatgtcttcgggtgaataacacttgcaccgtaataagccatctcaattgcttcctcataggaaatattggaaagcagctttacatcactgaacttccttggatctcccgtcataactcccggcacatctttccagatggtcatcgcttctgcatttaagcaataggcaaaaatagcagcagagtagtcagagccctctctacctaatgttaccgtaaaattattctcgtcagatccaataaatccctgtgtgacatagcagatttcaggattaagatttgaaataaattcttcagtctttgcccagtctaccataccttctctgtatgaattatctgtctttatataatccctggcatccagccattgattggtaaactggatctcattcagatactcacttacgatttttgtagagatcatttctccgcagcttaccacctgatcatatacaaagttgtagttgggggacttgtttcttcttaaaaatgaatcaatatcatcaaaaaagaggttgatttcagcaaaaaccgcgtggttttcagggaaaagtccctccgcaatctcaatgtgtttttgttttatcttttcaatttcagtttgatagttttcttttttgaaataaagctctacaaccttttccaactcgttggtcgttttgcccattgctgaaatcaccagcaaacatttggcaaatccctggctttccagaaccctggacacgtttttaacactgtcagcatcttttacagatgctccaccaaacttgaaaattttcattaaattgttaaaaataaaattgttagataaaaaattacatgagttttttacggacgtcaaaattataaatttacaacgagatatgaaatagcccggcagggtgatagaattaagatttccttaaaaatcaacaattcatgaaataatctgaattttttatgaacatgaagctgcaaatttggaggccggattttcaataatatcctggtattatgttgtgtttggcttgtatctttctgaaatacaagggttaatctcttttttaattaaattttcttaatgcgataaattttccgaaatttgggcaaaacgtaaaaagaaaaatatgtcaaatcaaccattacagactttaggagaatttcttatagataagcaggacgattttcagtattctacaggtgaattctctcgtcttctaagtgcaataagattggcttcgaaagtggtaaacagagaagtaaataaagccggaattgtagatataacaggagctgcaggaaatcagaatattcagggagaagaacagcagaagcttgatgtgatcgccaacgaaatttttattacgtctttgtctcagagagaggtggtttgtggaatcgcatctgaggaaaatgatgactttattgatatcaaatgtggtgaaaacggacatttaagcaaatatgtggtgctaattgatccattggacggatcttccaatattgatgttaatgtttctgtaggaactattttctccatctacagaagagttacagaaccgggaacacctgtacaactggaggactttttacagaaaggagttaaccagattgcagcgggatatgttatttacggttcatccacaatgatcgtttatacaacaggaaacggagtaaacggatttacactggatccatctttaggaacttactatctttctcatccaaacatgactttcccaaaaacaggtaaaatttattccattaatgaaggaaattacatcaagtttcctcagggagtaaagaattacctaaaatattgtcagatggaagaaggtgaccgtccttatacatcaagatatataggttcattggtagcggattttcatagaaatatgcttaaaggcggaatttatatttacccttcttattcacaggctccaaacggtaaattaagacttttatacgaatgtaatccaatggcgtttcttgctgaacaggcaggaggaaaagcaacagatggattccgaagaattcttgaagtggaacctactgaacttcaccagagaatcccattcttctgcggaagtgtagagatggtagaaaaggcagaagaatttatgcgaattgacagcgtaaaataatggaagcaaaatatctgaaatatttattacaatttaaacgcccgagtggaacatctcgaggcgttttgcttgataaggaaacctttatcctgactgtttctgaagagggaagaaaaggaataggtgaatgtgctgttttcagagggttaagctatgatgacaggccagattatgaagaaaaactgaaatggttgtgtgaaaatatcaacctggatgcagcttttctgaaagaagaactgaaagaatttccatccatctggtttggttatgaacaggctgtactgaatcttagaaatggaggaaatctttattttcccagtgaatttaccgaaggaaaatctgccattaccatcaacggtttgatatggatgggagatgcagcgtatatggaagaacagattcaggataagctgaaaaaaggatttcattgtattaaattaaaaatcgggtttgattggaaatctgaacacattatccttcagaaattaagagagaagttttccaaagatcagttggaactgcgtgttgatgccaatggaggattcagtaaagacgaagcgatagttgttttgcaacagcttgctgatctacatattcattctattgaacagcctgtcaaagccggaaactgggatgatacggcagagttatgtgcaaaaactcctattccgatcgcattagatgaagaactgatcggaatcattgaccctgaaaaaaagaaacagcttttagaaaaaataaagccacaatatattattttaaaacctgcattggttggaggattttccggttcggatgaatggatttcccttgctgagaatcagaatatcggttggtggatcacatcagctttggaaagcaatattggattgaatgctattgcccagtatacttttaccaaaaaaaatccaatgcctcaaggtttaggcactggagctttatttgttaataattttgaatccgttttagaacttaaaaatgagctgctatggttcaaaatataactgttaaaagttaattagcataatggtggaggcgaatctggacatgtagtttgcctacaatagtcctgcgcttatgatcacagcacatagtaaaggaatgtcaactgtgacatacaagaggagaaggttttctccttttgcggttttggtttatctcattttatgataataagtattaaacccttttatagtttatcgaatatggatttggatagtatcagttttttaatctgcaatcccttcctgttcagaatatttgaattttttttaatccggtctgtaggaggacctggcagtaatagatcgaatattttgttgatttagaggttgttacacaattaaatcacatctttcacgaaaatagctttcttgatatagtttaatatattagaaaacctttttttaatctgtcccataattaaaaattgtaattccctaataaatgaattagcaatcattgtgccatactgctgttttttagttaatttttaacgtataattcattttttagggactattttaattatttattaagaaataattgtgaaaatgttttcactttctttagatctgttggtaataagatttctgtcgattccatataaattctggaagatatcattttgaacctgagagctggaaaggtatccccagtgatttcctacttcatatttaaagctgtttagcagatcatcttttacaaacgtacaatcgataacagaaacaatatctttatactgatcaatgtcgctcggaccatttttaccaagccttggagtgaggatatttttcgtaaactgagaagctccgagaataatatcctgtctgtttaaataaatggaaatcctgttggccaataacggaagcttattaaatgaatcctcggcatcttcaaatactttatagctcacatcagcatttaaaaggagaacctggtctataacacgaagaatattttctcttttgaggctgtataacatactttgaagaactctgtttcccatagagtgggccataagatgtattctttgattacagggtgcaagatcccggttggaaaaaatatcttttaaaaactgagtgtagaaataaaacaatctcatcagggatgttccggaattgatacttgacgccttatcatcaaaatagcttaacggaataatactgctggaagctggccagcttacgaataaaatatgttctacaggagatgccggattatcaatgaatattttttttagatccagaatagcctttaattcatcatcaaaatcatataaataaccatggatgaatatcaggacgtcacttctgtctttagtggaagacatatttttgtacaattcataaaacatcctttgggttccgcccagattattggcagtaagggatgattttctgattcctttttcattcaacagaacttccagtacttcttcatacccttgcttttcaggttcagaaaaaagcttgtaatttaaaatatttctgttggtatagtcctttttctttttagcctgtggagagagttcctgataattgtcaaaatcacattttgcgatcctgaaattcggaatcgagtattcatcattggaaaaagagtccactttttcgcctttatgccggacaattttccggttgcttaagatataaacagccatgatggttattggttataacggttttagaattcctaaattagtgaaaaatattgaattccaaccattaagggttttaaactatgacttttacaaaagcttatttttccgtaactttgtaaaacttttttgctaaaaacaaaagctactttaatggaagaagaaaaaaaatcactcaattttattgagcaaattattgaagatgatctggcaaacggtctgaaaagagatcagatccgtttccgttttccgcctgaacccaatggttatctgcatgtaggtcatacaaaagcgatctgcatcaactttggactgggcgaaaaatacaatgctcccgttaaccttcgtttcgacgatacgaaccctgaaaaagaagagcaggaattcgtagattctattatgaaagacgttgaatggctgggtttcaaatgggataaagttttgtacgcatctgattacttccagcagctttacgattgggcagttcagttaattaaagaaggaaaagcttacgtagatgagcagccgtctgaagtgatcaccgagcagagaaaaaatcctacagaaccgggaattgaatctccatacagaaaccgtcctgttgaagaatcattagatttattcgaaagaatgaaaaacggagaatttgaaagtggttcaatgtctcttcgtgcaaagatcgatatggtttcgcctaacatgaatatgcgtgaccctgtgatgtacagaattttgaataaacctcaccacagaacaggtacagcatggaaaatttatccgatgtatgactgggcccatggtgaatccgattatatagaacaggtttcgcattcactttgttctttggaatttgaaaaccacagaccgctttacaactggtatttagatcaggtttacgaagaaggaaaggttaaaaacaaacagagagaatttgcaaggatgaatgtttcctacatgattacttccaaaagaaagcttcaaagattagtagctgaaggggtagtaaccggatgggatgatccaaggatgcctactatttcagggatgagaagaaaaggatttacaccgacttctatcagaaattttattgagaaagtaggagtagcgaaaagagaaaaccttatcgaaattcagttgcttgatttctgtgtgcgtgaagacctcaataaggttgccaagcgtgtgatggcagtggtagatccggtgaaattagtaatcgaaaactatccggaagacaaagaagaatggttggaaactgaaaataatccggaacaggaaaatgccgggacaagagaaattccgttctcaagagaattatatattgaaagagaagacttcaaagaggaagcgaacaataaattcttcagacttaaattaggcggagaagttcgtttgaaatcagcatatatcatcaaagcggagagagtagaaaaggatgaaaatggagaaattactacaatctatgctacttatgatgaaaaaagtaagtcaggaagcggaacagaagaaagcttaagaaaagtgaaaggaactttacattgggtatctgcaaagcatgctattccggtagaggtaagaatctacaaccaactttttacagtggagcagcctgatgcggaaaaagatgtagatttcttaaacttcatcaaccctgagtctgtaacaacggtaaaaggatttgctgagccaagtctgaaagacgttgcggtgggagaaccattacagttccagagaatcggatattttacaaaagatcaggattctacagatgaaaccctggtatttaaccgtacggtaactttgaaagattcttataaacctgaataattttcaggaatagaccataaaacaaaagcaggacttcatacaagtcctgcttttattatttaatagcttaaaatcttgaagtatgagattctacttcaggaaatccttgtcctgataggcgggatttggatatttataaaatccttccccggtcaatactcccagttttcctttatcaataaattcttcttttaatttttcaacggcttttatctttagtggatcctgagtttcttcagcttccattttattgatattataagcggttgtgattcctacaacatccagaattccaaacgggccggttggtgctccggtggcgaccatccatgtcttatcgatcgtttctatatctgagacttcatctacccagagattgactgcagcgccaagcaacggaaccaataatgaattgacaatatacccgggttgttccttttggataggaagtgctaccattccaattgcttttgcaaatctgataagcgaatcaaacacttcctgtgaagttcccggatgccgcattacctctcctgtattgtgcttccagatttcattggcaaaatggagggctgcaaacttttccggtctgcctgtagcttcagcaaactgactcggcagaagggtagaagaattcgttgcaaataccgttttttcaggggctacctgagccagcttatggtaaaattctgttttaatggttggatcttcgggaactgcttctatcagaagatcagcatcttttactgcttcagcaagatcagatgaataactgatatttttaaatgtagcatcaagttgtgcctgcgttgcacccagatcttttttataagcttcacttaaagtggtgaatttacctttggctttctccaatacttcatcattgatatcatatacagtaactttgaaaccgtgataggcagtctgaaaggcgatctgatatcctaatacgccgcttcctgctatcgttatgcttttaaaatccatgagatttatttttatatctgttttagaatagttgtttgtttttttaacgcaaagatttataaaaactgattattatttcaagagggcaaaggcagataaatctgcttcacaaagttatacgcttcatcaaatcaaattgttgattctcttctttgctccctctaatacattattataattctaaacctttgcgttaaaaataaagtatgcactactttaaaactattgttttgtaagctaatattttcaatcttttactccttttacccattcctgaaatctggttaagaaagattcgtgttcttctttttcttccggacggtttaccagaatgtgttcaaagtaagttccttttaatatttttcttaaaattccttcccctaagaaaggtttatagtcattcagagcctgagttgcttttaataaatgtctgatatcatactgcaatggattgatgtccggaacctgtttattaaggttaagcaggttgtaaacagctattcttgcagttcttacagagctttccatggtgaatacaacatcattattggtttctacaaactgtcctacaagacctaagttggtacatccttcaggaaccactctcggacggtctcccatcgctcttggcataaacatagatgtgatataaggcatgaatgctgtacgtacaatagtattttcagtaacattatccagctggtctgttattccaaggtggtagcataactcggcaagaatctcgtttccggtacattgaggcatagtttttttgatataattaccttctttatccatcagtaaagcatacacccaaactacaaggatatcatccggctgagtagggaagtgcggctgtctgttgcaggtaaaactcatcacccaattggagtctgtaatggtaataatccctcccgtagcagttcttcctgaataaggatcatttacacacagttctttcagtttctctgtaaaagcagaaggacggcatgttaaggttgcagattcccaggaagatttttcaatatgactacagaatttttcaggtttcccgaatacttcagatttcgcggcaagatttttccagagtttccatccggcactttgtcctgcgctgctgttatctattgtaacttcaggaacggtattgttatcaccgtagaaagtactttcggtcatagagccggtagttacaataacataatcatctttactgattggtatttttacttcctctccgttttgttcagtaataattccttctacggtttttccttccgtgttaatatgaatatcaagatcttttacaagggtattaaactgaatctgtacacctttttctatcaggaagttttttaagggagttacataggtgtcatattggttgtatttcgggaataccaggcatgagaagtctttcattccgtcaatggcatgaaggaatctgtgcatataaagtttcagttcaagtaagctgtgccagttttcgaaggcaaacatagaacgccagaagaaccagaaattactgttcaggaaagattcagaaaaataatcttcaatcgtaagatcgtccagctcttcttttttcttcaacagcagttttacaatcgccagctgatcttttttctcaagtccgaatttactgaaatccttgatctgtccctggttgtgaatgagtcttgctttggaataattcgggtcgttgtcattgataagacggtattcatccaatacactataaggtgcaggcagctccaaagcaggaatatcctggaacatgtcccataaattttcataggtcatatccatttcccttcctccccggataatatagccgtcttttgcgttgccggctccatcaagagatccgccttcaacgttaagctgatcgaggaaaatgatatttttgccgggtacacggccatcacggatgaaatagtaagcggcagacatgccggcaattccgcttcctacaatatagattttactgttttcgtaagactgtaaaggaatacctttattacgttgatagtttccgatctgatcggagaaaggcatcgttttttcaggagtgttaatctgaacttctttgcttgaatccggctcgtggtttacatttccaaactggtcagaagcatttaaaactttatcgaattttgaattgatcgtactcatcttttattgtttttaattaacaatataaaggtacctctattctgaaagcgatatatatccccaagttcagaattattatccccaaattcttatgactggatattttctttaattctatattctgaaggagaaagtgtagtgtgctttttgaaaaagcggccgaaagccgatgctgaattaaactgaagttcaaaggctatttctgagattgtgacgtccggatttccaagcatgacataagcttctttcagcaacgcttcatcaataacttcatgaggtgtttttccgcttgctttcttaatcatttcgatgaggtatttattggaaacgtgaagttgatccgcataaaactgaaccgttcgttctctggtaatattttcacggatcagtttaccgaatttcagataaagatctttctttccttcttccctttccggatttgcagcgttttcctgttctatgatctcagcagtttcaagcaatagattgaaaataatggtacgaataatttcttcagtgaatttaccctgtttcttggattttttgttaagataatccagaaggttctgcagcaataaagaattttttgcagtggtttttacaatactgtatgaacctttggaaaaaagattcattttctcaatgataaaaggattggaaatatttttaatcagaaaatttttgtcgaagaacagcagtttcattgtaaaatcgtcacttgcttttccaaatttcacaatcgtagagggtgcagcgatcaaaaagctgtgagcgtctaccctgtatttctggcggtctatctcaatattgatttcacctgcggtacaaatgcacagagcatagtaatccattctgaaaggagacttcggaaatttgaaaatcggttttccggaagaaatatagtaggattggcagcaatcaatactgtaaaaagataacgtgtcatgtaaattttcgtaggtaagcattcttacgtattgattaaatttttatggtgtttttaagaagttttagtttaaaactcctgttgttactgcaatttacgttttttataaaagcatttgggttttatgtattaaaaaattatttgagatagttgttttaaatggttttatgaatatgttttataaaaaaaggtttaaataaaggcttttgagttatttttatctaattttgcattttcaaatgacaccccaaatattattgtgagattaattagcgtatatacgagttcttttaaaggactctcgcaggaaagctggatgctggcgttggtaatgctcatcaacagggccggttctatggtacttccgtttctgggagtgtatatgaccaatcatttacatttcagtattgaaaattcaggaattgtactgagctttttcggaataggttccgttatcggatcgtggttgggtggaatgatcacagataaaataggtgagtacagggtacagagtttaagtttgctgctcagtgttcctttattctgcctgattccgctttttacaacagaagcagggttggcaggaatcattctggctcaaagtattgtaagtgaaacattccgtcccgcaaactcagtggccatcacaaaatatgcaaaacctgaaaatattacaagggctttttcgcttaatcgtatggccgttaatcttgggttttctattggtcctgcactgggtggtattttatccgctatttcttatgaatttctgtttttcagtaacgcattggctgccttgcttgcagggttgctatatatctggttctttaaggatcgtgcaaaattagccagagagaaagccaaaaaggtaaaagacgtaattgttattaaaaaagaaaattctccatacagagatgggaaatttttgatttactgtgccttctgtatgctgttttccatatgctttttccaactgttcagtacattaaccatattttataaggatatggctcacctgagccaacaaaatatcggatatatcctgggatacagcggttttctgattgtacttctggaaatggggctcgtacagattgctgagaaatattttacattagcttttaccatgctgataggaactttcctttgcggattttcttatgccatgcttgcttttgattacagtatgattacacttgtgctgtctatgaccttactctgtgtgggagaaatatggacacttccttttatgtcaaccattacagcattacgttcaggggataacaataaaggtgcttatatgggattgaacggaatgtctttttccattgcatttatcgtcacgccttacataggaacactgattgcggaaaagttaggttttaatacattatggattggaaccggagtattagcaatggttattgctattggtttctactttattattccttggatgcttaaagataaaaataaggtagaagaagagacaatatagcgcttttacttttaaatcaaaaaggttcgggcaatttcgtagaaattacccgaaccttttttaatatctataaaccatttatgataaagatcttgaaagaatggtattgatgatcatattcgcatgaattctggagttttcaataaaccataaatgagtatcttttcctccgcacacaacacctgcaaggtagaggttggaaatattggtttccatggtttcaggattgtaaaatggattcagacagtctccgttgagttcaattcctgagtttttaagaaattcaaaatccggaagatagcctgtcatggccagtacaaaatcattgtcgatttcatgaatttctcctttttcatctttaaaaactactgtgttttctttaatctcgaccatttccgaattgaaataggctttaatgcttccttccgcaattctgttttcaatatcaggttttacccaatattttacactttttgaaatttcagaatgacggatgatcatcgttacttcagctccttttctgtatgtttccaatgcagcatccacagcagaattactggatcctaccaccacaattttctgttttgcgtaaggataaggttcggtataataatgcttaactttaggaagattctcacccggaatattcatcaggtttggaatatcataaaatccggtagcaataattacatttttggcttggtagtttgctttggaagtcctgatctcaaatatttcatcctttttcgagacattcatcactttttcatacaggttgatgttcagttttttttgtctggcaattccctgatagtattccagtgcttcctgccttcccggttttggagcagtagatataaatggaatctcagcaatctccagcttttcagcagtggagaaaaaacgcatatacaaaggataattgtaaagagaattgacaatggttcctttttctatgattacataactaagattgtttttttgagcttcaagagcgcagtttaaaccgattggtccggccccgataatcagaatatccaacatttccatctaacaaatgtacgatgtaatttttaaaatgagaagccaaaactcctcaagtctcatagtctttatctctttatcttatgtaccgcttggcatcagatttggtgttttctaccaattgcaaaaccttaaatatgaaaaaattattgattgctgtatttgtcatgagccttattgtagcctgtaagaaagaagctggaaagcctgttccgaatgagatagattccatcgcacaaaataaaacagacagtgccggtaccattcagactaatgccaataaagaagctttattgaaacagactaatgatgaggttctgaaaacgcttaaagctaaagactatgttacttttgcttccctgattcacccgcaaaaaggaatccgtttttcaatgtatgctttcgttaatctgaaagaagacaaacatttttccaaagcggattttgaaaagtaccaacctaccaaaactttgtttacctggggagcgcatgatggttccggagatccttataaagcaacgatcaatgattatcttgggaaatgggtgttttctaaagattttacagcatcagaatattcattgaataaattcattggtggtggtaattccctgaataatttaaaggaaatatatcctaaagatgacttcacagaaaattacatcaaaggaaccgaaaaatatggtaatatggattggaaaacactacgttttgtatttgaagaatttgagggaaaatattatctggttgctgttataaatgaccagtggaccgtatagaagttagacgttagaagttagaagtggtaagtaaacttccggctttcagcttctaacttctttctttatattataaaatttcagtcagttggtgggtcagattttttcttgagaactgatcaatatgctgagtgttttcaagaagatcgccatttttccaaagattgaatttttccagaataaattttttgaccatttctgtgtcctgatacccaaaatgttttcctgcctgggtttcttccaggattttggcaacgtcagccttgtccgggccgaatgagagaatctgttttcctgaagccagatattcaaatatttttcccggaataatccctcttgaagactcattcggaaagttagtaataagaagcatatctgaatgctgcatctcttctacagcttttccatgagaaagatacccaaggttcagaatatgatttttaaggcttgaattttcgatggattgtagaattttatcatcaattctccctacaaatttcaatttgaagtcagccgcaaattcagcatgttctctgataagctcatccagaaccttccaaaggttttccggatttctgagctgctccaaaaccccaatataacttagagtaaatgcctgtctgatttgcaaatttgccttttcactattttgcccttctgcttttttaccagaatcactttcatcaaatccattggtaatacaaaccgcattggctcctgcttttctgaaattttctgcatcagtataacttgtcgctaaggtaatatctgcattcttaaatacggcactttccagctggcggtgctttttatccgaacttttggttaatttcaaatgtttgtaataggaaatttctgtccatggatcacggaaatcggcaatccatttaagcttgggcattttatttttaagccctaagccaatcagatggagagagtggggtgggccggaagtaacgatggtatctattttattttctttcaggtatttttccaggaatttaacagaaggttttacccagaaaaccctggcatctggaatgaaaaaattacctcttacccagattgaaagcttggatttccagctttggttttttccgacatcaaactgtccggctttgaattttttgttgcttttattcagcttttcagcaagctgataaggctcccatattttggttcttacgatctcaatattttcaggaacatctttcatcagggtttcatccagcaatggataacttggattttccggagtgtagatgatgggtttccagccgaattccggcagatattttgcaaacttcagccatctttgaacaccaggacctcccgcaggaggccagtaataggtgataatcagtatttttttctgttccatttttaatttaatggtctttgtcattctgaacgcagcgaagcgcagtgaagaatctcactctatctcttcattgagaaattttcaatctggattgaatccattaattaagttttctttcttttgtctggtccagccttttatttgtttttctctatttattgctgtctcaatgtcgccaaaatgttcaaaatatattaaataaaagcatttataccttgaagtgaagcttttttcaatagcttcaggatttttatgccaatataatctgttttttaaatcgttggtaactcctgtatacaatactgtttttattttatttgtcagtatataaacgtagtaattatgagtgcctaacgttttcatttgagattcttcattacgcgatgcttcattcagaatgacattgcgcaacattatttttattatttaaacactttgttcaccagcaatttcttttttcctgtttttgttcatccagaaaattccaaatgcagctaacaggataaataatccaaatgaaagaagagaaaaccattttcctttttcaatcacctcaggttcaaataccattctgatatgatggtttcctgcaggaacatgcacagcacgaagcaagtaatctgctttgatgtaaggaacttctttttcatctacaaacattttccatccgtgaggataatacacttcagagaatactgccaattgaggggttttcgactgagatttaaattcaagttcgtttggctggtatttcgtaagattgataaatgctgtagaatctgcctgaaccggtttgttatcaaaatatgatttgtcagatgaagcaatgacagctgtttttttgttatcaattgttccaatagatttaatttcctgtttagggctatctacaaattttaaatcacttacaaaccatgcatttccgttggcttttggattaggaacaacctgtggctggtcaggacctccgaaaaccatgtacttagcattcagtaagtttaatacattaggcgtttttacactgtcgatgctattgatatattcatttaatacatcatcataccttcttagttttacagcgtggtaaccaccgatagaagctttaaaataagaagtattggtctcactggttacacccagtgtctggttgtaaattctgtagtgagttttgtctttttcagcaatggtttccaatgttttgttaatgttgacattggataaaatagattccagattaggatttccctgaactttttccgccagcagatctgagctttctgtctggaaaggattttcagcaaagattttatctacgtagttttcgtcatttaaataacgcttgtttacgctccagagatcaaataaacttacaactccgatgacaaccaaggcaatattctgattaagctttttctttaaagtcaggaatagtgcagcagcagcaattgccacataaatgaatgcctttatcgcatctattctgaacagtttatatctttcatctactagatagtcaagcaggaaaggagggaaataagtcttttcgttttctgtagcaaaacctaataaagactttccaaagattaaaagaatcaataaaaaacctaaagttcctcctcctacgtaaagaaggattttctgtttgtattcttcagtcagtttttcatccgtaaagaatctgtataatcccagaatggcaattaatgggaataatagctctaccacaaccaggattgaagaaggagctctgaatttattatagaacggcacatagtcgataaagaaatcagacaatggcatgaagttacttccccaggccagtaaaatagtcaggatagaagctcccagaatccagtaacggtattttttccaggcaaaaaagaatcctaataaagcaaggaaacatacaatcgctccctggtaagcaggtcctgatgttcccggctggtctccccagtaagttaccccgctgaagcctttggaaattctgtccatttcagcctgtgaacctacattttcctgaaccagttcctgaactctgttcatgatttctttgccttcaggctcctggcttccgccacccattaatctcgggatgaacaggtttaatgtttccattcgtccatagctccacatcagcatgctttccttatccattccggattttcctgaagtatggctgttattatccagaatctgcttcccacgaactgtttcttttacatattctgaattggccataatcctctgcgaattcatacccactcctataacacatgatgccgcaataattcctgatgaaataagaaaatgcttcatcggtgtttttttctgaatagctctgatcagttcagaaaggaataagaatcccagagcaaggaacaggtaatacgtcatctgcgggtgattggcagcgatttgaagccccataaaaagggtcgtgacgatgaatccccagatgtattgtttcctgatataaaccagtaaaattccggctaacagcggtgcgaaatattcaatggtatttactttaccattatgtcccgctgcgataataatataaaaataagtcgaaagtccgaagaacgtagcgcccagaagagcgtacttccagtttctgactactaccattcccaaaaggaaaaaacctgcaaacagcaggaagagataattgaccggccttggcatgaaattcagattgctgtcaatttttttgatgatatcacccttgaactggcttcccatctgataagtcggcattcctccgaacatggagtcactccaataggtttcatttccggtattggctctataatcaagcagttcttttgcacctcctctgtactgcacgatgtcatgctggaaaagctgtttccctgaaaatacaggagtggagtataaaaatgctaaaactataaatactactaatgaaactgcaatataaattaagtttttattttttgccatgctggttattatcttttatttcttggaatttttaccttttgtcattactctcttttacctcttcatagtctacagtttctgcatcccagttaaggttctttttgttattcttgttcgagttgtgtatgtcctgctgtctcttattctggttttcattgttgaagcgatagctgtaaaaagtcttaaagaaaattcttttcagaatattccagacaaagaaaataataatggcagtgagtactaactcaagaatgtacttcataatttaaaaattaaagttcagggtttaaagtttatatttcaaaccctgaatgtttattcaagttatttagcagatgggttgaccattaccgaagaattggaaacgcttttcatagactgagactgttttccatccgaaatggtttcgatctgagttgtttttacgttgatattctggttggtgatccatcctgtgctttcgtcaaacttaatggttccgttctgaaccagttcactgctcaggctgtgtgtaataggtccctgagctttcttctctgtctttttaggaatacctccggttaccgcaatttctgcagctccgtttcctaaacttttcaatacataattggaagttacctttactgctccgctggcgtcagcattttcagaagtagaccatttttctccgattttcactccttttttaggaataatcatcaggtttttatgaaactgatctttcaatactttttcattgaatgattctttaaggcttgctactacgcttgctttttcattggcatctttaataagtgtccctactgcgttacctacttttgtgtaaacagcatcaaatcctgtaatggaaattacattccctttggtatccatcttcatctgaagtttgtttccggtaagcgctttgttgacattccagatcattttaagttcatcttctttaggaagaggaagcttggtatccactactacagtttttccctgtgcagactgagaacttctctttgctacaaggttaagagtcatttcatatacatttcctttaatatcatccaccacgaagttcatctcgtctgtagattcgctggttgcagtgatcgattttccctgaggatctgtcattgtttttacatctctctgatatgtagtaagaggataggtctttcctttttccagcttaaaagtctgtgttataacgcccgcagaatctttgatagcaggattttctgaaactttcgctacagaatcagcaggaacttctacagttactgtttttcctgttttaggatctacttttgttatttttgctgtttcttttttacaagatacaagagctattgatgatataagcgcaagcgctgcaatgtttctcattaattttaactttattttttactactgtttcttaataaattatctgcaatatcctgcagttttccctgggattctccatccgactcgttagaaagcactaccactcccatattttttgacgaataaatctgaagtacactcgaaaagccaaatgtacctcctgtatgataaacggtttgggttccgtcttcataggtatgtaacctccaatataatccaatagcatctccttcactttttacaagaggagtatgggatgcttttacatacttattactctcatccagatgatactgcatgtatttcaccagatcctccgtagtagatataattcccccggccggagcaaaaatagtggtgaaattcctgggcattacctttcctttttcgttgtaaccggtcaatcgttgtgcagaattcgtaccaagaatagtatgattcattttcaaaggctttgtaatatactctgcaaggagatctgcatagcttttatggtatactttttccaggatatctcctgcgatttgtgttcccgtattggaatatttatactctaagcccggaacaaaatccagttttgcctgatgaagatcttcataaaacttctcctttgaatagtttttataaaaatcggacagcagtattgccactgagtccatcggctttttgaaggtctctgactgatccggtaaaaactgtggcagtcctgaagaatgattggtaaggttgccaatcgttatcggatgctttccaaattcaagattaggataatctccgcccagatatttacggatgtcgtcattcattttgattttatcatccgctaaagcatgagccagaagagttcctgtaaatgttttggtgatggatgcaatctcgtacagacttttggaagtcggaagttcctgttttcccgtttctgttgttccgtaattataaaaataacttttaccatccttgaaaacacctattgaaagtcctacacgtgcaggatcctgcatatacgcaagagcttctttctgtaccatcttgtcaagatcagttgtaagacggttgtctgttgctatttttttggtctgtgcattaaaaataaacggagcaaaaaataagggtaaaagtgattgtattttcataatttacggattgggtatcacagccattttctgtcttaccgcttcatacaaaatcgctccacaagccacagaaacattcagagattgggttttgccttcaataggaagttttattttttcatcagcatgatgcaacacttctttggaaattccggtttcttcatttcccataacgatagcacaaggctcagtcatattcacatcatagattaatttctgagctttttcactggccgcatacactgaaataccgctttgctgaaggaaatctaccgtgtgtgcaagattgttttccttacatattttgatattatagatagctcctgctgaagtttttatggcgtcagaattaataggagcagcgcctttttcaggaatgatcaccgcatctattcctacgcattctgcagttctgcagatcgcaccgaagtttcttacatcagtaagtctgtccagaattaaaagaaaaggcgtctttccctgttcaaataactgtggaacaatatcctccactttatgaaacggtacatccgaaataaaagcaaccacaccctggtggttttttctggtaaaacggttcagtttttcaaccggaacataattgggacggattttatttttcgctaaaatggcctttaattcagcataaataggaccttgaagtgcattctgcacaaagatcttgtcaatcgtttttcccgcttcaattgcttcaatcacgggacgcagcccgaaaataaaatcgtctttcattgaaaatgtattatatagttatagagtgaatttgtcaatcgtgaattttactttgtaagtcaatttgttggatgtatattcacatctgaccattgacttgcgtaagcaagattcactatcttcctttctctcctaaaattgctcttttctgtgccatcacatatccgtagtgaaggctttcatgcatattgttgaagataatggcatcctgaatacttttcagatccattccgaaacttgtggtgtaaggcgtgtaatctgagaagaaatcactgtcataatccttcattaaaatctttgaagtttctgtaagtaaaaattccagatcttccacttctgatttctgaacatttaaattgggcagagttccctttttgtaggtttcaatccaatatttatcaatacggaacggatttccgctcaggtaatagtgcaggagctgctgtgtggcaaccgtgtgtgcaatattccagtaaatattgttgttgaagccatccggaatcagaatcagatcttcatgggatgtgttctggaggatatctaaaaggttttttcttacctgtctgtgcgcttgaaaatgataattcattttgcgaaatttttaatcaccaaaaatagtttaataaactggaaatgacaatttttgaacaggtgattaaagcaaattttatatatttttatgaaaaaaacggataatcttattgagttttaagccttcagcaattcgttaccttgcatcaatacaggaatttttaacaaactttaactcaaaaatggcatttattatgttgattaatgcaagtatttatcagaaatttaccacttattttaaatcaagctatgtcagagatatatcaagctgaagatatccgccaattgacggaaaaagtaaaagaaaaaaactacttattttctcttctgagacaggaaatcaataaagttattattggacaggaatacatggtagaccgtcttttggttgggcttttaggaaacggtcacgttcttcttgaaggcgtgcctgggctggctaaaaccttagcgataaaaacattggcagatgccgttcacggagagttttcaagaattcagtttacaccggatttacttcctgcagacgtagtgggaaccatgatctataatatcaaagacaatgatttttctataaaaaaaggccctgtatttgcgaactttgtactggcagatgagatcaaccgtgcgccggccaaagtacagtctgcgcttctggaagtaatgcaggaaaagcaggtaactattggtgatgaaaccatgaagctaccaaagccattcctggtgctggcaacccaaaacccgattgatcaggaaggaacttatctgctccctgaagcacagagcgatcgcttcatgctgaaatgtacgatcgattatcctgcttttgaagatgaaagacaggtgatgagaatggtttctacttcacatcagccgactgtgaagccggttatttcccttcaggacattgtagatgctaaagaattgatcaaccagatctatctggatgaaaaaattgaaaaatatattctggatatggtatttgccacccgttatccggagaactacggtctttcagaacttaaaaattatatcagtttcggagcttctccaagggcatccattaaccttgctattgcttcaagagcctatgcattcttaaaaggaagagcatttgtaattcctgaagatgtaaaggcattggctaaagatgtattgagacacagaatgggcttaacattcgaagccgaagccgaagagatttcaacagaagaaattatcaacagaattttagcaaaaatccaggcaccgtaatgagtgaagtaattatcagaaaagcagtcgtggctgactgtgctcctatgctggatttaatcagagagctggcagaatatgaaaaagcgctgcacgaggtgacagtgacgctggacgaatttactgaagatggttttggcacctctccggtttggggagcttttgtagcagagtatgaaggagaaatagtcggaatatcattgtattatgacagatattcaacatggaaaggaagaaggctgtaccttgaagatcttgtagtaacggaaagattgagaggaaagcagatcggaaagaaactgtttgatgcgacgctggaacatgggaaatcaaataattacagcggaatggtgttccaggtattgaactggaatgaacccgctatcaatttttataaaaaatacagtacgaagtttgacaacgagtggtcgaacgtatccattgagtttaaagattaacccaaccccggatccctaaacccgaatattgaactttgaatttaaaccttaaacttgtctatgcagataaaagatattgtaaaaaaagtaaagcagattgaaatccggaccagaaaaaagacggaagctgctttgatggggcaatatcatagcgcctttaaagggcaggggatgactttttctgaagttcgtccttatcagtttggagatgagataagaagaatcgactggaataaaaccgcacgttttcgtgaaccgtttgttaaggtaatggaagaagaaagagagcttacgatgatgattctcgttgatatttctgcttccatggattacggaacgaaagttcagctgaaaagagaatatgtggcagaaattgccgccagtttaggattttcagcggcaggtaataatgataaagtagggctgatcttatttgctgataaagtatataaagtaattcctcctcaaaaaggaagaaaacatattctttccatcatcagtaatattctcactgcagattatgttccggcagaatctaaaatagacaaagcaatggaatatatgatggggatttttaaaagaaaatctctggtgtttttattttcagactttgaagatgcttatgattccaaaatgctaagagtggcttcaaagaaacaccaactgctgggaatgcggatttacgatgaaaaggataatgaaattcctgacgtaggatatgctcttttgcacgatgcagaaacaggaaaggaaatctgggccaatacttctagtgcaagatggcgatatacctttgcagaagctcagaaacaaaagctaagagctctggaagaagactttgccaccagttctgcaggttttatgaatatcattgccggttcagattattcaaaattattgtataattactttcagaaaaaataaaaccggatcggtctataactaaaaaacatgaggcaactgcctttattattttaacattgagaaaaatacttttaatattatcctttctgatctgtgcgaatgctttttcacagatattatcctctaacgtagaaaagaaaacccttgccctgggagaaaccaatcatattactataaagattgacaaccttaatgggcagcaggttacttcagctccgaagaatgagctgctcccttttcattttgaagaaaccaaagacagtatcgggcaatctgccaatacctatgaaagaaaaatagaatttgctgtttttgacgaagggaaatttaccattccggaactggaattcaaagtgggtgataagatccttaaaacgattccatacgaaatagatgtcatcaatactgctcagaaagctgatcagattaatgatatcatgaaaaataaagaggtgaagcttgagccgcaggattactgggagctttataagttttatattctggctgcattggctggtattgcaataattattgctattatcatgtttgtaaaatggggcagaaaatccaaaagcgctcctgtagtagctaccaatcagactttaaaagaacttgactcacttaaaaagaaaaaatatattgaaggaggaaacttccgatcgttttatgtggaactgattgatatttcccgaaacttcattacaaaacaataccatcttccggcagatgtccttcttacagatgaccttattgatgttatgaaaaagaataacacaatctcccaggacaacgaaaaaattgtggaagatgtattccagagaggagatcttgtgaaatttgccaaaacttttcctgatcaggagaccatggagagagattttgccaatatcagggattttgtgaaaagatcatccaaagatttagaattcgaaaacttaagaaaggatgtttaattttgagttttacagtccgtggtttttactgctttttctgctgtttatcccacttttgattaaagatatcgggagaaagaaaagaaaaggcataaaggtacctacagtaaagaatatggatcacagtggtggtatccagggggtactttttttgttgaaaatctcaaaatatatcatactttccgctttgatcattgcaatggcaaggccgagaacatttacgatttctcaggaccgggatgatacaaagggagtcgatattatgttatctattgacgtttctttaagtatgctcgcaaaggatttaaatcccgatcgtatcactgcgttgaaagatattgctgtaaaatttgttcagaaacgccccaatgacaggataggagttgtcgcgtatgctgcggaggcatttacaaaagttcctgttacttcagatcatcaggttgttattgatgagattaaaaatcttaattctgcgggtcttgaaccaggtacagcgattggagaaggtctctctgttgccgtaaatcacctggtaaaaagtaaggctaaaagtaaagtagtcattctgatgacggatggagtaagcaatattcagaatgcgattcctccacaggtagctgctgaactggcaaaaaataataatataaaggtatatgcaatcggaatcgggaccaatggttatgccctgatgccaacatcacaggacatcttcggagatcttgtctttactgaaacagaggtaacgattgatgaaaataccttaagagaaattgcacagactacaggaggaaagtacttcagagctacctcaaacagcagtcttgaagaagtatacgatgagattaaccagttggaaaaatctgatgtgaaagtttccaagctttataattatgaagaatattttaagatatttctctggattgctttaggaatgctggtattggatgcattgttgagatgggtgttttataaaattttaagctgatgagttggtctttaggaaattattggtatttatttttactgttgcttctgccgctgttagcttcctttttgatccgttttttaaaatggagaagtaaaaaaagagaaatttttgcagccagtcagtttcatgaaaatttatttgaaaagaaatcaggatttacaaggtattttcctgcattgtatttattggcagttttatttctgatattctcaatcattgaccttctgaatggctcagaagaggtgaaaagcacccagaaactgaacaatgtgatttttatgctggatgtatccaattctatgaatgcagaggatatagatccgagccgtcttacagaagctaaaaatctgatgatggctactatgaagaaaatgaataatgacaaaatcgggattgtcatttttgccggaaatgcaatgtcgataatgcctcttaccacagattataattcagcagaaacctatatcagcggtattgaaacaagctctatgcagattcagggaactgattttctgaaggtaatgcaggctgctgttgaaaaatttaaaaatgtaagcaaggggtccagaaaagttgttctgctaagtgatggtgaggataatgaaggaaatgataatgcagctatacggttagcgaataaagaaggagtgagcattacttccgttgggatcgggactgatgaaggtgccccggttccggaatatgtttttggacagttgatgggatacaagacggatgttaatggcggaacagtaatttcaaagaggcagacggaggctttaaagaaaatggctgaatctacagatggaacctacattgacggaaataatatcaatgaggccccggacagaattgcagaagctgtaaataagaagtctgcaggtgctgaaaccatggtgaaatcacagaatgcaaatcattactatcaatattttcttgcggtatctattctttttttctttttaatttatatttttaatcctaaaaaggactttaatgtgtagatttcctctttatatagaagaaattctacaagtactttaaccgaattttaacaaataaaactctgtttcttaacatataaaggaataattttgcaagtgatgaatactaaaatcatatttttatcgtttattgttgccttctctttctcaggcttcctgtttgggcaggaaaactacagaaacttaatccatgaaggtaaccagaaatttgacggtaaagactatgagggagcctcctccaaatacatggaagcgataaaatccaatgataaagattttaccgctcattataacatggggaatgctctatataaaagtaaaaaatacgaagaagcaaaagcagagtttgaaaaagcagaaaaactttcacagacacttcctgacaagactgccgcacttcataatctgggaaatgcttatatgcagatgaatcagccggaaaaagctgctgattattataaaaaagctttaaagcaggatccctacagcgaggtaaccagaaaaaattatgagattgccaagctgaaagaaaaagaaaaacaacagcaaaaaaacgaacagaacaactcaggaaaaggtggcggcggtaatgatcagaacaaaggtgacgatcagaaaggcgacaaagacaaaaaacaggatcagggtaacggccctcagaatgaaggcaaaagtgaccagggagacaatcctaagcagaatcagaataacgaaggcagaatgccgaagaatcttgaaaatgcgatcttagataaaataaacgaaaaagaaaaagaaaccgccagaagaattttaaacaaaaattcttattcgatgcctgaaagcaacgagaaagattggtgatgcagcacaaattgatttacatattgcttaccctggcgtccgtaattacttacggacaggtaaatctttccatggatgcagataaatctgagtatgcgggtaaggatattatcaatcttactatcgttcttgaacttaacggaagcgaccttgtacaacagacaggtttacagcttcccgatctatcaaaatttaatatcataggaagcggatctgttaccaacacggtgattgacccagctaccaatacattaattacccaaaaagtatccagaattgcccttgaacctaagaaaaaagggaaaataaaaattggttctgtgctggttacggtaaacaacagaatttacaagacagaaccctttgatgtcaatatccgggatatcgttgacaaaaggtcaatggcttccaatacatccagtgatgtttatctgaatatggaaattgatgacagggatgtatatcaggatcagcctactgttgctgtactgagagtatactcaagaaacattgataaccttagaaaggtgaaaaatattcgtcttccgcaacaggataatatcaatgtgcatcccatcaattttgatagatctgaaatagatccgtcaggatatggaaatatgccttcacaggtgctggcgatgtttatggtattcccgaatgaagctggatatgtggaggttcctggagtaacagcatccgtaagtacctattcaaataaaaccaaaattgtttccaataaagttaaaatcaatgtaagaaagctccctgaaggtgctcctgagtgttttaaaaatgctgttggaaactttaatgtaaacgtatataacgcttccaaggaaaaaccggaagctaaaaaaccactgaatgtggtagtgaaagtttcaggtgaaggtaatttaccggatatggaacttccaaaaattgccgcctccccggattatgaagtttttgccccgaaaattacttctaaagtgactcccggaactacagggatgaaaggagaaatcttagctaattatgttattattcctaaaaaatcaggagcaatttccattaagacagaacagtttgctttcttcaatcctgccagtaaagaatatgtagatctgggacaaaaaacactggctttgaatgcattttctcatgatcagattatggaagcccgtactacggtagaaaaagtaaatgaatataccaataatcttcttgaaacggtaaatactcctgttttaaagaccacatcattcaaggtgaaagaaaagaataagattcactggaatattcttctaactaatattgctattctgataagcttgtttgttgtctatctgttatttaaaaattggcaaaaaaaacgtacattagttagggaaaatgtaccgtcaaaacctttaggttcagtggcagaaacagaaaaagagatcagagaattgatgaaaacagatatcaatgattatttcggatatctggaaaatcttaaagataacggagaatatgagaagttctttgttactctggaagaattggatgaagaggtgagaagtcagtatttcaaaggctctgcttcggagttcaggacttttcttgaaacgcataaaggctctttgatagcagaagaatatggcaaattgcagcagagagttcagatggaaaaatataatcctgtaaaatctgcagaagctcttgaagaacttttgaaaacaattgttaatttatattcacaaattagcaaataatcagtttattttcatatttttgcgaaatttttaattacaaagagatggaaatttttgatggtttctcttttaaagagattgttaccagctttatggttctttttgccgttatcgatattatcggctcagttcctattatagtaagccttcagcagaaattcgggcagattgaagccggaagggcagcaattactgcaggagttattatgattgttttccttttcgtaggaaacaagattctgaagcttatcggagttgatgtaaattcctttgccattgctggtgcctttgtgatttttgtcatagccctggaaatgattctgggaattgaaattaataaaacaactgaagcaaaggccgcatccattgtacccatcgcatttccgctggttgccggagctggaactttaacaactgcactgtctctcagagctgaatttcatgatattaatattatctgcggaattattcttaatacaattttcgtatatttggtgctgaaatcagcgaaatggttggaaagaaaaatcggggatgctactttgatgatcctgcagaaagttttcggaatcatccttttggcaatttcaattaaattattcactgcaaattttgcccagctggtgcagaattatattaatttttaagagtcatgaagaagttttataaagtatttttagtactgtttatcgtattcatcgccatcaatctttatgctatcaactggcagacaacagatatcttaggagatgaagataacctgaaatttgtattctcagcagcagctgcaggattaggtcttatcctgctttttgtaatggatacatggagcagaatcggtgtaaagaaataaattgaatatttcaatatagatataaacctctttcctttgaaggaggtttttttgttttgttaggtggtagggattaggtagtagataatagataatagataatagataatagataatagataatagaagattgccattagatttcaatacttctttctatcaatagaaacgggctttagccccgtttaaataaaatatataatttcaattggcttcagccaaaacttatgaaatcctacaaaattctataaaataacaagatttttcaatatggcttcagatttcagttccgtttctctccattctttttccgggttgctttgggctgtgattcctcctcccacgaaaatatgtacagcatctttataaagtcttgcacaacgcaaattcacaaagtagaaaatgctttcttcagtttcaaccttaatatagccggcatagaattcacgcggaaatttctcgtatttacggatattctcgttacaaaaatcttttggaatgccacagacagcgggagtagggtgaagatcccggataatactgtcaagatcatcaggttttatactggtcttaaaatctgtccgtaaatgtttgatatttcctgaaacatgatcatatgtttccgactgctgtacattgttagaatagtttttaagaatgttctgaatgtaggcggtaaccggcttttgttcttcaatttctttttcagaccattcttcagataccggcagggtacctgcaagagccatggtttcgaactcataggttgctttattaaacttacctaatacttccgagaaagctcccatccatgcattctgtccgtcattaaacaaatatctgaaagcattgggataggaattacataaatttttaaaactttctttataatcgattactgtaaagtcggtaaatatttttcttctggagtaaacaagcttaggtagattgttttctttaatcactttgatcacttcctgcaatgttgcacagtattcttctttcgtttcagctatagaatttgttaaatctatgatcagatcttcatttgtaaccgggttaagagaaaattccgaagcatcagattcaattatatctcctctgaagctgatttgatcttgtccgttataagaagaaaagtggacagtattttttgtatttttttcatcagtagtcagaagtctctcgtcaaaaggaagtttgaaataaatcatgagttatgaagattttgaaaatcatcagaggaaaatggtataagtaatttccagcgtgattttcctttctgcaaaggtattactagtctgaaagatgtcaaaataaaaaggacttaaatttattttaagtcctttattttttatgctgttgcaacttatctgtgaataatattattcgtcattgttgtatgattgataagtactcctttttcatcgcggatttcaatttcagaaacgtgcatcgttttaccttttctgataaaacgtgctgtagctgttacaataccatcctttttacttcttaaatgattggaattgatattggttcccacaccgtaatatttttcgccatcaataaagatattagacaggcttgaacctaaagtctccgctaaaacacagctcgctcctccatgcatgatcccaaacggctggtgagttcttggcagaacaggcattgtggctgtaagggtttcattttccagatcaatatcgatgaattttatttcaagtgttttggcaagagttacatctccccagttattgatgaatgctaatatttcttcttttgtctgacctttcatttttaattgctaatgatgattgattaattttgctttacactgtcattttcattccctgttcccataatattgggattccagttggcagggactttagggacaatatcatttttcacataataatcctgaatttcctgcatgatctctgaaaaaggtactgatgctattctttcgtacggaatagtatatcccagataaacaatttttcttttgaaatcacctgctgccagtacaataggaacttttgccgccaatgccatgtggtaaaaaccttttctccatttcggaacccagcttcttgttccttcgggggtaattacaagactgaagtcttccttggaaaactgattggctacaaaattgacaagatcgtttttctggcttctgtcgataccaatacctccaaggccttttacaatactcccataccaggctttggtgtgggcatctttaatgataatttttaaaggcttttctaaagaccagtaggcgaaatttcctaaaatgtattccatattatgagtgtgcggagccactaccagtatacatctgttcaggttgttgacatcgccctgcagaacgactttccagcctaatatctttaacattgctttgcctatcagctttttcatagattcttggattaaaaacaaaaaagtataaccaaactttggttatactttacaaatatattgaaatattatcgctcttaaaacaaaccgctaattaaatctacgattttcattacgaattccattgcaaattgtatcatgatgaagctgtgtttttgtttatttggttattaaatttttagctttacgaaattaaaacatttttttcatattagaaactaaatactgttttattttcacttttctgagagaagaagggtgtgaatttcaaacggttgccatccactcacaccttctaccactctctgaagttaattatttagtttgtatggaaatttcgttttttccgtctttgattttgatgtccatatccttgtttgatttcttgatagtagacacagcagaatcaattactttctttgcctggttgttcggaacttttttaccgtttacaatgatactgtctttatcatcagagttgtattcgatactggaaccgtttaccgtgattttattcttttcaattcttacattgttatggtcgtcatcattatcctgatcgttgtcattgataccatctccatccaggtctccgtccatgttgatgcggtcttttttcattgaaataacaactgttttttgcggaactacaagttcataatctaagctatagtctctgaatctgtgctcatatggatatttgatgtagttcggaagtaatactttattatttaccacttctacagggactgtcatctgaatagggaagttatatccttttccttcttttttgatgatcagataaggcgttttgatatccggttttcttgtaacatctacagagatataatcttcttcatacactgattttttatcagaataaatatcattgtcatatgctttgaagttctgagggatgttgatttgctttacatctacatatactgtatctgaagtagtgttgatggctacattttctacatcctctttatttcctctatagatcatgtctttcttagccatgctgattccgaagtaagttccaagcccgatcagaagaagaaataaacctcctacaacccatccgatatttctcagctttgtttttggagagaaaatcttgatgcttaataagctgaaaaggattgccggaattaaacttccgatcaccatcatcgcagccagtactttatccagtccctgatcatccatatagaatctgatctcattagctccggggaagtctgtgtccattgcgaaaagggcaaataatacaaatactcctataatgcttcctacagccatcagtacgaagaatcctcctacgatgtacttaaatacattccagattccgcttcctgcattgttgatataaggtttgttttcagtatagatttctccgaccctctgagtagattcattggcaaattgtaccagtttattagactcattcttaagattgtcgaagttcataggctttccctgcattttcaggaaatctgctgctgtttcagcttttggaagtacgatccaaagaattacatataaaagtcctattaatgaagaggaaatagctgctgtgaaaattcccaggataaagattccaagccagattgctctcattgcagtaatatccattcctacatattgagctaaacctgcgcaaactcctgctactttttgtttttccggatcacggaaaagctgttttttatctgtataataagctcctgaattactttttctggcagatgttttttcggaaaaataagcttcttcctgttcttcgattttttctgggcttccgatctgtgcaatcaccttttctacatcggtgtcattgatcacttcacgttttcctaaagaatctttgaagatttctaccattctaatttctatgtcatgcattacctcatccgcttctgaagcctccagtgagcttctcagtgcattcaggtaatcgctgagctttatatatgcgtgttcttctatcgtaaaagaaaaacctgcgagtcctattgagagtgtcttgttcatagctttgttttttaattttgttgggtgatttgatttactgaggctgtcagctcattccatgtattgagaagttcatccaggaaaagttttcctttttctgtgatctgataatattttctgggtgggcctcctgtagattcttcccatctgtaagagagaaactctccgtttttaagtcttgtaagaagagggtagagggtcccttccactacatccagttttccttttttcagttcatcaataagatcggaaacatacatttcgcggttattgatgagacttagaatacagaattccagaattccttttcgcatttgcgctttggtattttcagtattcatctttgataagttttgttaattagttatatttttagaaaaatgctcctagctagctgagcctattctaattttacattacaaagatatgtaaataaaatggtattatgcaatacaaagtagtgaaatttttaaaataaattatttaatcatctgataatcaaattaataatttttattgctgttttttgttaaaatgaattttggcaaaaaatgatgaaaaaactttaaattttaacacaccaagaaaagattttctacctagtctaattcatcttttattttatcattcatcatccatcacttattattataaggagcttgggttttgagatcgggataatgattcgtatttttgttaggaaaaaacacctaatccatttaccagtaccatgaacattttgaacagctgtaagcacttatcggtatttcttttattgggccctttatgctttgggcaatatcagtttgaagtaaaaaatatatcaaagaaatataatgcgattttccaggtagaaaattgtaatgatggccagtgtggaggaaaaggaacggtagaattgtttgataataataacagcaaggtacagagttttgcttctgataatcttgttttaaatccggaacagggacaaaaattgattccagggaaactgattcctctgaccaatgaccagcgttcagtaattatagatgactttaattttgacggaaccgaagatgtggccataagaaacgggaatatgggaaattacagctcggcttcttatgatgtatatgtattcaacagcacaagaatggcatttgtaaaaagtgaagaacttacagacctgggctcaaatggttttgatctttttgaaacagatgccaaacgcaaacgtcttatttcctacggtaagtccggttgctgcaggctttttacaacagaatatgctgtcattccgaacaaaggactggatagagtgctggaaaaggaggaagatatgaccaatgaggatcaggtaaaggtaataacaaaagaaaagatcaataataaatggattaccaaaaccaaggtgtatccggcagatcagtataacagaaataaaaagtaagatgaaaattcagaaagaaatcgattttatcctggcagtggatgccttgaaaaatgtgcagcgaagaaactacaatgccgatgattcccgaagggagaatacagcagaacattcgtggcagattattatcctggcccagatcctttatccatatgctaaaaatcgtgcagacattgatttgctgagagtaataagaatgctttccattcatgacctggtggaaatagaagccggagacacttttatttttgatgaaaaagcaatggtaggaaagtttgaaagagaaaaagcatctgcccagaagatctttggaattctgaatgaacctttacgtacagagttctttaacctgtggcttgagtttgaggaagaaaaaacgccggatgctatttttgcctgcgggattgacagaatcatgccgtttattttaaattcccatactgcaggaaaaagctggactgaagcaggagtaacggaaaggcagatccgaaatatgcttgaaaatgcgatcagcagagcatctgatgaaatgggagaggcttttgagcttttaatgaacagaaatcttgaaacggaaaaggttttgaaataattttaaaaagacactgctcatttgtgaacagtgtctttttataaatagccttttatgaggtgagtaacaaataattatcagggtttaataagattccttcctgagaataaaatcctgccatactattaaagacataaaacctcagttcgaaatttttataaggactgtccagtttaaattttacttcttttccatctttagaccaaaccggatttttgaccataataatggtattgcttgtctgctttccatctacatattcaaatagtctcaactgaagagtggctgtctttttcattggttctgtgaattgcaccaccatattgtttgtatctgctttcttaaaatctttattgttggcattgacaatggaaggctgtgagattttctttcctgttttcttcgtccattttaataatggaacatacagtttgtccagacttttatgctttttgtaaagttcaataaccttttcggaaaataaattctgagcaatgaaaccacgtcggatattcactttatgatagatagcggaaagactatccgttttttcttttggaaatttttctctgataaataaatcataaacagcccatgtcatatactcattaaatgaattgatcccaggatatcctgagtttttatcccaatttgccagattgaaacttgctgctatttcttttgagtatttatctgaaacagggtttacatagccatgatcaatttctgaaaatacagtgtgattatcaagaatccttcttgctagattatcttttaaatttccaaggataagatcttctccgatattaggaaagtcaacagttaaggagctgttaatatctctatggcaattctgtccgcctaccaaaggagaaatggcgataatatatttcttatctccttcattggctggtttttctgctattttatctaaaaaagcataggtatcattgatgtaataatactctttatagttatcaattaaggtattataaaactgttgatgatttttataaaaggttctgtaatttgatttcttcacaaaatcattaatcagttccaggttttcatctacttctttagggccaaatgaattgaatgcgaaatctcttttaagcatacctgcattatcaaaagaaaacgcataaaaatcagttcggaaacccaggaattttttccagtcttttctggaatagtttactttttttagcagtggatgatcttttacaggctcaaaataggatataatttcatcataatacggaggaattttctgaacatcatatggatctgtcttaccgtactctgtgagtgctaaaataatatttcccagttcgtagctttccgggagttcaatttttacgtctttttgtgctgttagagataccgaaaggatgagtgtaatgattaaaataatttttttcatgtaatattagttcttctatagtttagggaaatagtaggaataatttcctgagggctaaaattaaagaaaaatgtaatgaattccaatcagtgtttaatgaagatatattatagtgttttggaaaaatattcgggcggccagaggccgcccgaatatttagtatttatagtatctgaattggtttcttgaattcatcaatcgctacaaaagtaaaatcacctacaattgctttttctctttcgtaggagtacatctgctctgtgtaaatttcaacatttactttcatactggtttttcccacgtaggaaaccttcccgatcagttccacaatagttccggcaggaataggttttttgaaatcgatcttgtcactgcttaccgttaccactctttttctggcaaaacgggttgcggtaataaaagctacttcatccatcagctgcatagccgtaccaccgaaaagggtatcgtaatgattggttgtgttagggaaaaccgctttaaagattctggtttcggatgcttcaattctttcttctgtagtcatatatcattattaattaaagcgaaatgagagatatcaaaacaacagaacaatgacaggaactataggaattcctgaaacaattcatcagatcaatacaacttcagatcgcgaaagttacatgttcaagaaaaaggcaggtctcctgacttgtaacatcatttatctccttcccatgcctcgcacagtggatctttgataaagacttcagttacttacagttgcgcgacagtccgtgattttcacacggttcccttttaatctgcagtgatgcagaaccaatttctgtgatgaataagtataaaaacttttcggatgcaaaaataatgaatttattccggattgtggaaaataatctgactgattacccttcctttcttaatagtccacagagttgtatatctgttttctcctgaaccgttgatcatataaagaaaaatattatcgttgtccagggaagttactccaacgttctcaaaatccatggtaggctggaacatatttttgatagcttctcttacaaaaacagaacctcttcccggctgttgtactctgattgatttgatttcagtcatcccttcgagaagatcatttccgattccccagggttttactttatcaatggtaaggagttttccttccgcatctttttcctttttacgatatcctgcattggaaggataaatatcaattaccactttgcttctttgggcagtaggaattttaggatcagaattgtctgtgaaaataagtgatcttccgtttttggatttggaaggggtataggcgggaagctggtcaatataagcaatacgctctttattcaccattccttctttatcaagtgtttcataacgtacaaacggtttgtcatcatcctgtttttccggatatttgatccatatccattctgtttctccaggagcaggctttacataaacgaatacatcgcctttgcgcatacggatcttgtccacaatttttctgtaattgtctttatgaacccgcacattggcatatccttcttcagcttttaccactccgaaaggaactttattctgcccctttacaaaggccaaagaaaaaatactgaaagcagataaatagaatgctttgtttataaaagtcatcatgaaaattttttgatccttcaaatatataaattaaatgcttttcggaagataattataccgctgcagttcatttaaatcttgtatttgtttcagatgaccgtccgaaagcagatatataagttcggaaatatccagaacatctttaaaattatgatcagaaataataaatcctttatgtgctgactcctgaagtataattttctttagttctccagtaacctttggagaaagactgtgaaatggctcgtccagtaaaataaaatctgctttagaataaataatcatcagggtttcaataattctctgctcacctttggaaaggtttttaggtttatcatgaagaaaaggttgtacaaactctgaattaaaaagtaattcagtatttctttgattacaaaaaagaggaaccaggtttttgatttttatattttggggtaaaaagaggtcctgtggcaagtaggagattcggttttttctgtcggaaatgtttttcagaatagtgttgtcatattttataaactgagtatcaccatattcagttccgaagatgattttcagcagtgttgattttccgcttccatttcggcctaacaaacctatgatttgtcctgtttcgcatcctatataaatatcctgtagaattttcctttcattaaaagattttgttacactatcaacatgcagtctgctcataaaaataatgttataatttttacaataatacccgatactattgttcctgcccaaagaaacgtccttgaaaaacctgaattggcataaaagtaatattcacttttaaaccttacttcataaataaagtaatggagaagagctaaaattaaaagaaaacttaatccaaatgtttcaaacctgtggggtagcagaaaagaaataagtaatgaaaacaataaggcggggatcagtatctttttataaaagatccaaagaatagtaaagtttctggccatgttcaatactttatgaatagttgtctgatatctattatccgaatttcaaatgtattaaaaagaaaataataaagacgatatattactattttcatcactttaaaaaatgatattctgaacacttcattaaattttatttaaaatttgactaaatttgatattaatcttttaagctataatcatgaaaaagctagttctattatttattttgttcattatttcattttataaatgtaatgtattgaaggggaaagaaaatacaattgctttgttgttgccgccaacaaatgttacggttacggatataacccctacgagtgttaccgtttcctggactcctcaaattggtacaggaagtacagtatcttataataaagttggtcttccaggatcaggtggtacaacttacactacaagcagcagtataactattactaatttgacacagtgtactacttatgaagtaaaggtaagttatgtgcaggctggaggaggatattcagctcctgttatatttacaactcctatgtggtactgtatggaaaattctacagcaacaattactccttatctatatgcatcaaatgtgacacttaatgcaacagacctacctgcaatggttagtaattcaacaggaacaaaagcttatgcagattatcgatcggattctactcgcaaagtcaaattagttcgtggaagcagcaacaatactatttctgctactaaagccggaccagctgctcaaaatccaacaactatagggatttggattgattataatggagatagatcttttgactctaccgaaagaatactctactcaagtaatagtacagatataaatcctgtggcaacttttagtgtaccccaacaagctggacaagtagactgtaaagttgctatgagagtcatatctaatacaacaccttatttttcaaattgtggacctacagcagaaatacaggattatgaagttgaatttattgatgctgtaagtttgaatgttaatgaacgtgagatggtaaatcgtgaaataaatacttatcccaatcctgttgctgatattttaaatttttcagggacttcagaaataacagattatgaaatttataactccgcaggacagaaattgggagaagggaaaatttataattataaaatagacgtacatcatttaccaaaaggagtttattttattcagttgaaagacaaagaaaagataacccgattaaaattcattaagaagtaaacaaagagagaataccagaaggtattctctctctttatttgcataaattaatccttagattaattaaattctttcaagttcatccgcatcaatggttgttttgaaagttccgtaattgacgattactttattacgtgagattttctcaatagttccaacactggtgcttcctgtaatacggacacgctgcccgactttcatccacacagcacggtcagttttacgtttttcctccagtctttcattggtctcagcaattttttcaatcacttcttcttttttcaactgttgggtaatttttctcttaacgacctgcagacgtttggattcatccttatcagtacctaattttctgaatttttcctgttcaagaagctttacaaaatcttttacaacatcctttctggattttcctttggtatagctgtcgataaatgcttcgatcttatttccgaactgaagcttacggtgttcctcttcatacagcttctggaaattgaacagtttctgctgaagctggtcattaagcttctgaaggttatcacgtttatcctctacagattcttttctttccgcaaggtcggatttcagtttctcaacctcaaatttttcctgctgcagttttacaatcgttttatcgagattgacaatatcatgttctacctttttcttggcagaatggatgataaaccttggaattttattcttttctgcaacttcaaaggtaaatgaacttcctgcctgccctacttccagcttatacattggttccaatgtttcttcattaaagagcattgctgcgttttgggcatttgggagctgttctatcaccagtttgatattcgtatagtgcgttgtaatgatggcaaaactctttttgtcatagaaaaactccatgaaactttctgccagcgcacctcccagctcaggatcagaacctgtaccgaattcatcaatcagcaaaagcgtattggcatcagcctcacggatgattcctgacattttcttcaatcttgatgaatacgttgataaatggttttcaatggactggttatctccgatatcagtcatgattttttcaaagaaaaacatttcagacttaggatgaaccggaacgaggataccactctgaatcatcagctgtaataatcctaccgttttcagggtaatcgattttccaccggcgttcggaccggaaatacagataattctgttatgctccgttaaagtaagtgtctgtggatgaatcgttttattctctattttgtttcttaaccataacagaggatgataagcatctcttaatctcagtgttttatgatgattgattttcggaaggactccattaatcagttcaccaaatttcgcttttgctctcgtaaggtcaaggtcaaaaatatacacttgatatctccatagctgaggttgaaattctgccagttctgcagtaagtttacggagaactttatcgatttcttttttctcttcttcttcactttcacgaagcttgaagtagtgttttacaacactgtccggctgaatgtaagtaatggagcctgttttggaaattcctaatgtccttcccggaaccctttttttgaatcctgattttacagccagcaccctctggtcatcaataatggtttcccgtatatcgtccagaaaatcactctgaccatatgtggtaagcgcacggttgaagttttcctggatggcttttttagcaagctggatttcagttcttattcctttcagagctggggaagcttcattttttacttcaccaaaacggttaaaaaccttatctactttctcaatgatctcttttctgaattccagtacagaaacttcttccaataaagttgggaatgtttccggcatggtagggaaaaacttctgcagttttccgatctgttccgtgatggtttttattttgatgaaagcagcattttccaggcggtagttctcaatcagcatcagtttcagctcactttcaatatcttcatattcatcaaacggaatcgcatttgaactttcgaaacttgacaggtattctgacgttttctttaatgaaagttctgcctcgtctatttccatcggacgaagttgaagaattttttctcttgttttcggagaatacgcaaatggggagatttccgcgagcaattgcggaaactctaattcgtctaaatcttctttatctatatacacagtgcaaatttagtgagaattttgattattacgtatatctgagagatttacagaataaattaaccgggatttaaagttttaacactaaaaaataaacctatgatatttcttttattaaatttgaaatatgaaactggaaacccaaagattattactgagagatatcaacgaaagtcatgttgatgatattttgcgaatccgaagcaatgaggtgatcaatcggttcgtcattaggaagtctcctaaaaataattacgatgcactccagtttattctgacaatcaaagaaagaactcaaaataaccaaaccatctatttgggaatttcttttaaagatcagccgaatcttatcggaaccatctgtctctggaatttttctgaagaccggaaaacagcagaagttggctatgaattgctgccggaatatcacaggcagggaattatgtctgaagctttgaaaacggttttggattttggttttaatgaattgaatttagacgaaattctggctattacgaataaatttaatgaaaattcaaaagggattcttttaaaacatgatttcattttattggaaggaaagaaagataaaggcttccctgataatattatttttagtctgaaaaggctctctgtcagccaccattaaaaatccaaaaggttttctctatctttatcgctgattgaaattacctatgaaaaatgaaataaaatctttaacggggcttagaggagttgtcgcattatgggttgctttttttcattttagttttttcaggaatgaattcattcaggatatagtagggaagggctatgtagctgttgatatcttttttgtgctgagtgcttttttactaacggtttcttattctgaaaagtttagaaatctgaattataaagtaatagaggtcttttacaaaaaaagaatcaacaggatttatcctgtttacatcatatcagttgtttttattgtactgtttttagaaaaaagctctataattggcttcctgatcaatgccacattagtacaatgcttttttaatcccaattatctgctgaatatagtttattggtcgctaagcacagaatggatctgctatttgatctttccttttacgttatggattatcctgcgttataagattcgcagtgaaatcttaattatattaagtttaattctgaggtggatgcttcctcatcttcccggtcatttatatataggttctgaaatgccattgaaggaaggagaatcaacagcatatcttgatcttccttatggccttgtttcccttctgagaaccgtttcttcctattttcttgggattggggttgcccttttaactccatttaaaacaaaaaaagaaaacctcatcatttatattgttactgtaatatttatgtccttgttgtttattgataaaggaccattgtttattcctttattatcagcattgatgatcaaatgtctgtatgaggggaagaaaaactatctgaagacatttttggaaaccaaaacaatatattttttaggcaatatctcatactcattgtatattatccattatatggtgaagaagcagaatttcgttattgtacataattatcatcttaataatctgttattactatctttttcattattaatgtcttacttttcttatatgctgattgaaagaaaagtgaaaatatttaaggtatgattgttgcgcctattttattttaatattattatttttgcaatatgacctggacagaaattttagccccgataaaaagtacggaatactttaaaaccctttgggaaaaagtgaagaatgaatatgcaacaaccaaagtttttccaccaaaaaatcagatcttcagagcattggagttaacggcttttgatgatgttgaggttgtgattattggacaggatccttaccataatgactatcaggcgaatggattgtgcttttctgtttccgaacaggtagctgctccgccttcccttaagaatatttttattgagttaaaagatgacttgggagtggtaagaacttccagggagcttgatgattgggcaagacaaggtgttttgttgttgaatgctactttaacggttcgggctcattcacctaattctcataaagatctgggctgggagaaattcaccgattttattattaaagaaatttcggataaaaaagaaaatgtggtatttgtattgtggggcgcttttgcacaaaaaaaagccgaacttatagatccggctaaacattttatacttaaatcagcacatccttctcctttttctgttcacagaggtttttttggaagcaaacctttctcaaaaattaatgagtatcttgtttccaaagggaagaagcctatttcctggtagaaccagcggattgatctgcttttttgattgtaattccgattttgtattttccggctaacgcttttgctccatcctgttgtttaggatatggggcaatatcctgtagtgtaatcgtatatccgttaaactctgttgattggtgataatttcttgccggaaaatctccgctggcaagattcagaatcattggtcgggtagaagttcccattacctccacctgggcaacagcaactccggcccagatacaattgacaccttcgggacagcggctgtcttcagaaattcctttgaatgtaacattcatctgatattcccttaaaaacttattttctccttcactaaggtatataacaccatcttgctgattattggcgcttgtagatttcgtacctgctggcatttcagtggcttttgtgtttatctttgatttcttttgggcatcgcatcctgttaatgcaaatattcccaggctgagtagaacaattttatggaacatagtttcttatatttaattaaatgacgttaaacatattaagtagtactaccaaaaacattgccactcctaccacaaaactgaatcctgttccgtagatgaacccaatcagtgctcctttggtagatcgtaaggctttattcatatccttactgtcatgaagcaattcaccgatgaatacccctgcaaacattcctatcagaaagcccaacggaatcggaataaatattccaacaatggttcctaccacagaaccgatacttccccagcgtgtacctccatattttctgttggtcttcgccggaatcacatagcttaatactacagaagccgcagtaagaattccaaatgcccagatataaatcataggaagatcagcatctgtcccgaatttatagatcagaagcccgcaaatgcttagcaaaagccctggtaataccggaagaaaagttcccagtatcccgacaaatagtagaataaggcagaaaatatttataactgttgtatccattctttttaaaaatatagatgcaatataaaaaaagtggccttataaaaagccactttgagaactgagttataaaattttattacaaatttaagattacgtattccaggatgggtcctgttttaccgatatttccgcttgcatggttatgaaatgtggtataatagatatttccgctgcttgtagttcctgaacatgagcccacataatcgccatgtgcctgatgggcgctccatgcgttctgattaatggtaatggtaacattgttaccatttgccgtatgatggcagatcgtcatatgatttttgttcaacgacgttcctaccgggattttaggagctgtcgtgtctacatatttattggttcttatcatcagtggctcattacctttctgtaccaatacttcccagaaattaggatcataatgctgaattttttcccataaagacatatcatactgaatatccagtgtgctaaaccctaatgctgctgccatagcagtattggtaacactacagttattatacatagctgaattgccagtgttattaaaacaaatttttgtaagatcaagaaaccctccataaatactgcagcccgaaacatatttatctccgcctacaaggtaggcggcagcccagtccgaagtgtaaatgcttccgccattcgtaataaaagtagagagattactgaaaacagaaagatcattgccgggagagttggttcccgtttgcgctggattacgtgaaccacagttcagaaaaataatatcatactgggaaatggtgttgaaattttttaaatcctgataactgatttctgttgcggtataaccaagacttgtaataatggcctctatttcgtcgtaactgccttctacataagctatttttgcaatctggttcagtttggaatctttgccggcaacagtggttgtctcatttttgttaacggtaatgggaatctcggttctgaaattaagaccattacctgtctggatgtgaagaattgtatttccttcaggtaccgtcaggctgaatgtaccatctgcattggaataggtgtggtaaacctgatttttattgtcaatagtgaatacaatggcaccgccaataggttttgttccgtttttagcaaataccttgccttctacagttccggtaggtattttggaatcttccgggctgattgagtcatcactgcctttacaattgaataacaatacaagggtgcacagcatgatgaacaaataattttgtttcatatttaattgattttgattggtttagttttaatcaaatttaataaatttttaatattaaaacattaaatatgtaaattattttaatatttttcatgtaaatctattatttgtggtttatttttcaattataatcgtggcttgtggcagatttgatattttctgtgataaccgttccataatttttattaaatattttccggtgcataccctttgggatgaaaattgattatgaatagtaaaatgatgattcttaatttcataaatttgctgtaatgaatgaccagttacaagaaaccaaaaattttatacaggagctgagtgaacagctctatatctatattacccgcatttcacctgccgggctggactgggtttttcacattattgtaaagctgagtttacttcttattctgtttttaatcactgattttgtttttaagtttatcatcaattctgtattcaggtcatttcacaatgaacagaagtttccgatcttaaaatctgtttatcagtcaaaaatcaccaattctgtagcccactttgctgctttaattgtggtgggtgctattcagggttccatatttccggaaaatgcactgccaaaaacaaccatttttattataagatgtgtcaatttagggctggtactgatacttgcaggaatgctgtacaggtcgctgactgctttcagaaattatttcagcatcaaacaggatttttataagatcatggcacttaatgccatctcggaaacggtaaaaatcttaggacttttcgtatttacagtagtagggatctgtgtgattttcgggattaaaggaacaacaatcgtaggaagtcttggggctattactgctgtgctggtattggttttcagggatacaatcctgggatttgtaacaggtcttcacgtggccacttctaaaaacttaaaagtaggagactgggtaagcattcccaaatacagcatagaaggaaatatcacggagattaatctgttgactaccaagattaccaattttgataaaacagtgtccaccattcctacctatgatctgatgacgactgagatcaaaaacatgcaggtgatgtctgagtccaataccagaagaataaaaaaatcaatttactttaacatcaattcttttaaatttctgacagatgaagacattgaacgtttaaaggagattaacctgatttcagattatcttcaggaaagaaccaccgaaatcaaaaaagaaaaagaaagcctggtacataaagataaaattgtaaatggaagacagcttaccaatattggtgttttcagatattacgcacagaaatatattgaaaacgatcctgatattgacaaaaacggtacccggatggtccgtcagctggatatcactccacaagggctgcctcttgaagtatactgctttgccaatgattccaaatgggagcgttttgagcagattcaggcagatatttttgatcatctgctggtagcttcaaaggaatttgaacttcaggtaatgcagataagcgtaaaagtgtagaagttagaaaccagatattagaagttagaggctaagctcttttacaactgatgtttaagtaatgtaataaatataaaatttaataatagtatggaggtgtaaatggaaatgataataacaattcgttatctaacttctaacctttcatatctaatctctaaaaataacaatgacaaaactaagcgtaaacattaataaaattgcgacgttaagaaatgcaagaggaggtgaaaccccaagtgttacagaagctgctgtaaaaattcaggaattcggagggcagggaattaccatccatccaagacctgatgaaagacatatcacaagaaaagatgtttatgatctgaagccgttgattaccaccgagttcaatattgaaggaaatccgcacaagagctttatcgatatggttttggacgtgaagccagagcaggtaaccttagttccggacgctgataatgctattacttccaatgcaggatgggatacaaaaaaacaccttgattatcttacagaaattattgctgaatttaaaaaagcaggaatccgtacctctatttttctggatcctttaccggaactggtggaatatgctgcaaaaacaggagcagacagaatagaattgtatacggaagcatacgcaaaaaattatctgaccaacaaggagcaggctataaaaccttattatgatacagctgttgaagctactaatttcggattgggaattaatgcaggccatgatctgagtctggaaaatctgaaatactttgccgacaacattccaaatcttctggaagtatctatcggacatgctttggtttctgaagcactttatatgggattggaaaatacagttcaggcttacttgaaaagactggctaaatggtaattcataagaaattagaagttagagattagaagttagtacaacttcaattatattaaaaatagcataaacaaattatgcatgatttatctaacttctggtttctcacctctaaattctaaaatatggaaattttaaactcaaaaatattcggcgaagatttaacgaccacgccgcttctggtatttcacggattattcggaatgcttgacaactggggaagctttggaaaagatctcggagaataccttccggtacatctgattgaccttaggaaccatggcagaagctttcattcagacagcatgtctcatgatgacttggctgatgatattgcccgttatatggatcattacggaattcagaaagcccatgttctgggacattcattgggagggaaagcagtcatgcagtttgctataaaatatcctgaacgtgttgaaaaattgattgttgtagatatctcacctaaagcatatcctccacatcatcagggaattatcaaagccttggaaactgttgacttcaataaggtaacttcaagaaatgaggtagaagcagttctgaaccaatatattcctgaaaggtctaccgtacagttcttaacgaaaaacctgtattgggatgacaataaaaaactgggctggagatttaatcttaaaaccctatctgaaaaatataatgaatttgtatccaatgctgttaaattcggagtttttgaaggagatacattgtttatagccggggaaaaatccaattatattctgccgcaggatgaatatggaatcaagcaacaatttcctaaagctaaaatagttacagtaaaaaatgcaggacactgggtacaggctgaaaatcctgttgattttgcaaatgttgtgaaggagtttcttggtttagattaaaattttactcttattttgggtgttatgttaaaattttattaaaaactaatattatttctccatgagttgaaatttttgtactttggattttcaaaaaacaataaaaatattaacttatggaaaacaaaaattcaaaaaagaagccattttttgctacattcctggaaaaacaggttaaagatcctgaaacagtaaaaggaggaggtattacttctgtgctggcagatcagattacgacatcccttcaggatcagatcactactcctcttaaggataatgttaccaagcctgataatgataatgtaaccatgaaatatccttctgacggtgatgaggatgttttagaagtatgataatatagataacataagctaaattatatttaaaccaaaactaaaacattatgaaaagcaacaactcaaagaagaaaccgtttttcgcatcattcctggaaaaacaggtgaaggatcctgaaacagtaaaaggcggaggtgatataacacttgccgaaacagatttgatcacaaagccgacagtagacacggtaacgtctccgaaagatgatatgatgcaaaccatgaaatatccatctgacggtgatgatgatgtaatcaaccttccactgtaagatcagacagaatattaaataaaatagcagggaaacttaaacattaagtttccctttttaataaaaccggcaaatgattctctgcatcacccactcacaggatttttataatattgagatcttttttgaatatctgaattccaaaaatattccttatttcagattgaattccgaccgcctgaaccatcttcagaagatcagcatctgtgaaaactcatttgaactgacagatgaatcaggaaatacaattcattctgacgatatcaaaggagtatggcacagaaaagcctggaggatcagtgctcctgaagagctggatcaggattatgaaaggatttttctcaacgaatatggaagcctgaggtataatctgatgacggctttggaacatattccctggatcaacccttatgaaaacgaaaagaaagtagacggaaacaagatatttcagctgaaaactgcacagagaaataacttaaccattcccaaaaccattttctccaatgatgaagaaaaaataacgacatttttccatcagtactgtcagggaaaagccatagccaaacttcatggggtaacctcgaaaacgatgtcaggagaaaatatgatttcgactacagttattgaggaagaatcccttgaacacctttctgatattgcatactgcccgatgattttccagccatatattgacaaagaatatgagctgagaattgtctacgtggacggagatttcttcacaggaaagatcaataacagtgaaaatgcagactggagggtagcgcgtgaaggatatttctggtcagcctatgaacttcctgagactataaaagcaagccttacttctatgatgaaagaaatggggctttatctaggagccatcgatatgatcaaaggaagagatggagcttattatttcctggaagtcaatccccagggagaatgggggatgctgcagaaagagctgggatttcctattgcagaaagaattgccgataatcttatcaaaagaatcaatttccatgaataaaattttaattataacccacaccgcagataatttttctattgaaaaagtaacagaatacattgaaaaaaataactgtgaagtcatccgctttgatgttgatgtttatcctttgcaaaataaactttccaccatttttcaggatggagaatgggtaagctttctcgaaactcctgaagcaaaacaccgtttggatgacatttctgccatctggtaccggagagcttacaatatcggaaaaggattgaaagaagaaatggatagtaaattttacggggccgcaatgggggagatcaggaacaccctttttggcttcttcgaatccgtagatgcttactctttaggaaagccaagtatataccgaagattagacagcaaggaagaacaattgaaaatagcagataaattaggtctgacaattcctgcaacctgccttaccaacaaccctgatgaagccagaaaatttattctgaagcatcagaacgtagtagccaaaatgcagaccggttttgccatctatgaagacggtgtagaaaacgtcgtgtttaccaatgttgtaagcgaagataaactggaagagctggattcactgctgtattgccctatgcagtttcagcagatgattcaaaagaaaaaggaacttcgtattaccattgtgggaagagacgtctatgcatttgaaatagattcccagcagtctgaagatgccaaaatagactggagaaaagacggtattaatctcatcgataaatggagcagaacagaacttccggcagatgtggaagcaaaactgcttgaacttcttgatgtttacaatgtagactacggagccatagacatgattgtttctcccgaagacgaatattacttcattgagatcaatgctgccggagaattcttctggctggataatcttacagaaggaaaccttatttccaaaagcattgcagacgttttgtgtgacaaggctccaagaagaaataatgaagtaatggcttaaaaacaaagcaatttgtaatcatagaagtcctgaaagctgtcaattctttcaggacttttacttctactattcagctgtggttatatttttcctgtttattgatttctgaatgataatattggttaaattaaattgaattatgctttaaaaatcgcaaatttgcagaagcagtttttctgaggagtttttacagatccggaagaattgccggatagaaaatattgttatattttagtcagcaatcaagtaaataattaatgatttttgtaacgggtgctaccggaatcctgggaagagtaattgtactggaacttcttaaaagggggagaaatgtacgggcttccaaaagaccggggagcaatttaaacgaagtaaggcattcatacagcttttatacggagaatcctgatgatttttttaataagattgaatgggtaaacgtagattttgatgatctcgactctttgaaaactgcgctgcagggtgtagatgaggtgtatcattgtgccgcaaaagtgagttttcatcccaaagatgaaaaagaaatgtaccataccaacatcaagggtacagaaaacctgctgtttgcctgtgaaggatcagaagttaaaaaatttcttcacgtaagctccgttgctgttcttgataattttaatgaaaaaggagaattagatgaagattctgactttaatccaaaactggaacactctgcttacgctatttcaaaacatttatctgaaatggaagcctggagagcttcagcagaaggaatgaatgtcgttattattaaccccggaatgattgtaggaagcggaaactggaaccaaagcagcggagagcttttctctacatttgaagacaatagctttaccttttcaggagggtctgcttatgttgacgtaagagacgtagccaatactgcaatcgggctcatggaaaataatctttttggagagcggtttatcattgttgcggaaaataacaggtatgccgaccttgccagacagatcagaacccgtcttgggcttaaagaagcaaaaattcttaccccaactcaactcaacgtggggagaatagcgaacatccttttcggatggctgattccaaaacttagaatggtgaccaaatccaatattgaagctatatcttcattcaacaccatttccaatcataaagtcaaagaaaagctgaattaccagtttattcccgtaaaagaaagtatagactttcacctgaataattatattaacgacaaaaagctgaagaaatgaatcttgcagaggcaattatccttaaaaatgtagaaaaacatcctataaaagcggctatcggatttaaaaagaaagatgcagcctggaaagagctgagctggaagaaattcagtgagattatttttaaaacagccaatgctttaaaagaagcaggtgttcaggaaaatgacagagtcgctatttattcagacaattcatccgaatggatgattatggatctggcctcaatggctgtcggggctattacagtacctgtttattctaccaataacgcagaacaggcagaacatatcatcaacgattctggtgctaaagttgttttagtaggaaaccagatgcagtatgatgcctgcctggaacttttacataaagaggaaaacaatctggaaacgattattatttccaaaaaagcagtgtggatcaaaaaagaatttaacagcttttatctggaagattttatagcaaaagcttcaccaaagctggagatctgtaagagggaatatgatgatactgccacattaatctatacctccggaaccaccggaattccaaaaggagtaatgcttactcacggaaattttatcaaagcgttcgattcccattttgaattttttaagtttaaaaactttgaagaagaattatcgctggcatttttaccgttaagccatgtttttgagagaagctggagcttactttgcttatatggcggggcgcgtgtttacttcctggaagaccctaaaaatgtagccaaagcactggaagaagtaaaacctacggcgatgtgtgcggtaccgagatttttccagaaagtatgtgccggagtcctcgaaaaggcggaagaaggttcatctttgaaaaagaaaatctttgactgggctcttaaaacgggatgggaaacagccgagctgcgaagaaatgaaaaacaggtccctttgggattaaaactgaaagaatctgttgctgatatcctggtcttcagtaaaattaaagaaaaaatgggcggaagactttggtttttgccatgtggtggcgcatcactttcgccggaagttacccgtttctttgaatcagtaggaattcatgttactgtgggttatggattaactgaaactactgcaacgttgacgcttttccctttgactcattttgagcatggtaccagcggaaaaccattgccaggcgtagaaatgcgtatcggggaaaatgatgagatccaggcaagaggtaacggtatcatgaaaggatattacaaaaaacctgaagaaacccagaaagtgtttaccgaagacggatggttcaaaaccggtgatgcagggaaatttgatgataaaggaaacctgatcattacggacagaatcaaagatcttatgaaaacgtccaacgggaaatatattgctccgcaacagattgaaaacctcctgacgaataataatttcattcagcagattatgctgatcgcagaaggacgacagtttgtttcagcgttgatcgttcctaactttgagtttttacaggattatatcaaaaagaataatattccttttaccaattgggaagatgctgtgaaaaatgaaaaggtaatagatctttacaaggagaaaattaaagaattacaaagccacctggcagattatgaaaaggtgaagaaatttaccttaatgccggcagaatttgatatcaatacaggagaaataactcctactttgaaggtcaaaagaaatgtggtaattaagaaatatgcagatattatagagaagatgtactaaacagtacctttaaattaaactatgacgacacaagaatttacaggaaaagaaaatttcaccattcatacacaaacggtttcagagagctgtccgtctaatattgccctgattaaatactggggaaaatatgctgatcagattcctgccaacccaagtatcagttatactttaaatcattgtaaaaccaatacttcaatggaatttatggctaatgaacctttttcagtacaaactttccttgccggaaacgaagaggtgaagtttgccgaaaaaattgaaaaatattttagaaatatagagcaataccttccatggattctgaaaggtaaatatatcatcagaacagaaaatacatttccgcacagctccgggattgcaagctctgcttcaggatttggagcgatagcaaaatgtcttatggcgttggatgcttcatttacagaaaaaacctttgaagaagaatctttgagaaaagcttcatttctggcaagattgggaagcggaagtgcatgcagaagcttatacaacgggcttgtggtatggggagaaactgatgaggtagaaggaagttctgatctgttcggggtgcagtatccggatactgaaattcatgaaattttcaaaaactttaatgactgggttttattgattcatgaagggcagaaaagtgtttcttcaacagtaggacatgggctgatgaaaaccaatccttatgcagaaagaagatttcaggaagccagggaaaactttgttcctatgaaagaaattctgaaaaacggagatatggagcgttttatcaagctggtagaacatgaagcgcttacactacatgccatgatgatgatgagtgatcctgcttttatcctgatgaaaaccggaacgttggaagtcattaataagatctgggatttcagaagagagaccggatctcctttattcttcacgttggatgcaggagcgaatgtgcatcttctgtttccaaacaacggttctgaggaacagatcaaagcgttcatagaagctgaattattacagcacacccagaaaaatggagtagtgaaggatgtgatgaaattctagtatgaaaaagaaaaaactttatattcttattgctgttgccattgctttattacttatgttttttgctgaatatgaggtaggaacagaaaccggcagctggggtagaaacagaactattaattggggatggaacttcggattttaataaaaataatgatgtttaatagaagtgggcttagcccacttttttaatcttcagtaacaacagcctcccggtcgccttcttctttttttccttccttgatcatgatttctgcttctgctttttcttcagcagtcgctttttcaatcaattcttcctgctcatcattgtgatgatctatgaaaaattcgcagtataccggaaggtgatctgaaccgaaattatccagggttttcagctgtttgataaagatatcttcactgtgaaacatcagatcaataggaaatcttaaaagacgatacttggcgtggaaggtagaaacaaaagaatgtcctactctcggatctatcagatgactggtttttctgaaaagtacagatgatcttgaccacgcgacgttattgaaatcacccgccacaataacaggctttctgatatcttttatacgtttggcagcacttaggagatcgccatccctttccttcgatgtttcctcctctgtaggactcggcggtggcggatgtacaccgaaaaaaacaaaagagaatccatcagctgttttcatgtgaatttcaatacttggaatatcatcagccacaaaataatgagtctttgcttctttaatttcaactcttgaatagaaatgcataccataggtgttttcaagagttactttatgctgataaggatattctttttccagtgatctcattgctttttcccaatcgctgttactttccatcgtcatgaaaaaatccggattatgctttttaacaaggctggagaatctctcatattctttattgaactgataaacattagccgaaataaaatgcagcttgtcagaagacctgtgaagctgtctgtgtttttttacaggatacagaggtgtataccttacgagagtccggctgtgatagacaaacaaggccaataaaaatccctgataataccatagatgttctttcgaatcgatgatcagcccaaacagaaaagtgaaaaaaataagataggtaacctgtattttagcaaattcaggaacccggaatatccagtgggagtgctgaatgttgggcagtacagtcatgaccagtaaaagtatggccagggtcatataaataatccacatatgaaactatgaaataatttggttacaatttaaggaaaatgaattttaaaatttattgatcaatttaaatttaattttatctatttttattaatctaaatctgttccatgaataaaatagttgtgttttttcttctgatcagtatttcaggcttcggtcagcaaaataaagatattgaaaaacctatccgtaacttgtttctcggcatgaaaaatgcagatcccgagctggtaaaatctgcctttacggaaaatgcagtccttcaaaccataacgaaagacggtactgtaaaaagtgacagtatacaggattttattgcttcagtttcaaaatttcccaaaggcgatctggatgaaagaattatcatagaagctgttcatacagacggaggcctggcgagcgtatttactccttattccttttatttaaaggggaagctatcacattgcggggctaatagttttcagttggtaaagcagaataatgagtggaaaattcagtatattattgatacgagaaggaaagataactgtaaagaaatacaataataaagttgaattcagaaataatttaaaagtaaaaaatgaaaatccatcatattgccattatctgttcagattatgctgtttcaaagaagttttatacagaaattttagatttgaatatcattcgcgaagtataccgtgaagaaagacagtcttataagcttgatctggccatcggggatcattatgtgattgagctgttctcttttcccgatccgccacagcgtccgtcacgtcctgaagcatgcggcttaaggcatcttgctttctccgtagaaaatgttacagaaaaacgaaatgaattgatagaaaaaggacttgcttgtgaagacatccgtatagacgagttcaccgggaaaaaatttttctttacccaggatccggaccacctgcctttagagttttatgaaatgtaaaattttagtgtgcgtaaccggtaaggaaactcaccgccataatcgctaaaacaatagaggaaatgactacatagacgtagtctttttcttttaaataccctatcagagcgaaaacaatcctcatcagaggagtaatgatcagtaaaagaatacccagctgaatgatggccataccttctcctttgcacagagaatcccagaaatatccccatatcttttcagaagaagtacctaccacaagactggtgtaattttcaggcattttaaaaccttcgaagaacagtttgataaaaccgatcagtgatgtcgccacagatagaataacacccagtctcagaagatttcctacggaacggttcagatctacatctgtaaaattctttttcattatctgaaacttttgttgataccgttatacatcatataaattgaaaggatggtaatcacaatggcaaaaaatacttttaattttttcgtttttgataccatcagcgtctttgaaccgatgaagcttccgatgaccacaccaatcagtaccggagctacaattaccggaataatttctcctctctgaaaatagatcagtgcgctggctactgccgttactccgatcatgaagttactggtggttgtagatactttgaaaggcagtttcatcatattatccattgccaataccttcaatgctccggaacctattcctaaaagtccggacatggcaccagcaaacatcatcattaaaaatccgggaactgtatttcttgcagaatagcttttcaatatgcctttatccggaaatgttccgtatagtttcagcttatcttcaagacttcctttgatcagtggctcctgatgatccggttttcctttaagatttaaaataaccgttaaaagaagaatacttgcgaaaataattccgatggtattcggattaagcattcccgaaacaagggcaccgatgatagctcctgctgtagtagctatctcgagaaacatcccgattctcatattggtaaagccctctttcacgaaagctacagccgcaccggaagaagttccgatcacagaaatgagcgaagcaccgatagcgtaatgcattggaacgccgaaacccagcgttaataaaggaataatgataactcctcctcctaaacccgtaagtgaacctaaaagaccagcggaaattgcgccaaggaagagtatgataatttctgacatactacaattaatgatacaaatataaaattattgtgcttgtctgccaaacatttgaaaaagataaatttaacgtatttttgtatgcatgaaaaatcatttgaaattattttatgtcattctgggggcaacacctcaaggaagaaatattgagcagcacgatgttttcttcggaattgcagagaatctgaaagacctggttccggatatgaaagacttttggaaggaagctgatgggaaaatccacgtagactgttaccaggaagtacaatttgctgacggatatgaagtggagattgtgaacaagggagaaaagtcatctgaagaccagctgttttttctcaatttaggagggtacaagcctggtttctttgaagaatttcatgagcagcacttaatggtaggaccatccatgggcgaaatcgtaaaaagagcaaaagctaccgaattttatcagacgatgggttttgaaggagctgtaagtcatattgatgataagcatggagtagatattgacgatatttttaatgtgagtgatattcttcctgcccatatgaaagaaaaatattctatcattcttaaaaaatctgatgcagaaagtcagaagaacccgatgggacttggttatttaaaaattgataagatccaataagaataaatctaataaaaataaaaaatgaaaataggaattctgggaggcggacagctgggaagaatgctgatacaaagtgcattgaagtatgatgatgagttttatactctggatcctgcatctgatgcgccatgtcataatatctcgtattttacgcagggaaatttcaatgactatgacacggttctgaacttcggaaaagataaagatgttgtaaccattgaaatagaacacgtaaatgcggatgcactggcagaacttgaaaagcagggaataagagtggttcctaatgccaatattatcaaaaccattcagcaaaagatccttcagaaagaattttataaagctcacaatattccaagtccggaattccaggtggtgtggaacagtgatgaaaaaatcatcatgccgttgccattcgttcagaaaatgaataccggcggatatgacggaaaaggagtccaggttatcagaacggaagaagattatcagcatatctggacagaagcttcagttatagaaagtcttgtggatattgacaaagaactttccgttattgttgcaagaaacgaaaaaggagaaaccaatattttccctgtaactgaaatggtggcagatccgaaactgaatcttttggactttaatgtatgtccggtacttttaacagaggatgttcagaaccagattgattctattacggagaaattcctaaacgcagttaattctccgggattatttgctattgaattattccttgataaagaaggaaaagtatgggtgaatgaaacagcgccaagacttcataattcaggacaccagagccaggaaggaaatacgaattcccagtttgagcagatgtaccgagtggtaaaaaatttacccttagctgataccgatgctatcacgtacagcggaatgctgaaccttgtaggagcagaaggatatgccggaaaagtagtttatgaaggaatagaagatgttctaagactgcctgaaacctatatccatttatatggaaaaacagaaaccaaaccgggaagaaaaatgggacacatcaatgtccttgcagattccagagaagagcttatggaaaagcttatacaggtaaaaggaatggtaagagtgattgctgagtaaatcatttataaaatataaaaaggagcggttttatctttaaaactgctccttttgttattcagggtattcaatagaaacggctttagcccgacgctattgatgatttaaatcttttataatcaaggatttttaaccacctcaatattatcctttttataattgtatttaatataacttcctaaagcggttgataaaatagagaattcttcaagcgatgtaagtggagcatagagtttaaaagtacagatatctgttgctgaaataaaaggattggtaactaaatgactatgggtagacatggtcactgttcctccgttttccaatgatgtaaaggcaggaataagccttgagtgaaactttttatgggaaatgatattcccttttttatcagaaacaaaaagataatcattaccgaacggaattactccatgttgtgcggtacctggtattaaatacaccttatagttttcattaaacggaataataatcatattaagactatatccctgtggtactgttacctcatattttgagtcagacagctgaggaataatagtggaacggatattttttaaaatattttcgttttcattaagccccctttctttgaaattttcctttacaggtttcatctggttatttttgaaagaaagttctgcaataatcatatcaccggccttattaagaaaggaggttttgatggtgtcgtttttctggtatgtgatatagcttcctatattttcagcaagtcttttattactgcctacaagatctcctgcatgccaggatgcattttcataagaatagagtagatttccttcagttttgatagaatccagcttctttttcagttctttatctgaaagagtaaggctttgtgcagaaataatgatggacataaaaaggaagagaaatccaatagtttgtttcataggttattttttcgagccaaaatacgaaattcaataggaatagtcttgagctctttcttaaataattatccattcaaatgattttagccgaaacataatttaggtttcggctaaagccaatttttttcctattgttcacaacgggctaaagcccgatcctattgatctattgatgagtgaaattttttaatgatctaataaaaatgattattggcagagaataaacttccaacatccctcttccagcttccatactttctaaatttcttttatttaaaaatcttctgaattacatttccaatctccacaaaatctccgtgattccctacagaacgtacctcgggactgtttttgtcatattctgagaaagggaaaatcagcagatagttattctcgcttagatttctgttcagaagttccggaatcagtctcattcttggaatataggatttcataccgcgtttcgccatcagaataatcaaagcttcatcatctttaagctgtgctgcggttttttctccgtcctgccaggtgctcatgataataaattctgcttctatattagctttctttatgattttctgaagaatatcaataatattttcaggtgcataaaaaacaaccgtagctccggagtttctggcaatgttccataccctcagcaatgcatggaagaatcctgcttcctggtgggcattttccggaatcattacggcatatttcttaatggtggaaagaggctgcgctgcatggtataccaatacattcacatcatcattctgcagataaccgttgtagagattgtaaacgaaagagggagagaatcctttttcatcttctaatccgatgatcaggtctgtgattttctgttctttaattacattattgactccattgatcacatcattgtcgtatctctttaaagcctgtaatgtaacatctgccgcggcagctgcatcagctgcctgatgaagaagtttttcagcattttttactgaagattcattcttatcttcattaatcacattcagggcaaacagatcttctgtattggagtgtgctttgatcaggattcccaggttcaccattctttcaactgttgcttcatggttaatggctaacaggatattttcttcttcatgtgtatttccggaaacggtatcttcattatcgctttcagcaattttctgggcacttgccatcgaaataaaggaggaaatggtacacgatacaagaatcaggaggatacttccattcagtacatgttcattcagcaatcttacaggttctccggtttccgtttcagaaagaataatattatatccaaccatcacagatgcaagggtggccgctgcagaagcggaacttaatccgaagatcagttttccttcctctttagtaagtctgaatgttttttgagtagcaacagcagaaaggtatttccctccgatggaagccaccagcataatagcagccacttccagcgtttcccagcttttaaagaacactttaaaatcaatcagcattcctacactgatcagaaagaatggaataaagatggcatttcctacaaactcaaccctgttcattaaagaagaggtgtgaggaataagtctgtttaacgccaaacctgcaaagaatgccccgataatagcctctacaccggccagttcagcaagcatggccgccagataaatcataaccagtacaaaaatatactgtgatattttatcatccacccgtttgaagaaccaacgtcctatgatagggaatacaattaatacaatcaatgcaaaaaccacaaaagacacagataatttgacccaaaattctgttccgacatctccctgagacatgcccacaattacggcaagtaccagtaaggccagaatatctgtgatcatggtacctccgacagtaatattaaccgctttgttttttgcaattcctaacttgcttaccaatgggtaggcaataagagtatgggaagaaaagaggctggcaaaaaggatagacgtcagcattgaaaaatgaagaatataatatcctcccagatatcctaatacaaaaggaactgtaaaggtataaataccaaaagtgagacttttccatttgttctttttgaagtctcccatatcaatttcaagtccggccagaaacataatgtaaagaagtccggtagttccggttactacaatactactgtctcttgacaatacgttgaatccgttggggccaatgattgcaccggcgataattagtcccaaaagatgcggaactttaattttattaagcagcaggggagctgcaaggatgatgaccagtaccaaaagaaatttcagtaccggatcttctatgggaagactcagattgtgtatactcagtaaaatcataagtgtttttattttgtggaacgtactaattcaacagagaacttggcggtacagccatcagaagtgatggttcttgttcctttgatcttgttgtccgaaatatcattaagaagaacgttcatttctacattctttttggctgtagaatctgttttgaaagacaatcttatttcattattctcaaatttgcccgtatacagcctcaccagattattgttattgataattttggtgacaggctgggtaggatcattatcaaattcccagatatcggtgcgctggtcacccacagcatattcactgcagttggattccgtacagatcacttttccgttccatgggccagagatctcggcaggccatgcagcaattaccacagaatcttttttagcaaaaatactgtctctcattttcagaagtgactggtattcggattctttcttggcaaaaagcttttctttctctaataattgtttttccctgtcgttcaggttcttttctttctctttgtaatcacagcttaccaataaaaaagaggcagccatcaataaaaaaaatgtgtttttcagcatattgtatcggttggagtatacaatataggaaaaatgaaggaaatatgaaacctatgacacgaagctctgattttaattgtatttaataaactcaaaaacagaagaatagaaagcctgatattcctgatgttattttttcttacgactcgattctttgttttttaaacatggctggattgtaattaatcacaaaaactcccacaatgatcagtattgctgcaatgatgaatttggcagaaattttttcgtcaagaatcagccagcttaaaaaaatagagatgattgtattgatataagccaatatggatacctgaacgggagaaactttggtaagtgcatagtgaaaggcaaaaaatgcagctacagaaccaaggcaggataaatacagcatggcagaaatacttttcaggctccagtttccgaaattataattttctgtaaaaagaaatgcaaaaatgatttgtacaatccctgcaaatgcaaactggtaaaaaaggttcagtgaaatatttccactttgaatattaagctttttcgtgaaaattgttcccgaagcccacccggcaatagcaataaataaaaacagaataccaagggcataatccggattcttaagatcattgatgccgtcccagaatatgaacaggattccgctaaaacatagtacaactcctgcaaaagcccgccagctgaatttctgaagtcctaaagccatgcttccgaaaaacaccagaataggagagcacgcacttatcagtgaggtcaggctgctggtcacttcttcttcagcaacggttgtcattccgttggcaaccacaagcattaaagttgaaaagataagctgatatttcaggttgttccatccaatccatttaaactcttttttataggtaagaataagaaacatgattacagcggcaagagattgacgtattcctgctacaaaccatgcgggaatagtttctaccgcaacccttatcgataaaaacgtagtaccccagacaatagcaacggtacatacagccagtgtaagtttataatctttcaatttaatgtggtgtgacagcaaatatatctattttaaaagggattgtaatggatacagatgcggttatttataggagtacagatgaaaaatttacgccaaaaaaatcattattaattatttaaatagtaaaatgtacatctattgaaaaaataaattgttccagaaaaattgttgcctttcacctttacgttttaattttttatctttggacatctaataaaattgaagatggtaggaattattatgggcagtcagagtgatctgccgatcatggaacaggctgcaaattttcttaaaagccttgatatcccttatgaactaacggtagtttcagcgcacagaacaccggaaagaatgttcgattacgcaaaaacagcccaggagagaggtttgaaagtaatcatagcgggagcaggaggcgcagctcaccttccgggaatggtagccagctgtactacacttccggtaatcggggttccgatcctttccagtaattctatagacggttgggattctgttttgtctatccttcagatgcccggcgggataccggttgctaccgtagctttaaacggcgctttgaatgcaggaattttagccgcaaaaattttaggaagcggtaatgaagaagtggcagctaaacttcagaaatatcaggattctttaaaggataaagtactgggaacagtagatgatatcaaagctcagcatcctaatcattttgataaatagtttattttaaactcaaaatagaagcctcactttacagcgaggctttttgttttactttttaatgaactttaaagagatagtctggtctttcaaaatgagttgtaaaatgtaatttcctttcaaaagaggtcctatattgatcatatctttgtttggatttccttcttgcacaacccttccgcctgcatcataaattttatagctcttaatatcatttaatccttcaatatggatatcatctaccgcgggattaggataaagtgaaaacttttttctgacttgtatgtctgatgaagacagcaggcagtttcctacagtatcacccgacatcgtccatcctttattgataagaatattccttttgtctgccgcatttgaagcgtatttcagaggtgctgtaatatctaaatcgacgttatttgcagtgttaggattgtctgcccatcctgccagtgttttactgaaattttcacaatccattcctgtctgcataaaagcttgggctccgttattaacgctggcaagattccagcttgcaagggattgattaaaattcggagtttccttaagaatctggtctattctcgtaaccttggtcatgtcccaattttccagggaatgattaaaggctgtgcagccatgaatagcatgggccatattggtaattttagaagtgttccaatggtctaaagattgattgaaagcagaatcaaaatggaacataaaacgaatgtcttcaaggcttgaagtatcccagttattcataggttgattatagcttgggcaaagagcaaacatccatttcatatcagttacattcgaaacgttccagttgtttaaagtctggttaaagagtcctcttcccgcaaacataaaactgagatcagttgcagaggacatatcccaactattaaagtagggaggattaaactgatcaggaagtgagctaataatggtgtcaaaaataagggcaaacataaacctgaaattcttaatcttagaagtatcccagttttgcatggaacttgcgcctgtaaagctttttgtaccataaaacatgtaagaagcatcctcaacattacttaggttgggaatgtctgtagcagtgatctgaacaagtttacattgactgaaggcattgttcattgatgtccagacaatatttccccattgttctatttccagtattttatcagcgcttccgttgacctgccagatagggaagatctgatcaggaagctgtgtctcctgtacttctccaaattttatttgtttaaaaacgccatttccgttacttacttttactctgtattttgcagcatccttatctccgtatgacatcccgaaatcaataaaaacttgctttgtggaagttacaccaacaaggcttccattatgctggggaaaatctacttcttcccagtaaatgtcatagttttcgccaattccgggaaaccatatttgttgatcaccagcctgataaggagcacttactgtaataggctgtgttacagtagaagcaggcttccagatggtgataaattcattctgggcttttatcatgcataccatcaaaattaaaaagactggcaaaaattttttccgtatcatattggttatttcttaattaattttgaagaaaatgttttttctttcgtgataagctgtatgatgtaatttcctttgggtaaagcgcttacattgattatatcattgttaggatttccttcctttacgagtcttccgctggcatcataaattttgtaatttttaatatcacttagcccttcaatatggatatcatctgctgcaggattaggataaagcgaaagttttttattcagctttacatctgatgaggacaataaacagtttccaacagtatcaccagtaaatgaccaacctttattgatgagaatacttcttttgtctgacacattggaagcatattttaatactgttaaaggacctaatgagatattgttcgccgtattgggattatctgcccatcccacgagtgttttactgtaattttcgcaattaagtcctgataatgttagagaaccggtaccattggtaagagaggccaaattccagtttcctaatggctgattgtagcttgttgcaccattcagtatatgatcaattctctctactttagtcatgtcccaattttctaaagactgattaaatgatgtacaaccatgaaatatatgagccatattgataactttggaagtgttccagtttaacggctgattgaagaccggaatcatatgaagcatgaagtgcatatcttcaaggtttgaggtatcccagttatccagacgctgattgaagcttaaacactggccaaacatccagctcatatcagttacttttgatacatcccagctgttgagagtctggttaaaatgagttctgtttgaaaacatatagctaagatttgtggcagatgacatattccagctgtcaagataaggtgggttgaattgctctgtcagcccagatggcaatggtgtatcaaataaaagtgaaaacataaaactgaaattccggatcttcgaagtatcccagttttgcatagagcttgcacctttaaaattggtagtaccataaaacataaaagaagcatcctccacattattaaggtttggagtatctgtggcagtaagctccataagcttgcatagactgaaggcgcagttcatagtagtccatgaaatattaccccactgttctatttctagtaatttatctgtacttccattgatctgccaaatggggatcagttgctcggggccgggaagtagctggaccgttccgaatctgatttgtctgaatgtaccgctgccattgctcacttttaccctgtattttgcatcggacccggctgataatgaagtgccaaaatcaataaaaacctgctttgtagaagtgatattggtaagagttccgttgtgctggggatatcctacttcctcccagtaaatatcataattttcaccaattccgggaaaccatatctgttgagaatttgcctgatagggagcatctacatttactggtggtaaaacagtagaacccggtttccagatggtaatgaattcattctgggctttcaccaggaagaccagcataaaaaaaaagaatgttggaaatttttttaaagtcatgtttaacgttttataggtattagttgtctttgcttactgtttaataaataggcgagggtagatcttattattcattaaacctgttagagaatgaatgtggaattatcagcactttcctatatgattgtaccggagattttttacaatgaaataataatgcagggagagaaaaggtaaaatttttgtacatgtcattagtttgtgaaataagcaaagctaaaatacgaaaaaatcaatataattttaatttaaatgtaaaatttataaaattttgtattgtttagcaaggttgtataatgaaacaaactctccggattggagagtttgttttattcctgaatcatgttgtcccgggtgtttttctgaacggctatggctccgaaaagagcgagcaaaaaggcaaaggcataaaaacccttttcacttggaaggatggtggcattccaaagccctattgccagtaagacaatagatgataatgtagcaaaccagcagattccgtaataaatatccgtaacctgaatattttctaatctgtctcttacggctttctgcaaagaaacaacagcaaataagccataaagcaggatggtgaaataatatcctttttcattcagctgcatttcagctcttgcaagaccgacaatgaaaccgatcattcctgctcccaatgctacccatgatgcagcaacaaatgcattcgacactctttgttttttcatagtttaatgttttattttaatagggctaagatattcattttttataaatacagccctaatagagggaaaatataggggaaaaccgggataactgcatgaagcaggtttatgttttgactaaagccaatagatgttatttttatttagtgtcaacgggctaaagcccgttcctattgaatgattatgatgatgaatcgaatttcgtaattccaattttcatagcttcgattgtaactttatctccaaacgtaagaaagaataggagagttggatatggaacgtctggtttgaagaatatgagtgagtacggagtcaacacaaaaaaaaactctccaaaataggagagtttatcttattgcgtgatgtattcataattgtactgaacagaaagacttccgtcagcttcctttccaacaacctgaaccggtaatcctgagctgttgtattgtatggtgtaagttacagtctggctttgctgccatactccgttatttttaaagcttattttttctacgagataattattcttgcttaaagtataagctcttcccatcataattttgatatacttattgatattggtgtaaggattgagtttgtcatcataagaaaaatcacttttgttgctgtaagttatagttcctccccatgttgacgtttcagatgaaatattgtttccattataaacatacgtatcagtgccaggattggaacaatcaggattctgacagagtgtggaagagatcacctgcccgttagcgttataattataggtggctgttctgttataattagaatttgtgtaaatcgcttttacgtttgccagctgatcaccattgtaagtatagactgaataataatctaccgtaccatcaggcttataataggttgtttttgagggttttccggcattgtcatattcgaaggttgaagttcttccttctgaaattgttttgattagttgtctctgattgttataactcaaagttgaaacaattgtttcaggattggaaggattatcgtaataaatagtggttaccttactcagcaatagctgaggctgttcagaagtgttggttccctcattatcatcattactgctgcagctgttaaagaataagacagcgcccatcattcccagaaataataattttctcatggtattttttttgtgggcaaaaataaggaatactgtataatgttatataaaaaaatcccactatcttaaaaaatagcgggatcatatcatgtttagatttcttttagtatctgtaatactcaggcttgaacggcccttgtacttctactccgatgtacgcagcctgctcaggagaaagagtttcaagctctacgcttaattttttaaggtgtaaagcagcaactttttcatccaagtgcttaggaagggtgtatacttcgtttttataagcagcagaattgttccataattcgatctgagccagagtctggttagagaaagagttagacattacgaaacttggatggcctgtagcacatcctaagtttaccaatctaccttctgcaaggatgatcacttctttaccttcaacagtatagatatcaacctgaggcttcacttcagacttcgtatgaccatagtttttgtttaaccatgccatatcgatttcattatcgaagtgaccgatgttacaaacgattgctttatctttcattttaaggaaatgttctcctcttacgatattgaagttacctgttgtagtaatgatgatatcagcattgtctaccacagtgtctaatctttttacttcataaccgtccatagcagcctgaagggcacatattgggtcaatttccgtaactgtaacgatagaaccagcccctctgaatgaagctgcagtacctttaccaacgtctccgtatccgcaaacgaccactctttttcccgctaacattacatctgtagctcttcttactgcatctacagcagattccttacatccgtatttgttgtcgaatttagatttagttacagaatcatttacgttaatggctggcattaccaaagttccgttcttcattctttcatacagtctgtgtactcctgtagtggtttcttcagaaagacctttgatatcttttgttaattcaggatatttatcaaaaaccatgtttgttaaatctccaccatcatccaggatcatatttaatggctttctgtcttcaccgaagaataaagtctgctcaatacaccagtcaaattcttcttcatttaaacctttccatgcatacaccggaattccagcagcagcaattgcagcagcagcgtggtcctgtgtagagaaaatattacaagatgaccaggtaacttcagctcctaaggctaccagagtctcgataagcacagccgtttggatcgtcatgtgaagacatcctgcgattcttgctcctttcagcggctgagacggtccgtattcttcacggatagacatcagaccaggcatttctgcttctgcaagggtaatttcttttctaccccattctgcaagggagatatccttaactttataaggaaggtattgtgttgtagtactcatatgtaatgaataattttaaattcaattgataacgaaaggcaaaattacaattaataattaagatataaaaacgacagatcaagttcagacttatgagattaagcatgaaattctgaactatgaaataaagctctttctatgcttaacctttgtacgttcatgtcatcttcttcaaatggtttcttttcactatttttgtccaataaaaaaagaatgccactttaccgagatttttcagatgataatgcaacgatccttgtttggaagtatgatgaaagtgaagaacttgatatcaatgaacttctggaaccggaaaatgctgaaaaggtaaaagattatcatcctaaaaaattactggaagtcctgatggtgaggaagctcttaaaaggactgaagcccggttccaagattttatataaagaaagagagccttttctttctccttatgatgcggaaatttccattacccattctttcccgtttgctgcaatagcgatctctaaaaataaaataggaattgatattgaaaagtttaatcccaagatcttaagggtaattgataaattcacgtatgaaaatgaacggggattcattcctgaggacaaagcggatactttttttacaattatatggagcgtaaaggaaagtatgtacaaaatccatcactcaaaatactggtctttaaagaaaaactatgaagtgaagcctttcgagctgaagcatcttcacaaaataagctgccgtgtctatgacgaccagttttcagatgagttcaaggcaagggtagagttttttgacgattactgctttacgattgtggaggagtaggatctgtttcgtttctgtatttttcgattacttttctctgttctttcgctacatcatagatcagttccagaatatcctgaatgtttttaagctctgtcagatgggaaaccttgtcggtatctcttctgtccacgatgtcattttcctcaatttcagtttttcttttcagcagcatatcttcaatagaagaatcttccggctccagacggctttccatttttaatgtttcattgatgtcatttccgttgagaagggtagaggtctgccgcatttctgcttcaatttttctgctccagctttccgcatctatttccggatattgctcattactttttgcatattgagacaaagatgcggtataggctgtaatcagatgggaggtcgccacaaactgatggacaacttccagttttttctgctgatttttaggatcagaaatcattctctggaaattatccgaaagattagccagagagataattgcatttttccgttttactttataatcttcaaggtcaaaatttccctgtaagaatttggaaattacactctgaaaatagataaggttatcggcagcagactttttcatcagatccagattttgggtatgttcccaaaccggcagcacaatataagatacagcaaaagcaataattccggcaatggctgtatcaacaattctgtctttaaagataatattgactttccctggatttaaaaaattaaagctgaggaagacataaatcgtcataaataacaccgcccagaaatatcgtcctttcagaaaactaaagcacataatcatgctgataagcagaatagcaaataaaatcccgttaatatgaacgaaatacaaaatagcataagcaatagttgcccctgcaatagttccgtacagacgaaggagatttctttgtttagtaatagaataggctggttttaaaatggctgtaatcgtaattaatatccagtaagtatgtcccagtccaagaaaatcaaacatagaaaaaagatatcctaacagcaatgccgttgtaattctgattgcatgtcggaaatgggatgatgataaagaaatattatttcgtaataccttggcgttaagtttcggctcattaggcataaatttccttaagtccaaccctgtagataaactttttgccagctttatatcctgtgaaaataccttatagatctcgttgatttctttagtgatctcataaatacgcatcaggatctgacgcaggatcatgaaattttcgaggttgtcaggagaaagctgtttatttctgagttcgaaataattataatttaaattctttaattccagttccagattgaacatcgctttggctcttgtaccgctttgaagtgcaattccgatattggtgatctcttctgccaaaagattaagataatcatgaatattcaccagaatcatgctgtcttcaaaactctgctgcagcttttgataatcactttcagaggtcatcagcttttcatggaggtccatggaattcaggaacatcagcatcaataaacggctggtggtcgtagattcattgacgatagttctggttttgaaaacggtttctctggtatcttcctgaaggttctttatttcaatctgctttgcgataacctgagtagtcagtttattaaagtccgggtttttctgataataattagctttaatctttaaaaagtcagccagctgaagataattttccccaatcatctggcttgccagcttataagggcgaatggtagttacaataaggaaaataagtaaaaaccatgtacatccggaggcaaatatcaggagacttttgaagatattacttcctgtaagatgtccgtcaataaagattgcgagtaccacaagagataatgagcctaccgcagccagcctctgaccataaaccccgatcagggagaaaaacatcccgaaaacaatgacttccagaaggaccagtattttgatattcattacaagacttgcaatgagtgccacaaatacaaaacagcagatcgcaaaagtaagggcatttcttcttcggataaaaggtccgggctgatctgtaagtgctacgaagctggtacctaacgggaaaaggaaatattcttttaagattccgaagtgggcgaggactaaacagggcagaacagtagctaatgtaattctgatcgcagaatatacatactgactggttacaaattttttgagttccgccgaatagttcatactacaaaaatagctattgaatttaagaaaatggccataaaaaagagacttttctcaacttaaatattatatttttttaaagtgctgtgttattatttaaaatagaccaataaatgaagcacgattgataattcatagatcaatgttggttattaaggtcaatggtgaatttttgcttcgcaaagtgaatggtgaaattttacagtgtaaaaaataaattgacaagcgaagcgtattgacgattgacgattcaagtatcaaaaagtgaattttgctttacaaagtgaatgatgaatgtttgcagtacgcaaaaaattgacaaacgaagcgtattgacggttcatcattgcctataaaaaagcctcataactaatatagtatgaggcttttttatatagctgttgctttttttaacggtctacgttggatgtttcgtcaccgatgttccaggtaagcccgaaacgaagtgtgttatccaatgcactgttgatcttggacatgttgatcaggtaagaaaggtcaagcccgaaagaacggtattttaacccaacacctgctgttgcaaactgtcttgctccctgctcttcgctttcatggaagtaacctcctcttacagaaaatgcgttgtcataagaatattctaaagcaccactgtacatgatactgtttttatttttgaaagattttccgataccggccattggccctacgttcgggatctggtaaataggctgtcttgtatttgggtctattccggcatattcagatcctggaaccaaaagttttgaaccttccacagaaattccgattctgttcatatcatccaggtacatatcatatccaacccctaatcttgccatggtaggaagataagatcttgattcttcatttcctgtataatccagtttaggacctaagttctgaactgctaaacctgcatttattttaccatcatagccaccaatactggagaaccttggagagttatagtatgctgaaacgtctactgcgaaactgtttgccgctttaagggtagtatctgtgttgaatcctccggctaagtctgaacggatgaatctaccggtaacagctcctgagaatgaatcagaaagtttcaatgcgtaggcaacgtcaattgagaattcgtttggttttgatgtacccattgatgcgatttctgtacctaccagctgagtcaggtctacctgtcccatattgaaataatagatactcgcggaaattgtagatctttcttcctgcccaagaaacttatggaacgaagcatataataagaatacatcattggtaagtttccccatataaggcgtatagttaagacctacggaagaacttgacctgctgaaagggtatttagccgcattccagaattgtgaaaatgcatccggagaggttaccaccccctgatctcccatacctcctgatcttgcatcaggtgcgattcttaggaaaggagctccggtaagaactgggtttactttacctaaatcttgcgaatagcctaaaaaaccagcactcaaaccaaatcctaaaagcagtttagtagttaaattcatatgttgtcttttatatattatcagttttttattaatattattgtctatgttttattttattatttcaaaagtaccattttttctacagctgtagcacttcctttgcatttttcttgattttgactttttgcaaatatcttaaaaatatacgtacctttcgctactgtagaaccaaaatcatctcttccatcccattctattgcctgacgaggggttctaaagccctgcaggaacggttctgcaaccaccggctgtgataaagttcttaccagtcttccggttattgtataaatctgtacgttcacatccagaatgtcatcacaattgtgttcaaactgaatataggtcttgtttgtaaacggatttggccagttcagcggacggttgatggtcaggtgctggtcagattcatctttaacttcaaaatttaacgtagcagttgtggaattattgtttatatcccaaactttaaatgttaattgatgctgaccgactgccagatttctgaaagggtaggttacattccccttctggtactcggcaagacttggatttaaacagccgtttccttctcccggggcgtaaaaatcatttaacacaaccgtattgataatctgcccgtcaagatataccgtaatatcgtgtcccactccggatcctgttgagttgattcctgtatcatcagtaagacacgcaagaagcataggattctggttggtaattcctccgtctgcgaagttggtattattcatgtatagctttactttcggaggttggttatcattgattccgtttggattgatatcacccacctgtaccgcctggttgttgaaaacatccgttgacttgttatctgcgtaggctaatattcttccctgccccacagcataattaatgtctttaggtacatagaattccgcagtaaatacaccgtttacagcagttccagcagattttacaatcgcacttccttcttcggtatattctaaaaccggagataaaacaccactgttatttaaggtttttttgtttaaccttttatcaaaaatattgatgcttacctttccgttaaaagtagtattcaatgttccgtttggattattgacgtgtccttttatttttacgaaatccagacctctgatcagtcccggaaccggcgtttcaatattatcaattaccagaagtctttgtggtctgcttaatttcatagcaggatcccccaggaagtttacttttaaatggttactgttgggtcctttttgctttttagcaagtaagtgggcatttcccaacgaattaaaatcgtcattggttagtttaaaaatattctgggtaaaggtattggtaaaatcacgtccgtaatctactccgatagcacggctggaagtaatcatggtagaagctccgccctgcttcattttaataaactgttctcctacagagttggttgcaggctcatcccataatgtaaattcacaggtgatggtagagacaaacggaaatctgctgtatacattagagaaattattggcattctgaacttcagaacttgtaaggactctttcctgtgcccacccattgattcctccatgcccgaaataaaacaggtacaaactgtttccgatagcattggagatcgcctgattgacctgtggatatcttcgtccgccggaagtactctgcgcggtaaaagcatccatatataactttttaacattatattctttaagttccggctgacccggctgttcaaatatactggatagtgaactgtccatcacattatggaaagggcttcctccttcattgttgtcatcaacaacaaaatcaagtcgcatacgccagtctccgaaaggggttgactgtccctgaagggaattgtaataagccagtgttttattgatcatatctccggcttcgcttgcattggctgccggaattctaccaaccggaagatccgggaggttgttttcaattaataatgtattttgtggcttggtcattacgatataatcatccgttacaaatgatgatacataatctgaagactgctcactctggtagctggccacaacatttgtattgttcggaactctgtttttataatcgtatgaagcatccccgagaatgaatacatactgaagtctgcccacaggagtattgagcttggtaacgaaatctcttattgcagtaaggtctctgcttccgctgccatattcctcatagatcttattgatgtcaacaatttctaccttatagttatgattggtctgatggtagctggcaagtctttgcgcctggcccatcatttccggaacggtaaggataaggtaatctacgttttgtatagcagacagattctgattggaaattcttcctacgaattgcggactgaaagctgcatcagcacggaaagccacaaattcattattgaaattctgatcagaagcagtataagcaaagttgaaagaacctgctccggccttattcacccttctgctggcattggtaatatccgttacatcccatacctgttctatggcagccgcattgctgatgctgaaaccatagttagtgttacttccgcttacaatagaataatctctgaagttcatctgtgagccattgaaagtaagattttccttatactgaacttctacataatcaaaataaaagcttccgttgggattcttggaaatatcaggattatacaccaatgtaaactggtttccggtaagatttgttaatgttccggagtaggtgacagggtagaaggtatactgatagctcgaagtatctgaaggaatcgtctgtatcggctgtggatttaagttgttgatcttaaaatcaatggtattctgctgggaattatacgctaccacctgagttctgtatcgtatcacatcattggcctgtataggtgaattggtagtaagcgttactgttttttcattggtgaaaggagtatcttccacccacgttcttcctacctttaacaggtttttctgatctttgttgatcacctggtagctgtcgtaccttgtgatcaactgggcagggagatttccgtcaacagtgggaactctttttcctgcacctttgtcaaagttgatatagtaatatgagaaatcctcatatatatttttaacattattgcttgggttgatacgggtttcatgtcttttaaaaccatttccgttggaagtatcataaaggttatatccgtccgggccctgcgcatagaaaagagcataatcattgtcattccatacaccgtcatcttcacctactacctgaatggcattttcctgtaatgccccgtatctcggatcctgattgtactcaggaagcatgacgcctccgtttccataaattctgaaattctttgggtttacagaagcaggattaattccgttatctttcaaaaactgtgatgtgattttgaatatcccggacttgtctacttttattttataaaaattgccgctggatagcggattggctgtagttcctattttattaacggtgccggaggtattaacaaatgcggaagcttctgaaacattgaacgaagataatctctgaacacggccttttacatttttaaataaagcaatgctgatactggcatagctgtctccttcggatgaatagtaagaaacgtctgctacatcatggtcaggaagtctgcctttatccagttcaaataaatcctggttggaaacgttctcccagacaaggtctgagatttttaactgcttttctccgattttttgcttggttactataaaaacattattttggctgaaagaaaaaccctcatttttaaaattgggaagaattaattttgtgtcaccaaaatcctggattttggaaccattccattcaatggtgtttctttgggcgtaaagtgttgatgcaaaagcgattaaagataaaagcgtaatttttcgtttcatgtttactattgaaattgctaaattacaaaataaatgaaaattttagaattaaattgtgatacaataaaattaatttgttaacgtttttcaaaaaaatcaaatgtttacttgatttattgaataatttattttttctttgtactttgaaaatatttatatcgactatgaaaaaactaaagttgttttcattaatagcattaagttctacacttgcattaaccagctgtggcggatcaggaaccagcaaaggtggcggtaccaaaaaatttgtcagcaaaacaggttggaaaccaaacgaaaaacagggttggttttttgcaggaaagcaacagaagcagaagggttggcctgggatggtatatgtagaaggtggaacttttacaatgggattagtgaaagatgatgttatgcacgattggaataacacacctcgcagaatgcaggtaagttcattcttcatcggagaaacagaaattactaactacgaataccgcgaataccttacatggttgaagtatgtattcccaccaagtgacccgagttttaaggaaatctataacggtgctttaccggataccttattatgggacaacaaattagctagaaacgattataatgaaacgtatctgcgttctccggaattcgattactacccggtagtaggagtttcctggactcaggcaaacagatactgcgaatggctgtcagacagagcgaacgaaaaagctttgatgcaggctggtattattgctaaagatttatatatcaatgaatctaacaaccaaggagggacagcattcaatatggataaattcaaatcgaatgatcctgaaatgcagggatacatcaatgaaaaaagaatgcagcaaaaaaccggtatgaaaaccacaaaccagagattgcttgctgctaacagagctcctaatgctgccatggtacagaagttcagacttcctaccgaagtagaatgggaatatgctgccctaggtatggctaaaaacagagaatataaccaataccttggtaagaagcctcaaattgaaagattaagaggtactaaaggaagagacagaggaatgttccttgaaaacttcaaaatgggtaaaggtgattattccggtatcgcaggatggaaaaacgacggatcagctcagacttctgacgtaagacaatacccatctaacgacttaggaatttacggtatgtacggtaacgtgtctgaatggaccgctgacgtttacagacctatcattgacgaagattacaacgacttcaattactatagaggaaacatgcctcaggctatcgtaagaaacggagacggaacttataaaatgatcgacgaaggtagtatcaaatatgatacattagctgacggaagattagtgtacagaggacttccgggacaattcgaaagacagactattgctgactacagaaactacagagacggagacagacagtcttctttagaatactacagagcagctgattctactgattcatttgacatgtacaactctcctaagaaaagctttgttgtagatgcaaacggtagagtgaagctgcagaaagattctaaagaaagaacttcaggtatttctaacgatgttagagtagtaaaaggaggttcctggcaggacaccgcttactggctggatccgggacaaagaagatataaaaaccaaaacaaggcttatggctggataggtttccgtgttgcacaggatgccagaaccagcgataagagtagaactagaagataatatttatcaaaaaatacttaaaaaaaaccttccggaaatccggaaggtttttttatttttgaaccatgaaatcgctttgcctaaaagtctgaaaatacttgtacagatctggcgattgtatctgatttcaatatatatatattttccacatgaatatagaacagttttatcccttatttctgcaggccgcaaaagtgaccatcgacagcagaaaaatagcagagaatgatattttctttgccttttccggtgagaatttcaacgcagcgactctggctgaaaaagccatcgatgacggaggtttggccgtaattgttgaacttccggaatttgaaaacagagataaaaatattttctatgttccatcgactctggagtttttacagcagctggcaatttatcacagaagaaagctttccattccttttattggacttacgggaagtaacggaaagacaaccacaaaagagctgattcatgctgttctctcagaaaaatttaatgtacagtatacgtccggaaatctgaataaccatatcggagttccgctgaccattctttctataaagcctgaccatgagatagcggtgattgaaatgggggccaaccatcagaaagaaatcgaatttttgtgtactatctcacaacctgatttcggatacattaccaattttggaaaagcgcatctggagggattcggaggctttgaaggagtgataaaaggaaagtctgagctgtatgattatcttaaaaataacaacagaacgattgttgtgaatgaaaacgatcctatccagctggaaaaaactgaaaattatccttctaaaattactttcggtaaagaaacttccaattataattttgaatcgttctcagaggaacattttgtagggttgatttatcagggagtaaaagccgtttcaaaactgacaggagaatataattttaccaatctttgtgcagctgctagcttagggcttcattttggaatcggttttgaaaaaataaaacatgcgctggaactgtatacgcctaccaatatgagatctcagattgtgaaaaaagagggaagaactctggttctggatacgtataatgccaatccgagttctatgactgcctctttaaataactttatcagttttgaaggcagtaaaaccattattatcggagatatgctggaattgggtgaagagagtgagagagagcataagaacatcctaaaactggctctggatcttcatttcgatgagattattactgtcggaaaacatttcaaggctgtcaattcttcagatcttgcttttgaaaatacaacggaactcgcagaatatttgaaactgaataaaattcaaactgaaaatatactgctgaaaggctccagaggaattgctctagaaaaaataatagactttatttagggtaaggaagctggaggttgggagtgggaagtttctgaaggcaatcgaagagtgttctctttttattcaactttataaaatttcattaataaataaacacttgaagaagtagttggccggaatataacttccggcttcattcttccagccctcttacttatttcttcaaatcccagaattcttttacaatcagtttaatatttttaaatgtacttggaaaaacttcattttcaatttctgatgtcgttttccaggcaacttcagtaataccttcttctatctgcggcttggaagtgtcttctccgtcgaaattcatttcaaaccagtgggtacacttcaatattttttcaccatttctttctacataaatgtgataagtagtattgatgaattttacaagctctacgtcgctcaagcctgtttcttcctctatttcccgaacggcagattcttctctggattcacccttttccatcttacctttgggaagatcccatttgcccagtcttctgatgaaaagaattttcccttcaggattattaacaagacctccggcagcctctataattctgaaaagcttctggaattcctgccatatttcatccaaattctccccatatacattcagttcctgcgcagaagtattctccagaagatccaatgcgatctccaaagttgtataattttcatacctaagctttttttcaagttcttcaggatgcttagatatcaataattttttttcgttgacaaaaactttatacatttgtaatagttaagaatttaaatacaaaaataaaaaatgaatttagaaggacgaaagattattgtcaataaatcatctaaagaacttaccgagttactgaaatctcctgaaaattataaagattttatgccggatggtcttcagaaatttgaaacaagagataacggatttaaattcggattacagggaatgccggagattgcgttaaaaattgacgaagtggatgatcacaaagctgttttaagatctgcaagctccagccttgatttctcattaacagcaacattgaacccgatcagcgacaaccagacagaggttcagatgttatttgaagggaaattcaatccattcatcaaaatgatggtagaaaagccgttacagaactttatcaatacgcttactgataaaatcgaagcttataaataatacaaaacctccaaaattggaggttttttgttttatgtaatttctatgctataactcctgagcaatgatcaacattacttcccgttgcagaagacaaaacgttgatctcattgttcatttttaaaacacccataaaggcaaatatcagagcttccttataatcgataatttccttttcaggaatgattacttcggcttttgttttggctcttattttttcaatcagaaatgtgttgtaggcacctcctcctgtgatcagaatatcttttatactgtttgcattgatgacattagagatctgttgagcggtgtgttctgtaaaagtagccagtgcatctgtgatttcaatattttgaagaaccggaaatatatgctggttacaccattcaactcctaatgatttcgggtgaggatgttggtagaaatctaatacgttaagctgattaagcaaatcttcatttattgtacctttttcagccaatgttccgttttcatcaaaactcttatgaagcttttgagccaggtgattcaaaacaatattcaccggggcaatatcaaaagcaattctctttccttctgatcgtaaggaaatattggaaaatccgccaaggttaagacaggcactgtatcctgagaaaagtaattcatcacctataggaaccagaggcgctccgtttcccttcatcaggacatcctggcttcggaaatcatagatcacgggtagtccggtttccagctttatagccctgccgtcgccaatctgaagggtaaaacctttctgtggctgatgaaaaacagtatggccatgagacgcgataagatctatattttcaagctgatgcagatggataaattctttaaccttttgtccaaggtaaaagccatatgctgaatgcagttccagaaggtcttcagcagcaaggtgaattgaatttctaagcttgttttcccaatcttcagaataggggaatgtttcggctttcagaattttaaaggtccatgtgtcctgcttttcaaattcagcaagacagatatccaagccatccagacttgtcccggacatgattccaatagccagcgctttcatttcaggtttattttttattttcagaaattcttttcgaactgaaatctcccgaattgttataaaacgtgtactcggaaaaatcatctttggccgtcattccattggctcctaccaatgtagagccgtcttccatggtaacatataccgtatctttggtatagattctgttttttttctgatcccagtaaatactctgcatggcaaatctctgcccttcgttggttcttattcttacatcgcctttggcttcgtagaattttttgtattcaaaaatacgggcgtatttcgcggtgatccttccaggaactttaggtttctttttatcaaaaaactcaatatcaattccttttctggctactacatacgggctgtcgatcagctcatacttttcaataatgggtgctttggcttttaaagtaacaaaaccggagtcgcgctgtataatattggcgttattgataatttgtgaaggaaaattcttgctttggttgccgttggctttggtaagatcctcttcacaggatgtcagtataaaaaatatagcacaactaaaaaggcatgctatatttttatatgatattttttctgaaaaattcattttagttataaagagtctttctgaaccatttgtcggcaaaattgaagccgattctaaggttgatgaaattctggttgatcaggttgttttgaagagttcctctcttaccaacttctagcccgatttcaagaccgctcattcttgtgatactgctgtttttgaatggtagcattaccccggcagaaataccgaacttgttaatgctgtttccttccagtttaagatttcctctttcgtagaatgctccatatctgtagatcacccttgagaagtagcttctgaagttattatagttaggaaggtaccatccccctgcggaaattctgtagctatcctggaaatcaaaagttttaccgaaataattgatatcttctccctttttataatctatctgaccagatacaaaccaatggttctcgcttccgtacccaaccccaagggaagcctgtaacggaagaaggtttttggattttgtttctttttgctcgatgattgtttccgaatcggtcatctttgtagtttcctgagcatcagaatatctgtatgtactgttagtgtactgtgtcgtcatgttacttgtgttcccaaaagtagcagtggctcctacggtaaacttcttgtcagtacgtgtatttaaagtctggtagcttgtaccaagcgtaaaattaaaatttctgattctgtttttagtctcataaccatttacatattcccctaaataagtaccaagattactgttgtaagcacggaattcattaaggtcattaagatctccgaaataaagattagcttttgctcccacagataattcctgattaatcttataagaaacagcaagctgggcagtatttaatgttccactacctttgaagctgtttttgtatagaggagtcgtattatcactggcaagctgttccgttacgatgtcgtagcttttggaactgtatggctggtaagagattcccattttcacttttgaagataatggaaaagcgatcgaaatattggaaagatacgtagaatgctttgtagatttcatatcgttatagttcgatttgaaataattgttttcgttggtagcttccagtctgatacttgtaagttcaaaattggcgttatttgccgggttggcaaaattgaaactactggtaaaatcacttataaaagcagtagatatacctcccattgaagtagtttcgatcgtattatcatatttcacatctccaattccataagctgcataaggagagttgcttagactctgtgcattcagaaaatatccaactgatatgaatgatactacaaagatttttttcattctttatttttaaaacaatgcgcaaatatcttaaatattaatgaattgtaaaaattatatgtggttaaagtttgttaagggcctttcttcagaagaaaaatgcaaattttcacgcatatatatagcaattctttatataaaaaaattattcggaaaaagagatttctttatcagattcactctttattttatagattaaagagacttaattttatgaattgaaataagattttttatctttgaaacatgaattgggagaatatcgccggacagacgaatctgaaaaaacttcttagagaaagcattgctaaaaacagagtgagccatgcccaactttttgtaggaaaggaggggtacggaacactccccatggtactggcctatgcaagagaaatcttcagccaggaaaatgaacatgctgctgcaaaagtagagcatctcaatcatctggatctgcacttcagctttccggtttttacggataataagaactcattaagtaagaataaatttgatgaattcagagaaatgattctgtcttctccttatgccagctatgatgactgggctgcctttttggagtcggaaaataagcagctatttatttctgcagatgaaattgatgatcagaatcagaaattttctttaaaaagttttgaaggaggaaccaaaatacttattgtctggagagcagataaaatgaatgtggccgcctcgaataagtttttaaaatttctggaagagccgccggcaaaaacggtgattcttcttactgccgaaagtaccaatgacatccttcctaccatcctttccagaacacagattgtagaaattcccagaattcatgatgaagatattgaaaactatctcaaaaagaatttttctgtttcggatgagaaagtaagagaaattgttcatgaggcacagggagaccttaatgaagccataaaattgctgaactcaggtgacaagtccaatgagtttgaaaagctctttgtgcaatgggtaagagatgcatttatggtaaaaaagaaacccgaatatctcagaagcattattttctgggcaagagaaattgcaggttggaacagggaaaagcagaaaaacttcctgaattattgttctgaaatattcagattagcattgcttcagaattatcagtccgaagatcttgtctataaaaaaatcaatgcgaatgggttcaattgggcagggttttcaaaatttataagtggtgccaatattgaaagcatcctggaggaaatcaatacagccgatcttcacctgacaagaaacggaaatcctaaaattgtctggacggatctgggaataaaattatcaagatatattcataaaagcacataaacaaactccggttacagccggagtttttattttaaagtacaatcagttatcatattgcttttagttttcttctttttttatctattatttaatggtaagtattcagaaaattcaaatactgttattagaaattttcattactattaaataaatgtgaactcttttttaagttgtttttcattaaaaacagtctttccttcagttttagcatctattatagaaactgtcttttctttgcgataaattaaatctatattaaaaaatcaatcaatcgtttgatttgaataaaaacttatgtaaatttgcgccctgaaaaatgaataccaacatgatttcaaaagaagagaatatattatttgccgccgaagagctctttgctgagaaaggattcgaaggaacctctacccgcgaaattgcaaaggctgctaatgtaaatatctctatgatctcatattattttggctctaaggaaaaactttatgagaaattagtagaatatagaatgaatgaaggtcagtttttttcgaaagatcttttgggaagaactgatatcaacgaatggcagaaaattgaaagagtaattgatcagttttctaataagatccggactcaaaaatgcttttacaggattatgcagagagagcagctgcataccaagaatcctcagattgtagaatttttgaaacagactaaaatgggattcctttccatgtattcacagatattggaaagcggccttaaaaatggaattttcaccaaaaaaccacctatctatctccttcattccaccgtaagcggaactttattttatgcattcaatgcaaaagaaatgtataaagaattcctgaatgaaacagaagatgaggaagcttttgacgaaaaatactatacagaacttaataaacatattaaatatttactaaaagaccttttaggttatgaagagaataaataactcagtgattgcattatcactattcataggaatagcccatgcaaatgctcaggagaaaaagacactttctcttgacgaagctgtgcagctgggaatccagaacagcaagaatctcaagatcgatgcagccaagatcgaagaggctacagctgatcttctggaagctaaaaacagacaactaccggaattaaaagtgtcaggtagctatatgtaccttccgattaaaccgaatgtggatataaaacttccgggtgtttcaggagcaggaggtcccgaggtacatcaggtagcttatggctcagcaaatcttagtgttccaatctacagcggaggaagaatcaaatatgggattcagtcggctaaatatctggtagaagcttccaagctgagcactgagaatgataagattgctattgcttataatgtagctcaggcctataataacttatttaaggcaaaccagtctattaaagtttttgaagaaaatcttgcagcttcccagaaaagagatgaaactttcctgaaaatggaaaataatggtttgatcgcgagaaatgacagattaaaagccaaccttcagacttcaaatattgaacttcagctattggaggcaaaaaataattacaatattgccaatatcaatatggatcttctactaggtcttcctgaaacaacggtacttgaagtggatgaaaattatattgaagaaggatcagatgtgaagcctgttgatttttatgttaatgaagccagagaaaaccgcaaagatttgcaggctttagcacaacagagaaaagcagcagaactgggaacaaaagctgcaaaagcagaaaatcttccttccattgcattcaccggaggctatgtggctgctgatattcctaagtttcttaccgtatataatgcaatcaacgtaggaatcggggtatcatacaacttatccaacctttggaaagaaaattcttctttaagacagtcacaggccagagaaaagcagcttgcggctactgatgaattactgaatgataacattaagcttgatgtcaacagagaataccagaacactgattattccaaaaagagaattgctgttttcgaaaaatctgctgagcaggctaatgaaaattacagaatcacaaaaaataaatacgacaacggtcttgcaaccatgactgaattgctggatgcagacgcagctcagattgctgccaacgttggcgtaatcaatgctaaggcagatgctgcactggcatacagaaaactattacagacaacaggaactttaacaattaaataatcagatcgaaaccaaaatggaaaataataatacacaggcagctgaacctaaaaagaaaaaaagtttagtttttcctatcattttagcggcagtagtaatcgggggaggaatctacggttacagagcttatacttacggacagtatcatgaagaaactgacgatgctcagattgcgtccaatatggcaccggtaatttctaaaatctccggatatgtagctgaagtaaaagtaaaagacaaccagtttgtgaagaaaggagatactttggtgattttggataacagagatcagaaaatggctcttgaacaggctcaggcagcattatctacagcgaaaagtaatatttccaatgcagaagctgctacaacagcaacttcgaaaaatatcgggtcctcagaggcggcagtaatcactgctaacgctcagatagaagcggcaaaagtaaatgtatggaaaacatcacaggacctgaagagatatgccaatcttgtaaaagaccattctattacagaacaacagtatgagcaggcacttgctgcaaaacaatctgcagacaaacagctacaggtattggttgaccaaagaaatcaaatcgctcagcagactcatattgcatcttctcagacggcggcaagctctcaacagatcagtgttgcaggatcagtggctaaacaaagagaagtagatgtagaaaatgcaagactgaacttatcatatacagtaatcctggcaccggaagacggatacgtaggaaaagtaccaacacaggcaggtcagtacctgcaggcaggatcacaactgtttgccttggtgaaaaacgaccagaaatgggtagtggccaactttaaggaaacacaggtcgataaaatggtggaaggccagaaagtaaaaattgagattgatgctttccctgaccaggaatttgaaggagtggtaagctcattctctccggctacaggagctactttctctattcttcctccggataatgcgagtggtaacttcgtaaaagtagttcagagacttcctgtaaaaattgactttgtgaatcttgacaagaatattgcaaaaagattgagaacaggaatgaacgtaaaggcagaagttgctttgaaataacatttaaattgttaaaagtcaatgaacttcgttgtcaatagtgaatcagctttgctgtcaattaaaacggtaggctttataattcaccattcatttgcgaagcaaaattcaccattgatttttcacatcgaaaaaaacttatgcaagattcattagtagaatatggagcgcggagagtgatcattacgattactgctatcctttgtgcccttcttgaaattgtagactccacgattgttaatgttgccttgaatgaaatgaaggggaatcttggagctacgctttcagaagtgggttgggtgattacagcctatgctatcgggaacgttattattgttcccatgacaagctggctctcacagcagttcggacgtagaaattactttgcggcatccatcatcatatttacggtattttcatttttatgtggaaatgccaccaatatctgggaacttgttttcttcagattgatgcagggtatcggaggaggagccttactggtaacctcacagacgatcattacggaatcttatccgattgaaaagagaagtatggctcaggctatctatggtctgggagtaattattggccctacattaggtccgccacttggaggatatattgttgataattacagctggccatatatattttatattaatattccgatcggaattgcagccactttaatgacgctgcagttcgtgagaagtccgaaatatgctgaaaaacgtaaagtttcagatgtcgattggatcggtatcggcttattggctgtaacggtaggttcattacagttcattctcgaaaggggacatgaagaagattggtttgaaagcggaatgatcgtggcctttacagtagctgcaatattaggatttatattattcctctggagggagcttaccttcaaatatccgattgtagaactccgggtattgaaaaatggaaacttaagaatcggaacggtgatgtcgtttgtattaggatttgggctgtatgggtcaacattcatcgttccgctttatacacagagtattctgggctggacggcacttcagtcaggagccttaatgattccggcggctttaacaactgctttcatgatgcctatcatcggaagattattgacgaaaggagcaaaacagcagattttggtttctctgggattgttcattttctttatctatagcttctggggatataaaattctgacaccggacaccagcaaagatgctttcttctggatgctgattgtgagaggagcaggactgggactgctgtttattccgattacctctttgtcattaagtacgctgaaagggcaggagattggtcagggtgccgcttttaccgggatgatgagacagctgggaggatctttcgggattgcagcaattacaacctttattgccaatgcaggccagaaatacagaaataacttaatttcccatctggatgagaacagttttgatgttcagcaaaggctggctgccctgaaagcaaactttattgcaaaaggaatgacacctgatgctgcaatgaatgccgcttacaaaatgctggatctgtccgtaaccaaacaggcaaccgttctttcctacatggatgtatttctttatctcggggtcatattcctgatatgtattccgtttatcctattcataaaagaaagaaagagcaaagaaaaaatagatttgagtgaagccatgcactaaattttaaatcaaaaccttcgaaattttcgaaggttttttttatgttattttcttacgtaaaatagtaggagacaataactttctgtttttattttgtaacataaaaataatatcacttgttggagagtttatttattttttctagctttacatagttttaagacttcaactacaatctcaaatactaataacttattatatgaatcaaatccagctgccggaaacgtacgtggcattatcacatttcagaaaacatgatgtttatctccctgagatgaatcaggctcagattattgcagatttctttcccggaacttttacagagcttacccagcgcctgtctgatattacaggagctttctatggaggaatgcttaaacaggtaggaaaactgtatggagcagaagcggtagaagagctttccagcacttttatgtatgatctcgggtcaagaatggctttaaagaaccttgaaacaaaatccaatctgcagcctgggattccggctgttgcaaaaatattgataggagcagtctttacatccagtcccgaatataattttgagtttaaagaattaaatgaccataaatgtgagctgctgatcaaaggcgtggaccggtatcataaaatcacccagagtctgcagattgcagggctgctaaaatggccggttataaaacctttcatacagggagtttgcgatactatggggctggatgttttacttgaaataaaagtcctgaaacttgatccggacagctcttgcagttatcatgtcatagtttcggaaaaatagaatgggaatactgaatactggaaaattaaaatacattcctgaaatatcaatagaagcggactttagtccgcttttaccattataaattgagaatcggcttcaaccaaaacctaaaactcacatcctgtgcccaagctcctattcaatcctctcaatccattcaatcccgctgatatcaatcagttttaaggaatgaatttcatttttttgaagaatatcgtcaatattcagggtcatatcggcttttgcccccaatggaattaccagactatgtttccctggtttcactttggcaacataatgattttgaatattcttttcaggaattccggcaagttctttgtgatcaagctcttttaaaatatttccttttttgtccagaatatgaatgcctatcaaaaaagagccgtatacatcggcaccttcagttctgtatacttcaaatttcagatctgagtaattatgggagatgtttgaaatttcaagcttcggttttactgatttattgtgaaaggttccccacacgccgccatggaaatactgattggtaaaaagggttagtccgaatatggttaacgatcctgccaatacgaaaactttaggttttgagatgggtaaacttccggatcccagccattgaaaccattttttctgagtaaagtttttgttgtttttcataaaataatagtccagtgaataagcaccacttcccgaaagaaacagagcaaatccacccgcgattcccagaacacctatctgccattcatcaagacaggttgttcccagccagccggaacccagtaaaattccaaaagcaagactgaagataccgatactcatcaggcgggtaaataatccgagaatgatgaataatcctacaatagcttcaataatggtaaaaatcatcatggagcgctgtaatgtatcgggatgagtaaccaggtattcaataacaggttttattccaagtgcattaggtaaaaaatgattgaatttttccccgacatatcccttttcatcaggaataagtttgttttccaggataagtctgcgccagaacgctgaaaaataagtccacccgatgaccatacggagggataaagtatataagccggccaggtccgaagactggctgtttacggtatgtttcattgaaattaatattgtattgtaaaaaactgatttttaaattgacttaaaggttttaaatcagattaagtttcagccttttaaacagaatatatttcggagggctttttcctgttgaatgaccggaatagatattgagaaagatcttttcttcaacagagttgtgtacagctggagtaaaaccagataagaatttattatactggttttgaactttgatttttgaaactgataggcctgaagaagcagatgccatatcgcagctgaaagaaaaagaggaagtggtttttaccttattcaatccactgataaactcaatgtcaaaaatatcaagaacattccttttaacagagcacggagacaatgaaaacaccaaaataagcatcgtaacaacagctttgtaagttttcatatggaatcctgaatggtgcatgattacaaaactacactttatttcaatgtaagcttaataaatttcaggaaatcattctgctgatctacaaataagtaatgggaacagttatcaatcagtttaaagtttttctttcccacaatattgttaagatcatcaagctgtttctctgaaaatataccgtcatttttaccatatacggcaaaaacagggattccttttttccggatattttttaaaactgtagtattatcaagattattcaaaggttcattctgataaaatgtaagaggagagttggggtttcttatattgtttttataaaattctcctgcctggtattcctttctcagcttttcactttctgaagtagggttaggcatgtcaaagaagccaagttttcctgccatttcatagcatctttttctgtatgcagcagaatttttatccagattttctattgctgaaatctctgttagctgtacaggatcatttttgaaatgttcttttgcctttttaagaatatggtcataggtttcctgctgggtaaataaagcacctgcaagagtcagcgactttaccttttcaggaaattgtgccataaacagggttccgataatcccgccgaaactgtgggcaataatatgggcctttttaatattatacgcggaataaataccttttaaatcctcaaaactttctttaaatgtcatggttgcgttttcatcttttgaacgtccttcaccgcgtctgtcatacacaatgacataaaatcctttatcagcaagtttttgcgctgtagttccttcaaataaggtggcatttccacccggtccgccatggataaaaataacaggcggatttttatgttcaccataagctttagagtataaattctgcgctttacagaacatggaacctatcataaaaagaatggaaaacagtgctttcattttaattgttttgagtcgtctaaactactaaatattctctgagcaaaagacaataaaatgatttgaaataatattaaattttaaaaattaaaatactgctgacgtactgttgtcacaatcctgctttatctttacagtcggaaagttttacataaaatataaaaatatggacaccaataattttgacaaaataataaaacgttccttagacatcagagaaaagtatcatcaactggaaatcaaaagtatcggatcagagtggacattggaagaagatgctctagcttaccttactgatgcagcattggtagggagaaatgtgatgtctcatcagaaaacgtgggtaaagaaagattctgcggatgaactggaacataagttggcagaaaatatctggtggctgattgtcctggcagatcgtacagggattgatcttaaagaagggattgaaaaattcttaactaaaacagaaaatatattgaaatgagttattgtttggcaatagaaggaatgaagcctgaaagcagaaaagagctgcacaagaattatcatgacaactattatgggtttcctattcacgatgacaatgaattgttcggaagattgatccttgaaatcaatcaggctggcttaagctgggaaactgttcttaaaaaagaagaaagtttcagaaaagcctatgataattttgatattcagaaaatagcggcttataccgaagaagaccgggaaagattgctgagtgatccgggaattatcaggaataaactaaaagtaaatgctgcgattgaaaatgcccaaacaatcattgaactgcaaaaggaatttggttctttcgaaaaatggctggagcatcatcatcccaaaacattacaggaatggatgaagctgttcaaaaaaacattcaaattcaccggcggggaaattgtaaatgaatttctgatgagcaccggatatcttcagggagcccatcatgaaagctgtcccgttcactcaaaagtactggcacaaaaacctttgtggaaaaaagctgaggaaaagtagaatacggattactcttcaattaacaagcctggattctacggaatgacaaatagaactgtctgacatgtgcatgaatgatgtcattccgtaagagtctcattattttaatcattctttgatgtctccttcatcagttctttatgttctttgccccatttttcaaactcaaggataatggtgttcagtttatagcctatttctgtaagttcatattctacccttggaggaacttctgcatacactgttctggtgatgattttatcctcttcaagccttcggagctgaagcgtaagcatgcgttcagtaatgttctgaagcttttttctaagttcaccaaacctcatttttccattgatcagataacagcatattgctaatgcccattgtcctccgataatattggaagcataaatttccgggcactcatcagcaagcgcttttttattggcataattggttgaggtttctttgattttagtcattacttacattttttatagtaccatacaataggttgctaatgtacgaaatgtacgttacgtgtagtaattttgtaatagaaatttaaacataatgaaaacattagtgattgtgacacatcctgatatagaaaaatcagtgatcaataaaaaatggattaacgagttaaaaaaataccctgaaaaatatacggttcatcagctatatgaagcttatcctgacggaaaaattgatgtagctcaggaacagaaactgatggaatcttatgataaaattgtatttcagtttcctttttactggttcagcagtccaccgcttttaaaacaatggctggatgaagtggttttgtatggctgggcctatggaagcaacagcggttttaagctggccggaaagaaaatgacactggctgttactgcaggaatagatgaagaagggtatagcaaatccggagaatataaatatacgatgaaggagcttttccgaccttatgaactcacttttgattatataaaagccgattataaagaaccttttgtttactacggaattgaaagagattcttccgatgagtggatcaacagaagtgttccgatgtatctggagtttctggataatttataagaataaaaggtaagttggacttgaattaagcgagttcagcttacttttgtatgtattcaaaaggttctacattccaatcctgaatatatttctttatggtattgctgtcaatgttaaatgggacatccttatatttccagccttttgaaggaacttttaaatctataagataattttcaatagagtagatgtcgagaacttttgcatttttgggttttatagaatcaaagatgatgagaaatttatctccttttttgtaaaaacaacttgttgttttaaagtatattttattatcaacctgatatttgtaatctgttcctaaaccattgttgtttttttgatgccagtctgatatagcttctccaatggtgtatttggggcttttgagcaggtcatttacccccaaattagaactaattaaacagaatatgataaatacaaaagtgactattaaaataatgatgtgaaatttttctgaaatcaattttttcatgctccggttctatatttctcattgaacttctgcagatctattgcctgctcctggaaatattctttaaatgtatctgaaagatttatatctttaaatttcacaagggtatatccgctgtcaaaagcaataatttctaaaatgctttcctgaattaaaaagtgatcaggttcccaaacacttgtatcttcaacagataagatagaaaaggctgaagtatcgggttcaatagtatttggaacggctgaaataatcccccaaatgatctgagtattgctttgatagagctgttcaaattccggatgatccaacacaaaataatctttatcaaaattaatgggaagagtctgatcagatataaaatctaaatccgtcaaaatccatttataaacggcaagattattccaaataggttttaaaacctcatgaagattagtatggaattttacgttttttgtacttctgataatccagttcatttattccttatttaaaacccggtttattcttttctctgcttcttcttttgtaatgccattataaaaatcatatacaaacggatgctcatagctttggtgaggataaacaaatggacgcccgatagaattattgactaccacggttgtaggaacactttcttcaaactcataatccggaaggtaggtggaaagccatccgaaatattcagcttcaaattccttattatcatagttttcaacatattcatcgaagtttttttcactcagtgaaacccagattccataatccagatctctacagtcatccactacttcctgtacaagtacagtacggataaacctgtgggtatcttcttcttcttttatgacgcacagatctgagctgagttctgtatttttcaattcttcttcagataaacaggaataaaaataagggtaagaataggcaattgccggccagtcttctttttcctctccgcagcattggcagatgtattttgtcattgtattttatttgtaaatgttgataaacttaaattcctatcctaccgtaggagtatcctcttccttcagtatttttttctccttcatggtaagcatcattctttcatatttatacttttcccaatcaaagctgttgagaaaatcaagggcagcctgaaatcctctgttgaacagttcttccttttcctctcttttcataaagaaattcagccagctgctggtcccacagttaacggtctgtatgctgtacagtttataaaaggtatgtttggtaagaaatgttttatcattaaatcctttcaaggtacttatgatatttccggcatagctgaatggtgttttaaggatttcttcactggttttccctttttccgaaaggatagcagaatcacttgtgagctgcactccaaaaaggggcattctcggataaaaaacttcatccgcatgaaacagatcaatagggaagttggaaatactgccaccatcaataaaaactcctgcaggattgatatcttcaggcttggtattcatccagtatcgccaggcatattttacagaatcatcgtctttattgatttgtttctgaaaaggctcaaagaaaaaaggaacagccatagaagcccgtacaaattctgccggactgatgtgcttcagctcctcttcagaccagtaaaggttagccatcgtgggaagttctaccttaatttgggcattgatatcggtggtaatgaccacatattcggatttgagaagataaaacggattatttttataataatcgttattgacagagctttcgtagaaaatccggtatcgggtctggtcaatatgctcctgatttttgattttaatcttttcgatgctttgtagagccatctgataatattcctgcccgtttccatatcggtaattaaggttgagctctctttctttctggataaattttttgttaagatgggcaaccgttttgatcccgaattgatccagcgcattctgcatcgttttctgaaaagtatttccgggattcagtccgctgttttcttttctgaaattgttgtaaagctttttgatacagaaaaataaaataacggccggtatcagaggaatcagaaacatcagtttcgcattcaggatcgttgttgaaggggccagaaaagggatactgaccagaataataaaaaggatagcggcaataacagcattgatcttaaaaaaatccttgttgttcagcatcgcatgaagggtggtttttacatacgtcttcccatccatgaaatctgaaaaatcccagctgaaaaggatatccttgatcagctcacttttagattcttctttggttttacaggctgcaataagcattgtattaatggcgccggcacttgttcctgccactttcagaaaacggatgccaaatatttccagaccgtaaagatagcctaccaatgcgcttccccagacaccaccaccttcctgaacaaactccacatactgatttccggattgatccagaagatcggaaaactctttgccggaaatattctgatgtaaggccatcagcttttctttggatgcctttgaaagggacgaatcttcaagaattttattgaggttttcagcggtcatggtatttttgttttattgggatgatgattaaagacaacaaataatcaacgggtcatattagataggagataggttttggtgtcaatataaaatctgatcaccattgttttcgccttacataaataaacgtagtgatcacaaccgtagccattgctcccaaagttataaaataaccatacttatgatgaagttcaggcatattgtcgaaattcatcccgtaaaccccggcaataaaggtgattggtaagaagtaaacggaataaatggccagaactttcatcacctggttggccttctgatccgaaagcgccaggaacatggaaataaggttggtgatctgaatattcaaatgatcaaaatccgccacaacatctttatgtttatcctttaaatcaacaaattcggagtcctgtaaattcaagagtttaaatttatcaatagcgtccgtagagatgaccagcacccgtgaatttaatcctgattttcttttcagtttgtaaagacggcggatctggctggtatgattggtatttttaagaaaaatctcgttttcaatattatccatcgtttcgaaaaggcttaaagattcatcatcaaaactcttcataatcaggatagcaatcatgagggtgatttgctgaggagtaacgtcctgctggatcaaggaaaccttttttttggtttcggtgatacttctggtcttcatcctgtggatggtaataatggtattttcaaccagaaaaattccaatcttggtgctgatatcactgatcgtattcagattttttctttccagctcagtactttcacggagcaggaagaatttaacgttcccgtcttcttcatatttcggaaggtggttaggatccatcgtatcttcaagaagaagattgttgatttcatatctttcatgaagaaatttcaggtcttctacagtaggagcctctacatctacccattcgcactgggaggttctgtatattgtatcaattggcataaagtaaaaatactaatattttgaaaaactatgtgttaaataagttttatctttgccaaaattaaaaaactatatgattaaaagtacaataaaaggtgtgggattttatgttccagataacgttgtaacaaatgatgatttagcaaaactgatgactaccaatgatgaatggataacagaaaggacaggcatcaaggaaagaagacacagaaaaaacagatatgactctcaggaaaccagcgcttatctggggtttaaagctgcagaaaaagctattcagaatgctggtcttacctcaaaagatattgattatattatctttgccacgctttctccggattattattttcccggatgtggtgtattgcttcaggacatgctgggatgtgatacgataggagcattggacgtaagaaatcaatgttcaggattcgtatattctatgagtgttgccaatgcatttatcaaatcaggaacctataaaaatattcttgtggtaggagcagaagttcattctttcggattagatttttctgatgaagggagaggagtttctgttattttcggagatggggcaggagctgttgttctttcggcaacggaagatgaaaatgcaggagatattttagcaatgaatatgcattctgaaggaaaatatgcggatgatctttgtactcagttcccgggttcaaagttcggatggagtgacagaatgagaaaagaccctgaaaatgtaacgaacaaagaagtatacccgattatgaacggtaacttcgtgttcaaacatgccgtaacaagattcccggaaacgatgatggaagctttgaacaaagcaggaaaaaccattgaagatcttgatatgttcattccacaccaggcgaacctgagaattgcccagtttgtacaggaaaaattcggattaccaaacgagaaagtgttcaacaacatccagagatacggaaacacaacagcggcttctattccgattgctttaagcgaagcaattgagctgggaaaaatcaaaagaggcgatcttgtccttctttctgctttcggaagcggatttacttggggcagcgttctgtttgaatactaagcgaagctttattttcacttataccacaactcaagagctcaattcccatattttggaggaggcggaaattcaaagaattttgacggggtggttatacatcataaaaaaacgcagaactctgttctgcgtttttttattttgggtcttaataatcaattaaaggcttttcaatagtttttccgtgtcagaagaatcctgtcctgtactttttgcaagttcaatagacttttcagcccatatttttgcatttttcttatcacctaccttattgtaaagattggctaaagtatctgtattggcaaagttctgatctttttttacagattcctgcgcccatgcaatcgctttttcaagagactccttgttatttacattttcaaagaagttccatgcaagggaattcagttcttcagaacctgctgcagaataatctttgtaaaggtcaaggattaatttttcatattcaggaatatctttattctttaaagctctgttggctttcattctttttaagatcttgtcagcctcttctttactcaggaatttctgggattcagacataaaatagctgtcattccatgttttggtatctgcattgtatgcttttttggaaatagtattcagcttaatatttttatcaaacttttcatatttatcttccgggaagaatttaacgatatcagcttttttatcctgaaaaatcttgtacaaaggactgtctgtagtctgaacccctgaaagaagcatctgaatatcttcctgatctaaactggctttctgctgaaaataacggttcatcactttaccggcaaattcagcatcattatacatggtaagccctgcaagattctttaaaaattcggggtctttttctccgttttcaaattgctgcttcagagaagtcagccttttgttgggatcttcagcatcttttgcaaactggataaagtctttttcttccacatatcctaaagttctgtgtaccgcttcaccgtttccgtcgataaacaggtaagtagggaaggcttttacgttatattttttggcaagctcaattccttctcccttttccatatcaattttagcgttgataaaatgggaattataataatcacccacggactgaagcgggaaaatatttttaaccatcagcttacaaggtccacaccatgaggcataggcatcaataaaaaccagttttttttctttttttgctttggcaaggatagaggcaaaattgccttcttcaaatttaattccctgtgcccatgccagcacacctataaatatggaggaaagtattgctatttttttcataaaaaactttttattccctgcaaatgtaataaatatgatgacacatgagccgttcatattgaaaataattatacaggaactttagcttaaaaacagagatcatgtgatatgaaagataatcagttattattttagtcttattattaaaattaatgtaaatagctattttgtggtaaatgattaaatttcaagataatattttaataaaaaataaaatatcattagttttgtaaaaaacaaaaagacactccgtgaaaataatgatgaattattataaaatcaaaataataatttgtttttttatgcctagaagtcttctgaaatttttgtttttgctgataacagcagttcctatattcgctcagaaaaaaaataactttgatcttatttgtgaaaggacttcttccgtcacagctcataagaatttacccaaagccatcaaaactgccgattctctttacatgtcagctcaaactcctacagagaaaatcaggtgcctcatcctttcttcagaactttatcaccatgcaggtgaacttaaaaaagcaatttgttacagtgaaaatgcacattcggtaattaataagattaatgatcctcaggagatgaccgtggtaaccagattacttgcgaggcagtatagacaggtagggttatacgaaagatcaaaaaaatacatactgaaaggacttgcagctgccggcagaatcaatgattttcaaaagagtaatgaggcggcaggattgctgaatcaggaaatggcattttatgaaatggagatggggaattatttcaatgccatacagcatatcgaatcttctctgaaaaattttgaaaaaataaacagtgataaagaaaacagcattgcagctgcttcttatcagctattgggagacgtttacttcaaacttaatgattatcctgtttctgaaaactactatagaaaagcagaatgtctacttaaaggcggaagctgtacgctgggtttggtgtataacggattggggggaatccgtcttaagcagaaaaactggaaagatgctgaattctatcttaaaaaggcagagaaaattgcagatacatcccggagtcttaagcttaaaaaagcagtgtattccaatattaatgattattatgaaggaacgggagataattttaaagcctcattgtatgcagtgaaatatgtacgtgcctatgacagtattgcagcccgcaatcagagttttacaatgaaagcctttgatggttcaaaaggaaaaactaataataaaaagaacgggcagatgaacagcgtaaaaaatgcggctattgtgattctctttatttcactggtcggtctgctcatttttatcagaagaaagcagaaaaaacagcgctcaaaattacgaaacatgatgagggcccagtttaatacagtcggcggcagaaatcattatcctttacaacaatctgactctgagttctctaatatatctgtagaagaaattgatgacaaagaatctgaagcagaccgcagaagaaatgattctctgatgacttcagaaacagaatcaaagttgcttgaactccttgaagactttgaaaggggtaatctttataacaataaaggcatgtctctttcctttcttgccggtgaactgaataccaatacaaaatatctgtcttatgtcattaatcagcataaaagtgcagatttcaaaacatatatcaaccgtttacggattaattatatcgtagataagctcattaatgatgaaaagtacagacagtataaaataagtatccttgctgatgaatgcgggttctcttctcacagtaaattcgcatcggttttcaaagcggttacggactattccccatctgcctatatcaaatatctggataaggaaaaccaatctgataaagatgttcattttcccgaaaatgattaaaaatggctgtttttttaatttctatcttgtcattttcatgaaaatgaacaacctattattttaaagaaacgcctttctatcatatatttgtgccagtttcacaggacaaaacattatcctgatacttcttatcgctttttattccgctttctgaattaaggtcattataagtgaaacaacaaatcctctttttaatcttttaaggaaatattctgtatcagaatatcaaccatattttataatcggggttgattgcccggttttttttcagtcaagtttttttaagtgcaaatccacagaaagtctgtggatttgtgattttatttaactttggtgctgtcggtttttatttttgatgtgtctgcagttgctggtgaaggtatggaattggcgactgcagaatcacccattctgtttcttaaggagtctttgttgtgggcttctttgtattcctctcttttttctttgttttgagcacagcttccaagaaaaagaagtccaagaactgctcctatccataattttctcattgtagtatattttaatgtttggtattaatcaaatgtaggaatttaattaaaaagataaaagataaaagataaaagataaaagataaaagataaaagataaaagataaaagataaaagataaaagataaaagataaaagatcttgttattaaacaactactatatatatttggaagtcaaagggaatttcttctgttttttcatcaggttttgtaggattaataatgggttagattcctacggaatggcaagaccgattgtatcatgtatttggtgctgcttaattctttttatcattccgaaggaatctatataacgttgttttcaacaagtttgaagaataaacgattttttcattaagctattatttgtcaggatatcaatagaagtgggctttagcctactaacactataatcaagattcatccgacttaagccagaacttaattttctcatccataattatatcaagccccttactctttaactttttatcataaaaaaaatctgcagcgcttgcaactgcagattttccatgttaagttaaacgtatataaatactatttgacaggagacgttgccatagaatccctttttatcttgatagtgtcaggattcgtcatttttgtagtcatggtatcagtagttgtaggcggtatacttttttgtgcactgtctactgttgctgaatcacgattacttgttgacattgtcgattctttggttccacagctcactgcaaatattcctattccgatggctgttagcaataactttttcatattattttattttggggtgtgtaataacgaaaaatcaacaattattcctaacagggactttagaatcgtaaaatataggtaaagtttgttaaaagatgttaggtagcaggtagtagattgtaggagttaggagttagagtgagagagtaggagagtagatgggttagagagtgtaggacattgtgtattaagtattggaggactaaaagtgtattttatggatacaataaccttaaaccataaaccttgaacttttaacaccacccataactcggaaccggaaccccgaatccgcattactccacaaaaaagccccgaaaccgaaattccggggctgttttaatcatttatcaatgatcatttatcttttattatcctaggtatggatatttgtagtttttcggagaaacaaaagtttcttttacgcttcttacagaaacccatctcagaagattcattttagaacctgctttgtcatttgttcctgaagctctaccaccaccgaaaggttgctgtcctactacagcaccagttggtttatcattgatgtagaagttacctgatgcattttctaaagctttataagcttcgttaattgcgtaacggtcttgtgagaatacagaaccagtcaatgaataaggagaagtagaatctaccagcttaagtgtttctttccagtctttatcttcatatacatagattgataagattggaccgaagatttcttccaccatactttcataatgaggatttgtagtttcgattaccgttgggtgtacaaaccatcctttagaatcatcatattttccgccgatagctaccgtagcttcaccggaagcgttcgctctgtcaatatatcgtttacatttttcgaaagaatttttgtcgattacagcgtttacaaagttagatgtatcttcaggagaaccgattttgattgtgctcatctgatcttccattacttttttcacatcagcccaaagagatttaggaatataagctcttgaagctgcagaacatttttgcccctgatattcgaaagcccctcttaccaatgcagtagctacagcctctacgttcgcagacgggtgagcaattacaaagtctttaccccctgtttctccaacgattcttggatatgttctgtagttgtggatattatcaccgatcattttccacattccctggaatacttttgtagaaccggtaaagtgaagacctgcaaaatccgggtgagccaatactttctcagcagtttcttttccgtctgtaaagatcatgttgataaccccggcaggaagacccgcttctgttaatacgtccatgattacttttgcagaatatacctgcttgtcagacggcttccaaaccactacgtttcctagcatggccatacaagtcggaaggtttcctgaaatcgcagtaaagttgaaaggagttactgcaaagcagaatccttctaatggtctgtactcaacacggttccagattccgttgtcagaaaccggctgttcagcatacatttctgtcatgaactctacgttgaatcttaagaagtcgataaactcacaagcagaatcaatttcagcctggtgtacgtttttagactgcccgatcattgttgcagcattaatcacatctctgtaaggaccagccaaaagatcagctgcctttaagaaaattgctgcacgctgttcccagcctagttcattccattcttttttagctgccaatgccgcgttgatagcgtcatccacatgctgcataccaccctggtaatagaatccgaagtcatgagcatgatcctgtggagactgaagctgcacttttgtatcagtttttacttcctttccgttgatgatcattgggatttctaccttttcagcccacatttttttatacgtggcaataaggcttttaacttccggagaccccggttcatatgaattcaccggctcgtttaccgctaatggtacttgcgaaattgcttttgacatattacgttttattattttattaaattaaataagatgtgtatacaaatttacgataattataaggaaagaaaaaataccaccttactttgtaaaataaacttaattgttaattaatccttagtagataatattttttgagccaatataattgataataaaacatgtattaatcttgttttttaaatagaagaaaaagataaggtgaatattcatagttataggaataaggacaaaaaaatatttgtcatagttcataaagagtgcttatgtgctgtaaataaaggatttgtgactgaatgttaaaaatacataaaattgcatttgttgcgattttgaacattttaaataatttttttgatagccggggctttcagattgttctaattttacagcattattaacaggtatgaaaaaaagagtcttatttttctcttttgtgatatttttctcagcgttatgtgcaggtctttttgcacataagggaaaagctcagccatactctgatatcctttcaaaaattcatcttcttcagcagaaatctgatcagcagacccatcctgaaatgtacagtttttcagatgtgcaggatgttcaggattccaatgactgggagaaagtgaaatttgattactcagtgcttgcgcagcagtggttatactacttctttgccggctacacttacagtacaaaggttgcggccgttcaaaaccgtatttatattacagcaccaaggtacatcctgtatcattccctgcagattgcgggctgctaattccttttttaaatcgtaatgacttttatggtttgtattgatgtgaatacagatccgtaaaaatcgttttcacactttacatttttaaatatttctatttgccttacaaaaggtgaacaggattctctttgtccaattttaaataaaaaatactatgcacttaacaccgagagaaacggaaaagcttatgctgtttctggcaggcgaactcgctctgaaaagaaaggcaagaggccttaaattaaactaccctgaatccatagcactcatcagccacttcctgcttgaaggtgcaagagatggaaaaaaagtagccgaactgatgcaggaaggcgctaacctccttactaaagaggatgtaatgccgggcgttgcggaaatgatccacgatgttcagattgaagccacgttcccggacgggacgaagctggtaaccgtacacaatccaatccgttaatacctattcatatgataccaggagaaatttttgtaaaagaagggaccattatctgcaatgaaggcagagaaacggtaaaaataaaagtaaccaatacaggagaccgtcctattcaggtaggttcacacttccacttttttgaagttaacaaagcgatgaactttgaccgggaaaaagctttcggaaagagactgaatattgtagcaagtactgcagtgcgtttcgagccgggagaagaaaaagaagtggagctggtagaaataggaggaacaaaaaaagcaatgggcttcaataatcttgttgacggacaggtagattccgaagaacagaaaaaagcgagccttgcaaaagttaaagagttaaactttaaaaatcactaagatgagcttacaagtagacagaaaacaatacgccaatatattaggtcctactgccggagacaaaatcagactcggagatactgaaattatcattgagatcgaaaaggatttcacccactacggagacgaagccgttttcggaggcggaaaaaccgttcgtgacgggatgggacagaatgttacggcgaaaagagatgaaggtgttttggacctttgtatcacaggtgcagtaatcattgaccactggggaattgtaaaaggagatatcggaatcaaagatggaaaaatcgtaggaatcggaaaggctggaaaccctgataccatggatggtgtatctcctaatatgattatcggagcttcaactgaagttcacggaggaaaaggatatattgtaactgccggaggaattgatactcacattcattacatctgccctcaacagatcgaaacctctttgtatagcggaatcacaacaatgatcggtggaggaacaggacctaatgacggaactaatgctacaacagtaactccgggaagattcaacatgcagaaaatgcttgaagcagcagaagaatattctatgaaccttggtttcttcggaaaaggaaactgttcagctgaagaacctattgaagaacaggtggaagccggagctttgggagtaaaaatccacgaagactggggagcaactcctgcaacgattgatgctgcactgaaagtagccgataaatatgacgttcaggtggctatccatacagatacattgaatgaaggaggttttcttgaagatacgatgagagcaattaacggaagagtaatccacaccttccacacggaaggagcgggtggaggccacgctccggacatcattaaagcagccatgtatcccaatgtattgccggcttctacaaaccctacacgcccttacaccatcaatacaattgatgaacatttggatatgctgatggtgtgccaccatttgagtaaaaacattcctgaggatgtagcgtttgcagactcacgtatccgtcctgaaaccattgctgcagaagatattcttcatgatatgggagttttcagcatcatgagttcagactctcaggcgatgggaagaccgggggaagtgattaccagaacatggcagactgcaagcaaaatgaaagagcagagaggtgatctggctgaagataaagatagcggaaatgacaattaccgggccaaaagatatgtggctaaatataccatcaacccggccattgcccatggtatttcagaatatgtaggatcagttgaagaaggaaaattagccgatttagtaatctggaaacctgcattattcggagtaaaaccggaaatgattgtaaaaggaggatttgtaatcgctgctaaaatgggagatcctaatgcatccattccaacccctcagccgattatttacagaaacatgtttggagcacacggaaaagctaagttcggaacttgtgccaacttcgtttcgcagatttctattgataacggaaccattgcttcttacggattagagaaaatgatccttccggtaaaaaactgtagaaatattggtaaaaaagaccttatccataacgataagacacctttaattgaagtgaatcctgaaaactataaagtaacagtagatggtgaatacatcacatgcgaacctgcagaaaaacttcctttaacacagttgtattacttgttctaagataaactttatgcataaaacctgacaggtttcaaaagcctgttaggtttattcaacaacaaaaaaagatttatcagaccctattttaaaacaattacagaactacgtttacaatgaaatatttaaataaaacagttttttctcttgctgtagccggaatttctctgctttcagggaatgtaagcgctcaatttctgggcgggcacaggcttaaaagtgatgaagacggaccaaaagggcaattcatggtttatggctcgttggattactcaaaaatcactaccccatcaagcagcagcagtaccgtttccagtgcaccgcttggattgggttattttatcaataataatgatcttgtcggggttaattatgcctactcacagaatacggttgatcacaatgtagtttacaaacagaatgaagcgggaatctggtatagtccttcattaatgcttggaaaatactttgtattgatagggcaggtagatgctcattatgtttggggacagcaattgtcaacagcggctgatgcgatgcagaactttaatggattccgccttcgtgcttatcccttgattggaatattacttggtggcggctgggcactgaaattcaaatttgcagaactgtctatgcttcagaccaaaacaaaagaagaaggctggacgaaaagctatatagcaggaatcagtggttcaacattcggggtaggaatctccaaaaacttagactttagaaaaaaatccaacaatgatcattaatcaaatcataggcaatcttgctgaaaatcctacggaaaaaaccatagattatcttgatctggaatggtttgaaaccaccaaaagaatccagcgcaaaaaaaccagacagggaactgatgttgccatcaaatttctcagagaaggacagcgcttacgtgaaggagatattctttttgaggatgcagaaaaaataattgcaatcaatgttctggaaacagaagccattgtgatgtcgcccacttcactgctggaaatgggtaccgtatgttatgagatcggaaacaaacatattccgcttttcattcagaatgataaagtattgcttccttttgaaataccgatgttcagatggctggaggcaagcggttttaagccggaaaaacaatctgtgaaactgctgaatcttcttaaatccaatgtagagccccacggacatagcagtcttggatccacaatttttaccaaaatcttaaaaatggcagccccgaaagatgaatagcatgaatataaattttctgttaggtttgcttcatttggcggatcctacacttccgatcggtggatatacgcattccaacggacttgaaacttacgtgcaggaaagaattgtacataatgtagatacagcgaaagagtttgtacagaatatgcttcagtacaatcttaaattcaatgacggagcttttgtaaagctggcttatgaagcagcagaaaagggagatttaaagcagcttttagaactggataatgaatgtaatgcgataaagtgtcccaaggaaatccgccaggccagccagaaattaggagtaaggctgattaagatattcaaaagaagagagcgttttcctctgatggaagcattcgaaaaagcaattcaaaacagggaggccaattctcattactgtattgtttttggagtctatgcctgtttaatgaaaattcctttgtatgaagctcttttagggttctattacacttcggttgcaggaatgatcaccaatgctgtaaagctggttcctcttggacagctggatggacaggatatccttttttctctttaccctgtgatggaaaaaacagctttagaaacaatagaactggacagagacatggtaggactttgtaatacagcctttgacatccgatgtatgcagcacgaaagattgtactcaagactttatatgtcctaaaaagataaaaggtaaaagagcaaattagcgaattgctctctgctgagtgaaacgcccttgcgatcggaaaatattcacaatcaaaaaaacttagcgcacatagcgttaaaaaataaaatttaaataaaatggaaaacagaaaatatataaaagtaggagtagcaggacctgtgggttcaggaaaaactgcattactggaaagattaagcagaaaattattcggcacgtatgaccttggagttattaccaatgatatttatacaaaagaagacgcggaatttatggcaaaaaacagtcttcttccccatgacagaattatcggggtagaaacaggaggatgcccacacacagccatccgggaagatgcgagtatgaaccttgaagcggtagatgagctggcagcacgtttcccggaaatcgaactggttcttattgaaagtggaggggacaacctttcagcaacattcagtccggaccttgcagacgttactattttcattattgacgtagcagaaggagaaaaaatccctagaaaaggaggaccgggaattacaagatcagatttactgatcattaacaaaattgaccttgcgccttatgtaggagccagccttgaggtgatggaaaatgacgccagaagaatgagaaaaggaaatcctttcgtctttaccaacctgaaaacagatgaaggactggacaaagtaataggttggattaaaaaatatgcccttttagaagaagttgaagaaccgaatctggtaagataaatggacagtcatttaaaaattattgcaggattcaagggaggagaatcctatgtgaaagatctttatgtctcacttcctttcagggtagtctctgtaggacagcgaaaaaatgacaaaaagctctatcagatggtaatgagctcctctccgggaattctggatggagaccactatcatttggatgttacgcttgaaaaaggagccgcgcttcagctgcagtcacaatcttatcaaaggcttttcaacatgcaggacaaagcgcttcaggaactcaatgtctctatggaagatgaaacttcttttgcttacgttcctcatcctatcgttcctcacgaagattccaattttaagagtaaagcgaagattcatatcgggaacaacagccagatcatcatcagtgagatcattacctgcggaagaaaacattacggagaagtctttaaactgaagcgttttcagaatgtaatggaaatctatcacaacaataagctggttgtcaaagataatgtcttgattcaacctgatatgatcccgatcagcagcatcggaaatctggaacagtatactcatcagggaactctgatcttctgcagtacaaaggaaaatgtagacaaaaacggattggttgaaaaaatagttgaagcatccgcgcagcatcatgaacaaatggaagtaggggtttctgcaatggatgacaatggttttgttgtaagagctctggggcatggaggagaattgatgtacaacttcttcctgcatattcaggaaatcctttggtctttagaataaaaattaaaatgattctttatttaagttacagagaaaatattcaatagaggcgggctttaacccgcaatactaaaagatatgcttccattggctttagccaaaacttaatagagaacggaacagcaatagataaatagaaaatggacagtacagtttgggcacttcttttaagcgccgtttcaataagttttatacacactgcttcagggccggatcattacctgccattcattgtgatctcaaaatccaaaaaatggagcggaatgaaaaccgcagtattaacggttgtttgtggactcggtcatgtattgagctccctgattttaggttttatcggggtgtttctaggatggcagctgaataagatttcatggtttcaggatatcagaggaaacttctctggatgggcactgctgattttcggaggcgtttatctgatatatggtctcattcaggcaatcagaaacaaacctcacaaacattttgacgtgatgggtgatgatgtctatgtatatgaacataatcacagcgaagtggtaatgcctcagaaaagaataaaagtaaccccgcttgtattgttcatgattttcgtgatgggacccagtgaacctttaattcctttgttgttttattcaggagtaaaactctcaatgtctgaaattgccgtattggtaatttcttttactgcaactacagtattaaccatgcttggaatggttcttctgggacgctatggatattcaacattattcaataccgaaagactggaaagatatatgggagtggtaagcggagctgtagttactgtttgtggtgtcggaatggtctttcttggatggtaaaagggttttgggtttcgtgtggtagagtttgagggtaagagagttgagagtggaattgtttaaagtttaaagtttgaggtttaaagttgttatcctttcactaataaattgacaattcaccattcacctgtaaagcaaaattgattctgtctccaatgtctattatctatccgtctcttatcttactatccacaatcattaatacaattaaaaaaactatggacgaatttttcaaaaaactaccttttttagacaatatattaaaaggaatcgggcagattatgctccaggaaaacagatggaccgggcttctgtttctcataggaatcttcatgggaagctggcagtgcggagttgcggtattgctttcaacggcagccggaacttttactgcaacgaagcttaaatacgatcaatctgaaatcaatgcgggactgtacggcttcagtgcagcgctggtgggagtagcattggcatttcttttccaaactacggtattgatctgggttttaatcctatcaggtggagcattggctgcagttatccagcatttctttatccagaagaaaattccggtgtttacttttcctttcatcattattacatgggtattggtttttgcattgcatcattttacccacattccaccttctgctatgctaagcagtgaagtagttcctacagaatatgatgactttctaacatgtaccaatgggtttggtgaagtaatctttcagggaggggtactttcaggaatgattttcttcctggctgttttcatcagttctccggtagcagcgttatacggattagtcgcatccattcttggtgcaggattatcacaactgaatggagaacccatcaaagaaatccacatgggattatttggattcaacgcggtgctttccgctatcgttttttccggagtcaaaaagacagacggtctatgggttcttattgctgtccttattaccattgccattgatgatttcttaatagacaatcattgcctggatatcgttggcggagtatttactttcccattcgtagccggaacgtggattacacttttaattcagaaggtatttcttaaagcgaaatctaatggttagatagtgggagagtttgagggtttgagggtttgagagtggaagattgtttaaagttcaagatttaaagttcttttacgatgattgacgattcacttgcgaagcaaaaattcactattgctattcctctgacttctaacctctggtttctaactcctaaaatcattaatacattatacattttacattgtacaaaaaaaataaaaaatgaaaataacaaaaatagcagctgcatttctggtcatgacattcagtggaaaaatgatggcgcaggaagcagaaaaacagttgctgatcaaagatgcagatgacaaatttcccattaccgatgctttggtaaaatatgatcacggaaacagccatacccatacaggaccggacggcacttttgccattcctgtaaaatcccttcctgatacccttgtgatcagccgtcagggatatgatgaggtaaaatgggtggtaaccaatgatgaagataaaaataaagttatttttttacagcataagccttttcagatttccgaagtagctatcaatcacagctcgttcttatcagcgattactaaagttgatctgaataaatttccggtaaactcagcgcaggatctgttgagaaaagttccgggactttttattgctcagcatgccggaggaggaaaggctgaacagctttttttgagaggatttgatgccgatcacgggactgatgtaagcgtgaatgtagacggaatgcctgtgaatattgtttctcatgcccatggacagggatattctgacctgcactttgtgattcccgaaacagtaaacaatatcgatttcggaaaaggggcgtattacatggatcgcggagactttaatacagcaggatatgtagactttcagacgtataatggattgaaaaacagtataattaaactggaaggaggttcatttaattcaaaaagagtattgggaatgttcaatattctgcatgatgatctgggcagaaaaaatgcgtatgtagcagcagaatacaactatacagatggccctttcgatgtgaaacagaattttaacagagtcaatattttcggaaaatacaaccaatggcttacggataacgattatttcaacattcagttttcaacattcaattcttcctggaatgcttcaggacagatccctgaacgtgccgtagatgaaggaattattggaagatggggaagtatagatcctactgaaggcggaaaaacctcaagaacaaaccttctgatgaattttaagcacattatttcttcttcggagcagatggatgcgatggctttttattcaaaatataatttcaatctgtattctgacttcacctttaatttaaaagataaggatcatggagatgaaatccagcagactgacggaaggaatatttatggagccgaagtaaaatatacaaagactttttcctttgccaacagttctttaaactggacatcaggaattggattaagaaatgatgatattaatactctgcagcttaatcatgtttatcacagagatatgctgcttgacagattatccgatgtgacaggaacagaaaccaatcttcatgcttattcagggttgatctggaaaaccggaaaatggacgatcaatccggctttgagagtagatcattttattttcaatctgcataatctgctggatgccgaactgctgccttccggacagtcaaaagaagcaacaaggctaagcccaaaactgaatttctcctacgcacagaatgacaatgtgatgtggtttctgaaaactggaatgggctttcactccaatgacctgagagtggttgttcccaataagagcgaaaatacgcttccatattctattggagcagatttcggggtaagattacacccgttcaaatccttgatcattactccagcagtatggtttatggatcttcagcaggaatttgtttatgtaggtgatgatgcagtggttgaaccttccgggaaatcaagacgtttcggggctgatcttggagttcgcttccagccgttggaaaacttttatctgaatgcagatatcaattattctcacgcaagatttactgaagaagaaaaaggtcaggattatgttccgctggctccggtagttacgagtacaggatccgtaaactgggacttcctgaatggcttttctttggcgcttcagtacagatacctgggagcaagacccgctgtggaagataacagtatcagaaccaaagcctattttgtcaatgacctcatgctttcctataaccgtcagaaatggggtgccaatcttcaggtcaataaccttttcaacgtaaaatggaacgaagctcaatttgccaccgaaactcagctgaaaggagaagcagaacctgttacagatcttacctacacacccggaagtccttttggagtgagagtagggttgtattataagttctaagtgagagagtggtagagttttagggtttgagagtgaagaatgtgagttccgggtttcggggtttttattctcttgcttttttgcccttttaccttctctgctgattcagtattgagttaaaatattttgtataactttattaatcataacaaggatatggaagttctgtccaattttcaatataaaaaactttttcttccgaatattacggacaaaatattagctaacaatgctgatatacagctctatcggatagaaaattatcttaaaggaattcttatgccggtaattccataccgtacaacgttcaattttattattttcgttaccaacgggcatatcagacaatatcttgaaaataaagaatatcatgctgaaaaaggaggtgtgatctttattaagcaaggaacaattaccgcaactgttgaactgtcagatgatattgaaggtttctttctagcttatgaaaataatattctgtctgaacaggaactgcccaagcataaaagcagtattttcttcatgaccccttttctcaatctggatagcctgacctatggaactattactcagcttctcccgatcatggaacaggaattgtggctgaacaacctcaatgtgaatgacgtagtggtaacgatgcttcaccttatattgatcaagatgctgagcacagattctgatacccaccataaatctgcaacacgccctatggaattatcccttcagttccgggatttactctttaaatatcatgtaggagaaaagagagtggcattttatgcagacaaactgtctgtaacagaaagctatctgaacaaatgtgtgaaaggagttacccaaaaatccccgaaacagtggatcaacgagatcgatatcaattacagtaaagcattacttcactccagcaaagatattgcagagattgcttacgaactgaactttcataccgcatcccactttacccagcttttcaaaaagattgcaggaatcaccccaaaggaatacagaatacagtttttgaacaacaacaggatttcaatataataaggctggaagcgggaagtcagatgctgtaagtatgaagtagcctgatcaaaataagttgagaattcagaaagttattttaggagtttcataacttccatctccctgcttccattcttccatcttctacatcctctcgttttccaggattttcagcaccagcctttcttcctttgtaagatcggcttttccgtcattttcttcaataatttccagttcgtcaagatactttttgatggtattgttttcgtaaagattgatgactaaaggatgaacgtaatattttctgcagacggccgatgtatttcccagattttctgcaacgatgtctaaggcttcttttactttctttttatactgagtgtcattttcagcatacccgatttccttgaaagcgatcaaagcacttaccgttccggaccatgtcctgaaatccttggcagtaaaatcctcaccgctgatctctttgatatattcattcaccatacctgaatctacagaatgacggtttccttcatcatcaaaatattgaaaaagctcttttccgggaatatccttacacttctgaacgagtctcgccagccttttgcttctaagatcaacatgatgcatcaccccctttttgcccttaaaagtgaatgtgattttttgtccgtttactttcacatgcttacctttcagggtcgttaagccaaatgatccatacagtttttcataaatagaattaccgatacggatgttggttctttgcataaggcttacaattaaggccagaattttccgcttttcaaaatttctcaatgcaagatcctgttctatatgcagcctcatttctggtaatgcatatccgaactgaagcatcctgtaaaattttgtatgatttcttaaagcgctccaaagaggatggtaacggtactgctttctctttttgacatcaaaacctgttgcctgcagatgtccgttttccagtgcgcagatccatacattttcccaggccggcggaatgaccagcttattgatccttgtaatctcttccttgtctcttattttttcaccgtctttataataggaatatttctttcccgtttttttacgggtaattccggcggtctctgcatcggtggtatatacaagatgtaccgcctttgcagaagcttccgggtccttcatgattttaacaatttttgaaggtttaaggtgagaaatgatttccaggtctgtattcttctccataaagcatggttaagagtttttacccctcgaaaaaatcagtaaaagaattcctgctattacacagactaaaagaattccccaccacattcctgccttgaaaattgttcctactgcctcacagcttgttagtatcaacaagctaaatatcgtaatactgtataagcttaattttttcataatcgtatattttgtgatgttagactcttaagtgatcagctctccagttttttatagatcttttaatttcatctcctgagatgttttcatgaagggctctgtataaaagctctttgaattcatcatcatatgcaaatctcaatgcggcaatctggtcaaacttcagtttttcaacagtttcatccgatcttatgttgaagatttcaaaataccgttgctgaaattccaggatcaccatccggttttgaagtcccagtgcataatgctgccgtgtcataaatgcaaggtagaaaagcagaaaaatcacaatagaaaacaggatccagatcaaccggttttccgggtcatcccagattttataaactccaaaaatctccaataggatgagtataggaagataaataaaatgatgtggcggataaaacttcctgtggttattgtagttttgctgtttcataaggtagaatgctgcaataatctttccaaaatttactattttgataataaattgttatttgtggtatgtttagttggtttattttggcttctccgtattgatattctttgctgtaaaattatattgttcatatttcaatatctaaatatgtttttggtgataaaacggaaatcaacgtttgtatcggatttattagtatggtattgatattcaggtgatcacttttctcaataaagttgtttaaactttacaaaaccatagaagtcgaaggttcttaaaatacctgagttcacttaagtaagtttaaaatgaaaccgcagaaaagttcacataggataaaaatcaaagattttcacaaaacttaagtgaacttactatgcataaagttggcttaaaaaacttaagtggttaaaacttttgtggttaaaaataatgactataaagtttaaaaagcttgaaaaagaattcctttaaaaataacaggttattacgtaaaatagctgttgatttcatcttccgactttaaatttttcgtaactttcggtggttaaaaaagaaaagaatgacttcaaaggaaaaagttgctgcgcttcgtgaagaaatgcagaaaaataatgttgatgcatttattgtatattctgcagacccgcatatgagcgaataccttcctgaagaatggcaggaaagagcttggttgtcaggtttccttggttccgccggttttgtggtggttaccaaagacaaagccggactctggacagacggaagatactttacacaagctgctattgagctggacggttccgggatcgatcttttcaaagacggtatggaaggaactcctaattatatcgactggattatttcagaaattccttcgggcggtaaagtggctgtaaatgctttggcggcttctaatgccaactgggaactgctttctcaaaaatttaattccaaaaatattaccctgacagatcttccgcttttaaaagaagtatggaaagacagaggaactccatctgctaacccgatttttgtacatccggtagaaagagcaggtaaatccgtatcagataaacttgctgccatccgtcagaaaatggaagagcaggaggctaccgtacacatcatatcaagtctggatgatgtcgcatggacattgaacctcagaggaagtgatgtagacagcaaccctgtatttttaggatatattgtgattactaaaaatgatgctgtcctgttcacagggttggaaaaaatggaagtagcggctagaaaacaaatggatgatgcctttgtgaaaatgatgccttacgaagaattttacaattatctgaagaatttcaaaaatgaaaaagtactggtttctccaaacagcaaccaacagatttttgaaacactgaaggccgacaaccagtttatcaaagctccggttcccggtaatctgatgaaagcccagaaaaatgaagctgagctggaaggtttcagaaaagtgatggtaagagacggtgtggctatggtgaaattcctttactggttaacacacaatgcaggaaaagaagccatgaacgaatattctatcggagagaaactgagaggcttccgtgcagaaggagaaaattttgtgggggaaagtttcggttccattgtaggatataaagataacggtgccatcatgcattattctgccaaaaaagaaggtagcaaagaagtaaccaatgaggatactattcttgtagattcaggaggtcagtaccttgaaggaactacagatattacaagaactttcgctttaggaaccccttcggaagaatttaaaagaaattcaacactggtattacagggattaatccgtttatcaatggtgaaattcccgaaaggaacaaaaggtgtacatttagatgccatcgcaagacttccgttatggatggaagggaaggactttaaccacggaaccggacacggagtaggaagtttcatgaatgtacacgaaggtccgcagaacatcagaaaagatctgaaccctcaggaacttcttccgggaatggtgctgtccaatgaacctggatactatcttgaaggacattacggaatccgtcatgagaaccttattgctgtaaaagaagcagagaaaaccattcatggaacattctatgaatttgaaacattaacattctgcccgttctttaaagatactgtggtaaaggaaatcctttcagaaagtgaaattgcatggctaaacagttatcacaaaacctgtgaagaaaagcttgctcctcatctggatggagaaattaaagaatggttcctgcaattggtaagtcctctttaatatgatgaatgattgtaggttgttgataatcattgctttaaatcctttttgtaaatcttaaacaaaagaattgttagataaaccagagtcctgtaaggtatttcctgcagggctttttctttttacacaaccgtatttttacggatataattctagggattccactgatggataaaagctgagccctgcctatatttgtaccaacaaacatcattcatatattcataaataactcaagtaaattcaaagcggtaatcatctcgtcctgagatgatttttttttattaatcgaaaattatagtgggtaagctcaaagcaattcacgaaattgatagggtctttgctaaaattctgcaaaaattaaaactttgtgttgttccggtatagaacctccgtctttttatttattttcgtaattcattagaaacatccttatttaaaaaaatgatacgtgattactttcggagctttaatctcttttcacaaggtgaaattgaagagtttctgcagcttttcgaaatccgaacgctgaataaaaatgactattttgtgcaggaaggagaaagatgcagggaagtagcgtttatcaactccggaattttccggtctttctatacttccgataacgggaaagatatgacctattgtttcaagtttcccaatatgatgattgctgcgtactcatcatttatttcaggatgtcttagtaaagaaagcattcaggcaattactgatgtagaattgctgattctgaaaaaagagaagatggatctcctggtaaaagatgccctgaactggactcagtttttaaaaatcattgcggaacaggaataccttgaacttgaaacccgttttttccagcttcaaagagacaatgcggtgcagcgatatgaagcattgttaaagaaccatcctgattatattcagaaaatcccactgcaatatcttgcttcctatcttgggattacacagcgccacctgagccgtatcagaaaggaaatttctttttagacatttgtcctgtctgttaaaacagatgcactatacttttgtcaaaaaaagttatggagcaaaatattttaattattggaggaaacggattagtgggaaaaacaatatcccggatcctcaaatccagaaatcctcatcttactgtttttatcgggggaagaaagggtggaaaaacagacaaagagctgaaaattgatgttacagatcctacttcttttaaggttattccggaaaagaaaatcagtctcattattctttctgtaaatgataaagaagatcatgtacttcgtttcgcaattgatcaccagatagattatctggatattacgaagcctaccccggctttggtaaaggcttacgatattgccggaagatcagatatcaacagcaggattgttttcagttcgggctggatgggcggaattgttcctgcattggttaataccctttcagattcaggtgatattaatgaggtgaagctctttgtttattattctgtgaaagatctggcgggggatagctcggctcattttatggcagaaaacgtagcggttccttttgtacattatagaaatgataaacccatttccatcagacattttttagatacggaaacttttaatttttcctttggaatagggaagagaagtgcatataattttgatgtacctgatttgtacattctcaacaaaatagaaagaatttctgatgtgagcgtgaaaatgacttataattcaaaattcattacctggctgctgggggcatttcaatatctcagaatctacaatattttatctttaaaggagagaaaaatgatttttggatccagtggcaccggagatcaggctgtctttgaaattgtagttgatgatccttcgggacaaaagaaactgagtctgcagagcttaaaagggcaggcagaactaaccgccttatctgctgttctacacaccgaagaactcttgaggaatcctcatgaaaataaggtctggttcagtcatcagctgcatgaacctttatcattactggcacaacttaatgcctatgattctatcaatatcaatgtgataccatgaaaaaaatagcaattatcaacggacatccccataaagattccttcaattttggagttgcggaagcttataagttgggagctgtagcatcaggagccgaagtcagggaaattgtcatccgggacttagatttcaacacaaatctgcagtttggataccagaaaaggatggagcttgaaccggatttgcttaaagcatgggaaattatacaatgggcagatcatttggtttgggtgcatcctgtgtggtggggcggacttcctgctttaatgaaaggatttatagaccggttatttttaccgggaatggcgtataaataccgggaaaactccgtgtggtgggataaactgttaaaaggaaaaacagctcatatccttacaacattggaccagccgggctggtattaccgtttgttttttggaaggccaagcgtcaatcagcttagaaaatctgtcctggaatattgcggagtaaaaccggttagagttacttatatcgggattatccggaattcgaaggatgaacagagggctcagtggcttacgaaagtaaaggtgctgggaaagaaacagaaataaggtccccggaatttttaacatatgatgtaatgataactttatccggcaataattttctattgtcagataaagtttcattgttaaagaaattacttaaacttatcaaaaatattggatatatattaaaaccatgaagaaggattaagaaataaagcataattaagatgaatcattctgatttttaagcttaaagcgaagcttatcttaatactctcaacgccttaatacaatcttaatgtttcaataaacaaaagtttaaacaagtttaaagtaaaaatactcttgttcccatttttacagtcctttttttccttcaatccaatatgcctgtgattttatgcatttcggagagattcctctggctttaagaaatttcctgatcagtgacattcgtcctccgtttccggtaatataaaagataacttcatcatcgctaatagcttctttttcttctgtcagaaaatcattcagtgcctcaatcattctcatggtattgtttttagggatatgatagccgtataaattgagattttcaagtgctgaagcttcttccagttcatgcaggcatataaactgtaagccattttcttcaacaacttctttaatggaaagggaacttccgagtgaagtttcatctcctacagaaaaatgaattcttgcatggggttcaaaaaaacgttttcctcttggtattaaaattcttacagaatctccggtagataagcggctgataaactggcttcctacagctttgtcatcatgtacatgaaatatcacttcaaaagttccggtctccctgttaaaattaaatggtgaataattgcgaaaatctctatcactgacccggattcctattgcataggcgggctcaaactgaacatcctgtaaatcactttcaaaatatatccggcgaagaccaggagtgatagattctatgcgggtcacggtacaatctttaaattttgaggaccagacattttctacagtgtcattgatccatttcggtaggcttggcataagtcattttttattgcaaaggacgttgcaaaatcagaaaatacctatagcggtttcggggaattaattggactattcgtggttgagtttattggttttgattccggaattctgagggcgactggtcttccagttttgaaaataaacggctgaagtaggtatgatcactatacccaagctcataagctacctcttttacgctcagattggtgaaaacaagcaatcttttggcttcaattaaaatctcctgatgaatccagtgctgggcgggctttccagttacttcacggaccgtttccgttaaatatcctcttgtaatattcaggagttctgcgtacccggatggacttttcagggttttgaatttctttctgaccaaaattctgaatgctcgcgatagttgcaaagcacggctttcgttagaaacagggaaattatttttctgagaatacatcatcataaacattcccaggaaggcattgaggaaagactgaacaaccagaaagctgtctttggcagacagcatttcatgagtatacgaatcatgaagcatccctgctgttgtgctgattttttcgctatatttcttatctacagataaaggttgtatctcaacaaggcattcatcaaaaaaagtccgtacggcatcaggaacaagttctgctttaacagcaataaaccatccggaaacattattcattaaaagtccctgatgtacttgcccgggcaatacacagaaaagagtggaatcttttgcttcaactgttttaaagtctaccatcatttttacatgtccgctttccatgcaggtaaaaatataatgactgtcccggtgtattcctttgttcatgagagcgtcttcaggcctctcattccatttatccattcttttgatatggaatctgtggccggaaataccactcagatcataagtaggaattgtctgtttcattgctgagcctgttgtaatgaaggataatacagccacaaaattacatattttcactgttttatactccggatattaatctgaaattcgcagtgcattacatcacgatgtcttttgaagtcagactttatatgaatatacactggtatcttcagtatccctttcaggcaattccttcctttttctccaaaagaaataagcaacagcagcagtcgcaatgggaagagcaatgccaaattcatcaatataataattggtatttcccgtatctagagtaagtggtgtaaaaatagactgtataaaaaggttgtgactggcgtgcaaaatagcgcctgtccataaactcccggattttaaccttagccatgtgaagataaagcaggatgcaaatatcatcactgtaaaacataaaagagccagccatttggggccgcccgtattataattggaaaacaggagaagaggataatgatagatagaccatataaggcccatccagagagaggtaaaagtataagaattaatcttggccagctgtggagtgagaagaccccgccagcctatctcctcacctaatgccgagcctacagagcgcaccatcccaaagctgctcatcagaataatgtacaggatcaaggtctggccatcagaaagatcccaacccatacctttacccgcttctgctacaaactgatgattataaaacccgccagctccactaatccagatgatgaggtaaggaacaaggctataaagaataggtatgcagtaagccataatctggtatttcgtaagaccccatttccagcccagggaagaaacaggtattttccggatccggcaggtaagaagtgctgcaatggccggacaccacattacaatagttgcataagatataattcctccgccgagttttccggtacggatacacatataataaaccgggaggcagaaaagaagggtaagaatcaggtaagtggcaatatttttcctgatttcggatttgggtatcgtattttccatagactgatctggtgttggagtttataaataattgaaaaacagaatattatttttaaataaaaatacacttatttctaatatcaataataactttattactgttcaatttaaaaaagaagtcttctgtttttaattttggaaaaatgtaaattagccaagataaatttttttccgaataccctaaccatgtctaagctaaaagtcataagagaacaaaagaacctcactcaggaagaactgtcagaaaaatcaaagatttctgtaagaaccattcagcgcatagaatccggaacagagcccaaaggacatactctgagagtgctggcgcaggttttggatatagaagaatctgaattactatatacccgtgtacaatccacaaatgaaaatactggaggtgaagaaacggatgaagaagaaaaggggcctcagatcaattattcttacatcaaaatcatcaacctttcatcacttattttcacacttttgccaccactgaatatttttgttcctctgatgctgatgtttaccctgaagcagaacaacagcctggcaagacagatcatctcagttcagatgatctggacggtaatggcgcccattaccttcatgctcggaatctttctaaagttcggaaaacagtttacccttgtccttatgagcctgattgttctttccaatgtatttattattcttcgaaatgcagccgaaatagaccggaataaaaaactctatttcaggctgaaattcagtatgatataaattctgtcaggactttgtcgggtttttgtcgggtcagtttttaatgaaaaatctgttaaaaatctaacctttgtcaaaaaaataataatgacaaagtcttcacaattgatcctttctttttttattctgttgatgaatgtattgcatgcacaggtagaaaaaacagatcctctttataaaactattatgtcgaaagatagtttgctttttactgcggggtataataaatgtaatatcggacagatggaaagtctgctaaacgacaggtttgaattttaccatgataaaggtggttttgcagacaaaaataaatttatcagtgattttaaaaccggattgtgcaaatctccggaaacctatcaggtaaaaagaatcctgattgataagagcacagagatttatcccatgtataaagacggaaagatctacgctgccattcagaacggagatcacctgttttatgaaaaggcagggaatcaggctgaaaaattagtaggcgaagcaaaatttacccatctgtggatattggaaaatgctgaatggaagcttaagaattcattgagctttaaccatcatccgaaacaaactactgataatgaagcgatttttgataatgatcagtcgatgcagagctggctgaaagaaaataatattcccactcttggattaggaattatcagagaaggaaaattacagcaggtaaaagtttttggcgaggtaaaaaaaggcatttcagcgcctcaaaatgccctatttaatgtagcatcgctcaccaaacctgttacagcaatggtaaccttacgccttgtaagccttggcagatggaagctggatgaacctcttgatacctactggacagatccggatattataaatgatattaggcataaaaaattaacaaccagaattattctcacccatcagacgggatttccgaactggagatggatgaatgccgataaaaagctgaacttccagtttgaccccgggacaaaataccaatattcaggagaaggtttcgaatacctgagaaaagcattggaaaagaaatttggaaaatcgctggatcagcttgccaaagaactcatctttcagcctctcagaatgaatgataccaactatatctgggatcagaatactgatgcatcaagatttgtaacggggtataatgaaaaaggagagggctatccgatagagaaaattacaaatgctaatgctgccgatgacctgcataccaccatccaggattatggaaattttatggtgagtgtcatgaaaggaaaaaatctgaagccggaaatattcagggaaatgataaaaaaacaggtaaaggttaaagaaaataaatattttgggttaggctttgagatttatgatctgggaaataatcattatgccttatctcatagcggagcagaccagggtacccgctgcattgccattattttacccgattcaggaaagggaatcattatttttaccaatgttgatgatggttataaggtctatgaaaagctggttcttcattaccttggagaagatgggaaaaagattgtagacatagaaaccagataactgtttatgcaatgaaaatctttgtatattcgggatatcaatctggaaataaatgcgataagcgtatttatttccaggatatctattatgaacagaaataaaaagaaagctatgtggcaatactatatcatctctgcagcaggaatcattctgtttgtggcagctttgctgagtttcagaaacactcttacgttcttaaaaaaagcagaaaaggcaacggcaaccgttacctcactgcggatagatgattctgacggagaagtatatatgccgctctttagtttccgtacccgtaataatgttgaatatacttttgaacttccggaaggcaccaatccttcagcatggtcagtaggtgagacggagactgttatttatgatccggaagatccttcttctgtaagtttatatacctatttcagaatttttgcatggccgttaatactgatctccatagcactgccattactggtgattggcagcgggtattttattgcagaaaagtttttacaataatctgaattcttattttaccttttcaaggagatataatttagcaccggaaaatcctaatttgggcatcaggttaccttccagaaccatagttttactgttgacatcaataacagaaatatagttgttggaattatattctatatagttttctttttctttcgtggaaggattctttccgaactccattgaatacttcacccaatcttcatcctgggtgctgcagtgtaccggcttgaatttggattttttagccttgaaaacgatctggtcaaaaccttctgtacattccgaggtaaatgaaccgtcaggattctgatctttagaaaagtcctcaaatgaaccacggtaaacacccactactttccaggtgccgtccagacggtcttcatctatttttcctttggccttacttaccgcccagctgattccgttaaccgttccctttacggctttatatcccagatttacagctccggatacaacttttgttgccgttcttaccacacatgaattgagaaccagtacagccgaagccagaaatagtatttttttcattttgtcaaattttatcctgcgaagatagtattttaaaaaaagatctgtaatttttatcaggaaagcaggagaatttgttttattgaatgataccctttatttcccgtcaaaatacttcttaagatcagaaatattcctgatatgaagctcttcagcctggtttctgcgcatcatcagtgcataagcattgttgaatcccaagggctgcagccattgaattccatattgtttttcaaacgctgaattcacataatggtatgttttatcaggactttgggaaacctctctgattgtttctgctgaaggttttaaaagaaccagaagtccggttccagtatattcagggtaaaaatcaattgcgtcattcaataaggcatcgaaacagatttttgttcctcctaaaccggttttggtttccactttataatcagtatacccttcaataagcatagtgtacatttccgcaaggatatattgttcaccaaagatttttgaaccaatccggatggttcccgaatttcctttccggggacttttatacaggttattgctgatgagaaaatcctttgcaatcctttccggagtctggtggagatgatcagctctgtaattcaggtccgtcatgatggaatcattgaattttccggccagtaaatttaaggttttctccagatccggaaattttttcagtgttttagtcttgataatgggagccgcataatatggaggaaatattttttgatcatcatccagcacatacagatcatatgctttgattcttccatctgtagaatatccgctgatcaggtccaattctttctcataagcggccttatacataattgcatcactcactacaagagggttaacattgagtccatatacggaacgaagcccgatatcaccgtcctgtcttcccataaattccggggtaaaaccggctttaatggttcgatgtgatactgatgtcaaaagatagcctgctcccagaacaataaggctcgcgggaagaatatatttcagcttctgaaaaaatctatagcctgatttctggatcatagcaatgatctgatccagtacaacggccagtaatgcggccggaatggctccggcaagaatcatattcgtattgttgagcgaaattcctccgaagataaattctcccagaccacctgctgccacaaaagaagccagggtagctactcccacattaataaccgctgcagtcctgatgcctgcaatgatcaccggcatcgccagagggagttttactttaaaaagaagctgcctcctgttcattcccatggctttggcagactcaatcactgcaggattcacccctgtaattccggtataggtattccggataatgggaagaagagcatagatcagtaaagccgcaatggccggtttcggaccaatgccgaaaacaggaatcataaatcctagcagggcaatacttggaatagtctgtaaaataccggcggcgcccaacaccagactggaaagcttttttttcctggatatcattatgcctaaaggcactccgatcacgatggccagaagcaatgacaaaaaggtaagaccaagatgctgaatgatctgcacagacagcttttcgtgttgttcagcaataaattgccagagactttgctgctgtgtcataccatctgtgattttttataatgattaaacgctttcactacttcttcataaacttcagcattttgatgatcagaactcagttgctgcaaaacatcccagacacttgtattatctgtactgtccggtctgtagtatgaattttcaggagtaagaaacggactgatatggtgcagcgcagctactttatattctaacagaagccggttttcagcaaaaaaatcacggacaaaatgcgtggcaggctgataaagcatttccctgggagtgccggtctgtatgattttcccgtgatccatcagacatatcctgtgccccagttcaaaagcctcctgcacatcatgggtaaccaggataatggttttatttttaagttcttccagcgatttaaattcggaatgaatatcagctctggtaatattatcaagtgctccgaatggttcatccatcagcaaaacagggctgtctgcaatcaatgcccttgcgatgcctacccgttgctgttgcccgccgcttagctcatggggaaaccgttgcagaacttcttcagaaagatggagctttgccaggagctcatgcgttcttctttccgttttctttttgtcccatttcagaagttcaggaactacggcaatattctgctgaattgtataatgaggaaataacccggaatgctgcatcacaaaacctattcccattctcaaatcctcgggtttctgatctttgatatttttaccattaataagaatgttccctgaatctgcttctataagacggttgatcattttaagcgttgtagttttcccgcatccgcttgtgcctaaaagaacaaggatttcctgatcagatgcctgaaaagaaatatgatccactgctttttttccgttaaaactctttgagattgattctactgtgatcataggtgaaaattaccgggcaagtctgattcctgtgaactgccattttaaattaggctgaaaaaaattacggtaggtctttctgctgtgtcccggaggtgtagcttctgatgctcctcttaaaaccatctgattcaccatgaattttccattgtattcacctacagctcctgcttctttcttaaaatgaggatagggcaaataggcagaattcgtccattcccaccgtattccccagtcaaagtagtcagaagcaacttcccattcttcttcagtaggaagacgcattcctttccaggaagcaaaagcagaggcttcgtagaaattgatatggcacaacggggcatcgggatcggtttcctgtagtccgttgagtgtataatacatccacttgccttcaatataatgccagtatagcggggattttgcagaattctgtttcacccagtcccatccttcagcatgccagtgcctgaaatcttcatacccgccggcttccataaattctaaatagtctctgttggttaccagctgactggcaatttcaaagtctgtcagatatactttatgccttcccagttcattatcaaaacaaaatccttctcctttaaaaccaatttcatacactccttcagaaaagctgagcatttcggtagtttttgaatcgttttgtacagatttttcttctgtataagccggaaaaagcggattatgtcctaaaatatacttaatatcagtgattaataattcctgatgctgctgttcatggttaagtcctaaatccagaaggggctcaacagcttctgtcagaaatgaactttcaagaaaagctttcatgtgttcatccacatactttctgtattggtatatgtctgaaacagaaggacggctgaggtttccgcggtccgtccggattacccttgccccaatagtttcgtaatagctgttaaaaacaaaattatactgatggtcaaacactttgtaatcaggaaaatgaggaacaaggatgaaggtttcgaaaaaccaggtagtatgtccaagatgccacttcggcgggcttacatcaacaataggctgtactacataatcttcaatttccagtggggcacagatttcttcagaacgtgtgcggacgtccatatactttttcgtaatatcttttgtggtggtctctgatgtcatgtcttttagtttttgatgattggtttaaaatgaaagaaacatgatttattttcactttgcagatgctgtgcagttttttattgtacctgccagatcacatctacaaaccattttttagaatctctgatctctccggttatggaaaatcccgatttttcaccgagctccctgatcttttcaggcgagaacttctgtgaaatctccatatcaataatctcattttcttcaaatgaaatcctcgtatcgccaatcgttacctgctggctgataaggctcaccagaaaacttctgcaggctccggagacagggtcataagtctggtaatgctgaaattgtttcagatcaaaattaccgccaagttcattgttgatacggctcaggagattaagattaaaggcagcggtaatcccttcctcatcattataagcattcagaacagtatgcgggtttttcttcaggtcaaatcctaccagtacacggtctttggaagacagacttttgttcaggtgcacgcagaaatcttcagcttcttccagaggcatattcccgatattgcttccgaggaacaaaaccacttttctccggttggataatgcggctgctttttggagcatttcaaaataatcaccttccaaacaggtaattttcatttcaggtaaccggttgctcagtttttcttgaagtatagaaagaatattccctgaaatgtcaatcggcatataggtaaaatcaatccctttgctcacaagtctttcgagcagataggttgatttcattgcatctcctgcgcctaattcaatcaggtcaaaagattcggttccgggaataaggagttctataagttcatctgttttattcttgaaaatatccagttcacaacgggtcagataataagcaggcatagccatgattttctgaaaaagatgatcaccggttttatcgtaaaaatattttgaagataattttttaggagtactctgcagtccgttcaaaacatctgaacgaaatatatctgcagtattttttgcagtctcagtgtgtgaatctaactgtacattcataaatcttattttgtgtggttgggtagagcactgcaattatcctgccttttaaaacatgaaaatttttttgctttatctaattaaatataaacaattttacttttaataatttgattttcataatatttttatcaaatgttgtactttttatctcattattcaatcaaataaccctgagctcagacataaagtcaaacagctttataatggttctttatttccaatatcactattggttcccatgcaggatttcaccaccttccagggacatttcaatagcctggttactatacatgaccatttgtttttcataatctccaacagcttccggaatactgtttttgctgatcagataacgggtcagaagagcagcatctgtaaaggctgtattggctcccactcctcctgcagggctcatcgtatgaacagcgtcccccaaagcggtaatatttccggatttccacggttcctttggtaaagaagaccggataggagtgacagataaggaagacctgtctgcatactgaaataatgccttaagctgaggatgccactgatgggtcactttatgaacagcatttaaaatatcttccgttgaatggctgtagaaatcagactttaccattccaaaaactttgggattgccgataaatgcccagtaaaaataatcggagatcgggctgagaagatcccaggacggatcttttcgggaaaaatcaaaagacataaaatctgtgattaaagaaaaccggtcaccaatgatcactgaagtgccttcctgtaattccttggcaatggcgtgccgggcttcctcagaatgaaaagttctcccatagatggtaatattcccggtattgatttttctgtctcggcaatactcctttccgattcctgaatgaactccatcagcagctactaccaaatctgcagtgtaggtaaagccgtctgaaaatgtaagttccacttcaccgctttctgtttcctgccagtctgtgagttcttttccaaaacagatattgtcctgtaggccctgaagcagaatttcacgcaacgtcatgcggttgggtttcaggtcgggcatttcttttactccgtcactccaggattctacaagaggattttgagagctttcaagagttgttgttaaaaccttcattccgctgtagcttgccgcgcaggtagcaaggaacagcctgtacagatttccgggaaggcattcctctaaagcttttctgccgggctcattcaccctgattctgtatccttgtgaacgggtgtttattgctgcgtctttttcaaatacggtgcataggattccattcttttttaatccctgagcaaggcacagacctcccagtccggctcctataacagcaatacgtttgctttttaattgttgtaccatcataattgttgatcaatctttttattatttcttataattgacgggacaaaattagagcctggggacagggaataggagagctatttaacggtgatgatgggacaaatcatggttttcagatctgaactgtaaagcggtcattcctgttccttttttaaagaaccgtgaaaaataaccaggatcatcatagcccaactcaaaagcaatctgttttacgtctatatgggtgtaaaacaacagacggcgggcttcccacagaattttctgctgtatccagaagctggcaggatatccggtaacatcttttacggcttcattcagatagagtggagtaatattcaggaaatctgcatactgctttacctgtttggttgtcctgaaatgctctgtgatcagctttttaaactgccttgtaatcgaatatctttggccacggtgctgaaaattttctgtttctgtttctgttcctgaaattcttgaaataatgattccaaccgaggattcagccaatgatcttgtgatggaaggaagatgtagcgcaggatctttttctgctttttcgaaaagagggggcaggtcaaaaataatgtcattttccgtaacggctgaagactgatggagccattggcagagatccagtatttcgcggtaagattcaggaataagttcagcttctatgaataaaaaccatccttcgttgtctttctgatgaatatactggtgaatttgcccgggaccggcaaaacataaggaaggaccttttaaatatatcttgttaaaatctatttccattacaaagtttcctttctgctgaagaataaacatataatgatcatccctgtgaatttcagcctgtttctcatggaatatggataagggtatcacccggacagctgaattttccagttgattgtgatgggaaggaattgcttttttcatatattttacgaagatacgtgataatgatgattgataaatgataattgatgattgatgagttgctcaggtagtttatttatactgctgtctgctttaacgtccgaaaatctggattcaccgcttaatatgacctgttcaaagtttttgtattgagttccggttctgctttatcataattttaccattataaaacctcacgattatgaatactacattgaacttcagtaaaaaaataagatccgctttatccctgatcatttttatagggacgggattattatcactaaaagcacaggctccttccactggtgaaaaagaccaggaaagtacagctatcagatcagcttttcagaatacaaagaaaatcagggccgggcttctggatgttggatatgcagaagtagggcctcaaaatggcaaacctgttatccttctccacggatggccgtacgacatccatagttttgaacagtcttctgccatacttgctgaaaaaggctaccatgttctggtaccttatttaagagggtacggaacaacaacttttatatcacctgatacaaaacgtaatggccagcagagtgctgtggcaatggatattattgcttttatggatgcactgaaaattgacaaagccatcattggcggctttgattggggtgccagaactgcggatattatggcagcattgtggcccgagcgctgttccggactggtggcagtaagcggatatttgattggaagcccaaaggcaaacgaaaagcctctgcctccgaatgctgagtttttatggtggtatcagtattacttttcaactgaaagagggtataaggggtataaagctaatactttagctttcaataaactgatatggaaaacagcctcgccaaaatgggcatttgatgaccagacctatgaacgttctgcagcggcattcaataatcctgaccatgttgatatcgtgatccacaattaccgctggcgtctgggattggcgaaaggggagaagcaatacaatgcgtttgaagccaaattggcaaaatctccatctatcaaagttccgacagtgaccctggaaggagatgccaacggagctgcctttcctgcccctgaaagttatgcttcaaaatatacaggtaaatatgcccaccatacgttaacaggtggaatcggacataatttaccacaggaagctccagaagcatttgcagaagcgatcatggaagtagatgctatgtcacaggccagatagaacctgacggattaagaaaaaaccaccgctcaatgcagtggtttttttattgtatcttattaaaatgttattcttgacgatccttttcagtctttagtttattagccagaggattagcgtacatagccaggaaatattccctggaaacaggatctgacggatcaatacgcatttcaagtctgcggacaaataattgtttttcctgttccgtatattcggaagcgtaggtattggtattgtgcaggaggtcgtaagcgatgtacttggtaggccaaagcttataattactgatgatggaacggtcaatcacctgggcaattgcctgtagctgcttgtttttgttatcgatagtggctgcaatttcatccagttccgtatcaagcacatcaccggcatgaaggtgaatgcgtttcttctgtcccagaattccgctcaggatattggtgaaatcttcatttttccccttgatatattcttcatccctgtgttgtgccagcagttggggcatctttagggaatctgtaggatcatattcataggagatggataccggaacaatctttaaggacttaaaataatccgtcaaggactggtcaccggctgccatagccagcattttcaaaacaccctgctgggtagaatcgttaccgtcttttgtacggccttcacgttgggcaatccatacggaacggttttcattatatagctgttccctgatatattcagacattgtctgtgaactggtgagctgttcacgaagaggaaggcctctttgcaccaggaagttgcggttcagcttggcaagtacatttaaaaactttttgcggacaagattatccccgatcgccgaagcggtcataatataaccaccttccagcaagaccagattaagcagtgaagtatccagaacaatatccctgtggttggagatgaaaaggtaaggggtgtttttatccagcttatcgaaacccgaagtcgttaagccgtcggagcttttcgcaaggatctgccgaacagcaaacgcgacaaactgatgctggaaatcactaatggaatgaacatttttgaactgctccagccatacctgctcatccgtatcaggaaaagtaaaattcatcagtgctttcatcatgggatcacgggctatgctctgtaatctctcattcacttcctgatcatagaaataccggatttcatcaaacttagacatgcggttgggtaaaaattaaaactttttgcaaaagaacgaaaatttattgggggattaggtataatgggtgttaaagtattatgaggggcgtaggagttgggtgaaatagttgtgcaatagatcggcttgcacaggcattcaatttgttattccgtgagctaagtttttgtgtcttatttgcgcccaccttatcattcagcatgaatctaaactattattttatcattatttattattaaatgctttctgtgtccggattcctacggaatgacaagcgttgtggataggctaggagaatggttaatattatgtctggagaaagtaagcggctatgcacccacatacacgcgcccaccttgtcattccgcaggaatctaaactattattatcatgcactatgaaaaaagtttctttgcctggattcctacggaatgacaagcgttgtggatagattaggggaatggttgataatatgtctggagaaagtagtcagctatgcaccaatacttacgcgcccaccttgtcattccatagaatctgaactgttattatcatcatttataccaattaaaagtatagaatgcaaaaaaatattcatatcaaagccaattctcaaacaagtaattcaaaaattctaaattaggatttgtgctccttatcaattcaagtttcttaattcttgaccagtttttaatttccttttctctttcaatggcatgatgaatccaattatatttttcataataaattagaaattcaagattgtatcttgcggtgaagctaccgggatttaacttggttttgtgttgatacaatctcctgtggaggttcccggtaacaccggtataaagtacttttctgcttttattggtaagaatatagatatagtaggtatggcttccttttgaaaacttaatcatttgtgtttgttttataaaagttacaaaaatatcctgctcgtgttgcaataatctaaacacttattttacctttacttatgtctggagcaagtaagcgactatacaccaatagttacgcgcccaccttgtcattccgtaggaatctgaactgttattatcatcacgcattaagaaaaactttctgtgtatggattcctacggaatgataaacgttgtggataggctagtagaatagttgatattatttctggagtaagtaagcggctatgcaccaacaattatgcgtcccctcgtcattccgtagaaatctaaactgttattttatcattatttattattaaatgctttctgtgtatggattcctacggaatgacaagcgttgtggatagattaggggaatggttgatattatgtctggagaaagtagtaagctatacacccacatatacgcgcccaccttgtcattccgcaggaatctcgatcattttatttaagtcatttaattgaaaattcagaattcctaccaaattggttctcacctttgccctgtattaattctaatatcactgtgaaacaagtaacaattttagtagcgatgctgtgttcagcgttaatgatcaatgcacaacagggagccggtcagggaaaaataagtgggagagttgtggattccagtacaggaaaaacaatagatcatgccagtatcgggctcctaaatcaggataataaagaaatcaacgggacgacttcgaatgaaaaaggagagttttctatggatcatattgcatcgggaacctataaagtggctgttttttatgcaggatataaaaataaaacaacagcagatattcagctcggggacaataatgcggtagttgccctgggcgatattccattagcaaacggagaaacggcaatagaaggagtgacgatcgttggtaaaaaagcggtgattgaaaataaggttgataaaattgtttttaatgccgctaatgatgtgacttctcagaatggagctgcgattgatgtcctgcgaaaggttcctcaggtgacagtggatgcggatggaaatgtggaacttcagggaaatgccaatatcaggtttttgattaacggaaagccgtccagtatatttggaaatagtctggcagatgcactcgcttccattccggcaagtcagattaaaagtattgaagtagtttccagtccgggagcaaaatatgatgcgcaggggacgggaggaatcattaatattgttctgaaggataataaagtaaggggaatcaatggaagtgtgaatgccacgggcggaactttatttgaaacaggatctctgaatctgaattataagaataataatttcagcatgaatgctttctttagcggaaatgctcagctaaaagcgaagactcctttttctcaggacagaacttcaagagatacagcttctattaccagcacccatttattacaggatggatataccgattttgaaagacatggttaccgtacaggtttaggtttcgactggaatctgaataaatccagttcattaagcggatccctttctttcaatagcttttcgaataaaagtacaggattaatcaatcaacagcaatacattacggatcatactacttctgatgtaacctctattatcggatccagaacttctgataaccaatcttccgttcgttctgtagatggaagtctgagttttagaaagagctttgcgaaagaagggcaagagcttacggcagattacgtcttcagttatagttctccgaaaagcagctattttcatacccaaagcttattgggagcagcaggtccttacaatggaatttcagggagcaatcccggaacggataacagccataatatttcagtagattacgttcaccctttgaatgataacgttacttttgaaatggggcttaaaacagtacagcagcatattaccaatgctaccgatgttcatgttttgaatacttcatcaggacagtatgaaacagatcctttgcaatcctatcatttaaattatgatatgggaatctatgctgcttatttttcttccagattgaaactattgaactggctggatgtaagagcaggtctccgatatgagtacactactctgaaaatcgatttcccgaatacgaatattccgtcatatggcttactggttccttcgttgatcttgtctcacagatttgatagtgatgaaacggtgaaactatcttatacaagaaggctggagcgtccggaatatacagaactgaatcctttccttaatgtcagtgatccgcataatattaccaccggaaatccagccttgaaacctgaaattggagataatatggaattaggctacacaaaaaacctggccaatggagggaatatctccttgtcccttgtagagcgcatcaacagtcaggatttaaaacagattaccaccttttatccaatatttacagccaatggaacagagtataccaatgtatcggttacggcaagagataatatcgggaaagagtacaattccggtggaattgtctctctatcacttccttttttccagaacaaactgaatctgagaagtaatatcatggtatttcaccgttatattgtaagccatatttatgtaggaaatttggatatgggaatgcggtaccgtgcgaatctgaaccttaattatcagtttccaaagaactttgttctggaagtgttcggaaattataactctgcagccaaaaatatccaggggaaaaatccacaatcaatcacctatacctttgccggaagaaaagagttctggaacaaaaaagcaagcttaggatttaccatcaccaatccgttcaataagtacatcaaacaggtaaccactgtgagtaccggagattatgattcttattctgtaagagaattaccgtaccgatcttttgggatcagcttcagctataagtttgggaaaatggattttaaaaaggagaaggatattagtaatgagtatttgaatgggccgggatcgggaggttagaattaagtaatggaatggaaatagtttctaaatatttttttatatttaactctttataatagatgatgaatatggaacacaaaatacatcagggacgcaatgtaaaacgattcagggaaatgctgggcatcaagcaggaagcattggctcttgaccttggggacgactggaaccagaagaaagtttctctgctggaacagaaagaaattattgaagaccctttactgaaaagaatttctgaagtattgaaaattccggtggaagcgtttcagaattttgatgaggagcaggcggttaatattatttctaatacatttggtgagaatgcatttagtaactcatttaattatggtacaattaattttcatcctattgaaaaaataattgagttacatgatcaaaaaattgagctttatgaaaggatgctgaaggagaaggatgagatgatggggagactggagaggttgattgagaagagatgatttaagatatagaaaaaggttcagcagatgctggacctttttagttatagtgttgaatgtttattttatagatgtaattagtctaaattcataaatatttggagcaaaaaacaaagtttaatgtttttaatttactatctttaagtgtgaaaatagaataatatttaaaataaagattgaaataaagaaatataaagacaaatggataatctaaccaaagagcagagaagaaagaatatgcaggcaataaaatctgttggttcaaaggcagaagtaattttagctaagtctttatttgcaaaaggttatagatatcgtaaaaataataattctgttcttggaaaacctgatctgactttcaaaaaaataaaactagccatatttgttgatggagagttttggcacgggaaagattgggagataagaaaaaaaaatcttaaaacgaatcaggaatattggattcctaaaatcgaaagaaatatgcaaagagataccgaagtcaattcaaagttatctcagctaggttggagaattttaaggttttggtctagagaagtagaaaagaatttagatacttgtatttcacagatcgaatatgaaatcaataaattaaaaaacaaataaccagatatgccaaatacaggagataattttactacaacattaaaacaagctcatctagaatggggagctcaccgccatactagtagtagagaaattagatatggagaaggatatttacaaatcccatctacatatgcttataattttgagataacaaatgataaagaactaacaagaagccaaatatacacttttagtactgctgatggttttattcaaaatggatttttaaaagcttcaggaaatcaagctagagaaaattatgcaaagcaatttcatggcaatggagctcttaaattgttgggtgattggttttaccatattgatgctcaagaaggagatcaaattaaaattgagtttacaagcccaacaaatattcttcttactaaagtttaaaattttagccctcttttttgtaaattgcgctttgatttagaaagaaatgaagctagcaaaaaatatcagtgttgaagaactaaatactaaagcctgtcagacagaagttctcaaaaatattgaggatggggaagctgtattaactcattatcttcataatatacataatggattgtcctcgcattataaagaagatgccatgcaggtaataaaaaactatttagaatacaaacaggataataatgtatcgatagttgaggaagaagctattcagcagtttttatttgaagtagaaaacgttccttttcctacccctgaaaactattcatttaaattcattgatttatttgctggtataggtggttttagaattgctatgcaaaattctggcggaaaatgtatttacacgagtgaatggaataaagatgcaaaaattacttatagagaaaactttggagaaacaccttttggggatataacaaaagatgaagttaaaaggagaattccaaatgaaagaatagatgttctttgtgcaggttttccttgtcaggccttttcaatagcaggttatcaaaaaggattttctgatactagaggaaccttattttttgatattgagcagatcgttgaaaaacatagaccgaaagttgtgtttttagaaaatgtaaaaaatctagtatcccatgataaaggaaatacatttaaagtaattattgaaattttagaagaaaagcttggatataaggctttccataaagttctaaattcaatgacgcatggcaatgttccacagaatcgtgaaagaatttttattgttgcatttgatccggatcaggttcctaactatgaaaattttgaatttcccaaaaaaattaagcttactaaaacaattcatgattttttagagaaaggaaaacaagatgaaaagttttactatcctaaaacacatcagtactatccagagcttgaaaagacaatgacaagtagggatactgtctatcaatggaggcgtgtctatgttagagagaataaaaataatgtttgccctacattaacagctaatatgggagctggagggcataatgtcccattaataaaagatgattttggtattaggaagctgactccaaaagaatgttttgctttccagggatatcctatggataaatttatactacctaatattgcaaatagcaaattgtatatgcaggcaggaaattcagtaaccacaagcttggtagaaagaattagtaaacaaattataaaagttttgtaatgagtgtttgggataggtattcagaggaacagcgtagtgaatatatccaattcttacaggtatatggtgctctttcaaatttgtttagacagaaaaaaggggaagatataccacatcttgattcaaagtttcaggaaaccatttttgctaaaatattcaactgtcaaaatgtagatattggaaatacaccccatgatgtattatctgtttttgatgataaaagaattggtataggtttaaaaacctggatggcgagtaagccgtcttttcaaaaagtaatgcagctaaagcgttatcaaaaggaaataaataagtttcaagataataatgaagctcttgcttataaagtttctgaaataaaaaatgaaagaatgacgagtgattatgagcgtctgggtttgtcagaaactgataatatatatcattacgtgactcgtgataaaggactttttaatattcatgaatgtgcatatccgctcattgatctatctaatttacaaataatagattctacaagttctgcattaacttggagtgatggccgaaaggattataaatatacttatggagattctcaaatttggcaaaaatttgatccaagtaaaaaagatacactactattaaatcgttttgatattaaaatcatagaggatccttttacttttttattacaatcttatttaaatcttactgattcgattcatcaatctgaagatgatttcgtcgaagtgtatttacctctctattcatatagaagtaaggaagtagaagaaaaatccggattgaatgcgtggaatgctgctccaaaaaataaaggaagtgatacgttaagaccattaaatgaagtgtatatccctattccacgagaatttcataaaaaattccctgatttttttattgaagatattttcgaatttgaaaattaccgcaacgcctaccaaggtgaaaaaaaagataagccagaagttcgtttccgcctcctgttaccgaatggaaaagaaattccggcattagttactcaaagtaatatgaaagcgttgcaatctggaagtaacacagaatatgatgaaaatggaaagagatttgggcagtctgcgttaggacaatggctgttagttgatgttttaggcctaaagcaacgaaaggtggtaacacgagaatggttacaaatgaaagaaacagattcagtccgattatggcgaaaaaagaatgactattccttaatcaatatagactttgctcctatcggtgcatttgaagcttttatgaatggtgaacctattccacagaatgaagcataatcccttgctatgcttctactaaaccttcaagttcgttaagattattaaaagctataagatgattaaagccatgaaaattacctttaatagtttcttttgatccaaaaccatattttttgatattaagcagattatctttaataatttgtgaagatgcataaccgcaaagctgtaatgtggaattttctgttgaatggatgaaaatacaaggataggcgttgtcaatatctatcaatggtaaatttgaaccaaacatgaccacattgactactttatcagatataataatttctggcaaaaacttatctacactaatattttcaaagtctataaaagtgtttttcaaatgtttttgtaaacccattataggtattgatttgtaaagaaaattatctagaaatgcctgaccctcaaatttatctctaagctcatttatatcacgtactttaagatgattgataactaatttttctaaataaacaacctctcttctcgttagattaattgtttgaaatgacttcttataaggtagtaggtatttaatataatctttcataattgttacaaagtaatgaaaaagaaatttacccatcagaattagttaaatgattataaacatattaatgagctattataagtaaattgactgagttgttacagagttttatttaaatggctcttcgagaaggtttttaagaatcattttttatattcaaagttacggtctgcgccctcctacacatccacctcctcaacctccacactggcagatacacaaacaccacagacagtacaccagccagtacacccaccagcacagccattgccgtagcatccagcttataatcttttgagaaattatactgtcctataaagagcagggataaaaccagtgctcctgtaatcagaccgtgtaagatgcttagtttggtcatgagcttttttatattcagctgttcgtctacggtaaactcaatggcttcctggctggcggcatcggttacccttttgatgatatcaatggtaaggactaccggcaggaaaatagccatcggcagggtaaggcgggccaggttttgggttcctgagaaaaaatgggtgtagcctagctctttgaagctggcataggcaatgatgaaattaaaaaatacatttgggaggacatagtaaattgtacgcttcatgagaaagcgtctgagggtagttttttttataggttttggctttggaggctttattttaaatttcatagagaggcggtcaatagctcaatggctttatcttttatcttgtgggcttcttctttcggaagaaaattctcattggacatgaaggtgaagtccatctgctggttgtacgtactggcgactaaagtgtttgagttcagccatgggaaagccacggtaggactaaaaaccgtttccagactgaagttttgataatcattcgggatattcaccttccccatattggatagggtcacatcatggccgccttcgctggatttcaacatactgatcatacggtctacaatgggatgcatatgttctcccatccacaggagctcacgggcttccagtttattgattttctctgtcaggtcctttttgatctgtttggcattgcccagcacatccttactgtcttttttgatggaaagctctaccgttggggcgaaagcaaataaatgatcttccttgatttccggaataaaatgacgcacatctaccggactgatcaccttacctttggcacggtctccctgaacatcacggaaggcctgcatcaccgaagaacacagcaaagcatgtacagaaattccgttggctttacatttttcagtgatcagtttggtatcctcaggggtcattttccagtgaatggcgtagtttttcccaaggtttctctttttgctttttcgttggatagaaaagaatattctggcaaaaagcagataaaggccggctttatattttttaagacctgtattaaaatccgaaggcagaaaatcatctaccgattcaaaagcaacataaggaatcaacggaagataaggattgtccagcaggctcagaagctcccgtagtaaagtcactccggtggttccgtctgagatgcagtgaggcatgatccagatgatttccgaagtatcttttcctttcacccataccacttcagccagtggttttttgggttcttcaaagaatctgaaccatcctttttcggattctttaaaccagtcgtcgtctgtttttctttctacaatccggagcggaatgggttcaatatcttgttgtcctataaaaaaaggatagcgtcctttgctgtgatcaatattagctctcagcataggatgcttctgctggattttgagcaaagccgttttaaacgtgtcctcagcaatctgtccgttgatctttgcggtgtaaacacagtttaaaggcgtttcaggatctacatacatgatcctttccaccatcattaaaggtcttttgatcatgatactgccatttgttttagttgtgaatgaatcgtttgcatcacttcgtcacgtactgccatggcatcggtatacggtaaataaccttcgcttcccatgaaagaaaaatccattttaccacggtaggtagagaccaccagggtagtggtattccccaaaggaccaatgacagacggactgaggatggtttccaccgtaaatgctttgtactcatgaggaatctgaatacgtcccagattcgaaaacatacagtcgttggaggatttcccgttctttaaaagcctggtgaaattttgaagcgcgtcatgtccggattccatcaccatcatggtgaggtaaggattcagctttgaggtcttctgttccacagatttctgcatggcacggagattatccgtaaagcttagcttttcatcagcagacaccacaatcatcagcccgaaagcgaagatatggtcttctttgatctgttgggcaaaacgcctgatgtctaccggacaggaaactttattgaaggatttttctccccttacttttttaaatgcctgtaatactgctgcactcaaaaatgtattcactgtcaccctctgggatttacagtaagcgattaattctttgcttaccgtttcatccagcttccagttgatcaggtaatcactctgtctttccacagcttttttgcctaccgggatccatttgatggcggtagcagccagtcttccgataaatctggccttcagtctctgtctgcggttgttcagaatatgggcaggaaccacatcttcaatgcctaagatcgggttttctgtcccgatgtcggccgccggattgtccagagcgattaaaaactcttttaaaaaagccattgcagaaccaccatcgcaaagacaatggtggaacgcaaataacatgtcagaaacgtcttcccctttgatccagacaaaacggatcaggggtaatttttcataattaaagagggtgttccattctttcctggattcttcctgccactgatcttcactttgtctggggacgatccttacaggaatagaaatcgttttttcaggaacgttaaaccatggaatatttttttcatcatagctgatcaatgctctcagccatggatgtttgttttgaatttgggttaatgcctgctggatctcttttaaggtaaaagtccctctcagtctgaacggaataactgcgttaaaaggttctgttccgtcccctaataacatacgttccccgaatagcaatcttctttttacaggtggattcataggctacacagaagctaatgttgaatgttcgtgtacaaaattttctaacagttctaccgctttgtcatttcctccggcaagggtgaatgtgttctgaacttccctggcagcttcccggtatttcggattttccagcaattcaaaaacggtttcacgaagtgcatctacacgcagtctcttgtagcggatgctgattccgcagcctgcctgctcgatcagtttggcaatatggaaatgatcgtaagcaataggggtgatcagcatcggtaatccgttacggaaagtatcgtttaccgtattgaagccaccgtggcagatcaccatgtccatttgctgcatcactgcagattggggaacaaagctgtttacgataaaattatccggccattcttcaaagatttcgggtggagtagcggcaattactgtaaccggctggtctttaaatgcagcaatgatcttttcaaaaaatgcttttctgatgtctaccagcaatgttcccaacgatacgaatattttcggagtcgtggaagcattcagtttatcccagtcaaatggggcatcgttcgggcggccttttaccggccctacaaatttcatatgaggcggaacggtttcaaatccggcaaaagcctgtgaagtaaacaccatattcagtttgtgagaatggatataaatgccttcttcatgaatgcctacttctttttgcaggtctttgatcagtttttgctgccattcccagatttttggggcacttttttccgtatctcccatcacatccggtggaaccggagtagtggttacacaaggaatattgtttttgtgggcgaaaagcgcacctccgaaagtgatacaatcattcacgatcacatcgggcatccagctttctgtgagtctcgttaatcccggcatcatcattttagcgaaaggaacataggtttcttccagtgccagcttcatcacttcaggtcctgaacatgccggaccatcatcctgcctttttaaaatatgggcaatttcctcctgatacgggataaggtcttcttccggatagaaataagaacctccttcaggaatatgcttactgtctaaaggcgtaattccgaaccattttacttcatggccacgggcaatcagactcgctcccacacttaaagtaggactcacatgtccgaaaaacggaggaacaacgaataagaacttagaaggtttttcaggttttgaagcctttactatagcttgctccaataagtctgccgctgtggctgcacctcctgcttctgcaaaagactgacctactttctgagcggcttcacggtagttcgggttatttaaaatctgctgtacggcttctctcaggtgattggctttgaaccggttgaagttcagacgttcacctgcttctgtacgcaccacacggcctgcaacgtgagactggtcataggcaatcggaattactaccaaaggaatcccgttggataaagtttcagaaaccgtattgtggccgccgtggcacaccacaccatcaagatgaggtagcaggtccagctgaggaatctgctgatataccataaagttttccggccactgctcaaaaagctgtggatcagaaaccactacaacggttaaatcttcatctttaaaggcatcaattaccttctggaaaaacgcttttttatgatcatgatcgaaagtagttccgatgcttaccagaatctttttgttggcagcatttttcaatctgtcccaatcgaattcacaagagatacgacgctcggtaagaaccggtcccgtgaatttatattgaggtgccagatcatccatttccccaaagaaataattggaggtcagtaccagtgtcagcaggtctgaagtggccagggaacgttcttcatagaagcctaattctttctgtaaactgataatttgatgtacttcccattcgtgaacttttggaagctcattcataattttaatggctgccggagcggtaacggaagtggcataaggaattccaagaatttttgcagcaacagggactgcaaataactgatggtccccgataattaaatcaggctggtatgtttttaataaagcgataactcctttatagcaatgtctgttcagtggggtaagaacttcttcgtaaaggaacttcacactgtcgattccgtacactacttttttggaaataatatcaagatattgttcactttcttttttttcttcgtcggtctgatcgtattggatcagtaataattttcctccctcgggaagtttagcctctaacgttgggtcaaggctgatccaggctacctcatgtcctctttccagtaacgtagcaccgatgcttaaggtaggattgacatgtcctgtgagtggtggaactataaatgcaaatttagccatggttttgtgttaggattttagataaaaattgagcaatcgtttcagcgataagctgaggttcctggataggaatattgtgatcacccgggattaattcaagttcagactggctgatttgagactgaagccactcaccggtaggcctgcagttggaatcagcgccataaagcaataaggtaggagccgttaatgcattgaaacgggcttcaccaaggaaatgtttttccttgatcatatctgctttgatgctggtctggttaaacagaaattcatacatacggtggttcttttccatttgtcttttgcccatctgcactttggtggtatcggtaaagttggcaacataatgctcaaggaattctttgctgtattcatcaatgatgttacgggctttttcgtcctgaggatccggagcttctatcactaccagttgattgatgcgttcaggatattccagagctgtttttaacgcaataagacctccgaaactgtatccgacaagatgtactttttccagttgaaggtgatctgttaaacctattaaatcggatgacatgttgtcaagatcgtacccatccggaaagcgttcactcataccgtggcttttcagatcgtacatcaccacatggaaatgttttgccagaatgggggcaatattaaaataataaatggacaggttactgaacataccgtggattaagaccacggtttgttcggctcctttattaagttcctgtatatgaacttgtctgttattgacagtgattattggcattcgtagatataattgatgatcatactaaggtcaagattgatcagctggtccagatccatggaagacagccagcctgtaaaatcgatctgatcgccaaaatgcgccttgattttttcagagaaagagacaatctctatgctgtccatttcaagatctttggtgaatgaactttcaggagtaatatccatctcctctacaaattcagcacctatcacttcagtaataaaaccttttaataaagtaaaaagttcttcgtggttcatttttaatgttgcgtttacagtgtccatccgataatataatttttatgtttaatagttttgatttcaatattgttgatccacaggtgatcgtcttttatttcttcgacttcgaaggcttttggatttcctttcagtccggttcctgagaactttccgtaggcttctttagctacccagaaacgggtggtccattctgcctgatcttttccttttaataaggctaattcatggtccgtaaataccagatcatagaatccttcgctgcgttcttccatcagttccatatcaattcctacagattttccatatctcgcaattcccacggcatcttttcctttgtgagccagtgaaatatggatattttctgtaaaatcactgaggaggtaaggtttccccacttcatcggaacggatttcaaatgtgatcgggaagcaggcatgatttttttctttacggagaagatttcttacggcatctttcacggccacacggcttaccatccagtttttctttttgttaggcaatagctgctggtgatgctgtttttccgtctggttgaaatatcttttcaggataaaatcccatgaagcgactcttgtataggcctggtggaagaaaaatacttcaggagcaatctcttccgaaagacggttatgcagcggcgacatggaaacattccataaagcagcgtcaatttccagtcttctgttttgccagcccgtaatggcgcaccatacttttccgtcccttttcaggatgatatctgcgatggcaaattcatcattaagctcggtcagcatacaggtgcactcaaaaataccttcctgatcatgcatatttccgaaaaactcaatatctctgatttttacagggaatgcaatgcggtctttcaccaaagtaagctgcagccaaagcccgaacagctgtcctgcattatcaagcaaagagcctttaccaccgtttccttttatcttcccgataattcctttgtctccaacagctgaaacttctgtaattccctggtatttttctccatggaacatgtgcatgtcatagatttcttcgggtgttctttcgataggtaaaagatttccgatggaaagattgaatgctggtgtcggaacagaacccaattttaaaatgacttctgcgttggcaaagttttcaatatcgagataagcatgattcggtgaacgccattctccttttacggttttttcgaaaggtttggcaacattcatccattggaagacacttacgttcatgattttatggaccagtgttcccggaatttcggcttctgcaatttctgccagctgttcaaagatcatcgtcatcgggattaccggttccatatcggctacatgagcccatccttttggctgtctcaataagctgtggtcgatcaggtacggatgactttccagcgttacgtacaaatcttttgtgaaatttgtacttcttgctggttttggagcggcctgttgtgctacaggagcagcctgagcaggacgtggaattgtaatctccggacggttctggaataaagtcaatacttcttcctgcatacggatcatatcggcaacgttatcctgaaatgcctgtaccagcggatgaccacttttggcagtcatggctgaagctgaggctgtgtattgttttggtgtttcaaaggcttgagctaaggcttttacttctttaaaattacggacaataggagagcccaattccagcttaataccttttcctgctggtttttttgattgctgctgaacttctaagaagtcaatagcaatggttttcccttctacaaataacgaagccactacacgttgtaactgcgctaatgcagaacgggtaggaacgctggaaggaatggtgctgaatgcttttcctttcaaggtatcatcaataaatccgatcagaccgccagttcccacctgaatgaagactcttgcgccttcttcgtataatttatcggtcagttcacggaaacggacaggttctaccaaatgctctgcactcagttttctgatggctgcctgatctgcaggataaggttctaatgtggtagctgaccacaaaggaatttttgtctgctgaaactgtgctttttccattccggcaaggattacatccagtttatctgcgataaaaggagagtggaatcctgactggaaaggcagaatctgatggaaaatctgctttgcttttaacaatggaaccagttcatccaaagcagcattgcttccgcagagaatcacctgattggggcagttgtcattggaaacatacagatttgaaatttcattaataaaaggttttatggcttcaatccctgctcctatggcaataaattttgaatcttttaattcaaaagtttcaggattcagtacatcaattaaagcttttacagaattggcttctgccagctcggacgaatatcctgccagccattctcctaaactgtgccctgcattcatatccggaatgattcccagttttttcaatgaattatcaaggatactgcagttgttgaaaatgtttaaggcatcagttaaaagaccttcaccttctgtttcaataggcgctgttaatccaaaataacggcttaccgtttctacttcacctttcgccagaccgtctaagcctggaaatacaaaggctaccttaccgccatcctttaataatggggtagaagtataccaaatgtcctgtttatttttccagatgatatttttggaaacaattttaatcgccttttctattcttgcaggcgttggatcaaaaattgccaccctaaaatctccttcaccaatagctgtttcattattttgtaatgcggaaagcagttcttcatgcgtgggtcttgccagtatcagtacctgatcttttttaggcatatcataaccttccagaacaacgtgggcattgattcctccaaatccaaaggcatttacagcggcaacttttggtaatccggtttttgaccagtttttagcttcctgtaccggttcaaaccttgtattctgcatctccgaagttggattctcacaatataaggttggcggtaaagtgtcatgatgtaaggcaagacaagttttaattaatcctgcaattccggctgccggcatcgcatgcccgatattggacttcacagatccgatacctgccgccggagcagcttcttcttttccgaagaactgagccaaggtctgaagctctgttttatcgccaagtggtgttcctgtgccatgagcttcaaggtaaccgactttatttttatctaaatcagcattgatccatgcctgttccaacgccttcagctgcccttttacagatgggctcattacgctggttccggtaccgtcactgctgactcccacacctttaatgacagcgtagattttatcctgatcgcgaacagcgtcttccaatcgttttaaaacaacgaaaccacaaccttctccaatcaatagaccatcagcatcactgctgaaaggcttaatctgctgctggcgtgacatggctccaagttgggcaaaaatactccagaaagcagcattctgtcctgtgtggactcctcctgcaatcatgatatcggaacggcctctctgaagttcctgcaccgcatggtctacagcgattaaagcggatgcacaagcggcatctaccgtaaatgctgcacctcccagattgaatcggttggcaacaagagaggcaacaagattgggaattaatcccatcgcagtatctgctgcaaaacggcctttacgttcctgaaacgcatgctttaccttttcaatatcggaagaagaaacgtgaggcagcaattcctgcagtaatgaagaaatctgttcaccggttcttacaatttcgatagcgcgggtagctcccggaccggtatagtttcctttcccgatgataattcctgttttttcaagagaagtattcttttgaaatatgccagcatcttccagtgctttctgtaccagatcaagggtaagcaaatggtcgggttctgttccttcaacggctaatggcaaaataccgaatgctgtgggatcaaacgtataatcagagataaatcctccacgctgacagtaaaaacggtcaacgggactggtggcatcactgaaatgaaccggatctatccggtcagccggagccaactcggtagaatcgactttattgacaatattctgccagaaagtgttggcatcctgtgccccgggaaagacacaggataggccaattacagcaatatctgtttttttcatactttgtttatgcagagttttaccaattatttcctgacatgatcagcacctggctttcagttccgtatttgatctcatttaagaagatttctttcccttcatccaatggaatcatggaaattcctctgcgttcgtattctgattcaagggtggaagagaccattccggcgcctttccatggcccccagttgatggagattacttttccttttaatcttttgtttaaggcattggcataatcatccagtacactgttggcagcagcataatctgtctggcctttgttaccgtatacggaagcaatgcttgagaacaataccacgaactggcagtcttcacgaagctgttctgccagtacacgaagcggttttactttggtatcaaatacacgtccgaaagaacttgtggtcttttgtttgaacagtttatcttctaaaaggccagctccatggatgactccgtccagacggtcgtatttttcatagatattgctgattaatctgcttaaaccttcttcgtcacaaagatccagtgattggtaaatgatggtatttccaagttcttccatatcacggatggtgcggagaatctgattgtttttgaaaattttcgttgtttctttttcaatctctgccggagaagtgaattgtccggatctgatcagaaagcctctgatttcctctttggttttcattccttcaaaatctttcgcagaaatttcatttctcgggtctgcagatcttcctaccagaatgtaagtacacggataagcctgagacatatgttttaccaactcggcggtaattccctgtgctcctccaagtaccaaaaccacagatttctgatctagctgaatgtgggcttcacttaaacttgttgacaatggtgaagggatgatgtctactttgtgtctctggtcatttttataaatgatttcagcaggtttatcattggtaagaatttcctttaaggtaatctcagcaatctgatttacttcctgaggagtgctcaaactgatcagtctgcaggctgtattgtcaaattctcttgccaggctcttgaaaagtcccggataaccctgatgatgacgcaatacgcttacatcagtgatttcctgaagatgagccggaatatctgagatcagataaacccattttgctttatcaaaatccagttttttgatcagatctacatgatcgatgatgcttggtttatctgctgctgagaaaaggtccagcataattaatccctcaatatctgaaaggtctttttcagtatctgccaattctacgatagctccatgtttttccaaagcttctctgattgctgaagaatgcttgctgttatcctgagtgatggcaaaacgttttccctgcaatacttctgtattttgtaccagggaagcatcagtaggtgtaatatcaaaacggagacgtgaaagtacattttgggttggttccacggtatttgtttcttttgcttcctgagtagtttcgttcgattcaccattcatttcgctgatccagcttgccagaccgcgaagtgttttaatagcagccagtttttccatcacatcatccgcctgttcaaggttttgaccaaaaccgattttggttttaagatcaccgatgatttccatacgtttgatggagtcgatactcaaatctgcttccagatcaaggtcaagacctaacatttctttcggatatcctgttttttcacttacgatatttaaaatagcattttgaaggtcttccagagaaaatgccggttgagcttgtggttttgaagctgttgattcagctgcagatctgtttttttcaggagcagcagttgtttcagcccctgagaattcagtaagccatgaaacaagaccgcttaacgtttttatgcctgctaactgctccataacggagtcttcactggtgtttccgttacccagagttcccagttcgttacgaagtgttccgatgatttctactcttttaatagaatctatacttaaatccgcttcaagatccatttccatacccagcatttcctgaggatatcctgttttgtcacttaccacctgcagcagtaaggatttgatatcttttgaaggagcctgtttcacagcaacagctacttcctgttgaatatgctgaaccggaatagcagagactggctgttgagccggagcctgcaccggtgaatgatatacaggagctgggaatgcctgcggattctgtcccataaaggaaagcatcacgtcacgctgtgcctgtatcattaatttcatactgtttaaatattcctgcagcatacgttcggcggtagattgtgcttcagctgccggtgcctgttgatttgtagtaaaattgttcatgggaatagggtttatgagtggtaatgcaccattggaaggcaaattaccatgagttgggtaggcggtttgcccgtttacacgccagatggcagggcttttcttgtaaagcccgggttggttaagatcaataacctttacattgcgtccatcgaaaagtttactgatattgaagcttcggcctgttcctaaatattgcgccagcatgcaaagaagatgactgaatttattatggctgttgtcttcaacatatagggtaagctgatctttttccaggcaggatttggtcagtccggtaagaacttttcccggacctacttcgatgaatattctcgctccatcgttatacattgcctgcagctgttctacaaatcttacaggctgtaccagatgatcggtaagtctttcttttatttcagatggatttgaaggatatacttctgcagtcgtattggaccataccggaatctgcatttcgccgaaaggaacatctttaagtacttcagcatataaatccttggattttgctaataacggactgtggaatgcacaggcaacttcaagttttttagcggaaataccttcctgtttaagaacttccagcaatttattgatcgcatctgtattgccagcaatgacacattgtgtaggggcattaaagttgacaggataacatccttctactttagcaatgatcggttgtaaacgttctgctgtagcacttgccgccagcattgaacctggatctccgccttctacagaatctaagatagactgcgctctcttaacacttaagtccaccagtttatcttctccgaaaactcctgcaaagcataatgccggaatttcaccgtagctgtgacctgccagcatatccgggataatacctaatgattccaggaatttagccaatgcaagatcaacaattcctaaaagcggttgtgctaagcgggtatctttaatggtttctttttgtctttttacatcggcttcattgaatgttttggacgggaaaaccactttttcaagttcaggatattcatcaataatcttacgcatagccgggaagactacgaatagatcacgggccatattgattctctggctgccctgtccaggaaatgtgaaagctactttaccttcttttttatttacagtaaaagtgtctttggtttcaatgcccagcagtaccagttccagcttcatcatcagatcttccacagtgtctgccacgatgctgaactggataggtttttctgaactgatgcttaagctgtaggcaatatcctgtaacggaataccatcattaatttccaataaagcttttacctggccggattgtccttttgcttcttcataggtatctccacggaaaacaaacaattctgaaggccatgactgcattacgattgaatcatcttgtttaggatggttggcaatgaccgtgtggaagtttgttcctccaaatccgaaagcactgattcctgcataacggtttttctctgaccataacccgctttctgcatggaatgcaaacggacttgtttcagcattataataagcgttagggtgctgaagatgtaaggtaggtggctttaccccgtgatatacagcaagggaagctttgattaatcctgctaatcctgcagcacacttggtatgtccgatctgtgtttttaccgaacctaaatgagtctgacccggtaaagcccctgaacggctgaacaagttcgttaatgcactcagttctgttttgtcacctactaccgttcccgtaccgtgtgcttctacaaggcctacggaagccggacttatccctgcctgggaataggcgcgttccaaagctcttacctggcctatttttcttggagcagtaagcccaagtgctttaccatcactggatccgccaacacctttgatcacggaatagatacggtcaccgtcacgtacagcatctacatatctttttaaaacaaggatagcaataccttccccaagggcaataccgtctgcgtcaccgtcaaatgtagcacatcttccttttcgggataaagcatgtgtactggagaacatcagataatcattgattccgttatgtaaatctgctcctcctgcaagaaccatatcagattttcccaatacaagttcctggcaagccagatcaatagctgctaatgacgaagcacaggctgcatctacggtaaagtttctgccgccgagatccagccggtttgtaattctaccggcaattacattggcaagaatacccgggaatgagtcttctgtagtatgcgggaaggcttcttttacttcttcgtgaagttctccgaaaacctgtttataatatcctctgaaactatagctgttggcaaggtcattaccgccttcagcacctatgataacagaaatattttctctgttgatttgtttttcaccatatcctgcgtcttccattgcacgttttgcaaccaataacgtcagcagttgtgttggttcgatggcagccagagattgtggcggaattccgaatgccagcggatcaaaatcaattttaggaataaagcctccccatttggagtgggatacatccggaccatcagaatccgggtggtaatacagttctttattccatctttcatccggcacttcggtaacactgtcttttcctaaaataatatttctccagtattcatccagatttttagcacccgggaagatacattccattcctacgatggcgatgtccaaaggtttctctgtagaaacaggttcttcaggcaatgctgcattctgaacatatttatgattgtctacgatactttggtgaaggtctgccaacgagattacacggttgtgcatcgtagctacctggccaatcatgtacattcctaagtctagttggtcatctttaggaatgctgacaagttgatcgccctggcgttctatacctttagctgcaatacgtaagcggcctacatttaatttttcaagctgttcccatacctcttttttatccattccggctgccagaagtttcgctttttcctggttgaaataatgggcaaatgctgtatttaagcaacgggtttcatgtccgggagctgtttccagtaagactgtatctttcgcctgcatggcctgcaactggaattcttcctggatggctccggtttgtacagcttcatgagtatacagataggctgttcccatcaataccccgatttttactcctcttgccgctaatggcgcggtcatgatggatacaaacgctgttgaaaatgcgttatgaattcctccggcaaaaaagacactgatgtcttccggatgatcctcttttaaaatacgttcaatctgtttttcccaaagaaccgtactggccagtggtcctacgtggcctccgcactcgcgtccttcaaaaatgaaatttttagcaccttctttcaggaaaatatccagaagggcaggagagggaacatgtaaaaatgattttatacctgctttttcaaatattttggcctgggcaggtcttccgcctgcaattaaaaccacaggaggttttgcttctaatatataggaagtctgttcatctctcaattcctgtggggcaaatcctaagattcctacaccccatgttttttcaccagccagttttttggtgtccatgaccagagattttgctgattctccttttagtaaggataaggccacgaaaggtaaggctccggcatcggcaaccgcattagcgaataaaggaacatcacttacacgggtcataggaccttgagcaataggatattgcaaaccaagatcccgggctaaagcgttttctttatcaacgaccttaagcgcctttgcctgcttcaggtgtccgtacatggcttctttaaatccgaaaaccagttttttcagtgttttaaagtcttcatacaggtctgtggccagtgaaatgtcttgtcccatagggatataacatgtattaaggtcgagaccgtaaaagaattttttcagctcttcagcagtagtattttcaggtaaagcgggtgagtggggtcttaccagtacgcgatggttagcaatcaccttagtttctgtaccattcagttttgagcaaacttctttcagatcttttggaactgaactttcaggaaacagggccagctggctgtccagtacaactcctgttgctcccaatgcttttgatgccgctgcggtatggggacctattcctccctgtacccacaccggaatattccggatttcattgatcacacgctggaacaatacaaacgtggattcatatcctaccagtccgcctgcttcatttcctttaataatgattccttctgctcccgattgttcggcctgtatggcttcttccaaactggttacctgataaataagaggcaggttggaaggtgcagacattccgaacggaagaatggcaaatcttactttttcagaaatctgaagggcggaggaaatgtcgttagaaaaataaataccatatgatggtacgtctatctgatcaagttgatgtaacgcttcctgggcagttgtaagctcatctcctaaactcagaacgggaaatgcacccgcctgatgcagtttaagcataaggttaacgtccggtttttcgaaaggcgttagtccaataatggttaattttttcatggcgtgataattattgaatgatagcaagagtttataataaaagtgtcaagccttttggtgataagacctgagctttttattatgatataataaaattgggttttgtcaaatagttaacaatatgtattgtttggtgttgattatttaataatcttccaattgtggacgggttgtaaagtgtgttgttggcgtccggcttttcaacgggcattagcctgattttggtcaagtttttcatagcatcacggtatagaaatagttaatgatatctcatatcgaaaaacggataccatttgtgtttatggtgtttttctattatgagtgaataaaaataataaaactatatatattttttaaacataaatgaaatttgataatgatttcttaataggaaaatatcaattgttcatgtgttattaaaatataattattgtttatttattcttagaaacatgccggtacaatcttctttactttaactataaatatttatagttaaagaaatgttaagcaaatataggaataaaaaataaaatatttcaaaaacaagagatttgtttttggttatattacaaaaagataatatagggtaaatccggtttcggaatgtaaaaattgcctttatcaatctgataaaacggcaaagcgaatttaaataaaattaatcaatatattgtgatttaatttaaattatttatgaatttttcatatctttttgataaataaacagataggtaattttaagaataattaatatatgcttccgaaattcataaaaaaaagtaaatagatagaatcggtatttttatttttaaggttaaagagattgtttattagtgtgttatatatctacggataatatttctgcgatttaaaaaaaaatagttttcattataatttatgatcacggagtattttataaaacttttgtatttttgcactcttaagaactcaatcataatttgatttgatgaattatgatttacatatgcctgtgtttataatagtaagctcgtgttctcttgtttttgcaattatgacaatttaacgagtttctattcctgtccattactcaattcgtattgacttccttttctgaatcggccaatttccggtcgatcttgaataactgcagtcagatttcagagatctgtctttttgggtgcatcatacagaaattgtttttggattaaaaaaatacaacaaaagaaaacaggtatatatgaaacagacaacaattttcagatcagatgctcacaaagaaagagtgctggagcaatatgacactgcgttagcaaattttaaaggaaatatccgccagcaagtggtcccaacaaactttggagaaacccacgttctgagctatggaaatgaagatcatcctaagcttgtattacttcatggagctaattctaacgctgcatcctggatgaaggatcttgctttgtacagcaaagaatataaagtgtacgctattgatattatcggggaaccaggtaaaagtgagcaaaacagacttccttatcaaggtaatgattacagtgattggctgaatgaggttttccaacaactgaaaataacaaaagcttctttggtgggattgtctcaaggcggatggcttgcgataaagtttgcagccagatatccggaaaaaatcagtcagcttgtccttctttctccggcaggagttgtaaaaacaaaacgcagctttgttttaaaagcgatattcttttctctacttgggaatgccgggaagagaaaaatcaataaactgataaccggttcacagaaaatagaccagcctgttcttgactttatggatctcatgcagtcttctgtggaggcaaggatggataaggaatatattttttctgatgaagaattgagaaatattgccatgcctgtcttttttataggtggagcaggtgatgtgatcagggattctacagaaataaaagaaagacttgaaaggttgcttcctgattttgaatcctatattgatcctgacaaagggcatgtgctgattggtttagcagataaaataaatgcgtttttactaaagagaagaaatgattaatccttcatgcaagagctccaaaacattttgttttggagctcttatcttattttatgtacttgaatctttaaaatacgcttaatccgtactgttttgccagatctaaaatcatatggtaacccgccagcgaatttccatgctgatctaaggcaggactgaagactccgattcctatttttccgggaacactcacggtaattccgcctcctacaccggatttacttggcaggcctacagttctggaatattcgccgctgaattcatacatgccagccgtcagcatctgtgattccaccaattttgccatgtcggcatttttataggtggagtctccatcaaatcttacacattggttggcaaagaagtacccgattttcgcaaggtcttctgcagtaagttcaatagaacactgcttgaaatagttatccagctgatcttcgttcccggtaatcagtccgctgtttttcataatataaaacatcccgcggttacggtgtcctgttgatttttcggattcgtaaacagatttgttgtagtctattgaagggtttttggtgatatatcttaccatatcaagtattttcaggaatggtttttcgccttctcctgaaatgagggaagtggtgagaattgctcccgcattcatcataggattaagcggtttgcctgtagtttccaggtttgaaaaatgattgaaaggtttgtcagaaccaaaataccccattttatcaaagatattggtttctcctttttcattgacagctaccattaatgatatgattttggaaatgctttgcatggtaaatttcttatggacgtcaccggtattgaatacttttccatttttgtctaccactgaaaaggctattgctttagcatccatttttcccagttcaggaatataatctgccacttttccctgggtgtaataagctctgtttttctccagaatgttgtttaaggttttttctgaaatggttgagatatctgctgttttctgtgcataaacaattgtgcttaaggaaataaaagctgccgtacagattcctttcgcagaaaataaaaagcggttgtttttcatataggaagatcttcaaataaatggtttatgataagccttaaaaaacaaagataaagtattttaatcttgtcagcaattctcatttgccgtacttacctctaaccggattgaataaggaatcatcacagaaaattcaggtatttctgaagtcattgagaatgtatagtgagggtatggaaagaattaaaaggagatatttttttttatggattttattgtgattagttttaatataaatttaatttttatagtataaaataaacaagtatgaatttttattgttgattttattgtttttagttattggaaattagaattttatttggttttaatgaggggatttaataaaaaatgcatttttttctgcataactaatatcactgtgaaatagcatatagacaggaattattctatatgattgagattcagatgtaaaatattgttattttttcacgattaaatgatttttgtattaaattttttattaatttgataaaaaattaataacactttttttaataactatgaaaaacaacacctattttggtaggcagcacatcttcagatggctcctgctatgttggcttttggtaccctgggtactgcaagcgcaagctcgaattacatggaccgctcaggtcggatgccaggagttccgtggcgaaaaagaaggcccgatccctgataacggtattgcttattcctacatcaattcatcgcaatgtctccgtgtctgtgaggtatccaatgtggtatatgaggttcagggaccaaatgtttccgccgttcaatggacggttgcaggaggaacagtcaccacttcaggacctggtaacactataggcaatgtagcctggggaacggcaggtaacggatctttgcaggctgtcattacgtacagtgacggaactgtagaaactcagacaatctgtattgaaaaaatcaacaggccgattgccaagtttgaaatgttaaatctggatgaagtggtatgcagaaatacaacgatctattttgataacctttctgaccagaacggagggtcggatattgtcaattatttctgggactttggcgatggtacaacttccacagcttttgaaccctcccacttatatgctaaccccggaaattataccattcagcttaccgtaaccaataaatgcggttgccagagtaaatataaaaagcagatcaaggtattgaaagctgatcctgtacagatcaactgtgcttcagtggtttgtgaaggcagtaaagaaacctacagtgctcaggatggatgtagcaaaggacaatggaaagtaatcggaggcacaattgtgggcactaacggtaacgagattgaagtagtctgggatcaggtagacccgcttgaaggattcggatatgtaatgtatatgtcagagtgtgcctgccctgaatggactaccatcaaaattcctgtcgttttaaagaatgcaaaaattaaaggacaggcggtaatatgttccggcaggcagtatacctattcaattcctcagtggcctacaaccaaggttctatggaatgtaacggggcctgcgggaggtcagctgaccaatacccagcaaagaaatgaaattgttttctctgccaatcagccgggtacatatcatcttaccgctaattatttcaatacattgttgtcctgcgaaggacaggcttctattgatattgttgtagaagcaccggtactggtaagcggtggtgtagatgaaatctgtgcaggaacaagccagggattcacggcttcacctaacgtacctgttatctggaaagtaacaaccggtagctctacgtatacttctccggcaatgacaggaatattcaactacaactttgcaacagcaggaacttatacggttacagctaccaaacagggtggaggttgtgaaagcaatgcaagaattatcaaggttctgcctattccccagccacctttaggaacaatatccggagaaacaaaagtatgtccgggaagaccttatgtttataccataagttctgttgactcaggaatggtaccggtttggagtgtaaccaacggaactattcagggaagtaatgccggatcttctgtaacggttatatttaatgcaggagccacgtcatatacggtgtctgctcagaacaaatctatcagtaatgcaggatgtctttcggctccgaaatcatttaatgtgacgaaactggatctcagcacgattgtaattaatcctaactcagggcctttctgtccgagcagcactcagactttcagtgctaatctgaacggaattgttccggattctatggaatggtcatttgcgagttctaacttcggaagtgttgttggcggacagggtacagctaatattactgtaaacttcaacgaaatttcctcaacgagtacgaccgatctgattctgaaagttgtaaaatgcggagtaacgcagacgattactatgccggtatcattaataacacttccggtagtaagttttacaaatgttggcggaatctgtttaggctcaaatcttactttcaccgtaaaccagggaaccattacttcagcaacgaatgtgattttcacttttgctaacggaaatacgtatactacagccttcaacccggccggagtttatagcttcccgaataccggatatatccagaacaattcaggaaacaatgtttcccaaacggttaccgtaacgtatgaaggaaccaacggctgtaactataggcctacagcaagtgctaattttattatctatcctgaaaccattattacaatttctccggtatataatattgcagtttgtgatcctacaacgatggcaccgtatacgcttacggctaacagttctacagggcttacaaatattgtttcctggcaatggtataaagacaatacaattatatcaggtgctacgactaattcatatgttatctttggtgctggtgcttttggaacctacaaggtacgggcagtagatatcaatggttgtgtggtttattcccaaaatgttaatgtaacacagtcttgcccgagcagcggaagctgtacaacggatccacagattaattttgttccggcatggtcagcctgtaataatattaccgtttcaggtttaacttacaatggaatcccggatcagatccaatggttatctgacagtgtacttactttagtttccggtcagggaacagcttctccggtctatcagactaatcttgcaggagcgcatattgtttttgtacgtttaagatacggatcatgctggtacagcaaaggagtagaagtgagaaagcattacgagccgaaattcaatatcagtacagtttgtaacggaagcggatatacggtaacgcttttcaatacctctactatttttgatattaatccggcgtctgttacctataccttcacttcatccggacagcctactcagacaggacaatctgctacatataatctgatgccaggtacctatacctttacaatgacggtatcttcaccgggaaaaccaacgtgtacaactacacagactattacattggctcctgtgcctgatacgacattcctggttcctgcatggttatgtgcgcgctcaccaattacgttcagtccgataacatatgttccaggaaatacctacacatggatttttgatggtacatcctatattacgacaggtccggatgccacaataacttacaatacggcaggaacaaaaacaattcagctgaaaataagaacccctatgggatgtgaatatacttctgctgtaattagtgttaatgtgaaagaggcatcccttgacggtactataacacctccttctcttgtagcctgtatgggaagtgctcctaatatcgtatttaccagtacagttggaactccaagccagtatatctggatgaatggctctcaacctgtaccgggagcgccaaactctccggtgttcacacctgtacagtccggaagctactggccggtgctggtatcatcagacggatgcagaagcaatgttatgagtgctgcagcagtaccggtaacacttaaaaatccaccatatgtcaatatatcaggaacagccaatatctgtgacggatcttcaacagtacttacaggtattgtaacagacaataccctggaatatcaatggaaaaaaggaaactcgatagtaacaccatgggcttcggctccttatcctattgctttaagtacaggaccgttgtcagcaggaacctatgtttatacgctggaagtaagaactccgggtacatcaggatgtacaagcagtaaaagctttactgttactgtaagcagcccgccggcacctatttcggtaagctataatctggttaactgtcagccttatgagattatgctgactgcctcagggccatctgccggagtttataactggagtaacggaatgacaggtcagtcgattaccgtaaatgaaggtggtgcttatcaggtgatctacactgcgccgagcggctgtaaagtggtgggtaatacacaagtgccgctaagccttgaaagtctgatgtgggtattccctacaggatgctataatgaatgtcttagagaggggcgctatatcttaggaccaaaaggcgtttttgatcatcatgaatggcagttgttcggaaacaatatccggagcggaaacaatgattatatctacccgctgtatatcaattatgcaggtacctatcagcttcagattgatcatttaggatgtcagtttacgtcaggaaccatgaactactatccaggtaaagaatgcggattcgaaacagattgtaaactggaagcggatatcaaaggtatgaagtggtttggagatcattataaagtgtatggggtcatctacaataccggaagccagccgataagccttacggtttcaagtcttaatggatttggagtgtatattccatctattattacgattccggcaggaggaatgtatgacatgaatgctaatccattagcattctatccgaactctggtttccagggagctgatgagatcttattctcaaatgatacctgtaagtttactaccaaagcggtagatccggactggatgggtatgagaagtgcaggaagaaatgtagttgcggcttcagtttcttctctgaaaatgatcccgaatcctgcgaaggaaaaagtgaaaatctcgtataatacgggcgatgaaaaattactcgcaaaacaggttacagtttttgatgctatgggcaatatcaaattccgtaaggaactgaaagcggcttccggagaggtagacgtggaagttaccagctggctgcaaggtgtttatatcgttattgtacaaacgggagatacatcattacaaggaaaactaattaaaaattagtagcttataaagcagtgttctcttcggagagcactgttttttatagtatttgataattaaatgaatttttatgatacaattaaaaaacaaattgtggggattacttctgattttgccatcattatcttttagccagacttaccaatggcaatggggaaagcaggcaggaggggtgacaggctctgcagatccgggatttcattatatctttgatgaatccataagggatattgtagtagacaacaacaataatacctattatcttgcaacaatgcgtgaacaggggcaaaacctgaatggaacaccggtaaccaattatggcctcagcgatctttttctgttctccacagactgtacgggaaatataagatggtccagacctataggaggtacgggaaacggagaaaatgcatggcatattaaattggataacaacggaggtttgtacatggcagctacgatttataacaattcatatgcaggagatcccaatgctactccggtacattttgatgatactcatacactgcctctgtatacctattatgatcagacgatagatcctgcccacaaagcagcttttcttttaaaatataatacttcagacggaacattggcatggagtaagcctttacagggagatgtcagttttttctcccgcatgtgcgatgttcagacgatgtatatggattcatccaaaaatatccatgctgtaatgggtttcagagcgggaacgcatttaaacgggttaattacagtaccttctacctttacatccacctaccagtattatgcagttaagttcaattatgacggtggcaacatgacacctgctgctcctgtgcttctccccattaccggagatgccatcaatgctgtgggaagagaagggaaggttaatctcgtgtatgatgaaactctgaaccgttattatcttgccggtaaaagaatggatcccggattcagtaatctggttgatctttcgtataataatgttccgtttacgaaagcggcttatgtgcttgcttttgacggtactaccggagcagaagtatggagaagggaaattaataatggtacaacgagtacggatgatgaaattcattccattataaaagatccggttacatcagatatttatatttcaggacgttattttaacggaataacagtacctgccactttcggaacttatacttttccactgagaagctatgtggaagcggttccttttgttatgaagatcaatgcttcgggtaccgtgcagtgggcaagaactccggatgggatgtccggcctccagttcggttatcgttttactaaaggaacccttgcccttaatggaaatgaaatagcatttgccaaaggaagctggtctgatatatggggcagctatgcaatggtacgtcccgatggagaccgctcagatccattattggtaaggcttaacaaagataccggggatgtcttgggaacgggagagatccgcagtaacttttatgttatcgatgagtttacagcagtagctgcagatcaggatggaaactatgtagcaggtggtttttttcatgatcaattatttacagattccaatgataatgtcaatacaatgactgttaatgtagcaggcgggaaatctcagtctttttttacaaaatttgccaaatcagtgtgcagccagatgtcagtagaagaaactgcggctcaggcaggaatacagttataccctaatcctgttcaggacgtattgacgatcagaagcaaagaaccattggtttcttatgagatctttggtgctgcaggacagctggtgaaacagggagctttgaatatggcgcaggaacagatagtattatcttctcttcagacaggagtatattacataaaacttaaaaccaaatcttctacagtaacggagaaaatactgaagaagtaaaaaaacaaaactgaaaattaataaccttatatattgaacagtgtcttctaaaggacactgtttttttatggatatttttttgattaaaaaaagattgggatgttcgcaattttacaattttttgccttcgggaatgttttgttttgtataaaatttttaaaatgaaaaaattacttaccctgagcggattattactatttactttctggtgtaatgctcaagacaccgatcttatgaaaaccgtaagaaagaccatagaagccagtaacgaaatctatgctgatctggcgaatagaaacgacggatctatccttacgcgctataccagcgatgcatgtctgcttccacccaatgctgtcccgctatgcggaaaagatgcaatacttggtttctttaagaacgggcctaaggttcatgttaagtttacaattcaaaatctttacggagatggcaaaacctcggttaccgaagaaagctattatgaaatgaccgatttggacggtaaaaagctggatgacggaaaagtgattgtgatctggaaaaatacaaaagacggctggaagatgcatcgtgatatgttcagcagcaatcatcctgcaaaataaatcaaaagccgatattaacagcctgctgaagatctgtatcatttttaatcaatgagtgtctggatgcagaaggagtaatacctgtaaattttttaaactctttggtaaaatgagcctgatcgtaatatccgcaatcataagcgatggctgtaagcgattcctgggtgttaagaaccatgtgcagacttctgttaaatctgatcacagccgcaaaagaggaaggactaatcccgatatgagcaaggcaaagcttctgaatatatctttctgacagccctgaactttttgctatagcaggtaaatccaacggttgattacccatgaaaaactgctggctgagtgcctgaactactacagttttctttatccgggattcattttttttcagttgatgaagaaaatacatttccagaacatggatttttgaatagaggtcaccggcctgcatcatacggtcatacaaatctctgctgtcattttttgttatatcgtacatatcagtggcatagttcgtgaattctaccaaaggatcagaaaaaaataattgtccggcatgcggatagatccgtgctataagaactgaagttccctttgctgcactgaggcgggtgggaagggtgagatgtcccagaaattctatatccggagtgtctttttgcctaccatcgatcttggtagcggcaaaaccaccggaaatattgatgatcaggtctgtatatccgctgggataaaacacttcatccctgagatcttcatcaatggtaacaacggtataattctttatgtaaggtgccaggctggatgatggtaaaatttgcatagctgctgtgggtgttaattcattgatgcatagtttattcgaagttaggaataaaaatcatatgaattaaaaatcttggaattaaaataaaaaatccaatatcaaaagatattgggttttttatggtgaaggttttgaaaaacctattccgtatttttgcagagaattaaactgctaaaggttttatttaaaaatatgagcgatacattttccggcaatcctcaaatagaggtggtttcttccttttccgaacttgtgaatacgcgttttcagggagtcagaaatgcaatttgctggcagagaaacctggtcgggaattttaaagaaattgtttctaaacttcagttaaaagagaatattaccgaaatttcttccgatgatcttctgtcactggatctttcagaagaagggaataaggcaagagaaatgattttaaatgacttacgcttattgacagattttggagcttctccggttcttaatttgcttaaaaattatgaaagggatgaggaactcggctttatttcaacagatgtctactcttaccatgtcgatcgttcacctgtcggaaccgatacttttctgtgtacttattacggagctgcaagtgatattatccctaatgatcaggtggtacagaaaattgtaatttctgaaatccgggaacagctcagaaaattacatgatggtccggaagaagaatttgaagacttcctgaaagactatttttttgaccttcattatcagcctgagcccaatgcagaacctgtcaatctgggaaaaggacatctttggagaattgccgtagatcatccggaccagcaggcactgccatgcgttcatagggcgcccgtggaaaatgacggagaatatcggttgctgctgatctgctaatgttgatttgttaagtcagttttgaattagaatttcaagttttgcaaaaaaatccagcatcgaaaaatgccggactttttttataatttataaattgattgtctttaccatttaatttttattttaggaacaacttttctgatctcctttgccacattatttcctgcttttcccagctcattgcttatatttctgaccagttttaccgcttcgtgatttttcccgggaccgtattgtaaatcgtgaactgtggaattccatgttctgacaatatcgtttgtgggtccaaactgatcttttaacgcttctccgatttggttcagccctttaacaattgtattgttttttccaaaacatccatgatcgccgccgactccgctggtcaggcatttacttaattcccggtaggtcaattgtccgccggcgcaaccagcaaatgcataaggctggcctcctgtgcttacagcgcactctactgctatctgtgcttctgtattcagattaagcttgcctgcaccatagcacacagcagttcccataaaagaaacttctccgctattggcctgatctttaaaacaggataccaattgttttaattcagggtcatttactttatcagtaaaacatagcggatacatttcataatgatcaccgtattctttatagcacttcatcatatcctgagtaatctgcttctctttggaaccacctaatatacttagcatacaaaggctttgttcctccggagtgggcgaatttttggcgcatttgtagatttcaagttctttcctgccagccatattcgtcaccatacagtcaccgaattccagctgatttaatgtgccgtcaaagttcagggagttcttgtagcagtctacggcagcttgttcgctcgtcatcataacatctccaaaaggcttttgctcatcaacaatctgtgtggggatcggtcttacgccgtcagcagtttcaatccctgtctgattatcataaattggtttcggcaggtgcataacaggtgggggaggaacaggaatattggaataacccacgacccgatatccatatctgtaatccagttcaattatattcttattaaaatccagaaaaaatgctttttgataaggaacggctgacggcagacataaatagttaattcccgtctggtcatatactgcctgacctgcatttcccggattgccatcctgaacaatcatccctgtgttatacatggtaaaggactgaccatacgttgtcaaaaaaaactggccgataggatatacctgcgcaaacaggaaggaacagaaactcataagtgaaaccagtccgcttataatcaataattttttgatgatagtattcatggtactttcttttttgataaagttaccgctgaagaccaatagctggaaattacccgttttcgctattttttaaataatgatgctgtgtggaaattttgcgaatttatattcttgacattgctttgaattctgtgggcctcatattggtcagctggtggaaattattactgaaagctgcaatattggaatatccgacttcataggtgatttcagtcatattcaggtctgtgtctttgatcagttccatagcccggatgattctcagcatttttatatactgaataaaagtgatgtgaagtttggtctgaaataatcttgtcaggcttctcacactcatccctgattcttttgcccgtattctctaaagtaagcttttcatgtaactgatttctaagacggactgtaacaacattaagccgctgatcatccgttgtgggaagctgaatagaaaactttttaagattttccctcgataagagctccttcaatgtggtcagaaattgaaattcccaggaacctttataataatttccctgccatttttcgctgaaggcaagcatttcagataacagcttactcaccggatagatgcccagttcattataaaaaccgtcagaactttcttcaggaaaataaatgttgatcatatacagatcctgagtattaaacatcaggttatggggatattttagtgataagattaaaaacccgtcagccaatctggaaattttgacagtgatccggaaaaaatatcatactgttttaactggtattttttttgttataccctgaaagccagctttatcagtgagtgtactttactgggcagtgccgttttacagacggtttttcagcttaattgtaagattggtaatacgtaaatataaacagttacagagatatgctttggacagtatgtgttttgtgtatgacaattttaggactgatgtttttactgaaaagacttcatcagccttatcttattgcttatatcatagcagggatactattgggaccttacggagtaaagctctttgaccagcctgaagaaatagaggccgttggtgaggcagggattttattactgatgttttttatcgggatggaaatcaatgttcccaataaaaagagccttattattaagccggtattggctcagggtatcaaaatattgctgagctttatgttcgcttttttacttggatggatccttacacttgattttaagagtattttgctcatcgcaattctctttacctttaacagtacagcagtggttgtggaatttttgaagaaacacgggacactgcatacagcttttggtattgttattctcaatatcctgttgctgcaggatcttctcctggccccggtgctgaccttgcttaagttttggaatggtgaaaagttcaatatgctgaactttgtcattcccctggctatctgtatcggaatttttttaatattcagaaaaataaggcatctgagggaaatcagattttcaagtacgtttcttgaaaatgaccatgatctgcaggtgttttccggtctttttatctgccttgggtttgggcttgttgcagaggttgtaggtttgagtgctgcattgggaagttttattgccggagttgtagtaggaaagatcagggcatttcactggcttgaacattccctgttgcccttcaaggttttcttcgtggcacttttctttgtatccattggtttgaggctggatctcaattatctgttttccaattatacgctcattaccataggtactttagttgtactgatcagcaacagtgtcatgtcatctatatttttcagaatattgaacttcagatggaaagacagtttttatggaggtgcattgctgtcccaaacgggagaatttggaatccttgccctttccattgcttataaaacaggaatggtgggatatgatatttataaggccggactgggaattacctgtttatcacttctgttgtctactatttggatcagttgttctgttaagttccgtagaaataaggctgtctgaaagtaaaggaatgaaatacatgtgagattgtacagatagctctatgccaaaaaactgaaattttgacaggaatgcggaaaaaatatcacactttgccaactggtattttttttgataaatttttcatatacagctggccggctgacgtgtaattaaatgattgttaaacttatttaaaaagaaattgctatgaataatctagtaagaagaaacggaaacagcaacctggctttttcaaacatctttgatgatttttttggtcgtgaactttttaactggggaaataacaattactcttctaccagtacaacagtaccatcagtaaatataaaggaaaacggagaagcatatgaagttcaggttgctgctccgggaatggataagaatgattttcagatcaaactggatggtaacctgctgacgatttcatccatgaaacaggacagcagcgaaacaaaagaagagaattttacaagaagagaattcagttatcagtccttccagagaagttttgaacttccaaaggatgttgtagaccaggataacattaatgcaaaatatgaaaacgggttgcttatgctgaccattcctaaaaaagaggatgcaaagcagaaaccacctagaatgatcgaaatatcgtaaactgaaaatggctgctaaaaggcagtcattttttatttttatacttttttaaatatgtcggtggtatcttgtttaacttgttggttttgattgttttaaatagttgtgctggtccgaaatttgcatttaaagataatacctttttactaagatattgttttgaaatcataacaaataactgagtaatatgatcatcgatgaaaatcttttacttgaaaatggagcagtttatgaggattatcaggcaaaggaaattatttatgagctgggagatattccccattattatttccagattgttaagggaacagttgaattgaataattaccatgaagatgggaaagaattcacactgaatatcatttcagaggggcagagctttggagagtctttactttttgggaacaagaaatacccgatgaatgccattgcaaaaaccgattgcaaaatccttaaactgccaaagtccaattttttgagtatgctgagtgaaaatatggaactgatttttaccatgttccgctacctttcggaccggcttttctataaatatgtaatgctgtttaataattcagccatagacccggtgctgaagataaaatctttaatggattattacaaggaaagcgcactaaaccaaaacccttattcttaccaggtcccgctgaccagacaacaaattgccaatttaacggggttacgtgtcgaaacggtcatacgtaccattaaaaagatggcagaggatgggcttcttaaactggatggacgacagattttttactgaaatcagatgtcagggtgctatgcgaaaataatcacagaacaatcggtttaaaaacagaatgtaacagttcgtaaataacaattgtcttcattataagatgaaagtcctgcagttactcattgtgctgtattattatttctttaaaaaataacctcatgaaagcgtacacagttattctgattctattgaattttttactgataccaccaatacaggcccagcaaacattgtggggccgccagcaggaaaaggagagtatatacagcattcaggatagcgtaatgatccgcacaagggacggagcagaaatttctgcaatggtagtacgcaaaaaaaatgatattattcctctgcctgtaatactgcagtttacaatttatgtgcgggatcaggggcgggatatacaatcgcttaaagaagctgcagacagaggatatataggtgttatggcttatacgagaggaaaacgtttcagtcaatctgagatttttccgtatgaaaccgacggaaaagatgcctatgatgtgatagactggatcagcaggcagccatggtgtaatggtaaaataggaatgtacggaggaagttacaacggctttacgcaatgggccgcagctaaaaaactgcatcccgcattgaaaacgattgttccttatgtagccaatcgcccgggaatgggacttcctatggaaaataatatctttatcaatcctaattatgaatggtccttttatgtaggcaataataaatatctggataataagacaggtgatgaccggaaaagattccggaatatgatgttcagatggtgggaaacaggagccgcttatcgtaaaatggatagcattgatggcacacccaatcgtctttttcagcgttggataagccatcccgcttttgattcctattggcagaatatggctccgtataagaaagaatttgcaggaattaatattcccgtactggcctttgacggatattataatgattctcagaattcaggaatatactatttgcgtgaactcaataaatacagtcctcaaacgccggcttatctgttgattggtccttatggtcatttcggaacacagatgggagggcaggaggtcatcaacggatatacagtgagtaaaaatgctttatttcccatcagcgaatacacctatcaatggtttgattatattctgaaaggagctgaaaagccttcttttctgaaagataaaataaactatcaggtaatgggaacagatgaatggcgaagcgcaccttcaatcgatgccatgcacaacagatatatgaaattgtatttcagctctgaaaaagcgaacgatgatgagtatttgttaagctttaataagcccgaacctcaaaaatatttagttcagaaagtagattttgcagaccgtataaccagtaataatgattattaccctgatcccattattcgggaaagtatatccggtaacggttatgttttcgtaagtgagcctttggatgctatgctggtaaacggatctttccttgggaacatcaaaatgagcattaataaaaaagatgcagatattggagtcactctctatgaacttactcctgaaggtaaatattttcatctttcttactatatcggcagggcaagttatgccagagataatactaaaagacaattactgacccctggtaaaaaagaaaccatcacctttgaaaatactcatctggtcagcaaacagctgcagaaaggtagccgtctggtcgttgtgctgaatatcaataaaaatccgttttcagaactcaattatggtagtggaaaaactgtagcttccgaaaccattgccgatgccaaagaaccattgattattcattggtataatgatagttttgttgagattcctgttttacaatagctgatttaatttcaatcccatttagacatcaacagttatcctgaaattgatatgtttgattagtactacctgaaggaaagtcatgaattcacttattcgaaaaataaatactcttgattgcttttaaattcatatgatcagcatcataatacaaatattattattatgctatatttgtaataataagatcaggagaaataagaaaataagaacaacaaaacctaaactaaattattatccgttctaagaaacttatttttcaataaatggcagaaaaggagcatgttattacctatagaagatgtaccaatgatcaaaaaatagcagttattggtatcattaaaaattattatcacagttctaaagctaataatattgtggtattgccagttaatgcaaactgcattatctaccaatgattatgtcgaatattcccccgcagcgttacgaagatttaaaggagatactgtgttcccaatgtgactatactataacgcctacacgagagtaactatattttctatacctcaaactttaccttattaataccaacctgactttttaaaagtcaggaaaaataaatttggcagctattcagaattgaatatttacgaaataatgttcagcaaccatgacttttatcctttgagaggaaaaactctgagttgcttaaaatttgcacttataattactgccgattttactgagatattcattcgtaagcataacaaaaaaaattaaatagtatgattatcaatgaagatcttttgctcaaaaatggagcagtttatgaagactatcccgcaaaggaaaatatttacgaaataggaggtattccgcattattattttcaggttgttacgggaacagtagaattgaataattaccatgaagatgggaaggagttcacgctgaatattatttcagagggacatagcttcggggaatctttacttttcggggataagaattatccgatgaatgccattgcaaaaaccgattgcagaattcttaaattaccaaaatccaattttttgaatatgctgagtgaaaatatagaactggtttttaccatgttccgttatctttcagaccggcttttctataaatatgtaatgctgtttagtaactccgccatagatcctgtgttgaagataaaatctttattggattattacaaagaaaatgcagcaatgcaatcgccttattcttacggagtcccgcttaccagacaacaaattgccaatttaacaggattacgtgtggaaacggttatacgtaccattaaaaaaatggcagaggagggtattcttaagcttgatggacgaaagatcttgtactgataatttagaaataatgatctttctatacagagatgtagacaccggtattcatattgtttaaaaacataattttgaatagtacaaatgtgctgttttaaaataataaccattaaacttaagccaaatgaatataccgttatttaccactgatcttccaattgcggtgcatcctgaactgaatgtccttacagaccatatgaaagacttttttaaaacagaagtcttcaatataatgaatgagaacacacagcgatatggagattatatagctgtcggtgctcaatacacagcgtatatttttccttttggaaatatagaaaaacttaaatccatctgcaggtattacagcgtgtgggctctgatggacgatcagttttttgacaattctgtcgatctggacaatattcttgcagtgattgaaggttttaaagcagcagtgaatgaacagccggagattgatacattattttacccgattgcccttttttgttcagacacaaactggactaaagaggcgaaaaacatcttcagacttgaaacggttaaatatctgaataatgtattggtgcagcgtaccatagaagtgcagaaaaaagaggcttctcttgaagaatatcttgaatgcagggcatatgatgttgcaatgccggtcatgttttctctattatggtatcttcatgatgatttgccggcatcttcttattacagcggtgtatttgaaaaagcttttaaaatttcaggttttacgataggacttcttcttgatttgtattcctataaggctaaaaagaaggaaattaaagaatatgcacatgctgtaaaaattatccagagacttgaaaactgtgatgaacagaccgcgattgataaggtggtttctttattctatcaatactcatctgaactggaaaaagagtttgatcagctggaagaccaatatcccaatgaagttcgttatttcaggtatatacaatccggctcaatccggtattgtaatgaaaacaggaaaatccgttatctaaaagagcatgaatcagatgaaaatatatctaaagaacgaacgataatgtgatctcttacctctaaacgtaagacaaatgaaaccccctttaaatattgcatttaaagggggttgtgttattgtgattgtaatctgcatgcaatttaaaatgctgcctgctttctgatacagaaagtgtactacttcctgtttatgcggatttacagaaaagtagtatcgcaattcgtaaacagtattggcgagttctcctatcgattctacgtaattttgttaaacgatttttttaagagaattatacaatgttttttctactggaaaatccttacttttgatttttaaagtgggaaacatctgtttttgaatgttttactttatgtttcttttaaagtacatgatattatagagaatggttcttttcgatgaaaaactgtcttttgataccgtgagattagctgtgctccgaatatgaataaaaaagtttggaaatcatatgccattatgaatggacgatacatgattctttctgtactacacagagttggtttcctgttctagaatctatggtacaagagctgtttttaagctattctcagggtgttttaccgagttttaagtctgagttatggtgtgatagtgatgagtgccttaaagtggcttagaatcaaaatgattggctttacctatctgtggtagaaccaatcatttcttatttaagatatttaagttgtaagttattgttttgtcaacacaatatctttaggaaaattcatcggaaagtcattattctgttctacatagacattgtgctggcaaacgtcattataaaagcttggtaaatattcaaaatgcaaagtcatttgggttggagtaaaatcagtaatgattaatgttgctgttttcctacacatatttttaggagagaatgtaagagttttttgtaagccattttttaggtttatccctattcctctaaactctggtgtttgatcatcaaagttagagattctgtctatctccacaaccccactagagttgattatttttcgttctcctaaaatttcatcacgataatatggatgagtatctccaggaatagaagaataagatttaatttttttcaattctaaaaaaagtgttttaccattccaagtacccttccataatccaacatatttatctagttcgttattaatatcttttagataggcattatcaggaatgtcgcttgggcttgtattaagagggtaaatttgtgctttacaggaaattgtaataattgttgaaaataatattaataataattgtttcataattttatatttttggacattgtcttgtttttctacttccgttttcaaggtaaatttctatattggttccatcgctatcaattttaaagagtttaaatccaaccatattcattttatctttcataaattttaaaaactctttctctaatttatccatatcatatataacctcttgacttacatttgttaccttcacagcactactaagataatcaatatattttgtgtttaactcttcaaactgttctgctgtataattaggaagagagacaacatctgtaccatcaaaagccattaaataattaccattactagtcactactgtatatgtaagttcatttaaaggaatttgagacgtacttgttggtgtattattcaaaccattcgcccaaactatccatttattaaattgcaaaatatctcctggagaaaatattggatataaaccatcataatgagtatgttgtattgcaaatgtattagggaaaaacctaacgtcgacttgttttgttccaggcatattttgtaagagttggttttctgttcctgtttgagatgttcccaatctataaccattttcatagctgaaacctgttttcttctgtaattcggttatgttagctttaaatttttcattattagtagatttttttattcttccacaaggtgtattttttgggagtgtgagagtcggggttgtaggagttccatcatttgttccgcttcctaagcctgtagtgggtcctaattcaccaccacctccagtaccgtcatctcctaaagctgtgctagctgtacagactaatgctactacggttaggtgttgggcaggataacctccctgactttgccagttgcaactgccccaagtactttcattagtctggttatggtctcctgtatagcaagagaaatacatatctactgtttgataagaacaagattctacagtccccatactattagaaactactcctccgtgttttgatttctgttagattgttttgtgctttttgtaattcagttttaagagctaatttgtgtttactttggtctaaacggattgttttggatgttggcctgaattggctgctgttgttgtaggtttattgttctgttgtgagttcattcctgcaggaatagaacaagaccataatggttactaatgtgagtaacctcgcaataaatttgtttttcattatttgtataatatttaaaaaggtttttagttttcttgtcgataaagatataaaaatcatttattggttaataattcaaatatatactttgaaagtgtcaaaacttgacgtgttatattttaaaaaaatatttattgacggacatatataagaatgagacaaataaaaccccttcaaacattatatttaaaggggtttttgtgttattgtgattgtaatctgcatgcattttaaaataccgcctactttccgatacagaaagtcaattgcctttataatgaggcgcttgtgtagtgtcgggggaaagcaagagcaattaactcctcaactctaaataatgtaaacaaaaatacaaattaaactttaacatcaatatagtattgaaaacaacggtgttgtatctcaaaatagtatttgatatattaattaatcctatttaaactaaaactggcaactgcctcttatttgatcatgagaaaattaagagaaacagctgtccagtattctttaaaaaacataatcaaaatttttgcttgtgataaaattacccatgatttacaataatattagtactaatttatttaattgcttatctaaattatttcaagatagagaggtgattcacaaatagaaggagataaagataaatgttcagaattaaacgaagtttataattaaactgtaaaagagtatatattttatttaatgtaaagcgttatccttttataagtaaatcggttaaggtgttctgaggctttttaaaaagtgttttaacttaagatcatataagcaatattttgattaaaatagattattaattatattatttttttttctatattggcaactcaaaacaataacttatgaaaatttttattaaactattaaagaattacgcaagtaatttaaggcttggtaattacttgcaacaccgaaacaagccccttcaatattactctaaccatcaaaaacttaaaaaaccatgaaaaaagcattaagcattttatcaattttatcattttttatttttattatttatgcatgtactaatcaggatgaaaatatagtaaatacaagtcccgaaacaaaggttgttaacgcaaataaaacaatggagacagaaaatatttcacctgaagaactgggacaaatacataacaatatacttaaacaatattacagtttatatggagaaaatgatacagaagatttgcttgagatgaacaaaagacttaacgaaatatctgtagatttatatccttcgaagtttactctgttaagtgatgatgaaatcgcaaccttcacagagttttcctatggcgcaaccaatgtgactggctgggactatagaacgcattctattaatgcactagatgatgcgctaggaaatggtacaattagccaggatttttacgatatgtttaagtcattagtagtggatggaggtacatacgaagaaactttgggtaaattacaagattataaaactgctctttctaaccaaccagcaagcactattaagactactgaaacaaactttatcaatggagctatttcggtatatactagcagtaaagaatattgggcaaatgacccagatctacaaagtagcaatacttcagggaaatattttggaggatgtgatccggaagatcaaattgcaattgccgacacatatggttcgataatggggggactttttggagtagcgacaagtggaggagtgtcttctgtagtatggggagctgttggttcttggggcttctcaaaagctatcagaatgcagatcaaaaaaaataatgggaaatgtgtttaaatgagataaaaaaaaaattagacaaattaaatttcacttattcttgtaaagatagcacattagagataaagcttggattcggtttaattgctgaagtaaaacaaaataatactagtatatcggtttcgggaattctgaccccttggaatccaatttcaggattatttagggtagatattgagaaatcgttggtctacaactctatttcgttgattatattctatattctattatttttaatgatattagatgatttcaaattgaatagctttttgttaatttttgcaagcttaatctgtgtccatcttatcttgtggtatattttatttttagtaaagtactattcttttcgatctcaaatacaacaatggatcataatggaccactaaaattatcaagtttatacataagagactgcttaaaagcagtctcttttcgtttattaaggagaatcaatactgaattcttcttttgatttacgtagtttttcctcattgacttttttcttaaatcccttttatgattcccatcagcttaatctatttatactgattctgtcggtcacttcaatgaatgtatcgtaatctttcatttactctcatattactctgtcttgtaattgcatacttttaagttagcaaggaatggacaaaagatgtattaaaacgttgataaagaaaatcaaattctcttttccactttcctgagaattttgtcggaattttaatttaaaattttcgtaaatttattaggataaaactataccatgaattaaatatggttgttaatcttcaagatcttacttaatgataattgattaaaataattttcttttttataacaagtcacaaagatagttttataccttccaacaaaattgtgggaacccgtagccattataacttcttaaacatgtatagtataaaagctaatgtgctacttacttcatatactgtaggagagttcgaagtcctctgtaaccatcacttttagcctagccatcattccgaacgtgtttcgtacaatgagatcatatatgttctggtcatcatttgtacaaatgaaagcagtaaaaagcttcatttctagatcttgttttgtacgggcgtgtctttatttatgaccgcgctttacgctgcaagtcctcgctttgctgtggccttttctcttcaatcactcacgcaggtctttctatgcattttcctggtgcaaccaccctggagccctatgccaaaaaacttattattcctatttagcaaaggaatatgggatgcaaatttaccctgcatccttatttacgctattgccattccattatatgcccatagaggacttgagcccggcagattgaatagaaagctttaatatcattcttccaaaaaaaggataaaaaggcagccaagttacatcagccatcctgtgtagtattcccccaagagaaaaatgaatgaacggttccccccgaagggtccccccattaaatcatttttctcttggtctacccggctgtccgatgagttggtctgctttctttttttcctttttcttttgaaagaatcatatcggggaggccccggaaaggactggaagaacataacaacagtaaaactctaaaaacagaacgttatgaacattacagcaaaaattacaaaaaatgccgtggtcagaaccaccactagcggtaaagagctcgttagctttggtattggcatccgccacacctacaaaaacaaacaaggcgaaaaaatctcaatggatacctatcttgactgtgcctattggagaacaacgaacatagccccataccttaaaaaggaaaaatcgtagagctgtcgggaagaatcagcgccagtgcatgggtagaccgtgaaggaaaccttaaggcaggcttaaattttcatgtttcggaaattatttttcatggacaggataacaaacaggacaaagctacaaaaggtcacgagcctgtaaaaatgctttcgagagctttggaaacagcacaggaaaataacgatgatctccctttttaacccttaaccctcaaaatttaacatcatggcaaggtacccaatacatatagcagatgccagtgtttatgttggcacatacacgaaatacaacgaaggctcacttttcggaaaatggcttaacctcaatgattttaccagtaggggggaattttacgaggcatgcgcccaggtacaccgggacgaagaagatgccgagtatatgtttcaggactacgaaaatatccccgaaaacctgatcgatgaatcatggatcagtgagaatgtttttgaagtgctccacgagctttcccttttgtcggaaaatgatctcgaagcattcctcttatggtgtgataacgaccacatcgatttatccaaggaaaatattattgacctgattactgattttcgggatcactatataggtacctacgactgcgaggaagattttgcttttgagcttgtcgaggagcgcgaagatctcagcgattttgcaaagcagtatttcgactacagagcctacgcaaacgaccttttttgcagtgactattggtatcgggacggacacgttttctacaactgatccataagcacgggcgactgtgggagcagtcgcccttaaaaaaataacatcatgacacagacagaactaaaagataaattcagggatttactaagcctaaaccctccattaaaagagatggaagaactttttttcaaggccgttaaaagcggtgccttagattataagaatgaagatccgcacacttatcgcactgcaaaggtcatttaccatgtaatacattctacaatggccgaatcatggaaaccgctatccgaaagtaatcgtcaagaagtcgaaaaccttaaagcattcttgtagtcatggcaatttcgtgtaacaatacggctgttcgagtgaaacaaaaatttattaaaaatgaaaatcacggatttaaacggtttggagattacagtgacaaacctggataaagccatcaggcaggcggagttttttaaggacttgcaccatgtcccgcctgcagcttccgataaacaaaggcagatgtactggaatgacatctacaataaacttttggaactaaaatcaaaaatatcatgagcaatctggcagataaaacagaatatcaggctttaaaaatcatcgcccgaatggttaaggattttgaacgtttgcattgcctgaatatgacggcatcggacgattgggatgccacaaaagcaaggaatcttttgcaaggtcagagcaacggctatcaaattaattacggccgtaggggcagggttaccatatcctgttccgtgaaaatgacaaacaataacacgtccctaattttataatcatggacaattacaaaaagttcacagactaccttttcgaccagtttgtaacactggaaagatgcattggtaaaagcaggtcacacgactacctgcctatttttttcaattatattgaaaaaggattctattacaggaattcaaaaaaagcaaagcgatatgcccagatcgtattttccagtatatcctacgctgttctaaattggaaaacacatcttctcgacctgaaaaatgaccccaaagatgcccaaaagaattttacggcctatctcaagaggttggaagtattgcagtattcccccgaccagatcgccaacatgctgatcgaacgctataggctcaatcatcccacggatattttagaccctgaaaaccccctttaaaataagcgattatggaagcaaatttccatgatattgaaaggttcagaatcctcctcatacccctggggtaggcagagcgttcccaatgcaagggaacgcttttacctgttattctttcatgcatttcaggtgccccctgatagagcgatcgaattttttactgtttatgggtaaaaggaaaaacgggctgccaaaagctgatgacttttggcagcggctcgagatgtagcgaagggactagctgataccttcttccaaaccctcatctttttcttcaagtaagagatcatctaaatgctcagcaaaattcatctttttgagtatttgatacaaagcctcctgatcatctgtattctccacgcccttgcttaggtagttggccataaaatcttcgaaaaactgatgaaacaagcggacaaaagtttgcgcctcctgggcaagtgtagaatctgtactatagatcagattttgtaatgcaagataaaagcgatagagcaggattacgtttttcgaacgaaagccgtattcataaagtgctttcatagatccagtgatatgcataaaacttttttggatcgactgtacgatggcttctataataccttccttgccattgatgatctgtccaacaccgtcccaatcataaagttcataatatttcatctgaaggaaagactttttatttggcctgataaataaatgcgggtccgaggcaatctggcatataagctccagatgaatctcgaaaggtgatccctcatgctgttccgggtcctgagaaatcctttcaattggatagccggcgaactgggaaagaatggaataggcattataatcggcaagaaaggatgattctgctggatcgaaatctgaatcaaaaataatatttaagtgtccgatatcttccatatgcagctgtgcttccgttccttttttaatggtctccgttctgggctttatggcccgcaatccgctcagaagggaggtaaatagaaccggatccttttgtgaaagcccgataagaacggccgctcctacaatatcccactggggagcagcttcgactaaacggagaaaataacgggtcatctctgacctgtccattccctgggattttttggcgaaaactgccaggattggacgtatgcaatgataagcaaccagttccggaagtttcggataaatgattgtttgatctgtttgcggtagatcacggatcaatatcagggaactctggatgagttcctggtaatcatcctgatattttgttttaaaagttgtggttagaacggctccgcttccaatggcagcgatacttagccttggtacggttctacgggtttccagttcctcaacgaaacagttcgcaattttttcgtaaagctggtggacacgttttgaaaatatcccgttccgggcaatatcctgtaacagttcaaagtcggggacagcgacgattttgataacttcattggccttaagtcccgaactatcccggcctgtgagcagatatcttaaaattcttggctcccgatattcttcggtaaaatacccccctcgctcaatggttaccttgaaactacggaacatgatttccctagcctggtgatattcttcgtcatcaaaatcattgagttttaaaacggtacttttatggcctaatgctgtctggtgaattctatggggtacctccgagatctgcttgtaattgaattcgtctatgctgtacaatatccgatgctgactgccctcaaaaagattgatcagttccagaatttcttccataattccttctgaaatatttttattgaaattatccagtaacaggtagaatttaccagaactttcatcaaaaagtgaagtggatagccagttcctgacttgttccggattgaccgaatttttggcgcatgaggtaaatgaatttgccaattgcctgaatatagacatattcagttcattacaatcaatataatacacaaagctgttttcagaagttactttttgataaaactgatacagtagggttgtctttcccgagaacgcagcacccttaactcctacaagtgtctgtcccgtagagaaaatatcgtctatttccttaagaatactacgctcgacctgaaagtcatcgcagatcatggcggttgggtcagaaatattgcctctatgggatgcaaatttttcaccgctcataccattgatgagccctgcaaatagtgcagggtctctattgagaagaagatcgacagcatcccgtaaatcttttgtggcaatttcaaaagcattgccaatacactcctgaataaaatcccagtcaatctgctgccggtcaatcttttctttggtgaaagtatcgtaaaagacgttgtcctttccattggaaatcaaagtaataggtggcatctggtccagcagccttgcataagaaatgccctgatcccggtcagcatcactgagctgcacattttcattttttaactcgagcataataacgttctggttccctattgtgaaaagtatatcggaaatcgcacgtactgaatttctattgggggttttcgctttaacaacaatgctgtggtgtcccacttttaccgaaaaagatttttggtggaccaaacctactttgtgaaatgtcgggaaaacctgactcatgattttactgatcatggcctctaaggtggcctcgtttactttggcgttgctcatggttttgaatagttattagttaaaatatagcataaggggtacccctccttcacaagataggaaataaaaacaaatgtaatattgtttttagaggaatttttattgtattgggagggtcttcgtgtaactttagctttaaatattgctgtggattttgtaaatttatagtaataaccaaaaaactaattttatgaaaacgagttctttacactatatgaaaattgtaattttgctctgctttgtggtttcatgtaaatgcccgatgctgcctgctccagcaatcaaagtcagccatacgaatgtctacgatggtacaagcctccagttacttgttccccatctcaaaaatgcagaagtttattgggaggggcccactgaaatacaagaaggagaaacttggcagatggattctgtaaacaaaatgatgtccggaaaatatagtgtatggtatagaagtactaagagaaaacgatgttattcagcagaagccgtttacaatctaaagattgattctttttccgggtttcccaaacctgaaattatccagtatcagaatagcctgatcagtgaaggaaatagtattgtattgagtgtgcaggatattaaagatgcaaacgttcattggaaaactcccaaaaacgactttactggaaatccactgattataagaaattcaacggtactggattccggactgtactctgtaaactatgtccataattttattcccaatgtgtcatcggagtcttccactaaaactattttcatatatcaaagacaatttgtaacctcttataaagataagaaatattttctcgattttgctttctttgataaatccatacagatctggttaagagaggatcagctgaagaatgatatagtgaaagataaaatgcttgccgaaataaacttcggaacaacaactcgtaaggatttttcggaattcttctgcgaacatgttggttatctagaaaaaagtaaatttctggccggttgtgcagtaactgctggagcctctgggtgtctgttaggagcaggtgaaggattaccattagttccttcctgtgttgtactacttaaattacttgagccagcaggtgccgcatgtcttgaaggagtactgggtgaagtgacaaaagtattgggtattcccgcagcagcagatatgggagggcttggcgccgcaattgctaaggaggaatttgcagatgcgattacaggtttacttaaaatggccctttgtaaaactgcaggtaaggagctggtctttaatcttgacggaagcgttatattaaagccaaaagctctatctgcttcgggtaaacctacgacaaattcttcaggatcacaggattggccaggtggacatgatggatctcaggggcagggaggaaaaggttcaaatagtggtgagaccggaggcggaaaaccgaacagcggaaatggcggtggcgataaacccaatagtagaaatggtggaccaaaaggagatggtggcctaggaccgatgccttttcaaaaaagcagtaaaaaacagcaaaagtaatttctcaacgatgtaaaattgtataagaatgtatctgcctggggttaagtgaaaagcctgctagaaagcagttttttttgctttattaatgtcaggatggtatgctatagttaaaatggagtgttgaataaccataaatacaatctgctccagtcgtagtaccgcattaatagtgcaaatatttatatttttttatgtcaaaattgtatcaccttttgaaagttttgaataagggggggatattatattttttttattttcgccccacaagtataataaccagtaatttttttaacgtgaacttctttgcagtcagctccatattttataaaaaacatctttataaagtccctctaaagaatttattctatttgctataacatgcgtgttaaaagttactttggaaacgacgtgtataataaatctctacaatttttagtgaaataatcaaagaaaatctaataatcaatgaaaaaattctatatcagtgcattaaccttgtgcgctgttgtggtgacttccgctcaggaagtcgtatggcagaaagatatcaaatcctctacacaggattttctaagccagattaatccgactatcgacgggcaatatcttatcacaggaagctctatacaagctaaaagccattcgcaagcggctaatagtcagaagcaaaataacggttacgattttcatcttatcaaactcaatcagcaaggtgaagaggtttgggaaaaatacttctcaggatcaaaccatgattatctgtctgcaagcgttactacacaggatggtggaagtttactagcagggacttcatattccgggaaaggtctggataagaaagaggactctaaaggaggatccgatatctggctgatccgtatcaatgaatttggtgatgaattatggcagaaaaccttgggcagtacttcagatgaagaagccagagcagttatccagactacggatcttggattttttgttgccggaaatatacagaatgcctcaaaaggatttggttccaaagatgttttgattacccgactggataaagatggaaaagagttgtcccaattagtcttaggaggaaaagggctggatgaagtagagaaaatgattccaacgagagacggaggagcactaattggaatttactccagaagttcagttggaggatcaaagaaagccgaaaactttggtgagggcgactattggatcatcaagctggataaaaacggtaaagttgaatgggagaaaaattttggaggaaaaggagatgatcatttgagaaccctggccttaacttcaaatggtttcattatcggtggagaatccagatctgaaagatcgggaaataaaacagcaggccttgaagaaggatcagacgtatggctgatatcattaaatgaaagaggtgaagagcagtggcagaaatcttacaattttgggaatcgtgatattctgatgagtatgagtgttcttcattcggcagatgataaatcctcgaaaggaatcttattaggtggctatacccaggcagaaggaagagtagagactgatgatgaaactttctggatgttatatcttgaccataatggcactgagcagtggagaaagcatgtaaaaggtgaatccaaaaagaaggaagaaaggctttcagacctgaggctcaacaaagatggttctattgttctggccggaaccagtgcagaagaattgggtaaagagaattggaagattgtaaagcttggagacaaacaggttgatcagctgattgaaaaatacgatatcaagatctatccaaatcctgtttctgattatgcttacgtagaaatcggctatgacttcaaagaggctgatattattttgtatgatatgagtggaagacagcttcagagtattaaaaccaagaacagagtgaccaagatcaatacccaggctttggtacagggggcgtatctggtgaccataaaaactgaatcgaataaaacagcgaatgcaaagctgattaaaaaataaaaaacaataattcatgaacattaaactcaaacaccttcttgttgcattttactttatgcaatcaggtgtttcttatgcacaaagtgagcttttatataccaatcttttttctcagagtcccgtttctaaaagctttggtttccagggactttatccagtaaatttatacagaggactccctgatatttctgttccgatctttgagaaaaaagttagcaatactaattttaacatttcgctcaactatgatgttagtacggttaaacccgaagcagtacacagttgggttggattaggatggagtaccaatgttggaggggcaattacaagagtcgttaacgggcagtatgatgaactttacacaagtcatcttaacgaacatgacaaactttcctatctcgatcattacaatacattggataaaccggactgggattctcaggcctcattatctgctttttattacgatgcggaaaactcactacgatttacaagtttttataattactcaatgcagagtggaaatacgaacactcttaacttcggaggagggttagataattatacggataaatggatgctgatccccgatccggacgaatttatattaaatgtattgggtattaatggacgattttacatgaatgagaagggaaaatggatcggaagaactcgtgatggaaaaacattttcaatacagcatgtctataaagaaaatcacacaataaaacccaacagttatatcagttataatctgagaaggattttatatggttttacagtcacgatggatgatggtacccaatatatttttggacaggatgataatgccgtagaatttactgaagaaagacctccttgtgccaattgtaattttaatgaacagattgtagcaagttcctggttaatcaatgaggttaaatttccagatggcaaaaaaataaaatacacttacgaaagagctccaaagcctaactatattgcaagtcaggtaggttatgatattgtgttaaaagcacccaatattgaccttttcgaatcctatggttcaacagctttaaactggcagtataatacttatctgaaaaaagtggaaagtgatgaattttccgttgaaattaatacatcacaagtaaagccattaaattatcaggttttgaacgagcaattaagaggccaaatgggttcttatctgggctcaggagatagttcgcttctctttaacacctggtttaaaattgatagtatcattgtaaaggataaggataaccataccgttaacaccacaacatttcattataatagtgttgatacaaccaagcgaatgcatttggaagcagtgataaagaataacgaagaaaaatactcatttgattataatcctaagacgcttcccctataccttgattccaaatatgataaatggggatactatgctccatcaacccatagtactccggatcttgaatatacaaaagctgagactttagaatggataaaccatcctacgggaggagttacccatttcatctatgagctcaatgatttttccaagtatggaaataaaaaccctttctatacatctgcgaatacccttgagctgattgacaccgtttctcctaatgaaatagcgggtggcttaagaatcaagaggatcgaggcttgttcagaacatagtacaggatgtgtaatcaagaactattcctacaatggtgataacggaaaatccagcggtattttaccttatcagttcaactttaccagagctggagaagtccaagatatgtataagtttagtcataaatcaagcagctcatatcaatccttaaaaggggagaataacatgattgggtatagtaaagtaaccgtaacagataccaataatggtaaaactgaaaactattttaccaattttgacacccctaattgtaatgatcagagagggcctataattatgggaccgcctgatcaatttaccggactgtataaaagtgttcctttcacatctttttctcttatgagaggaaaacctcttaaagaaattacatcctctgctagtggagtggtgcagacgaaagaatatgaatatggatataacaatcatctgataaaagcatatggtctggtagaggaaaatattcattatatgttgaacctactaacagttaccgcttataacgtcaattttaatagcagcttccttaaaggaattaaaaccactttaaacggagtagaaacaaaggaatcatatgattatgaatataactataatactctgaagtctcagaaaattatagattcgaacggtgatgagtttcaaacgaactttacgtatgcttttgataagccaaataactttttagtaggaaaatatatggtgggttttccacttaaatctgaggaaatgaaaaacggaaaagtagtttctaaaacagaaacgttgtacccgttaagccaaacagaggctgataataagacttccggtttgccattacctacttctcaagtttcttaccagttgcaaagcaactctccagtcactgaagctacatatgacaagtttgacagtaaaggcaatctacttcagtacacaacaaaaaatggggtttctacatcgattatctggggatataagaataatacccttcccattgtgaaaatccagggagccaagctatccgatatacctcaagcgtatgttgatcagattatcaatgcttctaaaatagatgctcagcaggcgacagatgcatctgaacaagattttgttaatgcgttggaccaatttaaaaaccgtcctgaattggcaggatatcttattaccacttacagttatgatcctctaattggtgtgaaaagcatcggacaaccctcaggaattagagagttttataagtacaatgcagcgaatgaactggaaagaatcgtggatcaatccggtaatattgttaaagagtttgcttataaatataatatcaagaaattctataacagcgaaagaagccaaacctataccaaaaataactgtaactcgttacaggttggaggtacctacacatatatagtacctgctaataagtacgtatcattgatcagcagcacagatgctgaacaacaggcagccaatgatcttgcagcgaatgggcagaatgctgcgaataccaacgcacaatgttataatgcccaatgctatgcaagttcaataaatggattccaagttggacctcatgcagaaatttctcaaaacgttttaggacactttaaggtagatatacaggtcaaagtacctaactcactaaccaatccagatggcagccaatggtggcaaaaaggagttgctaacatcccgaatccatgtcgtcctaatacaaatttagcacctgatatattcaataataatgttaaagagcttacaacaaatacctggtggaaagtacagatcacttctgcgggtgaccttatattcattcctaatggttacgtggctcctggcactcagctgtattttgtttttgagtacgataaagttccaaactaatatggtgatgaatcataaaaaagcgtatttacaagtaaaaacttataacctagaatttgtcatttaatgaaaagaatatatacaatagccatactagtatggaccgttatagaggctcaagggcagacgcaacttccttcaggccttactggtacgattgacgaaaattatgtctacacaagaacgtaccttgaacctaaaactcaaagtgatagcaatgctaagcaaatacaggctattcaatattttgacggattaggaagggctaaacaaacgattaatataaagggctcaccaaagggcagagatattgtgactccttttacatacgactattatggaaagccaatacgggattatcttccggtaccacagtcaggcacacaaaacggaaaaatatactcacaaaattccctggcagttgattttccggttggagatccggaaggaatatatacaggagaaaggccttttatggaaaaagtgcttgaaaaatctccattggacagagttatacaacaaattcaggtaggtaatgactgggccagcaaacctgtaacctttaaatatgaaacaaataaaaatggtgagctgaaaaaatatacggctacctttagttacacctctttagtagcgaaacttatattgtcaggttcttacggaccaggtcagctttttaagaatacaactaccgatgaagacggaaaccaaactattgaatttaaaaatagtcagggccagattgtattggtaagaaaagtaatcagtgctacagaaaatgcagatacctattatgtttacaatgattataatcaactggcttttgtgattcctccaaaagctgccatacaaccagatgctaatactgtactaaacgagctatgttatcagtataaatatgatgaaagaaaccggttggttgaaaagaagctgccaggaaaagggtgggaatatatggtgtataataatgctgatcaacttattcttacccaggataccgttcttaaagataaaggacaatggctatttactaaatatgatcaatttggaaggatcgcttacacaggaatcacaaataatgctgccagtagggtttcaatgcaaaacagtgctaataacaatactaatttatatgaaaccagaacttccacaaccggctttaccttaaatggattacctgtgtattataccaagctatccactcctaccgctcttagcatactgttgagtgtaaattattatgacagctatcctacatatagtttcaaccctgctttgccagtaaatacaccagatatgaccgtgttaacgggaactcctactgctgatggaaaaagtactaaaggacttccggtcatgagttttgtaaaaaatattgaagatgataattggaccaagaattatacctactatgatcaaaagggaagagtaatcgggagccactctatcaaccatttaggcggatacacaaggattgaatctgagctggattttaccggaatgccccaaaaaacggttactactcacaagagattagcaggggaaccaggagttactattacagaacactttgaatatgataatcagtacagattactggttcataagcatcaggtagatgataaaccggagcagattcttacagaaaacagctataatgaactttcccagctaaataacaaaaaggtagggaataatttgcagagtattgattatacttacaatataagaggttggctgactggtattaataaagcgcaaatggcaattcctgatttaggaggaaaattattttcctacatagtcaagtacaatcagataaatggaattgaaaatcccgattctgcactattcaatggaaaaaatgtgaagccaaggtataatggaaacattgcggaagtagactggagagctgtggagtcattaggagctaaccctccaattgcacctaaaagatacggttatgtttatgatgctttgaacagacttacagcaggatattaccaaaatcctgtgaacccttacagtaaagaacatacagaatccctggcatatgatctgaatggaaatattgcaaacctttacagaacctctgctatagaaggaaataatacaaccgccacagttattgacgagctggaatatacttatgggtccaataaccttaccaatcaggcatctgtgattaaagactacaagaataatccttcaggatatgaaggcggaggtggtaatatccagtatgaccttaatggaaatatgtggcagatgccggataaaaatataaccaagattacatataatcatctgaatcttcccaataagattgagtatggaaacttagggctctctggccttcataattacctgtacagcgcagacggagttcggcttcagaaaaagcttcctaaaattgaatgcgggattatcaattgttatactgtaactgagattactgattatcttgatggatttcaatattatcgcaacgaatcagacaataatgggggaggcggtatcgaagaactcagcatgatcaccgacaaattaaaatatgcatacgaacaacaggcttacagtactgaaagtggaattacaatggcacaggcagctccattaggaataactactgttaagactcctcaactcatgttctttcccacagcagaaggtttttatgattacgggaaagatcagtatatttaccaatataaagatcatttgggaaatgccaggataagttatgcaagaaacagcgcaggttctcttgaaattacagatgctaatgattattacccttttggaatgaaccacttaaaaacaggaaatgctttcttcggatctggaagttataagaattacaaatataatggtaaagagcttcaggagacggggatgtacgattatggtgcaaggttttatatggcagatatcggacgttggggagtattagataattacagtgagaattattttcctatttccccttatagttatgtagcaaataatccaactaaatttattgatataaatggtgagtggatatatattaatgatcaaaatggaacccaatacagatatcataatggtgcaacacaacatcaagtagatggtaaatggaccaatgtagatgcaagtactcaattatcagattatgttgttcagactatagcaggattaaatcatttagacaaaaatacttcaataggaaaaacaatgattggatattttgatcaggcacaaggcaaagatggaaaaataagagatatttattttaattctacgagtgatgtttcacatataaaatatggtatcagcaatataattgaattaaacccatcagacaaaggagtttggactactttgggtaatgactctaaatatacccctttatacaccacaatagcacatgaaatggggcatatttacgaaaactatgctttaggaataacctctcaatccgatacaagatttggacctaacagtaccacagcggaaatatatggtacgcacgttgaaaatattgtaagagcagagtcgggtctaccattgcgaacccattatggtagtacttgtggaggttctacttgtattcctaatgatgatgggaggttgatagacaacgcaggaagtagtatttattataataaaagtggaggtcaaatatctcctactcctagtgttgaaagtattcttaagataaacggcaaaatattgcaaaaccgatataattatattggaactgccggatattataaattgcaaaaattcaaaaatcgccccagataaactataaacttttgaaaatgaaaaattttttattattatttagtattatgttattttcttcttgtaactcccaaggaaagataactatgagacaaatgaatgaaaacttactaaaagataaaaattctattacctatcgtgatcccaagacaataaaaatgcttacagatgcatataaggtttttagattgttaggtgtaaagtcttgcgatatagatcctgacaaaaaatattctcagatttatatagaagacggtttccacgatgaagaaggtttttacaatgggatttttataataaataataaaaatatttgtgaggttaccacaagtccttataaattacatcaagacagtgtttcctatactaaagtcaaggaaaaagatatttcatatggtgaaatggttttctacactaaaaaactttctatcgaagattttaagaataaatatcctgatgaatatttcaggtacgaattggttaggcaaaataaagtcaatgcttttgaaaagtgtttagaaattgatcaatataccccaaaatcaattgtttatgcgcgaagccattactttacaggaggaaaaatgcaaacttatcatttgccaataaagtatagtgatattaaaaatggtatagaagaattgccttattttaaggaaagtaagaagaaggaatttacagagtgtatcaatgaattgaatatattaaaaatacacaattcgtcgattaaaacttcatcttttcaatgatttaaaaactgtaaacggaaaagttacattgattgaactatttcgaattaaataaggtgaaaaaatcagtaattagagaaggatgcctgcaggcatcctttcttttttttatatttcagatttcggtaggagattatttattaaaaacagtaatctcaaaatcttgatatgttcaaggaattagtaaggtaaatcagcttttcttttcgactggaacctcacgcgactgtggtaagttcaggaaccaattcatacgctggtaataatctgcgttttcatttgccatgttgtgttcaaacattaaaattttatcatcactgctttatctgataaatgatataatatgtcaatcaaaatgtataagataatactgctcaatgctctaaacttagcttaactttaatatttaccttttaaataataatacaagtgaaagatttgttttataaagccattacgtaacggagggataatactgccggcaataaactcaaggtcagaacgatgacattagaagaatattaggtagttgtgttacaccaaatgacaaaacgttttgttcaggatttaaagttaagagtcaaataattgcgaaacggcaataaccgatataaaaatgccccgaagatagtcgaggcgctaaatgttttcacaacggaataatccttattgtgaattgctttcaaaattattagcacaaatataaactaaaaattaaataaatagcttacgggtatccgtaatttgaatatttttttatttctatttttatatgatatcaaaaaaattaataacgatgactaaaaatatacttggagtagatttgggagtttcatcaattggctgggcgtacgttcaggaggatcccgaaaatttggaaaacagtaaaattatcaaattaggagttcgtattacaacctttgacaattttgtaagcactaaaacaggaaaagaatctaaagaacctgaaaaggattttaaaggaggaaaagggatttctccaaatgcaggaagaactttagccagaagtgcgagaagaaatcttcaaagatttaagttaagaagagccaatcttattgatgttttaaagaagaataatattcttaaagaatctgacttacttgccgaagttggcaaaaattcaacatttcaaactcataaattaagagctaaggcagtaaaagaaaaaatagaacttgcagaacttgccagagttttgcttcttatcaataaaaaaagaggatacaaaagcagccgtaaagctaaaaatgtagaggatggacaggttgtagatggaatggctgttgctaaaaaattgtacgaagagaatttaacacccggagaatactcatatcaacttttacagcagggcaaaaagcaattgcctgatttttaccgttcagatttacaagcagaatttgataaaatttgggagtttcaaaaacaatttcatcctgatatttttactcaggagctgtacaaagatttgcagggaaaaaataaaaacgctacctgggcaattttgcaagagcctctttctcttgtaggcatcaagcaaataggaacagttcaggaaaaaaaggtcgaaaaatgcttttggagaagtgaagccgtaaaaagacaattggattttgaaagtctggctattgtatttcaggaaattaacagcaatctgaataattcaagcggttatttaggagcgattagtgatcgaagtaaagagctttattttcataatcaaacggtcggagaatgtttatttcagcagttgaaagccaatcctcattctaagctcaaaaatcaggttttctacagacaggattacttagatgaatttgagaagatatggaaaactcaatcggcacattataaagaattaacgaaggaattaaaggaagaaatccgggatattgtcattttttatcagagaaagctcaaatcacagaagggtttaatcagcatctgtgagtttgaaaacagagaaattgaagttacggataaaggaaaaacaaaaaagaaaacagttgggctaaaagtggcaccgaaatcatctcctttgtttcaggagtttaaaatttggcaaagattaaatgatttagaatttacaagtctagaaacaaaagaaaaatttcctttagaattagaacatagggaaattctatttcagaatttaaatataaaaggaaatttatcttcaaaagaattaatagaactgctgggatatccttcaaaagattggaagtgtaatttcaaagaacttgatggaaataaaactagtgaaaatttatatactgcttttctaaagattattgccagtgaaggaatagaattcccaaaagaatttaaattaaccattgatgatgaaattaaggtttctaaaataaatgcttctgcagagatcataaagttatttattagagagaagctgtcagaaatggaagttaatacatctattctggattttaatccggaattggaaggaaatgatttcgagaaacaggcttcttatcaactgtggcatttgctgtattcttatgaaggtgatgattctccttccggaaatgaaaaattgtatgatttgctggaaaagaaatttggattcacaaaagaacattccaaacaattagccgagattggtttttcccaggattatggaagccttagttctaaggcaatgcgaaagatctatccttacattaaagaacataaatacagcatagcctgtaattatgcaggttacaatcactctaaaaattctttgaccaaagagcaattggagaaccggattttgaaagaacaattggatatacttcccaaaaactctttacgaaatcctgtcgttgaaaagattttgaatcaaatgatcaatcttgtgaatgaagtttctaaggaatacggaaaacctgatgaaataagaattgaattagcgcgagaactcaaacttaatgcggaagaacgcgctactatgacttccgaaattaataaagctactatacaacatcagaaatatgcggaggttttgcaaaaagaatttggtataaaatgtccttcaagaaatgatatcatccgatataagttatatttggaattggcaaataacggttttaaagatttatacacggatgtaaaaattgaacgggaaaatttatttactgagaaatatgatatcgatcacattattccgcaatcccgtttctttgatgatagtttctctaataaagttttagtcccaagaagtgctaatcttaaaaaaggaaattttacggctttcgattatcttgaaatcgaaggaaaggaaaaattagagaaattcctcaatattataaaagatctgtatgataagggagcaattactaaagcgaaatatgaaaaactacagaaaaaaggctctgaaataggagaggggttcattgaaagggatttacgaaacacacagtatattgctaaaaaatcaaaggaaatactttttggaattaccaattctgttattgccacttcaggaaggataacagacaaacttcgtgaggattggaatcttgtcaacacaatgaaagaacttaatttagataaatacagaaaattaggtcttacagaaacggtgatcaattcaaaaggagagagaaaacagagaattatcaactggacaaaaagaaacgaccatcgtcaccacgcaatggatgctttaacggttgcttttaccacacataatcatattcagtatttgaactatttaaatgctagaaaagatataaagcataaagagcatcaaaatgtttttgcgattgaaaatttaattactgagatcattgataagaaaaatggttcaaaggaaagaagattcaaagagcctttcaaaaattttagagctgaagccataaaacatttggatgaaatattaatttctcataaagctaaaaataaagtagttaccaaaaacacgaataaaattaagaaaaagggaagtgtaattgcaaaaacagagctgaccccgagagggcagctacataaggaaacaatctacggaagttcaaaatttcttacaacaaaagaagaaaaagtatcaggaaaattcgacgctgaaaccattcagaaagttcagaatgaaaaatataaaaatgccctgctaaaaagattacaagagtatggtggggattctaaaaaagcattttcaggcaaaaatgttatttctaaaaatccaatatttcttaatgccgaaaaaacggagcaattacctgaaaccgtaactttagcctggtatgaaaccggctatacgattagaaaagcagttaatcctgataattttaaagattttaaaaatattgaaaaggttattgataggggcgttcgtgatattctaactgaaagattgaaacaatttaactctaatcctaaagaagccttttctgatttggaaaagaatccaatatggcttaataaatcaaaaggaatctcaataaagacggttactattacagggattaataatgccgaagctttacattataaaaaagatcatttaggaaacgaaattttagatgaaaacggtcaaaagatagccgttgactttgtgagtacaggaaataatcatcacgttgcaatttatgaagataacaatggcaacttaaaggagaaagttgtgagtttttatgaagccgttgaaagagtgaatcaaaatttgcaaattattgacaaagaatataattcagagttaggctggaaattcttatttacattgaaacagaatgaaatgtttttatttccatcggaagattttgatccgaaagaagtagatttatttgatgaaaagaatctgagcttgatttctaagaatctttatagagtgcagaaatttggagatatttctacatcaggtatttgttttaggcatcacttagaaacaaacgtagaaacaaatgcaaaattaaaagatattacattcaaagttattcaaagtacaaaaaatttaaaagcccttgtaaaaattagactcaaccatctgggaaaaatagttcaaattggagaatattaaaacttttacaaaatgattacccgttccatctacatcggaaatcccgcttatcttaagctcaaagatgagcagctgaaaatcctatgtccggatacccaaacggaaaaagggagtgttcctgtggaagatttgggcttattgatgctggatcattatcagattaccatttcgcacaatttgattcagaaaatgatgggaaataatgttgtagtagtgagttgtgacgcgcatcatctaccgcatggaataatgcttccgttgtatggacataccgaacattcagatcgggtaaaagatcagttggaagcaagtgagcctcttaaaaaacaactttggaaacagacggtggaatataaaattgaaaaccagaaaaatgttctgatgaaactgggtaactattatgagccgatgattgaatatcagagaaatgtaaagtcaggcgatataacgaatatggaagggatcgcggcacagcattactggaaatacctcatcagcctggattttttgaggcaacgtttcggagattcacctaatcagttttttaattttggatatgccgtgctcagaagtattgttgcaagagctatcgtggaaaccggattattgcctgttctcggcatttttcataaaaataaatacaatccgtattgccttgccgatgatataatggaaccttaccgtccgttcgttgatttactcgtgatgcaatggttgaaaattcattctgataccgaagaactgtcgaaagaattcaaggctcatattctgcagattgcaaccaaagatgtgcgtattgatgacaaaacaagaccactgcttgttgctgtgaaaatgacggcttcgtcgctttacaaatgctacacaggagaaaaacgactgatctcttatcctgaactgttatgaatgccgaaaggtttaatgcataccggattatgtgggttttagtattatatgatctcccgactgagaccaaagcgaatatgaaagatgctaaccgctttcgcaaggcgctcattgatgatggttttactttgtttcagttttccatgtatgtgcgccattgcccaagccgggagaatgctgaggttcatattaaaagagttaaatttatgcttccaaaaaccgggaaagttgccattatgtgtatcacagacaaacaatttggagatattgaaatcttctttgccaggaatagagaagagccacctccaacctttcagcagcttgaattattctaaattttaaattctaaatataaaaataatctactggttttcagtagattattttttgaggctgtgactaatcacgaaggtaataatttctgaaagcaattcacaacattaagacctgcaacatctatgtacacaccgctgtgactaatcacgaaggtaataatttctgaaagcaattcacaactagcgcgttaatttctgcgcgtatgttttcgctgtgactaatcacgaaggtaataatttctgaaagcaattcacaacaatttttttattgagattatcgacatttttgctgtgactaatcacgaaggtaataatttctgaaagcaattcacaacacctcttcgttttaggtgctgaaggtttttgctgtgactaatcacgaaggtaataatttctgaaagcaattcacaactgcatgctcgagttttaaaattctttcctggctgtgactaatcacgaaggtaataatttctgaaagcaattcacaacaatcttttcgtttaatacgtagcctgaattgctgtgactaatcacgaaggtaataatttctgaaagcaattcacaacaacactgttagatttaagtagtacttatgagctgtgactaatcacgaaggtaataatttctgaaagcaattcacaacttcgccatacataattctttttcttaattcgctgtgactaatcacgaaggtaataatttctgaaagcaattcacaacagccaattgaaactctccaattttagcggcgctgtgactaatcacgaaggtaataatttctgaaagcaattcacaacctcatactaaaaacacatattaatgtcactgctgtgactaatcacgaaggtaataatttctgaaagcaattcacaacttcaatatctgattctttaccatcttctttgctgtgactaatcacgaaggtaataatttctgaaagcaattcacaacttcataagccaattgtttactttgctcaatgctgtgactaatcacgaaggtaataatttctgaaagcaattcacaactgtaggtattatatagttagaattgtaaacgctgtgactaatcacgaaggtaataatttctgaaagcaattcacaacacaatgggaataagttcatctgcacaccttgctgtgactaatcacgaaggtaataatttctgaaagcaattcacaacttgttcagtgcaggcatatttcccgttaacgctgtgactaatcacgaaggtaataatttctgaaagcaattcacaacgattgtcctttctttgccctctaaattttagctgtgactaatcacgaaggtaataatttctgaaagcaattcacaacagtctggcctacacgttttttatcaatttcgctgtgactaatcacgaaggtaataatttctgaaagcaattcacaacaatggtgtctgcatccataacggggcgtttgctgtgactaatcacgaaggtaataatttctgaaagcaattcacaacagtgaagtgattgtttagctgtttaaaggcgctgtgactaatcacgaaggtaataatttctgaaagcaattcacaaccgtacacactttggctataccagctcacaggctgtgactaatcacgaaggtagtaatttttgaaagcaattcacaacactgtggagcaaaccaaagaaagagtatttgctgtgactattcacgaaggtagtaatttttgaaagcaattcacaacaactcaaaaacaataatacaatggaaaacggctgtgactattcacgaaggtagtaatttttgaaagcaattcacaacctcaaatgttcggagtgcaaatatagaaatgctgtgactattcacgaaggtagtaatttttgaaagcaattcacaactttcacgagggccttaaccatcaaaccgtagctgtgactattcacgaaggtagtaatttttgaaagcaattcacaaccattcggtccaatggttctcacatttatccgctgtgactattcacgaagggagtaatttttggaagcaattcacaacttgcagtgcgtcaaacagtggtttgttgaggctgtgactattcacgaaggtagtaatttttggaagcaattcacaactaaaagagtttgttccggatgtgaagaaaagctgtgactattcacgaaggtagtaatttttggaagcaattcacaaccttgcagactctccggaagtggtcactgaagctgtgactaatcacaaaggtagtaatttttgaaagcaattcacaacccggaagtgaactatattcagtaaatggatgctgtgactattcacgaaggtagtaatttttgaaagcaattcacaacccacgaccccggaataagtttgataccattgctgtgactaatcacgaaggtagtaatttttgaaagcaattcacaacacacagacgtaaggaaagaggtcttgttgagctgtgactaatcacgaaggtagtaattttaaaagcaattcacaacaaacagataagactgtacgctattgtttttgctgtgactattcatgatggtagtaatttttgaaagcaattcacaacgcgcaaatcaaaatccagtttttaatttttgctgtgactaatcacgaaggtaataatttttgaaagaaattcacaacgaaccggcttcagattatactagggaacctgctgtgactaatcattaaggtaataatttttgaaagcaattcacaacatgttcaaactgtactgagccgctgacacgctgtgactaatcacgaaggtaatcattaaggtaataatttttgaaagcaattcacaacatgttcaaactgtactgagccgctgacacgctgtgactaatcacgaaggtaataattttttaaagcaattcacaactcataaaataaatggtgccatacgtaatgtgctgtgactaatcacgaaggtaataatttctgagagcaattcacaactagcccaaagatttcacgagacattggcagttgtgactaatcacgaaggtagtaatttttgaaagcaattcacaactagggcctcctgtgcgttgtatgttcttccgctgtgactaatcacgaaggtaataatttttgaaagcaattcacaactaaagcagtgacggctccttgcataacaccactgtaactaatcacgaaggtaataatttctgaaagcaatttacaaccatgagatcctgcggggtttctacgatgaagctgtaaatcaccacgaagataataaattttttgaaagtaagttgcaacttaagctggataagaaaggatgcatggatcatcttctgcgaagaatatctttccccatgccactgatttcgtccattgttttctttttgccttcctgtatccaatctagtaactctgctttggaaaagtgaagcctattgcccttcttgtagtaaggtacctcgcggtggcaaattttagagtacagtgtgggtaaggaaagcttcagcagttgactagcctctcttgcccctataaacacctcttcttcaggttcattttgcattctagctgatagtaatttctctattttttctaaccggtcttctatattgcgaagaattttcggtatctcttcaaatgtatagcccatgatttttttttataatattatactaagtcgattaattattttatgtaatgtcttgcagtggtacaatttgtcatcttatggaattggacaatcgcttaattatgagtagactctttctctcgtgctggtctacgctgttccatttagtacgttttttccaatgttatataaatccagtttgatcttttctgaagcctctttttttagactatctacaattttggcgtaaatcattgtggtttttatgtccttatgtcctagtaattttgaaactgtatatatagaggtgccagctgctatttgtagtgtagcgaacgtatgccgaaaaccatggaaagtaaaatatttggtgataccggcattaatcagccatttttttaatgcactaacagtatggtcatatctcaatcctttaaatactttttcattaggttccccaacagggcccaatagttgaatcacttgatctgaaaccggaaagtattccgcattttctgtcttctcctgactgtatactatataatagtttccaagggttccgtggatctcattccatagcagactttcaatgtcagaatatctaaatcccgtcattgcagaaaataatcctgcttttttaacaataggattcggacaatgagcatttgccattctttcaagctcttccaaaaataaaaaggaacgatgggtctgctgagtggcaatgctttctattatttcacctaaattattgggcatgaaacgctttttaaaagcgtttttaagggtcaatttaaaacggctataataagcagcggcggtattttttactattggctttttgctgcgaccaagagcaggaccggagagcagataatcggcatactcctcacaaatcgtttcattcaattcgataaaagaaatgttggggccaacaaatgatgtgaaatacctcacagccataacccagttatagcaatttcctctctttcgggcctccgccgtgaaaaagtctataaagtttgatttcatttttgaatccgagataaaatcaaatcgtttgttttgcaactctatttgacgttgcgccctgatatactctgctaatgccagggtttctttattgtaatccttctccgtccgattcttcggattatcgtagatatatagtttcaaatattgttttttttgcatcttcccagtatctgcattataaactggtggatataaatttagatacaaggaatgtcttcctttactaataggccttttttgtaaggtaacatttgacattatcactatttttagttgaaaattaataagtgattgatcataacctgtaaagtggttacgtcaaggaattatttggcggtaaattaacgaggttgttacggctttcactagccactgtatttacctgtctctattttttgtaacaaaaattcgattatttttcttggcacgtaaacaaaccttcccctgggatatttagggattttatgacggttaataagggtttttaaactcgtttcggaaatattgtatcgctgttgaatctcgccaatgcttaaaaaatctttaaggattttctcttctgagagtttttcgtcttgctgattaatcaaatccacaggaagtgtgacatgaaatagctcatcaatgtcttttttcagtagccgtattcttcttattgataggttggcagagggaattttacctgcttttatcattcgatagatcgtgcgtcgtccacacttaagtaaagcggctgcttcactgactgttaaatagtctactgtttttagagcgaaataggatttgtcgttttcgttttccctacggattacaaggtctgagggggcctcagcttttacttgactgtctttgatcttttgatcccgtacttttgccttatatgctcttttagcacagtggtcaccacagtattttgtcactgtagttctggcaataaaccctagtccgcagtgctcgcagaccttcttgattttcatatttgaactcataatatctttttgcgggagttcaaatgcacttaaggtgtatttaggtacgtttaaggtcattaaggtgcattaagataccttaagtgacataatttctcccttgtttgaaaaactaagatatttagagtatgaggggacaatagggggaacaaacgaataaaaaaaaccaaaattttaaaaaatcttacaaaaacagaaaatatgtaatatgttgatttttagaatattggtgtattttagattgtttcgacttgttttcttattttccgatacaaaacttagaaaaaatattccctaacacttcatcattagtcacttcaccggaaatttctccaagatgttccagggcatttctaagctcataggccaatagttctgtagagatctgaaatgaaatggcttccttcactttataaacggcatccagagactttcttaaggcttcaaagtggcgttgattggtgattaccacgttattttcttcagattttaaatgctcaacatatgatgaaagttcattcttgagatcctggatattttggttttcaaccgcggaaattttaatgaaatcaaactcatgggaaatggcattcctgaaaatgtcttccactgtttcgtatttggtaggcatcacttcatcaatttttgtagcgcagataatcagtttcagatcttctcttagcaaggattgaatcatttcaatatcctcggaaaaatcttccgtagcagcatcagcaagatatacaagaatgttggcgttttctaccttttctttagccttttttaccccgattgcttcaatttcatccacggtctcacgaagtcctgccgtatcaatcaatctgaaggcatgtcctttaatatggagaacttcctcaatggtatctcttgtagttcctgcaatattgcttacaatggctctttcttccttcaaaagcgaattcagtagagtagattttccggcattgggttttccgatgatggcaacagcggttccgtttttaatggcatttccgtattggaagctttcaatcagtgaatttaatttgacttcaattttatccagtaatccgcttaaggcacttctgtcagcaaactccacatcttcttctgcaaaatcaagttccagctcaattaaagaaacgaaattcaaaagatcggttcttaatatagaaatctcattggtaattcctcctttcaattgattgatggcaacttttctcgaagcttcattttcagaggcgatgacatccgcaattgcttctgcctgggaaaggtcaattcttccgttaataaaggcacgaagagtaaattctcccgctttggccattcttgctccgtttttgatcagggtttcaagaatacgttttccgatatgcggcgagccgtgaaaagcaatctccacagaattttcagtggtgaaacttttcggggccaggaaaatagagagcattacttcatcaatagcttcttcctcatccataaaataaccgtaatggatggtatgggatttttgctttgccaggtttttagccggaaaacttttctgaactacagataaagcttcatttcctgaaactctgatgatgcctaaggcacctattccattggccgtagccaaagcacatatcgtatcgttattcatgctgcaaatttacggtttttaatatgaattttcgtggaggtctgttattcagattatctattgttttatttaggttaaaacagggagagttggaaagttgcttgttatttttttgaattaaactacgtcttcagaggatgaaaaatcaaaattttagaattaaataatgctgttaagcgtcaggctttttaatgtttgtaatctattgctggatagtaggtcaggttgtttttgaataaagtgtgaagtggagattaaagtcaaccaatttatgataagtgaaaaattaaacacgtgtttggtatgttaattgtttcttaatgcgccaatgatgttgagaattgaaatattgttcaaataatcggtaataattcgttaaaatattataaatgtacatgaataaattattttttttaaatattaatgaaaaattgatttttttattagtgcttgctttcaatgctttagcctatgctcaatgcattccttacacagggcagacgatgacaagcggaaatacctattgtcttaacggaaatcttaccgtaagtacaaatatcagtatcccgaacggcgcaacacttatcatacaatccggacagctgcagtctaacagtattcaggtagatggaatcttggaaatcactggcggaacaagtgtgaagtctacaggaacggtgaaagtagggactttcgggtctcagaaaaattcaaaaatcaaattaggaaccaagtctttcctgtctcttgtaggatcagtgattcaggaagaccctaccttcgggggcttttatccgggaaccacttcagtgatcgaaatgggaacaagcagcgtggtggagatttgcggaacatttacccagcagtctactacttatccttccgttgaatatgtaggtgctcctgccggcaaagcgtattgcattgcaaaagcagatgtaagtggtggcggaggtgcttccatcatcagtgatgacagtcagattgtaaccattgccatgggatctgtaataggattaggaatggggaattcaagcttctgcggaccgaatgcaacaaaggcgatgtgcccttctctttggcctgaaggattatcagaagataaaacaagctgtggaaatgctccggtgattattgatgatattgacggattctgtacaaagcccggaattaccggtacaccggatggatataccagattcggaattactgtacagcagaaaaacaattcctggccggaaaacattcctaatggatttttagcgatggaatcaaaaaataaaggatttgtcatcaccagagttcagcatgtaagccagactccacagcccggagatgccatcgcagacccgaaagaaggaatgcttttatatgacattcaggataaatgtgtaaagctttacaatgggacagaatggaaatgcatccagaaaagctgtaatgattaatctaaacgataacaaaatgaagaatataaaaaacataagtatagcggttggtctggttgcttttaattcattttttgcccaggttgccatcggtaaacaaacagtggacggaaacagtaccgtattagactttgataacgtgcctgggaataccaaaggtttgattcttccggctacagcaggttttccgaccgggaatctggccaatggaacattgatctttgatcttacggataacaaagtgaaggtatacgaaaatgacacctggaaatctttgtcagatgccggaaattcaggccagatcgctcttaataattctgcagaatcagggaaaggagtgattataggaaaggctgaaagcactgcagatggagtattggtattggaatcagagaataaagcaatggtactgccgaaaatagaagctccacatctcaacgtaaaaaatccttatccgggaatgatgtgctatgatacagccagtaaaacgcttgcagtattcgacggttcagtctggaattattggaaatagcaatagaataattctgatgaaagataacaaaagcagctgtgtgaaaatatacagctgctttttcttttggattaaacaatctgagcactttccttgatgctgttcatcacaaaaatacttttggtctggccaatcccttcaatctctgataatttgttcacaaaaaactcatggaactcatccatattgggagccaggatcttgagcataaaatcaaaatctccgctgatgttgtaaaattctaccacttctttaagtttgccaacttcctcaataaattttcctgctgtttttttattgtgaacatttaaggcaatcatacagattaccatcattcctttattgacctttttacggtctaccacagcggtatattctttaatgattccctgtttttccatacgcttgatacgctcatgcgtaggcgtgggactcaggttgattcttgcagaaatatcacggacactcatcttggcgtctttctgaagcagacggagaatcgacaggtctttttcgtcgggaatataattttcagttgccattttgttctgtttttatagattttttttaatgcatcagttgttttgttcttttagatggattaaataattaatattgttccaaatgtaagcttaaatttttaaatacgttctgttaattctaattttgcaggaaatttgaaacatgggtacaaagaagaatattatattaattttagcatcggtaggaacatttgtggaggctttggatattgccattattaatttaactattccttctattcaacagcagtttcaaattggagccgagattgtacagtggcttcagacgctttatgtattgttcttcggaggcttcctgatcatcggaggaaaactttcagaccagatcggaagaaaaaaaatgtttttactcggggctttgattttcatgctgacttcattaggggcaggattgtcgcaaaattttgaagtactggctgttttccgtgccttgcaggggcttggagctgctttagtaatgccatcagcattatccatcgtgaccaataccttcagggaagagcaggaaagaaaccgggcgatcgggatcttcagttcatttgctgcaattggttccggcagtggtctttcggtaggaggaattatcagtacttacctgagctggcactgggttttcctcataaacgttcctatccttttaattacactggtattatcatactattatcttccggcagatgagaaaaatgaaacagcgcagaaaacagatatggtgtccggtatattaatggtgctgggtcttttaagtctgacctatggaacacacgaattagttcacattaaagaacagccttttctggtaacaggctctttggttgtagcattaatccttcttactgtggtatattaccgattgaagtctgtggctgaacctttagttgatttaaaattatttaaacacagatctttggtcgtttccaatgctgcattctttaccctgggagcattttttatcggatttttattcctgatttcactgatgcttcagaaagatatgggatacagtgctgcttcagcagggttaatgcttgttccgttcagtatcatttccgctttaacggcaaaatttattctgcctcatgtctcaaaacgtctgggctcgtcccaaatgggtgttctaggatggttgtttatgctgatgggaggcctgttattgctgatctctgtttacactggacatccgcttgcagttgttttattcggagccgcttgtatttcgggggttggaatgacgttctgctttaccgcgctttccgtaatgggaatccaggatgttgaaccttctcattacgggctggcatcaagtctgagttctacaagttactttctgggtgcagggatagggttatcattcatgactttgatgggccagatttttccatcggaattttcagtgggaagccttaacctgataatattgattggttatgctcttttagcgctcgggatgttattttactttatattgaaaagtttaaaaataaagcaggcagaagtagctgtttcataagcgacttaaaaatacacaaactatatgaagaaagaatcgatgcttaggtgttggttttttttttgtgaaaaggcaaaaaagtaaaatggctaaatagcagaattgtaaaatggcaaaaccgctaaatagcaaaatttacctgcctgtcttttatgtctttctatctttcactcttttgcccttttgctgttttacccttttgccttaaaaatgataaagtaaaattaaacctgtttcgtctgtagtgatgaagcaggtttttaatccattatcattatgaagacaaatatacaagaggggatcattcttattccggatttcagcggatttacagaatttgtgttcaatacaaaattgtatacaggcgagtatattgtgcgccagttattgtctacactgattgatgtcaatgatcagtactttgaaatttccgagattgaaggagatgccattttattttaccgttatgataaaaatccgtcttatcacagtatttcaagaatgctgtggaagatgagagctacctttaacaggaaaattgaggagctgagtaaaagtttaagtattactattgacctcgctcttaagtttattgttcattatggatctttttcacaatataatatcggaagcttcagaaaactatatggaaaaacgattgttgaagctcatcagcttttaaaaaacggagtggcagagcagccttcttatgtgcttttcagtaattcctttctggaaaacagtaagaatcaggattctgattttaataaggatccgttcctgctgcctgaagtaggggtaatccattattttgaaaatttaaactagcgtatacctttttaatatcattccttgtaaatttgctattgctagcagcccgggtgagatccgggctttttgatgggcaggtcttccggaaatatattgatcaggaactattttcgtatgttgctgtaaaatattcatgtattgatgaataaattttaaattttttaattgaaaatttaaattatatataaaatgcttttttaagaatatttattatggaagtagtttgcattgtgctgctttattgaaaaatatgcattattttctgttttatgtttaaaattaacactggtatctcgctgtaaattaggtatttattttaattttttttctcttttgatgtaacaaatttatgttcatagtggtcttatagaaaaaactataatttcacatgaaaataatcttatttccaatagcaatattagcgggctcattagcaatggcccagcaggctcagacaccggctgcaaatgatactgtaaaaggaaatgcaaaagaaatagaagcggttactctggttgccagaaagccgacagtagaatctaaagtagacagaactgtatttaatgtagctaatagtgcaattctggcaggaaatacaacctgggatgtccttagaatgactcctttggtaagcattgataataatgatgaggtaaaagcggagggacaactggttaccgtatacattaatgacagaaaatctgtttttactggaaaagaattaaaggaatatcttaaaaccattcctgctgataatcttatgaaaattgaagtgattaccagcccttcttcccgttatgaaacttccggatccgttatcaatattgttcttaaaaaaagagatgatgaaggagtgaaaggaagcatctccctgaacaacagacaaagtaccaaaaattcacaatacacgaatttcaacctgaactatcataagaaaaagtttacccaaaccctcataggaagttacaatagtggaaactatgtacagaagacccagacctgggataaccggtatgaaggaaataagcttacccggttcaatcttgaaaatctcatgcgaaatgaaagcccctctctttcttctacttcagagtttgaaatcaatgaaaagaataacttcggtcttgtcctggaatattcacaaaatcggaatttagtttcagcagaatcggatgggatgacttcaaaggacggagatccgggagaatctttccaccagagtcaaaacaactggggattcagccgtaatctggggactaatgctttctataaatattatgacaaagagaagaacagaattttagatattaatttaggaaccaattactccagtgataatgacgatgatttaattgataaacagattaataagcagggagttataacaacccagcaattgggtgtaatcagcaaaaaccagatgcgtaattattatctcaaggttgattatacacagccttttggtaagtcgggcggaactatggaagtggggggtaaaacggaactgaacaatcatgttattcctaatacactctatggtttcagtatcaatgatccctcatcagaatattttaatctatccaaaaacgacagatttcattatgaggataatctgagctctttatatgccaattacagcaaaacattttttgaaaaactggaaacaagaatcggaatcagatacgaatatattgattataaagtaagacaggatgtggcaggtacagaaagaagagactcttatggaacttttcttcccaacctgttgctgaaatatagtttttcagaaaagtttgatctgagccttacctataaccgaagtatctggagaccttggtattctgaatttaatcctttcgtaacacctgaaattaacggaacctattcacgaggaaatctttatctgaatccaaaccctaatgacaggctttatctgaagttcgggattttgaaaaagtattttatctctgcgaggtatatgtacaccaatcaggattattggacaacctatgttacggaaaacggaagaacagtttcattacccggaaactttgacggaaaggttgaaaaatattatctttttgccaataccaatcagaatttcctgaaaaataagctgaacgtaaatgccggatttggatggtactatatcaataataaagatttcaatgaaaaaaataagttgggagctaaagattatataagctattggggggcttctgcgaatgtatcttataccaatctgtttaataaaaacattaatgtaagcgcctggatggagcttgccaatcagaataacggaaattcttatgcaaataacaccaatgttttccataatatttcagtcaccaaaatattcccgaaaacccagatggaactgagcatgcagctgatgaatatctttaaaagaccttacggtgataacacaacctatagtcctgacggaaccttcagagagtattcaaaatgggactggtacggtgtttcgcttacttttgtaaaacgtttcgggaaccagaaggtaaaagaaaataccaaaacagatgttgagaaaaacgatggcggcggaaaataattaaagatcgttagataaaatgaaagcagattcccaattggaatctgctttttatttttgattggaagctggaagtgaaaagattcatctttactatttgttttaaaaaatctgtgaaatctctgtgatctgtgggaaaaatttttaacgcaaagttttattgagtttcttattattttaaggttgcaaagttttgaatcaatcaaattgattctttctaagcgtaaatacaatcagaatccttcgtaagcaactttgttgctttcttaactcccttaaaaatattacttttttatttaaaactttgcgttaaaaaccttcgtaaatctggcagctttcaagaaatctggaaaaataaaaaaacagattccgatctggaatctgtttacattctatcaaataattatcaaacagagttttactcttaacgctttttatttaagggtaaatttcacttttgttttaatcgcatcggaagaatttccaatcagagcttcaaagtctcccggttcagcaacccaatcatgtttttgaggatcaaaataacttaaagccgttttatcaatcgtgaaagtaacttctttttgctctcccggattcagatatactttttcaaatcctttcagttcttttgccggacgcggaacagatgattttaaatcactgatgtaaagctgggcaacttcagcacctgcttttttacccgtatttttaaccgttactgtaaaggtaatcttaccatcctgtgatattgtgatctgatctgcttttgctttcccgaattcaaaagaagtatagctcaaaccatgcccgaagctgaacagaggttttatatttttagtgtcgtgccagcggtaacctacaaaaatgctttcattgtaagtgatgttgataggatttttctggtctttaccttttccagctgccaattcatccttttgacccggatattctccaagctggtgtgctgaattgtcttcaagttttatagggaaggtaaacggaagttttcctgacggattggcatctccggctaagattgctgcaatagaatttccagcctcagaacccagataccaagcctgtacaacagttggaacttctttaatccatggcatggccaccgcatttcctgataccaaaactacagcaaggtttttattggcttttgccagagcagagatgatctgatcctggttgtaaggcaacccatagctttttctgtcatttccttcactgtcctggaaatctgccttattaaggccgcctataaaaatcacataatctgattttttggccagttctacagcttctttcagtaattcagcttcggagcgggtatcttttaaatcctgaccggattttaccccgttatattctcctccgatatcccctacatatcctctggcatactgtacatcagcctgctttccaaatctggttttgattccgtccaaaggcagcgtctcatattttacttttaatgaagaggaaccaccgccaacagtcattattttgatggcattttctccgataactgctatctttttagccttattaagatcaacaggaagaacatttccctggttttttaataaaacgattccttcttcaccaatttctttggcaaccgctttatgctcttcagaagcaatatttccaaatggtttattacggttcattgtagttttataggcaagacgtagtaatctcgttaccttatcatcaagctcttttgtgccaacttttcctgctttaattaaatcaagataaggctttgccagataataattgtcataggcatttttcgttcctgctgaaagtccgttcgtccatgatccgaactccagatcaagaccattatgaatagcctgttccgtattgtttacagcaccccagtcagataccacaacgcccttgtaattccattctttctttaaaatatcatttaaaagatactgattctggctggcatactgacctttgtacatatcataagctcccatgatcgtccatgaatctccctctgttaccgctgctttgaatgcaggaaggtaaatctcatagagcgctctgtcatccacattcacattactggtatgacggaacatttcctggttgttcagggcaaaatgttttacagaagttgccacaccattagactgtacccctttgatgtagggaaccaccatctttgaggtcagataaggatcttctcccatatattcgaaatttcttccgttcagcggagttctgtaaatattgactccggggccgagaagaatatctttttttctgtatcgtgcttcttcacccagagctttcccgtagttccatgccatttttttattccatgttgcggataaagcggttagggcagggtaggcgatgatagaatcgttagtccagccggcctgatcccattcatcccacattacttcaggacgaactccatgtgggccgtccgtagtccagaattcaggaattcccaatcttggaacacccggtgagctgaatttcgactgtgcatgaagcatagccactttttcttccagcgtcattcttgatagtgcatcctgaatacgctgttctacaggtttggattcatctaaataaacgggaattgagttattggtctgagccatataagatgcagaaataaaggtgagtaaacttataatgacggttttctttaacataatgcctttcagtttgattaaaaacaaaagtaaagaaaatttttattatctcaaattgagaaaataaaaaattatgaataaaaaaactgcttgcttatttacagacagcttattatgaaatatttttaatgataaagaaaaaattgaagagaagttgtaggatagatataaaagtgcaaagggctggattcctacggaatggacaagatggatgtatagataaagcgtgtaatttgtccattctgtaggaatctacgctcttaccctcaaactctcaaaccctcaaactctccaactcatcaatcccatcctttcacagcacctcccttgaaaatttccttagctttcttttctacttcaggagactcataggctttcacaaagttttttactttctggctgtttttattatcaggtctcgctacaaccacatttacataaggtgaatctttatcttcaacaagaactccctgtttttgctgatctaaacctgcctgagccgcaaaattattattgattacccctacaacaacatctctgtcatctagaacccttggaatctgggctccttcaatctccataattttcagctgtttcggattttctgtaatatcagttacttttggaagaagtccgacccctgcttttaattttaataatccgtttttctgcaacagaagcaaagaacgtcctccgttggtagggtcattcggaataacaatcgtactgccgtcctgcagttcactgatatttttaatcttttttgaataagccacaatcggatacacaaatgtatttcctaccggtacaagattgtagcctctctgtttggattgttccgttaagtaaggaatatgctggaaggcattggcatcaatatctccgttagtcagtgcttcattgggaaccacataatcgttgaagggaataagttccacttccagattgtatctatctttagctacttttttcgccacttcagcaatttcctgttcaggaccataagtaattccaacacggataaaattcgggtcgtcctttcttccagaacaagcactgaatagcaacattcccgcagccaataaaccaaaaatttttattctcttcattctattttttatttaaatactattagggtaaaagataaatgaaattactctcaaaccctcaaaccctctcactcaaaattacctgtgatcaaacctttttgacaatctgtcgcccataaactggataatgaaaaccaaaagaaccagcagaatcaaaactgtattcataataacaatatcatatccgatatatccatactggtagcccacctgtccaagtccgccggcaccaacggcacctcccattgcggagtaaccaacaagggtaatcaaagtaatagttgcattgttgattaatgaaggaagtgcttcaggaagcaaaacttttctgataatctgtaacggagaagctcccagcgctctcgcagtctctataagtccatgaggaacctcaataaggctattctctacaagtctcgcaataaaaggtgctgctcccacactcagaggaaccaaagcagcattcactccgatagaagttcctgctaaaactctggtaaaaggaatcatccatacgatcagaataataaaaggaatcgcacggaagatattaacgataatagaaagtcctctatgataaaaagtattttccagcagctggccttttctggttaaaaacaacaggattcctaccggaagtcccagtacaaaaccaaaaaagccggataaaaatgtcatgtaaaccgtttcccaggttccttttgccaaaagggcaattaccgcgtcactaagcatatccttttactgtgttttgaattttattttgattgaaataatagatcgcctgttggttttcctccgtaccaccctgaagctgcagcagaagtttaccgaagttggaatctccgaagtattccacgtcagcttttaaaagtttataagggattttatattggttgtatagtgttgaaagaatttgttcaacactgacgttttcgttaagttctatttctatcagcggaaacaaaccgtctttcggttctttctgaagtctgctgatgagttcctgtggcagggtcatgatgtctgaatttataaattggcggatgatcgggttttctctgtctgaaataatctcgcttaatgtaccttttgttaataattttcctttgtcgatcacggcaacgtggttacataccgatttgatcacttccatttcgtgggtaattagaagaaccgtaattcccagcctctgattgatgtctcttaaaagctgaagaatagactgtgttgtagcgggatccagtgcgctggtggcttcgtcacaaagaagaagataaggatcattggccagggctcttgcaatagctaccctttgtttttgccctccggataggcttttgggataatcgttggctttatcctccagtcctacaatcttcagtaattcgttaacttttctgttgatctgatccttgctggtgtgatccagctccagaggaagcgctacattatcaaaaacagttcttgaagaaagaagattgaaatgctggaaaatcattcctatttttttgcgctcctcagccagctgtttggagttgagtgcagtaaaatcttttccgttaataataatctgtccctcatccggtctttccaatagattcactgtacggatcagggtactttttcctgcccctgaaaatcctataattcctacaatatctcctttctctatggtaagactcaccttgtccagcgctttaaaagactgttttttctggtgaaatgtttttgatatatttctgatttctatcattctgattttatatactgtttaaataggctgataaggtctgcctgttctgtttaaaaatctcctaattcttctgattttgaccttcgaccgttttgaaagtttgaaatacttggtcacattcgttaaaagtactccaagcaatatgacaaataaaccatacagctgacctccattgatgctttggtgggcaacaatccagcctgcaatcactgttacaataggattgatataggtatgggtgctcaccaaagcagccggttttacggacagaagccaaatgtacgacaaataagcgactatcgatccaaagaagatcaaaaatagcactccggaccatgcagataacggaaccgcagaaaccgaaaaaccagtccattcttttctgaaaaaagcaattaaaaaagaagccagtcccgctattataagctgttgcgcaatattcataaaggtagattgagacgccggatttttcttcgaatataaagagccaagcacccatgcaatagaacttaatcccaacaccacaaatgcagtaatgcgaagatttccatcaacggctgcatgggcttcattagcatgtacactgccttttaaaaagagtaccagccctacaaacccaataaccagtccgatcggaataaatttatctgaaaaataatacttccagtttcttctgtcgatggcaataaaccagaacggcccggttgcaatagaaattgcggcctcagaagccgttacatattgttctccccaggctacaaggccggttcctccggtaaggatgagaattccggtaatggcattttttttccagttgatgagggaatttgctttttctcctttagaaagaagatatccgatcatcagaattccggccaccagaaatcttaatcccgaaagaataaatggaggaaaacctttcaagccaaatgaaatagctaaaaacgtaattccccatatcacatagatatttgtaaacgccaatggaatcaaccatttgtttttagaattgctcatttttatgtttttaatgttgtgttcaataaaaaaggccctacaacgtggtagggcctttacaaaatatgtctaaataaaagtaaggtcaaccacagtattcctgatttacaggcatacagatatgcttcatcatttttttgatggtatgtttctttattgaattattttttaattctgccttcattttattttatttcctgaatacggttgcaaatatataatataatttttattagtccactaaaaaagtagacaatttagatattaatttattgttaacagtctaatttatttaaaatcaaattgttgtatattttgttttttagtgtttaaaaatgctttatgtagttttttcttatagttaaccgaaatttcattgaaattatacagccattggtgttgtggaaaatataaaataaatagggatttttgggaattgtgtaaatcttattctggacttatatattttgaaggaaaaggagaaattgtatttattaaactagttaaatgcacaggatgtctgttcactgtaatttagcatcaaaattaaaagacatggacaatagaatattaggtctgcaccatattacagcaatagcagacaatgcgaaaagaaatttagatttttatacaaaagttttaggcgtaagactggtaaagaaaacagtgaattttgatgatccgggaacctatcatttctatttcggaaatgaaaacggaactccgggaaccatccttactttctttccatgggaaggaattggtaaaggaaccaatggaagcggaatggctacccacattggctattctgtgccgaaaggaagtcttgaattctggaaaagccgtttgcaggattttaatgtcaatgtagaagaaggcgaagtatttggtgaaaagatgatctcttttacggatccggacggacttcagttacagtttatagaaccttcaggtgatgacaacagaaaagtatggacaactgatgatattaaggacgaaaatgcattgaaaggatttcacaatgttactttaaccctaaaaaaagcagatcctacgatcaaagttctgaccgatattttaggatatgatctgaaaaaacaggaaggggaaagatacagatttgcaaccgatgccattgataccgctaatctggtagatattattgaaaacgatagcattcctgcgggaagaaacgctgcaggaaccaatcaccatattgcattcagagtaaaagatgataatgttctgatggaataccgcgaaaaagctttatctgcaggattgagcatcactccgaaaatcaacagggattatttctattcactgtatttccgtgaaccgggcggtgttttatttgaaatcgctactgataatccgggattcacagtggatgaacctttgaatgaactgggaaccaacctgaaacttcctgtacaatacgagggaatacgcgagaaaatagaaggagtgcttccgaaattatcatagatcatcggcaggctctgataaagatgctaattttgaattaagaattaaaaacaaacaaaatggaaagaacagaaatcgtgttagaaggaagaaaaggagaaattcagcttttctcagatgatcataaagcaggtaaaatggatatttcagtcattggaaaaaaactgactgtttaccatacggaagtgaatccggaatatgaaggaaaaggctttgccaaaattttactggagagactggtatcttatgctagagaaaatgatttgaagattctgccgttgtgtccgtatgttcatgcacagttcaaacgccatccggaagaatataatgatgtctggctgaaggaagaactctaatgattttgagagctgggtttcgggatacgagtttataaattcgagtttgagagtgagagggtaagagggtttgagcgtttcgatcttataaacccaaccccgaatcccatcataataaccaattaacaattttatcactatgaaccttatcacaggactgcatcacgttacggcaattaccggtaatgcacaggaaaatatagatttttataccggagttttaggacttcgtttagtcaaaaaaacagtcaatttcgattactcggatgtctatcatttttatttcggtgacgaatacggcacaccgggaacaattatgaccacttttccgtatggtaaagatctgatcaatggaaggcatggtaatggaatgcttaataccacagctttttccgtttccatagatgctctggattattggatgaaccgtctggagcggtttaatattccttttaagcagccacagcaaagattttcagatgaagtttttatttatcttgaagattttgacgggctgggactggaattggtttttaatgataaggacgaaagaaaaggatattacaatggttatattcctaaagattatgcaattaagggaatccatcatgtagaaatctggcaggatgcctatgaaagaactgctgctctgcttacgacacagatggaccataaagtaatcaaagaaagtcctgacagactgagactgggaacagaaaatgtgccgggaaaatatgtagatttgctttctacgcctaatgccttgaaaggattggccggaagaggaaccgttcaccatgtggcttttgctactccggatgcggcatctcagcttgaaatggtaaagagattaaatgcatacggactggaacataccgaagtgaaggacagaaaatattttacctctgtctattttaaagagccgggcggtgtattgtttgaaattgccacttcaggtccaggattcgatgtagatgaggaagcggcatttttaggagaaaatctgcaattgcctctacagtttgaaaaaagaagagagcgtcttacagaagttcttcctgtaatcaattacccaacagaaaaattcagatagaaataatgagtcatattttaaatataaaaacagcaggaatacctttgagtcaggcagaaaaagctttgatcatgattcatggacgtggaggaagtgctcaggatatcttaagtttatcccagcatttgaatgtgaaagattatgcactgctggcaccacaagctttgaatcatacctggtatccctattcatttatggcaccggcagaacaaaatgaaccctggctttcatcagctctggaaatggttggcgaaacagtaaaagcagcggtggatgcaggaatcaaaccagaaaatatatactttttcgggttttcacagggagcctgtcttacccttgagtttctgtcccgtaacgctcagaaattcggtggtgcagctgctattattggcggagtgataggagataagattaatcgtgaaaattataaaggtgactttgccggaactcctgttttcctgggaaccagcaatcctgattttcatgttcctgtagaaagagtatatgctaccgcaaatattttaagagaaatgaatgctgaggtaaccgaaaaagtatatgccaatttcgggcattccatcaatcaagaagagattgagttgtccaacgcgattatttttaattaagtactttacctttgaattattggtaatttttgatcctctaagtgtttaatgaagtgaagattcctatggaatgataaagtatgcgcattatctatccgctcatattgtcattccataggaatctaacccaatgtataacttagcattcaatagcggcgggctttagcccgccaaacaaaaaaataaaaatcactggctttagcccaaacctaaataatccgaacctgagaactaacttctaacctctaatttctaacttctaaaaacatgcacgaacagttacttttaatactggggcttttattactcgttatgatgctggtaatgctggcgcaacggattaaaattgcttatcctatttttctggtgcttgccggattagggatcagtatgattcccggcgtacccattttaaaactggatccggatattatatttttaatttttctgccgcctcttttatatgaagctgcctggtatacctcatggaatgatttctggaaatggaaacgcaccatcagcctgctggcgtttggtctcgtatttttgacttccctggtggttgcctatacgtcacagatgctgattccgggtttcaccttggcattaggatttttattgggcggaattgtttcgccgccggatgcagttgctgcgactaccgttttaaaaggactgaaggttcctaagcgtaccatcgctatactggaaggggaaagcctgattaatgatgcttcatcattgattgttttcaggtttgcgctggctgcagtcatgacaggtgctttttccatgcatgaagcaacaggacagttttttctggtagcaggaatgggagtcgtggtaggaattgcgggggctcatattttctatgccatacaccgctttttacctacaacaccggcaattgatgctgctgttacggtgattactccctatattctgtttctttctgcagagcattttcatttttcaggagtaatggctgtggtgagcggagggctgtttatgtccttccgtgcgcatgaaattttcaaaacaggaaccacaagaatcaatatgacgggagtttggaataccctgatcttcgtaatgaatgctttggtttttgtactgatagggcttgaacttccggatattattaatggactgggtgaaacctcattaatggaaggaataaaatatggtttaatcataagcctgatcgttattgcagtacgtttgttgtggatctatcccgtagcccatcttccgagatggttcagtgaaaaggtccgtcgtgacccaagtccgggatggaaaaatcctttaattataggatgggcagggatgagaggagtggtttccctggctacagcactctcaattccggtcatgatgaacagtcaggaagaattccccatgagaaacctgattatttttatcacgtttgttgtcatttttgtaaccttagtgttccagggattgacattgcctctgattattaaactgacaaaaatcaaggaaatagatcctattcttccttctcacgagcagcaggcaggaattcagattaggttggataagctggccgcagatcagcttgacaaaaagtatactgaattgctaaacagtaataacctacttatcaatcttaaaaagacactggaaaatgatattaaagtccaccagaatcatttaagctccattgagatgtgtaccaacaggcagaatgatatggcagaataccataaagtaatgctggatatatttgcactgcagagaaaagaattgtttaaaatgaaacgtgaaaaactcttcagtgatgatgaaataagaaaagcagaatcacagctggatctgaatgaattgaagattacgggaaacagacatttgtaggatgacgagcgatgagggtttgagttggagagtcgggagggtttgagagttactaggagtggaggcaggtttcgaggttcggttattgagtgggagcatttggaagtaaaagtgtttaggtttctactgaatggacaaactaagcactttatttatccacacactaggtcattccgcaggaatctaaatcgtcattttaccttttatgtaaacaatataaactttaaaccctgaaccttaaactttaaaccttgaactttgaatttttaaccttaaacaaaatgaaaacattacattttttagtgattggaaagaatcaggagattcttgatacgttaaaaagaattatagagaataatgaaggttggacagcagaaatacaaagtgatgaaaattactgctatgactatataaaaaataatacggttgatattgtccttttaagctcaggcttagaagatgattttgagaaagatataaaagttttttgtgccggtttggataaagatgtgaaagtaattgatcattatggaggaggaagtggacttttaaagaacgaagtttacagtctttttcctaatttgcaggggtaaactctgcattatgtttgaaaatatcatcaaaaatattacccgtttcatttccattactcaggaagaagagaaagtttttacagatctgctggtttgtcagtcattttccaagaaaacagttttgttgagggaaggtgagatctgccagtttgaagggtatattcagaaaggatgtttgcgaatgtattgtctggatgatgatggtacggaagtgactcttctgtttgccattgaagactggtggatcagtgatattgcatcatttcaggaacagaaaccttctaaagtttttatcgaaacgttggaagattcggaaatctatatgctgaatccggcaacaaaagaaaaattactgcaggaagttccaaaattcgaaagagtcttcagaatgctggttcaaagaaatcttgccacccttcagagcaggttggtagacaccatttccaaaaccgcatcagacagataccttgaatttatcaaattatatccttccatcccgcaaagagtagcacaatattatatcgcttcttatcttggggtttcaaaagaatttgtaagcaccatcagaaagcgtcttgcctcaaaagaaaagtaagcttcatgtcttaaactctctgcttagttttgttaattcaaagatcaacagtaataaaacagtgagattcctacggaatgacacaattgaaataatggctttacccacacaatttgtcattccgtaggaatctagacaaagtctaagggtaaaaaggctcttacactttccaaaaaaacagcaatccactatagttacaatgccgaatacaaaaatatccggcatttttttttgttgcaaagtcatttattaaactagttaaatgtataggatttccgacatctctaaatttgtactattaaaatgaacaaacaatctgatatggacagaaaagattttttaaagaaaggattattgggaacaggaatgtttgtggcatcagcctctctggcaagtgctatgaaaaatgacatcgatgagatcgaaccattagaaccgatcggatataatcatcttcccaatacagaatcaaagataaaagaaaactctgtgatccacagagctgacacaagaggaaaggccgatcacggatggctgttgagcaaccatactttcagttttgccaattattacaatcctgaaagaatgcacttcggagtcctgcgggttttgaatgacgataaagtgaaagcaggaagaggtttcggaacgcatcctcacgataatatggagatcatcagtattcctttggaaggcgatcttgagcataaagacagcatgggaaatacagccgtaatcagaagcggagatatccaggtgatgagtgcaggaaccggaattatgcatagtgagttcaataaaaacagcgataagcttgtaaaatttcttcagatctggatttaccccaaaaaaagaaatgtgacaccgagatacgaccagatcactttagacaaaacgaaaggtcaaaatcagtttcaacagatcctttctcccaatgcagatgatgaaggcgtatggattcatcaggatgcatggttccatctgggaacttttgatcagaataaagaaaccggttatcggatcagaaaaaaaggaaatggagtgtatgttttcatcttgaaaggaagtgcggaaataggcggagagactttggaagaacgagatggattcggagcatgggatatccagaatctcaatatcaaagcccttaaagaaggtacggaaattcttctgatggaagtgccgatgacactttaaggttactaaaagtctttttaatggccaatgccattttaaaataaaagaaataatgaactagtttcattacatgagtcgtcctaaaataggttgacataaattaaacaatatttaatccggagagatattttatttcttcggattttttatgcactttatctggagtttgcatattaaggcttagatgtggtcttttactacttgagaaactattcttaatttaaaggctatactgtagtctttttgtgtgcgcttttctctttttaatacttgatctttcataaataagtcgattagttgtcaacttatttcaggacgagacaacattgttgatttagcctccttttttaagggggcttttttataaaaaatatgataacgattgcatatctgacaagtaatttttaaacgcaaagtttaatattcctttttttaaattctaaggaagcaaagttggaatcaatgaaattgatcctttctaagcttgtgtaatatcctttcgcttcatcagcgactttagtcgcaattctttgcctgcttaaataaataatagcatccaatttcctttgcgttaaatacttaaaataagttttgtgaagcttcatatctttagaacggccaaatctaatttcctctctttcagttctaagtgcagcaaacccaactgaatttgaaaagtcaaaaaaaatcccgatttttgcactccttcaataaacccgagttcatgaaattatgtattgccgagaaacccagtgttgccagagatatcgccaaagtattgggcgctaccacgcctaaacaaggctatatggaaggaaacggctattgcgtaacatggacgttcggacacctttgtacattgaaagaacctcacgactacggcccacaatacaaatcctggaatctcttttcactgccgattattcccaacagctttggaatcaagctgatcccgaataaaggtgtggaaaatcagtttaaagtcattgaaaaactagtcgaagaatgtgatgaggtcattaactgcggggatgccgggcaggagggagaactcattcaacgttgggtattgcagaaagcaaaatgtaacaaaccggttcagcgtttatggatttcttccctgacggaagacgcaatcaaagaagggtttgcaagtttaaaacctgcagaagattataaaaatctatatcttgccggaaacgcaagagcgataggagactggctgctgggaatcaatgctactaggctttttactaagaaattcgggggaaataaagcggtgctttctatcgggagggtgcagactcccacactcgcaatgctggttcagcgtcagaaagagattgatgcctttacgacagaagagtattgggaactgaaaaccagataccgtgacgtccttttcagtgcggcaattgatcgtttaaaaacgttggaacgtgcagaaaaaggattggaataccttaaagtcaatccatttgaaatcgtctctttcgaaattaaagaaggaaaggaaaaaaatccacgacttttcgacctgaccggacttcaggtggaagccaataaaaaatatggatattcagccgaaaatacgttgaattatgtgcaaagtctttatgaaaagaaacatgtaacctatccgcgtgttgataccacttacttatcagacagtttatatccgaaaataccagggattcttcagaaaatgtatccttatcaggagctgattgccccgttgctggaagctccgattccaaaatcaaaagccgttttcgatgataccaaagtaaccgatcaccatgccatcattcctacggaaattccgccttcacagaatttgagcagggaagaaaaactgatttatgatctgattgcaaaacgtttcattgctgtattttacccggaatgtaaaatttcaaacacattggtggaaggaaaagtaggaaccattcctttcaaaaccagcggaagacaggttcttgaagcaggctggagagccgtttacgccaaagagcctaaagaagaagcaaccgataaggaaaaagaaaaagaggaagaacagaccattcctgaatttgtcgtaggagaaacgggaccccacgatccgatgatccaccagggaaaaacaacacctcccaaaccatacaccgaagcaaccttgctgagagccatggaaacggccggaaaacaggttgaagatgaagagttgcgtgaaatgctgaagaataacggtattggaagaccttccacccgtgccaacatcattgaaaccctttttaaaaggaaatacatcgaaaagaaaagaaaaaatctgattgctacccaaaccggaattcagctgattgacaccatcgaagacgaacttttaaaaagtccggaactgacgggagaatgggaatctaaactccgtaaaattgaaaaaggcgagtatgaagccaatcttttcaaagaagaactgattcagatggtgacagaattgactgaaaaagtagtgtatggaaaaggaaaagtgatcactcttgaggaagaagcaaaagaagaagtgaaggagaagaaaaaaagagaacccgcacagaaaaaagaacttcagtcctgggaagaaacaaaatgtccgaaatgtaaagaacataatctgatcaaaggaaaaactgcagtcggatgttccgatttcaaaaattgcggctttaaaattacttttgagattttcggcaagaaattatccgataaacagcttttagacctggttttaaaaggaaaaacttcaaaactgaaaggcttctccgcacatacggaagcaattacagaaggtgttttgactttaagtgatgattttcaggtacagcttagctaatccaattttggcattatccaattttatcagagataaaatctttgcgcgttaaagcatacaattcaataaacaacatgcgcatttgcgttttctaaccaaactgcaccaagactatttcggaatgataagctgtatggatagactaaatgttgtattttgtcattccgcaggaatccagccttgtacttttctagctattgtgcaacaataaccattttctcggagataaaatctttgcgtcttaacagcatacaattaggtacacagtctgcacctttgttttttccaacaggctataccgtgattcctacggaatgacaggctgtatggatagactaagtgttgtattttgtcatttcgcaggaatccagccttgtacttttctagctatccggaaacaataaccattttatcggagataaaatctttgcgtcttaacagcatacaattagatacacagtctgtacctttgcgttttccaaccaagttatactgagattcctacgaaatggcaagctgtatgaatagactatgcgttgtatttgtcattccttaggaatccagccatacgcttttctattcaatctcaattctttattctatttgcaaatacttcatctgaagacgtaaaaattcccctctttcggaggggtggcgaaaattcaaagaatttttgacggggtggttttacgctttgctgaacacatagtcatcaagaaatcccaacattagctcttttctgcttgataaactgaaaaaccgatccaacgataaaaagcagaaaaataacaagaagtgtctgtccgatgatgggatctttaatatctttagccaaagggtgcccaatcggaatccttgtgaaagtctcattgatagtaggaactaatgacagaaaaaaactgaatgacagtaaaaaattctcaaaatacctggctttcctgctttcttttttattggcaaacagaaagtaggcagcagagatcaaaacgatgataaacagcgaaaatacatgcccggcattaaaaccgccgtgtttcgagattgctaatgctgtaagtgatgttatggcagtagcataaaaatatacttttcccgaccgctgagccaggtcaattttaccatatttgataaatcctgtaatggctccaataagagcagcgataccgataatggtatgaaaaattcctaaaactgatagattcatattgagataattttaaattatacacattttgtttctcgtgaaactgatggtacaaatttgcggcagaaatacagaaatggttttgtgatttggttcaagtatttgagagtttggttcagcaaaaaagcatctctttacaataagaaatgctggataataatatagaaatgtttttactatttttctttctgtttctggcggtatccggagggagaaatatgatatttatcgctgaagtttttggtaaaggtggccaggtcattaaaaccgcagtcaaaagcgatatcggtgatacgttcatctgatattaacaatagttcggcagccttttccagttttttatttctgatatagttggccggtgtatcatgatatagctttgcaaattctcttttgaaagatgatacgctcaggttgctttggtctgcaagctgttcgatcgtgagctgtgaaaataaattggcttcaataatttgcttaaaagaataagtggagggagagaaaagctgtgaaagaatcaattgaactgaatctgcattatgtgactgggccagcaacagcataatttcttttaccttaagaattaatatatcttcattaatgagtgaaggattttcaaagtaaaaaagcagtccttctacatatttttgaatcaggaaatcattatttattttcccgcttgatttgttagaaaccgtattgacaggcttttgcagcaataaaggcagctccctgtcatagattcttttcaggatatccgggtagaaagtaacgatgacaatcttgcagtcctctgattttgaatgctgaatatgttttccggcactgatacagttcagaagcagggaataatttgtggcaatattaaattcctgctcatctgttttatattgaaactcacctttaataacatacagaaaacaggcctgctccgcaaccggaaaatcatatctgaacggacctttcagatcaattttctggatcagggtttttccaaacaattcgtattttttgtaatcattcagcataattgatgagttctgttttgaagaaaaacaagtgaaagttaattaatttcatgaaataataaccattttatcggagataaaatcattgcgccttaaaaacatatgacttatgaaataacatgcgcctttgcgtttccaaccaaactacaccgggattcctacggaatgactagcagtacggataaactaagttaagtgttgtattttgtcattccgcaggaatccggccttgtacttttctagctatcctgaaacaataaccattttatcggagataaaatcattgtgccttaaaaacatatgaattgggaataacctgcgcctttgcattttccaaccaagctatacctagattcctacggaatgacaagctgtacgggtagactaagcgttgtattgtctttcctttactgaagttgtgaagttccaacattggctttttgcttcttaaaaattactcttttcattctttactatttaaatcaatgtttaaatttacatacaaattcaaattatgacaccagagaaaagaaaactcatcacagacagcttcaaccgttcggaaactttacagttttataaagcagaactgctggaagtagaaaccggttttatatccatgaaaattcctaaaatggaaatgatgaccagaaaagccggaatgttcaatggggcaatgattgcctctttagtggatgtttcttcaggatacgctgctgtgagccattatcctgaggactgttatgtagtgaccgttgagctgaaagtgaattatcttcgtcctgcaatgggagatgctctggtttcaaaatcttatgtcattaaaggtggtggaaaaatcattgtggtgaggactgaaatctatgttcagactgaaggctctgaatcagaaagtcatgtagcgacttcattagtgaccatgatgaaaataaaataatatattaagcgaaataaaagacaaaatattccatcaataaagggttttaaagaattcttttttccggaatggaatggcttttgctccacaaaccccataaacattaaaaaatatcacaatgaacttaattatccgactatttattacagcgattgtcgcttaccttttaaccaaaatcttacctggggtacattttgaaggattctcttcagccattatctttgctattgtgcttggggttcttaacatatttgtgaagccaattttaagtctgttcggtcttccgctaacgattcttactttaggattttttgccctggtaattaatgcagcaattgttctgattgcagactatttcatagatagtatggtcgtagatggcttctggtgggcatttattttcagtatattactgtcaattgtaacttctctggcaaactcaatgttctcagatggagattaattaaaaacattgcatacctaaataaaaatccgctcaacgagcggatttttttatttttgataaacttagataaaacaggattccgctcgaatctgtcgttagctgtgaaaaaagaatgagaacacaagaaatgaagaagtaaggagaaacttttttatagaagggggttattagtttgttttttataaattaataaagtttacctgttaataaatcacctggtttaaattttaatgttaattctttcgtccgtttttattttaaatattaactttggcaatctttgaatttaataaaaggatgataaaaatcagctgattttttacatccgttaaaaaatgaatatcaacatatgaaacttaagtacagtctgctggctttggcagctccgcttttaatgaacgcacaacaagtaatgacgcctgaaattctttggactttgaaaaaagttggggtacaggcagtttcaccggatcagggatcccttatttataaagtaggacaggtagatctgaaaacagagaaaacgaaaaatgagaactattttctgaatgttcttaatcatcagtcttccaaaattgatttcggtaaaaaagcacttattcagtgggataaaaacgggatttatgctcaggaaggggataaaatctatctttctaaagatgccggaaaaacatgggcagaattctatactattggagaagcagataatattgtcatttctccggacggaaagaaaatagctttcagcaagcaggtgctggtggaaaaagtaatggggaaagacaaattcagtgatactccaaaaaccacagcacaggtttacacagacctgaaccacagacactgggattacttcaatgaaggaaaatacaaccatgtatttgtagtgaacgcttctgataaagtagaaggagctaaagatcttctggaagggaaaacatgggattccccgcaaagacctttcggtggagctgaagactttatctggagcccagattctgcacagcttttatatgttacaaaacctaaaagcggtaaggagtatgctaccagtaccaataccgatatctttgcttacgatttggcatcaggtaccaccaaaaatcttactgaatccaacaaaggatatgatgtaaatccaaaattcagtccggacggaaaatctctgatctggcagagcatggccagagacggatatgaagcagataaaaatgatgtgaaaatcctggactggaagtcagggaagatcacaaatcttacttcaggatgggatgaaagtgtttcaggagatgtgctttggggagcagattcaaaaacgatctactttacggcagcgttcagaggaacaaaacagcttttctcactggattcaaaaacagcaaaagtacagcagatcaccaaaggagattttgacgttaacgaaatctttacagacaacaaaacttcacttttagtaggaagaacagatatcaaccatgccacagaattattctctgtaaatattaaaaatggagaaatgaagcaggttactgaagctaacaaagaaacatacgctaagttggctcaggggaaatctgaacttaaaatggtgaaaacttcggacggtaaggaaatgggagtttggttccattatccgccgaactttgacccgaataaaaaatatccgactttagtgtactgtcagggtggtccacagtctgctcttactcagtttttcagcgtaaggtggaactttgccctaatgacagctaacgattatatcgtggtagctccaaacagaagaggtatgccgggctggggaacaaaatggaatgaagaaatttcaagagactggggtggacagccaatgagagattatctggctgcaacagattttgcgaaaactttaccgtacgtagatggtgacagagtagcagcagtaggagccagctatggaggctacagcgtatttatgctggcaggaatccatgagaacagatttaaaacgttcattgctcatgacggattatttgatatgaaatcatggtatctgactacagaggaactttggtttgcaaactgggatcttggttcaccatgggaaaagcctcttccaaaagcatatacagagttcaacccaagcaactttgtagataaatggaacaaaccgatcatgatcgttcagggtggaattgatttccgtgttccttacgagcagggtcaggaagctttccaggctgcaaaattaagaggattaaaatctaaactggtatacttcccgaatgaaaaccactgggtacttcatccacaaaacggactggtatggcagagagaattcttcgactggctgaaggaaactttataaaacaaaaaattaatagaaacgggctttagcccgtttttttatgattaaaaattccgatagctttagcaaaatcctcaataacttcctgcattaagctcccagcttccagcctgataaaagaaaataaaatctctatatttgaatatgcaaaagcgtatttcttcatttccacctattattgatgctcagtctgaaattctgattttaggatcaattcccggagtgaaatcattggaaaagcagcagtattatgcccatcctcaaaataaattctggaaaatcatttttgaattgctgaatgaagattttactgatgattacatccaaagaattgagaccataaagaaacatcatattgccctttgggatgtcattgattcctgtgagaggaaaggaagcctggattctgaaatcaggaatgaagaagccaatcagattgctgaactactggaagaacatccgaacatcaaagcaattttctgcaatggtggtaagtcttacaaaaacttacaaaagctgctgggaaaaaattataaattgcccatctttcaattgccctccacaagtccgcttcacaccgtttcctttgagaagaaactggaagagtggaagaggatattggagtttttggtttgagaatttgagcgtgggagagtttatgagttagagtattgaaattgtaaacgtatagattcctacggaatggacaactgggacgctttattaatgcatacactttgtcattccgaaggaatctaaatatagaatgcaatctaaataaaaatcattcattctctaaatattcccttaatccttttaataattccagctgatttttggtacggtctaaattatgttcaggatatttcgtagcataataaatactgccattcagataatccgttaaaaaacgaagttcctgaatatagatagcgacctgtgcggcgtagtcaagattctcagtttcagctggggtcagtttatcttttaaatggaacagaaacccttcttttaccgctttatacatttcagggttgaagttatttatggcacttccgtcatcttcatgggatgtattggtataggattgaatcattgtcccgaaatcatacaaaatagtagaaaccatcgtagtatccagatcaattaccgctaaaggatgatgctcctgatcgaagagaatattgctgattttcacatctgcatggataattcttttaggaatatgaccgtttttctccatctctatccattgatcaggtaaagacagaaactggttggtgatttctatttcagcttttgcgttttcttttaaatggggtgctgcattttttagcgagcccttatagtctgcaattcttttttcaaaattgagaaagcctggaatcggatcttcaatggcaggcagcttttccgtattatttacggtgttaaggaaataactgaaagttttagccgcttcaaaagccgtttgtaacgatggagcggtaagaaaggtaacactgttttctataaaattgagcatgcgccatggatggccatccgcatcttttataagaattttatgggttggtgagaggataggttcaataatttcaaactgatagttattggccctgagaatgtcattgatcattaaatgattattaacgatcacctccggctgtctgaacacatgatggttaattttctggaggataaactttttcccctgatctttgtcttccagaaggtaagtggtattgatcagtccgtcagtaacaggagtaagatcataatgatctgtaccgataaattcaaaaacaatatcgtttagctccataaattttccgggtatctgttgttgctgatctctgaaatcagaaaatctttaatatcctttttatcatcggcatatgtaacgcccatccattgagaaggagaagcttttaccttcacctttaccctttcttcgtccatcatcctctgtacagcagaaggaatataaaattcctgtttgggcagagggtcagattcaataaaatcatagaaataagcttccagataacagaagatatgaggatggaaaataaaaaagttcatggataccagtgcttcaggatccagttttatattttcgccgtttttaatgtaaacaatagagttatttattctttgaatagaagtttgttcctctattctgatcaggtaattttctgaatcaagcgtacatattcctcttgctacagctccgttaccgctcaatgttgtgcccacaggataagcaatcattcccagctgtgtatctgaaatatgatgctggttgatttcatgagcagccagctgataggcttcttttccgtaaaaatcatccgcattgatcatcacaaaaggctcctgtatcgaatatttggcacagagaacggcatgagcagttccccatggtttttcacggtctggataatcaaaaccttccagtgaaataggaatgctgtctatctcctggtatacccaatgcagctcaaaatttttagtttttgaaatatggttgagtctgtcaatataactttcgggaatcagtttgttgacaataataacaactttgtggaaacccgcttccagggcatcatagatagaatattcaagaatcggggagccgttaccgagtattccatccacctgtttaagtcctttgtacctgcttcctaatccccctgcgagtatgagtaatgtcttcttagaactcatcggtcattccaaatacaggtttacgggttttccattttccgttggtgaaatcagggatgtcaactacctgacctcctttggcaatagactcttcactcaatggggtaattgaataccacagcgccagatcgtatacatccatagggaattctatatttcgtttgatacattctataaaagtattcatcacaaagaaatccattccaccatgtcctgctcctgcagcagtgctttcaaacttcttccatatcggatgatcatattctttcatccatttttccgtattgtcccagcggtgggtatgattcattgttttttcaaaataaatatgtccctggttaaaatctccccatccgaaatcctgccacaatccctcagttccctgaaccctgaaaccaagatcataaggtctctgtaaacttgtatcatgagtaagaaggatggtttcgccgttggcacaggcaatctgggtggttacaatatctccctggttgaatttgactttggcgttcggatgattttctccaccttttggatgctcaacaatgtatttatggagtcctacagattttgaagagaatgaagacagtttggttaaacggtttcctctgttgatatccatcatcatagcaaccgggcctaatccatgggtaggataaagctctccgttacgttttacataatgttcggttctccattttgcttcactgaatcctttttctccgaattcagcaccggaattgtatggagtaactccgtcattgaaaagaacacctctcagatcatgctgatagccgcctcttccatgcaccaattccccgaacatccctttacggaccatgttcagaatagccatgatatctcttcggtagcaaacattttccatcatgaagataggaactttcgtttcttcgtaaacctttacaaattcccagcagtcctgaagctttatggctcctgaaacctccatgcccacaatttttttagcacgcatggcctcaacaccttgtgtaagatgccactcccacggtgttgcaataacaacggcgtctattgtttttaattttaaaagattccggtagtcatattctccgttggaaaactcctgagcagccggtttattattgtcttttagtattttttgagacgcggcaagcattcttttctccggatctgcaaatgctacaatctctacatcattacgttttgccagtaattttacatgttcctgcccacgaagaccgacgccaataaaaccgacgcggacctttttatctgttttaaaatcattggaataggcaaataaagaattgggtaaaaccagtgccccaaagcctgctaaagctgctgtcttaagaaagttcctgcgggagttgctattgtccatctatttttttcctaaatatattaaaacttttgtaaatggcgatggataaggggttgagatttgattggagagttagagaattgagggtttgagtgcttgatggaatataaaatctgaggagcgcgggaagaagcagaaagaagtttccataatgtaattattacggaaactccggatcacttctaagttgtttgtcttatttttccatatagtatacctcttcataaggctgaatcaatacccatccatgtcctgagaatttcatctggaactcttcgccgcttcctcttccgataaggcttttgaaagaaacattggttttcagttccgggcttagggttccggaccatgcaacagtagcattcggatctgtaaatacgggtgtgtcaggagttaccaacaaggtcaatggatctccgtgcgtggtaatggcgatatgtcctgttcctgaaagtttcacctggaaaagaccaccggacatcattcctgcgatacttttcagcatggtaatgtcactttttacgctttgctcatgagcaagtacgtcatttccgtttacacaaacggattcattattcagataaaggatgcggactttcttcccggaatccgcaacatataattttcctgtaccttctgctttcatcagcctggctccttcaccactgatagctttctttaaaagatttccaattccgccagccagcattccctgtctttcaaaattgatgtttcccacatagcttaccatgcttcctcttttcgtccataccgcttgattatttagattgatttccagaaggtgttttgtttccagctcaaaataatctctttgctgtggattttcttttgtttcgttaataaatgcttctattgaatatttgctcataatgatatttttacttttatagtgctattattttagtttgtcggattgataggctcttttgttactacagattatccaattgggaatgtttgccaggtacgtttcatcttcttcctgttgtcttcattattttttattttagtttttaaataatttggctttttcagttgaatatttcaaatgtataacgatcaggatacggattatcaatgaagtatatttgcttaaagattccatattgaattttaattttcccaaaaatactctttttgtgccttgaaactccccgtaaaatcacggttttatatctgattgtaaataatacttgacaaaggggtattcaatgtcgtatatttgcactccgaaaattacaccttgtaatttcagtaatttttaaaccgtaatttaaaaaatgaaaacatcagattttaattttgatcttcctgcagaattattggcagaacacccatcagagcacagagacgaagcaagattaatggtacttgatagaaaaacacagactatcgagcacaaattattcaaagatgtagtggattattttgatgaagaggatttgttcatcttcaacaatacaaaagttttccctgcacgtctttacggaaacaaagaaaaaaccggagctaaaattgaagttttcttattaagagagcttgataaagaaaccagagtttgggatgttttggtagatcctgcaagaaaaatcagaattggtaacaaattattcttcactgaagatgaatctttggtagctgaagttattgataacacaacttcaagaggaagaacattaagattcttattcgacggttcttacgaagaattcagatctaaattaaaagaactgggagaaactccgcttccaaaatatatcaaaagagctgtagagcctgaagatgcagaaagataccagacgatctacgcaaaagtagaaggagcagtagctgcacctacagcaggtcttcacttctctaagcatttgatgaagagattagagatcaagggaatcaattttgctgaagttacgcttcacgtaggattgggaactttcaacccgattgaggtagaagatctttccaagcataaaatggagtctgaagagatcatcattgatgagaaaaatgctgctattatcaacaaagcggtagaagctcacagaagagtttgtgcagtaggtactactaccatgagagcattggaaacttcagtttcttcaaataaaaaaatctctgcttttaatggatggacaaataagttcatttatcctcctcacgaatttggagtggctaactcaatgatcaccaacttccacacaccgaagtctactttgatcatgatgattgctgcatttgccggaagagatttcgtaatgcacgcttatgaagaagccgtaaaagaaaagtataaattctattcttacggtgacgcaatgttaattctataaaaaaagtaaaaagagccaagttaaaggtaatacaagtagagatgagacaaaatgatttacttataagaacttttacatttggggttgattgtcttaagtttttaagaacgcttcccaatgattctgaaagtaaattaataagatttcagctcggaaaatcagctacttcaataggcgctaattatgaagaatcccaggccggatcttcaaaagctgactttaaaaacaaagtgaaaattgctttaagagaagccagagaaagtcatttttggcttagggttttagaaggattagatggttatgattctgaggaatttaaagctttattgactgaaagtaacgagttaaaaaacattttggctgcaatagttaacaatactaaagtttaaactttttactttaaacttttaacttggctctttaatattatgaaagatatccgtacattatcattagaccagcttaaagactattttgtgtctttaggagaaaaaccgtttcgtgcgaagcaggtctatgactggctatggagcaaaaacctccattcaattgacgaaatgacgaatctttcaaaatcacttcgtgagaaaatttcggaagaatataccattaatcctgtttccgttgaccttcttcaaaaaagttctgacggaaccatcaaaaacggagtgaaacttcatgacggactgatggtggagtctgttcttattcctacagaaacaagaactacagcctgtgtatcttcacaggtaggatgctccctaaactgcgaattctgcgctacagcaagactgaaaagaatgagaaaccttgaagttgctgaaattgtagaccaggttgccctgatcgacagccagagcagaatgtatttcgacagaccgctttccaatatcgtatttatgggaatgggagagccaatgatgaactacaaaaacgtagtggaagccatcaaaaaaattacccagccggaaggattgggaatgtctccgaggagaattaccgtttctacatccggtatccctaaaatgattaaaatgcttgcagatgatgagctgcgtgtgaagctggctttatcccttcactctgccatcgaatccaagcgtaatgagatcatgcctttctcagataaatttccgttgacggatattatggaggcgcttcagtactggtaccaaaaaaccggttctgttatcacctttgaatactgtgtatggaaagggatcaatgacggtgatgaggatatcaaagctctaattaaatattgcaaacaggttccttcaaaagttaacctgattcaatataaccctatcggggatggaaaatatgatcagtgcaataaacaggcggaagaaaactatatccgtcagcttgaaaatgcaggaattaccgtaatggtcagaagaagccgtggaggtgatattgatgcagcctgcggacagctggccaataaaactacagattaaaatttccttaaaaaaagtctaaaactttcttaaaaaataggttaaaaccctacctttgcacaaattattttgtgatgatggattttcttatgagtgaggacgggctggaaaatgtatatgcatgggctatcccattgcatgctacagttattttagctgaaatgatttacagccacgtttcagaagctaagttatatagtgggaaagatcttgcgaccaatgtttatcttgcattgatgaactttggccttgaccttatcatgaaagcatttgccatgggtgtaatgtttttcttttaccaccacaggattttctcatgggatcttagtatctggtatttgctggcttgctttgtaatcacagattttgcctattatgtgctccattatgtagatcatcgttccagagcattctgggctgttcatattacccaccacagttcagaatatttcaatcttacaacaggattcagaagccctgttctgcagcctctttacagatatttatatttctcaccgcttgcctttttaggattcaatccgtggcatattatggtcgcttatgcaatcgggcaggtgtatggaacatgggtgcatacccagacagtgaaaagtatggggtttttagagcatattctggtaacgccttctcaccatcgtgtccatcatgcatgtaatgtaaaatatcttgataagaatatgggaatgtgcctgattatctgggataaaatattcggaacctttcagaaagaagaccccaatgtacctgtgaaatacggaatttatccaaagatgccggataacagaccagatacggttcttttttatgaatggagaaaaatctggaaagaccttaagcaacccggattaaaattcacagacagaatcaattatattttcaattcgccgggatggaggcatgacggaaccggaaaaacagtaaggcaataccagaaagagtattttgcaagacaggctaaaagaaaagaacaacagcaaaatcagaaagagcagaaaactgcttaacttctgatttaaatcaatagaaatctaagtgaaaaacgggctatcttggtccgtttttctgtttttagaattaacattcaaggcttttagattcatacaaaagtgtatggatggataatgtgcttagtttgtccattccgcaggaatctagactctcacttccaacttgatcgccaaacacgaatctcgaaatctcgttcaggctctcaaatactcttaccctccaactcaccagctcagaataaaaccctaattttgtcttatgaaaaaattctttctgattatcaccctgatcattatccaatctgctttttctcaacagacagactttctgaaaataaaaaaatacagagtcaattatctcaatgataagattgaagagacttcaggactgaatattttaaacggaaaactgtatacattcaatgatagtggaaatcctgccgaactttttgaaattgataaaaaaagcggagaaattatcaggacactgaaaaccaatttaatcaatacagattgggaagcgttagccaatgacggagaaaatttttatataggagatttcggaaacaataccgggacaagaaaggatctgacgatttacaaagtcccatacgaacgtctcgatgagtctaatgccattaaaattccaggttcggaaagagcccttgatggaacgaaaattctgttttattatcctgaacagactgagttcatttctaaaaatataaagaatgatttcgatgcagaggccatgatttatctgaacggaaagctgcatatatttaccaaagaatgggtttcaaaagcaacctcacattatatcgtagatcctgaaatctcagaactgcaaaaagcagaaaaaatagaaacctataaaactggttttgttgttacagatgcctcttattttgataaaaagctttatctgataggatataccaggaaaacagaagtctttttagatatttttacagaaacggaacccggaatttttttcaaagaaaagtccaagcattattacctcggaaccgcatttgcactggggcaaattgaagggataagcgcagacgaatcgggaatttatatttcaggagaaaaattcagatctccgttgggaagtgcaaaaccttcattttattttattccgaaagatcaactcaaagattaattttatcttaaaattgagcgaaaaaaattatctttgtgagaattaataattattcacccagtatcgcagattgtggcaaacattgtagaagagattaaacgaccgatcaatgatgaaatgaaactttttgaacagaagttttatgaatcaatgcagagtaaagtagctttattggataaagtaacccgttttattgttaccacgaaaggaaagcagatgcgtcccatgttcgtatttctttgtgcgaaactggtgggtgaagtaacggagaagacctaccgtggtgcttctatgattgagctgatccacactgccactctggtgcatgatgatgtagtggatgaaagttttaaacgtcgcaatttcttttcaatcaatgcgttgtggaaaaataaaatagcagttttggttggagactatcttctgtcaaaatcagttttattatctacagaccataaagattatgatttgctgggagtgatctccagaaccatccgtgaaatgtcagaaggagaacttcttcaactggaaaaagccagaaaactggatattacggaagatgtttactatgaaattatccgtcagaaaactgccacgctgattgcagcctgttgcgaaataggggttctttctaacaatgcggatgaagctttagccaaaaaaatgatggatttcgggacctttacggggatggcgtttcagatcaaagatgacctttttgattatttaagttcaaacgtcatcggaaagccggttggaattgacattaaagaacagaaaatgacccttccattaatccatacccttacaacagcgaacgagaaggatagaaaatattatttcgataccataaagcgttataataacaatccaaaacgggtaaaagaacttatagaatttgtaaaaagctccggcggtctggaatatgctattacagttatgaaggattttcagcagaaagcaaaagatattctaaatgaatttccggattccgaagcaagaaaatcgttgcatattatgctggattatgttattgaaagaaaattctgatagtcaccttttttatcaatcctgattttttgttctcctatttcctttaatcctgcatggtgtaacaggattcgtattactgaaaagaaataaccctgtttttcaatgatccaatgagttgtgattatttttgttttttgtaatagtaaattgctgtaaattaatattttgcataaatcaactaaaataattgctaataattcattgatattcaatataaatgttgtttatttgttattacaaaaaacaacaaataatgaaaaaaatcaaaacaatgatgatagcatgtgctatcagttcaagctttcttgcgtatgcacaagtcggaataggaactcaaaacccccagacaacttttcatatcgatggatctaaagacaatcctgtgacaggagctccttctgcagctcaacaggataatgattttagtgttacttcaggtgcaagggtagggattgggactgttgctccgaccgaaaaactggatgtagcatctggaaatgcccgtattcgtaatattaatgcgaatgtaggtattggaggaactgacagggttgttgtagctgatgctaccggagtactgaagactatcgattttactgcttattcactgtttcatgcgcgtttagcagctaaccagaacatcagtgcttctaccattacaactttattattttccacaccagtagcaacttctccgttctattcctataatgcaggaactggagtattaactcttaatcaggccggaaattatctggtaaccttacaggcaagttttaccaatatgcctgcagatagtcagctgctcatcggtataagacctgtaccagatgccaattacctgggaaggggaagtcattacaatgcaattgcttcttcaggaacggtaggtgagctgatgaattatacaactgtaattgttgctcctacagcaggctatcagatccgttttaccgcagctcccaatcaaaatgctacgattattgcaacagaaacaggatctacaggaagtggaaatgttaccaatgtaacagtacagaagatataattctatctttacattacaattaaaacaagtaaagtgttttgtatatgtttttaggaagctgaaagtgtatacagaacactttctttttatattcaaaatccaataagagttaaagatcacaatattgccggattttggtgcctagagatctttatttattttccggattaggcaattaagtgaaaattttaaattaaattattttcagggttacaataataacggccagaactatacaaaataaagcgattaaaaataaataatccgcaatgttctcaaacgtatattcccgcttttcgctttttgttctgatggccaggaaggaaaagaagcagctacaggcaaaaaggatacaggcaaatccagcaaattcgtccaaatatgtactctgactgatcttagagatttttaatgaggtaataataatcagtgaaaatcctaaaagattgctggatgcattcaaaatgtgaggcgactttttttccatcttttacaatttttctcaaaataaagcacaattttttttattatcaaatttttaaaaaagattattaaaaattaaaattaatttaaaaagtgtatattagcaaaatacttgaagaataaaaacttttttacttagctatgcaaacaacctatattgaaacacagcaaatatcctttcaagattttaaaaatcagatacttggagattacaggttaggaaggatttcccgtgaaatgtcttatcttggaagaagagaagtgctcacaggaaaagctaaattcggaatttttggggatggaaaagaacttcctcagcttgcaatggcgaaagttttcagaaatggagacttccgttcaggatattacagggatcagacttttgcattggcaataaatgcacttacggtagaaagtttctttgcacagatgtatgcagatacaagtgtggaaagagaacctgcttcagccggaagacagatgaacgggcatttcgcaacaagaagtttaaatgaagacgggagctggaaagatttgacagctcagaaaaatatttcttctgatatttctcctacagctggtcagatgccaagactactaggattggctcaggcttcgacaatttataaaagtgtaaaatttgacgggtcagaaaaattctcaagagaaggtaatgaaattgctttcggaaccattggagatgcttctacagcagaaggacatttctgggaaactcttaatgccgcttgtgcactacaggttcctatgattgtttcaatctgggatgacgggtacggaatttcagttcctaccaaaaaccagagagcaaaagctgatatcagtgaaatgttaagcggtttccagagaaaagaaggggagaaccagggatgtgagattatccaggtgaaagcatgggattatcctgcattactggatgcctatgcaaaggcagaacattttgcaagaacagaaagtgtaccggtggtagtgcacgtagttgatgttacccagcctcagggacactctacttccggatctcacgaaagatataaaaacgaagcacgtcttgcatgggaggctgagtttgacggattagtgaaattcaaagaatggattcttaattattctattgaaattgatgggaaagaagaagtaattgctactgctgaagaactggacgccattgatgaagaagctaaaaaagcagcaaaagcaggtcagaaaacagcatgggaaaattatcagaaagccatttcagaacttacccagtctcttttacctttagttgaaaatcttaagggacagaatgctgaagtggaagcttatattactcagttcaacaagttggtttcaaaagcgaaaaaagatatcttccacctggtaagaaaagcattattggcgacaagaggaacaaactctgcagaaagagttgaactgatgcagagatacaatgaattggctgctgttgaaaaggataactattcttctcacttatattctcagtctcaatggaaagctgaaaatgttcaggaaatcaaacctgtgtattctgacagttccgaagatgtagatggaagagtagtgatcagaaacaacttcgataaaatttttgaaaaatatcctgaaactttaatctttggagaggataccggaaacatcggtgacgtaaaccaggggttggaaggaatgcaggaaaaatatggtgctttacgtatcgctgacaccggaattcgtgaagcaacgattcttggacagggaattggtatggcgatgagaggtttaagacccatcgctgaaatccagtatttagattatgttctttactgtttacaaggaatgagcgatgatctggcaacggtacactacagaacgaaaggaggtcagaaagctccattgatcatcagaacaagagggcacagattagaaggaatctggcattcgggttctccaatggcagggatcctgaacctttcaaaaggtattctggtattggtacctagaaaccttacaaaagcagcaggattctacaacacgatgcttcaggctgacgaacctgcaatcattgtagaatgtctgaacggatacagattaaaagaaaagcaaccggataacttaggtgaattcacggttcctgtaggtaaaattgaagttactaaagaaggaaaagatgttactctggtaacttacggttctacatggagaattgtgactgaggctgccaatgaattggagaaattaggaatttctgcagaagttatcgatattcagtcgttgattcctttcgatttatcccacgaaattgcggagagtgttaagaaaaccaacagattagtggtgattgacgaagatgtggaaggaggaactaccggatacattctacaacagatccttgaaaaacagaaagcattcagatatctggattcaaatccgttgacaatctcagccaatgatcacagacctgcctatgcaagtgatggtgactatttcagtaaaccatctgcagacgatatggtagaaaaaatctacgctatgtttaatgaaacaaatcctcagaaatatcctgcgatattctaattgggatttcagataaattttgaaaccgcttccttttgggagcggtttttatttgttaatcctcttcagtcaaagtaatttataatgattttttttgcaaatttgtatcagaaagattttggtgatatacttaccttttcgaaagtgctcaattatattaaatataaaaatgaaaaaaataacttcatttttgaagtccagaaaatgggcactcattatttcgatactgtatgtaggaaccggaacattagcagtatgttcagcttacggcagtgatccattttacggtgaatggactttatatgccttgctgataacatttcctgtgtcagttttgagctttgtctgcagatatactgatcccagtatatggcccgctttattgattcagtttatgatgtttttaagcacattttttgttttatccttatttataaaaagtaagccggataattagaaatgattttcagttgttttaaaaagcaaaaaactattaaacattgacagcctttttatttttcacattctcatttaaaaaaacacagtctttatcatcatgtgatcccttcacctgatattttgcctcccattcttccagcaaatagagaataggcagcaaagccaaacctttttctgtaagtgaatattccacacgtggaggaagttctttaaactcttcacgaatcacaagtccatcagtttccatttctctaagctgatcggtcaataccttcctggaaatgacattaatgcgtactgccagttctccaaaacgtagcttcctgtctttaatcaccagaacaataataggcttccatttacttcctaaagcggccattgccttcccaagagggcagctgtattgcattaattcattctttttcatagagagatctttattttaaaagacatatgagatcatgtttcatatgttactttgatgttactaatgtaagttactgcgaagttaccactatttttttaataaaagatacaaaagtgaactattattagttactttgtgtaacaattataaaatataaatttaaatatgaacacatcatcattatttaaaccgtttcaatataaaaatctacagcttaagaatagaatcgtaatggctcctatgaccagagcacagtctgacaatggagttcctacgcagaatattgcagattattacggaagaagagcagcttcagaagttggattgattctttctgaaggaactgtgatcaacaggccaggatcaaagaatatgcagaatattccggatttttatggaacagaagctttaaacggctggaaaaatgtaatcgatactgtacatcataacggaggcaaaatgggacctcagatctggcacgtaggagatacaagaatgtctgaagattatcctctggttcctatggaaaaagcttctacaatgaccatcgaagatattcaggataccattgcacagtttgccgcgtctgcaaaatccgcgaaagatcttggtttcgattgtgttgaaattcatggggctcatggatatttgatcgaccagttcttctgggaagtaaccaatacaagaacagatgagtatggtggtaaaacactaaaagaaagaagcagattggctattgatgtcgttaaggcgatcagagcagcagtaggagaagactttaccattatcatccgtctttcacagtggaaacagcaggattataaaaccaggctggcattcactcctaatgaaatggaagactggttattacctcttaaagaagctggtgtggatatttttcactgttcacagcgtcgtttctgggaacctgaatttgaaggttctgacctaaattttgccggttgggctaaaaaaattaccgggcagccaaccattacagtaggttcggttggtttaaacggagatttccttaatgcttttgcagggcagggaacagaaaaatcagatcttacggagctcatcagaaggctggataatgaggaatttgatcttgttgccgtaggaagagctattcttcaggattaccaatgggtacagaagatcaaagacggcaatacagaagctcttcttgatttctcagcagaaagtatgagcgttttattttaatatcaaggaatgatgtttcgttttgcttgtcaatttttaacagcataattttttggctagcgaggtagaattatcgactcaaactggtattaaatcagcataattcactttattttatatttaattttcacctatttattaaagaacccgatttcagaacttctgaaatcgggtttttaacagatttaaatatctaaaactgcccgtaaaatggcagaaatgattttcttataaaccaatattcttagttggctttagttgcttcagaatgcttttcgggatagcatttttgtgaacaaggattgctgttgatttgtattcaacataaggtcttgttacgtaaatatatcctgcgaaatcattggttactccccatgaattcttcaccatataatattctttaccagtctggtcttttgccagtcctacgatatgcataccatgatcatccgttgtagaaaggttgttaagcgctttctgacgcatgtcttcagtaattgttttatcttttttaggctctgtaaacaaagtctgcttattctctgcagtaatttggtcaagatccatatccggaacgtaagctacaccgtttttataagagaagtaaggctcggaaacgtcagttgcccaacctacagaatatcctttatttacggcattgtcaataattgctgtaagatctttcatcggaacattccagtcagaatcatgactccagttatcaggaatcggaactacaaatttctggaaatatgggtaatctttgtaagaagataattccacataatcttcaggattgattcctacaacttctttagcaaatgttttcggagtatagtttttcccttcgtaagtgaagttggcaggtacttttcccaaatattcatcaagaatagcatctacagaatccatccagttatcggtcagttttccttttgaagaagcctgaacaaggctgtcaagaaccggtttcagttttccctgcatttccttgaagttgttggtagtctgtcctgcttttaatcccgtgtaaacatcctgaggaacggctccgtactttttgtacatattgattacatcgtgaagttctcctccgtcaccccagctgatagcaccattattcaaaacatataattttgctttatcgtggtaagagtttcttgccgtaaagatttcagcaagatctaccggttttttgcccattctctgcatttcagattcaaggaaagagtttcctgagtagctccagcaggttcctgatgaaccctggttctttacagaagttgcgcccacgtcctttaacgttgtgaactgaaaattagcattttgtgattggttgttttttaacttgttgattaagtcatcttgggcaaacatcatacttcctgcagacaaaacaaaaagtaatgatgcaattttggcatttttcattactataaaaagattatttatattaagagtcgttgataatagagatttgttacagagggaaaagttaaatttggtatgctaaaaaatatgataaggtacatggtaaaaaaagaaaatatttatttgcaaattgtcttttttacctttttgccaaaaaaaagattatgtttccaactctcaccaaagtttctgcatctatactcatataactcctgactatggaacgagaattattattagaatgccagcgtagcgatcgcaatgcacagcgggaagtttacgagaaaatggcgggtaggctgtacgcggtctgcagacgttatctgaaaaacgatgaagatatagaagaagtattggcagatacattctataaaatctttacgaaaattacccagcttcataatcccgatacttttgaggcctgggcgagaaaaattgcagtgaatgaatgtctgcagaaattaagatccaataaagaactcttgatttctatagaagaaaattatattgatcattctgaaggtaatgcagataacctttctctggaaaaagatattttaagtttactcaactttctccccgaaggctgcagagcgatttttaatctttttgctattgagggatatcctcataaggaaatagccaccatgctttccatcagtgaggggacctcaaaatcccagctcaattttgcacggaagaaactgcaggaacttttagcaaatcaaaacatttaacttttatgacaatggaaaataatcatatagatcaacaattcaatgaagcgtccaggctttcagaagagccagctgtttttcctggttttgagaaggtatgggaaaagattgaagagaaattagataaaaaagaagaaaaaaagagaattatacctctttggctgccttatggtattgcagcaagtttgatgattggtcttggggctttttactttatgaataaaaaaaagactgcagaacctttacaacctgtaattgcagagaatacaagttcaagtggcccgattaacaaaacggatattgcaaagatagacaggactatcaaggagaatatcagaaaagaagaattgtctgtatctgtacctcttcctttggcgcatcagccttcaccaatgataggaatgaatgtatacaagtctccaattacctgcaatataccaccaatacaagctcccgatagaatactttcatctctatccccaatatataatgataccttacaaacaaaacaaattgaagaggttgtaatgatgggatattcaaaagtggttaaaagaaaggatgtgacagcatcgagtaccattacaagttctgtcagcaacttaacaccacaacctgctgcttattcttcattgcagggaacagttcagggaattcagatcaatgggacaggaaatcagggaattaatatcgctccgggatatattaataataatcagttagtgatcagaggagctgcgtctataaaaccggaaaataaagctttgtatgttgtgaacggaatggtaacaaaagatgaatatttcagaaaattagaccctaacaaaattgaaaatattaatattctgaaaggaaattctgctacagcaatctatggaagtaagggggccaatggagtcattgtagtgactaccaaagatctttccagaagagaaagaaaaaaactgaaaaagctgcaggaggaaattaacaaacaacagcagattacaccggttactcaaaataatgaaagctatgatgcttttgttgaaaatccttttgaactaacccgaaaccagcctttgtctactttttctatagatgttgataatgcttcctattccaatgtaagaagaatgatcaataatggtcaggtagtcgataaaaatgccgtgagaatcgaagaaatggttaattattttaaatatgattatcctcagcctaaaaacgaaaatcctttttcgatcaatacagaatacagtgacgccccatggaatcctaaacataaattacttaaaataggacttcagggaaaaaatcttccgatggataaattgccagcctctaatctggtgttccttattgacgtttcaggatcaatgagtgatgaaaataaattaccattattgaaatcttcctttaaagttttgctgaatcagctcagaccaaaagataaagtcggaattgtagtttatgcaggaagtgcaggaatggtattgccgccaacttcagccggagaaaaagataaaattattgaggctctggatcgtcttcaggctggaggaagtaccgcaggaggagcaggaattgaacttgcttataaactggcgcaggaaaattttgtaaaagagggtaataatcgtgtcattatcgcaacagacggagatttcaatgtaggaacgtcttctacctcggatcttaaaacgctgattgagaacagaagaaagtccggcgtttttcttacctgcctgggttttggaatgggcaattataaagataataccctggaaacccttgccgataagggaaatgggaattacgcctatatcgataacatgcaggaagccaataaatttctggggaaagaatttgcaggaagtatgtatgccattgccaaagatgtgaaaattcagattgaatttaatcctgaatatgtaaaatcataccgcctgattggttacgagaacagaaaactgaaaaatgaagactttacaaatgataaaatagatgccggagaattgggaagcggacacactgttaccgctttgtatgaagtgattcctgcaaatgtaaattcggattttgctcctaaagaaagtgatctgagatatagccaaaacgcttcttcaaaaggattcggagatgagttggcaaccataaagttcagatataaaaagcctgacggagatagcagccgggaaataacccaggtggttaaaaattctgataacagaatatcttcagcaagtccggattttaaatttgcttcttccgtagcgtggtttggcttagtactcagaaattcagaactgattacgaagaaagatctttctgatattgaaaatctggctaaacaaggcaaaaataaagatgaagaaggctaccggtcagaatttataaggcttatagagagctataaaaccgttcagaagtgattttaagaggagagatttcttccggcaatttctcctctatattcaaagaaatctgttttatttaataatgatggaagtttaaattaattttaataatttcctgccgaaattaatagtagatgaaaaaaattgtaataaccatgttagggcttgccgcattgacaagctgtaaaactcaaaaaaacattgaaacatctggtgaaccaaagacttacagtgttcgtaaagataaggatcaggatggaattcctaataagctggataagtgtcctgatattgccgggcctgtagaaaatgagggatgtccttggccggagtcggatggagatggtgttattgataaagatgacgcatgtcctacagttgcgggacctcctgaaaataatggctgtccatggccggacgcagatggagatggaattctggataaagacgatgcctgtcctacggttccgggattaccggaatataatggctgcccaaaaccgaagtcagttacagcaatggaagtagaatattctataaaattccatgaatcaggaagggtgtatgaccatcaggttggtgacaaaaaagatgttaaaaagactacaaaaaaaactggtcaggatattgattataacaatgaagaatatgtagcgttagttgaaaatgcatttgaattaacccgtaatcaacctgtttctacattctctattgatgtagacaatgcttcttattccaatgtcagaagaataatcaattacggaggtaaggttgataaaaattcagtgagggtagaggaaatgatcaattattttaaatatgattatccccaacctggagctggtcatcctttctctattaatactgaatatggtaattctccatggaatcctaagcataaattacttaaaatagggcttcagggaaaaaatattccaatggataaacttccggcctccaatattgtttttcttattgatgtgtcaggttcaatgagcgaggaaaataagctacctttgctgaagtcttctcttaaagttttactgaaacagctcagacctaaagataaagtaggaattgtagtatatgcaggaaatgcaggaatggttcttccctctacatcagcaggagaaaaagaaaaaatcattaaggcgttagataatcttcaggctggaggaagcactgcgggaggagcaggaattgaactggcttacaaactggcaaaggaaaactttatcaaaggaggaaataacagagttgttctggcaacagacggtgattttaatgtaggagcttcttctacgtcagatatagaaacgctgatcacagaaaaaaggaaaacagggattttccttacctgccttggttatgggatgggaaattacaaagacaataccatggaagttctggcggacaaaggaaatggaaattatgcctatattgataatatgcaggaagccaataaattcctaggaagagaatttgccggaaatatttataccattgccaaagatgtaaaagtgcagattgaatttaatcctaaatatgtaaaatcataccgactgatcggttatgaaaataggaaactaagaaatgaagactttgccaatgataagattgatgcaggagaactgggaagcggacatacagtaactgctttatatgaagttatcccggccaacgtaaattctgaatttaccccaaaagaaacaaaattgaaatactctgaaatttctaaaaagaagaactttggagatgaaatggcaacagtaaagttcaggtataaaaaaccggatggagataaaagcattgagataactaaagtgattaaagaagataaatcttcagtgagtcaggattttaaatttgcttcttccgtggcctggttcggtttagtcctaagaaactcagaactgattacaaaaaaagatctttccgatattgaaaaccttgccaaacagggaaaaagtaaggatgaagaaggctatcggtcagaatttataaggcttatagagagttataaaacaattcaaaaataattcataaaaaaagaaatttccacagaaatttctttttttatatttttaagcatactaataactgatgaaaaagaattatttgctgttattgccgtttacaattaccttattacaggcacaaaattcacaactctattacactggaaaatttttaaccacaaaaaataaagaacagaattttttaaaagtttataataaaaacagtggtatatatgaactgactgatgagaaaggatttgccattattgcagctaagccttatgatacacttgtctggaatcgtggcaaaaatacccatattatagcttcttatgaactcagggaattaaaagttattcttgaaagtcagacggaaaagaaaagagtagaaaatgttcatagcaaagattatgacagccttatttcaaaggaaactaaagatgatttcagtattgaaaaaaatgagaaacatttaagtaaaagctcacactcttattttgatcagataagaaaattaaaacaaaaaaatgacagcatttacatcctgaaaaaacttaatcggagaacattactgttgaatggaagctttactacctcttttgatattaaaagcaggaatgcaattcccgcaacccaaagcagatatgtgcagggaagatcagaaaccggaaaccttgtttggagaggccctgaaaccaatgaaatgttcagttttggaccggatatttcaacgctgggatttaatggattagcttatgaatacgatcagaatggaaaactgattccatggattgatggacttcagcgagcaaaaatatatgacaacaacctttttaaaacaacggtaggatacaacaatcagctgaatgtaaatgcttttataaaagaaggatacaatgagaaaatccggctttcactgaatctgggacagcaaaaaaatcaaatgtattttatagatcagtttgatattgcgaatacctttaaagcaaagctgaatacagaactgggtggatattacattaatctagcatttaattatgaagaagataaagcaaccaacaccaatagaataggacttttcaacagggtataccagaattcattgctcactcctgtttctttttccaatgaacaaaatacttttctgaataacggctcacaaagaagttacagcaaatatgcagacaacccctctttcctttttcagcaggacagtaaataccattatcagaaccgtgaaaggcagtttagtctcaatgcagcaaaaaactggaataattttaaactgaatatcagtcagtcctatgaaagtaacaacatccggaatcttgatcagtataaacccactgcttacgggttcaacaacggaatacaaaatgaaaggattcaaaacaacagttcatatcattccaatattctggggtcttatactttgggcaattatgatttcaaaaatatcttcagcctgaattttatcttaaatgataaaaaatctgatgtttataacagcctgacccatcgcaagtacttctaccagagaacttcacaggatcatatttttaattataatttggaaatccgtgattatgattttgaagcaggctttaatcttgggaattcattttacatctccaatacttcccttaaaaataattattggcttccaaaggctaacttttatctgaagtttaatgacatcttcgattggaataattacagtttcaaactactgggaagttacacgcagctaagctccgagcctgaaattacaagatcatatgccgcttatgccactacattgctgaatgcagaaaattataatcagtactttcctgtgcaggaagtagaaaccttcaaaggtttatccaatatcaacaccaaagaatggaaagctggagccaggctgaacctcgggtattatataagtctggatggcgaatatttcaacagaaaaagtataaacgacatatttcctgtttttgaaaataatcagttgaggttgaaaaatatagcagaccatacctacagcggatatgaattcaattttgcttatgataggctgcgacttggatatgacgcgtatgtaaccaacaaggtttcattttttaaatataaggacatcgtagatcatattttacccggatatcagaatatggccgtttccggttttaaggatatttacaaaacactgttggaaggacaggctttgggagttgtcatgggaagttattttgagagaaatgcagccggacaactgatcattgatgagttcggatacccgaaaaaagcaggaggaatgaaaattattgcagatccaacaccggattttgtgatgaagttcaatcatagtcttgcttataaaaacctgtctctggatatcaattgggaatggaaaaaaggagggcagctctggaatggaacccaggccgttctcgattattacggccgttcttatgaatctggagaagaaagaaatattaagaattatgtttttcagggggtagatgtcaatggaagtgttaatcagattcctgtagatttttacgacccgtaccggagtgttcaggaaaacagatggtcaagatacggttatctgggggtggcggaaagttatgttcaaaaggcagattatataagaatcaacaatatttcgctctcatccactttccctgttaactacgggaagcagaatcttaaactgaccttttacgtaaacaacataatgctttggcaggccagtaaaggagtcgatcccaatcagaatttttatgatatggataacgggagagggctggattttttcaaccttccttcctttaaaaccttcggatgtattgtttcatttaaattttaactcatgaatctcaaaattatatctacctatatcatcctgttgggcttgttattatcagccttttctctgaaagctcagcagtcattccatgactttgaaaaagaaaaaacgtacattcagaccaaccatgttttttataagcctggagaggaaatgtattttaaaatatatgtggtaaaaggaattaataaccttccggtggaggaaagcagagtggttaattttgaaatcattgatccggcaggaagtgttcttaaaaaattgaaatatgaaattaccaacggctatgcacagggctatttctatttttctgaagacatgaaaggcggaatctacaagatcagggctttcaccaactggatgcagaatgaagaagggaaaaatacctttgagaaagaaattactcttcagaaaatcgtatctccaagaattcttatgaaactggattttcctaaaaaaggatatggaccaggagacgaggtgaccgccgatttttcaatgagaagtctgagtaaccttccaatccctttttatgaagccggttacacggtaatgtacaacgggaataccgtttccgagggaaaatttattactgataaagaagggaaaaaacttttgacatttaaacttcctgaggtattgaaatcttcagacgcacttctgaatattaaagttgattttgatgggtttacagaatccatttccaggaatattccgattgttctgaataatctggatgtgaaatttcttcctgaaggcggaacttttatcaacggaatagaacagaatatcgcatttaaaattctggatgaatttgaaaaacctgtagatgctgtcttggctgtttacaatcagaatcatgaaaaaataaaggaaatttcagcctataattttggaatgggaagctttcgttttatcccgaaaaatggggaaacttactatgcaaaagtgataaagcctgaaaatattgcccaaacttttaattttccggcggcaaaagatgaaggattgattttaaatattaaaaatgaaaacaaaaaactgatttttactatcatttcaacacaggaaaaaacaattatcctgaaaggaaatttccgtggaaaagaagtctattccaaagttattccgttgaaaaatggaaacaacccactggaaattcctgagaaagactttccggcaggaatctgcagatttaccgttctggaaaataatgttcctcttgcagaacgtattgtttttaccaataaagaaaatcagctgaatataaaggtaaagcctgtaaaacagcattatctgccaagagaaaaggtagtcctggacattgaaaccacggatgaaaataacaaacctgttcctgctaatcttggagtaagcgtggtagatgataaactatggacctatgctgacgacaaacagaatcatattgtttcctggcttctgatggattctgagctgaaaggaaaaattgaaaagccacagttctattttgataaaaaagaagaaaaagcggataaaagtttagatcttgtgatgctgacaaacggttaccgctattttgagctcatcccggaagttttgaaaaccgataaatacaaatacctgccggaaaagaaaaatacaatctatggagtagtagaagaccaaaataaaaacccggtaaaagctgatgtttttcttttgaataccgacagcaaaaaaattctcaaacaaacagttgcagaagatgggaagttctatttttcagatttaaatgcagatgattcatataaaatcattgctaaatcttctcagcctaaacatcaggttaaaatcaggattttgtcttataatctggacattaatcctttagtaaagcaaaaaatgtctcatatagatgtggaagaaattgtaaaggaagctgaaaaaaaagaggaaataaagactgagaacagaaataatacccaaacattgaataaaccgggacgctcaagatctgataccattcagaatcaaagaattgaagaggtagttgtagttggttacaatatgaataaagagaaagcagcggttgcttccacaactataacatcttctgtggaaattcagaatcccaatgtaacgtctctattgaacggaaaagttgcaggaatcgttataacaccttcttcccaacagggagcaggtgagcagatcaatatcagagggacagcctctattgccaatagaaatcctttattcatcgtagatggcgtccctgtagaaaatttcaataccaccatcaatccgaatgatatcaacagtataaccgttctcaaagatgctgctgccactgctgtttatggaagcagggctgcaaatggagtcatcatcataaactccggtaaaaacagcagctcaaagatcagttttgatatcactccggaatcttattttgccatacaggccgtcccatacggaaaacttgtctcatacgctccatcgagagcctttgcctatcctgaatacaaaactaccaatacatcctatcgttttgattacagggaagcgctttactggaatccggtagtggaaaccgataaaaacggaaaggcaaaagtggaattctataactcagatgccacttccacatttagaattatgacagaaggtattgctgcatcaggacttgcaggaaaagatgaaaccacctatgctgcgcagagccttatttcaatagatgcgaaaattcctcagtatctgacaagaactgatcagatgataattcctgttgtcctcaaaaataattcttcagaaaccagaaaaatgaccatggatgtcattgttcccaactatgtcaaattgatgcattctgatagcttgattactctgaaaccgttagaatcaggaagattatttgtcaaaatacagactgatgaaatagtggcttccaatattcagtttaccatcagatccggagatttcagggaaacgatgatcttaccgtttaaagtagaagaaaaaggatttccacataaattttccattatcaataataaaacggaagatataaaaatcaatattccggaatatatcaacggaagtctgttttcctcatattatgtatttgaaaatgctgctttacagatgtttgataatctggaacaactgaagaaggaaccttacggatgctttgaacagctttcctcaacggtgtatcctaatatttttatcctggattatttaaagtcgggcagaaagatcgatacatctacggaaaatctggtggttaaaaatatgaaaaaaggcttccagaaaatgctgagctataaaaataaagacggtggtttcggatatttcaacagtgaagaatcagatgtggcagtttcagcatttgccttattggaatttactgatttaaagaaatatgtcaatcccgatgttaaactttttcaagggctgtcttcatttattttatctaaaaaaaatggaaacggattatttgaggtaagaaaaggctatgagttaaaaaaggaatattctgagtatttctgggctagaaatatgtatgttgtatatgctttatccagatcgggctttaaaaatgaaattgaagactcttttaaagtaatgatgaaaagagctctcgccacaaaagattcctatcagctggctttgctggccaataccgctgctcatctgggaaaacagaaagaatacgatgatctgatgaaaattctggacctgcagtatgaaacaaaaaatataaaatgtgacattaccttcacaggttcatggtggggaagatctgccgaagcggaaacgctttccttatacattatggcgcttcagaaagatgaaagccttaatcagttgaaaattgcagaagcagcagatcagcttattaatctcaatggatattacgggtttggctctactcaggcaacaacattagccgtgcaggcgttgtcagattttttgtctaaaaatgagaaattatatggaacggaaaggccgataattaagattaatcaggcacaaactacaacgatgatgagcctttcttcagcatttaaggccggagaaaatatgatcagcattcattatcctgctaaaaatggattgccttataaactcgaatatcaatattatacccttcaggccccggaaagcaaagatattcctgttattatggaaacaaaactgaaatcagaaacatcaaaagtaggtgagaccaacagactgactgtcaccgttaagaataagataagcggccagctaccaatgaccattgcaaagatcggtattcctgcaggactgacattgcaaaatgctttactgaaagacctgattgataaaaaacagatttcctattatgaaatctttgataattatatggtgctgtactgggaacaccttaatgcggaagaaacaaaaaccatcaatcttgatctcaaagcagagtttgcaggaacatatactgcaaaatcaagtaatgtgtatctgtattatatgccggaagcaaaacactggaatcagggaattactacaagtattgaaccttgatgttataaataaaaaacaggctccttcatggtggtctgttttattttaaaattaattttcaaaaattattgaaaattcaaaaaatataattacatttgttacaggaatttaaaaaacagataacatgcagctttcagaagccaaagaaaaatacatccaaacctgggggacctttgctaccaattggggaattaaccgtacaatggcacaggtgcatgcattacttttggccagcaacagacctctttctactgatgaggtgatggaacagctggaaatttcaagaggaaatgccaatatgaaccttcgcggcctgattgattggggaattgtaaaaaaagagctgataaagggagaccgaaaagaatatttcgtggcagaaaaagatgtctggtacttgttcaaacagattactaaagagcgcagaaaaagagaaatagaacctgtaatttcttttctggaagaattaaaaaatattgaggataaagattcggaagaagctcaggaattcatcaggctgatgaatgacttcagctcggtaaccggaaaaatcaataatattatggacctggcgataaaaagtgacgatcactggttggtaggaaagattaccaatctgttgaaatagaaaattgaaagaggatgaaaatccttttttattttaatttaattttcaaaaattactgaaaatacaaaacttataatatcatgaagaatttttttaaacgttatctctatttaagtctctttctgactgttgttttaattgttgcagtctggttttttctcgttgccaaaggtgaatatggagtgacaatgttttttactattcctgtttccattggatttattatcggatatgtaaagtttttcaaaaaaatcggattaatgaacgttctgaagaccattttgaaaatagtcttaggattaggtattttctctctgattttgataggagctggcgtagaaggagctatttgtattattatggctattccatttattggctttgctatgtttgcaggcttcactattggttttagcattggggttcttgatgaaaaacggcataccggaagtgtcatagtatttattctttttatcaatcccgcatcttatatttttgatagctatacaaaacctattgaggaaactattacgacagaaatgattgtgaattcttccaatgaaaaagtatggaaacgtttaaatacacaaattaatttcaataagcctgattttatactctttgaaaaaggagtcagttacccaaagaatataaagctcgttaatgaaaacggaaaattaggctacagctgtcagactaataatgatcaattacaacttaatatcaatgaattcatagaaaataaaaaagtgaaattctctctggaaaatcagactgttcctatgaaagaaataacaccttataaagatattgatgccaaacatttgcatgattattttatcgtgaagtatggcgagattactctagataaactgtcagaaaataaaacaaaagtagtcgcaaaaacaaaatacagttacaaaattgcacctatctggtattggaaaaaatggtccggctatatcattgataaaatgcaaagccatgtattacaatctataaaaacacaatctgaaaatgaatgatctgcaacaatactttgaccgcatacagcccagatattatattaatgaaatagcgtccctgggttttaccagactgttcaggaaaatggccgttcaaaaggttaaaagctataaaaacaaaagagttcttgatctgatgagtggccagggtgaaaatctgaaatttcttcgcgaacataatgagaatacagagattataaccctggatttttctacagcaatgaatcttaagctattctcaacatttaaggagaaattattcataagacagattcgggatgacttttttgaaactaaaattccagacaattcgatagacattattctttgctcttacggaacaaaaacaataggagaagatcaaaaacttgttcttgcagacaggctgtcaagaattgttgatgagaaaggtgaaatcatcattgtggaatttgtaaagccgaaaacagcctggagattcacttgtgttaaatggtatatcgaaattattgttgcaaagctcttcggaagtgagtttggaaaattatttcattatatccataaaaatgaaagtctgcaagacttaaaaaatcaatttgttatcaaccagctttcagtagtttctcataagagatatttagatctcgtggaaatactgcatgtaaaaagaaactagttgtattaatactgatttcaagaattgctgaaaattttaaattaaaatgaatatgaaaaatctaatcattcacctgttcctggttatttatttcacaagaaaaggatcattataaagtaaaacgctaacaattataaaaccatttgaaatgtcaaccatctatttaaacaccgtaatcaacgcagatattcattatgtctttgatctggcgagaaatatagacttgcaccagcaatcaacctcaaatcccatgaaaaagcaattgcaggccgtacctcaggactgattgaagaaaatgaaactgttacctggagggcaaaacatctcggagtgtatcaaaatctcactacaaaaattgtcagcatggaaaaaccgtttcagttcattgatgtgatgcagaaaggtgctttcaaatctatgcgccacaggcatatttttaaatctgtaaacggaaaaacactcatgacagatatttttgaatttgaatctcctttaggtatcattggaaaattattcaatgctatttttctcagaggctatctcaaaaaatttctgattcaaagaaatgaaatgatcaaaacgattgcagaatcttcccttcgggacggaattgcagttttttaatgctaaaaattacagttatgaactttttaaaagcagaatggcgaaaactggccatcatcaattatgagatcaatccagaaattttgctcccataccttccaaaagggacagcgttagatttttataaaggcaaatgttatgtaagtcttgtagcatttatgtttttaaatactaaactattggagcttccagttccttttcaccggaattttgaagaggtaaatttaagattttatgtaaagaaaaaagaaaaaggaacctggaaaaggggtgttgtatttattaaagaaattgttcccagaccggcattaagctttgtcgctaataccatttacaaagaaaattatcataccatgcagatgaaaaacctgattcatcaaaaagatgatgagctgctgatccggtattcatggaaagataaaaactggcattccattcagattattgcagaaaatgcaccgagacctatggaagcaaactcagaatttgaatttatcacagaacattattttggctttacaaaaaagggaaataccacttccgaatatgaagtatgccatccgaaatgggactgctatactataaaagaccatcagttggacattgattttcaaaaaaattatggaaataattttgaatgtctgaatcaccggaaccctatttctgtcatgttagcagaaggatcagaagttcaggtcaaaaccaaaaaatatatcagctaaaaatccaaaaatcaaaggaaccctgttcacaatcatcaataaaatctgtggtatctgcaggaaaaactaaccataaaagtcacaaaacttttttagagacttaagatgaagataatatcattgtgcagaataagtacacaaaagtttttaaaatcttcgattttataagtgtaaaaatatttaaacatacacctctgtgaaatctgtggttaaaaccttaaacattgaatctgaaactttaaactttaaaacaatgaaaataatcatagccggaggcaccggatttcttggtaaaagcttagaaaaatactttacagaaaaaggagatcaggtatatattctgacccgtaatccaaaacgtgaaaatgaaatctattgggatgcccaaaccataggagaatggaaaaacagccttgaaaatgcagatgttctgatcaatcttacaggaaaatctgtggattgtcggtatcatgagaaaaacaaaaaagaaatctactcctcaagaatcgacagcacaaaaatactacagaaagccgtagatcagtgttctgaaaaaccaaaaatctggttaaatgccagttctgcaaccatttatattcattccgaaaaaaatctcaatacagaggaaaatggaattataggagatgatttttccatgaatatttgtaaaagctgggaaaaagaattttttgatgtcaaaagtgaagatatacgaaaagttgccctacggacttctattgttctcggaaaaaatggcggtgcatttccaaaactgaaaatgattacaaagctgggattaggtggaaaacaaggaagaggaaatcagatggtaagctggattcatattgacgatttctgcaaagcagtggaatggattattcaacgtgaaactatttcaggagttgtcaatctaaccgctccggccccggtttccaatgaaaatatgatgaaaaaacttagaaataaaatgaaagtaccctttggactcaacgcaccagtctggcagctggaagtagcatccatatttctgaatacagaaacagaattactcttaaaaagcagaaacgtttatccggaaaaactcattaaaaacggatttcaatttatctattccggatttgaggaagccattattaatctcttggaagcctaatgtttgcgggtttcccaaaggataattaaattagcggaaaactattccatatgccggttaaatccaaaataaaaccctttttcctttcctcttttttaataagttcaatagcattttcgcaggctcataatgtgtctgacggctatcagaagcccacagatcccttggtagcccaaaatctggagcagtggcaggatatgaaattcgggctgtttatgcattggggaacctacagccagtggggaattgttgaaagctggagcttatgtcctgaagacgagtcatggactcaaagaaaacctgaacacggaaaatcttattacgaatatgtaaaaaattatgaaaatcttcagacgactttcaatcctgttcagtttaaccctcagaaatgggctgatgctgtaaaaaaagcaggaatgaagtatgtagtttttacgaccaagcatcacgacggatttgccatgtttgatacccaacagtcagattataaaattacctctcctaaaaccccgttttcaaaaaatccaaaatcggatgtgacaaaagaaatcttcaatactttccgcaaagaaggatttaaaataggagcttatttctcaaagcctgactggcattctgatgattactggtggtcttactttccgccgaaagacagaaatgtcaattacgatccgaagaaatatccggaaagatgggagaactttaaaaaatttactttcaatcagttaaatgaaattacttccaattacggaaaagttgatattctttggcttgatggaggctgggtgcgccctttcaacaccatagatccgaaagtagaatggcagcgtaccatcaaagtagagcaggacattgatatggacaaaataggaaccatggcaagaaaaaatcagcctggaattatcattgttgaccgtaccgttcccggcaaatgggaaaactatgtgactcccgagcaggcagttccggaacacgctctttccattccatgggaaagctgtatcactatgggagattccttttcctacgttcccaatgataactataaaacctctcaaaagatcattgaaactctggtgaagatcatttcaagaggaggaaattacctgatgaatattgctcccggacctaacggagattatgatgccattgtttatgaaagattacagcagatttccggctggatggataagaatggatcagctgtttttgccaccagaagcattgctccttatcacgaaggaaattattattatacccaaagcaaggaccatcatactgttaatgtctttcatcttgatgaaaaatccgaatatcaggctccagctttgcttacttttactattccggaaaattttaagcctaaatccttgaaagttctgggtatttcatcaaaaattcagtggaaaaaaacaggaacaaataccattgaaatcaaattacctgaagaaaggaaaaacctgaaatatgcaacggtaattcaaattgcacaataatgaaagttcttagctttaaactcacgggaattgctttattgttgaatgttgtcattatttccgctcagaaacctttatataaagatcccgcacaacctgttgaagccagggttcaggacttgttgaagagaatgacgcctgaagaaaagttctggcagtgttttatgattcccggtgatttggataatgttcctgaagaacaatatgctcacgggatttttggattacaggtaagcgccggaaaccagggaggcggggctgccggccaactgctgaaatacaatgccaatgaagatgccgttaaactggcaaagaaaatcaatgcgattcagaaatatttcgtggaagaatcaagattaggaatcccgattatcccttttgatgaagcattacatggattggtaagagaaggagccaccgcttttccacaggcaattggtctggccgctactttcaattcggatttgatgaacaaagtttcagcagctattgcaaaagaatcaaaattaagaggaatccgccagattctgacaccggtagtgaatcttgctaatgatgtacggtggggcaggacagaggaaacctatggagaagatccttttttaacatcggtgatgggagtaaacttcgtcagctcttttgaaaatatgggaattattaccactcccaaacactttttagccaatgtgggagaaggtggaagagattcatatccgattcattggagtaaaagatatctggaggaaacccatttaattccttttcataatgcttttacaaaaggaaaaagccgctctgtcatgacttcttataatctgcttgacggaagaccttcaacggccaatcactggctgctgacagaaaaactgaaaaaagactggaatttcaaaggttttgtaatcagtgatgcaagtgcagtgggaggcgctaacgtcctgcattttacagcaaaagattatgatgatgcctctgcacaggcaattaatgccggacttgacgtgatctttcagacagaatataaacattataagctttttattcctccgtttctggatggaaggatctcaaaagaaagaatagacgatgccgtttcaagagtgctgagagctaagtttgagctaggtttgtttgaaaatccttatgtatcatcaaaagagattgaagaattaaaaaaacttaaccacaaacccttagcagaaaaaacagctgccgagtcctttgtattgcttcagaacaatgaccatacacttcctgttcctgaaaatataaaaaaaattcttgtggtgggaaccgatgctgtagaagcaagattaggcggatattcaggtccgggaaataaaaaaataagtattcttaatggtcttaaaaattatacaaaagataaagatattgagatcatgtactccaaaggaattgactggaatgtaaaagattttaccacagtttctgatcaatatttgtcgtctgaaaataaaaaagggttaaagggaatgtatttttccaacacagatttaaaaggagatcctgcatttgaaagacaggacgaacagttcaactttaaatggactttatattctcccaatccagaaaagcttcagccggataactacagcatccgctggaccggaaaactggaggctccggattccggtaaatatcaattgggattgcgtgggaatgatggtttcaaactgtatctggacggaaaattaatcattgaccaatgggaaaagctaagctattcaaccaaaactgtcgaagtagattttgaaaaaggaaaaaagtatgacattgcaattgagtttcatgaaaaccgcggtgaagctaatctggaactgatctggaattatgggcagcatgattatcagaaagaatttaaagaagctttacatcttgcccagaaagcagattacattattgttacagcaggaattcatgaaggagaatttcaggaccgttcatctttaagcctacccggaaatcaggaagcgtttattcatgaagtttcaaaattaaataagccaactgcagttgttttgataggaggttcagccataaaaacgacaacatggaaagataaggttggagcaattctggatatttggtatcctggagaagaaggtgggaatgctgttgcaaaaacactttttggggctgaaaatccatccggaaaactgccggttactttcccggtggaagagggacagctgcctttgtcatacaatcaccacccaacgggaaggggaaatgattattacgatctgagcggcgaacctttatatccttttgggttcggattaagctataccacttttgaaatctctgatttgcagttgaacaaaagccaatattcagaaagtgaaacaattatggctaaactgaatgtgaaaaacacaggaacaaaagccggaagtgaagtggtacagctttatgtcaaaaacctgttggcaaccgtttcaaggccggttattgagctcaaaggatttcaaaaagtagaattacagccgggagaatcaaaatctgtcactatcgaagttcctgtaaatcagctacaatttctgaatgaacaaatggaatgggtagtagaaaaaggaacctacagaattatgataggaaattcatcgaagaaccttcctttaaaacagaatattgaagttttatgacaataaaaaagagcagaattttctactctttttgtgtatatttctgaagttgtttagtattttctggccagtaaaacgttcaataagaatgttcctgcccagttactgttattagtaccgttggtaccgataaaatctacacgggctacagatacagttagtcttgttctaccgcctgtaccattattggcaaggcttacaaatgatgctgtaaatacatccgggaaacttgagttatttcctgccgtaagaataggatacatattggtaacattgaaaggagtaccctgatattcatatacaatagtcattctgctggcattggaggaggtggcagtatgagctctgtccacagatgttttacttattatccaccatctgtcagtcgcagaacctgaatcaaaggttgtattagtatgattggtccagtctgcaatagctgctgttccgagtgcatgaggaggaataaaaagctgtgtaccataaatttccacgttgcttggcttaggaagaactgtaaaagataaatcccaggttcctgcggaagtattactattgttaaccacttcagcataagctcctgtaggaattacaaaagaagcgacaggagtgttgtcaatccttaatgtattaccgcttgatgcctgaagcgtaatattattaggcgaaatgtttttaatcttataaattcttccggtaaaactcgctgttccggttccgatgacaggaagggtaaatgtggcatcagcagttccgttataagtgatataatgatcagtagccagaatattgtaggttgtggcagtgatctcagtatagccggctcttaatgaaccgtttacggcaagtgtactgttgggagttgtggtattaataccaacttgtgcagttaggggaacggctgcaaataaaaggatcgagatgtattttttcataactaaaatatttggtttctaacaaaaatataaaaaaaacagctaaaaaatcaactgatactgaataaattaaatgtttttggttaaatcccttcctggcgataggagttattgatgaaattcattagatcagcctgcatggtaccttcagatcctcagtaagatagtagctgcaacaaaggcggtgataaccatccgcaatgatcagttcattttgtcccctgaccaataatattggcgaaagttttttatttttttctacttttttaagattttctttcacgtgaatattagtttctggaagcaaagcaagtttactggctcttaaaatgtctttcgattttttgataatggtaggagcagtttttaatttttcaaccagctttcgtgcatcatctggcttgaatagaagttcgagataatcctgggctgccggaaagtcatggtcttctggttccttcagccatatggtgtctttagggatattgttttttttcaaggctttcataagtgctgtttaagataaataaaggtatgaaaaatagattgttatcagcatatttaatttcagatgaatgattggtttgatgtagattttaatttcttttaaaaaatattggtatgatatatgtaagatttatgatgaaccggaatgaatttaatcgagactattggattggttgaaatcattcaaaaatatgaacattatgaaaaagttattaatttcaacagtattgttattaggtttatccatgaatgttgcagcgcaaaaacatccgccagttcctccacacccttcaaagaatgagctggtgaatattaaaatgcaggaacttaccaaaaaatataacaccgagaaaaaactgattctgaaccaccctttggctacaaagcagatgaagagagatcagatgaaagctttaaatgcaagatacgcggctgaaaaacgattacttagacaggcgagataatatagattttttgcagttatttaaaatgtagaagccgttttttatattttcaactttgagaaatttttaatataaagtaaagtttattgaaagagaatacgtattgtgttctctttctttatataaaattgaacaggaatagccttattgatgcattttaagatcagcctgcagaaaaatggaacatccaatatttttccttaaattcgcataaaaatttttaaagtaatgaattacgatattattgtcattggaagtggtcctggtggatatgttactgcgatcagagcagcgcaattaggtttcaaaaccgcaattatcgagaaagaaaatttaggaggaatctgccttaactggggatgtattccaactaaagctttattgaaatctgctcaggtttttcattatatcaaccatgctgaagattatggtttgaataaagtggaggcaagctttgaattcccgaacgtaattcagagaagccgtggtgttgccagcaaaatgagcaaagggatcgaattcttaatgaaaaagaataagatcgacgtaattcttggtactgcaaaagtacagaaaggtaaaaaagtttctgttacagataaagaaggtaaagtaactgagtatacaggaactcatatcattatcgctacaggagcccgttcaagagaattaccaaacttaccgcaggatggtaaaaaagtaatcggatacagacaggcattatctcttcctgagcagccaaaatctatgattgttgtaggttcaggagctatcggggtagaatttgctgacttctataatacaatgggaaccaaagttactattgttgaatttatgccaaacattgtacctgtagaagatgaggaaatttctaaacacttagaaaagtctctgaaaaaatcaggtattgaaatcatgacaaacgcttcagtggaaagtgttgatacaactggtgaaggcgttaaagctaatgtaaaaacagctaacggaaatatcactcttgaagctgacatcctgttatctgctgtaggtattgcggcgaacatcgagaacatcggactagaggaagttggtattcagacagataaaggaagagtattggtaaacgaatggtatgaaacttcagtaccgggttactatgcgatcggagaccttatcccaactcaggcattggctcacgttgcgtctgcagaagggatcacttgtgtagagaaaatcaaaggattacacgttgaaaaaatcgactatggtaatatccctggatgtacgtactgccaccctgaagtagcttctgtaggtcttactgaaaaacaggctaaagaaaaaggatacgaaattaaagtaggtaaattccctctttctgcaagtggtaaagctactgcaaacggaaatacagacggatttgtcaaagtaattttcgacgctaaatatggtgaatggttaggatgccacatgatcggagatggagtaacagatatggttgctgaagctgttgtagcaagaaaactggaaactacagggcacgagatcatcaaatctatccacccgcacccaacagtttctgaagctattatggaagctgctgctgctgcttacggtgaggtgattcatatttaatctgaaatacaaaatcttatatataatgaaacccggagaaatccgggttttttagttgaagtaataagaactttgtcaaaggtctctattctactttaataactttggactgcatttcttcattgagtttataactatcctctataaaatgatattttacaatcttaccatgtactactttaaaaattactacaaactcagtactgaataccttgttgtaggtaaggatttttgaagacagatgtccggtagcggtagcattttcaccattaacagcaataaagtcgatttcaaatttttccggtttgacatttgagtataattctttaaaaaactcttctatttccttcttagtttgccttttacctgtccatggaaatttttgtttattcccgggtaagtcccagtctatataatcagaaaataaatctataatatttccttccttttttccggattgtaaagcaaaaaattcatctacaacctgctttgttgtcttttgagattctttattgatatccggcaatggatttttaaagatatttactctgtctgcatcttctgaagtaaaatcgggatctacataaacatgtatgcgtttgataaattcgtccttgaactcaaaaacattacagaatttaccatgagaagtcctgtaatcgggccattcctttccggatcttgtgattcctctttctgttccctctaccacaatactatggtcagagattacatatttaaaattatcaatatcatggcttaggctttgaagatgggctcccattacttttccaaaattcatgattccattttttcccttttcaaaaccgaatttaggataatacatttctacatcatctgtatagagattaaaatattcctcgtcaaattgcccttcatccacttttttgaaataggttatcactttgtttttgcgaagtgtcgccagatctgtattgttcatatttttttgtttttgtattgctggtttctcctgagctttcatattggtaatgtttataaagatcaggagagtagccgttattatgattttattcttcatttattttatttaaaccgatcgttccggaatgagataaaaaaaatttacttcttaatctgttctattaaaaaatcaaccatttccattacttcctttttattttgagtcaggttataatgactccagaagctgctgaaagaagataagatatagcgggcaataatctgagctgaagttgtacttttgatatttccatcttcctgagcctgtactatcgctttttctaaaatagccagtaaagatttgccgctatttaaaataagctgcctggcttcctggtcttccggaacaatttcaaaaatggttttcaccgtaagacatgctttattatcggttatagtctgttcaacaacatcacggataatgttttcaagcgcggttatgccttcattttttgcttgtaatgcctggtaatattgattttctttgaaatcagaataatttgataagcattttaaaaacaaatcatgtttattgccatacgtatcataaatactgcttctgttcagtttcatagcatctacaatatcgtgcattgaggtagcatgatatcccttttcccaaaagagattgcgggctatttccagtttttccgtatagtcgaattctttatttcttggcatactgcaaatatacaatttaaaccaatcgttccaaattgaatttattattatttggattctttaatagcttgaaaagctggcaattgattcttttaaacagatttttattaaaataattttaaaatcagcatatttattaaaattaacttaattatttcagtccgttttcttacatttattctatgaattttgaaagagttggacttgttttatcaggcggcggtactaaaggaatcgctcatgcaggtgtattaaaattcttacaggaaaaaggtattgaagtagatatcctttcctgttgcagtgcaggatctattgtggggtgccttcatgctataggcaaatctccggaggaaatccttgagtttttcaattccgtctattttttcaactggaagcattttacctttaatcagccgggactggtttcttcagtgattttcagaaattatctgaaacctatttttcatgatatgaaattgggagatctggatatagaagtgaaaattgttgcaacagagctcgttgccggaacccagaaaatttttgataaggattttgaaattgttgatgccattatcgcgtcctgttctatccccggtataacaacaccgtacatcattggtgatgaaatgtactgtgacgggggcgtgctgaacaattttcctgcagatatcatcagggatgattgtgataaactgattggtgtttttgtatctccgcccaatgaagctaaaattaaagatctgaattccattaaggccatcgtttcccgttcctatgatcttctttcctacaggatagaaaaaataaaatttgattattgtgactggtttatttcttcccagaaattagcggcttacggaacctttgagcgcaggaaagacaggcttgaggaaatttttaatatcggttacaaatctgcaaaagagagttacgaagaaagcaacttttttacagaattaaaacaatccggaacataaaaaatcctgtatcaattatacaggatttttattttataaaaaggtaaatttgagtaaacaggctataataacttccagcttctgtcctccagcttccagcctctatgcctcctaatttttaaccgcatatccatcctgacgcacaatttcacggtcattcgcatcatttacaaccaatgtgtaaggggcttttttcggagaatctgtaaggtaatttctccaaacctgataactgtgcccttcattgctgaagttaatgtaataatttcctcccgtaccatcaggtatcagttcgccgtcactgatgatcatacttggtttcgctgtgatctttgcattggcattccatgattggtaaaggtatttgccgtttggctgcttgtcaattctgattttgaactttttggttttgataataacagtctttggcacctgttggatggcagaagaagttataaaaccatctgttttcggattgggaaactctttggcattaacgaaagaaaactgagctaagcagaaagtccctaataaaatatgctttatcatattaaatggttattggttaacatttcagattctatcaaatatagcgccatatttcagctaaatgttctttttaagaacaagtgcgtaaagtttatcacaatgattttttaattataataaatttgtatgagctaaaataaattaaaataattatttaaatatttctttaaactcatctgtgtaagataacttttcataacctaagtgcttaaaatttccttggatgtagttttttatctgaaaataatttttatgatagaattccgatatctttacaattttatttcctgctttatataaataaagatattcgtaagtccctcccttaccagtcagatagctaaatttccaaccctcaatttcagaacttttataagtttttactagaagtccaaaaaatcttctgacaacaacattatctttattgattgttacaccgatacattttgttcttacttctccaaatagtactaaagacgaaaaaataagtatagctgggataaatattcttgggaataaaggcgtactaaaattctttgtaatgaaaattccaggaataattaagataatgagatataatataggaattaaaagtaatggtattaataatgctttaaaagtaaattttgtcttcattattaatcttaaagccgaatctcaaaattttgcgtatagcttgcaaacgcttcttccaggctttcaaatttacctttgaattcatcaatagggcagtcctggagaatatttcctttatggatcagaatgactctggagcaaagtgcttctacttcctgcatgatatgcgttgataataaaacagtcttttgctgtccgatttctttcaccacattacggatttcaatgatctggttaggatccaggccgttggtaggttcgtccagaataagtaaatccggctggtgaataatggcctgtgcaagccctacacgctgtttgtatcctttagacagctgtccgatcttcttcgatttttccggggtaattcctaccagttcaataacctcatttactctggattcagggattttgtgaatgttggccacaaactgaagatattcctttacatacatttccagataaagcgggttgttttcaggaagaaagcctattttctttttactttcaatctcattttcagagatgttcaggccattgaaaatgatttcaccctgatcaattttcagtgcaccgacaatagatttcatcagggtagattttccggcaccattcgggccaagaagaccgataatttcatttttatcaatagaaatgttgatgttgtcaagagcagtctgttcaccaaattttttggttaaattgattatctgaagcggcataaattataatgtctttctgcaaaaataaaataaaaaaactcatccgatggaatgagttttgcattatttataaaatataattattttcttgattttttcttcgcaccgccagatccgggagctgctgtagaagctgtatttgtagtgcctttagctgcagcaggatttatactggctggtttatcatacatcgtgtattttccattggttcttccgaagatcttatccacctgcttttgggttaaaaactgtgattttccaatatatttccggtttttgttgatcacctggataaactgcatggtttgctgcccgtaattcttttcataatgaagttcaatgatatcattaggaagctccaatacgacattctcatccggagtggagacaaagccatccataataagcttatataatccggcaacatcattattaaggttctggaatgaaaaagagcggattgtattcaggttgctggtgttcagatcctggtagttcactgtaaatttatcttcctttttatatagaccaacggaattatctttaccaatttccaccaaactttcatttttcaacactttgatctgtgagaaaactgaaataccgaacatacatgtaataagtagaattatttttctcatggaatgaattttaatgttttataaattggtgcacataaacttactcataaaaaagctaaaaagcaattttattcgttagagcaaaagtaacatttttttttaatatctgtcagagatcatctgccggtgctatggattgcattgcttattcaactaactgtgaatcattaatttgaatgttttttacaaaaaactatggtttcagatggtgacagcgtgataattactgaattaaatataatgcactgaaaaacagtttgaaaaaatattcaaatcaatatttgctaaaaccaatttaaataaatgttaaaaatgtggtttagtgaattaaaattaagaccaagagtgaatgcaatcctttataaaagcttatttaattcttccctcatcaaaatgacaatgatgtagaattgtatatagttgcctttgataataaaactctgtgtttaagaaacttataattcagtaattatctatgaaaaaggcaccatttacaagtaaatgatgcctcgtcactgaatatatttgaatgtaaaattgttttttgttttatctactcattctgcttgatttgtgggttattattaatctctttgttaggaatctggaacctgaatttatccggtgtcagattgaatcttccaaaagtatggttggttcctgtgtatatacgctctaatgggatatttaatcttttcatatcgaaccaggcataaccttcaccccaaagttctattcttttctggagaataatttcattgatcagttcactgcctgacttggtagatagggtataagcctgatccctttttgaagtaatattaaataatacctgtcttgcttccgcttctcttccttgtctggccagagcttctgcctgaatataataaagagaagaggctctgatataaatataatctccctcaaaaagggtaggatctttaaacttccagcttacgtaaggcggataatttttagtttttccattgaaggtatatgctgcattctggctgccattgaacactttcttacggtaatctgttgccggtatagcttcataaagacgcttgtctatcagcttacggatctgcgctgctcctgcatagccttcattggtattatcaaacattgagaagaaagaggcatagtaatttccgatactcatcgtggaaattgtgttatgaaaaccccatattacctccggattattaatgttggaaaatccggtagtggtatagtcatcttccgtcatcagagtaattccctgtttactttctccggcatattgagcggcttgtatgtaatctcctgtttccagaaatatttcggcagcaatagctttagcagttctttgatctatctgggctctggaggggcgtgagtaaccatccaaaagtgaaacggattccacaatatcttttttgatctgtgcatacacctcagcaactgttgatctcggaagtccctgattcggattgcttgccgtaagaaccaatggaagaccaggttcagactggtgtccgttataatcatgggcatagaaacgaaccagataaaagtaggagtaggctctcaaagcaagcaactgacctgcaatcgatctgttttttgcattggcatttttatccaggccatcaagaagtttattgatcacaaatattctggcataaaaagttgtccatacaatttcagaagcgatattgctggcattggtggcttcgtaattataaaacattcccaaatgctggttggtagactggatgacatcgttagacatcagatcagcacccgctttgattcccatgattccgaaatctgagtgcacggtagtgcctcccgcaccattgctgcgaagatcaagatagatcccacccagtattttttcagggctgttagcatcattattgagttgttcaccggaaatatctccgtccggtaaagtattgagatcattggcacagctgactgtaataaaaccaatagtgacagccgttatgaagtattttatttttttcattcctgttctttttaaaaattaagtttaaagcctaatgagacactggacagcagggaataacgatacgaatctgaaactccggtcagtgaagctctcggatcatatccttttctcttggaccacagataaagattgtttcccgttacataaattttcagacctgacaagccggcctgctgtgcaaaaccatcgggaagctgataggacagggttacatcctgaagactgatataatctgacttgatcagataaagtgttgaatttccattctggttcgttgccgtaagatctacccttggcaatgcagcatttggattttcaggagtccatgttttatccagatccgttgaatagttggacccataactgtcagaatggaataggctcctgtagatgtcatcatatccataccctccgaattggtaagcaaaattgactgccagattaaatctcttgtaagaaaaatctgtcccgaacccaccatatacctttggaatggcagatttcccggtgttatagtcggtagcctccttataattattggtaactgttctttcttccttttgagtagtaggatttatcgttgtccggtaccataaagcatccccgttttcaggatttactccggcaaattctttgaggaaataagtataacggtccccaccttctgtaagaataaacaaaccggttacaagacctgtatttctctgttcagccggtaaccgggtgatcttatttttataatgagtggcattggcatacacactccactggaattcatcaccgcgaagaatatccacacttagattggcctgaactcctctgttggtcatatccccgatgtttccatatttcacataagatcctgcgttagacggaggaaggggaagtgtatagatcatatcagaaaccttcctttcaaaataatcagcatttaaggttattctgttttttaaaagggagagctcaaaaccggcattcaggtttttcgaagtttcccattttaaatctttattcccttgcttcttcagagacagaacaggcttatcatctccgaaattattaattccgtaaatgtcctgataggcataataatctctagtagagccgcttaaaagaatgttgtcatttccctgctgaccgtaagaagcttttaattttaaagaattaatcacagagttatccttaagaaaatcttcttttgcaatattccaagctaatccaagtccataaaagtttccccatctgctttccggcgaaaagactgaagagccatctcttcggacgttggcattaaagaaatatttaccatcataattatacagtaatcttgtaaaatagccttctacagcatattcatagccgcttccggataaaccggtaatttttacagcattgtcaaaagcttgtgaatcaggcaataaaagctgttgctttgatcctgaaaaaccatcatctttgatcttattcagctcatgccctataaggagattgaagctgtgatttcccagttttttctgataggtaagtaattgctggtggtttagggtatatttaaagtttgaactttgcgaaatagttcctcctacagaagaagaagttcctccttccgtattcccgaactgcaggtttcttgtattttcgagataagccccgaaattataggtaaaatccagccctttaatgatttcataatttagaccaagattaaggttggtgatattacttacagtctgagatttgtttttttgaaggttgcctacaggattttcaaaaacagcataagatcttgtggcgccgttgggtccctggccgtctccatagtcatatagagcatttccatacttgtcataaagcctttggtaattgttgtcccgcagaaagacaggatagaaaggagcaatatttctggcaaactgaaaagggttggaaaaaccgctggtctcaccaaaatcctgtttgctgtaagtataagataaagcactggttaatttcagttttgaagtgatggagtagtctacattagacctgattccgaatctttcaaagcctgaagaaattaaatatcccttatcgtccagataattaagcgaagtatatgattttacctggtcactagtagcgttgattcctacggtggcttcccttctcaaagcaggcctgaaaagcagtttcttccagtcgtcctgatataataatttcgcatcaggattaaaagaaccatcctttgaaatgagttgattaaaaggaacattataagcattatatcccagtttggtcaatgctgcaaggcctacatcatgaggagaagcaccagacggaacagaacccggttgtttcagccttgcgatttcacctattctggctctgttgtagtaggctgtataataatcctgcggagaagtatacacagaataatcttcaatagatctgaagttaacccctgttcggacatcagcctcaatgctcagtcctttgcttttccctctttttgtattcacaataattactccattggcccctctggaaccatataaagcattggaagaagcatcttcaagaaaagaaatactttcaatatccgatgcggcaatactgttgagatttccactgtacgggatgccgtccagtacaattaacgggtcactggatgcattgatagagccaattcctctcatcctaatggtgggctgggaacctggctgtcctgaggagattacctgtactcccgccacttttcctccaattccctgaagaatatttccgttttgaagattagaaagatccttagccttcaacgactgtacagatcctgtaatctcttcttttttctgctttccaaaggctaccaccacaacttctttgatggaggtttccctggaaaggctgtctttgctttgggcaaaaccatattccgcgaatagcagtaaggccaatacaccaagcttgcattgtttctttttcattatattaatctaggtttaaagttgaattgtgtattactgctgatctctatgtaagaaataataattccctgcctccttttccagggaggatataaaaaaagattaaaatttacaggagatgtatccggatgaaagaagccttgaactttctggctttaattcctacagtaatgaatgtatctcttaaaaagttagcacatcatcatcatgcacatcatatcaaagcacatgtcttgagaaatgcagttgtgctgtgaaaggacagacattccacaacaattttgctgtgcaggagctgccgccgtaatggtgcataggcaagaattaaaggcactcttattcatgagaataaagtttatgatttttttaactgtgtcaaaattatttaataaatgacaaacacttataaaaacagaatatgagataaatcatactagtctactaaattagtaggttaattgattttaattaaatttttaaatcgtaaatatttgatttttaatatattgtttgctgttttgaaaatgttaaaaaatgataaaaaagttaattttcaattatgaattaaaattaaaatgagaagtctatttattttgtagactttttgtttattttatagctgtattttcatgagaataaggatcaggagcttcatcctgctatccgctcatactcctcgcacctggctgaatccactttctgctgtggggtaaccgctgctatcagggctagaataggattataaattataaattatgaattatgaattatgaattatgaattatgaattatgaattatgaatggaagagatatactcaaacatctgtgtttatctgtgtaatcagtgggaaaaatgagaatattcaatagaaacgggctttagcccgtttattaaaaaataaaatttcatctggctttagccaaaaccataaaaaagaagcctgccttttggcagactcctataaaaacaagattgaaaaagaattttattgtttgctgatatccggaactgccaacggagcctggtcccaaccgccacccaaggctctgtagacagcaacactcgctttgagctgattaaccttcttttctaccagctcaaacttagattccagggcatcccgctgagtaagcaggacttccatataatcggcacgggcatatttgaacaggtcgttggaaatatctatagattttgttaaagcatttacttccttcgatttgatgttcacactgctttccagattgtggattttcgataactggtttgctacctcaatataagctcccagaacggtctgttcataatggtacacagcctggatctgtctcgcattcgcattgtaatatgcagctttaatcgctcttctgttgatcaatggagctgtaagctctcctgcaagagaaaacagaaacgactgaggtttgataatatacagcggattaaaagcctgtaacccgattccggcagaaagatcaagagaagggtagaaccttgccttggctgctttgatgtcaagtttggctgctgcaagttcatattctgcctgcttgatgtccggacggttttctaaaagttcagaaggaattccgccatacactgcctgcggaacaacagaatcaaaagaattctgactcctttctacaggctgaggaaatcttcctaccagataattgatcttattttcagtttcaacaattttctgctgaatatcatactgcattccctgagttttcagaacctgggcttcaaatctctgtacagcgagttcattggacctggcgttcttctttaaatctctgataatctccagcgcatcgttctgaattttgatattctgattcagaataaccagttcattatccaatgccagcagctcataataagaatctgcaatctctgaaataagattggtggtcatgaaatttttgccttcaatgctggcaagatatcgctgtacctgagctttcgttgcattatgaagctttccccagatatctgtttcccactgggcctgggcacctactccaaaatcaaataatggttcaggcatttcccggccgggttctatttcggtattggcttccatagctccgatattggtgtagcggcttactttgtctacaccagctccggcttttaaacctacagaaggaagatattccccttttttggctttgatttcatttttagacatttcaatttcctgaaggacaatattcagttcctgattattctgaagagcctgcgtaatcagttcctgaagacgcgggtcactgaagtattcattccacttcatctttcccgtattgatagtgtcattttctgctgaaccatatttttcagggacggttttattttcagcacgctgttctatttcgataggtttacaggcagtaaggcttaataagaagactgccagacctgcatattgatatatttttcttttattcataatggatcatgtcttcgcttaatggagattcatcttcgtctttaatcatttttttaccgtcagaccacttggcaaatatgtagtagagccccggaatgacaatcactccgaatagcgtccctatcagcattcctcccaatgaagatgcgccaatggtatggtttccaatcgctccggcacctcttgcaaaaacaagcggaaccaatcctgcaataaaggcaaaagaagtcatcaggattggcctgaaacgggctttggagccttctactgcagcttcaagaatagaatctcctgcctgacgtcttttcacggcaaattctacaataagtactgcgtttttaccgagtaatccgataatcatgatcaatcctacctgtgcgtagatgtcattttcaagtcccattgcttttaataataagaaagacccgaaaactcccaccggtaaagaacaaagtacagcaaacggaatcaggaaactttcatactgagctgccagaaccagatacacgaataccagcacaacaaggaagacatagatggcttcattaccacgctgcgcttcatcgtaagacaatccttcccatgccactttatatccgtgaggaagtgtttttgcagcggtttcattgatggcttggatagcatcagccgttgtatatcctgctgccggaagtccgcggatcgccgcagaattgtacatgttgtaacgggtaatttcgttggggccctgcgtcttcttcatcgtcataaaggctgaataaggcaccatttcatcacggtcgtttttcacatacaggttcatgatatccgtaggaagtcttctgaattccggcgatgactgtacatacaccttaaagaactgtccgaaacggataaagccctgctcataggtactcccaatcagaatgttgaggttgtccatcgcttttccgatagaaactcctttctgcatggcagcgttattgtcgaataccagctcatactgaggataattggctgcaaagaaggtgaatactcctgaaagttctttacgttttttaagctgtgcgataaaatctttattggctttatcaaattcctgataatcggtggttctgttaagatcaagaagtctcatagagaaacctcctgaagatccgaatccaggtacagccggcggttcgaaaaattcaatggttgcgccgaggtcttttgatttttcttccagttctttcatgatctcctttacagaatggtcacggtcattccagcttttaaggttgatcaggcaggttcccgcattggatccacggccttctgtcatgatttcatatccagccagtgatgatacagattccacaccgtctacgcccatacagattttctgcaatgttctggaaaccttattggtctgttccagcgtagatcccggaggagtctggataatggcataaatagttccctggtcttcattagggataaatccacctggaagaactttgttgattacaaaaattccggcgcagaaagcaatcagaattccccatgtcaccacttttcggctgacaatttttctgaggaatgaagcgtattttcctgttactttgtcaaaaccgctgttaaaagaatctaaagctttagtgaaaatatttacctttttaggttttccatgatggtttttcaataacattgccgccaaaacaggagtcagcgtaagggctactaccgcagaaattactatagaacttgccatggtaatagaaaactgacgatagaaagttcctacaggacctgtcataaacgagatcggaatgaatacggctaccatcacggctgtaatggcaataatagctccggcaatttcacccattacttcttttaccgctttgtaaggtgaaatattactgtcttccattttggcgtgaacagcttctatcaccacaatagcgttgtcaaccacaataccgatggccaataccaatgcaaaaagggtaacaagattgatggttaatccaaaaaactgaatcacaaagaacgttccgatcagagaaacaggtacggcaataataggaatcagggtagagcgccagtcaccaaggaaaatgaaaaccacgatggcaacaaggatgaatgcatctctcagcgtgtgcattacctgttcaatggaagcatccaggaattgggaaacgtcataactgattttataatcaactcccggagggaagttccctttcatttctgcaagttttgcctttacgtctctgattacatcattcgcattacttccgtagttttgttttagcacgatagaagcggaaggatgtccgtcaagattggaataaatatcaaagaattcacttcccaattctactttggcaatatctttcagctttacattctctccttcggcattggaacgcacaataatattttcatattcttccggtttgttgtattgccctttataagtcagtacatattccagtgactgtgcagcaataccggaactttgcccgattcttcccggacgcccgataatactttgttctccaatagctttcatcacctcatctaccgagatatcataagcacgcatacggtcggggttcagccagatacgcatggcatatctccggcttcccaggatctgagattttgcaatcccgtggatacggttaatttccgggatgatattcaccatagagtagttgtacaggaacttttcatccatacttttattcgtactgtaaagattcacgtacatcagcatactcggctggatagggtttaccacaaccccttctttctgtaccagttccggtaataaaggcattacctggtccactctggtttttaccagaactactgcctcattcggatcagttccgggatcaaaaacaacgtttacagtagcttctccggcactggtggcatcggttgtgatgtagcgcattccctgaactccgttgatggcattttcaatcgtaatcaaagatgattttaccaatacatctgcacttgctccgggataggcaatggaaactgctactgtggttggggcaatcttgggaaactgctccgtaggaagctgcttcatggcaatccctcccataaacaggattacaaccgatatcacaatggcgaagaccggtcggtgtattacttttttaaacataatgctgctttggggttactcggcgtacagatccaggttagacattactttttcaggcttttgatattttgagctgatcttttggttttcctgaaccattctaagaccttccagaaggattctgtcatcctttccaagcccggaagcgactacataaatatgcggtaattcggcagcaacttttatttctctggcatgtactttaccatctttaccgatcacatagacatatttcttttccagctcttcgaaagtagccttctgaggaatcatcatagcattggcgtaaggtgacgtaatgacgatgtttccggtttctccgtatctcagcagtcctttcggattcgggaaagtagctctgtaagcgatatttccggtctcattgtcaaaatcagactctatggtctgtacaataccatcttgtgtaaactctttcccattggccattctaaggcgtacatgcatcggactgttatcctttttcgcatccatctggttaagatattcagcttccggaacattaaaatagacccacattttgctgttgtcggagagttccgttaccagttccccttcatccaccagactaccttttctgacgtgtaattttcctacaattccactaaaaggtgcacggatttcggtaaattttaaatgggtgttcattgaagccagttcagcctgggctttttcatattttgctttagccattgccatttcctggggagcaacgatgtctttgtcggagaggttcttggtattctgatattcaatttgtgcatatttagactctgctttggcacggtttacatcagattcataaagattaggcataattttgaacagcagctgccctttctgtacgaactggccttcatctacataaatagactgaatatatcccttttcctgagcacgaagctcaatatgattaatagaacggatttgagcaacataatctttgttaaccaaagtatcttttacaagcggacttgtaacattgaatgacgctgcttctgttttttcctttttttcagattggcagcctgccaacaggaaaataaggcacaagctgatatacatgagacttttcttgaccatgataagtattgtttttataataatttataattgaaaaaatagagttaccggctctcaaaataaattaagaaagctgataaggttttcggaaaaattactataaaatcacagtcggatgaccctgtactggatgtacagatcatcatgtaaaggctttaaaagttctgactgagaaagtgaaacagcgatttgtctgtcgtgaaatgtagtgacgaagcctgagatcagatgccagaaaccttctttgaaaagggcaagaagttctgtagaaccggttgattctacattatcatcattttcgttgtcattttcggaaagattcgctctgattttgttgtagtggggatggctgatattgtaagcatcattggtctcgtgatttttaagaaatgcaaacgattttttgatgctttttttctggtgaaccagaagatccgtagtaaagtgaagatcagtaggaatatctgttgagatatactgctggatttgcccatagtaccaacccaaaacggtaagcaatgcaaataacaaactgtacaaatattgataaaaccttttccgcatcccagagacaaaggtaattaaacttcaaaataagtacaaccgttatagattaaaaaagtgttaaaaagtgcccagtttattgaaaaaaataaagagaaaaatattattctggcattttccggaggggacatcggaatagattaaaaagaatctgaatgtaaagatcgtctgagaaatggttattagtgcataatttagtgtttttaacagaaaaattaatcttatttttgaaacggcattattctgcataatttttgctgtaacaagctacttttaacggttaagcataaccggtgttacaaaatcttccaatattatgatgaaaaaataccttatttatatatcacttttaggagcacccttattttggggacaaggtaaaatgactgaagcgtctgtataccagcataacctggctttatcagaacaggaaaacaaagcgatggcatttgatgctgatatcagcttatctgaggcggaacagactttggataaaaaaatatccgggatccgtaaacagctcctcagtgatacggaatcgaagaagatatctctatataacagttcttttaatgaattaaaaccattaatagaagacagcaatctgtttcagcttctccagacgatgccgaaaggaggtttgctacatacccacagcggagggataacagatgtgaagtggattatttccagagtgcgaaaatatcaggaaagctatgtttacgaccagaaagataatgatcagtttattttcgggcagctggctttttttgaaaagggaaaagttcccgcgggatttgtgagccttgataagaaactggcttcaagccctggttttgaaaaagagcttcaggatcttcttacgttgaaacgtgaccagctttgttcttatacagattattggattgaatttgaaaaacgctttaaacgcatcagcctgctgcttccgtaccgtcctttcttcaaggaatattatctgaaaggattccaggatctgataaaagataaagtacagcatgtggaaatcaggtatatttttgatgaactttacgatttccagcatggaaaatatcctttgaaaacttctatcacagatctgcaggatattcttaagcagatacaccaatcggatccgcagttcacgctgaagcttatctattcaagctttaaattcttagataatgaaagtattggaaaacaactggaaacggctttcataatgaagaaagaatttccggatatgatctcaggctttgatcttgtagcggatgaagcggcgggacatgatatccgtttttttgagaaaagctgggcaaaaatggatgaacttcacaaaaagtacggcgtggaactgcctcttttccttcatgcaggagaaagtaattctgccctgaatgaaaatgttctcgacgtagccttgttgaacaataagagaattggccatgggctgaatcttatctattttccaaaaaccatggagcagatcagaaagcagaacaagctggttgaggtaagccccatcagcaatcagattttaggatatgtaagcgatctgagaaaccatcctgccagggttttattaagcaacggaatacagtgttcaatcaatagtgatgatccttcagtgtatggatatacgggactgagttatgatttctggacaacactggtgtattgggaactggatgtaaaggcattgaaaaagctggtcttcaattccgttcagtattcttctttgaatgacaatgagaaaaagaaagccacagcctatctgaaccagcagtggaatgattttgtacaaaaagccaaccagcaattcaattaatcagaaaagatttttctgataaaataaatcgcattattgaaaccaatgatgcgatttgtcttttcaggggatcagtaaagattacctttttagctttaacctggacaattctttttttataacattacccagttttgaagggcttacttttgtcagaaccaaagattcacaaccattgaacacagcaaaacgttttaaggtttctgcaaaaggaataagccaaagttcaggggcgacggtgctgttttcaatatgtaaatgaataagctcaagctttttttcctttctgtgggctttacagtcgactcttccgataaactgatctccaaacaggatgggaagacagaaatagccatattgtcttttttccttcggcgtatagcattccagccggaagtcgaaatcaaagatctgtttcacacggtcccggtggataattgagttatcaaacggagacagcagccatactttggaatctgtcagatccaatgttttgttcagtatatcattcggtacaaaaacaagagttcctccttctgccttgatttttgatattctgtcttcttcgagcatacgttgtaacacttcattgacgtttttcttcagctcatttcctttgcggagatgagtgatctgttttactgttgtaaatccataggcgcggagattggttttgaccagatattctgcaaattcaagcggggtgggctctgtggtgttcacagaagaaggcagcactctttctgccagatcataagttttctgcattccggaacggccgctgatcatcaggtctccctgcatgaaaagtcgttcaagggctagtttggcaggtttccagttccaccagcttccggctttatggctctcattttcaaaatctcttgctcttttaggtccttcattacggatggtatctgtgacgtactccatcactttaggatccgcattataatagcgggattctccgcgtttgatggccagcatctggggcaaaacataccggaaatcctgcatgggaagataggaagcagcatgaaaccaatattcaaatactttacgttcttctaccagttcgtccagataattagcctgaaaatcggggattcttgtccagagcgtatgatggtgggcacgttccaccatagataaagtatcaatctgtatatatccgagatgctccaaagtgttaagaaccgcatctttcccggttccgaacggtgtgttttgcgttaagccctgactatccagcgttgtaagtttcagttgttctaatgccagcttcttttccatatccgaagaaaacagtttgtgatgttcttttcaaatatagtgatttaacggaatgccctgaacggtatctgttaattggacagggggcaaaaatcagttgttttgacggttatctcttttcagttccctttcaatttcatccacataaggaaggggagtaaggtaactttcttcaatatattgcctgatactttcatcagtctttttgttaattttcctgataaaaagctgattgctggtctttaaagattgaatataattaaatgtattctgagtattttgaaagaaggatttctcaagtattgctcttttatcatcattgatgataatatcactgaatgatgtattcataagaacagtttgaaaaaaagattctgcaggtaaaaaagtatgaagataataatcctcaaaatccattactgttttgttgttggttaaaaataagcaggtttccctcgtgaaaataaaccatttcccgcctatataaggtattacatttttcataaaagatcttttgtagatgaaagatgagatcatataagccaattctgtaaaatgattttgtattctttgcagagtatccggtctgtaaaatttctgatcataataaaagagataattcctgcctttattaatagtaagaaatttacggatgatattttgtgacttcagcggataatcttcaccactcagatttataaaataatcccattctttacttacattgagaagaaattccatagcgttcaattctgcctgaaccatgttgaagcctcccgaaacgatattcatactgtcaagaatatagacattgggaaactgaactatatagatttgtatttcttcaatgaaatccggtttcgcttttttatcaatatgaataagataaaactgatcccttgtatagattttctgaaacatgtttttaaatacttcaggtttatgatgtaccataatgaaataagcaattcttacatgaggacccgaacgggattctgatattctgggagaagggctggatatgggggaggaagtttgcatattttggagtttaaaatcatccgcataagcaaacaattcagttaatttgcagaaggtacgaataaatttttgataatcaattaattaaatgtaattgtctttgttttttttattgtaggtttgcagaacatttataaaaacaggtcactgcctttgctattctgtcatagtttaaaatcacattttttctttcagttttgctttttcagctaccaatttatagtcttttccttatggcaggaatatatgattataaagttctattgtagataagagcgacacgttattgccggttaatccgtaatatattcaaggatatttatgaaagctgaagcaagaaaaagatgagcagaaaagaattctcttttgtttatcattataatactccaattcaaattctgctccgcagatttgtttgtaaaataccggaatccggaatttataatgaattttaaaaatttaaatttaatcaatcctattatccgtgcagtgacagaagcaggatattccaggcctactgaaatacagtatactgtaattccgcatattttagcaggaagagacattataggatgtgcacagaaaggcgctggaaaaacaggagcttttgccttgcctattttacagttgctgaaaagacatgcgccggatcataaagaagtacgggctttaattcttactccaacaagagaattagcaatacagatagaagaaaatttaaaaatgtacagcaagtatctgccattatcccagctttccatttataaaggcgtttctattggcagccggcttgcagccctcagaaaaagggtagatattcttgtagcaacacccggagaactgcttgatgtagagaatcagagacatattgatttttccaaaattgaaatatttgttttggatgatgcggatagaatgcttgacatggggcttaccaatgacattaaaaaaatctcaaatcttatctctaacaaaagacaaaacctgtttttttcggcaataatgcccggaagtgtaaggcattttgcaaaaacgattctgaataatcctatagaaataattgtcagtcccgctttttcggaagtacagacaattaagcgccctgagattaagaatattcataaactgacaggagatgcaatgtctgtcagcctatttcataaataaaatctgtagcgtttacagattataatatacaattttaataacaattacaatgcaagaaggcaccgtaaaatttttcaatgaagcaaaaggcttcggttttattactccggcagacgggagtaaagatatatttgtacattcttcaggattaaatataagagtgatccgtgagaacgataaagtagtttttgatgtacaaaacagtgataaaggtttaaatgcagttaacgtgaggttggcataagcagaatatttattacaagtatgtaaaattgatattgtttgtcatatcaagtctcctatttttatatttttttacaaattcagattcatggaacttcagtatctggatatattgttttaaagaacattgatgtaatgtagattactttttatttttttattttcattatgttcattagcctcttacttcaggtaagaggtttttcaaggatttattgatatccggattgattgtctgaaaagtaaatgtacagacctggcctgcaattattacagtattgattatcatagctgtatctattttaattcccggaaaaatatgattattattaatagttttgatgaatataagtcccttgaagggcagatgatcggagattctgactggcataccatagaccaggcacagatagacagattcgcagatgctactttagatcatcagtggattcatattgatcaggaaaaagctcaaaaagaaggcccttttcactccaccattgctcatggttatttaacattatctctgattccctacctctggaaacagattgccgatgtgagaaatgtaaaaatggaaatcaattacggaatagaaaacctcaaattcggggcagccgttcttgtaaacagtgatgtaaagctgcaggcaactgtaagatcagttacggatctcagaggaactgtaaaagctgttgtagaggcaaagctgctgatcagagactgtacaaagcccgcatatacgggggatgtggtttttctttatcattttttgtaaacggcttaataaaagctttgtggcttttgtggtatgttttggcccacagatgccccagattttcgcagatgtttatatctgatactattctttattttaccacttaagaaaacatctaagatttttaaaaacttatgtgcacttattcttcggaaggatatcatcttcatctaagtgtttaaaagctttgtgacttttgtggtttgtttttagccccagctgttacagattttcacttacaaagtaggactgtaattgtatacgtgaaaatgcttatgtattacagtacaaatacttagcgttaaaattagagatttatactctacaattcgttcctttttcgccgttactttggtatgttcaaaagaagcttcataacctgaacaacggcagtatccgaaaagccatcaaaaagagtaggaacaataccaatattattaatcatgaaaaatcctgaaagtgttgctccttttgtagaagcctcacaaattatcacagaactgaaagacagagccaacgaaatcctgtcaagcgttttaagtacagacctgtctgctattaccattaacggaaaaggaaatttcccatattactggcaggacccttccaatctgaaatttaataagaaaacctatgactggatagcctgcaacctgaaagccgatactgagccggtgcagctggaccaggtgtttaccaattatttcattgatgttttctcgaaagtcaattattccttatctgaagaagatacagccgtactgaatgatgcccattcaagagctacagatcagcagatggctttacttactgcatgggtgggtgcctatggctcacttcctcctgctacagacaccatgcaaccaattgatatcattatggataggattgctacggaatgggccaaccctgccactactttatatcagattcagaaaagtgaaaaccttgatgctttactgaataaaacaccggcaagcggaaaacctattcttcctgtcttggccagttatctggatgctctgggggctaccatatctttacagaataatgtgacgatgaataatggttatctgtccagagttctgaagaatgtacagaatcctaaaaaagaaaacggaggactgcagctgaatgacgacagtattttaccagcttttgaggtgacaactccgctcgacaagattttaaacggccttaaaaatacttcacaggcagcccagatcgatatggaggtcagccgtgaatctgaaagccggttccgtgtttccgtacaggggaaaacgggtttttctattcctatctttgatttctttacgttgggaataggcggtaatgcaaattattttagtgaaaatattgccatcagcaaaaattctatcaaaatatccatgtcatttaccggggttaccctggtgacctttggtccgaaggattttaatattgccagcaatttgtactgggcatggtttgatcctatccgaaaagcgcagatcaacagcagagacaaacaggaagaaaaacatatttcaggatacaaattctctccggatccggcaacgaaattcgggcctgacggacctttcggtttgctgaacggagtggcaatttccaattatccaagtgttgagatcacagtaaccggtgaagattataaaagtattcagaaaacttttgagcagtctacttctgctacgctttctttcttaggaattcctctggcaagcgttaaggaatctacctattcttcttcttattctgtagaccattcaaaatctacgatcaagatcacactgacgcctcctccaagcctgatagctggtaataataaagattccatagcctgggtacttggtgctattgtagattatcctgcccagataggtgaaggtgttgaacttcttgatgatgaggaattagtggcgaaaggtgcttatcctaattatcaactgtataaagataataccggaactacttactgctcggtaaaaaaagtaaaatcccacgcagtgggcagcgaatggataagtgagtgtctggcagcccatccgggaacaagcccatccggaaaaccatggaccagccctcgacaatcaggggtaatctggccttaaaccaataacaaataagccataagaaaacagactgtctcaacgaggcagtctgttttttatatcaagatcttctaatatcggtatagtttagtctttttggccggaaaaaatactatttgacaagcagatagattccaacgccaatggcagcataggccgtcactgtaagaatatcagcaataggctgtgaaaaacgtctttccgcaatcttctcactgttgatctggttcttatggaatttcagattctttttagcattatgaaccggatgcactaccaggctgtcaccttcccatcggtcaacaatgactttgtagcttttgttatccacttcaattttaacgtttttaccggctgccagtttctcctgaacattaacaggagcaggcggttgctgaacattcaggttctgggaagcagggtcgtttttcggttgaggagcggtattattagcaagcttattgttggctgcaggatctgcaggcttttttacctgatacgtatagcagctggtaagggaacataatataatgatgaaataaagattctttcgcatgagccaaatttaagaattaaacggaatatttgggagtttgttttgaaagatcgtgtttttttggaaatctatgttttaagatgtacatcttttgatttgcagaattaatattatttctaaagtcaagagataaaaagtggcaaacatctgagattaaaaacaggtcttatagatatttttctattttgtaaactttttaaatattattaaattatatatagaaaatcatcataaataaaatcacaaataacttaaaataaactataaataaacaatatttatttagttgataatctgatatttaacataaaaaacaattcttgtatgattagagttatttaatatattagggttgagtttaaaataatcataacactaaaaaacatttaattatgaaaaaactaattttattagctgcttttggagcagctgggcttgcaagtgctaaagcaaatgatggaaaagcaatcaaaaatgacaacagtattgaggctaatactatgcaaaaaacagttgtttatcaagaatgtggcgttgttgttacttattggtctggtggtcaaatcgtaggacaggagactatagtttctgatcagccagatttacaaagttgtcaacaattccagaccggtgtaaaagttgctttatgggcggctggattttggctaagttaataaattgatttaattttaataaccctttcagtatttacagaaagggttataatattggaaatattctatgaaaaaaatacttctactgacattggtttttgtttcgggattatgtatttctcaacaagttcatgtaaaatatcaacgcgttttatctccttttacaacaacgcatgaggacttatatattaagaataatcaggtattatcagttcaggattcaataataattaataataagttaactgattcctggactttgggggtgaatttggataatggtaaaaagccttcaaaacaatattttgtttcagacttagataattctcctgaaagaaacttcttctttacatcaagtgttgataccaaagaattttttatatatgataaagttcctcagccgaaatggaatattgaagaaaaagaaaccaaaacaattgcaggttacaagtgtcacaaagcaacggctgatttccggggttcaaagatcatcgcttatttcaccaaatctttaccatattctgtcggtccatttaaattttatgggcttccgggattaatcttagatataagagttgaaaataaagattatgatatatggaaagccgaatctgttagtacagacgatcaaagtaaaatagtttataagcctcaatttctacgtaaagataaaataagttttaaagagtatgtagaagctaaagaagcacatatgaataaaatttttgcaaaagtttctgatgccctgcccaaaaacagcaaagttactgtcagaacaaatcaaagattttctgtagagcaaaaatatgaatgggaaaataattcggaagtaaaataatattttctgtaaaatagaaattatttatatagtattaataatcgaaatccaatccactacatgagattataactttacaaggttatatatagcatcgacaatttgggctataaatgtaattgaattttcaacatctacattctctatatcttgtatagaattagtgaataaatctatatctgcttcatgaactatctggtttctacgaattacaatatttcttaattcaattttgagattattttgatccatatttacataatctgcaattttttgccatttatgattttctggccatataagacttaaagcctgagctattttatctggatcttggaaagataagtgtttatggttttcaataattatattttctaaaatctgatttgcagttaattgtgaagtaggatttgccaaagtattgatatgaagcatgctaatagagaaagaattataagcgggagtattaattcttaagccattatatgattcaagtattccaatcttaacaatatcatgaataaatttgtctaaagctgaaaccatatatacaatttcacttcgtaacaaatcaactataaaatcagactggaaatgtagttcgttacttaaatgattgtataattcatgaattttatttattctttcacacgaattatcaaagtctattttagcgttcagcatattctttaatatgaattatttgtgctgcaaagtcattaaatatatcatcaaaaaattttctttttttctgcaactgtgctagtactggtccagtattatcaatttcggaatcagtaattgaaaatactggaacccccactaaatttgctttttgtagtaggctttgaaaatcaggaatttctgcaaggcaataattatctggtattttactatctataaaagaatcttttccaagtagcatattaaccttttttaaagatgggataagtgactttgtcacttcgtcaataatctcattcatattatttctaaatggagtattaggtttaccatttctgatgttaaatcgctgtattagtaaacctcctagcttaggatgtctcgatggaaatggatatgatgattgtgcaaacattgtttgcatcatttgagattgttgcacccatcgtggtaatacatgagagagtgttttaatcgccatcaaagagaaaggatcaggattagtaggaataataaacaaatcagaaatagagaaaaggttttgatttattgcacctaaacctgggttaacatcgaatataacatattctatagcatatttttctaccaatagatcaataagtgcattaaatgctccaggcaaattttgcattgtactaaaagcgttattagatgtttgtgcaaaacttaattgaggctcaatttcagtaagattagggtgtcctggtaataaaaataaattttcatttcgtggagtttggaaacaatcgaatgccataattgcttctggtttactttcaaaggctgggcttactgcatcttttaaattattgtttttagtattatcattaatataatattcttcaaaattatcttggagtattagacccgtcaaattacattgtgggtctgcgtcaactagaagaacttttttcccttgttcagctaatttccagcctaagttgaaagtagtagtagttttgctgactccacctttatgattgaaaaatattattctcatggtatttaatttagtatatgattgccaaatatagaaaagattgttctcaattatttacggttttccgtaaacatgtctgagcatagaaaaaatccttgaaaaaattcaaggttgctcacgaagagattctgtttaaataatctctttcttttaatttctgactacccttttttttgggttgatctaaccaaagattgacatcttatttatgactctgtttgtaatagagtgagttgaaaagggagtaaaagttatctggatgtctaatatgacctctggcttactgcctcattcatccaaactaaaagagagactatctcagtctctcttttattattttaaaacctgctggtcataaagaatattatcgtcttcatcaaagcttatgatgagtactttaaattgctttgcactgtcattattgaagaacttgattcttggcggaacgtaatcgctgtcgaagagatttggattccagtacagggtttcgcgcgtgtcgttttcaattttttcaggggcgttatcatcaatcatttcaatagggaattctgaaggtttatcatatcctttgatgatggctgagttgttctttttcgcttctttttcgttgcttttaggtttcatattgcctctcatcgtatagacggccacggcatcgcctactaaccctgctcctttaataatttttaccatcgcaatgttgtcaacgggaagattggcaatcatggaagcatcggtaggtatttcatctaaataaagcttagcctgctgcccccggatgtaaggtacattgacgcctgtactatttctctgaaatgtaaggccggcagctcttccctgcagccagtcgaggatattgactgatcctgaagcatgctggtcttcattcacaaagtcaaatatagtagcattggcagaagtgaacatgccgctggacagctgtttatccagttctgccttcggatctttcttttttcctaccaaagcaacttcctgaatctgtatgtcattactctctttctttttaatgtttttttgagtattgatggctcttgaaattgttggaggaagcgttttatttttatcagcttttaccagtgtatattttgtgggcgggaaattacctttgaatgttgtaggcgtcactaacggttctgcggtcacaaacagatcttcatttcctgattctttattttctgcattgacgaatgctgaaatttccagaggttcactaatgttgaggttatttaaataaatatatccgttctgatctgttttaaactggctgaatgccggctggccctgacctgactttgataataagttaaccgtcgtgttgatcatcagggcattattcttaacaggtttcaaccggtaagaaagatattgctgagactgggttttaatggtgggggcagctccgctcagtacggaattccagtcaaatcttttccagttttcagagataagcagggcatccagcgcttcagtgttggcatttttagaaaaatactgtgccgggctgtctattcttgttgtaaaatctcccgtcagccaaagtccgcttaaaagattttcttcctcaggagcctgggttccgttatcttcacttacgacaaccgtataatttttaaaatacgattccggagaaagatcgatgctgttgaaagctcttggtattgttttcaggctttggcctacaatttcagccttttcaatttttaaattaccgggttttataaaacaaagtctctgtgcagcaatattgtcctgctcatcaaaaatcaccaattgtaaaaccccgttagctccgttactgattttggtagggataagacttgatacatcattggtcagatgattgatgttggctctgtaagcaagatgattattgataagcccgacaattttatacccctgaagctgttgtttcaggttaacacctttcaaggtatatttaatcccttctttggagcttgaaacctgtatattcaagccgctctctgctaccggtggcaggtctattgtctggctttttcccgtattgtcccggatgatagcctggtatttctttcctgcagccggagttattgtaaaagaggctacatttttatcaaaagatgtaaaagtggtaaccggagtgtttgggttctggctgtcgattacttttccggtccagctttcaggcagagaagaattacttgataatcttaccgcaaattttaccggcataccgctaatgaaagttccgccttccggaaaggctttggcagaccagtccgggcttttggcaactaccaatgattctgcagagtttgggttataaaccggaatggttttaacaatctgaaaatcttcactaaagttggtcatataaggcgtatatgcccttacaaaataaacctgttccggaagatcttctttcagctgaaaatctccgctgccttcaccattggtaaggagtacggttttccagtcaattaattttttatcagaattataaagctcaacaaaaagggtagtagataatggcgagcggttatatccgtcgaatacaaaacttttgaaccatattttgtcacccgcagcatattggggtttatcagtgagtaaatatactttttcctgttcgtaattattctcaagattggtgatggctttttccagtttggtttgtgccagtacaggctgtaccatagaaagaagcgctacacagaatatatttttcatagaaatctcggcgcattttaattctgtgctaatgtagttaattaaacgtttcggaaattgatatttacaggttatttcacaggaaatcataaagaggaaaataacaggcctgtaaaaagagacagctattgaacagctgtctcttaaagtcgttatcttttaaagtaaaccttatcgtttctattcaaaaaggtttttaattcttacggttcaagctctgggcctccacatgagctatacggaacgcatgttaacttatcattgacaaaacacattcttacacattctgatcctccggcaattgtctttaattcttctttgttaagcttttttaaatttttcatatgaatatattttatgttcataacaaatctctacataattatcttacgatagatgacattaacaaactttaacgctaacattgcctgtgactttgaccatatttttttctatatttagaaagaagtatatgagtagacttatatcaggaaatgacttgtttttgtattttgtacgctggtattcctgtccatataatttaaaagaaaacaatgccgataaacccaatacctccggacggaggcctgttatataaagaaacagatatgactcagtttttccctgagccgttaaatgcaattactgctgtattatttttagccatagccattttctggaccgttcaattgaagggacgttttaaagaatatccttttttaacctactgcctggtcttattatatattggagccataggaggtactgtttaccattcattcaggcaatggccggtatttattatgatggattggctgcccattatgttactctgcctgtctgccgggttttattttatagcgcaaagcaccaaatggtactttgctgctgtaatggttctgggatatgcaatactgatgttcgctttaaggaactggattctggcagataacccttctctttttatcaacgtcaattatgcaattatggcctcgtttgtagttttctcggtaataaggtatctgatgtatacccagtggaaagccggaaaatgggtaggctttgctgtattatcatttgtttttgcactgaccttccgtatcgctgataaatgggaatggttcagcttcgggacccactttttatggcatacgtttggagctgtggcgacgttttgtatgtttaagtatattagcctgacacatgagtcaagtttaaaaattaaacggaatacttagtgttttcttttaaaagatgctgcttttattgctaaatgaaataatctccaaagtttctatacttcggagatctgaaataatataagttataaatatttaaaattattgattagaaatacgttttaatatttcttctaaagaaaaatctgggggtaatggcttaaattctttacttgtattgatagatgattttactctttgaaaatttcttagcttttggatatcaatttgtccaacaagaatagtatcattgagtcctccttttaattttaataaatctttagtggctgtctctttaggttgtgtcaatctggtgtcaccatacttacttgtattgacttgagcaacaaaacaatgtaaatctctcgaagtagattcaactatattcgaaaagtatggtgtatctttattccattctactccgattaataaatctatttttgattttaatttttctctatgacttatatttgctaattcaaagcaatagcaaactgaaaaataaatatttctgtaattaataatttcatagcgggaaggttttggtttagggactgccaagtaatgtttattaattaaatgttcctctccaggagaataattattttttaatctaaaaataatagtagcatcattaattccatttattttttgtgggagaattgagattacgaagttaaaagatgtattttttagagtcaaatgttcaattccagaaactatcataatttggttatcagtagaaaatctacctaatgccgaaattaaacgcattggcataaagttttcaggaaatagcaatagctgagcatcagactttcttgctttagataaaattttagataatttatttattcgttcatttgatagaataggtgaatctaaaatacttgcttctatattttcctctaaaacatcagtatttgcaaatgcaattcttggatttagtaatttctcgtctttatttactgtaaacttgttcactaaaaagtcttcttccgatccataaatcttttgtaatgtataaaactgatttttaagattttgatttaattcatgattcggtttatgtttggagttacccagacaatatagatcaaacgcaacgtctaaataatcttttttattataggcaattctttttttcaactcattattttcttcatcataaatttcctcttcatactcttccataatatcatataagatattagtttctatgacttcagaccgatttgaattttctgggttaaatttttgaaattcttcaaatgctgatgctatgcaacattcccagaattttataggtcggggggaattttttaataatgtgcgatcaagtttgtaattttttatatgaagatttttgtcaattaaatttaagtcaccattttttccgtcttctgtataatttaatagaggtatagaaacataatgatgtctaatcatatttgcttctctaattctaaaacctactttttttcgtgatttataaggatttataaaagaaaattcggcaaatagcaaagcgaaattttctcgactagttttattcgattgaaattcaaaattcttatttacatcataattttttaagaattttaaattcaacgaaatgctcatttcaaatgcaaaaaataaatattgtgttaatgcatcatgtacttgtattgcaatttctctagttaagctatattcgttgttagttttgtcattatctttgacattgattttttcaatttgttctagacagtgaaataaaaactcagtaaaggcggtaggatcatcattaactacaaataatgttaatatcttttcccaaagcttatagaaagtcaaacagttttctcccttaaaaaactttaaaattttttctttttcatattctgatattttttctctttttcttaatcctaaattgattttgtgtgaaagataaacagataaaccaaatcgatcttctttataatctttcaaagttcttattttaccatctgtaccatcatatgataaatgataagcattttcttcaaactctattaaattatcttcatcattaggcatatctcggaattcactagatttatcttcgatttccttctttagtttgtctataacaacacttgattcgtttttatcaaaataataaattaaggttttatcactttgacaatataaagaagaatatccgtttattttgaaaattcgattctctggtttattaaattctttctcaatggaaaacggggaattaataacatctattaagggataaaagttttttaatatatatagttcaatatctgttaaatcttttaaattaaaatttctgtttttatcgaatgatgattctttgtaattttcaaaaaaagtataatatttatctaatgctttattatccttattgtctgttgtattaggttctgatattacaattaaaatgtcgtccacatatctaccataatatgctggtttatatttttcaagtataattttatcaaaatcttttagatattcatttgctattattaaagaggattgaagacctattggaataataaatttattaattctatcgttttctataacttcacttttaaaatcatatggaatttttaattgtagaaccttttgagtaaaaattctatgtaatttttccattaaggtattaaggttatcatatatttccttagctccatcagtataacgaaaataggtttcagatattcttgccgaatagtaatagtctttaatatctaaatttaagaaaagtgtgtttttattattatttaataattgttgtgcagtattaacagcattgtctctccattgttgatattgagaaaaatatggtttatataaagctgaaccaaaaagaatttttgatttgtcttttgttaataacagtctatttcctacacactcatctactaaatctgcatctttttttatcccatccttaattgtccataggacagctataatatgaatttcaattggtgcatgaatgaatgctgtaactttatctagaatatattttgttttaattcttttattagaaataatagagtgaatggaattattttgtgtaaatttttttggatatactgttacagatatttcttctagaagttcatcaaaaaattccgaatctttattgtaattatttattttctctgttaaaatttcaaatttgtcttgtaaggttatttcttgtaaaaaagatgggaaatctaacttgttcttatccttatctttaaccttaaaatatctatttgtaagttcaaaatcagaaaaaatgaaattattttttgagtaattagtttcaaattcaacaatctgttctcttagtaataaatcaccagaatcataaaatatagttgtttttaatttatcatacgcattttcaatatcttcaattgaaaatcttctcatttgttttgatgtcatgaattttagttataattatttgttttgtgtgttattcgaatgtattgtttgtgttttgatgttaaagtggaattgaaatttttaaggttttatttctttatactatagaaatttagcaagttgagtaaaaagaataactctataagtattcctttcttcactaatatgcttgttattaaactttttgaaaactctaaaatactaaaggtatttaatatatgattaaaatggatacggtttcccgtaaccgccaaaaaaaatcccaactttcgtcaggatttatcaattatattgttttcgtaacctatattccaaccattttaaaaaagctagcaagggttaaatttctggcatggcagatccgcattatcgtgagaagagcaatttgataatctttgtcgtcttttattcttcgaacggtcttttcatcaatattatgatcaactgcaaatttgctgttattgttcatagggataacccattcatcccttataaattcaacaatttttctatttgcttctgtcatagaaacaaataaattacttattcttataaaaatctcggactcaaatccgaatatttgcaatttttccttacatttataaaaaataaaccaataagaagattgaaggagaataaagcatttcgcttacaaaatagctttagctatgtcttaacgattcttcatcccttaaaaactcttaatggttaagaaaaatttcaacaataaaaaatacaaacaatgaaaaaaagcaaaacaaactttgataaccggtttcgggcagataaaaagtactccgggttgcagctggtagaaactttctttcagttcaatgagctggatgtttccaaagaaaggctcagcaacattatgaattatgcggtaaagcgaaatagctggatctatgaagatccggcggtgatcttccagttttatcagtcgatgagatcattgatccgggcaggatttctcatgatgctgaaggacagaaaatggacggttgatacacgaccggaaaaaatttccccgtgggttcttggcctgctttcggagaaggaataccggaatcctctgctggtttttaaaacagcgttcagcgcgtacaccatcaaagaatttgattactttatgtccggaattgtctatttctcaatgggcgtctatgaaaatctgccggaaaggaatatcgtgatgccttacatccacacggtgaaaatgctggatgcggcacaccttattcttcagagaaggagagaagcaagagggtttgagagcaggagggtttgaggggtgtgcagtgggcttgagaataatgactgattatagttttggtgttgctgtcattctgaatatagcgcagcgaagtgaagaatctccataatccgctgtactgtttaaaaaaagatggcaggcactactttagaataggggacaagtgcaaaacataggaaataacatattacctgtagcatttaaaccattaaggaaaatgaagaggataagataagttaagattcatctttgatgaatgaagaagaccgctttatcaatatctttagctatatcttaactgttctaaacagcttaaaaaatcttaatggttcaaagaattataagaaattaaacttcgcccgtttaaataaaacgaaattaataatagaaactttgcgttcatcttttaaatcaggaataatttaaaatacaaactgatgatatttttttcagacgcaaagatttcattttttaactgttgattgtaagggagaaaagaaaagaatcaacttagttgattcgttgaagcttatggataagcatgccgcttcatcagcgacaaagtcgcattgctttgcttacttaaaacaaaacggaattataaatagaaactttgcgttcatctttttaatcaggaataaagcatgccgcttcatcagcgacaaagtcgcattgctttgcttacttaaaacaaaacggaattataaatagaaactttgcgttcatctttttaatcaggaataatttaaaatacaaactgatgatatttttttcagacgcaaagatttcattttttaactgttgattgtaagggagaaaagaaaagaatcaacttcgttgattcgttgaagcttatggataagcatgccgcttcatcagcgacaaagtcgcattgctttgcttacttaaaacaaaacggaattataaatagaaactttgcgttcatctttttaatcaggaataatttaaaatacaaactgatgatatgttttcagacgcaaagatttcatttttttaactgttgattgtaagggagcaaagaaaagaatcaacgaagttgattcgttgaagcttatgaataagcatgccgcttcatcagcgacaaagtcgcattgctttgcttacttaaaacaaaacggaataataaatagaaactttgcgttcatctttttaatcaggaataatttaaaatacaaactgatgatatttttttcagacgcaaagatttcattttttaactgttgattgtaagggagcaaatgaaagaatcaacttcgttgattcgttgaagcttatggataagcatgccgcttcatcagcgacaaagtcgcattgctttgcctgcttaaataaaacggaattataaagtgtattaaggtgtttaaaaaataaaattttgtgacctttgtgatttaatgaaaaatttaaatcattttttgtgaaattcacagtctggttcttttaattttgaaagaaagatgatttacttatatttgttccgcaaagtaaaattaaatgtttaaaaaagtaagcactgtatttatccttggattttatacggttttttgttctgcccagcaggtccggcctttaaaatcatctgaaatttaccgcgacctcaaaacccttaaacatcttcctaaagtcttataccttgcggcacatcctgatgatgaaaatacaggattgctctcctggttaatcaacgatcagaatgttgaaacaggctatctgtctttaaccagaggggatggcggacagaatttattgggcacagagcaaggggcagccctggggttaatcagaacgcatgagcttttggaggcaagaaaattagatggtgctcagcagttttttacccgtgcaattgatttcggattttccaaaaatacaacggatacttttaaacaatggaatgcagacagcattacggcagatgtagtctgggtaattcgtcaattccgtccggatgttattatttgccgttttcctcctactgcggcggcgggtcacggacagcatgcggcttcggcggtggtggcggaaaaagcttttaagctggcaggcgataaaaacgctttcccggatcagctgaaatatgtgaatgtatggcaaccaaaacgtgtattatggaataccttccgctttggcggagtcaatacaactgctgaaaatcaattgaaggttaccgttgggcaatatgatgcgcagctgggaatgggatatggtgaactggccggattaagcagaagcttacataaaagccagggtgcgggaacgcagtctgtagccggcatcagaactgaatatttttcacatgttgttggcgagcctgcaaaaaatacactttttgacggagtcactaaaacctggacttcacagggaaatgctgatattgaccaggcactggatcaaattattaccgctttcaattttaatactcctgaacagagcctgcctgcattacttgctttgcgaaaaaagataatgatgctgaaggattcagacctgaaaaaagataaaattaaatctcttgaccatattattttaagctgtgccggattcatgggtgaggtagttaccaatcaggctgaagcggttgccggggatcattataatttccggttaaatctgatttcaaggtcagcagatcctgtcgttttagagaatgttaaatggttaaatcaatcagaaagcttcaacagatcgttatcaaaagattctctgattaccattcagcatgacattcagattcctacggatgcagcccttacagaaccttactggctggcaaaacctcctgcgaatgcggcaactttctctgttccggatgaaacactgatcggtttgcctgaagcagaatcaccactgaatgttttggttggtttaaaaatcggtccggaaaagtttcaggttaagcttccattatctttcaagaaattagacccggtgcgcggtgatgtggtggaagccttgcgtattgttcctgctgtggaactgaaattcacgcaaccgctttatctcgttaaagaaaatgaagatttacatttgagcttacatcttaaggttaattctgataaacagttgggtaaaggtaacttaaaccttatgtacaacggagaaaagttaggtggagctgaggtaaattctttcaaaggaaaagattttaccgttgactacgttatcccgaaaactaagcttgcgtcaataaactcatcccgtttgcaattggatgccagttttgttgcagatggagtaacttataataaaaagcaggtattaatccagtatccgcatttgccttccttacaatattttgcccctgcaacgataaccgtaatgaaaggggatattcaggcaaagattaaaaaagtgggttacatagaaggtgcaggcgattttattcctgagttcctgcgcattgcaggcgttcaggtagatgtgttgaaagacggagacttttatggcaatacagatgcatccggcagcagccaaaacaaactgtcacaatatgacgccattgtgcttggtgttcgtgccaataacacagagaagaagctgggccgctggatgccttttttatattcttatgtgaaggaaggaggtaatctggtgatgcagtacaacaccaaccaggatacaaccgttgaccaattgggaatgtataatttcagtattgccaataagcgtgttaccgaagaaaatgcaacggttacatttttaaatcccaatcataaattactgaacttcccgaacaaaattactgctgatgattttaaaggctgggtacaggagcgtggcgcctatttccctgctcaatgggatgcagcgtatgaaccgctttttgaaatgcacgatacagatgaagagccgctgaaaggttctactttatatgcccaatacggaaagggtaattttatctatacaccgctggcgtttttcaggcagctgcctgcgggaaatgttggtgcagcacgtttattttttaactttttatctgcacagaaaaactgatgaacaggaaacttaaaaactggaatatctggtatatactattaacagttgttttagtattgcagatcgcattttattattggtttactaaattctgggcatgagtactatagattggaccgttcttattgttacacttgttgcagtggtggtttacggcgtattcatcggccgtggccagaaaagcaacgaatcttacctgaaagcagacaataaaatgccgtggtatattgtacttatcgggattatggcgacgcaggcaagtgccattacatttctttcggcaccgggccaggcttatacagacggtatgcgtttcgtacagtattactttggtctgcctctggcgatgattgtgatctgtattactttcatcccgatttttcagcgcttgaatgtctacacggcttatgagtatctggaaaaccgttttgataagaaaacaagggtactcacttcactgcttttccttttttcgagaggcttgtcaacaggaatcagcatttatgctccgagtatcattttatcaagcgttttaaactggaatatttatgtaaccaatgttctaaccggaggtatcctgttgatttatacctatgttggcggagcaaaagcaattgcgcatacccagaaattacagtttctcattatcctgggaaccatggcttttgcaggatatctgcttattcagaatatgccggatggaattggctttaatgatgcgctgtatctggcgggaaaatccgggaagctcaatgtcatcaccacagaattcgactggaaagataaatacaatatctggagcggattgattggcggtttttttctggcactttcttactttggtacggaccagagccaggtgggaagatatatcactgcgaaagataataccaacgcaaaaatgggcctgctgctgaacgggctggttaaaattccgatgcagtttgctattcttctgatcggtgctttgcttttcgccttcttttctctaaaacctgctccgatttattttaatgaacgctcttatcagtatttaaaagaaagacagcctgagcaggccgcagtttttgaaaaagaacatcgcgatttacaaataaaatttaatgaagaatcgaaagaaattctaaagctgaaggaaaataactctcctcaactcaaacaggccattcaggattttaaaaatacacaaacgcaggtaaaagcattgcatggcagagtagaggaagcgatcaataattcaaactataatgccgagaaaaccgacacgaattacattttcctgtatttcgtaaaaaataccttgcctgcagggatgatcggtttactgtttgccgtcattttcctggccagctggggttccatttcggcagcgctgaattcccttgctgcctgctcattaaaagacgttcatttgatattcagcaaagaaatttctgatgagaaaaccgaattaaaatatagccgtcttcacactttagcctggggtattttctcaattggtgtagcgatgtttgctactcagatgggttcccttattgaagcggttaatgtattgggctcccttttctacggtccgatattggggatttttctggtcgcattctattacaaaaagatcaacggtgcgaatgtatttattgctgccattttatcagaaattgcggttattgccgtgtatcagttcgatatcgtttcttttctctggcttaacgtaatcggggcagcagcggtcattatattttctgcaattggattgctgttttataagcagaaaacagtaaattcgtaaacaaacaatcacaaaaacaaacaaataaaaatattatgaaaacgattcttaaatctgcaactgtacttgttgctacgatgacgatctcaatgaatgcctttgcacaggacactaaaaaacctgccagccctccggctactgctacgggaaaaattaaagatgccactattacaataaactacagcagcccttctgtaaaaggacgtaccatctggggaggtttggaagcttatgataaagtttggcgagcgggagccaatgaagcaactaccttcgaaacggataaagatattaccgttcagggtaaaaaacttcctgccggaaaatacagttttttcttaatccctaaacaaagcggaacctggacagcaattttcaacaaagagccaaaacaatggggagcttataaatacgaacaggctaaagatgctttacgcgttgatgtaaaaacaaaagctttaccggcaacacaggaaactttagtttataaaataaacagtaatggattcacaatggattgggacaaaatctcagttcctgtagagatcaaataaattgatattcaaaaaattaaaatcccggtttatccgggattttttgttgaaagttagatcatcaacaacaaaaaaaaattgaaacagtcaaacgataatataagaacaatttcgcaattttgcttctatgaaaactttcaatgatttagccagctataataaatatctcaatctcacagctcctctgcatccattgatggacagcagggtttgcaagcaggctatcccgaactttccgcaggtgagcggtgaaattcaggttaatctgttcaagatttctttaaagaaaaactttaccggagacatcaattacggaaacaataaatattataccgagaacggattgatgcttttcagcgagcccggacaggtagtttcctgggacagtcttactttctgggatgggtatgcgtttgtttttcatcctgatctcatcaaacaaaatccggttgctgctaaaatccttcagtataaatattttagctatgaaatcaatgatgcattgtttatgactgcggaggaggaagagactataacatggctttttacaaaaattcacatggaattggtagaaaataaagctaatgccaacacctctattattttgtcgctgttaaatgtcgtgctttcatacgcagattttttttatgaaaggcagtttaaagataaagcaataaaagctgtttcagtttcttcaaaattaaaaagcttactgcaaaatcattataaagatttatccaaacccgtttcgaattttcctaccgtctcgtctgttgccgaagaacttaatatgtcttccaattaccttacggaccttctccgtgcagaaaccgggaaaagtaccatcagctatattcatgaatttctgattgaacaagccgaaattttattgctccagacagatatgaatatcagcgatgtggcttatcaattaggttttacaaacgttccttatttttcaagattttttaaaaagattaaaggcatttctccaaccaaaatcagaaatcagagaaaagtataagatattccccgatttgtgttaaaaatccagcatttgtgcaattaattttgaacagacaaaaaaatatgtcttaaagatttacatcaattaaaattattactatgatttttacaacacaaaaaataagcgaaagctactggaaagtgatcatcaataatcctccggtaaatgtattcgacccagaattttcagttcagctgagaataacgatggaagagttgtaggctaatgaaaatctgaaagttgtagttttcgaaagcggcaacccggatttctatgttgctcatgctgaattggttaatatttttgatttcccgaagggaacaggagaaacaggactttctatttcctggcctgatgttgcaaaacgtctggagcaggcagcatttgtaagcattgcttctatccgaggaggagccagaggcttgggtagtgaatttattcaggctttcgatatgcgttttgcgagcagggaaaaagctgtttttgcccagcctgaaatcggaatcggctcttttcccggcggaggcgggctggagcgtcttcatttgttaacaggaaaagcaagcgctttggaaattatcttaagcggtgacgattatgatgcggaaacagcagcgaattacggctggatcaacagagctttccctgataatgaactggacactttcgttgaaaatctggcagataggattgcatcatttgacaaaaaaatcattacaacgataaaatccattatgaatgaaagggtaattattccaaaaaatgagcatattatggaaacccaaacccgtttctttgcatcattaactgaaccggaagcaagaacaagaatcaaaaaactactggatcagggattgcagacctatggagatgtagagcttaatcttggtaaatatttatagtactatgaaagcaatcatattaaaatctcccggagatgttgatcaattggaatatacagagcttccgattcctgaaacccgtccggatgaagttctgataaaagtaaaagcaattagcattaatcccgtagacacaaaaaccagaaaaggagaaggcatgtatggtctgatgaaaaaagaccatccacttattttgggatgggatatttcaggtgttgtggaaaaaagtaaaagttcggattttaaggttggggatgaagtttttggaatgctcaattttcccggaaatggtaatgcatatgccgaatatgttgttgcacctgcttctcaattagccattaagcctaaaaatatttcctttgaagaggctgctgcttcaactttggcggcattaacgtcttggcaggcgctggttgttaatgggaaagttcagaaaggacaaaatgtattgattcatgctgcttccggaggagtaggacatttcgcagtacaacttgcaaaatatctgggagcaacagttaccggaacatcatctgcaaaaaataaagactttgtattgagtctgggagtagatcattacattgattatcatacgtatgactggccaaaacaaaaatctgaatatgattttgttctggatactgttggtggaaataatatcaataattctattgaggttgcgaaatcaggtggaactattataagtattcctaccggtctgaatgaagagataactgaaaaagctaaatcaaaaggtatcaatagctattttattttagtaaaatcaaacggtgaacatatgaaggagattgcatctcttttggaaaataaaactattaaaccacatatctctacagtattttcttttgacgagataaaaaaagcacaccttcaactggagtcgggcaggacggttggtaaagtggttgtggtttaaacaaattgtttctttatataaaaaaaatcgccaactgcatttagttggcgatttttagtttagtgtgaccaggacgagcgtatcttcaaatacctttattgcaataatggattatattacgacaagttctgtcgtaagagtattatagctttgtataaggaagtggaaccagttataattgttttgttaactagtattattatattgtgtatattggttatttttcattaaatgggtgtaaataatgttgtattttttggtttgttaattgattgtttaatcgacaatcttaaaatttattaaaaaattaaaataaaaatattgtttactattgtcattttattagctttgcaaacttaaaataatatgatgaaaattataaattaatttatttcctgttaataaaatttgacatgttttaaattaatacttctaaaactaataccattttatgaaaaattcatttacgttattatttgttttcataagtctttttttgttttctcaaacgacaatgtttggacctgtttccggacttgcttttagaaaaaatagtgtgaaacagcaggttttgcaaacagatactttgcaaaatcgtcttatgaattatcatcttatcaaagataatccttctgtaattttttttaaaaagcttaatacaagcttaaatcaacctacattgtttatggttgggaataaatttggaggcacagaaaataaagtgtatgccaaaataggaagttcaattataagtactcttggaattgctgattttcccgattctttaaaaattacgaatcaggaaataaacgcgaaaatattaacatttactaaaaaagatgttaataaaaggattaatcctattgttttttttaataagagaacggatgaaaaagtactgatccctgaggttttagtttttgataaaaatttatcagatgtggaagcccaaaaaattgaaacttatttagctataaagtatggaattatgatcaatgatgtgtctgaaaaaaattatatttcttcggatgatcatatagtatgggattctaaaaaaaataaaaattataatttcagaatcacggggattggaagggatgatgcttttgaattgtatcaaaaacagtctataaactctaatggtggtaatgtagctgtggctattgacagtttaaaactgaccaacaattttaacaacggaaccattgaaaatggtaattttttattgtggggagataataaccaaaatttagtatttaaagatgcagatttgctttcgcagcaccctaaaagagatatgttaagagtgtggaaagttcaaaataagaccatcgacaataaaattattaaagccaatatatatgctgtattaccggttcagcctcccggaaatttcattaaactaagattatttcaaaacgaaacagattatcagaatgatttatcaactgatattacaggaaaaaaaataaatgatacactttatgtttttaaagacatattatgggacatcaataaagatggtaatgactattttacatttagtttagatgatatccaaagtaatattaatattcaaatgataagtacttgtgaagatttaggaaataatctgatcaaaatttctgtaccgggaagtattttacctttcgaatattctttggaaagcctcactacaaatcagatgattgctaataatttgcagggaacgaacagtcaaataatatttaataatcttaatcctgatcactataagcttatccttaagaaacaaggttataatgatattattagaacttttgacctacaaggtattgttaaccagaatattgatacaaattatctttggcagggcacaccaattgagttggatttgaataccagttccttccagtatgtgttaacaaatccaaatggtcagaatacaactgcagcaccttattttctaaacggagtaggaaattacgaactcaaaataaaaaataaacttggatgtgagataatcaaaaatttgtcagttcttaatgctgcagattatgatgctcttcagaataattcattatttaagaaaattcaggtttctcctaacccttctagagatggcaatattattattaaagtggagttaaaatctgctaaaccattagctgttaaaatatttaacggtttgggtattctggttaaacaaggagaatattcttctgcttcagagtttactattccaatgtctatagcgcctgttgctggatattacagtattaaaatatttattcctgaagaaggaaaaagtgtcaatttcattatctattaaaaaaactaacaacctctatactcatcatgagaaaaagatctttcttcaatattaagaatattgatttgttaccagtttgtatacccattattctttctttatgtagctggactctttatgaagtttcgcataaggatgataaaatcagaattatagcaaatcaaaatttcagtccattcaaaataaattgtgattttcttaaacctttttctggtgggaaaaaaacaaattatttggattctggaaatggactttcagattcatcatccgttgcattaaataaaaatagtagcataaataaagattttttatttccaccgcagaaaaatattttttacaataaaacttctataaattcagaatatattggtgaaattgggaataaggatacaaagtcttgggatgccgatccttctgataatatttttaatgttaagttgtctgatattaaaaaaaatacttcttacacacttacatatgaagtagatgggtattcagacattaattctgttactagaagtattaatgggagttttgcggttggtggatatatcaaagtgaaacaatccggatggactgaaattaaggaaaatattgatccaactcttttaaaaacagggaataattttattctttttaatactctcaataaaggagattattataaaataaaaaatgtaagaatctcggaaaatggtatagcggatcaaaaaccatatcaggttatatctcaaatttatcaagataaaactctttacattcgtgggtttgtaaatccaacctcatcaattgatgctgttgaaattgccaataaaagaattgagctgcatggaaatgaatttgaatatttatcattaactgaaaataatgaaccttctataaatgttaagtttattgggaaaaacaattccttacatgcagaaacaatctttaaagataacaagaatatagtttctacgattgatatatataaagagtccggtagaaacgtaatcttcagcaatgaatcaggtgttgtatttggacttaggaatattgatcttccaccagtagatcaatcaatttcgaatgtaagtgcagattattatggattccgctttaaaaataatagtttgaaagaaactattatacatcttccatatgacgaatctaaacttccgaatggttatcatgaaaatgatataacaacatttacttttgattatacacataaaaaatggatgccagtttctgtggatagtataaatagtgaaaaaaaatatgttgtttttaaagctttagccagtggtgcagcggattatatcaatggggttgttaaacagccggaaagccctgaatcaaatgcctccgcttcgacaagttttaataatgctcctgtagcaaatccggcctctaaaataaatctgatatctccgccttcagccaatcaacaagggtcggctgtagtgcaatatccaattgaaattcctaaaggaaccagtgggcttcaacccagtgtagtaatcacgtataacagtgacaataaatcaggatgggcgggaacaggatgggatattcctgtagagactattgatattgatacccgttggggaattccggcttttgatcctttgaaagaaagtgagatttatacaattggaggtgaacaattagtgttcaaagatgattatttgcctaataaagttcagtttcaggaaaacagaagtgcaggagataggaaattttattatagaacaggcgttacggaaggtctgttaataacaagaaaaggatctacaccatcatcatatacctgggagatattggataaggagggtgtaagaaaagaatataatgaatttttaacagataatacttcttccaattcttcaggaaacagaataagctggtatctaactaaagtaacagaccgctatggaaacaccattgtttataactataccgattcttttgaaggtggaggcaaaggcaaatatttgtcatcaattacatacagtaataacacagttatcagttttgataacgaatcaggagtaagacaggacagagcttttacatataaatttggagttaaacttacagaggctaaaattctaaacaaaattacagtatcccgggccaatacgaagataagagaatatcagctttcaaatacaactataggacaattcggtaaaagacttttaacggaaattatacagaaagatggtaatggcaatgaatttaacagacataagttttcctatagtacagcaagaatttttgaagacccacctaaaacatataatacaggaaacgatatcggaaatgttggtccgtttaatggtggaaatgcatctgctattagcggagatttcagtgataatatcaataagatccgtgggtctcttacttttggaagtggatcaggctgcttttttatagggttcaacaaaaagaatacttttgggattaatgcttcttacagtgaaaataaaacgtatggtaaaggtcaattgatggatattgatggtgacggtttacctgataaagttttttatggaggaaatggaaaactatggttcagaaaaaacagcatgtcaggtttcggaagtgtttctagctcggtaaactggcctgcagggactccgttatccaaaacaagctcttatataggttctgcagggttagaatttgtttacaaacattacgctgctggtgtaaatgttaactggaccaataataatacaccggtatatttttcagatgtcaatggagatggtcttccggatttgattagttatggagatgtgtatttcagtagaatcaggaatggtgttccggagtttgagccacaacaagatggcggaccgaatgtcacagaaactacacctaatgtaatcttaagcggagtaccagctgtacaggttatagagcctgggcaaaccggaccgcagcttcttggtaatattgtaagaatgtgggaggctcctgttgatggcaaaataagagtgactaccaatgcacaattagaacaaaattctaccgatggagtagacgtttggatggaattgggaggaatgacaaaggattatgaagataatcctgcatatgtaccacctcattcaacaatgattggatcaaaagttacattaacaagtcccggtcaaccaatttcgatcagtgaaacagtagatgtaaaaaagggtcaaaggatttttgttgtagcaagcgccaaagaaaatccaattaaagataggatagtaactaatactgagatcagttatttttcaagtaacccaacagtaattccaaaagatgccaatgggaattattattacggttttaattcgtcagaaagctatttggcttcaagtaaaaaagggaatcctgtcgcagataaagctacggttaagatttcctggggtggtttaaccaatcaggtatttacggatgatgttaattttaagatttataagattgttgttcccaaaacggatacaaccggatttattcagccttcgacttctaatttgatttatcattataaattgcccaaaggagcaactcttaataccttaacaacaacaagtaacctggtttcaggagttgatttatcgaatatattggtaaatcaggttgtttctgattctaccgttacatttttcaattttgatgtttctgcagatactaatgtttcctgggaaaaaatcaaatggaagccgcagattgaagtcacaacagccactgatgtcttgctttcaaatgcattggtgcaatataacccttatggagaaagactgacgaataacctcccaaaggattttactcaatacgctatattttctgaatgcagattcttactttatccaaaatttacaagtgatgttagccagccacttaccataaatcttcctacactgcataatactacggttactttctcgctgaaacttaaaaatgcaggtggagatattcctttttttgccaaaaatacagtcaatgtagtaaataatgtgatggaaattccaaagcttaatttctgtgatatttttggtgtgaatggggttcctggaatgccgtatgatcaattgtggcaacatttattctactttgaaattacttcacctgattatgaagttgcaaaaaaactggcacagctgaatcctaatatatataactcatggtttgaacaaccgccacagccttcttcacttgctgatacagggcataaagcagattattttgcctatagagccaataacattcattataacattagtacaggtttagtttatcagggatggggaggcttttcatataatggttccaaatataaaaatgaaaccataagagaaagcgagtttaactcaagtatggccggctttaatgttaatatgcagaatccttctattccttgttcaggagatcctacttcacaggcatatcaggattgtgtgatggattacatcactcagatgatgaatagcaggtatttcacccctattgatttgaaaattgatgcggaaacatactcatctccactagagtctgccgagctagatcaatatcatttacagcctgctttgttaggaacatttacagagccggatacagagtctcaatatccaggctattcagttccgaatccaaggggtattattaagtattcaaaagggacaggagttaatatgtatggaagtgcctttattattggcggtaatgctggtttctccaaagattatactaaagatcattttattgattttaatggcgaccggtacccggatgttgtttcaggcaattcaattcagactactaacctgttgggacagttagggagtccgggaaatacatttgaaagagaaatgtacaatacaactacaaactttggtctgagcctgggtgtccctgttcctaccaaatttagtaatactttaaatggaggatttaaatcaggaggagaaaaaggaactcatactacaacttcagcaaatgcagttggaattgggctaaatgtgcagttaggacaggcaaaatcaaaaagcaaagcagtttggtttgacattaatggagatggcttgctggattttgtatcggatggtacgttatacattaataatggaaaaacttttataaatgaagcccataactggaatgtctctgatctttccaataacaactcctcctctttatctggaggtggaggatttagctggccaaatggaagtttatctattggtgtaggattggctcagtcaagatctactaccaatactgcatttatcgatctcaacggggatggaatggaagataagattgtaaggtcgggaagtacttatgaaatgctcattaatacaggaacgacatttacaaatgatatgatgagccaggatttcgaactggaaaacaagcaaaattcatcaggatttaatctatatggaacattatgtttttgcttagggataaaagtttgtctgggacttggatataataaagataaatctgtaagtaaacaaaccgtagatttaagagattttgatgccgatggtcttcccgatttgctgatttctgatgatgaatcaaatctaaaagtatatcacaacagtttaggaaaggcaaacttattgattggaattaccaatcctctcaaagggacaatggcacttgaatatgatctgtataatacaaaaaataattttggaagccttataggaggtacgtatcagatgcctttttcaaaattagcattaacaaaggtaacgatttcggatttagcatctaaaaataccattgctcagggaatcccaagaataattcctaaatctcaggtgacatttgagtatgaaaaaggaattcaggacagaagagaaagagagtttttaggatttggtattgtaaaaacaaaaacatatggaggagcagaggggcaggcttttactcttcatcagactcatgttacagagtatgaaaccaattttaattccagtgatttctttgtaaattacaatgatacaaaagtaagacagtatttttataaaaaaggactggtaagatcttcctatcttttagatgctaatggcaaaaaacgttctgaaactaattttacatacagatactttgatcagctatccaatactggatatcaattgtcagaagggcaggctgaaccgcagtataaagatatcggcaggattattcctttactctataaaactgaaaccataacaacggaagttgttggcagtaccagccatagtaaaactttaatttctacaatagatcagtatgataaatatggaaatgtaacctcatatacagatagaggaacgacgctggcgacagtgtcggatgatatctcagttaaaacagaatatcatgatcccggtgcgaaaaatattgtaggtgttcctagtaagaatactgttaccgcaggaagcattacaagggtaactacttctaaagtagatgccaaccgcaatgtaataaatgtttctaaaacaataaatgggcagcctgctgagtttgatatggaatatgatgcttatggtaatctactgaaagtaacagaaccaatttctgccaataaccaaagattttctaaaacatttgaatatgatcctacctatcatgcttatatgattaaggtgacggattcttataatctatcaagttcaactcaatatgatgcaaattatctgttgggagtaccaactgttattacagatgccaatggagtaagttctaattataactatgattcatttggaagggttactcaatataaatccccggttgataatgactggacgattaagttctattattatcctaatgaaattgttcctgtagctattaccgaaagaaaagctcccgtagtgaatgatgttactcctgctctgaattatttcagcagtttgttcaccacagtatggggagaagaattagctgtcaagaaattatttaagaactccggaactcagttttcttatgccaataatgtttttcagcttaaagataatctgggaagacctgtaaaaacaattcttagggataaagtgaccacaagtacaaatgcaagtacgattattccttctttgaagacctatgatgattatacgaactccgaagatcttgtagcaaaaatatttgtgtcaacgacttatgacaacatggatcgtccgctgagggttacccagaataacgttcagaccaataatggactggaaaatctggctactgaatataaatacggattcggacccgatagggatggagtgactcagtttatgagcacaacaataagtcctttaggaaatacctctgtagtttatacggatgaaagaggacgtaccacctcatctaagcaaacagatggaactcagaatttatgggtaagtaataaatatgatattctgagccagctggttcaggtaaaggatcaaaataatgatattacgacctatcagtatgacaattggggaagaaaaaccaaagtaatacagccagatgccggtgaaatgaattatagctatgacaggacaggaaaactgaccagttcagacaatgctttacttcttgcagcaggacaaagcgtgacctattcttacgactataacaggcttatgcggattgattttgctcccaatgattttgtgaggtacgaatatggtatagcaggagcgtccgacttttcggccggccgtttggtaagccagcttgataaaacaggattccagacatttaaatatacagctttagggcaggtcagagaaaatacaagagtaattgtagcacctaataatacccctaaattattcaaaacgtcttttgtatatgatgtatataacagaattaataaaataacgtatccggatgctgaagaagtattctataattataatgaagcgggattattaaaaaatatatacagtaaaagcccggtaaaccaaccgctggttcctattgtaagcgctattacatatgataacagggatcagatggtttcatttgccgccggaaatactacacaaagtaattataattatgacgcctggggaaggcttgcggaattatccttgttttataacaacaccggagcacagatacgcagaaatcagtacacctttgataaaaacgggaatgtcttgaatgtttcaggtactacaccaatgtcggggagtttcccggcaagcatgatgactgcagccagccagaagtcttatcagtatgatacatttggaagactaaaatcttcaaaaattacagctaccgggaaagattatacccagtactatgaattggatatgacgtataatgcggtaggaaatattgatgctaaaaactatagattaaaatcttatcagaataatattgcgtgccagaatcctggaaacctggggaaagatgcaaaatactattataatattacaggacatcctaatgcggtctccagaattgaatataaaaggaattatccttttgacagtcctatggattgcggtcccggaaatatatttccatcggacggagcagaagagtttacttatgatgttaacggaaatctgaataagttatataatattgttggaggaaaagcagagttgcacagacatttattctggtctgaaagcaataatctgaaagcagttggtgaaagaggagtgttaagtcattatgtatatgatgcaggaggagaacgtgtcctgaaaagtgatggcgtttccaagaagatgtatgttaatggaaacgatcctgaaaaaactacccagatggggagttatacttattatccgagtgggtttatggtacttggagagaaatcaatgagcaagcattactacattggcggacagagaattgcaacaagagtaagtgctatgccttcccatagatttaaaattgaagagaatggtacctattccggcttgcgtcatgtattggaagaagaagttaaaggtattgctgttcaggctcagtatccgcagattgtctgggttcctaccgcagatacacagggaacctatactcctccgtctaataccttagttaatgagccggattgcgcttatgttattgagcagctgattattaatttttctcaggataatgataaagaattatgctacaaaaatttcttggacaaatataatgaagtattgaacaacggtggaagcttctgtgcgttattggatgaaatcaccaatagtaatcctgatgggtgcttaacaggggagacaattccggaaatcctgagttctgaaatgtattggatacatccggaccatttagggagttcttcagtattgacaaatagcatatctaaaattaccaactggtacgagtacatgccgttcggagaatccttgatggaattatccaataatgaatatggtaatccttataagtacaacggcaaagaatttgattctcaaacaggatggtattattatggagcacgatattatgatccgcaaagaagcttttggctatcggtagatccattggtagaaatcaccatgtcaccatatgcctatacatggaatgatcctgtcaactatacagatcctacaggaatgatgggggaaaggataggggagcctgggggaccgaacactaataaagtatatgatggcggtgttatagaagagatcgtgcttaaaggcaaaaaattgaattggctgcaaagagttggtagatttttgggcttcggaaattcaccctccagaaatgcaacggcaggggaaataaaaagcagtaacaaattaccatggtatcttaataatagtaaatatggagggaagccagttttgacattaggggctcataatattgaatttccgtatattgaacgagaagaatatggaaataatatctttgaaaatggagatgcatttttaaagaatactgctggtgcaatgtacaatggtcttgcttctacatggaatgatggaatggcaggaaaagaagggtgtagttttatgtatgagggagatagtgatattgagtctactgttaggcatatttctagaggaaatataaatgcaatagaaatggaaggtatagcagctgcagttatttttcataaggtaggagaatttggagagttaagaggttcgggcccagtacctggagtattagaagttagtgatagagtaaagtccgtaggtcaatttaaaaattattttccaaaagaaggtacaatgatagagtttgtatttgatgctgattcaaatacttttgtagtaggaaagcctcatggtagagaagcgggggcttccccccatcaaaggctagttctttcattaaataaaaaagggaattatgtgggaggaatgtttaaaagacaaggaaacacaataattacagatgaatattctggacattatggacataaatggaatgatcaaatcagaaagcaatttgtaaactatatggaacagaaaacaggtctaaaagttaatcatacaatatggaaatgagaataatatatatatcagagattaattatgagtgttatttttacgatagttgttggaaagtagtttacgaaggtaaaaccataaatattaatataaataatttctatggttatcctttttatataatttttgaaaatatagaaacggtgagtaaacagttaacaatgctaatcaataaaaagaatatattgctttccgatatttttccaatagaactaatcttgaaagatattattgatcatgaccaaggttactggttaaatttatgtttatattttattattaaaatggaatgcttagacagtaatattatacagcttttgattaaaactcaaaataataaaaaattgagtcaagaattaaggcataaaataaggaaagttatacttcttaataattaagtataatgtgcttgtttttaatgacttaaaaaaagtattgataaaagaaaaaatacattgatggaaggaagttccatcaatgtttattacgataaggaaacaaataaatacgtttttccagatttgattgatgttgaagaattatgagtattataaataataaagatgtacgttgggaatataaaagcctgtaatatgtagattgtgtcggtagataagaataatccaccgcaattgcagtggattattttgttttttatactttagaatatttctgcctggtttactttaagtggtttttgaagatgtaatgtaaatgaatttgcaactgaacctacctaggcgagaaaatatggatatcattttaactcatttaaagatggagcagctaatttttagtctacagctgtaatctgtggaaaacatcaataatggaaacaacaagaaaatttaaacaattatcagttcaaattactttaaaaagtatagataaagaacaaagtgattggattacgtttaatgacaaaattcatactaagataataggagatgattattgtaggtcaggtataatgctcttggtaaatgaactgcctattatggaatgtgatcttaaaaattcttactttttaattacaacagaccggattatatctgtaatagatggtttttacgatgaagtattttttattgaaatgaacaatgtatcaaatgaatacaatactgaaaattttaaacaaattaacgggaagtatccaaaaacaaatataattgctgttaaaaaaaatgataatacaaccttgatagcaaaaatagattcttattatcctgcttattttgctaaaatgttgatatataatatcttttcttataaaaagcttgggaaatggtatgttaatccaaagtaatcactccataataagaaatacgattaaaataattaaaaaacagaatatgcagattttatctattgggataatttaaatacatagtaaataataatatacttatttctaatgaagcaaaaacatgtaccagttaacaactcttaaaaatatgtcattccattttactgagtatcatcaaaaagtttaaataatattatgaaaattaaagatgtattacaagcaaaacctgatagcgaatttttatacgaaaagttagtagagttaaatgaaggtggagtttttacacattaaaaaattgaatcgaattttaaaaaaatatttctgcagataacttaaagtattcgttaaaagaaacaatattggttgacttttattacaaataaaaaatctttttatggattatatgtcatggaattacagaggaatttccttttttaaagaagaagttattcatcttaatggtgaggataataaagaatttccatcaataaaagactttcaacaaaatggagtttatacatcagaagttagaaagaaattgtgtaagtatttagagaattgtccagcaattgtttccacttcttacagacgactgaatgcttacacgcttgagccgatattttctttaacatattttacagatggagaatttattttcactaatttgttgcaggaatatatctgctatgataattttgttttacctcaaaaatggtatgaattgattaaaatccgaaactatatcaatgacaattttgaattaaactatgaaaaaatttcatcgggagaaattgatgtatttgataattttgagaaaagttttgatgataatagtattatttgtgatgttatactataaaggctaaacacaacctaataagatagatacctggtttaagaatattggataaaaagtaatggataaatttataatattaaagtcaagctggggaattgctatatcttatgagataattgaaattataaaccataatcaaaatgatgaaaatgagaatgaagtaagccctccggtctttgttaggctaaaagagaattcattagacaatagttctttagagtgtttaacaaaaggaataaaaagtataacacaatttatcaaaatatttccagtttgtttttctatagaaaaattagaatataatgtctgtgactatcagcccgagggaatgtattacatgtttaggaaatggttctttgaaaaccataacatggagcttccccccattaatgtttattatgataaggaaacaaataaatacgtttttccagatttgattaatgttgaagagttataagtgttatatgtactcatacacattatgaaatgaaaaaaatcattttcttttataatgtattctatttgtaagaatataattagatattcgtaattaaattgtaaagtaaaaagtaatgattctaagtaaataaaaatggcgcctactataaaaagttggcgccattttactttcagtgacctcgacaggattcaaacctgtaaccttctgagccgtaatcagatgcgctattcagttgcgccacgaggccatttgttaacttgttgtttaacggttgcaaatataccacttttttccgttctttgaaacatgaaacagaaaattttacttttatttacggtcttctcgctaattgcctgtaaaagagaatcaaaaatttcgtccgcagactggacaaatatctccgctcgtacccagtttaaggagcatgatggtatcctggagctaaaatcgggtaattttacttacaattttaagcaaaatcaaacacctttcaggaaaataatgctgttgaatgcaagtatggcaggttatatttcggagcttggggcagaaaatttaatcataggtgtttccagtccggagtatatttattcagataaaattcagaatctgattaaagaaggaaaaatacagaatgtaggaagtgaacagaaatatgatgtggaaaagatcatctctatgaaaccggatgctatttttaccaatcacattgccagttttgacaatacctatgaacttttgaaaaataatggtattcaggtgatatttctggatgaatacatggaacagaaacctttggaaaaaacagcctatattaaacttttcggagaatttttaggaaaagagaaagaggctgaagttaaatatcaggaagtagagaaaaactataacgatctgaagcagcttgcgtcaaaggcaaaagaaaaacctgttgtacttgccaatgagatgtatggagatgtttggtatcttccgggaggaaatacttccgtagcacattatatttcagatgccaatgccaattatatcatgaaagataataaagacgaaaaagcattgacaatgagttttgaggaagtttatgcaaaagccggaaacgttcagtattgggtaaatgcaggaagccacacctcaaaaaaagagatgttgggcatgaatcctttctatgggaaactggatgtattcaataaagggaaaatttataccattgccggaaaagaaaaactgaaggcaaatgatttctttgaaagcggtgtggtaagagcagatttgattctcaaagactatattaagatctttcatcctgaacttttaccggattatcagcttacttatatgaaagaattgcagtaactcgcagtatttgcttatttttgcctttcctttttatcaagttatgtggaaaaaaattaaacagcttatcttcatcattcttgtactgaatgtagtttttatcatctggggcagattcttcaatccaccaattacccttacccagataggaggactttttgaatacggaaaactgcacagagattatatatcctatgacgaaatgggaaacaatgtgaaaaaggcggtaattgcatctgaagatcagaaattctttgatcatgacggtttcgattataaggcaatcgaaaaggctatgaaatataatgagaaaggcaaaaaaataagaggaggaagtactatttcccagcagacggcaaaaaatgtatttctatggcagggcagaagctgggtgagaaaagggcttgaggctgtttatactttcatcatcgaaaaagtatggactaaagacatcatccttgaaagatacctgaattctattgaaatggggcagggcgtattcggagtagaagcagccgctcaatattatttcggaaaatcttccaaagatttaagtgtctcagatgcagcatggattgctgctgtattgcctaatccaaagaagtatgatcctaaaaatccatcgccgtatttaagaaagaaacacaattggatcatgagacagatgaggaatgtgagtttgaaatagtatctttgtactaatgaaattctttaattccagcacaaattttgagtcagttcttaaaaaatacttttcttttaagaacgaaactctttctttagagccttttgcagagtttttagaaaccataaaagaggcggactttactgatgtgctcaattttttcagaagtaatcccaactttgctgagaactttaaatattatattcacaatatttttataggaaggccttttaacctttctctgacagaagctaatattctttcagaaaatgccttttttccggaacttaaaaaaagaattctgaacaaggttctgccacctgttgaaaatgagaaaacggtgtggtacatgattgataacgtcagcctgcggccgaaaaaagatctgaaatacctgcataatcttcctgagaatgagattaatgaatttttaaaaattttaggagcttcggactttattatccgtcctaatgtgaaaaaagagctcattttctctatgaatatcctttcctggagggttacaggaatggctatggaagtagaggtagtaagaatggctccacagtacagaaatcttgataatccgtttcttgccctccagaatgaactggagacattagccgaggatctggcaaaagatccctatgtacagctgcactccaaagacagcagatataagcagatcaaaatttatacagagcagtgccttgagtttgttaatattgcttttaagaattctgccaaatacggaatttcagggaagattaaccaatcccttctgaaaatccgccagcagaccgaaagaatttatgagatcgtacaattactggtgatcgatactgatgaagatgttcttataaaatctaaacagcttgtttttaatattctgaactataaatctcataaaaataatatttcagatctgatcaatgacagcacgagactgatctcccatcttattaccaatcatactgcagaaaccggaacacactatatcacttctacccgtaaagaatatatgacgatgttctataaagcaagtggtggaggaattattgtaggagcactgtgtgttctgaaaatgctttacggatatatcccgggaagtgatttttcgcatgcttttctgtactctatgaattatgcgatgggattcgtgatgatttatctgatgggctttacgctcgcaacaaaacagcctgcgatgacggctgctactatgacaaaagtactttctgaagaagggaatgcccaaagaaataatacagaatttgcccatttggtttctaaattattccgaagtcagtttattgcctttgtaggaaatgtattgctagcgtttcccatagcacttgccatcatttacggactggatgtatttttctctcagaatcttgctgtagaaaggtctgataaattgctaaaagatcttgatccatttaaatccaaagcgattttacatgccagcattgccggattttatctttttatttccgggattatttcaggaaatatcggaaacaattccgtgttttatcagattccggaaaggattgctaaaaatctgtctatcagaagctttttcgggaagaaatttgcaaaaggattgtcaaaatattacgccaaaaactggccgggtattgtctctaatttctggtttggtgtattcctgggtgctacagcgccagtcggaatgtttttcgggctggatcttgatatcaggcatattacctttgctgccggcaattttgcattagggttgtatggaaaggatttttcggtagattcctacaccttctggatatctttcctaacggtatttttaataggtttcttcaacttcctggtaagcttcagtttatcgatgttcctggcattccgatcaagaaaaatgaatttcggacaggtaagtgagatctataaagaaatcttcagatattttattaaacatccgttaaagtttttcctgccattgagttcagggctcgataaaaaagcggatgatctgatgagcagtacgatttccaataaatcagaagaacattgatcataataaataaaaaatgctgccttagggggcagcatttttctatagttatagctatttaaggcaaataggaagtcatcaaagaagtttatagaatctgcaaatccctaaatttctctgccccaaatttatcctgaaactttttcagataaaagcttttacgcattttaaaatcatgtttcaataaaggagaatcaatcttaatcacaatacattcattttctatattaacgctttttatttctttgaaaagactttcgtctagatattcttcaaggaaatctttgatgtcaaaagcaataagtttatgttcaaaaccatacattctggcaaaagattttaccagttcggaggattgatattcacgttttttcttcttcattttcggagtgcgtggttcgtgggagtgagttacgtggtccgtggtccgcgatttatttttttattgcagattatttttattccaattttctatgacccattttttataaaagttaatttttccacctaatatattatattcattttttaatgtttcaaatgtcgtggagacatcaggatatagtatgataattttctctaaatgattaatggtttcatcattacttgcatggctgtaaatgaggaagcgaatgtaatcatttttataaaaggatcttccataaccttcaacaatatttgtaattattgaatctgaagatcgccttaattggctgcctaattcaaatagttcatatttaggaagaagatgagaggctttatgggtctttaaaaataagtcaaaagccattttgtaaatttcaagatttctataactcatatcatttatgtttaggatattaagttaagataaaaccaaaaataatattcaaattttttatccaaagttttcaaccttgtacttcaaattctctaactcgaatcacgtaacccgcatcccgtatctcagcactaaacctcaaaaattatactttcctcattgatcttttttactacactttctgtacgttctctgtgagtatctgtgatgaaaatctggccaaaactttcacgattaaccagttctatcaattgggaaaccctgatatcatcaagtttatcaaagatatcatcaagcagtagaataggagtctttttcgtgagctcttttacaagactcatctgagcaagctttaaagaaataagaaaagatttctgctgtccctgagatccgattttcttaattaaaacatgatccatttcgaaaagaaggtcatccttatgaattcccttcgaagtataggttagcatacggtctttttcaaggctttcctttaaaagattttcaaaagaatcttccagcaaatgagattcatatatgacagatacggtttcttttccaccggaaataatcttgtagaaattctgaacaataggattaagctgttctacgaaatcctttcttttattgaatattttcgttccgaatctgataatcggatcatcatagatttcaagcgaatctttatcccaggttctgttcttggcaaaatacttgagcagcgcatttcgctgctgaatggtcttctgatactgaataaggtcaaaaagatacccggaatctgtctgggaaatcatagagtccagaaacttacgtctgctttccccggaatccgaaataagattggaatcataaggagaaatcataacgctcggaagatagccgatatgatccgcaagcctgtcatagcttttatcgtttttcttaattacctttttggcttccttaggctgggtaattctgatgatgtcttcactatcctcattctgaatttcagcatcaatggtgaaaaaatcttcctctttttttatattgttgagatctgtattgcctaaaaagctttttcctacagataaataatgcagggcatctaaaatattggtctttcccacaccattattacccacaaagcaattgatctgtggggagaattcaaattttttctcagtatggtttttgaaattgtagagggaaagcttcttgataatcattcgtcaaaaatacttcattattagtaaaaataaaaaaggaagtgcagaacaagtttccaccccgaatgaaaaataagcgtcatcccttttattttcagagaaataaataagaatataagttgcaataccagccataaaaaaagctatggcatattgtaattcaagaaagaagataccaattatattactgatgaaaacgagtgcataggcaatatatttggtattttgtacccctatcagcataggaaaggtttttactatatcactattcatatcccggatatcaaagggaaggacaagtgccgtaataaagaaaaaactgatcaggaaaataggaatactgaattccggaagcgtaagccagcagttgacaagtgcccagaccaatcctacgtaaaaaaccttcagtaaaggaattttacggatataaacatcaagaaaaaagctgttataaagcaatcccaacacaacaatgatgaaccatttcaaaagccttatttcattatgattttggatgattaaaaaagcacaaataattccagctacagcattcagaatcagtattttgaaaaaatgtctggtatattgatatttggtataaaggtaaccgctgaaataagtgatgaaaataagcagaacggtagggaaacggaatgtgttttgctctttcataaaaaatactgcaaaaagagttcccataagggagacataaatctggctgtctatgacagtttttttcagtacttttaagatgttcatttatcaaaattaatatatatgaaaagattttccaagatttttctgcttttgcttgtaatgctgagcttttcaatggtatccgcacaaaagtattacgatacccaatggaaaaaaattgctgaaaacagtacaaaaggagcgtataaatctaatcttcccattattttagacatacaaaaacaagccatgaaagaaaataatgccattgagctgatccgttctctgaaagcggaattcagtattgtaaaccaaacggtggatgatgatcagaatgatgctgcttcccaatttttcaaaaaacttaaggataccgaaggaaagctgagcggtgaaggtaaattggtatacaaagtcctgctgaacggtttcttcatggattattacaatcagaatctatggaaaataaacggaagaactaatatcaattctcaggatgtttcgcagatagaaacctggagtaagcttgattacaaaaattatcttaccaaaagctttcaggaacttgatcaggaaaaacctgaaatgaaaaagattttactggaaaaatataaggacatattttccggaacaaacgatatcacttattttccgacactgtctgattggtatgcacttaaaaaagtagaatttttatccgaaaacaatattttcacaaaaaatgaactgactgccaaccgtacagcgatcaatgccatctatgacgagctgattgcacagaacaccgggaatgcaaagctgtattttatgaaagaaaagattacagagaactgtaatttcaaccattgcaaagacaggcttgagcagcttcagaatctcttaaaaactaatgtggaaggagattataaagtggtaatcatgggagatatcatggatgaacttgttaacaggaagaaacctaaagaagcacttgcaatagctgccaaggcaaaaagtgaatatccgaaatctccttttattgaaaatatcaaaagtaaggaagcacagattgtgaatccgtacctgacgatcaaatatgaatcccagacccagaataacctgtcgattcattttgtggcgcaatatcagaatgtatcagaatttaccctgaatatttatgaagtaaaagatgatttcacttcaatgcttcagtatgttcagaatccttactccgatactttcggaaagctgaaaaagaatcttgtaagaaaagaaatattccagcttccggatcctaaggattatcagacccataaaacttcactggaagttaagccgcttccgtcagggttgtatgttgcagagtttacagttgcagtttctgatatgaaagaaacagactcaagagagaacttttatttcctggtttccggaaataggattatttatcagaataaaacggacagaaatcctctttctgatgagcttaagctggtaaacagtgaaaatggaaagccggtaaccaatgaaggactgaagttttatgaatttgtttccaataaaactttaaataaaatagatggaacgaccaatgcaaacggagtatttaagtttccttccacagaaagcaaagactattacagaactttccttattcaacagcctaagaccaatgattttcagatcatgcaggtgtacggaaacagaggctatgatgacgattataaccctaataaacaaacccgatcaactgctcagatctttatcgatagagggatttaccgtccggggcagaccgtttatttcaaggtcattaatacaaggcagaataaagaagtggaagctgttatttccggattaaaacaaaaaataactttactgaataccaataatgaggaagtttcttcccaggaattcatgaccaatgagtttggctcctatcatggaagttttatccttccgaaaggaaagctgaatggtaatttttacctgaggattgaaggagaaagccagggatacaaaaatttcagggtagaagaatataaaagaccaaagtttgaagtaacgtttgaacctgtaaaagaagagtataaatatggccagaccatagaattgaaaggaaaagcagtgatgttttccggagttccgctgagtaatacgaccgtaaactatgaaatcaaaaaacagaatatcagatggaggtatttcagctggtatccgcagaatgatgataatgaaaactcgattctgggcgaagcaaaaaccaatgaaaagggagaatttacgattcgtttagaacttaaaaaagatgaaaaactggaaggaatacaaattgataattataccatcaatgcatctgtaacagatatcaatggtgaaactcagaccgcggatacccaattgaaagtagcatcagtttcacattatatccaggcagaaaatatcagtaatacttttgcggatgaaaatgtaaaagtaaaggtagaaaccaaaaattataatgatcagaatctaaagaaaccttatcaggttaagttgtcaaaactcactgctccggacagaattttcagggataattttaaatctgaggtacagaatcttccgaaatattcaaaagaagagttcatcagtaaattccctcacgatctttttgataaaaatgatgagatcaaaaactggaaaacagaaaaagtattatttgaaaaacaacagcagccatctgcagataatacccagcttgatttagggaaactggaagcaggagattatcagctggaacttttcaatatcgaaggaaaagacaccatcaaaagtgctcagaactttagtgtttgggacaaaaaagctttaaaaccaagccaaaagatattccttacggttatcgctccaaaagaagaattatcaagaggagaaaaagcaaaagtgtatgtttactcagctgttcctgatgcgatggtgaatgtttttgtgcaggatggatccggaaaaaccgtttccgaagttcatcagatgaaaaagggaatattagaatacacggctgaaattcctaaagataaaagtgtctcttcactgaatcttcagtttcagctggtagcatttaatgatgtgaatacggaatctgtttctttaaaaataaaagacacagaaaaagctttgaaaatcgaaaccgttactttcagagataaactggagcctaatgttaaagaaaaatggacggtaaaagtaaccggaaatgacaaggaaaagatcaatgctgaggtattggcgaatatgtatgatatgtctctggatcagtttgctgccaacagctttacttggagaaaactgtatacaccatttgtgatcgttacttcatatggtatcaacaattacctgcagcagcaaaattaccagaaaagattaagatatttcgaagacagatatataactgttcctcagtttaattggtttgatggtgatttttcatatatattacaaggagaagttgcaggacttcaaaatagagaaggagtaaaagctccggcttatgcgctaccgccttcaccaattgctgggcaagcaaaaggtataagaagaaaagctattgctgaagataaaatagcagtagcacagaatgtgttacctgaagcaatggaatctgatgcagacggtattttagatcatgatgatgtagagaaagggcttgataaagtagctgtccgtcagaacctgaacgaaacggcatttttctatccggatctgaaaaccgatgtcgaaggaaatgtcaacttcgagttcatctctccggaagcattgaccaaatggaagctgatgttccttgcccatactaaagacgcaagagctgctaccctggaaaaagaagtggtaacacagaaagaattctcagtgactccaaattatccaagatttctaagagaaggtgatgaactgaacctgcaatcaaaactttcaaatcttaccgataaaaaactgaatggttctgctgaattgcaaattttagatgcctttaccaatgaaaatatttcttcaaaattcggaatgagttcaggggtacaaaatttcagcttaactgaaaacggaagcagcgcattgacatggaaattaaaagttccggacaatgtttcctccgttattttcaaagtggtagccaaagcaggtcagtattcagacggagagcagcaggctattgctgtgttaccaaacagaatgctggtgacggatgcagttccggttttcgtgaaggaaggagaaaccaaaacatttgtattggataatcttaaaaataatacatcaacaacggcttccaatgtttccaatacgttggaactgacaaccaatccgatctgggagattatgtttgcgcttccaagtctgaaaaatgatcagaataattctgtagacgtaatctttaacaaatggtttgctgatgtactggcttcggaaatattcaaagccaatccgaaaatgaaaacggtttttgaagaatatcagaataaaggattattacaatcaaatcttgaaaaaaatcaggaactgaaacagctgctgctggaagaaaccccttgggtgctggaaagtaaaaatgagggcgagcagatgcagaagctggcattattatttgatgttaatacaatgaaaaattcgatcaatcaggattgggaggatttcaaaaaactgcaaaatccggatggtggattctcatggtatcctgggtatccaagttcttacggaacatcgttgtacatccttaaaaacttaggaaaaatcaattcctggctaaaagataacgtgaaagattatcaaagtgctgatcagaaagctcttgttgctaaactgattcagtatgtagacaatgaagttaataagtattttgatgtgaaaaaaggaaatgtctggaacaactgggcaatagactatcttgataccagaaactattgggaaaagcaatatcctttaaaaggaaaaggagctaccctgaaaacgatggtaaaacaaaaagccaagaccgctaagatcacagattttacattcttcgggcttcaccgtgcggcattattaatgaacgattatggtctgaaagaggtgtctgataaattaatgacttatcttaaagaaacttccacagataccaaaacacaaggtgtatactggaaacaaaaccttaacgattggggatggtttggttctaaagtggtcaaccatgccggagcgctggaagctttcaatttgttgaaagctaatgatcaatcttttattgaagatatgaagatctggctggtaacccaaaaagaagtcaactcatggggaagctcaagagaaacagcagaggtgatctttaccattttgaattcaggaaaatcatggactggagctgaaagtgataaagctactatcgtttggggaggaaaagaattaaatcctcagacacaggcaacaggttatgtaaaatcaactttgaagccagaagctatagataaaagcttagcctcagtaaccgttaccaaacctggtcccggaattgttcagggaggattgttctggcagtattacgaagacctggataaaatcaaatcttctgaaaattatatttctgtaacgaaagagctttataaaaaagtaaaaacggtaaacggagaagagcttcagaaaatatcttctgaaaccccgttgaaagtaggagataaagtaacggtaagaatgattctgaatactgacagagcaatggaatttattcatattaaagatatgcgtgcagcaggatttgaacctgtagatgtattatccggatatcagtggaagaataatcttggatattaccagtcgaccaaagatgcttctaccaatttttatatccaatacatgccgaaaggaaaatatgtatttgaatacgatgtagtggccaacgcatccggtaaattctccaacggaattacaacgatgcagaattattacgcaccacagatgaatgcacacaccaaaggaagtaacgtaacaatttcagagtagctgataagcataaaactgtagtaatttttactgcagttttttgtttaaagatttggaacagaatagaattaaatcgaaaaatcaaacaaatgtttagttttggaatggtttttgaaattagatgagtacaaattaaaaaaattataaagatgaaatttactaaaactttaattacaggattggtattgatggctggggtaaatgctttcgctcaaaagaaagcagaaaagtttgaaaaactacagattgaaatgttcccaaaggcaaaagaaggatataagcaggtatatattcagcttcccatagcaaaaaacgaaaaagatttaaaagtagaactttttgttggggctgaaaaaatgttagactgtaacaattacttcctgatgggagaaatgaaaacccaggatcttcagggttggggatacaactattatgaagtagagtccaatggagaaacaggaggaacaatgatggcttgtctggataaaaaactgactaaaaagtttgtgaccttaaagcctgaaatcgtaagatacaacagtaaacttccgttggtattctatgtaccgaaagatatcgaagtccgctacagaattttacgtccggatgctgcgatgaaaaaagcagttcagaaataaatcagggtattataatgatacagaaaaactcctcacagtgatgtggggagttttcgttttctttgaagtatgtattcgtgtaaattcaacgttatttctgtcattccccaggagtccagcttccaatattcagagtcaacataaatgatagtgttttctgttaccaatgattttagctaaagccaaattgaagttttgtttttttattaaacgggctcccttcgactatgctcaggataataacccattcctattgaatatcaaattttactgattttatagattaagtaattattatacaagcctattcatccagtttgtcatttcgaagaaatctaaattcagaatgttttttttccagaatgttcttttttcctttttgtttcctacaaaaaatgtcgtaaaaacaatactgaaaaagtagagttaaaattttttttcaggttttctagtatttaattaacatttaaacgactccgacaaaactttattttataaggttttaaacttaaacatattttaaacttactttaaattcactacattgtagaattatctttaagtatttaacctttttttgcattatatttgttgtaaacataaaccatgaaaaacaatttattgatttttacgtttagtttttttgctttccccgcttttggctgggcacagtctgcgccggattttaaagaacttctggatagtgctatggttcgtgattcgaaccttaaaatgcagattacccaaaacaaacttaccgatctggatgaacataaattgaaagatatctttcttccaacactggaacttagtggtcaggccggttatctcaacggaacagcaagacttacgtcaccggaatttaatctcgcaccctttatcaatattccggaagggactttcaacaataatttcaatgtatcaggattttcaggtattgctaaggcagatgccaaaatgcttctctattcaggaggaaaggttaaatacatgaaaaaagcggttgaagaaaagaaaaaatctgaagatatacttctggagaaaacaaaagatgaagtgattgccactatttccagagcgtatgatcagctggccctgattcatcagtctaaaaaagtgctggatgaaagtaaaaaaagactggatatcaacaggaaaacagcagataaagcgctgggttatggtctgattactccttacgatcataagaaaattgagctggcacaggctacgttgaatgctaaaatggtagaatatgaaggtaaaaaagaattacttcttacccagctttatgttttaaccggaatcaacaaggaaagactcagaatgattgatccggtattatctccggtggaactgcttgctgcagaaaaaggaatagaacagagagcagaaatccgtgccttggaacatggcatcagtgctgctgattataagataaaagccgaaagaacatggatgattcctaaggtccagctaatggcttctgcttattatatcggtttgtacggaaacagaataaaatcctcagaaaatgtgattcctgcagttccattgcttggatatgaaggaaaaaaactggactggaggcccaataatattaatgtatttccattgattacagcaggagtaggttttaaatgggagatctttgacggaaaagagggaaaacatgctgaagaaacagccaaagtcggaaaagaggtattacaaaaccagaaagaagatgcgctaaaaaaattaacactgaatctggccaataaccaaaccaattatgatattgcttccgcacagattaccctgaaagccaaagaaaaggagctggcaaaaaatgcacttgtacaggcagaaaaagaattcagatatgggatgagcaaatcttcacagctcattgatgcagaaaacgatcttgaagctgccgaactggaatatcagaatgctgttttcaaccagagaagagcgggaatagaactgatgaggtctacccaggagctggatatcactaaattttatttaattccttaaccatttaaatcatgcataaaaatatatctatactcttcgcggctctgattttgttggggagctgtgacaaaaaaaacgaaaagatcaaagaaccggaagggaaaaccaaaaaagaggtgatctcttttgcccctaaagtcaccggaaggattttaaaaatatatgtttccgaagggcagactgtgaagaaaggggataccctggcacagcttgatgtacctgaagtctctgcaaaaatagcgcaggcacaaggcgcagtaagtgctgctaccgcccaggagcaaatggctaaaaacggtgcaacagcagatcagctcaagcagcttcaggccaaatataaaggtttgaaagaacaatatgaatttgcccagaaatcatataaaagggcgaataatatgttccgtgacagcctgatgtctccgcaggctcatgacgaaatctacgcaaaattacagggagcaaaagctcagtatgatgctgtagtggcagagctggatgatgtaaaaaggggaacccgcgtcgaaaaagtggagatggcagcaggacaggcatcacaggctaaaggtgctttacaggaggccaatgtcgcctattcagagagatatatcattgcgaccaacgatatggaaattgagaccatcagcttaaacaccggtgagcttgcaacagcaggatttgcattatttaacggatatattccggaaagtacttatttcaggtttaccattccggaaagtgctatttcaaaatataaaaaagggcaggaggtgacgatgcaggtggtgtacaataaagaaaacctgacaggaactattgtgtatatcaaacagctgacaaagtatgcagatattactactgcgtatccggattatcagctgcaggacgcgatctacgaaatcaaagtaaaacctaaggatatgaataaggctaaaaatattctggtaaatgccaatgtaatccttaaataaatgatacagaacggatagagcttcagcgaaattccattacgtttttcaacctataaaaatatacagatgaaagaatttttccgtcttttaaaacgtgagttcaaactttttatcggcaattctaccttgagaacggtgttctttctggcaccggtattctatgcaaccttgctggggtttgtctacaaaagcggaaaagttgaaaatacacctgtattggttgtcgacagagataacacgcctttgtccaatcaattgacagaaatgctcgaagacaataaaagtattaaggttttcagatacctgcaggagcctttgagcatcaaagatgaggtgatcagacatgaagctgcagctgtagttattatcccttccaggtttgaaggagatatgctgcagaaaaagtatcctgaacttaatgtttatatcaataccgggaatgttttaacagccaattttgcttccaaagcccttcagctgaccatcggaacattctcggccggagcttccatcaaagcccttcaaaaggcgggaatgccagctgcaaaggctgctacccagtatgaaccttttaaagccaactacattacccttttcaatacaacggggaactatcttattttcatgtggccggcgatgcttgccgtagttttacagcaggtaattctgttggctatggctgtaagttttgctgctgaatttgaaagaggatctttcataaaagaatatcaaaaaatgaaaagatgggctttcccgaccatgctgattaaggtaatacctatctgggtgttctctgttcttattgtaggcatttattactttatgcatatgatcttcagagttccgatgccggaagggatattcaattttattcttctgacagcgttttttgtaggagccgtttcatttctgggagtctttgtaagtattctgatcccggatgcattgaaagcaacgcagatccttatggttatcgcttcaccggcgttcattatcagtggttttacctggcctctgaatgcgatgcctgcctttgttcagtttatcgcgaatattattccgctcactccctttctgcaggcctttaagattcttttgattcaaaaaggatcggtagaacttacctttccttacctgaagcatttaagtattcttttagtaatatatgctgtcataggctggattgctttaaagatcaaactttggtttatattcaaaaaagccgctccgcaagaaattgctgtggaaaataattctccggaggatagtgagtagtttctgatttctggttttggctgattggttactgttgcaggttgtattagtttattgttaagaatatttatattaaattattcaaaatcaaatcccgaaacccagcaatttattactttgtatcccggaactccagaattcgcaactcagaactcgtaaccaggaataaataacgcacaatatcctaacacgaatcccgaaaccacgcccaattttttcaaccgactacaaaatcaaacaaaaaaactgatatatttgtctgtagtaaaatagaaattatatggaaaatgtatttgatgcaaaagatgctcaaaactatatagatagaatcaacaggctggtggaagatacccatggtttatgggggaaaatgacggtggatcagatgctggcacactgctgtataacctacgaaatggtgtacgaaccggaaaaacacaaaaaacctggagctattgcaaaatttatattgaagacttttgtaaaacctaaagtggtaggagaaaaagcctatccgagagattcgcctacagcacctcagttcttgattaccaccaggaagaattttcatgaagaaaaaacaagactgataggttttattcagaagacacagcaattgggagcagatgcttttgacgggaaagagtctttctcttttgggaaattaaatgcacaggaatggaataatatgtttgcgaagcatctgaaccatcacctggcacaatttggagtataaacacaaccttacatgaaaaaacttttattactttttgttctggctgccaattttgtattgggccagatgccggatatttccaatacatggctgaataacagtaaaccttatataggaactatcggaaacaagggacaggaactgaaactaaagatcaatatctctgaacagaataaaaaaaatgatcaggaatatttcgtttcaggatactctcttgtagataccaattattcaaaattcgaaggtaaaattaccatttcaaaatataaagattccagaaaacagggaactgtatatggcgaatatgaactggcagaagagaataaaggaaaacattccggacttttcaaaggaaaattcacctataattttaaatggaacaagaaaacagagaaaattgaaggacagtacatcgagcttacaggagactggaaaagctatgacggaactcttgaattcaagactcatttgaaaaatcagtaacacctcatcattttataccggacctaaaatatctcagacctcgggtcttatctaaaactcattaatactatgaaactaggcgcattttcaatcagcttaagcgtaaaagatcttcagaaatccaaagatttttatgagaagctgggttttacaacaatggcaggaactgaagaacaaaattacctgatcatgaaaaacggatctacactgatcgggctttttcaggcaatgttcgacggaaatatgcttacttttaacccgggatgggatgaaaatgcacaaaatcttgagtcttttgatgatgtgcgtgaaattcagagaagattaaaagaaagcggagtggaaatcggaagggaagctgatgaaacaacttcaggacctgaacatatctacctgaaagatcctgacggtaatatgattcttatagatcagcacagatagatcaggatcattatataaagatgacttaaaacaaacttaacttataaaaaaacaatcatggcaacagtaaacgtttatttaacattcaacggtaattgcagagaagcatttgatttctacaaatcagtgttcggaggagaatatccttacattggaacttttggagaaatgcctccaatggaaggaaaagaaacccctgaagaagacaaaaacaagatcatgcacgttgcacttccgatctcaaaagaaactattttgatgggaagtgatacaggaggagagtggtcttccaactttaaggcaggaaataacttctctatttctgtgaatgctgaatctaaagaagaagcagataaattattcggtggtctttctgcaggagggcaggtgacaatgcctatggcagatacattctggggagcttatttcggaatgtttactgataaattcggaatcaactggatggtaaactatgatgatcctgcaaaaatgcagcagcatccgtaaattcatatttcatttcaaaataataaaaaaaaccgacagctatttgtcggtttttttatttactgtaagctatttgcaggaaatagtttttagttcttcttgatgattttatagcttgctgtttctgttttgatgagatagattccttcaggcagctcggtaatgtcaaacgtattttcatcatttgtcacttccgcagattttatgagctttccggactggtcatataaagagattgtatcattttttttcagatgatcaatatggaagatgccggtagttggattaggataaatattctctttttctttcatggtgctttctgaagttcccaaagttgaaatttttgtccatgtaaatgcatcaaggcacatatagacataggatccggtggattgcagctggatctcatcaattacagtattgctgttattctgattattcagagtggcaaggtcaatcagggtaaacccattgctggtacctgtcgttcctgtagttgcattaaatgttgtattaaagccggatgttttggtggtggtaaattttggaattcctcctaatttccctgtgataataagcgttcctgatgaggttgactggtttaaagccgtattgcttaaaaatacccaaaattttgagactgtaaatggagaactgctcttaagactgaatgaaggagaaatgatattcgttgttcctgtattgtcaatgtagacattatcattagctgttccgttccagccggtgtttggataattgccctgaattctgaaagttccggcctgtgaaacaatattaaaagtatatccattactgataaaactggtactgccgccagatgcattttcaaaagttacagttgttgtctgtgcattgatcaatgctatcgtgcttaagaaaacaaaaatggcaaaagagataatttttttcatgatacagatttttagtagttgaagaaagtgataccacaaagtaacaatgaaacctaaagccgttacagcgtattaaatgccggatttaaaaacacgtagaaatacgcaatgttgtttattgctatagttataattttgaaaaatgaatattatgttaatgaaaatgaatttatttcacagtatggttagttttttcataacttgtagtgtgcaattgcaggaactttattttaaacctattatataatttaaaacaagaacaactatggaattacctaagcatgcagtatcattggatgatgctaaaacatggatcagcaactggcagaatagaaatgatattgacgggatgtcaataagagcacatattattcctgtacaagatgtaaatgatattttcaacaaggataaaggctttgagcaatatcgcggatacaatgcgatcacagatcagggagagtttaaatttttaatggtaggagtggatgcttatgggaacgatattgtcaattatgaagacggattttatgtctatgatatgactacaccctgtccaagcgtatgttctgccgagaaatggtggaatctgtaacctgaaaaccggagatcttggatcattggattgaaatattgtcattaattggaaaaggcattctgctgattaatctggcagtatacggtataggcttttacggttccggaagagcctatacatttttcatcggttatctggcgtggatattaatttgtgaaatcgtattctatgtattgaattcccagaagattaataatctgtttttctcacattattatctgatcggtcagtttttgctgctgggattgttttttcatgagattttaacggagaagtatcagaaaaaaacagcacgtattcttttagttactatccctgtcattctcatcatacagtatatgatagatccggaaaaatattatgtttttaatctgtttgaaatttttgtcacgtcttattctattataatcctggcattatttcatttatataatatattggatactcagaagaaatacaattatataagtctgggacttttgctgtatctcataagcagtacagttatatttttgtccggaaatctgtatacggtaatgaacaggaagctgcataaagagatatgggtgttcaatgttgttatgtttattgtgtaccagatttttattctggctgaatatctttcttcccgtagaaaaaatgtataattactgttatgattttacaaaatgaatgaaaatacaattatttccactatcgtttatacctttctggcatttactttactggccgttacgctgatcatattttattatttttcaaacaagaaaataaccagaaatcttattcagaaaaaagaactggaactcaggtatgagaaagatcttacccatgctattatcagtgcacaggaaaaagaaagactgagaattgctcaggatctgcatgatgacatcagttcaaaactgagtgtggtttctttaaatatccatcttttggattttgataatctgcccagggaagattacaatgacctgaaaaataaaatcatacatctggtcaacaagactgccgaaagtgcaaggcagatttctcatgatctgctgcctcctattttagaaaaatttggactgcatgctgccatagatgcattgtgttcagaaattaacctgtccaaaaacctgcaggttacctactccagcagtttatactttgcaaaagcagaagatgaaaaaaatttacatatctttagaatacttcaggagcttatcaataattccatcaaacatggcgaaagtactcatattgatatagaatttctgggaaaaaacgggaaaaatacctgtatttataaagatgatggaaaaggatttaatcttgatgaaaatactttgaaaggaggactcggcttacgaaatatcagaagccgggttgaactgatcaatggaacactgaaaattgaaagtgaaaacaataaagggactactgtagaatttacattttaaatagttataagatggaaaagaataccattcgtgtaataactgtagacgatgaagcgctgtttcgccagggaatttcattgctgatacagagagagaatgatattgaactggtaagcgatttcagtaatggaaaagagctgcttgatgaactcatcaacttacaggaactgccggatattatcctgatggacctcaatatgccggaaattaacggagtagaagctaccaaacagatccatatcagatatcctcagatcaaaattattgcattgaccagctataatacaaaagcatttattgttaatatgatacagtcgggagcctgttcctttcttaaaaaaaactcaagccccactgagttgcttaccgcaatccgggaagtctatagtaaaggtttcttttataataatgaagtaatggaagcattacatcaaaatcttacagaacctaaaaagaagatctctagtatttttgatgccaatcatatttccaaaagagaaaaagaagtattggagttaatctgtaaacaatacaacacagcagaaattgcagacctgctttttataagttccagaaccgttgaaggacaccgcaacagccttttactgaaaactggggccaaaaatactgcaggattggtggtatatgccattgaaagtaaaattgcagatatgaactacttaaaagaccgtttcgaataagcattcatagaatcatttcgctaaaaaatcaacatcattttatatttttcgattcattcagttttatgtttttataatctggaaacatacattacaacagtccgaaaaatgcaaaaggatgaaatcccatattgagaacattctcatagtcagtctgatattctggcagaaattccatctgctttttatataaaatcaaatacaaaagaaagtccctttctgtcgtgctattaaatattgtttgttattattgatttaaaatattaattttgttaaaaacgatagataatagtaattgacaaatatgagaaaggtttttacgaagttggcattcacagtattaagtttggggtccatatgggtatgtgctcaaaagagtgatctgggagcatggtatatgtatttcggaaataataagatcagcaagaagctgaactggcataacgaaattcagtaccgtaatttcgatgctgttggagatctcgaacaattacttatccgtacaggaatcgggtatgatcttacagaaaataacaataatgttttattgggatatggtttcattctcagccagccctatgtaaacggcgagaaaaaggagaatattgaacacaggatttttcagcagtatattaccaagcaaaaattcgggcgtttcaatcttcagcaccgctaccgtttggaggaacgttttcttgaggatgatttcagaatgagattccgctatatgattggattgaatatcccgattactcaaaaggaaatgctgccaaaaacactatatgcatcgatatataacgagattttcctgcatttcaatagtcccgttttcgacagaaacagagtgtatggagcgttaggatatgtcatcaacaaaaatatgaggattgaagcagggtatatgaatcagattcaggagaacagaaaccggggacagattcagattggtttttataacaatattccgtttactaagaactaatgaagcaactgctgaatgccctgatgaaaaccattatctaaaataaaaattaaacacaaaaaataaacacttatgcattcaggaaaaagatttggagcccgggagttcattatctggaccagacggagtatttacgctctgattatattatctgcaatccctacagtcctgtactttctgggttggacgtttctctccgttccatggcagccgattgccattatgggaacagcggttgcctttatcgttggatttaaaaacaatgccagctacagcaggctctgggaagctagacaaatttacggagccattattaatgacagccgtagctttgggtatatcctgagagatgcgctgctttctaaagatccgggcaaggtcaaagaaatgtttcttcgtcattatgcatggcttactgcattgagatttcagcttcgtgaatccagagcatgggaaaatatgggtacagatcagtttgatgaatatgctaaaaagtatgatattccggaaagactctccaggctggatgaggaactgaaaaaatacctttctgagcccgaacttcagtatattttgagcaaaaaaaacagagcgactcaactgatggcaatgcaaagtagagctttgtcagaagcttatgaaaaaggggaaatcaatgattttcaatggactcagattaatcagcaactggtaaaattcaccgataatcagggaaaagctgaaagaattaagaactttccatatcccagaaatttctcttctataaccacttatctgttgcttttattcattgtttttgtgcctttcgggttactaaaggaattagataaactgggtgacggaactatggtagaaggatggacgttatggtttaatattccattctctttgctcgtgacatggtgttttcataccctggacagtgtgggagaagcttcagttaatccctttgaaggtagtcccaatgatgttccgataactcagatcagccgtaccatcgaaatcgatatgcgggatatgctggatgaatctgatcttccggcagccatcacaccaaagaataatattgtgctttaatttttttggtggtaaagaaaaagtctaaacttcggattaaattaaacctataaggtttgggtaataataaatattgataacccaaaataaaaaataacacttaaaaaaactaaattaaaatgattcacagctatgttataatatccattgcagtactgctgtctgtgatgatattggtaatgatcggccagaaattaaaagtcgcttatccgatttttcttgtcattgcaggattgctgataagctttgtgccgggaatgccacgtattgaaatagaacctgatcttgttttcctgatcttcctgccgcctattttgtttgaagccgcctggtttacctcatggcaggactttcataaatggagaaaacagatattttcgatggctttcggattggtatttttaacctcaatagtggtcgcttatctttcgtcttccatcattccggggcttaccgtagccatggggttcctgctgggaggagtgaattcaccgccggatgctgttgccgcaacttcggttcttaagcatatgaagattccaaagaaaatcaccaatattctggaaggagagagtcttatcaatgatgcatccagtttaattgtttttaaatttgctttggcagctgttatttccggacagtttatctggagagatgccgttcaggatttctttacgatggccatcgggggaattgcagtgggagtagcggtaggtttcctgtttggggcattactaaaagttatcccaaccaattccaatatagataccattatcacccttattgtaccttacattatgtatgtgggagcagagcatttccatttttcaggggtgctttctgtagttgcaggaggattactgatgtcttataactcgcactgttatttaagccatacctcaaggattcagtccggtaacgtatggagtgtattgatattcctgatgaatacaattatctttattttgattggccttgagcttcctattgtagtggaaggaatgaaagagtataccatttctgaaggtattttctatagtgtagtcattggaggcgcaattatcggaacaagaattctgtacagttatgcactgatgtactttccaagaatctgctccaaagaattaagattaaaagttcctaaaccggattggcgggaaccgttcattatcagttttgctgcaatgaggggagtggtttcactggcagcagctttgtcaattcctgcttttctgccaaatggagaggcattccctcacagaaatattattctatttgtaactttcgttattatattgattaccctggtaggacagggattattactaagtccgattttaaagctattgaatattcaggatgccggaagtgaattgccggaagaaaaacaggaagttattcttatgcgtaagctgaaggaaacagcattacacaaactggacaatgacttttctgaattaacggtaaccaacagcctggtacgtcaccagaagcataagctggaaaatgaaatgatgctgatggcagacaaagcccaatgtatggcttccacaggagattatgtatcggcaatcaatgaaaataaagatgtcttacggcagatcatccaggcacagagaaacgaactgcaccggatgaaaagagaaaagatatttgatgatcatgtgatgagaagtattgaaatgcagctggattttgatgaagccaagattaccggcttttcacatgggtaaaagataaaccacaaaagccaaaaagaatatagaatagaataagttcgaatggtggataggtcacaaaatgaaaatctctggattttcaagacataaggagacttttcaagagtaaaagcttacactttaaaacagctgaattatttaaaaacttttgtgacttttgtggttgaatattacaaaatgtgtacatttaaacatattaaatttataatatgagtacacccatcacagttcagtatacaataaatgctccggttgaaaaagtctggaaggcattaaccgataaaaatgaaatgaaatcctggtattttgatatccaggattttgttttggaagcaggtaggaaattcaacttctttgagcctggaggagccaataaatatcatcatcagggtgagattttagaggtgattcccaatcataaattaaagcattcctgggcttatcctgatttttcagagaagaaaacagtggtaacctgggagctgcagcctgatgatggccagactcttgtaaagctgactcatgaagatattgaaaactttaaagacttaggagaaggttttgcaagagaaaattttacagaaggctggaatacgattttgggacagggcttaaaagaatatttagaaaaataaaaaatggtcacattacacccttttacgatagaggatgctcctcttcttatttcaaagataaaagacgaaagaatgcttcttcagtttgccggacctgtttatcgttttcctcttacagcagaacagctggaaaaggatttgtctgatgaaaacagaactcttttcaaaattatagatcagagcggacaaataatcgggcatgcccagatatttttaaaagagaagacatttctgctgggaagaattctgatctgggatgagaacaacagaggaaaagggtatggcaaaaaagtaatgtatgaactattgagatatggcttcagccattttgatagagaaacagcagaacttaatgtctacgactggaataccggagctattgaatgttaccggaaagcaggctttacttttgatccggatgttaaaaatgaagcaaagattgatcatgaaacatggatttcactgaatatgaaaatccataaaaatacttttgaattacaggaatcatgacacagtttaccgcactaagacctgttttatggacagaaaatcttgacgaaaccataggattctatatgcgtgtcctcggatttacacttatggggagaaatgatgactggcaatgggcatctctccgtaaagatgaaatatacattatgctgtctcaacccaatcagcatgaagctgcttcttcaatcggtttttccggctcgttctatttcaatgtcaataatgtaaatgatctttgggaagagcttaaaacaaaaaccaaaatctgctatgagattgaaacgtttgaatggggaatgagggaatttgcgatctatgataacaacgggtatatattacaatttggtgaagcagcagataatattggcaatacggaataaaatttgctatttttggagaaatatttagaaattcaatgaaaaaaaatataatagcgggtttcgcagcgattttattattggcgtcttgtaataaggataaggagattcttaatacattaaacacttataatacttcaatggaagcgaagggataccatttcggagataaacttgagcttccgaaagaggtaacagaaaatgcagaaagcgtaaccatcagctttggagataaagaaacaacaaaccttactattgatcctaaatttttcacattaggtgataatgcagtaacgttcaatattaaaacaaaaggaggcgaagtcctgaatcaggatgccaccattaatgtatttgcaaaaaatcctgaaaaaaatattccttatcagattgtagcggaatatcctcacgatccaaagaactttgtacagggattccagattgaaggaaataccatctatgaaagtgacgggcagaacggatcttctcaaattttaaagtacacgttaggaacaacaactccgcttgcttccacaaaacaggctcaggaagatttttctgaaggaagtactattgtgggggataaagtatatcagctgacgtggcagagtaaaaaaggatatatctatgataaaagttctttaaagctgctttctgaatttgcttatccaaatgtgctgggcgaaggctgggggttgacatacgacgggaaaaaccttattgcttctgatgggagtaaacttttatatttccttgatgctaatgatccttctaaattaatcaagtatatcgctgtggccggaagctcgcaggcatatgatcagttgaacgaactggaatatcacaacggctttatctatgcgaatgtctggcagaagcccattattttgaaaatcaatccggcaaacggagaagtggtgggaacttttgatttcacagagattgcaaaacagaacaccaaaggaagtgatgatgtcctgaacggaatcgctttcaaaggagataatatgctggtgactggtaagaattggccaaagatttacgaagttcagatcaagtaatctgattctattgataaaaacaaaaatagcgttcccttgggaacgttattttcgttttagggattaaattttagtatttttggcaaatgattaaaaatttcatgaagcgaaatatcctgaccgggctggttgctgtattcttgttgatctcctgtaataataaccaaaaaatgcttgattctctggctgattataacaatgcaaaggaggcaaaagggtatcattttggagataaatttgatcttcccaaagaagtgacggaaaatgcagaaagcataaccatcagctttggagataaagaaacaacagatttgactattagtccgaagttttttacactgggagataatgatgtagtcttcaagattaaaacaaaaaatggagaagtactcaatcaggatgctaccattaatgtatttacaaaaacccctgaacagaatattccatataagatagttgcagattatcctcatgaccccaataatttcattgaaggttttctggttgaaggaaatacagtatatgaaagtgatggaatgaagaatgcttctcagcttataaaatatgctttaggagcatccactccgacaattgtaaaaaaacaacctgctgaaattttctctgaaggttgtaccatagttggaaataagatttatcagttgacatatcaaaataaaataggttttatttacgataaaaatacatttgaggaactttcaaaatttcccctgcctaatataattggagagggatggggattgacttatgacggaaaagatctgattgcaaccgatggctctaaaaacctttatttcttggatattaatgacccttcaaaagtagtgaaaactatggctgttggtggaaattctgaggtttacaatcagctcaatgagctggagtattacaatgattttatatatgccaacgtatggcataaacctgttatcctgaaaattaatcccaaaaacggagaggtagtcgggaaatttgatttcagccagctcactaaagaaaacgatcagggagacagtgaacatgttttaaatggaattgcatttaaaggcgataatatgctggtgacagggaaaaactgggcgaaaatttatgaagttagctttaaataaatacgatgaagattttattagatttagtcattctggatgaaattatttttcagtaaattaccacattaaaaaaacggagtgaagtttttaaacatattattttttttccttttctgtacggcttcggcgcagaatattcttcctttggatactttgaaattaaaggaagcaaaggatctgcttgccgatgactatggaaatctgtatatctataaaaacaaagatttcagttttaccaaatatgactctttaggaaagcagatcggaaaaatgatgcttaccgttccgtacaaagtgcagaccgtacaaaacccactgaatgtgcctttgttttctgaaaatgcccaggaaatgaaatttgtggaccagaatatgaatgagattcaacggttggattttaaacagaaattcgggttcatcagaatggcttatgccgaagatctgcagcagctgtggcttctggatgacagtacaaagcgtttgatacagtacaatttcaggaatgataccaccattaattcttatccttttgatatcagctttgaagatctgatggatatgctggtctatgaaaataaggtctatattttaacgagaaagcatatccggatttacagccttaagtttgaaaaacttttcgaagcccctttagaaaacggaaaacgctttcggagagagaatgatcttatcatggttgtcgccggtaatttcatctcacaatacgttcctgaaaaaggaatgacgactatcttcgaagacccggatgcacaaattgtggataaaaacatactctcttattttgcaatcaaagggaacaaactctatctttacagccttgaaaaagtaaagaaagccaaacagcaaaaacagctggaagctcagccggaatctctgcagcagcctacggaaaaacctgtagaaaagacagatggaaatacggcagagaagccttcggacaataccttacagaaattgattgaagaaacttccgaagttcagactgaggctatcgaaaaacttatcaattaatcagtaaatacaaggaaaaagaatattatgcatattgcagttacaggaaacatcggagcaggaaaaacaactttgacaacgatgctttccaagcattacggatgggatgcacaatttgaagatgtagatcataatccttatctggaagatttttattcagatatgagcaagtggagttttgcattgcaggtgtatttcctgggaagcagattccgtcaggtgaaagagatcagagaaagtggtaaaaacattattcaggaccgtacgatctatgaagatgcccatatttttgctgaaaacctgaatgatatgaatcttctttcagacagggacttcaacaactattcatcggtttttgatctcatgaagtcttttgtatcagctccggatcttttgatctatttaaagtcagatgttcccaacctggttaaaaaaatctacaaaagaggccgtgaatatgaagcgtctatcagtattgaatacctttcaaagctgaatcagaaatatgaaaaatggatttccaattacacagaaggaaaactccttatcgttgaggtggatgatcttgatttcgttgaaaaaccggaagatttcggattcattctggagaaaattgaggcagaattacacgggttgttttaacatatttttatcagtacattaagagagagtcagtgtaattctttttaaatttgtttggatcaagtcaacttttttgaataattatatcatggtagttaaggttttacataacggaaactgttcaaagtcaaatgctgtattagagtatcttgatgaaaacggagtacctttcgagatcatcaatattattgaagatcctttaagtgtgcttgaaattaaaacagtactgaaaaagcttaatcaaagtgtttttcatatcatccgtaaaacagataagctgtatattgaaaactatgctgataaaaattattcggaagaagaatggataaagattctttctgaaaatccatctctcatacagaggcccattctggtaaaaggttcagtagcaatgctgggaaggcctattgaaaatgtaaagttctttatagaaaaataagtcaatttaataaataaaaaatccgttcttttaaagagcggattttttatttattggcgtctcttctcaggcccgtttatcacattatataaagcttctaactcttttggagggtgcccggaatcaaagtctgaggaagtatattcttttccatcagaagtaatgataatagatgctatcattgcctgatcagaatgtctgcctgtagtaggagatttcagttctgctatcttaggtaagtcaatagttctagccagttgggaaatagttttccattccgcaggagctatcttggtattagtaatctcttcgttgatattggattcttttgaagaaggagtaacgataatgcttttgctgaaccctcttgttctttctactaattgaatcttttcaatcttttcaatcttttgctgttgcacggtagtggtaatattttttgtattgttttcgctgttgtttctgtgaatgcagcttgttgcggatgttcctaaaataacagtaaacaggatcagttggatattcatcatatattgttttttgctttaagtaataaaaaaaccgcttcattactataatgaaacggtcttgtttttttacaatagaataacgccttctatttttgctacttctttataaatattcacaacctgattggcatccaaaacaaatgcattaatgttgcaggctgtgtattttccatttttgctttcgcggtttcccagtgtaaatttaatgccatcaaaaactctgtaaatttcagtaagttttgcctggtcagtaggaatgataaatttaaataaataatcctccggaaaatcatgatgatcctccagcttctccctcaaagacttataaaaatcctcagggcttgcgtgttgatttccttgtaatatatccatctgcaattgttaatataatataaatataacgaaaatttccctattttccaaatggcccaagcagcgatttggagttttggtgctcataatcttcgatgatattgaatagtccgtttaccagttgttcagaagcgagcttactcaatcctcctgaattcaccgtgttattatttccgcctaaaagactgcccagaaaattacttcctgataatgctgtattgatggtttttacaactccgtattcattcagtttttcatctactttaggggcaatggctgcaataagctgctgggatgttttttctttcagaatctgagtagcggtagtaccctgcataattctcgttacatcctgagcgtttagactgtttacagcatcctgcaaaataggttttgaagttgtaacagtatatgctgctgcctgagcaatataatctctttctttggctaccagggaaggggcaatcttctccagtgtagcattaatgtctctcaattctttaggaagagctttatctaccatattgttctgcagaaatgcttctttattactgtagattcccattcctttatcaataccattgagcagaattcttttaataatggaaagacccatatcggatgtagccagtgttgtgcatgattgaacactggtggtaataacagcaccggtcccgataataagagccgctgcaatgatatattttttcattctctttttattatctatttctaaatgcttttgtcaaaaagcgcaccaaaggtaattactattctctatttaacaaaatattaaattgagtgcatattttggtgaatattgtgtcaaaaatgttaaattgtcctttagagatatgttgaataaaggatagtaattttaaatataaaattataaaatttaagtatttgtctgtttttgtttaataaaacaggtcaatttttaaatgtttaagataatttaacagagttcgatattttttatatttttggctaatgtctttttttgagattttaaataactccacttagacaggtacgaaattgaatttatttgaataaaattgaaactatatgaaacaaagtaatttaaagtattcatgtctcattgctgctttatacttcggtatgaacgtcaatgctcagactactccaaaagacactgcagccaaagagcagaagattgaggaagtagttttgatcggatatggatctcagaaaaaagaaaacgttaccggaagcatcggaatggtttctgcaaaagatcttgctgataagccgaatgctaaccctataagctcaattcaaggaagacttgcgggagtaaatattacaaacacaggtactccgggaggttctccaagagtagacatcagaggagttggctcattaacagggaataccgtttttattgtagacggtatgattacaactgatatttcttatcttaattctcaggatattgaatccatgagtgttttgaaagacccttcgagtttggcaatttttggagctcaggcagcaaatggtgcaattattataaaaaccaaaaccggaaaaggaaaacctgtttttaatctaaattcatatttaggattcaaaacagtaactaatattcctaaaatggttaattctgatcagtatattgagttatacaacgaaaagttactgaatgataataatggaaaccctgcaggatcaatctccagagctgactttcccgcagatactgactggtttaaagaaattttccgtacaagtatcattaatgctaatgatttttctgcaacgggaagtataggaaaactgaattactatggaagcataggatatcttcaggatgaaggtaatcttgcagcaggccacggaattaactcaggaagtgggtttaacagatttaatacaaaactaaatcttagctacaaaattacggataatattaccatcggagataacttcagtttttcaaaaatgcgtactgatgtggcccaaaaccctcttttagatgcgtataatgcacctccgatattttcagtaatgaaccctgctacaggcaattatcagttttttaatggctattccataccaaatcccagagctaaactggatttgtatcgttctcaggtaagacaagagaggttgcttaataatatatggggagaattgaaatttttaaaggatttcacattcagaatcagctattctacggataattataatcctagccaatatgaatatacaccaacgcttacctatgttcctgtttctagtcaggtgaaatctacattgattacaaggaattttagaaatagtaattatgtctgggataatacaatcaattggaaaaagaaattaggtgatcataattttgatgtgcttgcaggtttttcaagaacaagaactaccttatcacaagattattggtctgcaagaagcgttaattatgatggaaccaatggctctttgaatattgccaatggaacagacattgttcatgtggagggtgtagatagggatgatgccgttgttactggtgttttccaggatcagcaaagaattgaatcattttttggaagattgaattatgattataaaggaaaatacttattaaatgcatctatacgtagagatgccagttcacagattagcgtagatagatcaagaacttttcctgcaattagtgtgggttgggtaatatctaaggaagactttatgagtggacagaatgtctttaatttattaaaactaagagcaagttatggtgaattaggaaatccgaatgttcagagaaagtttaatgcaaatacaactattattggtggaggtgcatattttggcaacacgggttatcctgctcagacaattgataagtttgttgatccaaatattggttgggaaactacaactggaaaggatataggattggagatggccttgtttaataataagctgaaaatagatgctgcctattatgataaagattccaaagatgtggtttatgctataactcagggaactgtatccggtgccagcaactggaaagacttttataccaatgcttattctttcaataataaaggttttgaattatctgtaaattataatactaaaatcaatgataacatcaattttggtatttatgggaacttcacctcacttaaaaatgaaattacatcagtttacggaggttcatacctggaaacgggagccagcttatttggaaactctattgtaaggctacaggctggacaggctgttggtgcttattatgggtatcaggtagcgggtgttttccagactgatgcggaagcagctgcatccgggcaaagtggtgcaaaagccggatggtttaaatttgtagaccaggatggaaacggtgttattgattcaagagataaaacgtatttaggaaacccgattccaaaaggaacctatggatttggagttaatctaaatgtttattcatttgatttcgctattgatttccagggagtatttggtaacaaaatatataattataacagagaacagcgttacggaaacgagacctgggatctagatatgtataataacagatggcatggagcaggtacatctaataccaattcaatgattacctctaaccaatctattattttaccaaatagtttttatgtagaggatggaagctatatcaggattagaaatattcaggttggatataacttaccaagagaatttgcaaaggctctttccattacaaaacttagattgtatgtaagtgcacagaatccttggactagtttcaaatatcatggtttttcaccggagataacgaatacggatagagtacaaatgggtatagataataatatttatccaatttctgcaatttatacggtaggaatgaatttaacattttaattaaaaagatcatgaaaaaaatatttttaacactttctatactttccttaattgtaagttgtaataatgactttgtagatatcaaggatgaaggacaaacagatgtaagcaacttcttcacaacgcaggaggatgctatgcaggcaacaagtgctatttatagctttttaagaagctgggaaaattctggttttcctgcacaatatgtatttggagtaactggagatgatgtagaaaagggatcaaatccgggagatgcatcattcattaatgcatatgataacttcacatttacagtaagtgatgaaggagtaagaggttattggattgggcaatggcaagctgttaacagagcaaaccaggttattacaaatgttccgaaaatagatatggatgccactcttaaaaatagactgatagctgaagccagaatgttaagagcctatttttattttaacttagtaagaatttatggaggcgttcctatatttgatggattaccagctgatggaaattatataaaaccgagaaattctgcagcagaggtttataactttattgtttctgatcttactgccgccgctgctgtcttacctcaaagttatcctgctgcagatctggggagagttacaaaaggcggagccttaggattactttcaaaagtatatttatatatgaaagattatcaaaaggcctatgagacttctaatcaggtcatttcgatgggatattcattagaccctgattttaaccatttattcagacctgcaggtgagtttggtccagagtctgtttttgaggttaactgtgattgttctgcagcatatggaggaagtcaatatgcggaggtccaaggtgtgaggaatcaattcggatggggttttttcaccccaacccaggaattggaaaatgcatttgagccaggagatatcagaaaagaactaactatcctaagagagggtgaaacaactcttgaaggagatttgattcacaaaggagatcctcaggcaggtaatatgtggaaccagaaagtttatgtaccatcatctttgaacaataaagcatgtggatacggttctattcagaatataagaattttaagatttgctgatatccttttaatcaatgcagaagctgccaatgaattagggaatacttctgcagcaataactaatcttaataaagtaagaacaagagcccatcttgccaatactacagcatctactcaaactgctcttagaatggctatttggcaggaaagaagagtcgagttggctatggaaaatgatagattcccagatttagtaagaacaggacaggcagctacttatttaggacctaaaggattcaagactggtaaaaatgagcttttcccgattcctttggacgcaatgaatcaaagtaatggagtctttgttcaaaaccccggctattaaatttaatcaataaactttagaggagaatgaaagttctcctcttcttttagttagaaaccctataaaaagagatctcatgaaaaggaacgtattatcaatggctattacctctttattttttgtgtattcctgtaagaacactcctgtcgctaagcaggaagctggaaaacctgaggtcgtaaaaagcaatatcacggatgaacaactgatggatagagtacagaaagatgctttaaagtatttctgggactacgcagaacctaactcgatgctgggaagagagcgttaccatgaagacaatatttatccggataacgataagcatgtaatcactacaggaggctcaggatttgggttggcaactattctggtaggagtggaaagaggatttgttccaagaaaggaagcagtgaaaaggcttactcacatcatggatttcctggctaaagcagaccgtcataaaggagcatggtctcattggatcaatggggaaaccggaaaaacagttcctttcgggaaaaaagataatggtggtgatcttgtggaaacagctttccttacttcaggaatactgatggtccgtgaatattttaaaaacggaaacgcagaagaaaaagcccttgcagcaaaatgtgacgaactgtggaaaggaatccaatggaactggtataccaaaggagggcagaaagttctttactggcactggtcaccggattaccaatgggaaatgaactttcctcttgaaggatataatgaatgtctgatcacgtatatcttagcagcatcttcacctacctattccattgatgccgaaacctattataaaggatggaccagaaacggaacttaccttacagataaaacaaaatacgggttacccctgtatgtaaaacataattatgccgaagaatatggcggcccgcttttctgggcacaatattcatatatcgggcttgatccgacaggattatctgataagctcgtgaaaaattactttgaagtcaataaaaatcaaacccttatcgactataaatactgtgttgaaaatccgaaacagtggaaaggctacgggcccaactattggggacttacagccggttacacaagaaatgaggatggaagtactggatacaccgctcatatgccaggtaatgataacggagtgataacgcctacagccgcattgagcagctttccgtacacccccaaagaatcaatggctttcctgagattcatttatactcaaaaatctgaattcattggatctgcaggaccttatgacgccacttctatccattacaacaattggtttaccccaagatatctggctattgatcagggaaccatagccccaatgatcgaaaattacagatcaggttttctttggaagctgtttatgaatgctcctgaaattcagcagggattgaaaaaattaagcttccagtcagccaaatatgggataaagtaaactcaatagaaacgggctttagcccgtttaaaaataaagattcaaatccatggttttagccaaaatctgataatatgaaattaaaactgaaacatctcccgcttttactgctgccgctttcattacagttgaatgcgcaggaaataaaaacggaattcaataaagaaattaaaagacaggaaaaaatgtcctacattctggattacccgcagaatgtaaaaggaaatgtaccgttaatagtcttcctacacggttcaggagagcgcggaactaatcttgatctggtaaaagcacacagcccgtttacctacaaaaatctgatcaaagaaccggtcgctattcttgctccccaatgtccggaaggaatgtggtgggataccgttacggtttataacctgatcaaagaaattcagaaaaaatataaaatagatgcttcccgtatctaccttaccgggctttcaatgggaggatggggaaccttgaagctggccatggagcatcctgaaatgtttgcagcagtagcttctgtctgtgctcctacagatcaggtgatgaccgccaatattcataggtttaaagatttgaatctgaaaatatttcatggaggtatggatgatattgtacttcctgccaatgcttttaatttttatcagaagctgcaccctgtaaatccaacggcagaattggttatcttcccgaatgataaccataattcatgggattcggcttactcaaatcctgctttgtatgaatggatgctgtccaaaaagaaagaaaagtaatccaagacaccaatgattgaaaaataaacccatcaaattaaagcaaaaaatataaaacaataatttaagaagatagatttatgaaaaagttaattgtaatcgccactttagcattggctcctgtaatttctgcgcaggaaatggtaacaaagcctgttcagtcttatcagacggctcagtatcaggccaaaaagaaagcttttgtagacaatcttttatctaaaatgacattggatgaaaagatcggtcagatgaatctgccgacttccggagatttcactacaggccaggcgcaaagctctgatatcgggaagaaagtagagcagggattagtaggaggattattcaatataaaaggagcggataagatcaaagctgttcagaaagtagctgtcgaaaaaagccgtcttaagatccctatgatctttggaatggatgttattcacggttatgaaaccacttttcccattcctttaggtttggcggcttcatgggatatgaatcttatccagcagtctgcaagagtagctgcgagagaagctgcttctgacggaatcaactggacattctctccaatggtagatatctccagagaaccaagatggggaagagtatcggaaggttccggtgaagacccttacctaggaagtgaaatttccaaaaatatggtatatggatatcaggggaaagatctggcaaatgggagtaatatcttagcttgtgtaaagcactttgcgttatacggtgccggagaagcgggaagagattacaatactgttgatatgagccatgtgagaatgttcaacgaatatttccctccttataaagctgctgtagatgcaggggttgcttcggtaatggcttctttcaatgaagtggatggagtaccggcgacaggaaacagatggcttcagacagaagtattgagaaatcaatggaaattcaaaggattcgtagtaacagattacactggtatcaatgaaatggtagaccatggtatgggcgatcttcagcaggtttctgctttagctttaaaggcaggagttgatatggatatggtgggagaaggttttttaacaacattaaaaaagtccctggcagaaggaaaagttacacaagctgaaattgatatggcggcaagaagaattcttgaagcaaaatatgaccttggcttatttgataacccatataaacatggtgatgcaaaactggcggcaaaggaagtctataatatggaaaatcgtaatatagcgagaagcaccgctactcaatccatggttttgctgaaaaacgataatcaggtattgcctttgaaaaaatcaggaacagttgcggttatcggaccattggtgaataactcaatgaatatggccggaacatggagtgttgctacaaaacatgcttcttcagtttctttaatgcagggattacaatcaaactacggaaaagaagttaagtttttatctgcaaaaggagccaatatagattatgatgctaaattagaagaaatctatgctgcgcacggtaaaaaaacagacagagacaaccgttccaaagaagagttattaaaagaagctgtggaggtggcaaacaaagctgacgttattgttctggcaatcggagaatctgctgaaatgagcggagaatcttcttcacgaactgaaatcaccattcctcagtctcaggttgacttactgaacgaattaaagaagactggaaaaccaatcgcaatggttcttttcacaggtcgtcctttagctttaaccaatgtaaaagacacaccggatgctattctgaacgcttggtttgcaggttctgaagcaggaaatgcaattgcagatgttctgttcggaaaagtaaatccttccggaaaacttccgatgactttcccaagaagccttggacaggttcctatctactataacgctaagaatacaggccgtccgctaagtcaggataaagtggacaaatgtacgtatgaaagattccgttcaaactatatggatgaatgtaatacaccattatatgcctttggatacggtttgagctatacgaaattcaactattccgatatgacagtttccaataccagcccgaaaggaaatcagactgtacaggcatctgttacagtaaccaatgcaggaaactatgatggagctgaagtcgttcagctgtacatcagagatatggtgggaagcattaccagaccggtaaaagaattaaaaggcttccagaaagtatttcttaaaaaaggagaatctaaaaaaataactttcgatattactcctgaaaatctcaagttctataacggagaattgaaatatgactgggaaccaggcgaattcgacatcatgatcggaacaagttctgatcatgttcagcactcaaaaattaactgggacaaataatataaaaaagttactcacagaattgtgtattatgtcttttttggcatgatttttaataatacctcggtaattactattatatgcaaattgacatgaaaaaaacaattttattgagcacaatgttccttggttctttggtattcgcacaacaaactcaaataaaagggggcgacagagatgcgcacggctgtattggctctgcagggtatacttactctcagattaaaaaagactgtataagaacttttgaacagaaaatcaagttaacagaagtagctccaaaagatagctatacttctatagctgcagttattttcagcaaggacatgaaaaaagctgaagtttttgttaaagatgccgagactggaagtattatccttaccaaagcgggtaaagccaaagcatggaaaaaggatggctatacattggttccttacaagaagaacggttaccagcttaaaaaagataatatcgtgatctatcagtaagatcagatttaaagatgaaaaccactcgcaggagtggtttttttcgtaccttagatagaaattaattaatatcacatttttgggatattttaaaccaatcagaaaacaaaaatttaacctatgaaaaaaataattttattcagtgccttgtcccttggttccttagtttttgcacagaaaagtactcctgttttaggaggtgacagagatgttcatggctgtatcggttctgcaggatatacctactcacaactcagaaataattgtataagaacttttgatcagaaaataaagttaaaagaattaaataccgataaaagttatacttcaatgactgcgattatttttaataaaagtatgactaaagctgaagtgtttattccggatggagctgcaaaaagcattattttggataaacagggaaaagaaaagatctggaaaagcggttctcacattaaagacagctatgttctgacaccttacaaaaaaagttaccagatcaaaaaaaatgatgttgtcatctatcagtagatcagattaaaatagaaagccactcggaagagtggttttttattatattagaagtttcaaatagacctaataatattgattggatatgccaaaattaataatcgttcctaaaaataaggaagctgaaatagctttatattatgataaagtagagtcagaacacattatagaatggaatgtgtccaatgaagaattcaaaagattatggattgaaggtgttttttctttgatcaataaagtattcagggactaatatagatgaccatgaagatgagcatctcactgatctaaatataatatcttattcaatgtctgagttgaagaagaaacagtatagtttcagaaagataattgaaatgtttgagctgacaatttattataaaaccagtattcatttttatttttaaagtttaatacattataagttctaagtttaaggatttttatatttttgacttcaattttgaactgatcagataaactatgttatcactcgattttcatcttcttccaaaacatatgggtagatttttgtttcatacattaatcattttctgtataaattttttatattttttactagtatattataatgtttttaaactggacagatttattaacgtatctaaagttaaaaatagtgttactgtgatggagaacatgatgatcattgtatatcttattcctgtttcgctttcttatatgtactatgttatttttatttatcggagagaaaacttattttttaagcttagtttttttgtgttggcatttgcattatctcaacagccgtattcttactggataaaaattatattaggtaaataattaatcaatgaaaagaggattaaaaatattacagtttatttgtattattagtaccttatttttcggattatatttattaattgcacttagtagcagtcacaatatcccctttcagacttatttagggataggaatttcaatattgttgtccattgtattctatttcttgattgaatttattaaaagaagaaaaggattttaatcgcctcgcttctgcacaaagcctttcgtgtggcaagtaaatgaataaaaaccactgttattggagtggtttttatatgtataaactggttaataattataatgctccatccaatataattatctaaatttaccgggtaagattactcaaaactccaaagtaacggattatatttacagagcagatggagtgaaggtaagaaaggttttcggaacagaaacaaccgattatctggatggcttccagtatacagattctgtattaaaattcttcccaacagcagaaggatattttaatgttgagaccggaaagtatgtgtataattacactgaccatcttggaaatacaagattaagttatgctaagaatggagcaggaacagagatcattgaagaaagtaattattacccgtttggattgaagcatgaagggtataatgtgttgacaggaaatcctgcatataagtacaaataccaagggcaggaattgcaggaaagtggttggtatagttttaagtggagaaattatatgtctgatttaggacgatttttcaattttgatccgctttcagagaaatttcaatacaattctatttatgcgtttcaggaaaataaaatgggtttaggtaaagaattagaaggagctgagctattgcaggaaagaggtttaataacatcaataggtatgacagaatatgatgtatatacaaaagagcaattacaagattatatgtcttatttaaattataaaccttctactcctgatccagaattaatgacagctgaagagtatccaacaaattcggtggcaaaaggagcagagaattcatcttcatttaaaggagttataggtattctagaattatataacgttgtaaataaaggaatcgaaggagtgaaagggatggttgctaccgataaaaatgtaaaagcagttaattatatggataaattaacaggagagtttaaggatatgaaaaccgcattaagtgtggtcaataaagctgatttaaaactagataataaaactataacagaaattactaattatatatttgatggttctttaccaaaagatatcaataaaagaaataattccgtagttagtttacaatcaaaaactaatattgtcaatactgcaaacactattatgagaaaaaatggtattatagttcgcaatggtccggaagttaaaaaaaggactgagttaaatgaagctgcaagacaacaaaaagaaaaattaaaaaaggtgggacaatgagaatgtggttattaataatattgtttagtgttatatcaacatcttgcaataataatactttggctgaaaggaaaataaaaaaaacagtaatcacttttttagatgctgttgaaaaaaaggatggaaataaatataaatcattaatttatgaaagtgaggtttatcctggagttatatcaatggaaaagaaatttttctataaaaattacaaaaaaatcaattctgatgtaaatttaaaggaaaatataaaaataaaagatactattttcaatggagccaaaaggaaatatgttcaatatcgtattaagaacaataatgcagattattttcaaaaaccattaattattacttttatattttatgatcagataggatatgataagatttataaccatagtatttttgataatatgttggattgggagtaaaatcccccgctggcacgagcgtctcactcatgtccacaaataaaacaaagcctctgcaatagcggaggttttttatgttataaactgcttcagtcgattatactttcaaccaaaataattatctaaatttaccaggaaagattacccaaaattccaagataactgattacatttacagagcagacggagtgaaggtaagaaaggttttcggaacagaaacaaccgattatctggatggcttccaatatactaattcagtattgaagtttttcccaacagcagaaggatattttaatgttgaaaccggaaagtatgtgtataattatacggaccaccttggaaataccagattaagttatgctaaaagtggagcaggaacagagatcattgaagagagtaattattatccgttcggattgaaacatgagggatataatgtattaacaggaaatccagcatataagtacaagtacaatggcaaggagcttcaggagacgggaatgtatgattatggagcgaggatgtatatgccggatattgggagatggggtgttgtagatccgctagcggagaaacatcctgagttaaatcctatgatgtatgcagctaataaccctatgatgtttattgatccagatggtagggattggactattactgaaagttatgataaaaaaacaaatacaactcattatcaactatcttttactggagccgtgttaaatagttcttcaaataaaaagattgatatgaaaaaatttgcaaaggctattcaatcacaaacagaagagatattcaataaattggggacaaacccatatattacagtatcagctaatatagatataagagctattgatagcaaagatgatttaaaaaataatgatacattaattgaaatcaaagattctaccgctccagagttcgatgcttttaaaaatgggaaaaaagcaaatgcatatacattaaatggaaaagaaatatctgtaaatgctgattatgcttcagacgctattgacggaaaaaatattaaatttattccacatgaaattgggcactcagcaggtttgcatcatcctatagcagaagctaaagctagtaatggaggttttcttgatctaaattattattatcctgcatgggatgtacctaaaaataattttatgtttcaaggtaatatgaaagtatctggtcttacagttaatcaactgcgaagaatgaatagattatataaagcaggtaagctaaataaaaaaacaattaatccagcatatgaaaaatgagaatattaattttttatatttcactactactcatatttttttcttgtgaaaagaagaatgacattatatttgaggaaaaaacaattaaatcttcaactttggttttaccgaaagaacggatgtatgtagaattaattgattattatcccgcagtgagtaagaatcaatctaatttctatattgttaaaaatatacataataatgatacaattttcgttgtagatataaataatttaccagtttatgattttattaaaaattatgaaggggtaaataattctacaattactttggaaaaaggaaattatgttaataagaaaaaggaatatataatcagaattcctgtaaaatacaataaaataaatagtaagaaaacttatctcggtgaacttatcaatttagttgactaagtatgacaataccgctggcggaaatgtatagaagatattcccccccataaataaaacaaaacctctgtagaagcggaggttttttatcttccttgttttaagaaactatattgaataatgatgatcatcaaaagttaataaaaaaaatatcattgtaaattgtataaaatgaacaagttacgtttttatatttaaaaaatctgtatattgtattaccaaattaaagcgtaatccgaaaagcatacagagtaggaaaaaaatcaaaaaaatgttactatgaaaaacttaagaaaactttcaaaaagagaattaaaaactgttcagggaggtatcccgatgtgtcttgcaggatacttttggtgttcattggaaaaaaaatgtatccctgtcggagcaccttgcggacttattatcgattaactaattaaaaatagtaaaagcaagctgtctcagaaatgggatagcttttttatgtgctctccatcaatcgacttaggaatcagtagcgtcaagaaaatttgattgtaatccgttaaaaaatttccactgtctgagcatgggacttgttcagaaccgaagcagaaccgaatgatccatgcgagtttggaaattttaggagtacattccaatttttagcggatgattcccgtcttgaacttttgcatacttttgtttgactacgtcgaatcttcgatttcaagacaaaagtatagatgaaaatcttttatctgattcagaatatggttgaaaaatcataaaagcaggattttcaactctcactgaaaaaccgtatttttgtacatctaaaaagtaaaagaacgaatgaattcctacaaaaatccattggaagagcgctactccagtgaagaaatgttatttaacttctcacacaataacaaattccagaattggagaaagctttggatagctcttgctgaaatcgaaaaagaccttggacttgaaattacagacgagcagatcgctgagttaaaagctaatgctgaaaacatcgattatgtaaaagctgcagagtacgaaaaaaaattccgtcatgatgtaatggctcacgttcacgcttacggggatgtggcgccttcagcaaaaggaattatccaccttggagctacttcagcttttgtaggagacaatacagacttaattcagatccgtgacggacttttaatcttaaagaaaaagttgattaacgtcatgaagaacttagcagattttgctattcagtataaagaccttcccactttaggatttacacacttccagccggctcagttgacaacagttgggaaaagagctaccctttggttacagagtttggttcttgacattgaagaactggatttcttccttgaaaccttacgtttcagaggagtaaaaggaactacaggaacggctgcaagtttccttgaacttttcaacggagattattccaaagtaaaacacttagataaagaactttcaaaaagattcggtttcgataaagtgttcggagtttctggacagacttacgacagaaaaattgatgcgaaagtagttgctttattaggaaatattgcacaatctgcacacaaatttacaaacgatttacgtttacttcagaaccttaaggaaattgaagagccattcgagaaaaaccagatcggttcatcggcaatggcgtacaaacgtaacccaatgagaagcgaaagaatcggggcattggcaaaatacgtaatgtctctgacaacaagttctgccatggtagcttctacacaatggtttgaaagaacattggatgactctgccaacaagagattaaccattcctcaggcattcttagctgttgatgctattctgttaatctggaacaatatcctgaacggaatcgtagtatatccgaacagaatcaacaaacatattatggaagaacttcctttcatggcgacagaatacatcataatggaagaagtaaaagctggtggtgatcgtcaggaaatccacgaggtaatcagagttcattctatggaagcttccaaaaaagtgaaagaagaaggaaaagaaaacgaccttatagagagaatcttaaatgataactctttaaaactggacaaatcaaaactgaaagaagttttagatcctaaaaactttatcgggttcgcgccgattcagacggaggaattcatcaagaacgaggtacagccgattatagaccaaaacaaagacttaataggattggaagctgatcttaaagtataaaacaatatgcagtcttttcggctgcatattttatttccagcctcaactatgaaaaaactgtttttgaccattttattgatgccagtcatgtctttttctcaggaaaaagaggtgttaaaatattttatttccaaggacagtttggtgggggtgaaaaatcaaaaaggagagattattattccggcgcagtttattaatcttacaggaatgaaagacaacgaaattgttgagagtacaaataatactgttttttttgattcttctctggctaataaaagtaaaattgagaaaaattcctggggagttgtttttgacagaaaaggaaatctactttaccagccctattcttatgacaatggagcagattatttctctgaaggactgagaagattcgttaaaaacggaaaggtaggatttgtagacagaaatgcaaaaacagtgattgaagctgaacataatttcgttgctccgtttaattatggatacgcagcgttttgtgacggttgtgactgggagaaaaccggagatgagcatagagcaattgtaggtgggaaatggggagtgatgaatgtcaaagggcagactgttctgccactcgcaaaacctacggaaaatgatgttgaaataaacgggaaatattatcctaacccatttcaatataatgaaaaagagaaaaatatccttcagttttttaaaaagcagaagaaaaaactttcagatctttattatgtaaatttttatggcaaattatctgaaaaggaaaagaatctgttttttgaaatcgtagaaaggccaaaagaaaattttccgtattatcaggtgaatacttataatgacagaaagaaagatttggatatgctttaccacttcaagttcctggtttcagaagatggaaaaacattttatgccattgaggattttaatgaaaaaaaagttccttttgaacactggcttaaggaagaaataaaaaatgcagaagactttcagaaggagcatccggataaccccaataagtttatcaacaaataaaataaaattggaaattccagggttcaaagttgaagaaaatacgacttattcctttaaatttgtacggaataatggttggagggaaaatctctttcaaaaattttcaatataatgggtttaaagaaaaaactttaactcagaaaaagtaaaaagaaaaataaatctaatattaaaaatctgacatctaatgtctaataacaaaagaattttcgtagaaaaaagaggaattttcgatgttgaaagtccaaaaatttttgatgaagtaaaagcggtggttccggcagttcaaagtgtgaaagtatacaatgtatatgatattttcaatctgaatgacggagaatttgaaaaagtggtgaacaacactttcgtagaccctgttactgatattttacatacagaaaaccctgcaaagtctattcatttcggaatggaatttttaccgggacagtatgatcagagagcagactccgcgcagcagtgtatcgctttgcttacagaaaatgaaaaatcaaaagtaagaagtggaaaactgatcgaatttgaaggagtctctgaagcagatttggttaaaatcaaagaccttctgatcaacaaagtagaatctcaggaaaaagacttatccattctggatattcctgcagaagaaacgccgtcaaaagtaattattcacgaaaacttcattaatttcaatgatgcagaacttgaaagtttctacaataatcatggttttgcattaggattagatgacctgaaatttattcaggaatatttcaaaactgaagatagaaatcctacggaaacagaattaaaagtattagacacgtattggagcgaccactgtcgtcacactacttttgaaacacagttgtcagacattcagtttgaaggtcagttcaaacatacattggaaactattttcaatgattatatcgaaaaaagaaaattcttaggccgtgagctgaagccgatttccttaatggaccttgcgacagtatgcggtaaatatttccataaaacagggaatcttgaaaaccttgttatttctgatgagattaatgcatgtaccattcagatcgaagcagaatatgacggtaaaaaagaaccttggtatttattattcaaaaacgaaacgcataatcacccaacggaaattgagcctttcggaggtgcttctacttgtttaggaggtgcaatcagagatcctttatccggaagatccttcgttttccaggctatgagattaacgggagctgcagacgttttagaatctgttgacaaaacattaccgggcaaattaccccagaaaactattacgaagcaggctgccaacggctattcatcttacggtaaccagattggtcttgctactacgatggtttctgaaatttatgacgaaggatacaaagccaagagaatggaagttggtttcgttaccggagctgttcctgtagattgggtaagacgtgaaaaacctgccaatggtgattcaatcatcattttaggaggtgcaacaggccgtgatggtgtaggaggagcaagcggaagttcaaaagaacaggacgagacttctatccacacgatgagctcagaagttcagaaaggaaatgctgtagaagagcgtaaaatccagagattattcagaaatcctgaagtaacgaagctgatcaaaaaatcaaacgacttcggagcaggaggagtttctgtggcaattggtgaaattgcagactctttagaagtaaaccttgatgtattaccattaaaatatgaaggattaaacggaaccgagctggctatttccgaatctcaggaaagaatggcggttgtagtcgatcctcaggataaagaaaaattcattaaattctgtgaagctgaaaacattgttgcagtagaagtagcaaaagtgacagattccggaagaatgcagatgttctggaaaggagacaaaattgtagacctttcaagagcattccttgataccaacggatgttcaaaatctcaggaggtgaaaatcaaccaccttgaagaagtaaaaacagaaactaaggcatttaacgaagaaaacttcctgaataccttaaaagacaaaaacgtagcttcccagaaaggattgcttgaaatgtttgactcttcaatcggagctacaacagtagcaatgcctttaggaggaaaatatcagcagaccctgatggaaggaagtgtgcagacactaccaattttaggagcaaaagatattaaaaccgtttctttggcaagctggggattcgatgcggagatttcaaaacaaaactcactgttaggagcatcttatgccgtagtggagagcgttgcgaagattgtagcgatgggaggtgattataaaaacatcagactaagcttccaggaatacttcgagaaattagggcaaaatcctgaaaaatggggtaaacctttggcttcacttttaggagcttatgatgcccagatcaatttaggtcttgcagcaatcggaggtaaagactccatgagtggaacctaccaggatctgaatgttccgccaaccctgatttcttttgcatgtgctaacggagataaagaaaatatcatctctcctgaattgaaaaatgcaggaaacaaactatatttcttcaatcatatcgctcaggaaaacggacttccaaactataatgctttaaaagaagcttttgaattcattttcgaaaacattaaagcaggaaaaattgtttctgtaaaaacagtgaaagaaggaggtttggcagtagctttagcaaaaatgagcttcggtaacagattaggagctgaaatcaatgctgatgaagctgtgttattggcgaaaaatattggtagcctgatcattgaagctaaagaagaattaagctcagctgctcttcagttgatcggagaagtaaaagattcagggattttaaaaattaataatctcgaaacccgaatcacgaacctcgaagccgcatataccaatacattcgagaatctcttcccgacagtagaaaaagaaaagatcacggttgaaatcgatgaaaaatcaaactcaatccatccaagaaatatcatcatcaaaaaacacggaattgctcagccaaaagtatttgctccggtattccctggaacaaactgtgagtatgatacactgaatgcattccaaaaagaaggtgctgtagtaagcagtctgcctttgatcaatatcaatcaccagctattggatgaaagcattgatgcatgggtagaagagatcagaacttctcagattctggcattctcaggaggtttctctgctggagatgagccggatggttctgcaaaattcattgtcaacgttctgaaaaacgagaaaatgaaaaatgcagttcacgaattattagacagagatgggatgatcatcgggatctgtaacggattccaggcacttgtgaaatcaggattgttgccttacggaagaatcaaggatttggatgaaaactctccaacgttagctcacaatgcgatcagaagacatatttctcaaatggttactgtgaaagtagtgaatgacgaaagcccttggttaaaaggaatgaaaggtcaaactttcaccattccgatttcccacggagaaggacgtttcatggcttcagaagaagagattaagaaattgtatgaaaacgggcagattgccacccaatacatagatcttgacggaaacatcgcacacggaatgccgtttaacccgaataactcattattcggaatcgaaggaatcaccagtctatgtggaaaaatctacggaagaatgggacacccggaacgatttgctgaaggtctcatgaaaaatataccaaccgcgaattatcacaacatattcaaaaacggtgttgaatacttcaaataacaatacaagaaaaatgatcgtcatccatggcggtcatttttcgtctttagatggtttctacgaagaagcttcaagtgttctgatgaaagatgttgattggaaagttggaacactagatggttttgatgacattctctacggtggttttggagtattcgaaaataaagaagaaattgaaatcatctggaaagaatcgcagaagtcaaaagaagacttaggctttgctgctacccatgaattctatgaaaacaaaatcagacagggacaacctttcaacataaaattaattcagcagaaattaagtgaattagaggaaggaaaaggacagacactctttgatattctggtggaaattataggatcacatagcaatattacactgacattagaatgatgagtaatgagtaatgagtaatgagtaatgagtaatgagtggaaatttttaaatatttacattttccagctagcttcatcaaatcaacttgttgattctctctttgcttccttgaatcaagagaatagcgataatatctttgcgtcaaaaagcagaatacattttaaaccattaagaataataaagattgtaagaaaagttaagattcatcgcttatgaataaggcattcttcataatagctttagctgttgccttaataattcttcgtcccttcaaaaatcttaatggtgcaaataagtttattcaaccagggtacaaactggtctatagccaagtgaaacgcccttgcgatcgaaaacattgaattaatataaaaactttgcgtcttttgcgttaaaaaccatgaaagctaaaagatattaatagtttttcttcctatttttactgtaacaaaactggaaacaataaaagctgaatgaaaaagattacttacgggctgttcttcggtgacagcattacctatggagaatatgatggagtcttcggaggatgggtagatattctgaaaagatacgctttacagaaatttcatgaaggaaacggagatgaactgatccttttcaaccttggaataggtggagaaacaacagaaggcttactcaaaagaattcctcacgaactggaggccagaaattctgctgacgggaacattatttttttaagttatggtgccaacgaccttgctataaaagatggaaagcagtttgtagaacctgaaaaatttaaaaataatattacgacagctgtcaatcatgccagacagttttccaatgaaatttatcttgtgagtattctgcctttttccgaaagggtagacggagtagtggtaagttcagggaagttgagaaccaatgaagaagtgattgtctacaatcagattcttaaagatcttgctgcagagcattcgcttgggtatattgatttttattctgcttttctggaagataaggagattttattatctgcagacggagtacaccccaatgaaaaaggctatggaatgatggctgaagtagctataccaatcattgaaaaatatttataatgccttatttattctcttatggaaccttacaaaaagagcaggttcagatagaaacttttggaagactcttacaaggtgaaaaagacactttatcaggttacaaattagatatgcttgagatcacagatcccgaagtattaagaaaaagcgggcagaaataccatcccgtgctgcagttttcagggaatgttgacgatcagatagaaggtgtgctttttgaggtgaccgaagcggaaatccttcaggcagacgaatatgaagtagacgattataaaaggatcgaaactgtttttaaatccgggaaaaaaggatttatttacgttgggaaatagttcctcatctttaaaacatacccatactgtcattgcgagcaaagtgaaacaatctcaataacaattagaaatactaaatttaagtaatttttctttgataaatatcaacggttttttgtcattccgagcaaagcaaggaatctatactcacagattaatagtttatgaagttgagattccttgcggggtggacaaaggctatgggtagattgtttttatacaaaacttcccttttaaacacaaatattacgacaaatatcacaagtaatattcaataggagtgggctttagcccacttactttataaaacaaatccaccggcttcagccaaaacttaaaaataatatcccattcaatcaattttaaaaactactgacatacccttgtcaaaacctgttcctatctttgtcctacaacaaaatcaaaaaatgaataaagtaaaagtcgatccttttaatgtgatcggaatctcggtaagaacaaccaacgaaaatggacaggcaggaaaagatatccctttattatgggaaaaaatgatcagtgaagatgtcctccattcaattccgaacagagtagacaataccatctattctatttacacagattacgaaaaagaccataccagaccttatactacagttcttggatgtaaagtggaaaatcttgagaacatccctgaaggtatggctggctattcttttgatggtggagattatgtaaaatttactacaaaaggagatctttcaaaagacttagtgatcaatgagtggatgaaaatatggggaatggatctggacagactatttactgccgattttgaagtctatggagaaaaagcacaaaattcttcagacgcagaagtagatatcttcatcgctgtcaaataagtaaaaagcaaaaacttcttgccctcacaacctttgaactgaagacgtgaaattcccctccctcggagggtggcagaaattcaaagaatttttgacggggtggtttaaagcttcaagcttctttcttccagctcagctgaaaatatatttccaatacaccagaattccgacaattaccgctgcaatggctgtcagaactacagctccggcagcaatatccttgataaagcctattcttttatcaaaatcaggttggatgatatcacatatcttctcaacagcggtattaaagatttcagcactcaaaacagcaaaagagacgttgaaaaccaatgctgcatccgtattgttcagtctgaaatagaagataaagaaaaggttgatgaagaatataaaaagttcaacttggaaatttctctctgttttaatcatcatgaaaacacctctgaaagcattgagaaaacttttatggatgggaggtttttgcatgatcttcgaagttttttcacaaatataggttttgtatttgataaaaaaatgtatatccgcagaaatctaagtataatatcaaggctcaaaacaaattaaggatctttgttaaaaactcctccataatattcttttctttattgtatctatttattatatttgtagaaacttattttataaatctatgaaatttattatttcaagtggtgaactgcagaaggctttgcaaactgtaagtggcgtaatatcaagctctcaatcgagaccgattttagaaaactatctttttgaattagacggaaataatgttaccattacagcatctgacggcgagacaactcttgttacttccctggaagtaaagtctgatgacacaggtaaatttgctgttcctgctaaaatttttcaggattttatcaagacctatggtgaacagcctctgacatttgttgtaaaagacaatgccgaaggaaccggaagccagcttgagattttagatgaaaaagataatttcgcagtagcattagacaatgctgacgattatcctgaattaccggaattcgacgcttcacagagtgtaacgatgccggcaggagttctttctgaagctttgacaaacacactatttgctacaagtaacgattctcttcgtccggtaatgacaggagtactgttccagtttggagaaaatgaaaccaatttcgtttctacagactcccacagattggtggtatacaaaagagcagaccttatgaatgccgaaccgatggagtttatcatgcctaaaaagcctcttaacattttcaaaaatatcctggcaagttccaatgaagacgttaccatcgacttcaatgagaacatggctaagtttacttttggtaaacatatctggatctgtagactgatcgacggaaaatatccgaactatactgcggtaattccaaaggaaaatccaaacgtattgacaattaacagaaatcttttgttaggagcaatcaaaagggcgtctattatgtctaacaaatctaccaaccaggtaagattcaagctttcaggcaatattcttcaccttcatgcagaagatactgaatatgcaaacaaagcagacatgcagattccttgtgattacaacggagaagatatcaatatcggattcagttccaaattcttaactgaaatgctaaccatcttagggtctgacgatatcacgatgaaaatgtctcagccaaacagaccaggtatcattgaacctgttgacggtcttgaagaaaacgaaaacatattaatgttatcaatgccggtaatcggattgtaatagtaatataacaaataatagaaagccggaattttccggctttttttgtagcatgctctctcacctatagttataagtaaggggtaatgacctcggaagtaggagcgttaagaaaatttaaatgtaatccgttaaaaaatttccattgtctgagcatgaacgaaatttaaaaccaaagaagaatcgtagaacccatgcgagtttggaaattttaggaatacattcaaatttagtggattattccagtcttgaacttttgtatacttttgcttcaaggtaaagtataataaaaaaaaacagttaataaacatgaaaaaaataataactttaggattagtggcttgttcgctattgggctattctcagaaaaatgcaaaaatctattatgaacagaaaaatgatacgattgcatattatgctgataatacggaaatttatccgatttcaatcactttttctgaacagccgcaattagaaaatctgaaaagcccggaatcatttaaaatgatcagagtgcttccacctaaatcaatgaagaaaaggattgcttattttgttatcaatgataagaagaaaggttggaaagttaaaaaaatgccatactatacattggcgggtgatgcaacgataaaagaatttgatacttcttaccagtatgaccttccttttaaaaaggggaaatcttttaatgtgtatcagggatacaacggtgtattttctcatcagaatgaaaattctttagattttgtaatgcctgagggaacagaaatcactgcggcaagagaaggtaaagtgattgatgtaattcagaacaataatactggctgtcctacaataagttgtgctaacttagccaattatatttctattttacattcggatggtacaattgctcaatattttcacttaaaagaaagcggtgctaaagtaaaagtaggtgatgagattaaaaaaggtgagttaattggtttgagtggaaatacaggatggacaaatggacctcatttgcattttcagtgttttcttcctgacccttctaaacctaaacagaagaataccatcaaaacccttttcaaaaccggtaatggaactaaaagtgaatatttagtggagaaaaaaacatattcaaaagaatattaattattgctttgttgaatttttaagttggaaggaatccgctttaatccaaagaaggcaataagacaacctgatcagacattcttagcttaagtattgaaattaacgaaaatttattatcttaaaattgttcctaaatttctctatttctcaaaaaaacacgacatttgtagctcgaaaaattacacttgtgtaaggtgtggaatttcaagtaaaagtttcaaattgagaagatgaatccttatttcatctgaagaattaaataagtagatagattaacaaatgaaaatatcaaacaactggctgaaggactttgtaaaaacggaattaaaaactgaaagaatcggtgagttccttacagatataggtcttgaagttgaagggatagataaatttgaaagtgtaaaaggcagcctggaaggaattgttgtagggaaagtattaacctgcgaaaaacatcctaatgccgacaaactgaagaagacaacagtagatgtaggaaacggaaaagtgctgaacattgtttgcggagctcctaacgtagaagcagggcagactgttcctgtagcagttgtcggaactaaaatctatgacaaaacaggaaacttttttgaaatcaaagaagcaaaaatcagaggagaagtttctcagggtatgatctgtgctgaagatgaattaggtcttagcgatgatcacggaggaattatggtgctggacgaaacaaaatatgaagtaggaaaaaactttgcagattattttgagttgactaacgatgaggttttcgaaatcggattaacaccgaacagaacagacgccatgtctcattatggcgttgcaagagatctgcatgcttatctttctaccaaccaattgaaatctcaatttaataaagtcgcttccgaagctttgaatggtgagggaactcatgacttcaagctggaaattgaagatgcagaactgtgtccaagatatatcggagctgttattgaagatgtaaaagtagcagaatcaccatcatggttgaaagacaggctgaaagcgatcggattaagcccgatcaataatgttgtagatattacgaactatattcttcacgggtacggacagccgcttcacgcatttgatgcagataaaattgcagacaaaaaagtgaaagtaggcgttgtaaaaccgggaactaaatttactaccttagatggtgttgaaagaactttgaatggttctgaaatcatgatcaaagacggtaaagataacccaatgtgtatcgccggagtattcggtggtgaaaagtcaggagtatctgaaactacaaaaacaatattccttgaaagtgcttattttaacccgattgctgtaagaaaaggagctaaagcacacagcttgaatacagatgcttctttcagatttgaaagaggggtggacccgaatcttacaagaacagcaattactcatgcaatcaaaatgattcaggaaatagctgaagggaagttagtaggagagttactggaagaatatcctaaaaaaatagaagataactatgtgatcctgagattctctaaaattgagcagattttaggaacaaaaattcacagagaaaaagtaaaggaaatcttgaaagccttggaaattcaggttttaaatgaaatcccaaatggttttgaaatctctgttcctgcttacagagcagacgtaacaagagaaattgatgtgattgaagagatcttaagaatctacggatacaataaaattgatgctcctcaaaaaatttcatttacccctgttaagttaagtgcaaacgatcaggatgaactggaaaacagctgggcaagaactttacaaagccttggtttcaatgaagtgatgaataactcattaacttctgtaaaagatgaaactgatgccgtaaaactattgaatcctttaagcagtgatctggcattcatgagaaagtctttgctggaaggacttcttcagaatacagtatacaatatcaacagaaagaaccaggatatcaagttcttcgaattaggaaaaatttatcacaaaaaagataaatacgaagaaagaaaacagctggcattattggtttcaggaagagatgttgcagaaaactggcttcagcctaaatctgcagtaagtttctataaccttaaagcgtatgttaaagttttattggaaagacttgctgtaaattataaagaagtggcattaacggatgacagattctctgatgcactggtatatgaagcagatggtaaagcattggtacgaatcggaaaagtagcacctgctttattgaaagattttgatatcgatcaggattgtttctatgcagaaattgaactggaatatgctcaggaacttcgttctaaaaatgagctgagattcaaagacattccgaaattcaacaagatcagaagagacctggctttattgattgataaaacagttaactatcaggatttatatcagactgccaaaaagaataaatctccattcattaagagcattaacctgttcgatgtgtatgaagggaaaaatcttcctgaaggtaaaaagtcttacgccatgagcttcgagcttttaaacgaagagaaaacactggaagaaaaggaaattacagaagtaatggattccttaatcaaatctttccagaaagaattcaacgctgagttgagatcttaacatttgaaaatatatatttcgacatacattgaaacggactttttaaagttcgttttttgtttttaatcattttagaatatccggattaatatgttttggctgaagccattgaattcttggctttttaagtaaacgggctaaagcccgttcctattgaattgcatttgtgaatatttttcatggtcaatttctccgcatctttgtcattccgtagagtctcagtgctctttataaactaattgtagtagagactctttcggaatgacagagcactggagatttcatagtaaagcttttgaaatagccggaaattattcaaaataccaagtgttaaagaataataaaattcacggcagcccgtttaaataatataaattccgtaaatttgggttaattcaaaaagaaaaaaatgaaaaatctttttttaagtatatgtacagttgcagtactggcttcatgcggatcaatgacaagcccttctgcgtctaaagtaggaaaggctcagcctgctcttgccaacacaaaatggacattggcagaaacggtaaaaggtaaagttccgacattgaatattgaaggagagaaaatcacaggaaatgcaggttgcaacaactatttcggaactgccagcatagatccgtctacaggtagttttacagcagggcagatgggatctacaaaaatgatgtgcaataacatcggcgtagagcagaactttatggatatgatgggaaaagcaaacaaatatgtgatttccgggaacactttagaattgtataaagacaatcttttgctattgaaattcactaaatcagaataaaaaaacaaaaggaactcaattgagttccttttttatgtttagagtgttattaatcttcctcttcttcgtcgtacttagccaactcttcgtcgcaccatttgaacgctgcttctactactttagtcgcttcgtctgccatagtttcttcatcatcaccttcaagatcatctaaccactcaacttcttcttcctcaacgtttaagataaatcttggatattctgtgtgaactacgaatagatcctctggaaattccgaattatctgctaataaaaactttggtaatttcatttttttaatgttttaactttctcaaagataaataaaattattgacttaaaattacttcaaaaacatttttgaaactttttcagcttttttgctttcagaataatcgtagaaaccttcccctgattttacaccaagtttccctgccattaccatgtttaccaataatggattcggagcatacttaggatttttgaatccatcatacatgacgttaaggatagcaagacatacatcaagaccaataaaatctgcaagctgaagaggccccatcggatgagccattcccagtttcatcacagtgtcaatctcttctacaccagccactccgttataaagcgtttcgatagattcattgatcattggcattaaaattctgttagccacaaaaccagggtaatcatttacttctacaggaacttttcctaaagtcttactcatttcatagattgcatcaaaagtttctttagatgtagaatatcctttgatgatctctaccagtttcataattggaaccggattcataaagtgcataccgattaccttatcagctcttttggtagctgctgcaatttttgtgatagaaatagaagatgtattggtggcaagaatgcaattggcaggagccagttcatccatctgtccgaagatcttcagttttagatcctggttttccgtagcagcctctacaataagatcagcagctcccacagcgtcattcagtgctgtaaaggtagtgatgtttcctaacgtttcagctttttgctcttctgtaagatttccttttgcaatgattctgtcaagattcgtagtaatggtttttaaacctctgtccagagcttcctgagatacatctacaagatttactttaaaaccgctttgcgcgaaagtatgtgcaataccatttcccatggttcccgctccgataactacaatgtttttaatcatttttcctttattttttatagatagttaaattttttacgtttttaagatccgattgtgaaacaacagttgttgaatcaaagaaaacatttccgatgctttgacttttcttattgttgttctgattggaaacagcagccgttaatcctcttataagacggcttttttgattttttgtaagataatctgtaccaatatataatgtatattcaccctcttttcccataccttttcccatcaggatttccagacttctgatctgacttttatttttaaattcctttagaaaactgatgacaggtttatcagacggaggaccgcagcagacacttccatagctgatctctaggtaattctgattcttctgcgaataaaagaatgcaaatgtcaggagagcagttaatactaatatttttttcatgttaaaccgctttaaaaataagctttaaattttatttattaaaatattcccaaacctccttcgaaatatctgaaatcatcctgcagttcactgcatccgtttccattgaattactgacgaataaagctaatgcataatgtttcccgttgggtaaagtaacaattccgatttcattttctgcgcctgttaaaccagcattattcttcccggaagctcccgtttttcttgcgacaggtgtgtttttgggaagctgttccaccattttattcaatccggttgaagtagaaagcattactttcatcagatagtctgtggattttttggataataactttccgtcatacaactttttcaggacatcagcagcggattttgtagtactataattttcatactgaacattccagtcattgtgcatatcctcttcattgtatttgatctgaaaaccttttactcctctagaatccataaacttctgaacaacctgggtgccgcccaacagcttcagaagaatatcacagccattattatcacttttggcaactgtatattcaatcacttcgcttaacggaatttcaacatttcctgccggatatttatcacgaagcggcgaccatgtattttccagtaaattcgatgggtttagcataattttctgatccagagaaagtattccctgatctacagcattcaggactgctgctgcaatgtgaaatttaaacacactttgcatcgggagttttttatctccgtttttatcgtacttaaagccattttcaaacccaagaacagaaacaccaaccgtagcttttttgttcttaaggattgaattaattttttgctccaataaagaggtctgagccaatgaaaatgctgaaatcagaagaaaaagaagtgctgtttttttcataatacggaaattaaaaagctctcttctgaagatgagaagagagctgcaatttaagataattattactattttaattcaaaataattcagattggcaccatcactttcaaagaaaattctgattttgttttctcccttctgaagcggaacgttttttacagaaactattttccagttttcatttcctccgctggatggcagtgatacattagccaggacttttccggaagcggtctcaattcttatatgagaatcttttgctcccgaatatctgatatcaagtgtataatttttatctgcttttgactgaaccgtatactgtagccattctccggattccgttttccctacataatactgattcgtaatcttatcattacatttatagatgtccacaccatcatttctcaattgctgcccggaattccattctgatcttttggccggatcgcttacccaaagattaatgaaatccttatccagataagctgaacccattcttccaaggtcatattctgaagcaaatattcttcccggagcctgatgatctttaaatggctttgttgaagcatctgttgtctgtctgaacatggcatcaataacgtcttttttaacttccgtattgctcagcttgtaatgttcggcaatctgcatcaacgctttttgggcatattcttttgatggcttttcgccgccgtttttccagtaatccaataacttttcatattcaggggtaatttttacattcgcaattccggcaatattatcaatctttttcataggccagaatgcatatccgatattatgcttatccagaagctgtatcaattctgtaaaccagacattggaattctcaccggtctcacccagccagatcgggatattatgtttttccctgaggtccaacgcaaatttcaacgtctggtcatcattataattccagtatttatggaaactgaaagccatattgttgtcccaaagtgcaggaagtccgttataattgtttccccagccgttaccttcaatgaagatcatatgttttttatcaactgctctgattgcagcagtaatatctttctgcagcttccatagcggagcattggacatttcatcagttccattcggatttttgccggtgaaattaatattaggctcattgatcaggtcataccctccgatccatggatgattcttatatcgttctgccagttttttccataaagctattgtttttctttgattctcttcactttcccaaagtgaaggtttagacttatcattatccgaaatgttgacatcgtttccctgtccgccaggtgtggcatgaagatccaggatcaggtatattttattgtcggcacaccatttcagtaattcatctgtcattttaaaaccttcttccagccatgtatcttttccttttaccggctccttttcaatcggaagggtataaaggttgtaatgcatcggaagtcttatcgaattaaatccggattgggtcagaagatcaatatcctgtttggtaatgccgtttttcaggtaagctttgtaaaacgcattcatgccgtcttcaccgattaattctgcaattttttccttaatcttatactgcggaccggcaaaatcagcagttttcagcatataaccttcctgaagcatccagccgccaagaccaaggcctctcagttgaacattttcacctttatcattaacaattttttgtccggaagtcttcagtaattgtgatgtcccaaattgagacaataaaaatgcggataatagaatagctcttttcatagtggttttaatggtttaaaataatagggaagtattagaaatgatacggaatggtgatggaacgagatgaatctgtattcagctcatttattgtatcagatatccatatatgtaaaataaaatctttcaatattgtattgaattattctccaaatatattgtttttttattttgaaaaagattttttattggtaaatctgtaattattaatgaattgtttttcttttatatgagtttcttaaaaacaaattctgaattaatttaatatgcagcttcatcaaatcaattttaatggattcaatctttgtttacttaatataatccgtcgctgaaaatgaaactttgcgttttttcataataaaaaatgctatctaataatccattattctgattataagatagcatagtatatttaagaatcagtatgtttctaactgatcagtttcataatctccaaagctacttttaacgcttcagttccgtcctccagagaaacctcaacatttttatctcctgtgatagcatctgcaaaagagttcaattcatccaaaatcgcattattaggctgaatatttggatattcaaataagatctgattcttttctccttctgcattttcaataatcatatcaaatggagtaggattttcaggagcgtccttcattctgatcacttctgcctttttttcaaggaaatcaacagaaatatatgcgtctttctggaagaatctgctctttctcatcgccttcatagaaattctggaagttgtaagattagctacacatccgttttcaaactcaattcttgcattggcaatatccggagtcttgcttactacacaaacaccgcttgcatggatgtttttaaccttagatttagccatactcaacagaatatccagatcatggatcatcaggtccagtacaacagaaacatctgtaccgcgtggattgaattctgccagcctgtggatttcaatgaacatcggattactgatgtactccttagttgctataaaagcgggattatatctctcaacgtgtcctacctgtgcctttattcctttttcctggcataaacgtaaaatttcttctgcctgctcaagagtctgggttaccggtttttcaataaagaagtgaagacctttttcaatggcttttaatgcataatcataatgataaatcgtcggggtgacaatatccagcatatcaatctgctccagtaaatcatcaaaattttcaaaatatttatacccgaattcggcttctaatttctttccgttttcaacatctttatcatggaaccctacaaactcatatctatctgactgatttagaagttttaaatgtatttttcccaagtgtccggcacctaccaaacctgcttttaacatagctgtattaaatttttgtaaagatagtgaatgtacatttattaaaatacatgactttttacttggagatttttaagattaaacacctctgttcattaaagaaattgcagtaaattcaaagcttggaaaaataactatgaaaagaataatttcgattgtatttgcattcgaattacttactagcggatgtataggagatagtccatatgacccgcaggctaaatgtggaactcctgcaaatctgatatttgaaaaagtgaataaccagctttcctggaacatgatcagtcagggcgaaggatattatgaagtacagtatggagaacagggcttcactttaggaaagggaacaactgttgtcaccagtaagaattcctgcaatcttccgttgtataagaataataaatatgacctttatgtaagaaaaaactgcggagttgacaatggccggagcaactgggcaggacctgttaccgtattggcgactaatacaaccacctgtataaaaccagcgtatgcaacctattcaaaaacaacctcttctgttcattcttctgtttttgatgctacagtaacctgggaaaatgatggagtttctatatatgaaactgttttgacaaccagtcctgcaccaccggcaagcggagaacaggtgatttcaggtcaaaaagctgtttatatagggttaagtaaaacggtgaattataacttttttgtgagaaaaagatgtgcagataacaccttcagtgatttttacggaccttatccgataaaatggaattaaaagataaaagaaaagcagttaacagatgtttgctttgtttttgtggataattctttcaggcgatttctgaaatctaatttctaatttcttatttttgtcaaatgcaggattcgtttgtacataaaggaaaaagaaagattttagtagattaccttcgaaacagaattggaatttcagacgaaaatgtactttcggctatgagtgaagttccgagacacctttttatcgaaagtatttttgaagattttgcctatgaagacagggcatttcccattctggcacaccagaccatatcccatccttccacggtagcggagcagtctgagctgctgaaggtaaaacccggtgaaaaagtgttggagatcggtaccggatgtggttaccagaccgctgttttaatggcaatgaaggctcatgtttacacagtagaaagacagaaagatctttttgatttttctaaaaagaaactcagggagcttcatctgttcccaaaattccagagttttggagatggctttgccgggcttcccacctttgctccttttgacaagattatcgttacctgtggagcttctactttaccgacagaattattaaaacaactgaatgtcggaggaataatggtgattcctttaggtcccacagatgaacaggttttatacagatttaccaaggtaggtcctacagaatttgaaaaagaagaattcggggcgtataaatttgttcccatgcttggaagtaccaatcaataattgtatcacagatacggaattggcagacgaatgatctcaaataccagttccattgttaaaacaagataaaataagaacggactattgagtccgtttttttatgagtaaaattcaaaagttttaaaataaaattaaaatattttaactgatttcggaatgaaaattgaactcacctcaaaacccaatcactaaaatcttactattatggatacgaacagattcaaagcgtcacatgattttagtaatcttcagaaaaacctgcacaataacccgggatatagtgtagagagctattctcaacaggtaaaagattacatcagcgacatgaaaaagaggaatcaggaagctaccaagcagggatttatggcgcaggctcagaaatctgcaaaagaagtttgggctgagattcaggaaattgcttcggaagcctgggagaagaataaaaaccattcagatgaaaagaaataatttttaatattaaagttcagaaaccttactttttgcgagtgaggttttttcttgacaaccattaatccatcacaatgaaagtctttatcaataaaagaattcccgaagcaggaattaaaatgctggaagaagctggtcttgaaatagttttcccggaaaaagaaaatctgtcttatgaagaatggctgaattactgtaaaaataccgatactattttaagtattggcacagaatttaaatatgacaaaaatttctttgaagcctgcccggacgttaaagccattgctttatattctgtaggttttgaccatgtagatattaaagaagccacccttagaaatattccggtagggaataccccggatgtactgagccgggcgacttcggatgtcgctttcttactcatgcagtcggtagcaagaagagcaagctacaatttcgggaaagtaaaagagggaagctggggtgcatttgatcctttacatgctttggggcaggagctttatggaaaaacgctggggatttttgggctgggacgtatcggatatgaaatggcagaaaaatctaagaaagcctttggaatgaatatcatttatcacaacaggcatcataatgaagaagcagagcaggagctggatgccacgtacgtttcttttgaagacctgatcagaaactcagatgttttgagtgtgcatgccaactttactccggaacataaagaattattcaataagtccctgtttgagcagatgaagtcaaatgctattttcatcaataccgccagagggggctttcataatcaaaaggatttataccaggctttggttgatcagaaaatatggggcgctggtctggatgttaccaatcctgaacctatggctgcggatgatcccattctgcagctttcaagtgtttgtattcttccgcacatcggttcggctactgttgaggcccgaaacggaatggccagactggcagcaggaaatattattgctttttcagaaaacaaaaaaatgcccaattgtgccaaccctgaagtttattctagtcgtttatcctaacttggaattatttttgttctgattacagaaacctttaaatcgtaatattatggcaccagaaaacaatattaatgagcaaaacagaaagctggaacagatggattataaccccaacgaagatatattcaaaaaagaaaaacatattccgcttgacggagacggaaatcctgttttagatgaggattttgatgaagataaaattgataagggactggatattcccggtgcagaagaagatgatgagatggaagagataggggcggaagacgaagaaaataactattggagtctcagtgataatgaagatgaccatgaagaggaaaatgatgatgttctaacttaaatttttacgataaataaaccaaccttgctgaatttagtaaggttttttttatgttgaataacaaccaatatgggtaaggacaattcccctccttcggaggggtggattcaaaaattaaagaatttttgaagacggggtggttccataatgctgcacaataaagtcttccaattctttcattaccacgttcagattattctttacatcaaaatcacttattctgaaaaccaaaagccccaaagattcaagatattcctctcttatgccgtcataaacctgcttttcatcatgacttgatccatctatttctataattaatcccaatgtttttacataaaaatcaacaatataattacctattattctttgtcggtcaaaatcaatcttatgaaaattttttgcacggactttcttccagaatatcacttcacccaaaatccgggctttacgtttttcttttaataatgcttttaaatggggattgtagggaaggttttcaacaaaattcctgcggatcggaactccaatgataatggttatgatttctttcatgattgtgtttatttttaaccaccccgtcttccaaagttatcaactttggaatctacccctccaacggagggaaattgatgtgtatttattcaaatatagtatttaatatcaagtggtgaccggtttacaacttttataactttgcttaaaccttaaaccttaaaccttaaaccttaaaccttaaaccttaaaccttaaaccttaaaccttaaaccattcttcccttcaccccttgcctatatttcctaatttgaatatctttaaaacttcaaacattgtttaaaaacatagacctttaaatagtaatatgacatttcaagaacagatacagcaggggattcctgatcagctgccacaaccgaaaccatacgagaccaatatcaaccatgctccgaagcgtaaagaaattttaggggaagaagagaaaaaactggcattgaagaatgctttacgttatttcgatcctaaatttcatgcagaattaattcctgaatttaagcaggaactggaagattatggaagaatctatatgtaccgtttccgtccggattatgagatgaaggcaagaccgatcacagattatcccggaaaatctgagcaggcgaaagcaattatgctgatgattcagaataaccttgattatgctgtagcgcagcatcctcacgaattgattacctatggtggaaacggagccgtattttcaaactgggcgcagtatctgctgacaatgaaatatctgtctgaaatgagtgatgagcagacattggtaatgtattcaggccatccgatgggattgttcccttcccataaagatgcaccgagagtggtagttacaaacggaatgatgatcccgaactattcaaaaccggatgattgggagaaattcaatgcattaggcgttacccaatacggacaaatgacagctggaagttatatgtatattggcccgcagggaattgttcacgggacaacgattacggctttaaatgctttcagaaagatcaaaaaagaaccgaaaggaggacttttcgtaacttcaggattaggagggatgagtggagcccagccaaaagcaggtaatattgcaggctgtgtaacagtatgtgcagaagtgaatccgaaaattaccaaaatccgtcatgatcagaaatgggtgaatgagattcatgaagatcttgatgcattggtaaaaagagtaagagaggcacaggctaacaaagaaactgtttctctggcttaccttggaaatgtggttgatgtatgggagaaattcgatcaggaagatttgagaattgatatcggatcagatcagacttctcttcacaacccttgggcgggtggttactatcctgtaggacaaagttttgaagaatcaaacataatgatggctgaaaaccctgaattattcaaagaaaaagttcaggaaacgttgagaagacatgcagcagcgatcaataaacatacagcaaaaggaacttatttcttcgattatggaaatgcctttttactggaagcttccagagcaggagctgatgtaatggcagaaaacccaacattaggaagagagttcagatatccgagttatgttcaggatattatgggaccaatgtgttttgattacggtttcgggccgttccgttgggtatgtacaagcggaaatcctgaagacctgaaaaagactgatgacatagcgtgcgccgtattggaagaaatgattaagaactctcctgaagaaatccagcaacagatgaaagacaacatccagtggattaaaggagcacaggaaaataaactggtagtaggttcccaggcaagaattctttatgcagatgcagaaggaagaatgaagatagcagaagccttcaacaaagctattaaaaacggagagattggacctgtggtattaggtagagatcaccatgatgtgtcaggaacagattctccttacagagagacctccaatatctatgacggctcaaggtttactgcagatatggccattcataatgtgattggtgacagtttccgcggggctacctgggtttccattcataatggtggcggagtaggctggggagaagttattaacggtggtttcggaatgcttcttgacggaagtgacgatgccgacagaaggctgaaatctatgcttttctgggacgtaaacaacggaatctcaagaagaagctgggcaagaaacgagggtgctattttcgctatcaaaagagctatggaagcagaaccgaacctgaaagtaacccttccgaaccttgtagacgaaaacttactgtaatatataaattcaacattggcagtgatcaacaaaaaactgttttcacatctgaacgtagaggataatgatcctgtatgggaaaagtttgctgaggttgaattttcaaaaaaaacaatatttccggaccgcaaagcctatcttctggaagatgggcttgtccggaaatattacatcaacagcacatcggacattgataccgaaatctgtgcagaattttactttccgggagatatttttaccgttgaagaaaaagcctccgatgcggtttacgaatccatcagcagcggtctggcatgggaaattaccctggatgaagtgaaagatatgtttgctttaaatccgcactgccgttttgtacagaattattatctcagcaaaaaactgaatgcggccatgaaaagggaaatgcttctgctgaaaaatactccgcaggacctctatgaatatctactcaagaacaaaccgcattacattcagaatattcctttaaaatatctggcctcttacattggcattacgcctatctctttaagcagaatcagaaaaagaattatgtaagctggaagaggggagctggaagctggaagttactctcagtcttaagattttctgtaggtttaataattaaattgatctatcatttcaaataaaggagaggtatagttattctatcacctcaataacttccatcttccatcctccatcttccaacctcaaaataccctcatttattatcttttgtttattgtcttgccttccgtaagtttcttcctttgctgaaaaaaagaatatggaaatacaaaaattaaactgggcagggatcaaacttacttctcacaacaaaatgatcttaatagatgctgttgaagattactcttattataaacccgttttaggggatgcagtggagaatattatagcgttttcagatcatgtacaggcagattacattctgtttacacatatgcatctcgatcattttgataaaggagtgatccggaaatgtttaaagaaagacggaaagctcattgtatacaaagggcttgaaggtgtggtaagaaaaattttgaatgacgtggagatcatagttcttgatcttgatgaaaccttcacagaaaacaatatcactttcaaacctgtatttgcgatggatggcgtgggagagatacagtcttcatggatggtagatgatggagaaaccaagatctttcatggcggagataccatctggcacaaccagttctggaagctcggaaaagaaaatcccaatatagattacgctttcttgcccgtaaatggtgtggtggtcaattttgagatcatcggtttggaatacagccctgttcctgcttcacttaatctgaaagaggcctttgctgctgctcatttgcttcatgcaaaaaaactggtccctatacattatggtttgtttgtgcatgagaaattttatattcctcaggtgtttgatgatcaggatttgaaaaaggtttcggaagaagtagggcaggagtatatgattttgaaagatggagcgctactggtgtaatcttgattgatatttgtaaggaaaattgtcattctgaatgcaatgcaatggaatcaagaatctcaacatcaataggaacgggctttagcccgttttcttttgtgcgtaatatgaatggctttagccaaaatttaaaattaagttgaggctgtctcaaaaggtaaaccaacgcctgtgagaatttcttaaatgacaaaagttgtcagacaggagtccgaaagagggggacttttgagatagcctcttatatttatatttttatatcgggctttagcccgataccattgatgatttcatttgatttctgaactattgtcattcaagaatttaaaagttatcagaagattatagattccacgcttcactttgttccactttgaatgacaaactttgtgcatatttatatttttctcagatagcgcggagctttgtaacaaatactgaatttcagaagtttgtttatctgtaagttttgtttttaatttatacttatcccacttgttttcgaatgaaggtaaaaattttatttaaaatgggaaatcatcatctatttcaataaatgggtgtttacgtaaattattttcatcaataaaatctctaagctttcgatatgattctaaataggatggtctatttccccaattattgccttcatccattacgtctggatttaaaaagttacctctatcatttacaaaatgttttaaattaccattttcaatacaggattttgtatgttcccagtcccactcaaaaatagcttctgttgcgcttataaaattagaaacgagattctcaaatatttctatattgtatttttttattaaattttgatttttgacattggttgtagttctttttgcggtaattcttgataatgccaatatttcttctaatagctctcggtcatcacgtaacgcctcgtttacaaccttattttcttctagtattttagtaacctttacctctaatttaggccaccacatttcaaaaacatcatcaaaaactttgtcttctagtttgttttctgataagctattattgatggttttaactaattttttaaaatcaaccttattgaactgagatgtttgaaattgtgttaaaggacctttaaagtctgaattatctaatccaaataagattgggcaaacttttgaattgtctaatgttttactaattgcgccagcttcaaatagcatccattgactatctaaattatcttttgtgtaaataaaaatacctagtctgctatgttctaattctttagaaatgtcagcattccaacgactccctttttctatatcttttggtgtgaaatatggttttacattttgtaaaacagcagggagccaatcttttattgcttcaccaatttgtctgctaacttctccagaccaactaataaaaactttcatttatatttgatttttttttgtaattatatctaatattttagatttatgtaattgattttttttatagtgattttggatattgttgcgagtaattaaaatcctctactataagcctaattccattgatttcaaattaaataaattaatctgacctatttttttctcatgtatgacaattgttaattttgcaggatatgcaaatttcatttcactcaatctaaacgtccaaagcattatttttaataaatcttcatcaccaatatttttatgttcttttatacgagtaataccagaaccaaaaattggaacggatacatttttttgagcgtaaacacgattaactctatcccaaaaattaatcaaaaactcaatatattcaggcatcgttaaggttgctctattgtgttcatcaaattttgaaaatgcagtaattataaagtcttgataaacaaaaattgtacttaatttaaattttacattttttcctccgcttgctctacgatattggctatcaacgatgtccgaattatctgagttattaataagaaaattatcgagatcagctattttattttgaaaaaaacgatttataaaaattccattaagtgagctgttagatataattttatcatctactattgtatcgaagaattcattaaatggaatagttttaagaccaggttctgaaaataaatcaccacatttaatatttacagtacttccgtctatatctatatttatatcagtaagtttatttgctttacaccaaattattagatatattaatatcaagacaacaaataatatatatccagaatatcttaaataatctttgtattcatcatgaactatattaaaaagcaatatgaatgataaaatacctgaaattactgaaaaataaatccagaatttatttctaatatttttgtctaagaaatttactttcattgtatgaattataatttataaaaataatcaccattttttatttttgaccctacccttaaatcagtgtcatttaaagcctttctaatgatttctttatttaaaggaatatgtaatgcaggtattttaaattttgaatctctaaaaattggtaatttatcccataaagaaattactgtagaattcagttctgttttggaataatttagtacatcttctttatttttaaaatcagggtatattacaataatgggtaattctaagttgttaattccataatctatttcttcccttaatgctctagaattaatagtgttattacttaaatataagataatgtttttagaatttcttaatctttcacgaagccttggttttaatgttgattcccaatcactattatcgcgaacattatatgttgtatcatgagcattattgaatggaaatgtactgtcagcccctttccatgctttcaacatattgtaataacaaaaatctttggttgcgtgagctccaagtgatgattcattaaatggttcactaacataaaatgcacaataattatttgttttactcataactttatttaagattattaatattgtttggaatttattataaaaaactctataaaacttcattattaaaaacttaactgaagtagccaaatttaaaacaccgaatccatattagttacagtgtttttacgaaaagtagtgtcaaatataaactacatttcttgtaaaatattacggttttccgtaatctcaaaagcctcaacctcaaaacatcccatttacaatcttccaacccctatagaactctaaaacaatagcaaaacacccctcccaattcctccgtttattacaaataagtatgtttggaacttcccaagttcttagggagtctcctgcaagttgcgggaagcctcccaagatattgggaggtttgttgcaagtatgtttgtaacaaaacaactttttctatatttaattgttaatttattaaatcaaaaatttcaattattttgcgcctttgcattttccaacaaaacagctataacataaaaaaactcagcaaatcgctgagtttttatttttgaaccattaaagatttttaatagtaacttaaggaaatatcaaagatgttttctaggcgctgtgctttatcttaatattcttaatactttcaaatcttctaaatggtttattgattcttaagggcctttatttcttcctgcaacctttggttttcctttttcaggtgttctatatagtctctttggttttccagaaggaattcgggtatattgcagtaataatttccacttactgttccaatttcattgttgcttaaggttccaatattattactattggtattattctcaaaattattgatctgtttggcatcctcttcttcatagatatcttctacaggaacatccaggaaacgggcgattttttcccattcgtcttttcttatggaaacgtctccgctttcttttctgctgtaattagatacatctgttgcaatgatgtcggcgatctgttgttgtgtgatgccttttacttttcttgcattgcgtagtttttctttttgcatgacccgtattttctacaaatatgcaaaatttttgttggagaatcgcaaagacgcaagttttttatacctgatgtgttgttttaaggcgcaagagaattatagattttcagcaagtgaagcttcatcaattttatcggagataaaatccttgcgtcttaagacagtttattttaataacaatttgcgcccctgcgtttttccaacaaattatatttttttgacgcaaagttttcaattatcctatttttcagaaaggaaccaaagttttgtggctgcgccattgacgaagcggcatgtaaaacgttagcttcgtaaaatcaatcttgattgattctttctttgctcgcttgagtatagcatttttaattagatctttgcgttttcaaaagggttaaaaaaactcagcaaatcggcaggctttctacgttcttattgttattttccaggaatctatgcagtgaaagctttaaaaataagagtttagattcctatggaatgacaaggtgaacgcgtaggaagactataaacatttatttgttcagaacttaatagaaactatccgcttagattatccatacagtctgtcattccataggaatctaaacggaattaggtgatttaaaaataattatattttttacatagttaatgaaaaactccggcgatcgaagatgccggagtctatgtctatttcaaagtaaaagagtattacttcacagccgcaatagccgcctcataattcggttcctgggaaatatccggtacctgctcttcatagatgatctttcctgaagggtctatcaccacaactgctctgctcagaagccctttcattggagaatctaccagctccaccccatagttccacccgaagtcggaacggaaatctgaaagcattaccacatttttgattccttccgcaccacagaatcttttctgggcaaacggcaggtctttggaaatacaaagtactactgtattgggaagatttcccgcctcttcattgaaatgatgtacagatgcagaacacactccggtgtctacactcggaaagatattcagaataacaaattttcctttgtaggaatccagagtctgatcattcatattgacatccgtaagggtaaatttaggggctggcttattgagagccggcaatttggcataggtatgaacttcctttcctcccattaaaacagtattgatggctttggatttttgagcaaagcctacagcagaacagaataagagtgtactgaaaactaattttgaaaacatgaaattttatttttcagctaaattattcttttttcaggagctaagattaattttaattcaaatagatcgaatctattgtcagaatatttttttcaaaacaatttacttctacctttatattattattaaatctcctgaagaaggagaatcttatcacataaaaaaatagaaagatttatgagttcagaaaatacagcatcatttcatcacatttttaagggtgaaaacgaaattcctgaagaatataaagttccggtgatccatcagagaacttatcttttaaatggcgaactggtagagtggaacggtgatgtcaccgaaatctattcacccgtatgcattcctacagaaaacggattggaaaggaaacttctgggaagcattccgaatattggcccgaatgaagccatggaagttctggaagcctgtgtaaaagcctatgataatggtcttggtgaatggccgactatgtctgtggaagggcgtataaaatgcatgcagaaatttgtatatctgatgatccagcagagagacctgatcattaagttactcatgtgggaaatcggaaaaacgctggccgattctacaaaagaatttgaccgtactgtagattatatcaaccagaccattgatgcactgaaagatctggacagggaatcttcccgttttcagcaggcagaagggacaattgcacagatcagaagagcgccgcttggagtcgttttaagtatgggaccgttcaactatcctctgaatgaaatctttaccacactgattcctgccctgatcatgggaaataccatcctttttaaacttccgaaacatggtgtattagctcactatcctttgctggaggctttcaaagaagcattcccgaaaggaacggtgaatactttatacggaaaaggttcagaaatcatcaccccgattatggaaagcggaaaagtaaacgtgcttgctttcatcgggtccagcaaagtagcaaacggactgaaaaaactgcaccctaaagtaaaccgtttaagggctattttaagtctggatgcgaaaaatgcagcgattgtcaccaaaaatgcaaacctggatgtagccgttagtgagtgtattttaggagcactttctttcaacggacagcgttgtacagcgctaaagctgatctttgttcagaaagaagttgcgctggaatttacagaaaaattaagtgcagctgtttctgcgctgaaacctgggctgccatgggaaaaggatgtgaaagtgacaccgcttccggaagtcaataagccaccttatttaaaagaatgtattgatgatgctttacagaaaggagctgcagtactgaataaagatggcggctatacggatgagtcgtttgttttcccggcggtagtgtatcctgtaaacagtgatatgaagctgtatcatgaagaacagtttggtccggtaattcctgttgttcagtttgaagatatagaagaacctatagaatatcaggtaaatgcgtcacatgggatgcaggtaagtattttcagtgaagatcctcaggaagtggcaagacttatcgatccgtttgtaaatcttgtaagccgtgttaatatcaactgccaggcgcagagaggcccggatgttttcccttttaccggaaggaaagacagtgcagaaggtacactttcagtttttgatgcactgcgttctttctctatcagatctttggtagcggcgaaattgacggattccaacaaagagttactgaatactattgtaagagaacatgattccaactttttaagtacagattatattttctgatctggttcagactgtatttaacataaaataaaaatcctcaataaacgtctttgtttgttgaggatttttttaacttaataccggaaattaaagttttgtgttataataaggtggtgttttttagaaatatcatctatgatcagtttgtaaatcatgtcttcatcggaaaaagaatttttagagaaaattgaaaagcataaaggagtggttttcaagatctctaaaatgtatatggataataaggacgatcagaatgatctctatcaggagatcatttaccaggcctggaaatcatatggtgattttcaaaagagaagtgatttctccacatggctgtacagaactgcacttaacacagcaattgtttttttgcgaagtgaaaaaaaacgtagttttatacagaatcagaatgtagatgggctgaatgcccggcaggagccttataatgatacagatgatataaacatgaaacggatgtatgaagccatccatcagttgagccccattgataaagcgctgatatttttctttttagaaggtttttccggaaaagaaattgcagcgcagctgggaattaccgaagtgaatacaagggtaaaactgaaaagggctaaagaaaaactgaaagagatcattacccgccagaatacgggctcctattaaatgataacactatggagttagataattttaaagaactttggaataaagatacaggacaggaatctcctgaaatttctctggaaaagaaaagagaaatccattctccgctgcagatgctgaaagtgaatatggaaactgaattctggctgatgattgtaacactgccaatgcttttaaccggtttcccttttgcttctacagattataatatcaggaccatatcagcatttgttaccatcctgaccgttgcgattatcatttatttttattcccggttcctgaaactgtataagctgctcaggaaaaacagcatcaataccaattatgacctgttcaatcttaaaacccagcttcttgtctcgaaagaaatttatatttcctattatatttcttacatccctctcggatttcttttgtcactgatcaaaatcaacttccattttgatatggaatataatctggcgatcttcggaatcagccttctgattacattattgctgatcgcttttatcatcagatactggatctattatatgtatggaaggtatattgatgatgtagtgcggctggtagatgagcttaacgggattgaagtaagtccgaaacaggaaaagaaaaagacctggtttgaacgctcacagagttttttcatgaataaaatgggaattaaaggaaatattctgaataccatcatatggttcgtatccatgtatatttttatcattttattcctgacacttgttcttctgatcatcatcatactgggtgcaaaactggatttcctcgatatcggatcattgcagagagctttaaataaactgaattagaaatggcttgtcttcttaaattttttatctttaaaaggtcgagctgttaaaaaaatatcagatggatgagattaaaaatcagatgtattctatagaagaatttctggaactcgtgaagcataagaaagacaggaaagaatcctatgacccggaatacaattatgcggtgtattcttcaaaagacgaatttgagcctggaatgaaagttttcattggcgatcctctcgatattggtgagaatgataatgaaatcttacccgattttgtataccataataaactgaattatatgtgctctgatgagaatattcaggatgtggtggatcttgctgtccggcagtacggaaatgtaacttcttcccagcttatcactgccctgaatcattatcttcaaaaagatgattttcttgattttaaataatattgatgtttctgcgcaaataataaaagtcttctgaaagaattgaagacataaaaaatttcggcgggctgaaagcccgccgaaactctatcattactgctttttatttttcttttccttagcaatttcgttttttatccaatccagttgaggatcttttttatcaataatatcctgcatgctctcaataatttttacatcaggaacaactccttttcgtgaatctgaaaaattgatattaggctgtaccagaagtaatccgattggaaatcttatttcagaattgggaagtttctgatatgaataaaaacctgcaacggtcccgtcattggcaccaccggtctcttctcccaccagcgttgctcttttatcattcttaagtttggcggtgataatagaagatgctgaaaagcttccaccgttaatcagtacaaaaacttttccatgaaaggcctgttttttaggttttgtaggtttgtcagctttcattttatagaagacctttccgtcttttttatacgtactgaaagcctgtgcaaaaaaataactagggtatgcaatacttttcagtgcatattccagcgggttgcttttcctgaaataattggtacgcagtggtgtattccttgcagccagctgcgaaggtttaatcagtgtaaaaggagcatccgccagataagaatacaggttgttgatctcataaagagagcctccataattgtttctgacatcgataataagataagaagacctggcattattgattcgggtaaaagtttccttatagaacctatctgaaaaatctctggagaaacttttcacttttatataagcaatagtgctatctttatcgagaaatttaaagcttctgttatatgaatcgctggaagccacataatcattcagtttcttttccagggtcttcttctccatttccttctctttttcaagatcagagtcggattttgtttcccgggttatagtatacgttttcttttttcccttatagagggtttcgagggtggctttgctgccaaaaccattttctgcagtataaaaattgaagaaaagatcctttaaaaaataaggatagaaagtggtattatcaccatcactgctgatcaggcttctgtatttttttatataaccggatacaggaacatgattgatggataaaatctcggttccgggttgtatattttcgatagaatctttgttttcaataatatacattctatctcctgaaatataatattcaaaacggctgaacattcctttctgatgttccagtcttttaatttcacttttggtaaatttctttcttggaattctcagtgaaaggtgtccttcccgaatgccggcaatcactggctgaagcttaaaataaaactgaagaggagtaagaggttcagtaattgtctgcttgagactgtcaaatttatgttccaattccttcttgggaatataccagtataattgagggtgcatttgctgtaattttgaataggcaaaatccacatcctccttaagttgctccggtggaatacatgcagcacgctgttcgttgtgtttttttatagaggcacaggacgaaaatatagcgagaagaaatattaccgaataatttttcaatgtatctgagtttttaacgtgctaaaatagaaagtttaaaattaatcaccatttaaatgagtaataaattttccaaaatacatgataaatttagttaaaaaatgtagtaaaatggaatatattttcatttaaaactaaaagtcaatacatttgaaatttatttgtaaagatgatgtattggattattacaagtctggctgttctgacagtcactttttttattgtgatcaatatgaaagcttttggcggcgtgcccaaagggaaaagactgaagcggataagacaatcgaaactttataaaaacaaacagttccggaatatcagccatactccctccattacagaaggatataaaatttccaaggttatgtatgacttctttttaggtaagaaggatccgctgctgaagcctctgactgtgatcccatctcttcatacggatttgaaaagtatagataaaaaccaggatgtattaatatggctgggacattcatcttattatttgcagacagatggagtttcttttttaattgatcctgtgttgagtctgtatggctcaccttttaaatattttaataaagcatttaaaggatcagatatttttaagcctgaagatattcccgggattgattaccttgtcatcacccatgatcattttgatcatttggattatcccactgtacaatctatcagagacagaacgggtatggtcattttacctctgggggtgggagcacatttggaaaggtggggctattccgaaaacaatcttattgaagaagaatggggagcagaagttgagctgaaaaatgatctgaaaattatttttacccctgccagacatttttccggcagaagggtgaggaagaatgataccctctggagttcttatgtcctgattacaccaacaaagaaaattttcttgggaggagacagtggctatgatagccattttaaaacaataggagctgagtatggtccgtttgactatgcaattcttgagaacgggcagtatggagaagcatggaagtatatccatacattaccggaagatgttatccaggccggtattgatctcaaagcagaacgcattattcctgttcattctgcaaaatttgcactggcacttcatccatggaatgaacctttacagaagttaactgctctcggaaaagaaaaaaagataaatatcctcactccgatgataggcgaggtagttgatctgaatcattcaggacagcaatttaccacctggtgggaaaactgatcaggcatgccagatttctttatatcttgcagggtgattttcaaactgctgtcttacaaaatcacattccgggtctacaagcaaatctttttcttctgcatagcgtaccaattcatccagcaatagtttggcgtatccttttccctcacgctcttcatcaagcttcgtataatatacaataagcagtcttccgtcaacctctatggacatataacctgcttttttatcatcaataaacagctgcaattcatcctgatatggagatacctgaaactttatattttccataataaataagatttggttgattaataattgaagaatacttttgaaaaaacattcttttcattaaaattacgaaattaaatcatatggaataattgtttttaagaatcttaacgaattttataacataaatgataagataaaagataaaagataaaagataaaagataaaagatgtttattgctataattcaataggggtgggctttagccaaaaattaaaataaatacattttataaagcttaagttttcattgataatttattgattattaatacgatcgatgtttaataaaaacctattacaatgccattacaattttaaaacaattaacattcaataattctaaaaaaataaaatatattttaaagataatcaactgtttatggtttttcttaacaaatattagtatttgtggttaaaaattggcactttaattgactatctcttcatgattaaccttaaagtggagtgaaatgaaaaaattaatattaacagcattattggttgggacgttcagtttaagctatgcccaatccgattattataatgattacagaaggagtatttcagatgtcaactggcaaagagtgatcactgatcttgtactttcaacaacacaggccaatcagatctatgtgttgaatgacagatatcgtgattatgattcgtggaacagggtttatgtagtagagccgggaagatggagaaatgaccgttattccgaactggaaagaatcctcggtagagaaaagtatattatcttcaaaaagaaatattacagaggacaaaatcctgtcatagtgtacggaagaaacaaaaatgattataaaaagttccgtaaagaacaggaaaaatactataaaaatcaggagaagtactataagaaacaaaacaaacatcgtggtcatggacacgatgacgattgggattaacaattatcaactatattcacttacatggctggcatctttgtcagccatttttatgtccggtcagaaatatttttacctttaatttgtttgaattttataattttgatatatggaaacacacgaatcacttaaggacttttatgaaagaaatgctcccaacctggaatcatcatgtatcggaatcagtaaaatgggacatttcaatgtattttcccgggaacactgctcactactgactccttacagcaggagatattattacaagatttcactgattataggaaaaggaaaacttcattatgccgataaatggattaaagtggaccgccctgctttattgttttccaatcctaatattccttattcatgggaggctgatgatgccaatcagaaaggctggttctgtctgtttacagatcagtttctgcataatggaagccggatgggtaatcttctggattctccgctttttaaaattggaggaactccgattttctttgttgaccaagaacagcagaaaacactttcggatatgtatacaaaaatgatgactgaaattcagtcggaatatattcataaatacgatatgctgagagcgtatcttcatctgatgatccatgaaaccatcagaatgcagccggcagaaagttttgagccttatcagaatgcctcacaaagagtagcatcattgtttatggaattgctggaaagacaatttccgattgacagtcctgctgcctgtttaaagttaaaaacgcccaatgattatgcgcagagcctttccatacatgtgaattcattaaaccgctctgtaaaagagattacagggaaaacaaccagccagcagatcaccgcaaagattattcaggaagcccaagctttgctaacccatacagactggaacatctctgaaatagcttacggtctgggcttcgaagagcctgcttactttaccaattattttaaaaaacaaacaggaattaccccaaatgctttaagaatgaaccttgtttgaattttataattcttggtttgaattctatataacagttgatctttccatattctaattttgtcttgtaaaattaaatcatacctatcatgaaatttaaaaaattaggaaacacagaagaacagttatcagcaatcggtttaggatgcatggggatgagttttgcttatggtcctaccgacgagcaggaaagtatcaataccttacacagagcgttggatttgggcgttaacttttgggatacagcagagatgtatgccaatggagaaaacgaaaaactgatctctaaggttttggttccgaacagagataaaatttttattgctaccaaattcggattcagatttaaagatggtaaagcaagccacagcggagctccgggaacttatttcgatggttctccggaatggatcagacaggccgtagatttaagccttcaaagattaaaaatcgatactattgacttatattacgcccatagagtagatccaaatgttcctgtagaagaaacagtaggagcaatggcagaattggtaaaagcaggaaaagtcaaatatctcggattgtcagaagcttcggcagaatctatcagaaaagccaataaaatccacccgattgcagctttacagtctgaatattccattttaaccaaagatattgaaaaagaaattctgccaaccatcagagaacttgggatttctctggtcccttattcaccgctggcaagagggctattcaccaatatctatgatgcacaaaatctgggtgatgacgatttcagaaaatcattaccgcgttatcagaaggaatatcttgaaaataacacaaagctggctaacgaaatcaaccaatttgcagcttctaaaggagtgaaaggaacccagcttgcgctagcttgggtactgaaccagggagatgatatcattccgattccggggacaaagcgaatcaaatacctggaagaaaatattgcagctgtcaatatagaactttcccagtcggatctggataccatagatgccatcctgaaaaaatatcctaatgtaggagaacgatacaatgaaggttctatgaaattggtaaacaactaaaaactattttagataaaaactgagtttcttcttatgaaagaagctcagtttttacatttatatttaaatgaaaagaacccgactatgaacagaagagaattattaaagaacggattattggcaggaacattaagtatgattcctttttccgggttaatggcagaacagagatccattccggaaaaaacaggggatgatctttccggatttaaaaaactgaagcttggtgagcttgaactatttattctcacagacggatatattcatgaagaaaacctgaattcatttgcgccaagaggcaccgtttcagaattaaaatcaattcttagagataatttcagaccagagaattatattgatcttgccatgaatattctattggttaaaacaaagaataagctcattctactagataccggaatgggaatttttgctgatgaaagaacaggatttctgttaaaaagccttcagaaagctggttttactcccaaagatattaccgacgtttttatttcacatgcccatcccgatcatattgggggagtgatagataaaaagaatcagcttatttttcctgatgcaaatattttcatctccaaaacagaacatgacttctggatgcaggcttccatgaaagacttcaacaacagtgctctgaaaacacaacctgaattccttaatcaatttatcccggccgtccggaatattctgaaaacgattaagcccaaactgaagttttatgattttaataatcccttgtatgattattttaattttcaattagcacctggtcacaccccaggtttagcggttacaaccatctcatctggaaatgaaaaactgatctatatcgcagatctgattcattccgatgtagtcctttttctgcatcctgaatggggatattttggtgatacggatcttgatatcgcgattgcatcaagaaaaaaactgctgaaacaaatggcagataccaggatcagagcatttgcttaccacttgccatggccaggtttgggttacacaaaagaaaaggctgctggttttgaatggttcccggagagttttatgagttaggtaacaggtagcaggtgatagcggtagagattaaggatatggggttgttgtcacttaatcagtgaacaggtacttagcattcccctcccttggaggggtggcaaaaattcaaacaatttttgacggggtggttaatataaacgggttactatacaagatatttcaatcaataacagaggactttagttcgctttcaggaacagtaatcatccatccggtttcagccagaacttattgatccaaactttaatgatataaaacaacagtacctcccgggaaacgggaggtgctgttttgaacataagaaaaatttaaattatgcttctccaaataccagctcaggagaatacagtttcctaaacatcagataagtcatcgtaagtacggaaaaagcaactattgcatccaccgtagccggaaaaccaagcacggcaatttttgaaaagaaagcaaagagaatatcaaagaacattccggcaaatacccattctttcagcctcaataatctgttgggaagcagaagaacgagaactcctgaaattttaaaaacacccagtatatagataaaatgaggtggatagcctaactgttgtgtgatgtcccatactacagaattttttgtaagttcaaagaacccgctggctccaaaccatagtgacataaaaatagctccggcccaatagatgatttttgtagtttttgttttcattgctgtatattttagttgttattatgtattagaaattatttaaaagatgtttttgctgatcccgagatttctccggttttgatattctgaataaaagctatcacttcccatttttcaggagaaaaaccttcaggaattctgaatgttgttgttccttcctgcttattcagtgagacgtggttctgtttatgaacaatttgccagtgatgcagatgacgcccttcgttttcacccttaccaacctgggtagaggaatgtttttcaacaagattaacgagaagtacactatgagaatctgaggctgaagttttatattgaacatcaatcgtactgctggaaatatttgccgatagtgccacatctgtttttttagaaacaagcagagctttctgaatggaatttttaatattattctcatcagagcctacaaattccgtttttccattaattatcagctgtggagtatacacctgtgaattcaaaatacggctgtactgctgttggcgctgcgaattttctgcagtactgaaccggtctttccatccaagacgattccagtaatcaacgtggtaagagagaagataaacaggctctcctttatattctttttcaatttttcccatgagttcatctgcaggtggacagcttgaacagccttctgaagtaaaaagttccaaaacagcgaaaccattggtttcagaggctggatgttgtactgtcttttgatctttattttgatgaataaatgctgaagtagcaaataacactgcggtaaaagcgcttactgtgattaagttttttagtatcatgtcttttaatttgattcaaaagtagatacttgataaaggcaaaagaatacaaaacaggttcaaccggacaaatcaaaaggtgaacccggaaattgtgaggggaggatatttgggctgggagaaggaagttggaagcgggaagtttctggagtaccaagagaagaaagtttgtcttttaaatattaaatagaagcaggaaagagcttaagaaattaaaacagatcagataaaagcaaaagaaaaccccaatcatatcaatcagggtcataatgtatctcaaaagagttctatatcttagaatgactgcaagtacttccagctcccatcttcagacttccttactcctaaaatattttaaggctggaagctggaagtgagaagctggaagtttttggtgtttgaaaaggaatagtattttatttttttatataaacaacaaagttcaagaactaagacagataaataaagcaaaagaaaaccccgatcatatcagtcagggttataatgtatttcagaagaactctatatcttagaatggctgcaagtacttccatctcccagcttcagacttccttactcctttacctgtcctcaagccacgtaaaaaaactatgcgttttttctttattgatcaaaagcttttcaggcgtttcaacagtaagttttacaaggattttacgttggaaataatgttccatttccttaatggctttgaaattaacaagatactgtctgtttaccctgaaaaattgcttgtctgaaacctgttccgctacctgcccaagcggctgggaaaggggaaactgttctttggcaaatgtcaccagatgcgtgatttcattgtggatataaaagtaggcaatatcttcagtaggtatggtggtatatttttgatttttaaaaaccaggaaactactcttaccggcagcagcaggctggctgattttttgtatcagtgattccaggtccggaagttcatttttctggaagaattttttcagttcatccacttttctcagtgcttcagcaatatcttcttttgaaaaaggttttaaaacatagtcaactcctttacttttaaaggcatccagcatgtactggtcaaaagctgtacagaaaactacagggcaggtgatctccaccgatttgaaaatctcaaaggaaagtccgtcagaaagatggatatccataaagataagatcaggtttgatatcttttaaaccttcaatacttgtttcaatactgtcgtaaacgccaaggattttcgaatccggttgtaagtctgagagtaaattctgcagggattttgcagccctgaattcatcttcaataatgattatattcatggattaatggtagttttatctggaaagttttttcatctgaatgaatgatgatatccttttccaataagtgtttgtaacgcattttaatattatcaagcccgactcccagcgaatcttctgcattcattttacgctggatgggattttcaatgacaatatggttatcgttgttatagattttaatatgcaaaggtttgctttgtgaaacaatattgtgcttgatgcagttctccaccagaagctgaagcgtgaaaggcggaataagggttgtattgatttctttttcaagttcgttggtgaacttaattccttccccaaaacgtgctttctgaagaaaaagataagcgtctactattttcatttcttcctgaacgctgatcagatccagttttctgctttccagcgtaaaccggtaaaaatctgaaagctttacaataaaatcaaccgtttcctcatcatgggtttcagccattaattttaaggtattcaaactgttgaaaagaaaatgcgggttgatctgctgttttaataattcatactgggctccaagattatcactctttaccttttccagctcaagttgtatctgctgtccggtataattgttctgaagcagcgtaagaaacatatagcataccagattgatcagaattccccttacttccaccatcagcatcaccggtccgaaattaatatgggaaagaatcagctgctggatccatgccagtccaaacatgatcaccatcccgaaagccagtaccaccatcaatctggaataggagatatgctgcctgcgttttcctgtacggttcagcatatagatattgatataccacatgataacggaaaaagccgctgtaatccccgagtttacggctgcctctttccagttgaactcatgagaggccagctgaggtacagatgataaaatacccaggaaaacagagcttatccagataatggctggtgagatttttattttttgctgttgcatgaaatctgctgatttgaaatggttaaattaatgctttttatttaaaatattatgataaatagtaaagcgggcgatttttattaaggcctgcttagggggcggtaactcatgaaatactgtattctttcttccttatttgagaaagtattcttaggctgatcatttttaagatcataagagatatttccggcattgtctgcctgaacggtttcgatacttaccagttctccagtgatagttccaccgatatattggggattgtcgtggtatttccaggtaaccagtttcataacagcacctgcttctggtgtccggcttttctttgacaaagatttcagtgctttttcgtttccatatagagccgacatagtttctttcttgggatttaaagaattggagatcaatttgagagaacccgcatcaaaaacaactctaacaagtccgttatttaaatcattattttctttgctgcacgcggtaagggaaataaggcttacccataaaatcaggattgtatttttcattttttctgtaaattttgaattagtctttgcgtatttactttcatcggaacatcaaacaggtaacctgttttttctgctaattgtctgtggcaggcaatgcaggattctttggcaaaagatgctgtttttcccgttgggtgaaggtcatttcccgagaattttgcaaatccccagccttccgtatctttatattgtctggaatcttttaccataaactgtgcattgataaattttccgggcctgatttctccatcaggaagctcttcctgtttccatacagattttacaacaacacttccttccggccatgggtgaaaattttctgtttccaccgcttttactgcgatatcatttccatagatcacacgaatggaatgatcaaacagtgtactcatactgatcactttccagtttttaaaatcaggtgtgtattgaactccattgggagaaacaggaaattttgttgatgctggaataggtacactagatgagacttgtggggtttcaatctttttctgagcagatgtacttactgaagataaagaaagcgtatattttttaatggtttcaatatctttctctgtaatcttagctgaaggatgcagaagagtatattcatggagaggcattttaccactttgcatcatattgagaatagcatacatttttccctgatgttctgcaggagataatttttcccattctgagaagttcaggacttctctggctcttctgatatctttgtttacagcccaggaaacaggagcaagcttatcataccagcttagattctgctgattggaatgacagttgaaacatgagttttcaagaatactgatcacttcctttggggcttctatttttcctgtaaccggctttccttccagtggtttactgaatagctgaagtcctccgaagattcctaatattgccagaaatacgatagcaatgggatttctctttttctttgcggtatccataatgtgtattgtttttattttctgattcaaaagtaggcgtgtaatacatgttgtgaaacggaaaacaaactgagttggacaaatcaaaaggtgaatcctgaatttttaactccgaaaatacacatgaaaaatcccggtaacacaattaccgggatttgcttaaatctgtttattataaagtcataccgccatctatcacaatttcggtgccggtaacatagcttgaaatctgatcatctgataaataggtcacaagttttgcgacttcttcagcagttcctgttttcttcaacggaatctgttctatgagatggttttgaatatttttcaaagtctcttcatccaaccccgccttactcataatttctgtttttataggaccggggctgatcatattcacccttatttttcttggagctaattctgcagctgctgttttcgcaatagaattcagtgctgccttacttgcctgataggcggagctgttaggtttataggtagaagcgacaatagaagataaaaagatgaccgaagcaccatcatttaataatggaatgaatttgcttaatgtaaagtaagctcctctgaaattaatattcatcacctgatcaaaattttcgacatccatgctttcaatcggagtcaatgtacctgtaattcccgcattgataaacagtatatctattttcccgaattgcgtttcaatttcttcttttaaaagatcaatatcactaaggtttgcctgatctgcgataaatggaatggcaccaagttcctgagccgctttttctacagcctctttgcgtcttccggtgataatgacagttgctccttctgaaataagttcttttgctgcagagaatccgatcccgctgtttcctcctgttacgacagccagtttgttactgaattttttcattgtaaattttttgtcaaagttattttaaaatggtatacttttgtaaccagtatcacagagtatatcagtatcattcatgatatcacttaactttgcaactatggaaagaaaccaaaatgaagaactaagagcgttacaggataccctttattttatcggcggaaaatggagaattcctgtgattaattctatctgtaacggaaacagacgcttcagggaaattgaacgcagtattcccggaattaccaccagaatgctttctaaagaactgaaagatatggaactgaacaaactggtaaaacgtaccgtttacccggaaactcctgttttaatagaatatgagcctacagaatactgccgaacatttggaaatattatccaggaaatgatcaattggggtagggagcataggagagtaattgtggaagataggtaaggtggcagatgttagattgcaggaattagaattagggatgcgtcgatcttgatgagtatatatgtactcactattcccctcctctggaggggggcaaaaattttttgaatttttgacggggtggttgtaccgatattttttaacggggtggttacaaaaaaagctccttaaaaaaggagctttcatttatatcaaaacgaacaattaaattccgtcaatgatttcatttaaaacagtgctaggtctcatggctgcatacgttttatatgtatcagttttgtagtaaccttcaatgttctgaggtttaccctgagcaccaattaattcagcattgattacttcttcgttttcctgcattgcctgtgccaccggagcaaactgggcagccagttcagcatcagcagtctggttagctaaggcttcagcccaatacattgctaaatagaagtgagaacctctgttatcaatttgacctacttttcttgcaggagatttgtctgtcgctaagaatttagcatttgcttcatccaatgcatcagctaaaacctgagattttgtattcccctgagtctgtgccaaatgctctaaagaagcctgaagtgctaagaattcacccagagaatcccatcttaggtatccttcttctaagaactgttcaacgtgttttggagcagaacctccggcacctgtttcgaataaacctccaccattcatcaacggaacaatagaaagcattttagcagaagtaccaagctcaaggattgggaaaaggtctgttaaataatctctcaatacgtttcctgaaacggaaatggtatctttaccttctcttgctctcttcaatgtttcagtcatggcatcttttacatcaagaattctgatatcaagacctgttgtatcgtaatctgcaaggtatttttctacttttttgatgatttctctgtcgtgagctcttcctttgtctaaccagaagatagcaggagtatcagataatcttgatctgttaaccgctaattttacccagtcctggataggagcatctttagtctggcacattctgaagatatcatctttttctactttctgagaaagaagaacgtttccggcttcgtcctgaacttctacagttccgtcagcagataattggaaagtcttatcatgagaaccgtattcttcagctttctgagccattaaacctacgttcggaacagatcccattgtggtagggtccagttttccgtgtgctttcatatcatcaattacagactgatagaaacctgcataagaacggtctggaatgatacaaactgtatcctcctcatttccgtctttgttccacattttacctccgcctcttacaagagcagccatagaggcatcaacgatgatatcagaaggtacgtggaagttggtaattcctttgtcagagtttaccattgccactcttggtccttcagccagcgctttttcgatatcagctttaatgtcagcttcctgagcatttcctttgattttttcgaaaagatcggcaagaccgttatttggattgatgtctaaagacttgaaagtctcagcatatttagtaaatacatttttgaagaaagtctcaacaatagccccgaaaataatcgggtcagagattttcatcatagtagctttaaggtgagcagaaagaagaacgtttcttttcttagcttcctcgatagcctcctgaacaaatgcttttaaagcttttaagttcattacagaagaatcaattacctcaccagcctgaagacctgcaaagtcttttaatacagattcagaaccgtcatttcctttgaatacgattctgtattttgtagcgttttctactgttgtagaagtttctgtaccgtagaaatcaccattgttcatgtgagctacgtcagttttgctgtcagatgcccagtcacccattctgtgagggtttgctttagcatagtttttaacagctttcggagcacgtctgtcagagtttccttctcttaatacagggtttacagcacttcccaatactttggcatatttagctttgatcgctttttcttcgtcatttttaggctctgcaggatagtttggaactgcgaaacctttaccttgtaattcagcgattgctgcatccaattgaggcacagaagcagaaatgttaggtaatttaatgatgttggcttcaggttttgttgccagttctccaagttctgccaaagcatcaccgattttctggtcgtctttcaaaaactcagggaagttggccaggattcttcctgccaaagaaatgtccggtactgcgatttcgatatctgctgattttgtgaaagcttttacgataggtaaaaacgagtgagtagccagcattggagcttcatcagtaagtgtgtaatagatttttgatttttctgacattatactgttattttttatttgaaattttaagtcccacaaatttagtaaatatcattgttttatttgggatatttccataaaaaaagaggctatacctctttaattttacattggtgtaattgtatggcttataaaccaatttctgtttgaaaaatgatcattggataaaagaaaaggtattttgactttaagattaatttaaccttaataaaacaggaaaaattttcttttttgattacatttgaagaactaaaaaataaatattatgtcaacgacaattactttaaaaggaaacgaagtacacacaataggaacattaccagctgtaggaaccactgtaaaagattttgcactggtagactcaggattaaatgtaaaaacccttgaaacttttgcaggaaagaaaaaagtattcaatattttcccgagcattgatactcctacctgtgctgcttcttccagaaaattcaatgaagaagcttcaaaacttgataatacagtgatcatcaatgtttcaaaagaccttccgttcgcattgggaagattctgtgcagcagaaggattgaataatgtagaaacactttccgatttcagaagcagcttcggagatgattatgaagtaaccattgcagactctcctatgaagggattgttaagccgtgcagtgattgttacagatgaaaacaacaaagtagtatatacggagcaggttccggaaattgccaacgaacctaattacgatgcagctcttgcagcattgaaataataaaaataatttttgtagaaaagccttgtgaatttaatttttacaaggctttttttgaacaaataaaacagcgcaaaaatggtaaaaagaattgtagccaatattaaaacagatgatctttctaaagcagaacaattttatcaggacattcttgagttggatattctgatggatcacggttggattaaaacactgggaaatgatgaagaggcaaaggttcagatcagctttgcagaacagggcggaaatggtactgaagttccggacctttcaattgaagtggataatgtggatgaaatctatgataaaatgaaaaaagccggctttgaaatcatttacggacttactgatgaagaatggggagtccgcaggtttttcgttaaagatccttttcaaaagctgatcaatattctgtctcaccaataaaaaagtatcatgaaagcagatcgcatcattcctgtcttaagaatctttgattatcagaaggccaaagaattttatgtagactggctgggcttcgagattgtctgggagcactattttgacgaaaatactcccgtttatatggaagtaaaaagagaaaatattattctccatctgagcgaacatcatggagacggaacacccggaacaagagttgccgtctggggggaaggggttcctcaatatcataaagagttaattgacaaaaagtataaatataaccgtcccggactggaaaaaacattctatggcgctgtatccttcaccgtaattgatcctttcgggaataaaattacatttgaagaagaatatgatgaagcaaaacataaagaccttgaatttttctctattcattaatttcaaagcagaataaatcttaccgaatgttgattacagtcaataaaaatccggaatattaaagctaattttgtagaatgaaacgttcaggaaccgcagatttaccccttcactatggcaaagtaccgccatggttgtatgagcgtatgtctgtgctggggctttccattattgaagtaattctcatggattatggtaaagatgaggtattgcgcaggctggcagatccgttctggtttcagagttttggagctgtaatgggaatggactggcattcttcaggaattaccacttccgtaatgggagcattgaaacgttctattaatcccaattcacaatctttggggctttatatctgtggcggaaaaggaaagttttcgagagaaacaccatcggaactgattaaaattgcagataaaaccggattgaatggaacagacctggtaagagccagcaaactttctgcaaaagtagataatacggccatccaggatggttaccaattgtatctgcacaatttcattctctcagataatggaaactggagtgttatccagcagggaatgcatgaatcggacggaacagcaagacggtatcactggcattccgaaaatcttacctcatttgtggaaaatcctcatacgggaatcaacggaatttcaagaggaagaatactgaatcttaccgatgcagaagcttcagaaaacagaaaaggaatcctggatatttcccataccgattcaacagaagtaatgaaagattttgcaagattgattcttcctgcccaccatgatgttcaggcttccgatgtagacctgaagcgtttgggagcacttctgtatgtaacccgtgagcaacagccgcagaattttgaagacttactgatgctggaaggtgtaggtcccagaaccatgcagtcattggctctggtaagtgaagtgattcacggggcgccgtcaagatttgcagatcccgcaagattttcctttgctcatggaggtaaagacggacatcctttccctgttcccatcaatacttatgatgaaagtatcagcattatcaggaaagggattgaaaaatccagactgggaaattctgataaactgaattccttaaataagctgcatcagatcgtaaccaaggcagaaaaagacttcaccccggattttgacattcagcaggtgattgaagaagaaagacagaattcctggcgttttggcgggaaaacggtattcggtgatgcagagaaacccaaccctcccaaacccatacagctttccctgttttaaaaaaatatttcctgtaaaagcttacaattactgtatcggcagatagtcattcccatcctccggaggagtggcgaaaattcaaagaatttttgacaggatggttaaaatagtttgttttttaaatgcctgtttaaaaaatattagccttataaatatcttttatttcagtttgatatctgcttttttataaaagctttatattctttgtttaatattttttctttttaattcaattaaaaattttatttttaaagacttaaaaaaattgacaccaaatgaccaataaagccttagaaatctgctatgattttcccttctttttccgtgaagaacttgacgaaatatttaaggctcatgaaaaaacatcttttcagaaaggagatttcatcctggaagaaggaaaaacagccaatgaatactatatccttgagagcggacttgcccgttcgtatgtcaatgacttcaacggaaatgaagtaaccacccatttttttacggagaatgaagtgattattgaggttttatccatgtttcaaagaataccttctcaggaaaatatcgtttgtattacagactgtgaatgctggaagctggattatgatacctttcaggaacttttccataaaattccaaacctcagagagtggggaagatcatggatgtcccaggaactttttgcctacaaacaaagatctgtggaaatgtttaccctttctgcaaccaaaagataccttaatcttctggagcagaaatccaaagtcatccagtttgctcctttaaaacagattgcctcttatcttggagttacagacacctctctgagccgtatccgtaaagaaatcgtttcccatcccaagaaaatttaaatcttgccctatgacaagttgattttcattgcaccttggtaattttggataacagtttaacactaaaattacagaaaatgaaagtcaatcagatttatgtgaaccttccggtaaaagatgtacagaaaacaaaagaattctggaccagggtaggtttttcaattaatgaacagttcttggacgagaaggcagcctgtgttgctttgaatgataccatctatgttatgtttctgcaggaagattatttcatgtctttcactaataagcccgttgccaaagaaaataccagtcaggttcttgtggcagtaggattaaacagtcgtgaagaagtagataaagtagtgaatacagccgtagaaaacggagcgtggcagcatgaggaacctcaggattacggttggatgtatcagaattccttctgggatccggacgggcacggctggaatatcacttttgctgatctgtctaagatgccaacagcataattcaacccggatacaaaataaatattgccctatggcaagcactttcctagtatatcctgataattttgaagcataatcaccactaaatttataaaaatgaaaatcaatgaaatatacgtcaacttaccgataaaagacgttcaaaaaaccagggagttctggacgaagctgggcttttctatcaatgagcagttttcagatgagaaggcaatttgcgtaatcatgaaagaaaatcacatttatgcaatgtttctcaaagaagagttcttccagacctttaccaacaggccttttgcgaaaggtgatacaacacaggtacttcttgccataggagtcaatagccgtgatgaagtggataacatggtaaaaacagcaatagaaaacggaggttcaaaatacagcgagcctatggaccacggatggatgtaccaaagcagttttgcagaccttaacggccatcagtgggaagtaatgcatgcagatgtttctcaattaccttccgaataattgctgtcttccaactatcaaataacagtcacatggaaacacaatcaaacgatatagaaatcataaaaaatcaggtagtcagtaactattacgtgatgactatgaatatggacggcattacccatgaagaatcgatgatttttcccaatggtgaagccaattgtatgaactggattcttggacatctgatctacatcagaaatcctttactgaatattttaggagaagattctgtgtgggataatgaaaaattttctttctataacagaggcgaaattgctttgaatcacaaagataaattgatcagtttcgaagaattaaaatcttatttaaaacaatctcaggacaaactggaagcaaaactcaacacgcttgaaggttttaaacctgaaacggttaaagatatctcaacccttagcctccatgaaatttaccacagtgggcagttgggctatctcagacgaattttaggaaaaccaggcgcaataaaatagatttcttgctctgctcggaataaaataaacagcattaaaatattcattaaagagcaaaattttatcgaagataaaatctttgcgccctaaaaacgcaaagtttttacaatacttagcgcctttgtgtttatcccaaattctaacctctaatttctagcttctaatctctaatatcaaattaaaatggacactccaaaatcaaaaaaaatagaagtcattattccggcttacagaatgcattcccaaagctttatgaatgttttggacggcatttcggaagaagacgctttgaaaagaattgaaaataaaaccaaccatattgtatggatggcaggaaactttatcaatatgcgctacggtttgggcgctctattgggaattcaggaacaggatccttataatgacctgtttttccagggaaaagcactcgatgaaagttttaaatatccgactttggctgaattgaaggagaatttccatgccatttctcctaagatataccagaagctgcatgaggtaaccgacgaagaacttgacgaaatatttgagataggaatgaatatccctttcatcaaagaaacaaagctcaactttgcaggcatgtgcatcggtcgtgaagattacttatgcggacagataggcttaatgcgcaggatattaaattatccgggaatgaaatatgatgttgacgaaaaccttacatattagcgatgaatccagtagaaaaaggatataagaaggttaacggaatccagttatattacgaaatctatgggtcaggaaaacctcttgttctgattcatggcggaggatcttccattttgtatgattttaaagaagttattgccagactggaaggcaaattccagctgataggaatcgatttacaaaatcacgggagaagcgagcatcgctatattcctgaaacctttgagcaggatgctgacgatgttgcaggacttctggcagaactgaacattgctaaggcgtcattctggggattcagcaacggaggaagtaccgtaatgcagattgcccaccgccatccgggaatcgttgaaaaactggttgttgcctcagctttctacaaaagaagcggaatgatagacggtttttttgaaggaatgcaggaagccacctttgactcaatgccggaacctcttaaaattaattttttaagcctcaatcctgatttttcaaagcttgaaaacctttttgagaaagactgtacaagaatgcagacttttcaggactggaatgatgaggtcttgtcttccatacaatcacccacattattcatcagtggtgatcaggatgtcatgaaaccggaacatgctgccgaaatgtggcggctggttaaaggttcccgactgatgatacttcctgcaacgcacggtgtttatatgatgccggattttgacggaagtattgataccaacttaatagactttaccgtaagagaggtagaaaaatttttaaaccattaagcattttatattcatattaacttaattaattcttaatggatcaacagtagaacctattttttataattataactttaaaattaaaaatcatggctaaattaaatccgtatctgaattttgatggaacagctgaagaagcgttcaatttttacaaaactgttttcggtggcgaattcgtcgggggaattcacaaaatgggaaatgctcccggtaccgaaaatctttcagaagaagaaaaaaacagagtgatgcatattgccctgcctgttggaaatgatcttttaatggcatctgatattgtacctggatttgggcagactcttactgtgggaaacaacaattacgtatctattttccccgattccaaaagtgaagccgacagaatttttaaagaactttctgaaggcggaaatgtggaaatgcccattgaagatcagttttggggagactatttcggatgcttccaggacaaatatggtgttcattggatggtgaactataatgaagaatacgcaaaatagtactatatttaactcattataaaagaggtgcccgctttatgggcagctctttgtttaaactttaaaaaatcagaactatggatccaattaaaatagacattacaattttagcaccggttgaaaaggtttggacttactttaatgaacccaaacatatcacgaaatggaatttcgcccacgaaagctggcactgtcctagttctgaaaataatcttgaggtgggaggtaaattcagaaacagaatggaggctaaagataaaagcttcggatttgattttgaaggtgtatatgatgaaattatacctcaccaggtgatcaaatatcatatggaagacggccggaatgtggaagttattttcgataaaatagatgacaatacaacgaaagtgattgaaattttcgatccggaaaaacaaaattctgtggaaatgcagagagatggctggtatgctatcttgaataatttccacaagtatgttgagaatcattaacaatattttttgtagccatgatcaatttagttatcatgtcaaagagtttaaattcaatgtatgcttttaattatgactccaaagaagaatttcttcacggggttatagcaataccggcaagaaaggctctggaaaaagaaaaaataaattctttggaaaaactgtcagattattccgaaaaagaaatcatgcagcttcatggtttcggaaaaaatacgatgcttaaactgaagaattatatgaaagagcatcaggtgtgttttaaagaggcataataagtattcaacctggcatttctaaggtgtcattgcagataagaaattactttcagatgcaaagacatcatatttctttgctgttatttatggtaaaatttttcacagcattttattcgttatgaaaaggaatgatccataagacaaaaataaaaatacatatgtcaacccatttaaatataaagttatgaacaacgatattttcccatgcctctggtatgacggagacgccaaacaatctgcagaattctactgtaatgtttttggaggagagatcacagcagatactcctgttgtaatgaacattgacctgttcggacaaagactgatgctgttgaatggtggtccgcaatttaaaaaaaatccttccatctcttttatggtaatctgtgagacggaagacgaggttcaaaaatactgggacaggttattggatggaggaatagccctcatggaactggggtcttactcatggagtccgaaatacggatgggttcaggataaatacggagtaacatggcagttattcctgggagaaaaagcaagcgaccagaaaataattcctactttgatgtttatccatgcaaacaatggaaaagctaaagaagcgatggagctttatacgaagacatttcccaactcaaacataggaaacatattaacgtatggagcaggaagtgaaggacatgacattccggaacctgcagaaaatgttcagcatgctcattttgtcattgataactacaacttattctgcatggataattcctatgatcatccgtttgatttcaatgaaggaatatcattggtggtgatgacagataaccagcagcaaaccgatcattactggaatacactgacggcggacggaggaagagaaagcatgtgcggatggctgaaagataaatatggcctgagctggcagattgtccctaaaaaacttattcagctgatgaacgattccgatcaggaaaaagcctacaaagtagttcaggccatgatgaaaatgcagaaaatcatcattcaggatctggaagatgcctataactcttaattatttcggcgtattgtttgatgtggtttagagaaaaagatttgcatatgaaaacacagaacaaatcagactctaagtcaaaggtccctgaagaagggctgtttccggaaattatccggaatgattatcagggaagccggaagctgcaagggaaaaaagcagtgatttccgggggagacagtggcataggacaggccgtagccgttcattttgccagagaaggagcagatgttgccattatctataaagaaagtgacgacgatgccagagaaactcagaaactggtggaaaaagaagggcagaagtgtatcctgatcaaaggagatcttaccaggaaaacattcagaacaaagtgtgcagacaaaattaaagcagagtggaagagccttgatattctggtcaacaatgccggaatacatacctcaaaaaccagtctggaaaagatttctgatgagcagattcaggaaacgtttgagaccaatatcatttccatgatttcattcaccagaaattttcttccattgataggaaaaggaggacgtatcatctgtacaacctctgtcacagcatatcggggaagtgatcatctgatagattacgcggcaacaaaaggagctgttttatcttttatccggtctctggcagataacctcgcagaaaaagaaattctggtgaacggaattgcacccggacctatctggaccccgctggtgaaagaagcttttgatgaccttgactcatttggaaaagatactccgctgaaacgtgcgggacagccttctgaagtagcaccagcttatgtttttcttgcttcaaaagatgcaagttatatcaccggggaaatcattcatattaacggcggtgattttgtcggaggataaatgagaagccgaaggccggaagttagaagttagaagttagaagttagaagtgattgatcagtaatttctctcaccctcaaactctcagactttcatactctcaaaccctccaacccattacccaccaattaacacttaaaaaatggaaaaattatcatacgaaatagaaatcaatgccgaacctgaaaaagtatggagtgtcctctggggtgatattacctacaggcaatggacatcggcttttacggacggctctttttatgaaggaacgttggaagaaaataatattgttaaatttcttgacccaaaaaacaacggaatgtacagcagggtagaaaaagtaattcctaacgaggaaataacatttctgcatctgggtgagatttacgatggtattgaagttcctcaggactggggtcaggctactgaagcttacttcctgaaggaaaacgaagaaggaactttgctgagggctgagattcagactcctgcagaatttaaagaattttttgaggagaaatttccaaaagccatgtcacttgtgaaacacctttcggaaaatcaactgtaggagccgcgaaataatacaaatcataaaaattaaaatatggaaactttatcatacgaaacagtaattgatgctcccatgcagaaagtctgggatattctctggagccctgaaacatatagcgaatggacccgttactttgcagaaggatccgtcatgaaatccgattggaaggtaggcggaaaaacctacttcgttaatgccagtggagaaggcatggtttctaccatagacagtcttgatgaaccgagacaggtagtattcaaacatctgggaatgatagataaggaaggacatgaagatatacatagcaaagaagtaatggagtggagcggcagctttgagaaatatttcctgatcgacttcgatgggaaaacaaaacttcatacagaggttcaggttgaaaaagaatggcaggatcatctcaatacaggatttacaaaagggctcatgattgtaaaaagccttgcagaaagagttagtcttgattcagtataatataattcaacgtttagagttcaaggtctcaagtttaaaactgatacctgagcctaatccctgtaacctgcaacctattatcaactatgaaactacttgtcatactttttggaacatgtattctggctttactggcaacttttctttttcaggggaaaccggattttatattttcgggaaacctgggaatggccgtttttatcatctttacaggcttttcacattttaaattccaaaaaggaatggcaatgatgatccctgattttattcccggaaaactgttttgggtctattttacaggggtattggaaattgcagcagggattggacttatgattccgtccatccgtgaaactacagctgttttactgatcattttttatgtattggtttttatcgccaacatcaattcatccaggagaaagatcaatatttttaaagcagattatacaggtcccgggatgaaatacctttattatcaaaggattcccatgcaggtcattttaattgcctggacgtggtatttcggaatttatttacactaaaaaagacattcaggaaaggctgtctttttttatattcataatgtttttttaattaagtgataaaaaattgtaacattttatagggataatgtgtcttattgtataaatgcacttgattttattattttaaaaaggtgctttcaataacttttaacccttaaaatataagttatgaatctactgaatcccaaaattttcggtacagcctatattgtactgtctactattatgatcaacgcacaaagttctactgccaaactgccgggagatcctactttgccatcttccaaagccaatcttgaaaagcttatttcttacgacaagggaaactttaaatacaaagttgaagattattttgcaagaccaaaagcttcagcatttaaaatctctcctgatggaaagtacctttcttataaagaaaaagatcaggataaaaaaaatcacgtctatgttaaagaccttggtaccgggaaaattaccaaagctattgttgaaaaagatgatctgataagaggttacggatggctgaacaaaaaacgtcttttctatacgcaggatagaggaggaaatgaaaatattcacctttacgctacagatatagatggaggcaatcagaaagatctgacaccgtttgacggtgtaaaagtacagtcgattattccgataaaggatacggatttcgttgtggttaccatgaataagaacaacaaacagatctttgaaccatttaaaatcaatttcgttaccggggaaatgacccaactgtatgaaaataaagatgtcaacagccctattgatgattacctttttgataaagacggaaatctgagaggatacagcgttcttgaaaacggattgacgacaaaaacctattataaagacctgcagaccggcaaattcaatctgatcaaatctgcagactggtctgataccttcagtattattgaatttaatgaaaattctaaaaataaagatgaagcgtatgtagtaaccaacctggatagcgataaagcgaggattgtactgtatgatcttaagaaaaatgttgtgattaaagaaatttattccaatccggtatatgatgtaagctcaataagtactgcaggtaaaaacaggaactatgagcttgattacatcagctatgaaggaaccaaaggagaaacggttccggtaagtaaattttataaggaaatacatgataaattaaaagctcagtttggagacaaagaatttggaattgtttcttctgatgataataatgataaacttctggttattgtaggaagtgataagctctatggaacttattatgaatatgataccaaaaccaggcaaaccaaacttctgtacaacctgatgccacagctgaaggaagaagatatggccgaaatgagacctatcgaatttaaaagcagagacggattgacaattcatggatatattacattacctaaagctgcgctggaaggtaaaaaagttcccttaattgtaaatcctcacggtggccctcagggaatcagagacagctggggattcaatccggaagcacagctgtttgcaagccgtggatatgcaacgcttcaggtgaacttcagaatttccggaggatacggaaaatcattccagaaagccgggtacaaacagatcggaagaaaagcaatggatgatgtggaagacggagtaaaatacgctattgaacagggatgggtagataaagataaagtagccatttacggaggaagccatggtggatatgcaacactgatgggattgattaaaaccccggatttatatgcttgtggagtagattatgtaggcgtatccaacatttttactttctttgattctttccctgaatactggaaaccttataaagaaatggtaaaacagatctggtatgaccttgataatcctgaagaagcaaaaatcgcgaaggaagtttccccggtttaccagattgataagatcaaaaagcctttatttgtagttcagggagctaatgatccaagggttaatatcaatgaatctgatcagattgtaaaagcgatgcgtgccaaaggatttgaagttccttatctggtaaaatatgatgaaggacacggatttggaaaagagccaaacaggattgaactttataagtcaatgttaggattctttgctgaaaattttaataagtaacctataattttataatgtttgaaacggaaggctcaggtcttccgtttcttttggttattatgactaggtgggtgtttagattcctacgcaatgacaagctgtatggataaactatcattacaattgtgtcattccgtaggaatctcaaatgacgtcagaaattgagaatggataaaaagatctttatcattcatcaattaccaattatcactcatcagcttagccccgatagaagcggttaccccggaacatgaataggagagtctgtgggcaggagtgtgggatggtctggcgtgaggagtatgagcggatagcgggaaaaagctcccttaaatataagtaatgagtaatgagtaatccggggataattgagaatataaaaaaccaacggataaaagaaaaactgaattgtaagaaaaatattttaaatttattaaagtaaaaccaaaaggctaaccgtcatatcagtatggaggttgtcgaaaaaataacaatgccacagaaggagaaagaaagcatcatctcacagaccgtttccaactacggagggaagctgatgtcctatattcgtcccaaagtgaaaaacacggaggatgcggaagatattctgcaggaagtgtggtatcagttcagtagccttacgaatctttctgagatcgtaaacgttggaggctggctgtacagggtgacggcaaataaaattaccgaccgttaccgtaaaaagaaaacagaaaatcttgaagatttcgtatatgaagacgaagacggcgagttctctatcaaagatatccttttgatggacgaaagcgcaggccctgaagtaaagatgtttcaggatgaaatctggaaaaaactgtttgaggcgcttgatgaacttcccgaaaaacaaaggctggtctacgtagaaaatgaactgaacgacaaaaccctccaggagatcgccgatgaacagggagaaaacatcaaaaccatcatcagcagaaaaaactatgctgtgaagcacttaagaaacagattgagaaaattatacgaagatttaaaaagttagaaaaagaaattatgaatcataaacacaaaaagggttggatttttttattgttatgcccgccattaattttagctgccgttacatggattgtaatgatgctttggaactgtcttcttcctgagattttaggagtgaaaacaattactttctggcaggcaatgggaatactgatcttaagcaaaattcttttcggaggttttcatttcggtaaaggaatgagagatttcaaggaaagaaaaatgagagaaaaaatggcaggtttgtctcctgaggaaagagagaaattcaaggaagtctggagaaacaaatgctccggaggattcttcaacagaaataacgaataatttaaaaatttgaaagaagtagtaaagtaaaattaaaattcattcgtctctataaaaaacaagaagtagtaaaatttaaaattttgaaaaaatgaaaaattcagcattaaaaggagctcttggagcactagccgttgtgggtgtagccttaattgctaaaaaagccgcacaaagaaaaagatttattaaaggtatttttgacgaatacggaatcaaagaaaaatcccctttcggactggcagataagatcagagaaatgaatgatgaggattatcaggaactgaaaggaaagttcaaaaaggaattcggttcaagatgctgcaaaaaggataatacctgcgaagcataatccataagaactaaattgaaattgtttaattccggcgcgggaagcaaagcttcccgcgccggaatttttttatttaaacagtttatataaacctttttaacactacatttgtattataaaagttcggttatcatgaagctcagggatatttatattgcattactgtctgttttctcaatcatcatctatggacagaattctcagcaaaaacattatattttctttctgcataataaatttctggaaggccattctttggaggagaagcatccaaaatacggggtggcagaatatgaagcaatacttcatcaactaaaggataacaatacggttgtgatttctgaaaaaagaaaagcagatacagatcctatagtgtatgcaggaaaggtgaaaaaacagattgacagtcttatgaaaaaaggaatccctgccggaaatattgcagtaataggaacttcccagggaggatatattgcacaatatgtttcttactatgagaagaatccgcaattaaaatttgtgattattggagccagttttaaagatgattctctggaaaaagataaaaatttcagattatatggaagaatactttccatcactgaaaaatctgatgacggccatattctgctgtcgcatgaacagaggttcatcaggtctcacattaaagattttaaggaaatagaacttaatacgggactgaatcatggtttccttttcaaagcacttaatgactggattgctccggctaaggattgggtttatcgtaaataattacggtcggtctatgacccttcggttcttatggttgaagttactacgaaatgatctgggtaatctgcgggaaatacctttaatatgaagttgagatttcttgctttgctcggaatgacaaattcgccgttgaaattgtatcggagataaaatccttgcgcttaaaaaaaatatacagattgttgtgaaaaactttgcggctttgcgtttttcaaccaatggattacgagctatattgagattgcttcaccttcggttcgcaatgactttctgattcatactttcaacaaaattttaccgtaaacatcaaacgcaaagaaaaataaatccttatttttgtattgctcaatgaaagattactattattttctcggtatatcacaggatgcttcagaagaagacgtcaaaaaagcttatcggaagttatctttaaaataccatccggataaaaatgataacgatgacttttttgctgaccgtttccgtgagattcaggaggcttatgagacattgagtgatccggcgagaagacgtacatatgaccagaatctggaaagccatcagcgaagtttcaggtataatattcctcctgcgatcaaaacgtttacagcgaataaaattcatgcgaaaaaaggagaggagattatcatcaactggcagacgaataatgccgatgtggtgaaggtattgcctttcgggttagaaaagccttatggagagaggatctttaagatcacagaatttaaagacggaaaattccagcttttgcttcatgcaacaaattctcttttgcacaaaacggttgttcagggaatcaccatcacggaagtttttgagaatgatgctgaaaagttcaaaaattcggtggaagaaatgtttaagccacaacctgcaaccagaattaacaaatccggccagcctaaaattatgatgctgatctggggaattattatccttgcgattgcaatctatatattgataaaaaacttcgactagcttaagccattttttttcttcccgggcattttttacatcttttacccttcttgaattttttgcaacatgatttcttttcacagaacatctcttcgttattgaaagagtaaggtgccaaaggcggaactttaaatgggactatcatattcatgatgcaaatatattaatttagaataaatataattaataaattttcataaaaaattgcaggcctgaaaattagacctgcaattggggctttatttaaatgaaaatgaagtcgaaaactgaagcctgaaagcatcacttctctttccttcaaaattttctgcacttgcgtaattgccttccatacccattctcaggtttctatagggatgataaataagattgattgctgcattctgaaaacgtttcataagactagtctcaattgcggagctggagccaacctgtgaataactgtaataaactgtcgagctccatttagaagaccaccaatgtccgtaaattcctaagatattgaacagacttagcatttctgctctatttttttgaggatcaaagacggcatcatagccttctccgcttaaaacaacattatttcttgccattccttttccgtatgaggcctgaaatctgaaatcatcaagatttgttatatgttttctgaatgaaatcatacctccaaatcctatcttggtatattcattttcctgattttcataattaacaggagagagcgtagcgccaattttagcataatctctggcatttccatagcgatacatgcccgttacaacaggaatcagacttttctttttccattccggatggttcttcggaatagtcatacttactttaccaggatcttccaatgaaaaggatagagcctctttatcagaaagtctttcagtataacgtagctgtatagatcgcagaagcatcgctccgttggctccgttaaaatcaaaaatattggggaaaatcctgatatctgtgaaattactccaggtttgcccaatcagccattttttccattgaagataaccatgccttaatcttggcgtagtagtcccgttaggtccgtaaaagtctatttctatataagcattaaccggagaatctccgtttttatctgtctgttttagccctagccctatctgtgattgtctcacactgaagtaacttgacattgaattttgttgtggaattataatagaaggagctacaattccgtctttagctccaaatttctgaaaatcaagcatagcgtctgcatgtataaatccttttaaataagcagaccatttcctgcctgaagaatctggttctgtattgacaagagttatttgtgcatgggctttagtctgaaataatattaaagtcatagtagtgaacgccggcataaaatgcctgctcaatctttttttcatcatttgtgttgttaataatggattatcttttatttactcacgtaaattgaatttatccgttaatatttaaagttacactgcttaggacagtttttgtgtttcattaatgtacttgatgcgaatgtacaaatgcttctggaaatggtgtaagtgaaaaatttaaggtttttaataggtttatagaagataaaagctaaaaaaaagaagcgaaaatgaaaggaatattctttaaaatttaatttttctaaaatagaattcattaaacggtgaaataataaattttattttttaacatttaaaaaagactttatgcctcaattttaagaatttttaagaaaatgaccgcctattttccatgttgtgaaatcgcttaaaaaatcgtaattttacgaatcttttttacaaacaaaatctaataaataaaaatgaatacagaacagtttgtgagccgtcacatttcccttaatgaagccgataaacaggcgatgttggaaaaacttggcgtttcaagtatcgaagagttaatttctcagacaatcccttcttcaatccgattagagaaagatcttgagatctcggaaccactttctgaataccaaatgttgaaccattcaaaagaattggcatctaaaaatacagattatacaagttatatcggatttggataccacaatacacttttgccttcagcaatccagagaaatatttttgaaaaccctagctggtatacggcttatactccgtatcaggcagaaattgcacagggaagactggaagctcttcttaatttccagactgtagtatgtgaccttacaggttttgcactggcaaacgcatctttattggatgaatctactgctgctgctgaagcgatgcacatgttcttcaataacaggtctaaagaccagaaaaaagcgggggctaacaagttctttgtttctgatcttgttcttcctcagactgtttctgtattaaaaacaaaaggtgaaggattagaaattgaaatcgtagttggagatcataaaacacatcagtttgatgattcttactatggtgttttattacaatatcctggtaaaaacggaatcgttttagattatactgaagatatcgtagaatataaaaaacttgaccttcaggtagcagtggcttgtgatcctcttgctttggttaagttaaagtctcctgccgaaatgggagctgactgtgcggtaggaactacacagagatttggtattccattaggatacggaggtcctcacgcagcgttctttgcttgtagagaagattataaaagagatatcccgggaagaatcattggtgtttctcaggacatgtatggaaaacgtgcattgagaatggcattacagacaagagagcagcacatcaaaagagagaaagcgacttcaaacatctgtacagctcaggttcttttggcggtaatggcagggatgtatgctgtttatcacggtccgaaaggattaaactatatcgctgatcagatccactttaaagcaaatgctttgaaaggaggtcttaaagcattaggatatcaggtagtagaagagccaatcttcgatacggtgaaaatcacgatgcctgaagaagagaaagccaaattagtaagactgatgctggatcacagacttaaccttaactatttcacagaaggtgttgtaagtattgcgatcaacgaaagtacaacattagagaaattaaactatctgatggcttctttcgctcagtttaaagacaagcagactttcaaattagaaatcaaagaaggatacagcattcctgaagaaaacttaagaaaagacgagattcttacggaagaagtattcaataaataccatacagaaacagaattgatgcgttatatcaagcgtcttgagagaaaagatttatcattaacacattcaatgatttctttaggatcttgtaccatgaaactgaacgcagccactcagatgttaccgctttcatgggaaaactggggagcagttcacccattcgtacctgtaaaccaggctgaaggataccaggaaatgatccgtgagttagagaaagacttggcagaaattacaggttttgcaggaacttctcttcagccaaactccggagctcagggagaatatgcaggattaatggtgatcagacaatatcatatctcaagaggtgatcaccacagaaatgtagtgttgattcctcagtctgcacacggaacaaacccggcttctgctgctatggcaggaatgaaaatcgtagttgtgaaaaaccttgaaaacggggaaatcgacttcgaagatcttaaagctaaaacggaacttcattcagcaaacttatcagctgtaatgattacttacccttcaacttacggtttctttgatgccaacattaaagaaattaccaaccttatccacgagcacggaggacaggtatatatggatggtgcgaacatgaatgctcaggtaggatttacaagtcctggaaacatcggagcggacgtttgccaccttaaccttcacaaaacttttgcaattcctcacggaggtggaggtcctggagtaggtcctatctgtgttgctaaacacttagtacctttccttccttccaacgcgaatatcagaatcggttccaaagaagcaatcgacggtatttctgcagcaccttacggttcaggattgatccttaacatttcttatgcttacatcaaaatgctaggaactgaaggtcttaaaaaggctacaggacatgctattcttaacgctaactatctgaaagaagtgttagcagaacatttcccgattttatattcaaacgaaaacggaagagtagctcacgaatgtatcgtagatttccgtcagttcaagtctttaggaattgaagtggcagatgtggcgaagagattaatggattatggtttccatgctcctaccgtttctttcccggttgctggtacattaatgattgagcctacagaatctgaaagcaaggctgaaatcgatcgttttgcagaagcattgatctctatcaaaaaagaaattgatgaaattgctaatggagaagcagatgcaacaaacaacgtattgaaaaatgctcctcacacagaacaactggttatttctgattcatgggataaaccatacagcagagaaaaggcagcttatccgttagagtgggtaagagaccacaaattcttcgcttctgtatcaagagtagatgaagcttacggagacagaaacctggtatgtacttgtgagccgattgaagcttatatgtaatctcagtttttaactataaaaaatccctttcagtaatgagagggatttttgtttttatagtcattgcgagcgcagcgaagcaatctctttaacgcaaaggtcacaatgatttttcgacaactaattgtttcaatgttcgcaaaggcgttccactcagcaaagcttaaacgatgtgtttttttggcaaattgcgagacttgtacggtcattgtcattgcgagcgcagcgaagcaatctcaatgatttttacttgcttttaatcagtccttcaagcctggtcatcatatcatccttttctttcagcattctttcataaagcgcaattttttcttcgtgaagctggatgattttatcaataggattgtaattattgacaattacacctgtcgcgttatcatggaagttgcttgcaataatattgatagcctgttcttcatcaaaattttgaaatgcttccacaggaatttttaaaacctcagaaatcttttgaagaagcggatcctcaatagtttctttctgttccaataaggaaattttcttctgattccagtcatcacctaaatccagcgccaaagcttcctgtttgatgcccagcatttctctgaatctttttacatttcttccctgatgtatcttttgttccatttgtggttttaagcttatttgaaggtttatgatgagtaaagataaaaaattgtgatgatattaatatgtggagctggagatttgtaccaaattctttttaattaaaacaaaatcacctccagattttctggaggtgcttagtatttaaattccggttttttatcttcgtttaaagctatacgccagcaagatagcaaagcccatagtaacgcaggttataattgaaatggtttcaattgaaattccacttttcatctgtgtgttttctttttcacatgaaaaaaagaataataatgtcataaacagacataccgatagtaattttttattcataaatgtatttgtttggttacgaaatatttacagcaaaaactataccggatttgtagactaaggaataggtttattgacttgtcctttcagttaatacctgcattaatgagtaacaaaggttttcttattaataacccttcggcaggctcagggtgacaacccgaataccaaccgaaatttttaagcgttgtcaggctgagcctgtcgaagccagtatttactaaagagataggtttttactgcttaattttcgtttaaatttttggaaacgttatctattaccaaaatataatgacaataatgaataataataccggcaatgaaaagtagagaagctattattatctcagtagtcaggtgatgtaggataaaatgcaggatcagaaaaagtgcagcggaatagatcagggaaaatagtatagaatacaatgcttttgttttgtaggtaagaattcttgtattttcgttgtagtaaaagtattctttgccagttgagaaaactaatggagatttgtttgcaaaatcaagtttaaacattttgttttcacctatgatggtgccgtcagcaggaacaatataagttaagcccctttctgtaattgaatggcatactacatcagtgacatttttaaacgttttgctatcttttatttctctctcaaaagtataagtaaatgggaacatagagttttaagcttagttatttgtttttccttcatcccaataatagctgtccgggtagattcttgctccgaaaacggcagttcccactcgtacaatagtggcgccttcttcaatagctgtttccagatctccgctcattcccatagaaagctctttcatctctacgttgggaatattttcacggatgatgtcctgctgaagatttttcaggattttaaagcatgcccttactttatcggtctcagcactgaataagccgatcgtcatcaatccctttatctttaaagtagagtagttggaaatctttcgggtaagttcaatagcttgatcaggattaactccaaatttactttcttcattggatgtatttacctgaattaaaacatccatcgttgtgttttcagctaaaagtctttgatgaagtttttctgccagttcaagacgatccatagactgaacgcaggtgacatcgtatttcaggatatctttaatcttattggtctgaagatggcctatgaagtgactttcatgaggaatgtcctttagatcttcatatttctccttcagttcctgcactttattttctgcaattaaagtgtatccgttttcaagagcaattttaatacggtcaggcggaacagttttggtagcaagtaataattttacatcatcagtattccttccggattgttcgcatgccttttttattctttcattgatagcggcgaggttgtggagaatatcttctttcatgatgggatggtttctctggcttccagttttttgatcaaagcggatttgacagccgtcaaagcatagtctttcgcttcagcaaaagaaatagaatactttctttcaacgcttctcatatcttcaggaaactgggctaataaatgatcgtagtacgtatcaagaatttcggcggaaggcatttcgtaattgatttttaactgaaagcgtcttaaaagggcagtgtcaataatctcgggatgattggtggcacagatgagaagtgcattttcagggtaataatctatcaactgaatgagggtattaacgagtcttctcatttcgcctacatctttatcatcacttcctcttgctttcccgatctgatccagttcgtcaagaaaaagtacagatctttcccttgcagccttgtcaaaaaccattttaatattctgtgacgtttctccaatgcgggacgaaacgatattgctcaggtttaaaataatgatattttttcccagagcgttggcaacggcctttgccgtcatggtttttccgcatccggaacttccttcaagtaaaatcttatggttaaccggaaggccgtattcctgcaattctttagcgtaagtatgctctttgataagctgtacaagctgttctctgttgccggcattgaggaatacttcgttaagatttacctgttctttatcctgaataataaggttgtacagattcatgatgatttaatgattattgaatacacaaagataaagctttacagcatgcaaaaagaaatcctgaatcataataaacatctggtccagcgcatagaatgatgaatgatgaatgggatcagtggtttacaggatgcaacataaaaaaaataaagccagacttacgaccggctttattcatttggatattaaaatttgttatgaaactaagatctttctgcttatgtttttggacccttttacccgatgggtaaaagagtgatctgatctctcagactaaaaacataaaacaatataattagtatagatattctataggcttgctttatttactattagtttctttctcttcttactgtcatgaaatatgaagtaattactactaaacctgttgcgataccgatataagttatcattttgtattatttttaattatttgacttttttttattaatttttcaattgcaatattactactttcaaatcatgtgccaaagtaaaatattatgatgtttatcagtgtattacggtggtttgtctttgtattatggtgatgttttgtttacattaaattaatgtgttattgaaaatttattaatacttttattattctttctgtaaaattttatgaaaacgttaatcgtttcctgacttctatattggacttgataaaacaaataataaataatgccttgcataatatcgtttttagatgccgtttttggcagtagattttctcatgtgaaatagattttgtgttaagaaaacttattattggcgataattttttgtgccggaatttttgtcagcttgacatttcctgatatatagagatattaatgatatgacacaactggctaataatgaggcgtaatggcacattttttccagatcagtcaaatatcacggaaaaaaggaagtaactatgaataaggcacataaataattttatgtgcctttagaaagtattattgtttactgatatttttaaaaatcaagacaggaaagggaattgtcgttagagtaactatattaattgttctcattttggaattccccggaggctttcactatttttgtacaaagaatgaatttatgggacgcagttatatttttcttgccctggcaattatatttgagatcattgctacctctttcctgaaaaaatctgaggaattttccagactatgcccatctgttgtaacggtgataggatatgcctgtgctttttattttctcagcctcacccttcgtcagattcctgtcggaattacctatgccatctggtccggagtgggaattgtctttataactataatcggtgttattgcattcaaacaggttccggatctgccagccataattggtattgccctgatcgtactcggagtgattattattaatgtattttcaaaaatggggactcattaaaaaataatttcctggtgcttttgcatctgtttccaatgtttagatcttgttttgtataagaaaaactttcccagtttatatttgaactttaaatatccgcgaaactcaataccgtcaaataatgtaaagggagtatccggattttcttctaaagcctgcctgatgccattgctgaatacagtaggtcctgtggtagaatgtatatcatgtggataacggtgagtattgatattatccatcatcaactccagtgttttctttagaaaaggatgattcttattgaaaataagtgcccattgaacatacagattttcatgtctttctacactgattactgcttcatcgttatccttaatcaattttctgaatggcttaataatactgctgtccacatccagatatacacctcctttcttatatagtacggcatatctgaaaaaatcagcttttgcagcaccaatcctcagcttgcgataagtttcaatataatgaggagggaattcttcttcaaggaaattttctatatcctgatcatcataaaagtaatagtcatattcaggattttttcgtttcatattccagatatgataacgcgtaatgagaggaagttttttagttataaaagtctgaaatatctgtttgggtacagccatattctatttttagtaagttcttatattaaaatcctgaaatcattttcataaaccatttgcatgagaggtaataagtttttcatgaaatagaatttcccgaatttgtgttttatgaagtttgattatattttgcgggaatggttaaatactgaaaagagaaaattttaatttttttttaatctctctgatattgagacttcaataataagttcagatattgtaaaatgtggtttcaccttttaaaggctgaatgacagactggaaaaaattgaaggtaaaaattctgtcatagaagatgtccagacagttttcaataatgacatcagtatagccggttttgtcccgatggcatgtttcttctacaaaaacaaaccagagttctgagagtccgtatcttcttctgaacgcttctgaatcactgcagtcaggtactgcggagtgtttaagatcacaaaacagaattccttttttatgaccatcatgttctacaatattaatagggtggtacaggtagctgagaattttcattttcgggtcgaagcattctacaaaatggtacaaatcaatcagctgtattactttttcttcttgttgagattctgtcataaaaaagcattctgaggatatttcctgagtcagttcatgaaaagcttttaattccatatgtgttcattttattagtgcaaaggaatagataaaagtagtatgcaaagatgtttttatacaaaacggcaggtattttataccaaaaccggaagtgtactaagaagtgtactcattggtataataaaatacaggttttgtataataaagtagttataatttccgttattctctatttttgttaatgataaaagagcctatcctatgaaatacagtccgtggaaatttgaagaaacatttgtgatggactttctggtggaagcgaaatatggattccgcagacatctgctgtttctcatcttctttttctttctgatttacagcacaaggttctggcactggtattccgggatatatcagtactacgttttattctttgtgtataccatcctgattgccatggtctatattaatatatatgtattggttcccaggttcttctttaaaaccaaatatattacctatctggttttactggttctgatgggcgtggcgggacttaatttcatcgggtatggtttcagacatctctttcaggatttcagaacgcaagatattccgaaagataatgaaagaggaggcatttatgaaggtattctgatgtgcattccgattattcttaccaccactaccataaaacttctccagaaatggatcagtgataataaaagaattaatgagctgagcaatcttaccttgaatatggaactcaatgagctcagaaatcagattaatccccattttctgtttaatatgctgaataatgtaaaagctcttatccggacagacccggccaaagcttcagtagtaattgtaaaactttccgagtttctaagatatcagctctatgaaaacagtgaagaaaagacattactgacctcagaaatagattttctgtccaactttttaaaccttgagaaaataaggcgtgatcatttttcttttgatattcagtctgatattgacaaaagaactgtcaacagtatctttattccgccgaacctgtttaccacttttgtagaaaatgctgttaaacacagtgtagacatcagtggaggagagtcttttgtgaatgtcaaattaaatattgagaataggcagcttcattttacctgtgtgaactcaagaagtcccggttatattgttcccgataaaaaaaacagtggtcttggacttgccaacattacaagaaggctggaacttctttatggtgatacttttgatctgcagatagagtcaggagataaagaatatattgtaaatttaaaaattcccgtgtaatgaattgtattatagttgatgatgaacctttggcaagatcagaaatgagatcactgatctccgaaatttccggtatagatattcttggtgaattttccagtgcgccgtctgctcttgagtttcttaaagataacgaggtagatcttatttttctggatatagaaatgcctatggtaaccggtcttgaatttgctgaaatgcttcccaaaaagtcactgatcatctttacaacggcctattcccaatatgccttaaaaagttatgagctggaagccgtagattatcttttgaagcccattgatccccaaagactggaaaaagcaattgataaggccattctttacacagaattgttgtccaaagatacagtaaagaataccgtagaatctaatactgcagactttttgtttatcaaagccgaacgccgattttacaaaattaatttttcagatattaaatttatagaaggacttaaagattatgttgttatccatacccggcaccagaagctcatcacggctatgaatctgaaaaccattcatcagaaaatttcaggtgaaacctttatcagggttagtaaatcgtatgttgtcaatatgaattatattgattcatttgataatcataatatctacattgaagactctgaaatccctctcggagaagtatacaggtcagaattctttacaagatttgccggaggccttctcaactcagactgatgatggatgagtaatgagcaataagtaatgaggaatttaataagcagggttatgatacgaaaagaatatgcatattcatctgtgtaaatccgtgtaatctggggctaaaaaattactcaacagaaacgggctttagcccgttaaatcaataaaaacattcgatggcttcagccaaaacttaaaaatagtttattcaataaagtttctgatctttttcacaaaagaagctccttctttttccaacacctgtctgttttttgatcagcttccggccgcaaaccgggcatacagatttggtatgtaccagccagtgttttttcaaaacaaaatcccttttccatttcaggaaatcaaaactataatttctggcttcagcaataagctcttttctttttttagccgggagattgcccaacagactttcaggctgtactccaatcctgaaaaggacttcatttttgatgatgttgcctacacctgaaaaaatatcctgattcattaaggcgtcgcacaccatcattttcggattcgattttagtttttcttccgcttttttcggattccactgatcgctcatcacgtcagcttcccaatcaatagtggagagaaagtcaagatctacagattttaccgaacaggtgtaaaaataaatgcttccggttgggaaaaacaaagccaggcgcaggcttttatcaggtttggtctgctcatcaataccgtaagagccaaacattaataaatggatacggatggccgctttctcaaaaacgaggtaagtctgttttccaaaagtacggatttcgcgaagggtctgcccgataaaagggtctttttcaaatttggcattccctgaaacttctatcacttgctggcctgcaaatggctgcaggttttctttcattaatatgatggatggaccttcaggcatacgtttgttttgagataaagattcaaatagtattccattatctgaatcttcatccaaaaaacaaacctatgtaaacattacaggatcagttatgtttttgccctacaaaacggataacagagcctgttccgttgtgaaacaaaccttctttgagttcgatttctgtttcttttaattctataatatcataatccgggaaatccgctttgatctcatcaatagaaaataaggattcaacatctttgggtccgcctactttctcattcctggcaatatattcaagatggtttttactgaaagcttctaaaataataaatccgcctttacggagatattgattcagcatctgatggatggaagacttaactgctgcaggaaaatgagcgtaaataagtgcaatgacgtcaaactgctctttttggtaattcagatcagaaagttctccaacctgataatcaatggtggttcccagctgatgagcaagctgcagtgctttatttctgccgttagcactgatgtcaaaagccgaaacctgccatccctgtgtcgctgcaaaaacagcattccgtccttcgccttctgcgggaaaaagtatagtgccgggctttaattgactaagttgctccctcaggtaattattcggttcggttccatacgcaaactcttcgctgctgtacctttcatcccatctgttgagccatgtgttgtccttcattgtaaaagaatttaaaatttgcatgaagaagaataaaaagtattcttcagttatattagccgtaccaaatgtagaatatttcttcaagcttccggcctctaaaaaacgtttgttataatagattttttgaatgagagatctgttcaataaaaatctaaatactattccgtacaattaaaatttgaagtaattttgaaaaatgatgaatttaaaccacattttcaccaatcaacgtacaggaaacaatccgcagaccaaagcttcaagaactgattttcaaagggatttcgatagaattatcttctcttcagccttcaggagactgcagaataagactcaggtttttcctcttcccggcagtgtttttgtacacaacagacttacacattctctggaagtatcgtctgtaggacgaagtttaggaagtattgtcggtgaatttattgctgaagattttaaaaatgaactgactgaggattcaaagaatttttatctccataatttaggaaatgtaatagctgctgcatgtttatgccatgatgtgggaaatcctgctttcggacattccggggaagatgccattgcaagttattttgaaagaaatgaaaaagatctgaaatccaagttcaatgaaaaagagtgggcagatctggtaaattttgaaggtaatgccaatgcgatcagagtgttggcacagcagcagcaagggaaagatgcaggaggtattcagcttactttctcaacgctggcaagcattgcaaaatatccgtgtgaggctgtagccaagaaaaaaggaatcattcacaggaagaaattcggatttttccagaatgaaaaggatatattcctggaaatcgccaaaggaacacagcttattgctgaaagtgaagaaccacatgttttcaaaagacatcctttcgtatggctggtagaagcagcggatgatatctgctacaatatcattgacatggaagatgcccacagactgggaattgtatcaacagcagactgtaaaaacttatttttcgagctggtaaaatctgaaactgatgacattcagagaattgagacaaaattaagctctatctccaatgaaaatgaacagatttcgtatttaagagcaaaagtgatcaatgctttaatcaataaatcaattgagatgtataagcataactttgaaaccattcttgaaggaaatcttggtaacggtttactggacatctataaaaaagaaaataaggcacttcaggacattgagagtttttcggtagaaaaaatttataatcataaagcggttgttgaaattgaaaatgcaggatataatgtgatgtatgaattgctggatcactttattccttccattctgaagtctgatgaaaaaagaaaatcttatgacgaaaaagctttgaaattaattccaaagcagtttatttacgataacggaaccgactaccagaaagttctaggagttattgatttcgtttcgggcatgacggataattatgctaccgatttgtatagaaaaattaaaggaatagacatcggaatgaccgtttaaattctatttattctaataattcagaagcctcttcgattaatgatttcattaaggtggaggcttttttatgctttaaaaccggagcaatctggccggaccagaagaataccagatcatttttctcttgttctaaagcagcttttctcaaggttcccatgaattgagcctgcaaaggaaacggcaatgttttatcagttgcagtcaaaacatcctgtgtaatttttgtcgtaattccgcgccctaatcttcccgtgtacgccctggtaagagtggtggattttgcagcttcggaaaacaacagttctttgtgaaagggtagtgccccggattcttcagttgcaagaaaagctgttccaatctgcacagcttctgctcccagctggaaagcacctgcaatgccctggccgtccgctattcccccggcagcaactacaggaatctttacacgatcccggattaattgaattaaagcaaaagttcccgttgtagaaagttcagacctgtccagaaatgaaggtctgtggccgccgctttcaaatcctgaggcgacgataatatctactccggttttttccaaagcaacagcttcatccagcgtggtcgcatttcccaacacaacagttccttgatgatgaagatcttcgatgatgttttcattcagcaacccaaacataaagctgaaaactttaggtttgatgtcaaagatcacttccagctgattttgaaatctggattcaaaagagggtggaggtgccggaatatctatatccaaaaggtcaaaataaggtttgaaagtttcaacagccttctgatattgctcttttgtatgttttccgtcaatgatatcatgatcgcttacccacagattaagattgtatggtttatcagttttcgactgtattttatggtgaatgtcatagatttcatggggtgacaaagtgtaggctccgaaacctcctagtccgccaagattactcactgtagttgttaactcaacagtagaaaaatctccgccaaaagggccttgaaagatagggtattcaatcccggttaattctgtaattctatttttgttccacatattttttcggtttactacattaaaggttgaattaaggttgtacatgggtcagtgtcttgttaataataagccatttcccttctatatgattgaaagttatgaaattataataattgaagtcatacatttttacatgcaatttcgcgacagcaattgaattgatgatatcaactgaaataatttcagctataaattcctttcccgatttttccggacttacgcggtttccgactccttcaatatactgttctgcagttttgaaataaggaattccattgatatccccgaaaagcagcgcatctttatagaaagcttttttcaaaagttctgtatcgcctttataaattcctttgaaataataatgctctatcacatttcttatttcggtttctgatgcctgaatggttttcatattcttaagattttgtgcatgaccgctcaacggaaagctgagcagccatgctataattaaagatagtttcatgataaatgatgtccggcacccatccctccgtcaacattgatgatggccccggagattaatttatttttagcaatagcaaaaatcatctgagccacttcttcaggctccccgatacggttgatgaggtgtattcctgcattgttatcaaggtctgcaccatgcattggagtcctgatcaatcccggcgcaactgtattcacccttatattgtcttttccaaactctgccgcaagctgcaatgtcagtgcatgaatagctcccttactcgaaataggtgccgtagaaggagattgggcaatggcgtggtacactaatggtgttcctatattgatcaccacaccatctttttgcctgatcatttgaggaatgacggcctgcgtggtaaagaaggttccttttaaattggtgcttaaaaaacggtccagatagtcttcagtaacttccagaaatggtttgttttcgtaaattccggcgttgttgatgagcacatcagcagacccgaatctttctaaagctgttttcaacagcgcttctcctgttgtcttatccgaaacatttccggcaactattgcgagattttctgcggctcccagttcatgatacactttctctaatttgactgccgtttgtgaattaatgaccacgttatctccttgatttaaaaaataccgggcagtttccaatcctattcctgaagaggctcctgttacgattacggtttgttttttcattgctgatttattttttgactgttgaaaatccctgttcttttaatacagaaacctgttctcctgcatacccccagttatcgtcttcaatctcattgataacaatatgtgtcaaatgaggatctttattcaaaactgaggttacagcttcactgatttttctgattaactgttgttttgtttcgcggttaaggtcttcgcgaagaacatctactttgatgaatggcatgatgataaattttagagttattgaattaataagcttccgcaataagatgaatgtttaaatcaaagttgttgtagatcaacgtatcacccaggttggtaaagaagttagaggacctgaatctgatattgaattttgttctgtctactacaagtctggtttttagaacagctgcattatctgttgttacaatatgaaggctggtgtcgataggttgggtaatgcctttgatggtaagatgtccttgtacgtaataaaaattctcatcaccaggttctgcatgagtaatttcaaatgaagcttcaggaaactgttcaacattgaagaaatcatcagaagccaggtggttggcaaactgtctattggtttcattatcctcaatgtcaaggattttgatggagcgggtatcaatgatgaactttccggactgaagtttttggctttcaaatatgaagttgccttcttttatgcggattgtaccgttatgagctcctgtaacttttcttccgatccagtggatagtactgttttcggtattgactttaaaaatttttgtatccatttttattgggtttaaatatggatacaaagttcagctcaccaaaagaaatatttacgtgatgtacctcacaaaatgaagatgagaataaacagtttaaaaagctgcagattattgatgaagcctgctcaaagtttctctcgtcactcccagatatgaagcaatgaggtgtttcggaaccaggttgtaaagttggggatacatagataaaagctcctggtatctgaatttggcatcattattcataaaagaaagaaggcgtttctgtgcggctacataccctttattggtccgccatctgaaaaaatgttcaacctgatgaatttctttacagattttttccctgtcctcatttgaaatggacaaaattgctgcatttgtaatgcagtctacattaatggtcgcccttgttttactgtaaagagcatcaaaatccgttacccaccacgtcggcatggcaaactgaagaataaacattttcatattgtcattaagataaaatgctttcaaacagccttccagaacaaaatattcatgattcacgaaatcgccttccgaaataagactttgccctttctttaaagtaatcagaccaaaatgtccgaaaacatagtcaagttgttcatcagtaagagaagtgaatttagagatgtgatcttttaatatttctttagaattgaccatgatgtataatgaataatcaaaagtaagttttttcaggatcattttaatttaaatgttttgaataattctacatgatgatttccgctgaacgatgctttaaggcttaaattaatttttcctatatttaaacagcacaggtaaaaattgtttttaacaaaacaggatttataacgacatattaaaaaattaaaaactatgggtatatacttagcgcccgttattttcttcgggcttatcattttgttcgcttcgttttttgtggtcaagcaggaaacagcagcgattattgaacgcttcgggaaatttcaggctgtaaaacattccggtcttcatcttaaactgccaattatagatcagatcgctaaaaggctgaatctgagaatccagcagctggatgtaatgattgataccaaaacactggataatgtttttattaaaatgaaaatttccgttcagtatcaggtgatcagaaaccaggtgggagatgcttattaccgtttggaaaatcctgaaaaccagattacctcattcgtgttcgatgtagtgcgtgcggaagttcctaaactgaaactggatgatgtttttgtaaggaaagatgatattgcagtcgcggtaaagagcgagcttcaggaagccatgaacagttatggttatgatattatcaaggctttggtaacagatattgatccggatgagcaggtaaaacatgcgatgaacagaattaatgctgcggaaagagaaaaaaccgctgcagaatatgaatctgaagctcaaagaatccgtattgtagccgttgcaaaagcagaggcagaatctaaaaagcttcaggggcaggggattgccgaccaaagacgggaaattgcaaaagggcttgaagaatctgtcagaatgctgaataatgtagatatcaattctcatgaagcatcagcgcttattgtggtcacacaacattatgatactttacattccgtaggggcaagcaacagaagcaatctggtacttcttccgaactcgcccactgcagcaagtggaatgctgaatgatcttgtggtggctatgacaactgccaacacagtgggagaagctacaaaaggaaaatatcctgaacctcctcaaaaagaatcaggtttttaaaattaaaagaaaaaagaagcgtaaatgaacctgaaaaaatgaacttatggaaaattttccgtgattgtcggaaataacatcaggcttcattcttccagcttcccgcaataaaaaacgcttctgaacttcagaagcgttttttattattatttcttcgttttagaaacctgttctaccagtgtgtatctgatagaagaagcatcagccggcggattttcaattttttctgttttcacttttaaaacatattcataacctggttcataagtgaatccttcaatattactgtagaagttcgtccagttttcagaacctttctcttttacctgcagacatttcatacggcctgctcctgcagaacaatctactgtttgggcccctatgataagtgttttttcattggctgccaccgctgtttttttcgttttagaaacctgttttaccaatgtatattttatagatgatccatcagctgggggattagcaattttttctgtttttacttttaaaacatattcatagcccggttcataagtaaatccttcaatattgctgtagaaattcgtccagtttccggaagcgttttcttttacctgcagacatttcataggagctacgcctgtacagtctgctgtctgcggtcctacaatgaatgttttttcatcacctgcggatgcattggttgtggttgtacattgcgtcattgcgaataatgctaatgcgggtgctgccccttttagaattgttgctatacttttcataaacttgatttttccccttacgtcgcaattaccatgccgaaaaaaaatactgaatttgtagtacttctgctattgttttttacttttttaatcatttaatttgaatttcttaaacactaaccaaaatataattcttataatgaatatggataatcaaatgcaagttgaaaattacaggattcaaaaacctgaaatgtgggcaggaaatatcggagatgaggaaatcataagtcggatcaaagattcagaatttgccagaaaacaaattgatgagggcagggattactgctattttctggataaaaaatactatacaagcaatacggaaaacagtgaatatgtctgcatggcctatacgctgaatgaacccggaaatctggaaagagcttctgtttctgatgttattgtggaagaaaacgaagtataccagatccacagaatcagcgttctgagagacggtgtgctgattgataagattccggatacgaaaatcaaagttcttgacagtgaaaaccagagcagcggaggtgttctgagcagtaataaaaagatcaatattaccattaaagatctgagattgtatgatatactcattttagaggattcaaggattaaagaatttactgatcgcgattttctgagaaaggaattctctaaatacgtttgggtaagtcctgataattactgggcttacggaagttttaaatttaccttcatcaatgaacgtgaacagacgattgcttacaaaaaaacttttttcagagacgaacaaggcaatgtccttgagccgcaggtaaaccatctgaaaaaaggagagcgcttcgttatcgaagaacagaattatatcaatcctgtagattcaggacgtgagatttttccttatgtggattttgctacagaaagcaactggaaagatctgtctaattatattgtccctttctatgaggaaattttcaataaagcttccttaaaagattttgctccgaatcttgttgaaaaactggatgccattgccgatcaggacgaaaaacttcagtttgccatagagtatgttcagaatcatatttattatatcttcaatgcggatgagatgaacgggcataagccacaggaaccttcaataacttatgaaaacaagcaaggagattgtaaggcaaaatcggttttattgaaagtgattcttgattatattggcgttgaagcttcagttgtattggtaaatttcaacacagattattatatcaagtattatcttccatcattattaagctttaatcacgtggtggtaaaagtaaattacaaagggcaggaatattttattgatgccactatccgtgatgaattcggattgatagaaaaccgcggattcatatattttatgcattatctggaagtgaaaaaagatcaggaactgcaggtaagaaaaccttataaatttccttatttctgtattgatgaaaaagtagatttcagtgcgcagggcaataccggaaaacttactttgtcaaccacttacaaaggaaacagagccaatgccatgagaaggtattttaagagtacgaataaaagggaaattattgacagctggaacagtttccttttctatgcgcttaactattcaggagacaggaatggtacagatgtacgggatgtgtttaaagacgcagctattgatgtggtaagtgatgataagaagctgaatgaagtcagaattcaatattctgctgttattgagaatccttattttgtagatcctcaaaagaatcgtttcctgatgtattttgacagaaatgtagtgaaggcaagtgcgagggatttcatgcataaagatttaccattctggcataatttcgacagcgagaaatacgagatcaacctgcatacggatcataaaattgatactgaagaaaaatatacgattcaggaaagcaccattattaatccgtattttgattataaaagtcgtaaaaaagtacataagaacggagcaagcgtgtatatagaatatagtcctctgatcaatattgaaattcctcagaatgagtttgaacagttcagaacagaccatcataccattgccgacagtaattacggtttgggaattgatattatcgaaccaggtctgatgaacagtcttaaattcagttttaagaaaaaatttaaataagatcctttaagtttaaaggtaaggattcaatgttgaaggtttagatttccgcgggcggcgaagccgcccgcggaaatcttttatattattttattctaattattaaaaaaaacacatatttatgtttaagatattttgtcttgcctcttttattgcagtctcatctctgattaatgcacaaaaaataaccaaagaaaatgttacaggattctggaaactgaaggaagctggattttatgaagggaaagagaaagtgataaaacaattcgataactgccgtctgatgagaaattatgccatcagggaagatggttttgctgtttataattatacagaaggaagtgtggaaaactgcagcccgtccgagcccagactttctttctggagaatcgtagaaaacaggatccagttttatgtagatgaccagaatatccttgaagaagtagtggtaacaatgaataaagataacacgatgacgttttcaagttatatccctgaacgaaaaaaagtagatggcgacgcttttgctgaaaaaatagcaaacaccgttcactacgatatccttgaaaaacaataaagtttcagacgtcccaaaactctgcctaagcatagtcattgcgaaccgaaggtgaagcaatctcaacattattcataagcagaaagttggaaaatgcaaagtcgctaagattttataagccatatgtatgtaagacgcaaggattttatcttcgataaaatttcaacagtacttttgtcattccgagcaaagcaaggaatctcaattattcagataagggtttaaattttaaacccttatggattctgtggtttattattaggcattatgaatttctgcttcccaatcaaaagttcaaaaaacagtctgaaatctgagattaaagaccacaaaggatatttaaacgtagcaggcttatttctctcaatcacagcatgactgaaccaggcaaatccgtagcctacaataggaatgtaccataaaaatctttcttttcctgaactgataacatatcctataacgaaaaatacaagaaacgtcccgataaaatgaaaaatccgggttcccgttttactgtgttcagtaagataaaactgataaaattctctgtatgttctgattctttcagccatggcggttagtttatgggttcttatgaagctaaagcaataattctgccgatttttatcagaggtaaaataaaaaaggcaaaatcgcagatcagtttctccatccggtttaacctttctgccattttgccttttcgcaattttgccaattatgatttagctattctttaattcttttcccagtttactgtttttgtatccgtagcagaaataaataaccattccgatcaggaaccacatcccgaaccagaaccagttctcgtggctcattcctgtaagaagatacagacatgagcttaatccaaccaatggaatcaatgataaatttttgataaacgctacaacacacagaataagattgatgatgataaagaagaatatagaagctctgaattctccttcattgggatctgaccagttcatcaggttgtcaaaaaattccggctgccattgatagaaagcaattaatccaccaataaaaacaacagggaaaatgattttaccattcacataaggaaggtgaaatctgccttttattttttctttggcaggaagaagaagtactccggcacatactaacacaaaggcaaaaatagtcccgatactcgtaaagtcaaggataaaagttttgtctgtaaacaggataggaatccccactacaattccggtaacgatggttgcgtaggatggtgttttatacttagggtgtatcttttgaaatcttgcaggcatcagtccgtcacggctcatggcataccagattctaggttgtcccatctgaaatactaataatactgtagtaatggctacaatagcaacgaaagaaaccacaagttccatccatgctacattggcatttgttttttcgaagatgaatgaaagcggatctcccacaccatcgaatttcttatagtctaccattcccgttaataccagtgttaaagcgatataaattaccgtacacagtacaagagagatgatcattccttttggtaaagttttctgtggatctttggtctcttcagaaagtacacttaatgcatcaaatccgatatacgcaaagaatactccggatacggcactcattactccggcaaaaccatttggcataaaggaaggtgttccggttgcaggacttacaggagtccagttttcagtgttgatgtaagcaaaaccaaccagaataactaataaaataacaccgagttttaagatcaccaatgagttgttgaaatttttactttcttttactcctacataacaaagccatgtaatcaatccgttgataaccaatgccggaatatctacaatgaacttcagactaccgattaacggcgctgttttccatgcatttaataattctttattttctgaaccatattgaaaggctttccttgcttcggtatagctgcaggtcagataatcaggaatgtgcattccaagacgtcccaggaagctggtgaaatagtctgaccaggaaaaggctacgtaaatatttccaaaagaatattccatgatcagagcccagccaattacccaggctataagctctccaaaactggcataagcataggtataagcagaacctgcagtaggaattctgctggcaaattcagcatagcataacgcggtaaacccacaggcaaaaccgcaaatcaaatatagaaggataacaccgggaccccctctgaaaacggcttctcccaaactgctgaaactcccagctccaataatggccgcaataccaaaaaatacaatgtcccacacacctaagacccttaaaagccccgtcgaagtatctgtatccgaatagatttttcttctaaaaagttgactcattcaataactatatttgatttgaaaaaaagcaaatgtaatgattttttattttgatgttaacagtcgttaacaacatttaagcaaaaatgctcaaacaaaaagctttagtctttataaacagggatttctacatagctgtcattgtaccattttatctccagcggctccccggcatcctttattgtttcatcactcacatccttgccagatccgtaattaatctgccagttaggattattattaacgccgaccaataaaagaaatttgcttcctttctctatctttctgctcataacatacgaattattaatcggaatctgttcaatgttattgggttcaagaagctgtcgtttttcattgttctttgcatagcttgctctcacgatatgagttgatagcaagtaggattttccatccggagaaatctggtacagataagtatcagtgtcaaaatcttttttattgaccgaaacattgaaaactcctgacagatttccgctcatgacgatatctttgtcaagtacttcactttcaaaagcaacagaattcgttgttttgatactgtcttttttactgactttataataggtgtctttctgattcctgttttttaaatcaacggtttgcttggtgaagctccggctttccggcttgctgaatactgaagaagtgttttttgtgtcctgaaggtaaaatttcaaggaagaattatgcattttgtcaagatcggcaacatgtttccacgtattcgtattcatgacctgaaaattgattttatcttttaaaatttccggttttttaccgcccttaagaatataatcaaaccatgagaaagcaagatcatcaatactaattctggccaccggatcaataggattaccattcacatatgtaaacccgaaactttgtgctcctccatgattgtaaggacctattacaagataatgatttgcatttttattgtattgatgatgttgtttaaaataatacaatgcaccaatctgatcatcgtcataatatcctgtagtcgtcaggatcggaatattgattttagaaaaatcttctttgtaaggaaccattttctgccagtactcatcatatcccggatgatccagccatcgctggaaaattttacttggcttcccgcttattttatctaaagatctgaatgatttcccgtttttgtaccattttgtaaaaatagaatcccactttacagcattggtaaaatcagcttcatcggtaaatttattattggttacatactgaatccactgcagcatatagctcatgaagacattattctgagcaggataatctatcccgatgcctactgccacctgtggaacgattgttttcaaagcaggatgcactttttttactgctgcccactggctgaatcctaaatagcttcctccgatcattcctactttcccgttgcaccacggctgtttgcttacccaatctatcacttcatagatgtcttgcgattcatgttcaaaaggattgttggcatcattgctgtttctcttgccacgagtgtttactacaacgcctacataatcataagtggcagctctctttccaaagaaaccatcaatgggacctgcatagatattattggttaaaatagcaggaagaggagacgtattctccttttttcggacaatagtaatggttaaggtatttccgttgatcttaaggtcttttgtttcagtaatgaatttttcattatcttttgaagcaagcagctgcataacctgaggtttgatgctggagtaggttttataattcagataatttttgcataaagctaaagcagttctgtaatcgatgctgtccttatctttctgtttatccagtacttttttcaactgttttctggattctcttacatctccgttaagagcgagctcaagtctgggaatcagtttttcaggaagactctgatatttttgattaaatactttctggagcgcattcgtaaaagaggcgttgttttctttttgctccatctttgcaaggctgtacagctcaaatccaatatatctgtatccacccatattgttatcggcaaaaagatcacggttttcagaaagagaagccaatgagtttttgtaatcctgggcaaccatctgcagacggaaaagattatccataagatcaacggtattttccggtttatacttcgccgactgaaggtgaggaatcacttgctgtgcaagttcaggaatctgtttttccaatataagagagtcagttacagctgtttttggaaaataaaatttttgtgcctgtacaaggttgacaaaaattaatgctaaaagtatcttaaatttcatggaatggtgtatttatggtatgtttttagctgctgttgaaaaagtatcaaattaaaataagtttttgataactgtttattaaaattgtttacattttatcagacgaaagtagtaaattttatcattgaacagtgagaaaatttacattgttataaaattgttatttataaccattaaatctgttaaaacttgcttaaacaataagtttttaatattttcgttaacttatttagactaattttcttatatcaagaagaatgaaatcaaaaaaaatacttttagcggctgcggtcatttatttcggaatctccgatgctcaacagtcccaatattttacccagaaagaaaattacaggtttaatctagccgaaaatctttatcagaccaaaatatacaacgcctctcaatacgaatatgcaagacaatatttctacaaccagaatttgtcccgttctaagaaagaaggcgcccagttttttgataatgtgatcggtgtgattcttcagaaaaatcatgctgaagagggattaactgctttcatgaaagaatatcctaattctgcttattttgcacaggctaatcttccgcttgcagattattacttagcaaaaaaagactttgacaaagcactggaaacacttaaaaaagtaaaccagtatcagctttccaaagaagagaataccgaatatattctaaagcttgggtatgcaaagtttatgacgggtgattctaaaggagctactgatgctcttgaagaagcgtataaaaccgcagatcagtctcagaagggagatattgcttatatgcttgggcacttatattacagcaacaggcaaaatgataaagctttccagtattttgattccattaaagaccaggataagttctcaaagcttgtacgtccttattatgtacagatgtattataatgataagaactacgatcaggctattacagaaggaaacgccctgttgaacgaaaatatttcagattcttataaagcggaagttcataagattatcggggagagttacttcatgaaaaatgattatacctctgcctatccgcatttgaaagactacctgaatgttcagcagaatccatctgaaaacgatttgtatgagatgggatttgtggcagcacagctgaaaaaatatgatgaagcggtttcttattataaccagcttctgaacagcaattctgctttagcgcaaaatgcttactatcagttaggaaatgcttatctggcagtagataaaaagcaggaagccctttctgctttccgttcttcttaccagatggattatgatgcgaaagtgaaaaaactggctcatgagcagtacgctaaattaagttatgacatcggtaacccgtttgaaagtccttcagcagttattcaaagttatatcaacgaaaatcagaatggtgccaatgccacagaaatgcggtcattactggtgaaatcttatctgtattccggaaactataaagaaaccctgaacgcgattgacagattgcagagttcaactcctgagatcaacaaggtagatcaggaagtttcttatttattgggaactgaagaattcaataaaggaaattatgatgaagctgagaagtatttcttaagaagtcttggtttcaacatcaataaagaatttaacagcagagctttatactggctggcacaggtgtattaccagaaaggaaattatccgtctgccattgttcgttatgaaaaacttttaaacgaaaacttccctgaaaagcagcagcttccttatgatttaggatatgcctatttcaaatccaaaaaatttgatcaggctgccacttatttcaagcagtatcttgccaatcctaaacctgaatttaaaaatgatgcagaacttcgtcttgcagatatccattatgccaacaatgacctgaacgaagcgattgccatttatgataaaaatgaagatgccacggattatactttatatcagaaagcaatggctttaggattcaaaggggatacgcaggcgaagattaacaaccttaaaaaccttttatcaaaataccctgattctgaatattacgatgatgctcagtacgaaataggaacggcatacgctgctcaggatgattttgcgaattccaatgattatttcggaaaagtaattaaaggttcttccgacaaagatctgatcgcgaatgcttctatctacagagcacagaattatattgaccagaatcagaatgacaaagctctttctgaattgaaatctttgggtgaacagtataaaaatacagcatatgctcaaaaggtggttcaggctgccaaacctatcttcacgaaaaacggagatgtttcaggctatgaaactttcgcaagaaatattggggtaaatgtagacgctgctgaaattgatgagatcaatttatcaacaggaaaacagctgtttgcaaagaaagattataagaacgccatttcttattacgaaaagtatctgacacagaacccgacaggggaaggtttatatcaagcgaagtatgaattgggagaaagttattaccagaccaataattcaactaaagctttacttgtgcttcaggaagtggctggaattcagaatgattaccaggatgacgcacaaactcgtttagctcagatcttccttgcacaagggaataaagcggaagccaaaaagtaccttgaaggtattaaaaattcttccaatatcagcattaaaaactatgcgaacgttgaattgatgaagctgtatgcagaagaaaataacttctctgaagctgaaaaactagccaatgcagtaatcgccaattctaaaaactccgcagctgttattgaaactgcgaaagtgatcaaagcaagaagcctgatgaattcaggaaaagataaagatgctcagacagcctatacttctcttgaaaaatcatccaatacttcggtagctgcggaagctttatatgctaaagcctattatcagaataaaggaaaggctttcaagtcttctaatgaaacgatctttaagcttgcgaacaactatgcttcggaagaattctggggggcaaaagccttggtattgatggcgaaaaactatatcggtctgaaggataactatcaggcaagttatacgtgtgatcagatcattgcaaactataaggatttccctgaaattgttgcagaagcaaaagaagttaaaaaacagattaagaaataggaaatgaagggttttaaaattgctgcttgttctttcttagtttcggcttcactctggagctgtatcccatcgtacagtgcctatccgaaagagtataaccatgcaaaagctgatttcaaaaagcaaaaagcttttgtagtgaataaagagcttaagagagaatttgagattttaaaacattctgatatttatgaaatcgtagatgacagtactcaaacagcaaaaattaccctgcatccgatgaagacctatactcctccttgtggaaacccaatgattgggagtatgattacagtcgggttactgccttcgggatttccgtatgatattgtttacagttatgatgtagctgagaacagtgaaacaaaaaattatcaatacaaattacaagtttatcaaagcctttggctgtttaatatattcagactggggagaactttttcaaaacagtcggggaaagctttattaggcagttatatagcttccaataaataaaagcccgttatatatttttttcaaataaagaaaatatgaacaagaaaattcaaatattatccatattatttttaggggtttcgtcggtggcgttttcccagatcaaggaggaaaaactggttcttaacaaaaaaagagaaccggaagtgaagaagatcgagaagaagaaaacttctgtagaaacgattaaaaattatccgccggaagagaaatcacagaatcccgtgaagtatactatcacagatgttcctgctgtttcagatttcaaaacttcaacgattcagggagaggatgtagctccgaaatttgacggaaccgctcagaataactatttccagttcggaatgggtaattatgggaaagttctggtagatgggaatgtttccaaaacccttgaaaataagcttgaagtaggagcagatgttcatgttctctctacgaatggtcttaaaaaagattacgactggaaatccgggcagacatcagccaatatcggtgcgttcttaaactcttacggcgaaaagggtaaattcaaccttaatgctgaatatggtttggacagctataattattatggaatttatgctatgcagcctaccggtgaacttgacctgaaacaaaaagtcaatcagtttaaagtaaacgggtattatgatttttattctaatgaaatactgaatgatataagggtaaaatcatctttcctgaaagatcattttgatgcacaggaaaaccaggtttcaattcttgccaatttctccaaacatgctgttgaattaggaaaatcaggaatcaatctgaatgctgatcttggagtgggattggatgctgtgaagacagattttgccatcagggataaaaactcagctaactttttcaataccagcctggctcctaaagtgaccttcagaaaaggagactcttatttgatattaggatcttcattctctttcctgaatgctaagaattccaatgaccagctggaacagcaaaaaaataataagacttactggttcccacaggcagaattccagtttgctgctgctaatgaatttaaattctacggaggggtagacggtggtctgaaactgaatacttatggagatatgctgcagacgaatccattcatcctttctgaccagtttttaaagcctacagagacgaaatatcatttttatgtaggtttgagaggagatattgatgaaacggtgaaatacgacttctctgcaggttacggaaaaatgagagacattatgttctttaaggccaatgatctttttgataacacttctgttaaccgttctgcttacaactttgccaatacattctctgcaatatatgatgacggaaatgtaagtgatatcaaaggaagcgtacagtatttcccgttagccaatcttattttagacggagaattaaggtttacgaagtacaatcttaagaattatgacaatatttataacgttcctttgtttaatgcaagtatcggggcaaaatatacgatgcttgacaaaaagttattgttaggatttaaaggaatctttgcaagtgacagaacgacaaactcttatgcaattgaagcagtaggtgcaccgaatgtaatttatcagtctacggagaatacaaatgataaagttggcgggtatgctgatttaaatctttctgcagagtataaaattcacaaaaatttcagtattttcgcactcggaaataatcttcttagctcaaaataccagacgtacaaaggctataaagtcctgggtgcgcagattctgggaggtgtgaaaattactttctaaagtataaatgacaggtaatcaggtattactcattacttatcatacattactgatgaatatggctgcatagtttaatggatagaacttcggatttcggctccgacagtgagggttcgaatccttctgcggtcacttaggacggacaaatcatttttattaatggtttgtccgttttttatttgagtactgtcaagattgaaaacagggctgaatttagctttgatacagaaatgcgttttattgaaatcaaatattctagctttatcagtacaaattcttgttattatgccgggagaaaattctagatatatatcactgttattcatatgtaaatagatatatcctgtaggtagtatttttacaagacaaccttcaccagaaattttatcttttctgcatattattctgattttggttttgaaattaacctacgggaaaatctaaatgaaaatcaagatgtcccttattaactctgtaatgatttcagatgcattcctatcatttaaagtaatatagcttctgaaagagactgtctccactgtggatttcgtgttgaagtactttttgttctctgaattctttggtataaactgactaaaacaatttcttatttaaaatggttcttaatgaaaaattttataattttgatagtgtgaaaaagctgatttccatattgttgttaacattgtatttggtttctacaactgaactgtatcagcttttgaaaatgccgcttcttattgagcattatattcagcataaaagcctgaatcctgaaatgtcgtttactgcatttctgaaaacccattacgatcatcctgtgaaggacagtgaccatgatcaggaccagagattgccttttgtttcacatgcaagcctgctgtctgtggttttcactattaacccttccttagattttcattgtatagaaaaagtttgcaatcctattgaaataaaaaagaccttttacaaaagcgcgctttataataaggaaattcttaattctatctggcagccgccaagatttcttcaatcttaatctgttttactcagtcattttttgaccgggaaggtattctgtatctgtatataatgcggatgcattcaatctatgcgtcagaataccggaattttattacgataattaagattaatcaatcattatatgcttacaaaaatcattgagttttctgtaaagaataaactcattattgcattgttggtattgggacttattggtgtaggtgcctatcaggttaccagactgccgatagatgcggtaccggatattaccaacaatcaggtacaggttattaccacggcgccatcttttggtgcaacagatatagaacggctagttacttttcctatagagcaggccaataacaatatttcaggattaaaggagatcagaagtttctccaggtttggactctctttagtgaccattgtctttgaggataatgttgatatttactgggcaaggcagcaggttgccgaaagacttcagcagatacaggccgttattccgcagggaattggaaatccacagcttggacctatttccacagggctcggcgaaatttttcagtatgtggtaagacccgaaaagggatacgaaaaaaagtacaatatcacagaactccgtactattcaggactggattgtaagaagacagcttttgggtgtaaaaggagtggcgggagtaagcagctttggagggaaactgaaacaatatgaaattgctgtaaatccggacaggcttaatgcctatggaataacaatcaatgacgtatttgatgcattgcaggccaacaatcagaatactgggggagcttatatcgaaaaaggacctactgttctttatatcagaagtgaaggattagtaggaagtattgaggaaatcaacaatatttctattgcgacaaagacaaatgatgttccactctttattcgggatattgctgaagtgaaaaccggctttgccacccgttatggagccatgacttttaatgatcagggagaagtttcaggagctgtagtaatgatgctcaaaggcgagaacagtaatcaggtcataaaaaatgtaaaggaaaaaattgcccaggttcagaaaacccttccgaaaggagtggtgatagagccttttctggacagaaccaagatggtgaacaatgccatcggaacagtagaaaaaaaccttacggaaggagcactgatcgtagtcttcgtactggttttatttcttggaaatatcagagcaggattgctggttgcctctgttattcctttggcgatgctttttgcaatatgtatgatgaacctctttggagttagtggaaatctgatgagccttggagctctggatttcggactgattatcgatggagcagtgattattgtggaatctgttttacaccagttcagtcacaattcaaaatttaaaaagatattctctgtcggaaaatcagaaatggatactgtggttatagaatctgcaggaaaaatgatgaacagcgccgttttcggacagattatcattctgattgtctatctgccgattcttaccctgcaggaaattgaagggaaaatgtttaaaccgatggcccagactgtagcttttgcacttcttggcgcatttttgctttcactgacctatattccgatgatgagtgcggtactgctgagaaaaagaagcgacaaaccaacattatcagacagaatgatgaaaaaggtagagaaaatctatctgacagttttgctcaaacttctcagaatacccagaatagtttttggtgtagtagcagtcttatttgtaaccgctgttttcattttatccagaatgggaggcgaatttattccttcccttgaagaaggagactttgcagtagatacaagggttttaccaggaagtagtctgacaacaactattgaaagtacccagaaagcagcacatattctcaaatccagatttccggaggtggaaaaggtcgttacaaaaataggaagcggggaagtccctacagacccgatgccgatggatgcttctgatatgatggttattttaaaggataaaaaagaatggacctcagcgtctacttttccggaattagcggataagatgggtaaacagctgcaggaggtaccaggaattactgccagctttcaatatcctgttcagatgcgttttaatgaactgatgaccggagcaagacaggatgtggtaattaaaatttttggagaagaccttgatgtgctttcccaaaatgcacagaagcttggaaaaattatagaaacagtagaaggaacccagaatctttacatcgaacctgtttcgggaatgccgcaggtaatcattgaatataaccgtcctctgattgcccagtaccatttgtctgtttctgacatcaaccgtgtcgttaatactgcatttgcgggacaaagtacaggattggtttttgaaggagaaaaacgcttcgatatggtggtacgtctggataacaaagaccggaaaaatgttaccgatattaagaatcttctggttcctacgccttttgggaatcagattccgctttctcagcttgccaaagtggaagtgaaaaatggtcccaatcagattcagagagaaaatgctcagcgaagaattgttgtgggttttaacataaaagacagagatgttcagagtattgtggaagaacttcagcagaaggtagatcagaagatgaaacttccaacaggatattatatgacgtatggaggttcttttgaaaatcttaataatgccaaacagcgtctcatgattgcagttcctattgcattggctcttattttcgtcatgctttttctggccttcaattctgtgaaagaaagcttactgatctatactgcgattcccctttcgattattggcggtgtatttctcatggcactcaggggaatgcccttcagcatcagtgcgggcgtaggatttattgcgctcttcggagtggcagttctcaatggaatcgtgttgatctcagagttcaaccgtcttcacaagagaggaattaaaaatatcgtaagaatcattatagatggtggagaatccaggcttcgaccggtgctgatgacagcatttgttgcttcattaggatttattccgatggcggtcagcaacggagctggagccgaagtacagcggcctctggcaacagtggtcatcggaggattgatggtcgcaacttttcttaccctgtttgtcttaccattattatatgtaactattgaaaaaggattcaaaaatgaaaaaaataaaaaataaaaaacaggcttccattctgacctttttggtatgcgtcggttttgcgggactgttaaactcccagactcccgttacattgcaggatgctgttgatattgctttgaaaaataacagaaatattaaaaatgaaaaactaaaatcagaatatacgaaagcccttatcagatcatcatctgacattcctcagactggagtaacggtagattacggacagatcaacagtgctctgacagatatgaaattcggaatttcacagaatatagcatttccgactgtatataaaaagcagaagaacgtgtacaccgaagaatggaaaaagtctctgctgaacgtttctcttaaagaatatgaactgaagaaggctgttagccttaccttttacaatatcctgtacgcgaaacaaaaagaaaagctacttcaggaaacattaaagctgtacactgattttctcgataaggccaatatccgtctgaaagcaggagaaagtaatattctggaaaaaactacggcttccaaccaaaagtctgctattgaaattcagctgaagcaattacaccaggagctttcagtgctgagatatcagcttcagtggcttttaaatacagaaacagatttcattccggaagatcagaaaatttatcagggaagccttaatgaggaactcagcttacatccggctattaaggtattgcagcagcagaaaaacatttctgaacagcagattgcccttgaaaaggcaaaaatgcttcccggacttcagctggcctacaacctcaacagcttcaaagggatgggcgcagatgataaagtgtacaacggtacaccacagtttcattctgtacagcttggagtttcagttcctgttttttccggagggcagaaagccagaattcaggccgcaaaaattgctgaatctgttgtggaaagtgatattgccaatatggaattcaacctgcagaatcaatacagaaaggcatctggaatttatcaggctaaccttgacattgtttcacaatatgaaaactcagaattgaaaaatgccgatatcatcactgaaacagctaaaaaacagtttcttgaaggagaaatcaactatctggaatttgtcatcctaatcaatcaggctgtcactttaaaaagcagctataccgatgcagtctggaagctgaatcagagtgctatagagctggaataccttactttaaatccataacaatgaaacgtacatttaaaattatatcatattccctgtcaatattaggattactcatgttttatgagtgtaaagaccatggaaaaacagagccggcgccggcaacagtatcttcaaaagatgaaaatgtagtaatgcttaccgatgcgcaactgaaaaatgcacctatagtaacaacggtactctccctgcagaaaatttcctccgttttaaagctgaacggaatgatagatgtaccgccccaaaatctggtttctgtcagtattcctttaggcggatacctgaaatcaagcagcctgcttccgggaaagccggtttcaaaagggcaggtgattgcagtgatagaaaatccgcagtttattcagcttcagcaggattatttaatggcaaagtctaaaaatcattttgcccaattggattataaccgccagaaaacgctcaaccaaagtcaggccaccagcgataaggtaatgcagcaggcccagtctgaaatgaacagccagaaaatcctgatgaactccctggctcagcagctacgtcttatcaatatcaatcctgaatctctgaattccgggagtattcagaaaagcgtaccggtttacagcagcatcaatggctttgttagcaaggtgaacgtgaatattggtaaatatgtgaatccttctgatgtcctttttgaactcattaatccggatgatatacatcttaacctgaaagtatatgaaaaagatctggcaaatctgaagaaagggcagaggtttgccgcctataccaataccgaacctgataaaaaatactatggtgaaatcctgctgatcagcaaagatgtgaccccgggcggatgggctgaagtacattgccattttgaaaaatatgaccagagccttgtacccggaatgtatatgaatgccgaaattgagactagtacctctttttccaatgctgttcctgaagagagtattgtcaattttgaaggaaaagactttgtcttcgtagaagaaaaaaaacaaacctaccgacttactcctgttacattaggcgaaacagaaaacggatttgttcagattataaatgctgacgattttaaaaataaaaaaatagtcatcaaaaatgcatatacacttcttatgaaacttaagaacactgcagatgaataaaaattatagtaaaataaaagaacttataaataaatacaaattatgaaaacatcttctttaataaaaacaggagcaggttttgtagtcctgttactgattgcaattcagttttttgatactgataaaaatatagcggtggttccttcggagaatgctattgaaaaacattaccaggttccggatcatgtgcagggaatattaaaaacaagctgttatgactgtcactccaacactactgcctatccgtggtacaataacatacagcctgtgaaatggtggctggcagatcatgtgaactcgggaaagcggcatttcaattttgatgaattttacagttattcaaaagagaaaaaattaaagaaacttgatgaagtggcagaaaccgtaagagagggtgaaatgcctcttacatcttataccgttgttcaccagaatgcaaagctgaatgatactcaaaagtcagaaatagaacaatgggtaaaagaggttaaaaagcagattgaatagaaaaacagaaaacattactctgatataataaaaacaatcagtaaatttaatatccatatccatttcatatgaattacaatataccggaagacttaaaaggacttacagacgctgaagtagccgattcaagaaaaaagtacggatataaccgcctcgaagcagttaagaaagaatcatgggccgatcttctgctcaacatcctgaaagagccgatgctgattcttcttatatgtgtttccttcatttatgtacttacaggggattatggagaggctttattcatgtttgcggctattgttggagttaccgcaatttctttttaccaggataaccggagcaaaaaggcgctggaagaacttgaaaagctcaatgaaccattgagtaaggtgatcagaaattcaaagattatcaatattcccacttttgaaatagctgttggagatttatgcattaccgaagaaggaaatctcatcaatgcagacggaagaattgttcacagcaacgatttttctgtcaacgaatcttcccttacaggagagagcttttctgtttttaaggacagcaaatccgaagacaataaagtttatagcggaacaattacggtttccgggcttgcggtttttgaggtcgaaaatattggaaaagaaactaaagtaggcaaaataggacagtctatactcaacataaaaacagaaatatctcctttacagctccagatccggaactttgtaaagggaatggctgttatcggagttattatctttcttgcagtatgtactttcagctttattaaaacgggagattttgtgaccagtttattgagcggacttacattggcaatgtctgttcttcccgaagaaattcccgtagccttcacaacgtttatggctttgggtgcctggaagctgatgcgggaaggaatcattattaaacgaagcagtattgtagaaacgctgggaagcgtttctgtgatctgtacagataaaacaggtacaattacggaaaactcaatgcagttgaagcatctttatgattaccgttctgacagaacttatgaagaaacagagtttggaacaaaggaactgaatgagcttattgattatgcaatgtggagtagtgagcctgtgccttttgatcccatggaaattacattgcataagatctatgagcagaaccgaaagcctgatcagaggaaagactatcaaatgtttcatgaatacccgctggaaggtaaaccgccgatgatgacccatctttttgaaaacgaacagaaagaccggattattgcggccaaaggagcccccgaagctattatcagtgtttccaatctttcagaagaggaaaaaagtaaaataagaacgttaataaagagtttcggagaaaaaggatacagagttcttggtgttgccagatctcattttgaaggaaatgattttcccgataagcagcaggattttaaatttgactttttaggcttaacagtattttatgatcctcctaaaaaaggaataaaagaagtatttaagcatatctacgatgccggtatccaggtaaaagtcattactggagataatgcggatactaccagagctattgcattgcaggcaggaataaacaacagtaatccacccgttaatggaagtgaaattgcagcatgctcagaagcagatcttatcaagatttctgaagagactactttatttacaaggatgtttccggaagctaagctggaagtggtttcggccttgaaagcacaaggtcacgttgtagcaatgctgggggacggtgtgaatgacggcccggcattaaaagcagctcatattggagtggcaatgggaaataaagggacggaaattgccaaatcagcagctgcactggtcatcaccaatgatgatctggataaactcgtgattggagttgctgcaggaaggagaatttatgccaatataaaaaaagcggtccagtatattatttccattcatattcccattattcttaccgtttctttgcctttgtttctgggttgggtattcccacatatatttaccccggtacatgtgatttttcttgaactggtaatggggcccacatgttctattgtttacgagaatgaacctatggagagaaacgctatgcaaagacctccaagagcacttacagatacttttctgaactggagagagcttaccataagcattattcaggggctcgtcattacagcaggaatattatggttgtatcagtactctgttaaccacggaaatgatgaagctaaaaccagagcattggtgttcactacgcttatattttccaatatactgctgagtctggtgaaccgttctttctattacagcatgctggagagttttaagaaccgaaacgttctgcttgcaggcatttcagtattggttgtacttctcttgctgattattctctatgtatcgcctgtttcgggatttttcagcgtgacagctctcagcataaaagaacttggactggcactgctcactgcttcagtttctgtgctgtggtttgaaatttataaattcataaaaaggctttattttaggaagtaataaatataaaaaatagtaaaaagcataacttcattagaaataattgaacattgcattcctccttacttttggaaaacacctttcaatgattatattaaaaataagcaggggttatttattgataatattaatcatattaagtttttgtattaaaaaaataccacaaataggtaattttgaattaattatttgtatatccataagaaagacatatttttgcacaacacaagatggaattatatttaattccatcttgttaccaaaaactaattgaaaactaattacaccatgaaaaaaactatcctggattttattttattattccatccacattgattgtttccaacaattaaaaacatcatcaaaccctgaaaatttctttggaaatatatgctgtatctatcggtatggcttactgtttatttctgaagcaaaactttcatggagttaagaaaccacgtaaacaaagcggaaccgaaaagctaaacgagtaggaagaatattataaaacttaaacatgaagagaattattttactaaaaagcatgaaaaaactttattttttattattaatttgtatttcattttctgtattggcacaaacgtatacttacacaacgtacaatacctcaaattcggcaataggaagtaattatattgctgacattaaaacagatcccaatggattattgtggctggccacttacaacggtgtttcctcttttaacggaaccgcttttaccaactataatactacgaattccgggattgcatctaatgcaattctaaaaattgaaattgatggccagaacagaaaatggattgcttctcaattcaatgggatcatcctgtacaacggtacagcctggaccaattacaccaccgctaattcggggcttcccagcaatgagattatagatatagcgcttgacgggcaaaataatctttgggttgtaacaccggcaggccttacaaaattcaatggaactacctggacgacttataattcagtatcaaatttaaattcggtagcaactgacagtaataatggggtttgggttacaaacggtggtgtgttatacaaatttaatggtactgattttaattttgtagctcagggaactgaaaagatactgagaattgccaataatacaatttatgtaaaaggctttgatagtttaattactttaacaacaagtggaaccaatgttacttttatttatcaaaataactcctgtctggcaggatataatccaaatgcattagatgttgacactaacagcaaagtatggatagggtttaatggtgcaggcttacaaaattttaccaattgtactacctataccaaaacaaatacaaattcaggcttacctgatgattattttagtgctgtcagaacacaagcttcaggaactatctggctgggaacattgcagcttggtctggtaaaaatgacaccagctgcaaccatttgcaatccacctacccagttgtatacttctaatatcacatctaattctgctactcttaactggctgccttcaacatcggcccctaacggagggtattattatgtgtacagcaccagcccgactatgacagggtcagctactgccagctcttctacaactgcgaatattgccaatttacttcctaacacgacttattattggtggatcactgcaaattgcgttaccagtcagagtacgtgggttccgggaggagcttttactacacttcctgcccagacgggatgctggaaaacagtaagtgcaggatatctacattcattgggaataaaagcggacggaacactttgggcctggggtaataatagcaataatcaattgggagacggaaccaatattaacagaaataacccggtccagataggaacagaaaccaattggaaaaaagtttttgcaggtgagaaatatagtattgctatcaaaacagacggaagcctttgggcatggggaaataaccaattcgggtatttaggagatggaacaactaccaacagaataactcctacaaaaataggaacagctacagactgggaagatattgcagttggaggcaatcataatttaggtctgaaatcaaatggaacgctttgggcctggggaatgaatatatacggaggtctgggagacgggactactactgataaacttgtacctgttcaaatagggacagccaattggaaaagtattgctgccggtagtttttattcagtggcagtaaagacagacggtacattatgggcctgggggtacaatgggcatggacaattgggcgatggtactttaactaaccgtattgtgcctaaacagattggtaccggtaccgattgggcagatgtggttacagggaactcacatactgtagcaagaaaaacaaacgggcttatttatacgtggggcttcaacgaatccggtcagctggctgatggaactaccgctaatagatctacaccttacttagccgctgatggaattcaaaaagttattgcaggaagcttcaataccatggccattacaatgtccggcaccgtgattgcctgtggaaataataccaccggatcttttggaaataatacttctgtaagctcttcaaactgggtgagcctgggtgccaatacgcctataatcctttctacaggaggatggcataccttatctgtaaataatgacggtatcttaaaagtatccggagctaataactatggccagataggcgatggtacgaacgttcaaaaacttgcatttacccagctcacatgtcctgtaagtaatttagcagttgaagaaatttcgatagcatccgaaaatctgaaagttttcccgaatcctgttcttgatcatctcaacgtttcatccgataaaaatatcctgtctgtagcggtttacaatgcagccggccaacaggttctttttgatgatatcaatagtaataaaggaacagttgatttttctgctttaacgtcaggagtgtatatggtaaaagtaaatactggccataatactgtaaaaacggtaaaagtaatcaaacgttaaaagtataatgtaaagtagtaatttaataaactttagttttgttttcacacaactaaaaactaaaataccctgctataatagcagggtatttgttttgactcaaacctcacttttttacacgttgtgatctgccttctacattatgggcgctgtcagatactgctgcattgatattgcctgtggcattccctgtattattattgctggtttttcttcctccaatgtggttttttgtattaatactgtcctgacttgttgggccgcttttcagagtatctgaagctgctgaaaccgctgtatcagaataattgctgtgggtattggcggaatcattaacatagttactgttttccgtattgttttttttgcaggccagcatagtaaaacttatggctgccattgataagattaaatttttcataggatattttgtaatgagttattggctcttgaggtgaatcaaatttcgatatttagccgatgcaatcatatgagtatggtcataataagagtatagctatccggaaattcaaaaatttataatatccggtctttgatcaaactcattttgatatatcttttactttgaagcgcaacgaaaatatagattgaaaattcattcgtttaatccgctgtttacgaagacttcaaatatctggtatttctgcttttcaaattcttcatttcgtaattctttatggttagcgtatgaaaaatggtgaataaagatctgtttttgatggcaatttattaatgaaaagtgtgttttttacattttttttttaagcaaaatgaaaaaaaaaattattcttcttatcataatatttattctgaaaattcaaattttttttgaagctgattatgattgcaattaattgtgaattcatatcttatgaaaatactaagtgtaaaattaatgataaccttatcataatttttatacaattgatatcataaaaaatcgatatgtaatgcattgataagcagtagataatgacggatttattttttttattcagatgaatttttatatttgtaatgttaccaaaatgttaacaaactaatgaatcagaactttattcatacctatgtctctgtagattgtgttgtatttggatttgaccatgaaaaccggttgaatatcttattagtacaacgccatgttgatgatatcccattggaaaaacaacgaaaactgccgggaagcctcatctttagcgatgaagatgtagatgacgctgcacaaagggtacttcatgagcttacgggaataaagaaaatggttcttaaacagttccgatgctttgctgatcctatgagagcaagcaacgtacatgatataaaatggatggataaggaatataagcatcatatagacaggatcatcacagtggcttatctttccctttgcaaaatagaccataagatcaacagtacgaagtatgataccgtagactggtatcctattgatgaggtgccggtattgccgttcgatcataacaaaattatcaatgaatcccttattgagatcagaaaatggattgaatctgatttctccattattttcgagctgctgccgaaaagatttaccataagacagctttatcagctatacagtgctttaagcgaaaaaaatatcgatataaagaattttcataagaaaatatcttcgttcccctatattgttcctttggatgaaatccaaaaagatgtatcacaccgtgccgcaagatattacaggtttgatgccaagatttacaagaaaaacaatacaaaacttataaaataatctttttttaaatattatgtacttactaggctatgacattggcagttcttctgtgaaagtttgtctcatcgaggcatccagtggaaaggtgattgcttctgaattttctcccaaaaaagaaatgaaaatcactgctataaatccgggatgggcagagcaaaatccagttgactggtggatcaatctgaagttggcccacgaagctgtcatgcatgaatctggagtacatgctgaagatatcaaaggaatcggaattacctggcagatgcatgggttaattctggtagacaaagatcagaatcttttaagaccatccattatctggtgtgacagccgcgctgtgccttatggtgagcatgctttcaagaccataggcgaagaaaaatgtctttctcatctgttgaattcgccggggaactttacagcatcaaagcttgcatgggtaaaagaaaatgagcccgaaatttttgaaaagatagacaaaataatgcttcccggagactatattgccatgagactctccggccagataggaatgacgattgaaggattatcagaagggattttctgggattttaagaacaactgcatctcggaagatattattaaccattatggaattcccaaaagttttttcccggaaattgtgcctacatttggtattcaggcaacagtttcaagggcagcagcggaagaattaggattgaaagaaggtactcctatttcctacagggctggagaccaacccaacaatgcgctttccctgaatgttttcaatccgggagaaattgcctctacagcaggaacttcaggggtggtatacggagttctggaccagctggaatatgataaactatcaagggtaaatacatttgcccatgtcaattatactccggaacagatcagacttggggttttgctgtgtatcaacggaaccggtattttaaattcgtggctgaagcacaattttgcaacctcactttcttcttatggagatatgaacgatatggcttcactttcaccaattggttcaaaaggattaagcattatcccttttggaaacggagccgaaagagtgctggaaaataaagatacaagctgttctattcacggaattaatttcaacatacatacaaaaggagatatactgcgtgcggcgcaggaaggtattgtattctcttatgaatacggaatggatatcatgagaaatataggaatggatatccaggtcatccgtgcaggaaatgccaacatgtttttaagttcaatttttcgccagtcgctatccagtgtaagcaatgcggtcattgaactttatgataccgatggagcggtaggagcagcaagagctgccggaatgggaataggattttattcagattcccgggaagcattttcttcacttgaacagatagcggtgatagagcctgaacacgaaaaacgagaacaatatttagaagcctatggcagatggaaacatcatcttaacgaaataatctaggaccattacaacagtatttttcatcctcttactgactcttaagaaccagtgagaaggggatctctacgcaaaaaattaaaaataaataaaaaataatcaaataaatatgaacactttaacaggtacaaaagagttttttacgggtattgaaaaaattaagtttgaagggaaggagagcaggaacccgttggcattccgctattatgatgcggaaaagatcgtgatgggaaaacctatgaaagactggacaagatttgcgatggcttggtggcacaccttatgtgcaaacggaagtgatccgttcgggggacctaccatccaccacccatgggatatcggaaatgatccggtaacaagagcaatgcacaaaatggatgcaggttttgaattcatgtctaaaatgggcttcaactattactgctttcatgatattgatcttgtagacccagccagcaactggaaagactacgagaagaatatgcagactatcgtggaatacgccaaacaaaagcaacaggaaacaggcattaagcttttatggggaacagcgaatgttttcacgcatgaaagatacatgaacggtgcttctacaaacccaaattttgatgttgtggcatgcgcaggaacgcaggtgaaaaactcaatagatgctacgatagcacttggtggtgaaaattatgttttctggggcggaagagaaggatatatgagccttttgaataccgatatgaagcgtgaaaaagatcatcttgcacgtttcctttctatgtcgagagactatgcacgtcagcagggctttaaaggaactttcctgattgaacccaaaccaatggagcctaccaaacatcagtacgattatgattctgaaacagtaatcggattcctgagacattatggattagacaaagatttcaaactaaatatcgaagtaaaccatgctacattggcaggtcacacattcgagcatgaacttcaggtagctgttgatgcaggacttttaggaagcattgatgccaacaggggagattatcagaacggatgggatacagaccagttcccgatcgattactacgacatggttcaggcttggctggtattacttccggcaggaggtctgggaacaggaggggtgaattttgatgccaaaatcagaagaaattccattgatgctgaagatttattcatttcccatatttcagggatggatgtatttgcaaaaggtcttcttgcagcggctgatatccttgaaaattcagattacaaaaaactgagaacagaccgttatgcttcttttgataacggaaacggaaaagcatttgaagaaggctcgcttacactggaagatctgcagagaatcgctcacgaaatcggcgaaccacagccaaaaagcggaaaacaggaattgtttgaagccatcgtgaatatgtatatataataaaaaataaaaggcttataaacactaaggatttttatacacaataattattaaagagccttttattcaacaactaatactaaaataataattatgaaccgattttatttcaataaaagcaatagagccgcattattctttgcaatgactttattgccttccggcatagcatattcacaggttaagaaagatacagtagctaaagaaaataaaatagatgaagttgttgtgataggatatggaacccagagaaaagaagctgtaacaggttctgtagccactgtaaaaggagatgccctgcgtgaagtaccctctgccaacattacccaggcattacagggaagaacggcaggggtagatatctctcaaagttccactaagccgggtgctgccatgcagatccgtatcaggggaacaagatccctgacaggagataataacccgttgattgtactggatggtattcctttcgtgggatcgctgggagacataagctcaagtgatatcaaaagtattgacatcctgaaagatgcctccgctacagccatctacgggtcaagaggagctaacggtgttattctcgttaccaccaacagaggagcaaaagggcagaaacctaaatttacctataacacctttacaggagttcagactttattttcaaaatatccgatgatggatggacctcagtttgcaaagctgcgtgcttatgccattcctgcaggaaatacaacccctttgtattcaaacggagctgatgaaaataacagcgtcaatacggactggcaaagcctgttttataagccggcgatgatgaccagccatgatgtaggggtttccggaggaacagaaggtggaaattacaatgtaggattatcctattttaaacaaaatgcattaattcctgttcagagttatgaaagatttgctctgagaatggccattgaccagcaggtaggatctgtctttaagtttggttttacaaccaatacaaactattccgtttcggaaggaaacggagtaaacccgggtgcggttctgggatattctcctattgccgatccttacaatgcggacggaagcccgaaaagagtaatgagtaccgcaggaggtattgatcagacatggatttataccagaagaagcttagagagcctggcagacaaatatattgatgaaaccaaagcttttgcatcctataataacctttacggagaagccagccttcccctcaaaggattgaaatacaggttaaatgtagggttggatttccgtacctcaaatagcggaaactacagtggtgtaggagtcttcaatacaaaccctctgggtccgtcagcggcaggaaaagggaataaccagacttatcactgggtattggaaaacctcctgacgtacgaccgtacattcggaaaacataagatcaacgctgtagcattatactccgcggaacagaataaatatacaagctcatacatgagtgcaaaaaatgtccctgcagactttttccagtattataacctgggacagtcgcctcaggcagacattacggtaagacctgaagaccaggtgtattcgaaaaccgggttgctttctgctatgggaagaatcatgtatacctatgataacaagtatatgcttacagcaacgcttcgtgctgacggatcttccagactggcaccgggtaacaaatggcatacatatcctgcattatcattgggatggaatgttaccaacgaatccttcatgcagaatatcaaagccattaatctccttaaattcagagcaggatgggggcagacctccaatcaggcagtagatccttacactacgatgggaagatttaatgtcgctccttataattatggacttgcaggaagtacagggatttacggaagccagccgccaaacccgaatttaggatgggaatattcaaaaacacaaaactacggggtagatttcggaatcctgaacaaccgccttacgggaagtgtggaatattacaaaacccatacctatgacctgctgacacagaaaagtcttccggcatcaagcggttggtcatccattgtttccaatgtggcagaaacagaaaataagggattggaagtttccttaaacggggttatttttgataatcctgatggatttacgtgggaagcaggagttaatttttacaccaataaaaacaaaattttatcgcttgcatccggaacagaacgtgacatcaataatttatggttcgtagggcataatattaattcattgtatgactatcaatacatcggtctttggcaggctggtgacccttatcagagtattctggagccgggaactgcagcggacgttgtaggatctatcaaggttctttacaccggcggttataatgctgacggaactccggtaagagcaataggaccggatgacagacagatttttgatacagctccgaaattccagggaggatttaatatgcgttttgcctacaagaattttgaactaagtacagtaggagctttccagcacggaggaatcctggtaagtacgatttacggatctgcaagttatcttaacagattaacgggaagagggaacaacgtggatgtggattactggaccgaagataatacaggagcttattttcctcgccctggacgtcatttgagtggtgacaatccgaagtactcttctacattagcgatgtttgatgcttcttatcttaagcttcgtaccattacattaggctataatgtcaataaagattttttaaaggatctgaaaattaccagcttaagaatttacttcaccgtaaccaatcctgtagtcttattctctccttatcataagttctcaggaatggatccggaaccaaactctttcggaaatgaaaaccaggcagtaagcggatatccaaaccgtcagcttgttataggagctaacaacccttccacaagaaattacttaatgggacttaacttaaccttttaaaactgtactgtcatgataaattttaacaaaaaactgctattaggagcaatctttttatccttaacatttacaggttgtagtgaaattcttgatgagcagccaagagcaatctatacagctgactattttaacacaccggacggggttaatcagggatttacagctttatacagacagatgagattactgtatggcaatggctactttatgagcaattgtcagaacggaactgacgaatctacctgggcacaaagtgcggacggtaactttaaggaattagatatgtccggaaacgggattatcaattccaatacttttcctacaagtatggtctggaactctgtattcccgtatatcaatactgctaacggaattattgaaaaaggaccaggattcggaattgcagaatctatgatctctgaagcccgtttcttccgtggattttattacttcatgctcgttcagacctatggaggagttcctctggatttaggagcaggagaattgaaatataacactttaccttccacctcttcagcaagaaatacggtaccggaagtgtacacaaaaacagtttttgctgaccttaaaaaagcaatagaaaacctgcctgcctcaccaagggtaacaggaggtgtcactaaaaatgtagcaagactgatgcttgccaaagcttatcttacttatggatggtggctgcagaatccaaacggcattccaacttatcccgaagtggcaagaactgatcctgacggacacaatgcccagtggtatttccagcaggcttatgatatcgctatggaaggaatcaacaatcccggaccttacgcgcttcagcctaccttttatgatgtcaatgtaggttcaaatgacaggaataccgaatccatgctttatgcagaccatacacagtcaagtacttattataacgaaagcgaccctgtaggatttggttcaggctgggctccggacaattttgcagcatggatgcagacctggaactatactgccatcaaaagtagtaaaacaacagcatgggtgggagcagacgtagtaagttcagtacagagagaagcagcacagtcactgggacgtccttgggttcgtatgtgtcctactttaggggttattaaaaatactttcgcagataaaaccaacgattcccgttatgatggaacctttgtaaccacgtacagagggaactggaacaagaatggaacaggtcttacaacggttcctgtactgtataacgccaataatttaccggtacagccgggaggagctatcttaagcttcctaaatgatgacagccagatgccttcttaccctacaggatccggacaaagcggtgtaggagcaggaacccttccgggaagagcagactgggttattgcaccgaacggaatcagcagaattgtatatcctggattatggaaaataggaacttaccgtaccgatgatccgaacggtttaggatatccgaatgccggattaacgcgtcctttcagcgttgccaaattctcagaattctattttattgccgcagaagcagccgtaaaaggtgctgcaggatctatgacagccagagaccttatcaatgtgatccgtgcccgtgccggaaagtggaagtttaataatgcccagaataccgcttatgtagcagataacagcgctgcaatgacagcggccacacctgccgtaattaccattgattatatccttgcagaaagatcccgtgaatattacggagaattctacagatggtatgatctggtacgtacacagaagtggggagattatgcggctacctatcagatcggaggagcttcttatggagatcactctccgcaaacagttacaagaaacatcaaaccttttcactatctgaggccaattcctcagagtcagattgatgcgatggaagtatcggcagatattaaggcgaaataccagaatcccggatacaattaatttcattctacattcatatcagcaacagagtaggtgtgaaaacacctgctttgtttatctgaattaaaactttacattatggaaaaaacctggcgttggtttggaaaaaaagacaaaatagaactgagcacgcttcgtcaaataggagtagaaggaattgtttctgcactgcatgatatcccaaacggagaaatctggaatccggaggccatcaatgattataaaaactatatagaaagccacggacttcgctggtctgttgttgaaagtcttcctgtgagtgaagcgatcaaatacggaggggaagaccgtgactctttaatagaaaattatatcacgagccttgaaaatctgggtaaagcaggagttacaacagtttgctacaactttatgcccgttctcgactgggcacgcaccgatctttttcacgaatgggaagacggttcttcatcactttattttgacaaggccaagtttgcgtacttcgaaattcatatccttcaaagagaaggggcagaaaacgactataacccggagatccttcagaaggtagaagaattaaaaaataccttaacggagaaagataataatgacctgatagattctgttattgtaaaaacacagggattcgtgaacggaaatatcaaagaaggtgaaataaatcctgtggaaaagttcaaaagtctgttggctttgtacgatggtacagataagcgtcagcttcgtcagaacatgaaatatttccttgaaaaaataatgcctgtctgtgaaaaatggaatatccagatgtgtgtacaccctgatgatcctccgttttcattattgggcttaccaagaatagtaaccaatgaagaagatatcgactggcttcttaaagctgttgataaccctcacaacggattgactttctgtgcgggttctttaagtgctaatcttcagaatgatgttcccaagctggctcagaaatttgcccaccggacaaaattcgttcacctgagaagtaccaatgtctttgaaaatggtgacttcatcgaggcccatcacctgggaggaagaggaaaactcatcgatgtgatccgtgtattcgaaaaagaaaaccctgatcttccgatgagaattgatcacggaaaacttttaacagaagatattgacaaagggtataaccccggctattcattcttaggaagaatgctggcgttaggccagatagaaggagtaatggctgccgttcagtcagaattacagaaaaattaatctgcgtttgtaataaaatagtaaaaagtaaaatgaaagacctgtttagtattaaaaacaaagtagcagtcatcacaggggcttcgggcgttttgggaggcagccttgccaaaagttttatagaggccggtgccaaagttgtggctctgggaagaaaccaggaaacactagatgcacgtgtaatagagcttacagatctgggaggcgaggcactcgctgtagaagccaatgtgatggatattgaaagccttgaagctgcttctgtgaaaataaaggaaaagtatggccgtattgatattctgctcaatatagccggtggaaatattccgtcagcaaccttatcacccgaacagtcatttttcgatatggatatgaaaggatgggcagaagttaccgatcttaatatcaacggaaccgtttacccgagctatgttttcggaaaagtaatggctgagcagggaagcgggaacattattaatatttcttccatggctgcttattcagcgattacaagagtggccggatattctgccgccaaatcggcaatcaccaattttacccaatggctggcctctgaccttgcattgaaattcggagataagatacgcgttaatgccgtggcaccagggtttttcattggagatcagaaccgtgctattctgttgaatccggatggaagcttaacggaaagaagtaaaaaagtaatggcgaaaacacccatgcagagatttggagaagtagaagagctgaacggggttgtacagtttctgtgttcagatgccgcaagttttatcacaggagcactgattcctgttgacggaggtttcagcgcattcagcggagtataaaaactaatttcttcatatcatcaaacagaaccttagtggtttcattaagggttctgtttttaaatgtagacatctaagtgttgtgaaaatctttgattttcatcttatgtgaacttttctgcatagtcataattgaaatgttctaaaaataaagcttttgtgcttttgcagggtttaaacaagttaattaaaatccaggattgtaaaaataaataatgagtaattccattaaaaataaagacgttttcggagaactgtttctgcttgaatcggcaaaggcagaaaatctgtatttcgggtatgccaaagacatgccggtgatcgattatcacaatcatctggagccggatgttatttctgctaatcagaacttccgttctccaaacgctatctggctggatggtgaccactacaaatggagagccatgagaaattttggtattgatgaacagtttatttccggaaatgcttcagatcaggaaaaattcaggaaatgggctgaggtagtaccttatacccttcgtaaccccttatttcactggacccatctggaactgaaaaacccttttggaatcagtgaatatttatcacccaataatgcagatacggtgtatcatcagatgaatgaaagtcttcagacacctggttttttaccacaatccattattgaaaattttaaggtagaagccttatgtactacagatgatcctgctgatgatctggttcatcataaagctttaaaaaacagtgggtttaaaacagctgttcttccggctttccgccctgatgcctatatcaatatgattaatcctgaacagtatctttcaggaattaaaaagcttgaaaaaatctgtggattttcgatcacatcagtttctgatctgttgaatgcacttcagtccagaatcaactatttcgtggaagcaggggctatagtggctgaccacggctttgaatatttcccggatactacaaaatggaatcatagccttgaaaaagagttttccgaatttctaaagggcaatctctcaacattttccgatccggatgcattgtgcggctacttgctgaaagagctttgtaaaatgtatgcagaaaaaggctgggtacagcagtttcatgtaggggcaacccggaataacaattcagaaatgttcaggaaaatgggtgccaatgcagggtatgatgccattggagaatcgtattacgcacagagattgagcgttttgcttgatgagctgaatacagaaggaaagctgaccaaaactattatttacaatctgaatccggcatttaatgaagttctggcaactcttgccggaaactttaatgaaggaggcatcaaatccaaagtacagtttggagcggcctggtggtttctcgatcagcttgacgggatgaccaaacagatgaacacactttccaatatcggtctgatcagcacttttgtcggcatgttgaccgattcccgaagcctgctgtcattctcaagacacgattatttcagaagacttttatgcaatatgttcggaagcgaaatggaaagaggacttcttcccgatgacgaaaaatgggtaggaaagatcattcaggatatctgttatcataatacaaaaaactattttgaaatctaataccatgcaggattcagcaaaaatactatgtttcggggaactgcttcttcactttgccccggattccgaaggaaattggctcaatgaacagtctcttaagatgtatataggcggtgctgaatacaatgtagcagctgcactttcccagtggaagaattctgtgaagctgttatcagcattaccggagaattttgtaggaaatcacctcgaactacagcttaaaaataaaggaatagaagtccttgcagaaaagaacaagggaagaataggaacattttatctttcttccgatggagatatgcagaatgcttcggtggtgtacgatcgctttccgtctgtttttacccaatcggattttgaaactttcagtgatgatgaactattttcagaggtaaaatggctgcatatcagcaccatcacgccggcattgagtgacaatgcattcggcaaatgtctgcaaatcatgaaggaagccagaacaagaaatattacggtttcccttgacctgaattacagggcattgctttggcaaaaccagaatcctcacaaaattaaagagctgatgccttttgtgaatgttctcatgggaaatatctggtctgtcgggcagttcctggatattccagttgaatatgagcttaacggaaaatttgatgatgaaaatcttctgaaacaagccgaaaaaacagcattggaaatcaggagacgattcccggaggtggaaaaaattgcaaatactttccgctttacaaacggagaacaggtgaattactttgccaccttatttactgatgaacagcttttgatttcagaaaaatataattcagataccattgaagaaagagtaggaagcggtgattctttcatggccgctttgattcatggaattttaaaaggaaatcctgatcagcagatcctggaagatgcgacaaaagttgcttttaaaaagcttttcgtaaaaggagataccattgatgaaagcattaatatcgaaacattatgagtgaaatagtacaaaaaataaaagaccagaaaatcgttccgttgttttataacgaatcgtttgaagtctcaaaaaatatcgtaaaagctttatacgcagcaggaatccgtgtgatagaatataccaaccgcggccatcaggcactggaaaatttcactaaactgaaagaaatttcccatacagaatttcctgatcttctgttaggaatcggaacggtgaaaaacatagaggaaatggaagattatactaacgtaaaagcagatttcatcattacaccagtgatcagtgaagcattggtaaaacatgctctcgaaaaaaatgtcctcttgattcctggttgttttaccccttccgatatcaatatcgcacatcagaatgggttaacactggttaaaatatttccggctgatgctttaggaaagaactatattaaatcggtacagcctgtttttccgggaatgaattttatgccaaccggaggaatccatgctgaaactgaagatatcagggaatggctcaatggaggtgccatagcagcagggttgggaagctctctcatcggaaaagatagtaatgaagaagaactgacgctgaaaacaaaagaattattacaacaacttaatcaataactcaatgcaggctcctcaaaaccgcaatataagatggtggatgctgtcccttgtcttcctcgccactacgatcaattatcttgaccgtcaggtaatgggtttgctgaaacctgtgctggaaaaagaattcagctgggatgaaaaagattacagctatatcgtcatggcctttaccacgacatatgccatcggttatatggcgatgggaaggtttatagacaaggtgggaaccaaaatcggatatgcggtttcccttattgtatggagtttggcctcaataggacatggtcttgtaaaaagtaccatcgggtttatcattgcgagaagcacgttgggaatcagtgaagcaggaaactttcctgccgccatcaaatcagtggctgaatggtttcccaaaaaagaaagagcattggcaacgggaatttttaactcaggagcaacggtgggagctattttagcaccgttattggttccgttcattctcggacattacggctggagacagacttttgtatggattggcgctttgggtatggtttggattgtcctttggtggaaattttatgctgtaccggaaaaaacaaaaaatatcagcaaggaagaactgcagtatataaaaagcgatcaggctgaaaaagttgaagagaaaaccaaaattcctttatcggaattactcagatataaagtaacctggtcatttgccatcggtaaaatgttaaccgatcctatctggtatttcttcatgttctggctgccggcgtatttctcggatgtattcaaaatggatttaacaaaaccatcccttccattgattattatttacagcggaaccacgatcggaagtattggtggaggatatctttcatcatttctgatcaaaaaaggctgggccatcggaagagccagaagcattacgatgttattgtttgcattgatggtggttccggtcatgttttcaaaatatgtagataatatgtggattattacgatcattattgcctttgcaacagccgcacaccagggatggggagccaatcttatgaccacggtcggagaccagttacctaacagctatgtaagttctgttattggttttggcgggatgctcggttcagcggcaggaattatttttccgttgttcatcgggattgttttggatacattcaaaaaggcaggaaacgtcaatggcggttacaatattattttctttatcgcgggaatttcatatgttgcagcctggggactcatttcgttgattaaaagaaagaaaacagcttaatataaaagtaatacagtttgaaatttaaaaaataaaaatgaaatccgggctttacataaccacaggtcttctgatcagtatattttcctttgcccagaaaggaggaaagtataagctgtggtatgataaacctgcaaaacaatgggtggaagctttgccggtaggaaacggaaatatggcagctatggtctatggagacccctatcaggaaaagcttcagctgaacgaaggcacattctggtccggaggcccttcccgaaatgataatccggatgctccaaaagtcctggattctatccggtattatttatttaacggaaactataaaagagcccagattcttgcggataaaggattaacagctaaaacagttcacggttcggcatttcagaatattggtgattttacactggatatggataacctcaaggatatcagaaattattacagagaactggacattgaaaaagcaatcgcaaccactacatttacctctggtggtattaattttaaaagagaagtttttgcctccattcctgatcatgtgattgtcattaaattgagctcagatcacaagaatgcactgaactttacagcgaaatttaatagagagcttaaaaagaacatcaaagctattgatgccactactttacagatggatggggtttcttccacattagacgacattcaagggcaggtgaaattcaatgcactggcaaaactcatgaccaaaggtggtaaaacccagatttcaaagagcggaatttcagtaagcaatgctcatgaggtcatgattcttatttccatagccactaattttacagactataaaaatttaaatacagacgaaattgtaaaaagcaagaaatatattgaagcagcagcgcataaaaatttcaaaactttagttcaaaaccatctgagtgcttatcagaactatttcaaaagagtagatctgaatttaggaacttccgaagcagcaaaaaatcctacagatgtccgtattaaaaattttgcgacgggctatgacccggagcttatttcattatattatcagttcgggcgttatctcctgatttcttcctctcaaccgggtggccagcctgcaaatctgcaggggatctggaacaattccaataaaccggcctgggacagcaagtataccattaatatcaatacggaaatgaattactggccggctgaaaagaccaatcttcctgaaatgcatgaaccattgatccggatgataaaagatttgagcgaaacaggaagagaaacggcaaaaacaatgtacaacagccgtggttgggtagcacatcataataccgatatctggagaataacaggcgtcgtggattttgctaatgccggaatgtggccgatgggcggagcctggctttcacagcatttgtgggaaaaatatttatacagcggagacaaaaactatctgcgaaccatttatcctgttctgaaatctgcagcacagttctatgaaaattttttgattgaagagcctgcgcatcactggctggtggcaagcccgtcaatgtcacccgaaaatattccgcagggacaccagggaagtgctctggcggcgggaaatacaatggacaatcaattgatgttcgatttgttcaccaaaacaaaaaaggcggcacagattctcaatacagattcagataaaattcaggtctggaatactattatttcaaaattaccaccgatgaaaatcggaagctacggacaattgcaggaatggatggaagacctggacgatcctaaagacaaccacagacatatttcccatttgtacggattatttccttccaaccagatcagtccgtttaccacgccggaattgctggacgcctccagaaccgtactcgttcaccgtggtgatgtatccacaggctggtcaatgggctggaaagtcaatctctgggctaagttattagatggaaatcacgctaataaattaatcaaagatcagttaacactggtagaaaaagacggttggggcagcaaaggcggaacgtatccgaatcttttcgatgcacatccgccattccagattgatggaaattttggctgtacttccgggattaccgaaatgcttctgcagactcaaaatggttttatagacattcttcccgcacttccggatgagtggaaaaacggcagcatttccgggctgaaggcgtatggaggctttgaagtcagcgtgatctgggaaaacaacaaagctaaagaaatcaccataaaatccggattgggaggaaactgcagaataaggcttccgaatggaatgcagctttccggaaatgcaaaactgaaaaaggcagaaggtaaaaacccgaattctttatttgaaattccggaaactccaaaaccactaatttctgacaaggcaaaattgaatcctgttgaaattaaaactgatcttatctatgatttcccgactgaagcagggaaggtgtatacattaagatggagtgataaaagctttgaaggaacaatttaaaattaaatctattacaataaaaactaaaaaatctatatatgaaaaagagtctaatgaatcctgtttttttaagaaataaaaccaatgtcattgcagtggcagcactactttccatcagtaacctctctgcacagactttttccaacttcaactaccgtggaaacgataaaatatataatgacaaccctcttaagccggacgagttctattccccgattttacagggctgctatcccgaccccagcattaccaaaaaaggtgatgattattacctggtaaactcttctttctcaatgtttccgggcgttccgattttcacttccaaggatttggtcaattggaaacaggttggacacgttctcgacagaccttctcaacttaaggtggaaaaaggaggtgtttctcatggaatttatgcgcctgatatcaaatacaataaacacaacgatacattttatatgatcactacccagattgcgggcggtatcggaaatatggtcgtaaaaaccaaagatccggcaaaaggctggagtgaagtccaaaaattgaattttgacggtattgatcctgccattttctttgatgatgacggaaaagcttacatcgttcacaacgacgcgccaccacaaggaaccgagcagtatcaaggtcaccgcgttattaaaatgtgggattacgaccttgaaaaagatcaggttgttgcaggttcagacagaattatcgtaaacggtggggttgacctttctcaaaaaccaatttggattgaaggtccgcatttgtacaaatacaaagggaaatattacctgatgtgtgcagaaggcggaaccggaggcaaccatagcgaagtgatttttatggcagattctccgaaaggaccgtttgttcccgctaaaaataatccaattcttacgcaaagatattttccgaaagacagaaaagaaaaagtagattgggcaggtcacgcagatttggtggaaggtccgaacggacaatggtatggcgtatttttagcaattcgtccgaatgtaaacaaccgtgttaccaaaggccgtgaaactttcattcttcctgtagattggagcggaacgtatcctgtattccaaaatggcctggttccgatgagaccaaaattgaaaatgccgcaaggcgttcagaatcaaaccgggcaaaacggatttttcccgaacggcaactttacatacaacgataaactaaccgataaaaacctcgatttccgatggattgcgatgcgcggaccgcgtgaaaacttcattactgcaacaaaaaatggtgtaaaagtgaacccaatggaaacgaatatcaaagcgttggctccgatttcatctttgtttcacagattacagcacgaagattttgaaacttccgtaaccttagattataaaccaaaatcggaaaaagaattggctggaattaccctctaccaaagcgaaacattcaattacgtttttggaattaccaaaaaagataaagatttctatatcgtattggaaagaacagaaaaaggacagtcaaaattgattgcaagcgaaaaaatttcactttcaaagagtatcaaatttcaggctacaggagaaaaagatgaaatcagcttcaattattctttggacggcaaaaatttcaaaaatctgggaggaccggtttcaggagatatactttctactgatgtagcgggaggttttacggggagtcttatcggactgtacagcacctcttccaatgatattgtaccgaattaagttagtattagcaatgtcacactgagcttgtcgaagtgttacttttaagactgaaaagaatcaaatcgaaccaaaatatcaaaaccttgaaaatcaaaaaatcttatatagtttctttattgggatttatcgggctgaatcttctttcagcccaggtaaatccttccggaaaacagagtaccgcatttaccaatcccatcatttgggcagatgcaccggatttatccattaccagaaacggaaatgatttttacctgatcagtaccaccatgcatctgatgcccggagctccggtaatgcattccagggatctggtacattgggaaatgtccgggtatgtttttgacactttgaatgacaactcaaaatatgatttattgaacggaaccgtttacggcaggggccaatgggcttcatcaattcgctaccataaagggaaatattatgttttgttttctccgaatgatgaacctttcaaatcttatttctatgtaactgatcatcccgaaaagggaaaatggaaactcattaccagaacaaggcattttcatgatgcgtctttgttttttgatgatgacaggatatacgtttttacttccaacaaagtttttgaactaagtcctgattttaaagaagtgatcggaaatccggatggaactgaggtatttcagaaagatgcttcggaaaccggacttctggaaggtaatcagatcatcaaaagaaacggaaaatattatatgatgatgatatcatggccaagaaacgggaaacgccgtcaggtagtctacagggcagataaagtaacaggtccttacgagaaaaaagtaattctggaagataattttttaggattttcctatgcagggcaaggcgctttgatagatgataaaaacggaaactggtattcccttattttccaggacagaaacggagtgggacgcgttccgctgctgctgcctgttcaatgggaaaacgactggccgatattgggagataacggaaaagttcctttgaaaggagaagttccgcttccgccgttcaaacccaaaaatcatctggtggaaagtgatgagttctctgataaaacaatgaaaatccagtggcaatggaatcataatccggtgaatgaagcgtggtctttatctgaaaaaaaaggctgtctgagactgaagaccagcagagtggtagacaatctgtacgcggctcccaatactttgacccagagaatggagggtccgacttcttcagcagttgtcgcaatggaccttaaaggaatgaaagatggtgacgttgcgggtttcagtgccttcaacggggattccgggattttgtcagtagtaaaggaaggtgaagaaaaattcattgttttttcaaccaacgaagtgagcctggataataaaacaaaagccattacaggggttaaaaaagaagaaaaaaaacggattcctcttaattctgataaaattttcctccgtatcgatgctgattttaacctagggaaagatcttgcagacttttattacagtacggatcagaagaactggacggaaatggcaaaagattacaaaatgatctttgattaccgtagattttttatgggatcaaaattcgcaattttcaattatgccactaaaaataccggaggcttcgtagatgtggattttttcagagtcagtgaagccggaaaataagaatcaaaagcagagaaaaatctgttgtaaacagtaagtaaaatatacgctattattttttttatctgaaataataagtgtgaaaaatacaaataaaaatcatgaataaatcagttatatgggctttaggatttgttttgtcgggaatatttgtttccgcacaaacttttgatcaacaggcaccgcagggtttcgatgtggaaaatgctgctgcttcccacgggaaaattgacacgattcaatatcaatcgaaaactgttggaacaacaagaaaagctttggtttacacaccaccgggattcaaaaaaagtgaaaaatatcccgttctttatcttcttcacggcatcggcggggatgaaaaagagtggttcaatcagggaaaacccaatattattctggacaatctgtatgcacagggaaaacttcagccgatgattgttgtacttcccaacggccgtgcgatgaaggatgacagagcgacaggaaatataatggctcaggataaagtggaagcttttgcaacttttgaaaaagatctgctgaatgacctgattccgtttgtagagaaaaaatatccggttaaaaaagaccgtgaaaaccgtgctttggcagggttgtcaatgggaggcggacagacacagaattttgctttcggaaacattgataagtttgcctggctgggcgcattttcttctgcacccaatacaaaagagcccaataagcttttacccaatccacaggatgcgttaaagatgaagctgatttttatttcctgcggtgatgcagacgggctgatgcctttcagcaagagaaccagtgattatctgagaaaaaataaaatccctcatatcttttatatagaaccgggcggccatgattttaaggtttggaaaaatgatttatacatcttttcacagctgttgtttaagcctgttgacaaaactaagtttgaaggatttaccgttttgggaactcccgcagcaactaatataagaaatgcccaatatcctcaaatccttcccgacggaagagtaatgttcaaagtgaaggcaccggaagcgcaaaaagttcagatcgatttagggaaaaaatatgacctgaaaaaagatgctgacggcttctggacaggtacaactgatccgcaaagcggaagcttccattattattccctgctgattgacggggttgcggttgctgacccgtccagtgagacattctacggaatgggaaggtatgccagtggaatagatattcctttcgaaggagatgatttctatgcattaaaagacgtccctcatggagatatccgtattaaaaatttctattccaaagtcactaactcatggagaagagtttttatttacaccccgccgggttacgaccagaatcctgctgaatcttatcctgcactgtatattttacatggcggaggtgaagatgaaagcggctgggccaatcagggcaaaaccaatctgattctggataatctgatcgcagaaggaaaggcaaaaaaaatgatcattattatgccggatgccaatattggacagggcggaatccggaactttggagagcgcaatcttcagatgtttgaaaaagagctgaaagaatccatcattccgtttgccgaatctaattacaaaataaaaaaaggtaaagaaaaccgtgcgttggcaggactttccatgggtggaatttatacactgtatgccggaattcagaattctgatatgttttccggtttgggagttttcagttcaggatatatgctgccgatgctccaggatgttgccaataaacagtaccaatttttaaatgaaaataaatctgctttttcatccaacatcagaaatttctggatttcaatgggtggaaaagatgatattgcttatgaaaacggtcagaaaatgttgaaagaactggataaaaccggaattaaatatacgtacacagattatccgggaggccatacatggccggtttggagaaatagtctgcatcagtttgcccaggtactttttaaataatgtttttaagtcaaaggcataaagaaaagtaattcaaatctgaaataaaatgggctttacaaaaatgaacaccaaaacttctatcattacggtcatcatgtttttcggaatggtaaatgtcagtgcacaggcttatcagaaaacagattcaggattgaagttttctgctgatcatatgaatgttgaagtgaaattttatggagaaaatacgatcagggttattaaatatcctgccggaaaatcatttgtcaaaaatagtttgtcggtcattaaacaggagcagaaaatcagattctccgtttcagaaaaaaataatgttatttcattaaaaacaaatgaccttctgctttccattaatactaaaaatggagtgatcacttatgcattgccatccggaaaagagcttttgaaagaaaccgcaaataatttcaaaccattcaatgatgccggaacacagacttattccgtaagacaggattttcagcttgaaagagaggaacctatttacggtctgggaattctgcaaaatgaaaaaatgtcccagcggaataccgatgtaaaaatgattcagaataacacctgggattttgtgcctttcttccagtctgtaaaagggtatggcattttttgggacaactattcaccaacacaatttacggatacgcctcagaaaacatccttttcatcagaagtgggagatggtatagattattattttatctacggaaaaaatgccgatggagtaattgccggaatgcgtgatcttacaggtaccgtacccatgcttcctttatggacatatggctactggcaaagtaaagaacgttacaaaagccaggatgagctgacagaggtggttaaaaaataccgtgatctgaaagttcctttagacggaatcatacaggattggcaatattggggaaacaattaccagtggaatgccatggacttcatcagtcccgattttccggatgctaaaaaaatggtacaggagatccatgatatgaatgcccatctttcggtttccatctggtcatcattcgggccaatgaccaaacagtaccgtgaaatggattcaaagggaatgcttttcaatatcagcacgtggccggaatcaggccgtgatgtctggcctccggatatgaattatccttccggcgtacgcgtatacgatgcttataatccggaagcaagaaatatatactggaaatatctcaacaaaggcgttttcagccttggtgtagattcctggtggatggattcaacagaacctgatcatctcagccagaaagcagaagatctggacactaaaacctaccttggctcattcagaaaagtaagaaacgcgtatccgctgatgacggtaggtggtgtttacgatcatcagcgtgaaaccactggtgataaaagggtttttattttaacaaggtcagcttttgcaggccagcagcgatatgcagccaatacctggtccggcgatgtcaattcttcctgggaaacattgcgcaaacaggtaccggcaggattgaatttcagtcttaccggaaatccgaatttcaactctgacatcggtggtttctttgctggtacttacaaaagaaatggaggttcaaaaaatccaatgttccaggaactgtatgtccggtggctgcagtatggaacctttacaccaatgatgcgctcgcatggaaccgatgttgcgagggaaatttatcagtttgggaataaaggagacattgtgtatgatgcgatagaaaaatttatcagacttcgttacagcatgttaccgtatatctattctgtttcccatgatgtttcaaaaaacgggtcaagctttatgagagccctttcaatggattttccttcagacaagaaaacatgggatatgaataatgaatatctttttgggaaatcattgttggtagcgccggttctcaatgcccaatatactcctgaaaagacagttaaaaccgatgaaaatgaaggctggaataaaaccgacaacaataaggataattcggtttcaaatatagattttactcaaaacaaaaacgtgaaagtttaccttccggaaggaacagattggttcgacttctggaccaatgaaaaacacagtggagggaaagaaattcagaaatctgttaatcttcagactattcctttgtatgcaaaagcaggaagtatcattccgttgggccccgatgtacaatatgcaactgaaaaaaaatgggatcatcttaccataaaagtttatccgggaagcgatactgattttattttatacgaagatgaattcgataactataattatgaaaaaggagcttatacagaaataccttttcactggaacgaaaaatcaaaaacattgacgatagctgcccggaaagggaagtacaaaggaatgattgagacaaggagttttaacctgattcttcctgatggccgacagaaaacggtaaattattcagggcaaaaaacagatattcattttaaataaacttaaaatattgaatatgaaaaatttaagtttaataatagtattgggattcttccagatttgttttggccaaaatccgatcatccaaactaagtatactgccgacccggcaccaatggtttataaggatacggtttatctttatacgggccatgatgaggacgatgctttcggattcaaaatgaaagactggttactatacacttccacagatatggtcaactggacagaccacggtgtagtggcttcacttaaagactttaaatgggtaaataccgacaacggtgcctgggcaccacaggttgtcgaaagaaacggtaaattctatatgtattgtccaatgccgaacaatatggggattggtgttttggtggcggacagtccgtatggtcctttcaccgatcctattggcaagcctttgatcaaaaattctctggatgacatcgatcccacagttttaattgacgacgacgggcaggcttatctgtactggggaaatccgaatctttggtatgctaaactgaatgaagatatgatatctcttgccggaccaatcaccaaagacccttcgtttgcgaaggtgaaagaccagccagatcctttcaagtatcaggaaggaccttgggtttggaaaaaaaataaacattattatatggcttacgcatcaaaatgttgcccggaagggattggttatgctatggcaaaatcacctacaggaccctggaattatggaggtgtgatcatggatggcgaccagagatccagcggaaatcatcccggtattatagatttcaaaggcagatcttatgttttcggattcaaccatatgcttaggatgcaaactatgagcaagcattacgaacgccggtctgtcagtgttacagaaattacctacaatgcagatggaactattcagaagcttcctttctggactgcggatggcgcaaaaagagtgggtactctgaatccttataaaaaagttgaagcagaaacgatggcttacagcgaaggcctgaaaacagaaatggttacagaatgggaacgcaatcaaccctataacagaggcaaaaaaatcacagaccgtatcatcgttacctcaattaacaatggtgattatattaaaatccagagagtagatttttccaaaggcgtaaaatctttagatgtgaatgttgcatctctctatggaggaaaaatagaagtacgttcagatgctcttaacgggcctgtgcttggcgttgttaacgttacaggaaaaggtgagggcgacttatataagactattaatacacctctgaaaagtgtaagaggaatccacgatttatattttgtttttaaaggagaaaaagaccttttctatttcgattggtggaaatttaatgaaaattaaaactgaattcaggaatatcaacaggaatgggctttagcccattttataaagaaagaaatatgggtggctttagccaaaacttaagtcatttgttatgagttatattaatatatcagttacaattttaaaaatgttcagatttaaactctttattttcagctttttaattgccggatactgtttaaatgcgcagtcaaccgtttggttagaccagttggatttgagcgttgtaacacagggacacggaaaaccgggcatcaatacttcggtggacggaaaacctataaccattgcaggcgaagttttcaaaagaggctttggaactcacgctgaaagttctttacttattacattaaacgggaaagtcaaaaaattctcagccttagtaggaatagatgatgagatcaaaggacagaaccctgccgtggaatttgaaatttatggagatcataaaaagctctggtctagtggtattatgcacctgggagataaagcaaagcctgtttccgttttgctggaaggtgtaaaacaattagaattagtcgtaacagacggcggaaacggaccttattatgatcacgctgattgggcagatgcaaagtttgaaacagcaggcggtgcaaaactgacaacatttaacccgatttcagcagtaccttatattttgacgccaaaacctgcggcaactccaaaaattaattcagcaggcgtttacggagttcgtcctggctcaccttttttgttcagggttgcagcaacgggtgacagggcaatgacttttacggcgaaaaatcttccgaaagggttaacaatagattcagagaccggaattatcactggaaaaatagattttaaaggaagctatgaagtgactttgaatgctaagaatgcaaaaggttcagcttcaaaaaaattaaaaatagaatgtggagacagaatcgctatcacgcctaccatgggctggaatagctggaactgcttcggacatgaagtttctgcggataaagtgaaacgtgcagcagatgcccttataaagtcaggattaatcaatcacggatggaattatatcaatatcgatgattcctggcagtataacagagatggaaaagacccttcattccagggaaaaatgcgtgatgaaaacggttatatcctgaccaattccaaatttcctgatatgaaaggtcttgcagactacatccataacaatggcttgaaaatgggaatttattcttcccccggtccatggacctgtggcggatgtgccggaagctacggttacgaaaaacaggatgctgaaagctacgccaaatggggtgttgattacctgaaatacgactggtgcagctatggcggtgtaattgacgggctgccggataatgatcccaataaagtttcttctcttgcatttgagggcggcggggatccagataaaggcgtgaaaccattcaaactgatgggaagccttttgaagcagcagccgagagacatcgtgtacaacctctgccaatacggaatgggtgaggtatggaagtggggtgatgaggtcaatgcacaatcttggcgtaccaccaacgatattacagatacctggtcaagtgtaaagaatattgctcttgctcaggataaagccgctccttttgcgaaacccggaaaccggaacgatccggatatgctggttgttggtgttgtcggttggggaaatccacatcagagtcggttgaagcctgatgaacagtatcttcatatgagtctgtggagtattttttcagccccgttgctgattggctgtgaccttgagaaactggatgatttcaccttaaatcttctgacgaatgacgaagttattgccgtcaatcaggatgttttgggaaaacagggtatttgtttgcagaccatcagtgagctcagaatttatgtcaaagaattggaggacggaggaaaggcagtagcttttgccaatttcggaagagaaaaagtgacactgtcatataaagatttcaaaaaattagggatttccggtgttcagacggttcgtgacctttggagacagaaggatattgcagaaatcaatacggacaaaaaaggtctttcattggacattccggcacatggcgttgcctattataaattcatttcactcaaataaataagattaagatatgaatcaacgaaactttaaatatatcacactttcttttctgttggcagggattggtatttctgcgcagaatccggttattcagacccattttacgccagatcctgctcccatggtctataaagggaaaatgtatgtttatacaggggatgatcagccgggatttgatttttatacgatgaccaaatggcgggtgtattccacggaagatatggtcaattatacagaccatggttcgcctatttctttagagtctttcagctgggcgcgggacagagcctgggcagcacagtgtattgaaagaaacggtaaattctactggtatatctgtgtacagaccgttgacaacaatatggctattggggttgcggtgtctgacagtcctaccgggcctttcagagatgctttgggaaaacctctgatttcaaccggaacctgggataatattgacccgacggtttttacagatgatgacggacaggcttatctgtattggggaaacagtaaattattttatgtgaagctcaataaagatatgacttcttatcaggggaaaatcacagaaattccacaatctgtggaagctttcggcgggctgagacgtcccgggaaaagtgatgaggttctgcaaaagcaggaaaaatttgatgatgtatatgtagaaggaccatggctttacaagcgaaataatcaatattatatgatgtatgctggaatgaccggaagaacagaatgtttatcctattcaaccagtccatcgccaaccggaccgtggaaatatcaggggaaaataatgaccgaccagcctactaacagctttaccaatcacggtggaattatcgatttcaaaggaaagtcctacctgttttaccatactggattattgccggccggaggaagctacggacgttcaactgctgtagaagaattcaaatataatgctgacggtactattccgaagatcacaatgaccaaagaaggtgtagctccggctggaaccttaaatccatatcagagaaccgaagccgaaactatggcatggtcggaaaaatgcagcacttccgaaaacaggaaaaccggagtgtatgtctccgatgccagagcaggagggtatatcaaggtccgttcggtagattttgaaaaaggggcttctgcattttcagcttccgttgccgcaggaattgatggtggaattctggaagttcatctggatgatgttaaagggccaaaaatagccgagattgaaattccgagaaccggtggctgggaagagttcaaaaccctgacctcaaaaatttcagaatctgtttccggtgttcatgatgtctattttgtgttccaggggaaaaatattacggcaggaagaaagttatttaatttcgattactggagctttcagaaaaaataaaactgactatgaaaaatacaatacaatatatactggggttttgtctgataggtttttccgaaggcatatcagctcagaaccctattattcagaccaattatactgcagacccggcaccaatggtgtacaatgacaggctgtatgtgtacacgacacacgatgaggatgattccacctggtttaccatgaatgattggaaagtatattccacgaatgatatggtgaactggacagatcacggaacaattctctcgtataaagatttcgactgggcaaaacgtgatgcctgggccgcacaatgtgtagaaagaaacggaaagttttttttatacgttccgatgtggtccaaaaccaataacaaaggcgctataggggtcgccgttggcgacagtccgttggggccttttcatgatccgctgggaaaacctcttgttcagagcgaatggggagatattgatcccaccgtttttgtggatgatgacggacaggctcatatgtattggggaaatcctaaattaaaatacgtaaagctgaatgaagatatgatctcctatgccggaaatattacagaagttccgatgacagaagaatcatttggcaaaagagatgggaaacccaatccggaaagacccacaaaatatgaggaaggcccgtggctgtacaaaaggaaaaacctgtattatcttttctggccgggtggtccacttcctgaattcataggctattctacaggtaaaacagcacaaggaccctggaaatatggagggattgtaatgcctactgaagggaagtcattcaccaatcatcccggtgttattgatttccgggggaaaacctatttcttttatcacaatggcgcattgccgggcggaagcgggtttacaagatcagtaagtctggaagaacttacattcaataaagacggatccatttcgccatttaaaatgaccaacggaattacaaaagctattgcaacagttaatccttattcattcaatcaggcagaaatgattgcctggtcggaaaatgtaaaatcatatcagaataaagaggcaggtgttttcatcaaggcaaagaaaaatggggcttataccagtgtaaagaatgtggatttccgaaaaaaaggagctggttctttctctgcaagagtaggaactacccataacagtgacgtcactatgactattcatctggatgctgtgaacggaccggttgccgcaacggtaaaggttccgatgactggtggagatgaccgctgggaaaccgtaaaagttcagcttactgaaaaaattaccggtattcatgatctgtactttgtattcaatggaaaagcctcaacagatattatgtattttgattactggacctttcttgaaaataattaattatgagaaaaaaagttttatatatcgtattcagcctgtttctgatcagcaaaagctttgcgcaggtagcagaaatttcaagtccggacgggtatctgaagcttcaggttttttcagaagagggaaaagcatcgtataatgttatccttcagggaaaagcaatgcttgaaaaatccccgctgggcctggttaccagtgagtccgacttttcaaagaatctgaaatttttggacagcaaaaaagatatcatttctaagaaatatacaaacgaaaaaatcaaaaaatctgagattgattataaagccaatactttatcggttaatttcatcaatgcagaccaacaccagataggcattgaatttcaggtgagcaacaacaatattgctttccgttataatattccatcaatgaaagaacggctgagtgttgtggtacagtcagaaaccacagggtacagatttccgtcacagacgactacttttctttcacctatgatgaagccgatgacaggatttgcccgtacagcaccaagttatgaaagcggctataaagctgatgctgaactgggaatatcatccgattatggatacgttttccctggtcttttccatatcggaaatgagggctgggtgttgctttccgagacaggagtgaacagttcgtattgtgcttcacaccttgaaaccacagcagaaaaaaatctttacaaagtagcttatccgaacattgctgaaaataacggtttcggaagtaccggagcagctgtttctcttcccggaaaaacaccatggagaacaattacagtggggaattctttgaaacctgttgtggagaccacgattccttttgatgtggtagatccgatgtacgagccttcacaggagtatcagttcggaaaatctacctggagctggattctgtggcaggataacagtatgaattatgatgatcaggtgaaattcatagaccttgctgctgcgctgaaatatcagtttattcttatggatgcgctttgggataaaaatataggtaaagaccgtatgaaagagcttattcaatatgcaaaatcgaaaaatgtcggggtattactttggtacaattccaacggtgctgcgaatgatgctccgatgggacctagaaataaaatgaactcatccgttgaacggaaaaaagaaatgaaatggctgaaagaagcaggcgtaaaaggactgaaagtggatttcttcggaggagacaaacaggaaaccatgcgtctttacgaagatattctgtcggatgccaacgattttggactaaccattattttccatggagccactgtcccgagaggctgggaagtgatgtacccgaattatgcaggaagcgaagccgttcttgcttcagaaatgctctatttctcagaagatgtccgtaagcaggaagctttttttgccacacttcatcctttcatcagaaatacagtgggcagtatggagtttggcgggactttcctcaacaaatatttaacaaaatccaacagggataaaaataaaagacatactacggatggctttcagctggctacagcaatcctgtttcagaatcccgttcagatgtttggcatcatgccgaacaatcttaccgatgctccggaatttcagctcagctttatgaaagaaattccgacactttgggatgaaaccgttttcatagacggctatcctgggaaatatgccgtggttgcgagaagacatgcggatcaatggtatgtggctggtgtaaatgctgaaaaacaatctcagaaactgaaaataaagcttccgatgtttgcagcgaaaaacttgaaacttatcaatgatgatgcaaaaggaaatacatcagagaaagaagtaaaagtgaatgcaaaaggtgattttacgattgaaattcagctgcagggtggttttgtactgaaaaattaacagtaaaccttataggtttttaaaacctataaggtttgaagagattaaaagaatacagattttttaaggttaaataaaaactgattatgaatcatttaaaaatatttttcttattgtgttgtttgggttttgcctgcagatctatgctgcagaaccgtttatcagtactgagaaaatccccgacggaggatttgtagtaagaaattaaagattaataaacaaaaaacagggaaaaatgcgcttcaaaaacttatacctcttcatcatttcgggatttttggtttcctgttcttcctcccggagtctggagaagcaatcatccaaagaccagtggctcactacctgggcaactgctccccaattggtggaactcaaaaatctgccgccggaaccgggactttcggggaataccctacgtcagattgtccgtgtatctgtgggtgggaaaaaattgcggttacgtttttccaataggtattctacagacagccttgcagtaaaagccgtttctattgccgtgccgtccgatagcagtaatgtggatgcaaccagcatcagatcattaacgtttgagaagaaaaacagttttaaaattgctcccggatccgatatttattctgatgaagtgaactttaatctgaagcctaattcgttactggctattacaatttcctatacaaaagtaacccaatctgtcaccggacatccggggtcaagaacaacctcttttattgttaaaggtgagcaggccaatgctgcagtatttaaaaatcctgtaaaaacagatcattggtattcgctttttaacatcgatgtaaagaccggtgagccttcgtatgcggtggctattatggggaattccattaccgatggaagaggatcgggaaccaacaggcagaatcgctggccggatattttttctcagcggttattggctaatccttctaccaggaatataagtgttcttaatttcgggattggtgggaattgtgtagtgcgtggcggtttgggtcctacagcattagaccgtttcgattataacatccttaatcagcagagtgtaaaatggttgatcattctggaaggagtgaatgatctgggaggaacaagagatgctgatgatgcctctaaaagaacagaagaactgattgccgcataccaggtgatgattgataaggcgcatgctaaagggatcaaagtgtacggagcaacgattcttcctttcggaaagtcattctacgacaaacctttccgcatcgaggcctggaaaaaagtaaacgattggattaggaacagcgggaagtttgatgccgtcatcgattttgcaaaacaaatgcaaagtgaaaatccggaagtcatcttgaacgatatgcacgaccatgattttcttcatcccaatgaggccggctacaggagaatgggagagtttgtggatctgaacttatttaaaaattaaaatcaaaaagatatagtatgaattttacaaaaaacatttcgctgtttcttacgttgttgtttatattttttgtaaaagcaaccgaaccatttatttcttttgccaagacagaaaattcggtggtgttgaaagagcgcaattcaggtttgatgctgttttcagacagcgattcggataaaggaattctgcgcgctgttgcgaatcttcaatccgattttcaaaaagtaaccggcgtccagcctaatctggtttcccaaaactctggcctgaacggcatgatcatcattattggtgaagcaggtaaaagcaaaaccattgataatttaattcgtcaaaaaaagctggatggaaaaacattaacagggaaaagagaaaaatatatcattcagaatatcagcaatccttttccgggcgtttctgaagccattgtgattgcagggagtgataaaagaggaacgatttacgggatttatgaaatgtctaagcagataggtgtttcaccatggtgttattgggcagatgttccgattgagaaaaaagaaaatgtatactttaaaaaaggaatatataccgatggtgagcctgctgtagagtatcgcggtattttccttaatgatgaagaaccttcacttggaggatgggccagagcaacatttggcggagtaaatagtaaattttatgagaaagtttttgagctgatcctgcgtcttaaaggaaattacatctggccggcaatgtggggaaaggcattttatgacgatgatgctctgagcgggccactggcaaatgaaatgggtattgtcatgggaacttcccaccatgagcctatggctttggcacaaaccgactggcacaggtatattaaaaaaaataacctcccgaatgtctgggattacgctaaaaatgcggaggttttacagaaattctggaaatccggaatggagagaagtaaaaactgggaaaaacttgttacagtaggaatgcggggtgatggtgatgaagcgatgggagagggaactaatatttccctgctggaaaaaattgtaaaagatcaacgtaaaatcatcgcagatgttaccggaaagaaagctgaaaaaacacctcaggtctgggcattgtataaagaagttcaggactactatgataaaggaatgagggttccggatgatgtgatcctgctgttctgtgatgataactggggaaatgtaagaaagcttcctgacctttcaaaacctttgcataaaggaggctatggaatctattaccattttgattatgtaggtggcccgagaaactccaaatggatcaacatcagtcccatccagagagtctgggaacagatgaacctttcctatgaacataaagtagataagctttgggtcgtgaatgtaggagatttaaaacccatggagtttccgatcagttttttcctggaaatggcctggaatccgaagcagtttaatggtaaaaatcttttggaatatactgagaagtgggctgctcagcagtttggtgaaaaacacgccaaagaaattgccgggatgattaatctgtatgccaaatacaacagaagagtaacccctgaaacccttgacagtaaaacatacagcctagagaattaccatgaatttgaaacggtcttaaatgattacagagcattggccgtagaagctttacggttaaaagaacagattcctgccgattatcaggatgcgtattatcagctggttttgtacccgattgatgcatgcagtaatttatacgaaatgtactatgctgttgcaaaaaacagggaactggcagcgaaaaaagatccgggagccaatttttacgcagataaagtgaaggcatgttttgaaagaaatgcttatctggacaatcaatacaataatgtgattgccggcggaaaatggaagcatatgatggatcagatgaggataggatataaaagctgggcagacggaaaagaaaatataatgcctgaagtcacctatatttctgaagctgaggttcccaaagaaaaaatatttcaggagaaaaacggctatgtttccattgaagcagaaaattttgtaagaatgagcaattctgaccggatccattgggaagtgattcctgattttggaaaaacaaagtcgggagtgacaacctttccgcagaatgcctatcccaaagctaatgaaaatatctggctggaatatgatatcaattttgaatcaaaaggtgagtttgaagtccaattattattagctccgactttaaattttaatcataataaaggattgcgctacgaaatttcttttgacaacgaaactccgcaaattgtcaacttcaatggccattacaaaggagaattgggaagatggcagtccgagcatattattaaatctgttacaaagcattcggttcagcaggctggaaagcacacgttacgtttcagagtgctggaacccggcattgtccttgaaaagatactgatcaacaccggaggattaaaaccctcttacctgggcgctcccgaaagcgaaatgcttcactgattggcccaatactcatcacaaacaacactttaattatgaaacactaatcttaattcacattccaatctgaaatacagttccctcacagagaatgaagagaaagaacagcgaatgattttgtaagcaactttatttaacagatcgctgcctgatatcattcagggtattttcctgacggtttttgaaaatcaaccgtcttgatggggaatctattgcccttactttaattgtttacgatcaaaatcacgactatctaaaactaaaccattatgaaaaaaattttaagtcttgtaaccattcattctatagctctgttttgcagcctgatgcttcatggacagcttacaaccgtaaaaattgataagaatattccttatcagaaaataaaaggattcggaggatttgtctgcagtccccagtttgcgtataaccacatgtctacctcagagattcagacgctttggggaacttccagtgaaggtggatataatattatgagattgtatattcccgaaaacagcagtaactggagctcagtactggctacagcacagcttgccaaatctatggggcttaccatttttgcttcgccctggaccatgcccgcagcctggaaaaccaataaccatgtaaatgctgttcatactgacgctaacggagtacaacagatcggatatttaaagccggaaaattatcaggattatgcgctttatcttaacagctttgttacctatctccagaacaacggagtagagctcgattatatctccattcaaaatgaaccggatgaaatggcacagtatcagggatgtatctggactcctgcgcaaattaccaccttcatcaaaaattacggacagcttatcaattgtaaagtgattgccccggaaagtgtgggatttacggataattttgccagtgctttgctggatccttcggcaatggctaattttgaagtgtatggcgggcatcaatacggacttatgcagtctacctacaaacaattccagaattacaacaaagaaatctggcagacagaatatctgatcaactggaactcttcgtccacccagccggcaagagatttcagctggaatatagatgcatttacctttgccagcagtgtcaacaatgcattattgggtaatgtcaatgcttggattcattattctgccaaacgttattatggcttaatgggtgatggaacttacggaactactgcaggtgtaatgaccaaaagaggctatatcctttcacattatgccaagtacacaacaggaaaaacgagaatagaagccaaatgggatgacaaaacaggtgttttacagggttcttcctatatttcccaggatggaaaccaggtggttcttatggtcatcaactcttctcagaatgcttatagccttaaggttgatctgcctttttatacgacttcaggaacaaaagtactgaccaatacgcaatccaatatggtgagtacacctatcactatgagtacggcaacattccgtcctactgctgatatcagcccttccagtgtcatgacatttgtttttaataaaagtggtgacaggcctgcttctctcatgacaggcggcgatattcattataataaaattgaaacacaaactcctaccagcgcagcttttgggacaggattcaatatcagcaatacgacggtgacgttctccaatccaagccctcttatcagtaataatatgactgcagctaacggatatcttcagcttaatgaccgatacaataaactgatcctgcatgtaaacagctatacaacagccggacaaagctattcggacaatacgactttatactatatcaacagccaaggagtaacgaaatcgtataattacgggaagattaattttccacagggaggaaacttcgatatcaccttagatatttcaagacaggtgcttacagacggatgtaaaggaattttaggactgagaaattccaattacagctctgtgcttacaattaatctgggagatgtttatttcaatgtgggtaatgaaattgcttctaaattcggaggaacctattccgcaagcgacagctatctgatggatgctctggaaaacggctattatacttctgtagacttcagaaatgcagcaggagttacttcctccaataattggcagcctataagtgccaacactaacagcatttattatgtgaattcaaacgtaagttcatctgccaataatgtgatttcagggacaacctgttcaaatctcgtcctttccggtcagggtatggattttcaggtgccgtttaacttcacagccaatacagcttcttacagccgtacctttaatggttacgacgtgctgatcttaccattccaggctaatataccttccggagttactgcttatctgatgtctccggatgcaggtaatatcaattgtaccgcaatttcaaacgggatcattcctgcaaatactccggtaatcatcaatgcgacaggaaatattactttcaacggtacaggaaacgtctccactcctaaagcaattactgttaaccagatgaatggagtttatcagagcattaaagttccggccaatgcttatgtgctgaaaacagaaaacggagtaacaggcttctataaagtaagtgcaggaagtgagcctgcaataggatctttcaaagcatatcttacagaagaaaatacttattctgccaacgttcttcctttaaacttcggatcgttaagcaccagaaatatttctgctgaagctaaaaaagaggatgtaaagatatatcctaacccggtaatagcagaccttttcattgattctgatttgtcagaagcaactgccaccatttttgacggaagaggaagtgtcatcagatccggattgaaaataaattcaggaaaaaaccatattaatgtgggagatttcccggctggtatttactttattgaggttactcaaaaaaataatacagtagtgaaacaaaaatttatcaaagagtaaattgagtccaaagccatcatgagcactgcttatggtggctttatttctacaatttggtagatgaaaaccaaaagtaagtaggatttactattaatttaagtgtattatttacatttatttaaaatagaacgttatatttgtttttcattgcattgttgctgaataatactggcaatttgtataaaataagaatgaaaacataattatccgtaaaaatctgtaaaatcagtgggttgaaaatcattaatcacaaaatcaacaaccatttttcggacattattgaaaccatattacctatgaaaagaattgtattaatcctatgtgcaaccctggcagcacctttattttttgcccagagccattataaatacccattcagaaacccggatcttccggttaatgaaagaatagagaaccttcttactttgctgactacagaagaaaagataggaatgatgatggataattcccaggcagttccccgtctggaaattcccgcttacggatggtggaatgaagcacttcacggagtagcaagagcaggaacagccactgtttttccacaggcaatcgggatggcggccacatgggatgttccggagcattttaaaacctttgaaatgatttctgatgaagcaagggcaaaatacaacagatcttttgatgaggctctaaaaacaggacggtatgaaggactgaccttctggacacccaatatcaatattttccgtgacccaagatggggaagaggccaggaaacctatggtgaagacccttatctgacctccgttctgggcgttgctgcagtaaaaggtttgcagggaaatgacccgaaatattttaaaacccacgcctgcgccaaacattttgcagtacatagcggaccggaatggaaccgccattcctacaatgcagaaatttcaaaaagagatctgtatgagacgtatcttcccgctttcaaagcattggttcaggaagggaatgtaagagaagtaatgtgtgcctacaatgcttttgacgggcagccatgttgtgcaaacaatactttacttactgaaattctccgtggaaaatggaagtatgacggaatggtggtctcagactgctgggcattggccgatttctttcagaaaaaataccacggcacccatcctgacgaaaaaacaacggcagcagatgccctgaaacattctacggatctggaatgcggagatacctataacaatctgaataaatctctggcaagcggactgattaccgaaaaagatattgatgagtcgatgcgcagaatcctgaaagggtggtttgagctgggaatgcttgatccgaaatcttccgttcactggaataccattccatattctgtagtcgattctgaagatcataaaaagcaggcactgaaaatggcacaaaaatcaatagtgctgatgaaaaacgaaaagaatattctgcctctcagcagaagtattaaaaaaattgccgttgtaggaccaaatgctgatgacggattgatgcagctgggaaactataacggaacgccttcttccattgtaacgattttagacggaatcaaaaccaaatttccaaatgctgaaattatctacgaaaaaggaagcgaagtaacagatccttcgtccagaacatcactctatcagaatttcatcagtcagaaaaacggtacgaaaggaatgaaagtagagtttttcaataataatgaattcaaagggcagccggccaatgtttccgtaaatcccaccgccatcagctacaacagttttggaggaacccagcttgcacccaatgtaggaagagaaaatacctcagccatcatttcagggatttttaaaagtacctatacaggagaggttgtgttttctgcttccacttccgatgtctatacccttttcgtggacggaaaagaaattgccacaagaaaaggacctgatgcaagacatccttcagagtttcctgtaaaaatggaaaaaggaaaagaatacaagatagaactgcgtcatacacaaaaaggaaaatatgtaagcatcagctttgaagtctacagaaaagaccctgttaattttgcttcggtgagagaaaaggtgaaaaatgcagacgtcattgtcttcgcaggcggactttctccaagcctggaaggtgaagagatgatggtgaatgcagaaggctttaaaggaggtgacaaaacttcgattggccttcctaaagtccagcgggacctgttggcggagcttagaaaaagcggaaaacctgttgtttttgttctttgtaccggaagtgctctgggattggaacaggatgagaaaaattatgatgccctgttgaacgcctggtatggcggacagtccggaggaactgcagtggcagatgttttggcaggagattataacccttccggaaaattacccattactttttataaaaaccttgaacagctggacaacgctctttcaaagacaagcaagcacgaaggatttgaaaattatgatatgcagggaagaacgtaccgttatatgacggaaaaacctctttatccgttcgggcacggcctgagctattcaaaatttgtttacggagattcaaagctgggcaaaaatacaatcagtaccagcgaaaatgtgacgatcacaattccggtaaccaatatttcagaaagggatggtgaagaagtcgttcaggtttatatcagaagaaataatgatgcccaggcaccggtaaaaacattaagagcttttgaaagagctttaatcaaatctaaagaaacaaaaaatattcagctgatcctctccaaagattcatttgccttctatgatgaaaaagcagatgatctggtttcaaaacccggcgactataccattttttatggcggaacttctgacgatgcagggttaaaaagtattccgctaaaagtaaaataaaaattgattcaggacaaattgagacatgctttagctttcaaaatatacgatctatgacaaccaaaaataaaatattttccatcgcgatttccctcagtgttgcttttttttcggctcagaataatacagtccgtacttttaatctggatctgaaagaaactccggaacctgttaaaatacaacccaccatgtatgggattttctttgaagacatcaattttgcagctgatggcggattgtatgcggaactgattaaaaaccgcagctttgaatttgacgaaccatttacaggatggaaacagcccaacacaaaaacactttctcctaatctggattcggggtttctgaccatttattctgaccctgccaaaaccaataaaaattacgcaagaattactgttctgaacgataaaaattatattctcgaaaatgaaggattcagaggaataggtattcatcagggtcaaaattatgatttcagttttgatctcgagaatgtttcaggaaatattgctgcggtaaatgcaagtcttgttgatgaaaatggaaaggaaatttcttcagtttccacactcataaaaggaaagggatggcagaagtatacagccgttttcaaatcaccacaaactgtagaaaaagcaaaactgcggattacatttaccggaaatggcatcgtgaacatggatatgatctccctcttcccgcaggatacctggaaaggcagaaaaggaggattacgaaaagacctcgttcagaaactatacgatttgcagcccggatttttaagatttccgggtggctgtattgtagagggaagaactttggcagaacgttatcagtggaaaaaaacaataggaaatatagcagaccgtgaataccttatcaataaatggagtacaggatttccgcatcgtcttacaccggattacggacagtctttcgggttaggattttatgaatatttccagctttccgaagatctgggcgcagaacctgttcctattctgagctgcggaatggcatgccagttcaataccgcagaactggtgaaaatggaagaccttgatccctacgttcaggatgcccttgacctgattgaatttgccaacggggattccggaacaaaatggggtaaaatccgtactgaaatggggcatccaaagccttttaatttaaaatttatcggagtgggaaatgaacagtggggagcggattatattgaacgttataaagtatttgaaaaagccattcatgcaaaatatcctgacattaagatcatctccggaagcggaccatcacctgacggcgaattctttgaatatggctggaaagaactaaagcagcttaatgcgcagattgtcgatgagcattattacaattctcccgaatggttcatgcaaaatgcaggcagatacgaccagtatgaccgctccgggccaaaagtttttgccggggaatatgcagcccagtctgtaggcgtggtaaagcctgataataagaataactggctaaccgctctttcagaagcagcttttatgaccggtcttgaaagaaatgcagatgtggtctatatgacttcttatgcaccgctttttgcccacgctgatggctggcagtggacacccgatctcatctggttcaataatctgaaatcctatgcgaccccgaattattatgttcagaaattattttccaacaataaaggaacggatgtactgaaaatagaaaataacgggaaaactgtatccggacaggagaacttatatgctacagcagtaaaagatgcaaaaactcatgagattattataaaaatggtcaatactgatactcaggttaaaacggtaaatatcaaaccaggaactttgaaaacaggtaagaaaataaccaaaatccttctatccgcaccacagctttctactgaaaatagtttcgatgctgaacccataaaacctaaggaagagatttctgaagccaaaaatggagaaatttcaacggaaattcctgccaattctttaattgttttaaaggtgaaattaatttaataatttgatattcagtgttttgttaaaaataagtgtgttttttacatttatttaaaatagaatcttatatttgtttttatctcatcaggagaaattaatctcaataatcaaaaacgtttcatcaccatgaaaaaatatgttatcgggctggactatggtacagattccgtacgggccgttcttattgatactgaaaacggttctgaaataacttcttcagtcagctattatcaaagatggaaagagggtaaattttgtgatccctcagccaacagtttcagacagcacccttcagatcatattgaaggtctggagaaaaccatttcagaagttgtaagagaaagcggaatagtgccggagcagatcgttagtatttgcattgatacaacaggttcttcaccgcttcccgtaacacatgaaggaacagctttagcactggttccggggtttgaagagaatcccaatgccatgatggttttatggaaggatcatacagctatccgggaagccgaagaaatcaatacacttgcaagaacctggggtggggaagattatacaaaatatgaaggcggtatctattcctccgaatggttttgggccaaaatattacacatcagcagagtagatgcagaggtgaaaaatgctgcttatacctggatggaacactgtgattatctgacctatcttttatcagatcataaagacctggcaaccttcaaaagaagccgttgtgcagcaggccacaaagccatgtggcatgagtcatgggatggtctgccttccgaagaatttctcaacaggctagatccctctctgggaaagcttagaggaagattatacagggaaacgtatacatcagatgaagttgccggctatctgaatgaagagtgggccgctaaaaccggtcttaccactaaaactgttattacagtaggaacttttgatgcccattcaggcgcagtgggagcaaaggttgaagaaaatgtactgatcaggatcatgggaacttccacttgtgatatcatggtagcctcaggagaaaccatcggagatacaaccgttaaaggaatctgcggacaggttgacggctccgtaattcccggattgataggacttgaagcaggacagtctgcatttggagatgttctggcatggtataaagatatcctgatgtggccggttcaccagattatgatgcattccgaaaatatttcagacgagcagaagataaaactcgcagatgaaatggaggccgggcttatcaggaaattaacccttgaagcagaaaaaattcctctttcagatagtgttccggttgccttggactgggtaaacggaagaagaacaccggatgcagaccaggaacttaaagcggccatcagccagctttctctgggaacaaatgctccccatattttcaaagctttagtcaatgctatttgtttcggagctaagaagattgttgaccgttttgaagacgaaggtgtgaaaatcaataaagtgatcggaatcggaggagtcgcaaggaaatcaccatttatcatgcagacgctagctaatgttctggatatgccgattgcagtagctgcttcagaccagactccagctttgggagctgctgtttatgcagctgtatcagcaggaatttatcctaccgttcaggaagcaagcatgaaaatgggctccgcatttgaagcggaatatcagccgaaagcggaagaagtacagcactacagagaattaatgcagcaataccagaagctcgctgattttgtagaatacaataccaaactgaaaaacaacaggaaagaacttcagaactcctgaatattaaccttttgaatacactcaaatgaatacctataaagaactccaaagagaatgttatgaagcgaatatgcagctggatgccctgaagctggtggtctatactttcgggaatgtaagcgctgtagaccgtgataaaggcatttttgccattaaaccaagcggtgttccctatgatatgttaaagccggaagatatggtgattttagactttgacgccaatgtcattgaaggcaggctcagaccttcttccgataccaagacccatgcttacctgtacaaaaactgggaaaacatcggtggaatttcccatactcatgcgatctattccgtggcgtgggcacaggcacaaatggatattcctgttttcgggaccacccatgcagaccatttaacaacagatattccctgcgctccacctatgcgggatgagctgattgaaggaaactacgaatacaatacaggaatacagattctggaatgctttaaagaaaaacagctctctccggaagaagtagaaatggtcctaatcggcaatcacggtccgtttacctgggggaaaaatgcagaaaaagcagtctacaacagtaaagtgctggaaaccattgccgaaatggcgtatctcaccagacagatcaatcctgatgcagaacgtctgaaagattcgctcatcaaaaaacactatgaacgtaaacacggcaagaacgcctattacggacaggaatttaaacactaaacacttcaacataaacaactattaacgatcaacaaaactatgttaacacctctcaataccaaagaagtctggttcatcacaggaagtcagcatttatacggacctgaaacacttgcccaggtggcagaccactcacagaaaattgtggcagaacttgaaaagtcttctttcatttcggtaaaagtcattgtaaagccaacggtaaaaactactgaagagatatttgaaaccattgcagcagccaatcatgcagaaaactgcataggagtaattacgtggatgcataccttttcacccgctaaaatgtggatcagaggattaaaaattttacagaagcctcttctgcatctgcatacccagttcaacagagatattccgtggtctaccatggatatggattttatgaatcttaaccaggcagctcatggagaccgtgaatttggttttatggtaagcagactccgaaagaacagaaaagtcgtggtagggcactggtcagaagaaagagttcagaagcagattggtgactggagccgcgttgctgcaggctgggacgactggcaaggagctaaatttgcacgtttcggtgataatatgcgatttgttgccgtaacagatggagataaagtggaagctgaaacccagtttggtttttcagttaatacctggggaatcggtgaccttgtaggcgttatcaattctgtaagcgaaggagaaataaaaagccttatggaagaatatgaatcttcttatcacatggcagcatctcttttggagggaggagcccacaggagttcacttcacaccgcagcaaaaattgaattgggacttgaaaaatttttaaaagacggagggtttaaaggattttcagatacctttgaagaccttcacggattggaacagcttccgggaattgccgtacagcgcctgatgcagaaaggatacggatttgcaggcgaaggagactggaaaacagcagcgctggtacgtgccatgaaaacaatggggcagggactagaaggtggaaatgcctttatggaagattatacctatcatttagacccttccaatccttccattttaggctcccatatgttggaagtagaccctgtgctggccgccggaaaaccttcgtgtgagatccatccgctgggaatcggaggaaaagcagatccggttcgtctagtttttaattccagaggaaatattgattctctgaacgctgccctgatggactttggaaaccatttcagactgctgatcaacaaaaccagagcattggaaattacagaagagctgccaaaactcccggtagcaagggttttatggaaacctcttcctgatttatatactgccgcagaagcctggatactggcaggaggggcgcaccatacatgttacagtgaaaatatttcggcagaacagctggaggattttgctgagatagcggggattgaatcattagttattgatgaagataccaaaatgcgtgactttaaaaatacacttcgttggaatgaaatgtattatcgttaattaattttaaaaaatatgtaaataattatgaaaaaagcaatacataatagcatttttattttattatttttaattattttcggctgtaaaaaagaaaataacaaacaggatatttcaggaaaaatggagaatgtgcatacttcagactatggggtgacgccaaaaggcgattctattaaaaaatacacgctgaccaataaaaacgggatgaaagttgaggtcatcaacttcgggggaattatcacttctttaaccgctccggacaggaacgggaaatatgaggatgtggtactcggctttacaaaacccgaaggatatttcgatggcaacccttattatttcggtgctttgatcggaagatatggcaataggattgctaatgcaaaattctcactggaggggaaagcatacgaaattgataaaaatgatggacccaacagccttcacggaggaaaagaaggatttcataccagattctggaatattgaggcagtaaaagatgcaaaatttccgacattaaaattatcttataccagtgcagacggtgaagagggatatccaggaaaattaacaacaactattttttacacgcttacggacgataatgcattggaaatttcttacgaggctgagaccgataagcctacagtggtgaatcttacccagcattcctattttaacctgtccgggaattttactaaaacgattactgatcatgaactgcagattaatgcagatcattttcttccggtgaacgaaaccttaattcctacgggggaacagaaagttgtaaaagggactccttttgatttcacggtttctaagccgattggaaaagatatcaatgcagacgacgatcagctgaaaaaaggaaaaggatatgaccataactggattctgaatggaaaaggattaagaagcatcgccaaagtttatcatcagggaacaggaaggctgatggaagtcttcacagatgaacctggcgtgcagttttactctggtaattttcttgacggaaaatttgataccaaaacaggaggtaaaaatgaattcagaacagggttctgtctggagacccagcatttcccggattcaccaaaccagccttctttcccttctacagaattgaagccaggacagaaataccactcgaaaaccatctataaattctccgtaaaaaagtaaactatgggaaaattagcaactattgatattatcatattcctgatctatttcgtagtggtagcttcctacggattatggatctataaaaagaaaaaatctgaatccacaggaagtaaggattatttcctggcggaaggatcattgacctggtgggctatcggagccagcttaattgcttccaatatttctgcggaacagtttattggaatgagtggtgaaggtttctttgtcggaatcgctgttgccgcttacgaatggatcgctgctcttgcgctgatcattattgcggtctggtttattccgatctatcttaagaataagatctataccatgccccagttccttgaaagaaggtataataaatcggtttcattgatcatggccgtattctggctgtttctgtatgttattgtgaatcttacttccatcctttatctgggagctcttgccattgatactttattgggaggagaacatcttcacgggattatgatcgctcttctgcttatggcccttctgatcggtcttggaggaatgaaagtgataggatatacagacgttatacaggtggctgtcctaattatcggaggttttgcaacagtgtatatggctttgcagattgtagaccagagaatcaacggagcggctgtaggaaatgcgctggcaggattcaataccctgatcaatgaggctccgcagcactttaagctgattcttgaaaaacctacaacgaccacaactactttggcaatgcctcaaaaccttgatgtacagaagtatgtcgtgttaccaggtctggccatgtattttgccggtcaatggattgttaacctgaattattggggctgtaatcagtacatcacccagagagctttaggggcagatctgaagacggcaagaacaggaattttatttgcaggatttctgaagctattcatgccggtgatcgtaatgcttccgggaattgccgcttatgttttatattccaaaggacaccttccgggattcaacggagtgaaagacggtgcctactctgcaatattaggatttttacctgttggacttaaaggattggccattgcagcattgaccgcagcaattgtagcctcactggctggaaaagtaaacagtatttcaaccatttttacgttggatatttataaaaaataccttaaaacagacgctaccgaaatccagatggtaagaacaggccgctgggttatcattatcgcaatgatggcagcactggctttcacctggacagacgttttaggaattggcggtgaaggaggtttcacatttatccagaaatatacgggctttatcagtccgggagtttttgccatgttccttctgggaatgttctggaaaaggacaacaggtacagcggctttggtaggagtaattttaggttttgttcttgccattttcttcaacagctttgccgtgggaattttcgggaaagaaacatggatgtatactgcattcacttatgaaaagcttgaaaacggagtagtgcataccattaccgaaattcctttcctgatcaatatgggatggtcgttctttatcacgataatcgccatgatcctgatcagtcttgcaggtccgaaggtaaatcctaaagcttttgccattgatgtaacgatgtttaaagtggacaacagaactttagttttgatcgtgatgacactgcttttactgactgccttgtatgtgaggttctggtaaaagtgaatagtcaaaagtgaactcgtttcacttgtcaattttagaaattcaccattgacttgcgaagcaaattgacttttcacataagaaataaatttagtgtatgacaaaatgaatagtcaaaagtgaactcgtttcactagtcaatttttaaaaattcaccattgacttgcgaagcaaattgacttttcacgtaagaaataaatttagtatatggcaaaggtgaatggtcaaaagtgaacttgtttcactagtcaatttttaaaaattcaccattgacttgcgaagcaaaattgacttttcacctataataaaaaaaacaggatactttttaagcatcctgtttttttattatatcttaaacataaatccccttgagattttcttgttgtattttttttcgtcaaaccggtaaagaaaagacccttttctggaggaagtcatatcctttttgttggtgttaaccagaatatccatactgttgatcttgctggtaaagttccgtttgtcaaacttttcatcaaaaatagcttcatatagattctgaagatccttcatggtaaatttttcaggaagaagctcaaaccctattggcccagtggaagctcttctcctcagtctggccacagcatcttttaccatcttattatgatcgaaaataaggtcaggtgctttctgaagttccacccattttgcactgtattgctcattgatttgaatatctttctcaatattgatcagtgcgtaataagagatagacataattctggctgttggttcacgcttgatttccgtataacacttcagctgttcaagataaatattttcaagaccggtcagcgtatacaaaaccctgttggctgcctcatcagaagtttcgtcactgccaatgaagccacccatgagtgaccattcacccatttgcggttcaaaatttctttttaccaaaaggattttaagattttcgccatcaaaaccgaaaatgatacagtcaacggcaacaaggtgtttgggatattgggagtaatcctcagtcatcttttatattttattgcaaaggtaaagcttttataaatacgatattatataaatgtgatttatacacttttaaatttgaatgatttatttcattaaaactattccttaaggatattttgggaggtaaaactgtcatcaaaactgaaaattatcactgaaatcaggttaatcatagatgaattcaatgttaaaattgtgttaaaattaaaaataagatttataataatcaagaaaagggacttaacgttaaaaatacgataaggtatttgctgtatggttgaaatttttgccaaaacagatcctgaattcattttcatagggaatcatatgattttaatgttttgtttttctgcaaattaattatcttattttttatgataaggtaggacgttttttgttgtttttagggatttatagaaagttttaaatgaaaaaataagtcaaataggcgcagaaaatgtttcgtatattgaatctttccattattttagaaatgttgaattaacatttataatggccccgaaactttctgcttttttattgtgttttgcttcatttgcctcggctcaggtgaaggaaaaaatccattattttcctttggaaactgtcaggttatcagagagtgttttcagcaaagcgatgaaggcagatcataagtacctgatggccctggaaccggacagactattggctccttatcttaaagaagctggattaaagccaaaagcaaataattaccccaattgggaaaacacagggttggacgggcatataggaggacactatatttccgcattatccctgatgtatgcttctacaggagataaagcaatacaagagagaatcaattatatgatcagtgagctggaacgctgtcagaaagcctctccggacggatatatttcaggaattcccaacggaaaaaagatctggaaagaaataaaacagggaaatatacgtgcttcaggcttcggtttgaacgaccgctgggtacctttatataatattcacaaactgtactcagggctgcgcgatgcgtattggtatgccaaaaatgaaaaagcaaaagcaatgcttataaagcttacagattggatggcaaatgaagtttcaaacctttctgatgaacagatacaggatatgttgcgcagtgaacatggaggactcaacgaagtttttgcagatgtttacgatattactcatgaccggagatatctgaaactggctcaccgtttttcccatcaggctatccttacaccgcttttatcaggagaagataaacttacaggacttcatgccaatacacagattccaaaagtaatcggctacaagcgtattgccgatcttgaaaacaatacgtcctggagtaatgccgctgattttttctggcataacgttacagagaaaagatcctcagttattggaggtaacagtgtcagtgagcattttaaccctgtcaatgatttcagcagcatgatcaaaagtattgaaggtcctgaaacctgcaatacatacaatatgctgaagctgaccaaagagctttatgcaaccctgcctgaatcttattatatcgattattacgaaaaagcattatacaatcatattctttccacagaaaatcatgatcagggaggcttcgtgtactttacgccaatgcgtcccgggcactaccgtgtgtattcacagcctcacaccagcttctggtgctgtgtaggatccggaatggaaaaccatgccaaatatggggaaatgatttatgcaaagtcagataagaatttatatgtgaacctgtttgtcccttccacattgacatggaaacagcaaaatgtagtactccgtcaggtcaataacttcccggaagctcctgaaacaacattgatttttgatgctgcaggaaagtcagaatttgatttaaaattaagatgcccggaatggacgccgccttcggaagtaaaaattctggtcaacggaaaacaggaaaaagtacagcgtggttctgatggctattttacactgactaaaaaatggaaaaaaggtgatgttgtgaaaatgaccttgccgatgcatctttctgcagaacaacttcctgaccattccaattattatgcatttaaatacggtcctgtagtgcttgccgcaaaatacggtaccgaaaaccaacagggacttcttgcggacgatagcagaggcggccatattgctcatggtccgcagattcctttaaacgaaattcccgttatccttggaaatccttccgaggtagtcagccatgttacacctttgaacaataaaccgctcaactttgccgttacagggctttatccgtctgaaaaattcggggaaggactaaatcttgtgccgttttacagtattcaggcagaaagatatattttgtactggcctcaggctgacaaaaacgaaatagaaaatacattgaagcagaaggcaaaagaagaagcggaaaccagaaagttggatatgatcaccatcgataagatccagttaggggagcagcagccggaatcagatcattttatagaaagcaaagactctggcacaggatatatggaagaccgacatttccgtgatgccaaaggctggttcagttaccagatgaaaaataacggaaaaaatgcttcatacctttacctgctttattttgatgcgaatgccaaccgcacgctgaatattgagatcaacggaaaaaaaatcatgactcaaaatctggaaggaaagtccggagccttacctcaatatctggttgttccaataccggattcagaaaagaataaagaaaatcttagtgtaaaatttctggcagacgaaaaactcatgactgctaaagtcattgaagtccgtttactgacagaaaattacggaaagaaataaatacagaattaaaacagattttttccatgaaaaacaaaatcctatacttgttattttttcttgcagccatttgcagttttgatgcaaaagtaaggctgcctgctttggtttcagacggaatgattcttcagaggaatcaggatctgaaaatctggggatatgcagatacaggagaaaaaattacggttaagtttatcagtaaaacctataatgccaccgctgatcagaatggcaattggtctctaatgcttccaaagcttaatgccggcggcccatataccatgaccattaatgagattacccttaaagatattcttattggtgatgtgtgggtggcttcaggacaatccaatatggagcttccgatgcgcaggctgacacctctgtatgaaaatgaaattaaaaacgccaataatcagaatataagattcttcacggttccgcagaaatacaattttaaagctccccaaaatgatcttgacggcgggaaatgggaaagtacaaatcctcagacgatacttgatttttccggggttgcttatttctttgccaaagaactgaatgaaaaaaataaagttccggtaggcatcattcataccagtctgggaggatctccggttcaggcctggatggatgaaaaatcactgaaaaaatacccggaatatctcgctgaagcagaaaaatggaaaaatgatgacttgatacaatctacagaatcccaggaaagatcattaagcaaagcatggtatgcagagctggatcagagtgatattgggttcaatcagcactgggaaaaagataacagaaatgatgcaggatggaaaaccataatgctgcctggatcatgggaagaccaggaaggctcatttgacggttcggtatggttccgtaaagaaattatcttgcccaagggagcagatcagaaagcagcatttttaaatctgggaaggataaaagatgctgatgttacttatattaatgggattaaagtaggaaatgtaacttatgaatatccgccacgctggtacgacattcccaaaggcgttttaaaagaaggaaagaatatcatcacagtaagagtcatcaatggcagtggaaaaggacagtttattgctgataagccgtattatctggaaatcgacggacaaaaaacagaccttaaaggcgagtggaaatataaaataggagcaaaaatggaaaaaatggctcccggacagacatttatccgctggaagccggtaggtctttacaacgccatgattaatccgctgatcaattataaaatcaaaggatttatctggtaccagggcgaaagcaataccgggaaaccaaaagaatacggagatttgctttcaaccatgatctcagactggcgttcaaaatggaataagaacgatttgccgttcttcattgtacagctggccaatttcatggagaaaaaagatgaacccattgaaagtaactgggctgagcttagagaacagcagagacaggtttctcttaatgttccttattcaggacttgcggtaacgattgatgtaggagaatggaacgatattcatccgctcaataaaaaagcagtgggtgataggcttgctttacaggccctgaaagttggggaaggcaaaaaaatcatagctgacggacccgtttatcagtcgatgaaaacagaaggtaataccattattttatcctttaaacccggtacagatgatctggtacagggaagccttaaaggttttgccatacagcagaaagagggccgttatcaatgggcaaaagcagaagcaaaaggtaataaagtcattgtctggaatgatcaggtcaccaatcctgtcaatgtacgttatgattgggcagacaacccagacggcaatcttaaaaacaaaagcgggcttcctgcttcaccttttacaacagaaaaaaattaatttaacatagaaaaccttatcaaaatcaatggatcatcagccacaaaaaatatcggtaatagaaaaagtagggtatagcctgggagatctggcagctaaccttgttttccagactttagttacttaccttacttatttttatacagatatttacggactcaaagcagaagatgcttctgttatcacccttacggtaggattaattgccggatttggttttaacccgcttatcggagcgctggcagaccgtacaagttcacgatgggggaaattccgtccatggattttatttactgctgtaccgcttggtattgcagcactattagctttcagtacgcctcacttttcctatcagggtaaaatgatttatgctgcggttacctattcattattattgttattatacgcttccaataacctgccttatgctgcattgagtggcgttatcacgggagatatgggagaaagaaacagtatttcttcataccgttttgtagcagtaatgtttgcacagttttttgtacaggtatttatgcttcctatcattttatatgtaggacatggagacaaagcacagggaattgagactgttatgacttggctggctgtgatcggatctataatgttactgattaccttttttacgaccaaagaaagaattattcccaagccggagcagaagtcaagtctgaaagaagatttaaaagatttattccagaacagaccctggattattatgcttaccgtgactgcattcatattcatcacactggccatgaaaggcggagcttatgtatactatttcaataattatgtggatgaaaatgctctcaaaagttttatctcacccattacagcattttttaactctgcagggatgaatttctttggagaagacccgaaatctgccgggttcggattatttaatgcaggaggaattgtgatgatgattgtcggcattaccttctctaaaaaactggcagacagatttggaaaaagagatacttttattgcttcattattcatttctaccttgtttatcctgttctttatattttatcctccgaaagctgtggaaattatgttcctgtcccagattttacacggattcttttatggaatcagcacaccgcttttgtgggcgatgattgctgatgttgccgactattcggaatggaagaacaaccgcagggcaacggctattattttctctgccatgatggtaggactgaaagtaggtctcagcattggaagctctctggtagctttaattataggaaaatacggatacatttcagtacacgggagcgaacaggtgattcagcctgaaacagtggcagcaggagcgaaaatgctcgtaagcatattcccgtccattccgttttttattgcctgcggactgcttttattttacaaaatcaacaaaaaaatggaagttcagattgaaaaagatctggctgaaagaagaaaataaaacaattactatgaaacgtattttaattggtttggcggctcttaccgcttccgggctgtcggcgcagaaatccgatggtactttaaaaaaagcatttcaggataaattctatatcggaactgccatgagccttccccagattgacgggacagatcagaaagcagtagcgattatcaaaaaacaattcagctctgttgttgctgaaaactgtatgaaatctatgtttctgcagccaacggaaggaaagtttttctttgatgatgctgataaatttgttgatttcggaataaaaaacaatatgttcatcatcgggcatacgttaatctggcattcgcagcttccaaaatggttctttttagacagtaacgaaaaggatgtttctccggaagtgttgaaacaacgtatgaaaagccatattacaacggtagtttcccgttacaaagggaaagtaaaaggatgggatgtggtgaatgaagccattcttgaagacggaacctatagaaaaagtaaattttacgaaatcctgggtgaagactttattcctttggcatttcagtatgcacaggaggcggatcccaatgcagaattatattacaacgattataatgaatggtatcctgaaaaggtaaaaacagtcattgcaatggttgaaaaacttaaatcaagaggaatccgtattgatggagtaggaatgcaggcccatgtcggaatggatatcccttctatcgatgaatatggaaaagcaattctggcctattccaatgcgggagttaaagttaatattacggaactggaaattagcgcactgccttctccatggggcagttctgccaatgtttcggataccgttgcctatcagaaagaagtgaatccttatactaaaggacttcccaaagaagtagaagcgaaatgggaaaaacgttatcttgatttctttggcttgtttttaaagcataaagataaaataagaagagtaaccttatggggagttactgataaacaatcctggaaaaacgatttcccggtaaaaggaagaacagattacccgttactgtttgacaggaaagaccaggaaaaacctgtagtacaaaaaataataaaattggcagagaaaaattaaaatcaatagaatttttacttaatgaaaaaatcaaaatatttattcccggaagattatatggcagacccttccgttcacgtttttgaagataaaatctatatttatccttctcacgaccgcgaaagcggaattgaagaaaacgataacggggatcactttgatatgaatgattaccatgttttctcaatggatgatgtagacagaggagaaattaaagatcatggcgtagtcctttcggtaaaagatattccatgggcgggaagacagctttgggattgcgatgtagcctttaaagacggaaagtattatatgtactttcccctgaaagatcagaatgatattttcagaatcggtgttgccgtgagcgacaaaccttacggtcctttcatccctgaaagacatccgatgatgggaagctacagtattgatccctgtatttttgaagataaaggtaaatattttatgtacttcggaggaatctggggcggacaattacagcgttacagagataataaagcacttgaatctgctgtaattccagaaaatgatgaacccgcaatccactcaaaggtagctttgctgagcgatgatatgcttgaatttgcggaagctcctaaagacgttgtcatcattgatgaaaacggaaagcctctgcttcatggtgacaaacaccgtttttttgaagcatcatggatgcatcagtacaatggcaaatattatttttcttattcaacaggagacacccacttgatttgctatgcaaccggggataatccttacggtccgtttacttttcagggagaaattcttactccggtggtaggatggactacccatcatagtattgtggaattcaaaggaaaatggtacctgtttttccatgattctgttccgagcggcggtaaaacatggctgagaagcatgaaagtgattgaactggaatacgatcatgaagggaaaatcaaaacgattgaaggtctggaagaccagtcatagtcatctgtaataatttaaaatttttcaatgcgatatctgagactcaatattctattttttctgatatttcctttgctggtttttgcggaggacggaagtcaactctggcttcggtttcctgcaaaaaacggaatatcggcagataaaattatttccaaagggaacagtcccacgctgaacattgccagaaaagagctgagcggccactggcagggacaggcggtggaacttcgtacagaaaacaaagagaaaaacctgaaagacggctacaaaattgtttccacccctgaaaaaattgttatttctgcaggaaaagaaataggactgttgtatggagtctatcatattttgcgattacagcagacaaaagctgatctgtctcacttaaacacgattgaaaaaccttcatatgatgtaagaattctgaatcattgggataatctggacggaagcattgaaagaggatatgccggaagatcactttggaagtgggaagatctgcctggaaaaatttcgtcgcgttatgaagaatatgcaagagccaatgcttctgtaggaatcaattccgttgttttgaataatgtgaatgcatcacccaatatgcttagggaagattatcttaaaaaagtaaaggttctggccgatatttttagaccttatggcatcaaggtatatctttccgtgaatttttcttcacctaaagtgctgggtggattacaaaattcagatccattgaataaagatgtacaaaagtggtggaaagataaagcagctgaaatttacagattaattcccgatttcggcggatttttggtgaaagccaattccgaagggcagccggggcctcaggattacggaagaacccatgcggacggagccaatatgatggctgatgccctcaaaccttacaacgggatcgtcatgtggagagcctttgtctacagtccgagcaaagacgacagagccaaacaggcttatctggaatttgttcctcttgacggtaaattcagggataacgtaattattcagattaaaaacggacctgttgatttccagcctcgtgaagcgtttaatccacttttcggagctttaagaaaaacttctgaaatggtggaatttcagatcacccaggaatatctgggcttttcaaatcatctggtttatttggctcctttattcaaggaaacgctggatagcgacacttattctgacggccagggttctacgattgctaaaattacagacggcaccttaagacatgcaaaattgacagccatctctgccgttgccaatatcggggaagatacgaactggaccgggcatcattttgcacaggccaactggtatgcatttggcagattagcatggaaccatcagctgagctcagaacagattgcagaggaatggattaaaatgaccttcacagatgatcagaactttctgaatccggtaaaggagattatgctttcttccagagaaactgctgtggattatatgatgcctttaggattgcaccatatctttgcgggaggacatcattacgggcctgaaccgtggggcgattataaaggcggaagaccggactggtcacctgtctattatcatcaggctgatgcccagggggtaggtttcaacagaacaaaaacgggaagtaatgctgtttcacagtattttccaccactgaatgaaaggtatggaaatatctcaacctgcccggaaaatcttattctttggtttcatcatgttccatgggattatacaatgaaagacagaaaatctttgtgggatgagctgtgttatacctatgattccggggtgaagaaggtaagggattatcagaaaacctgggatagaatggaaccttatattgatagacagagatttaccgatgttcagtcaaaacttagaattcaatctaaagatgcagtctggtggaaagatgcgtgcctgctgtatttccagactttttccaaaaagccaattccttatgacattgaacggcctgttcacgaactggaagatctgaaaaagattaaactgaacatgggccatcacaattaaaaaatgaggcagctctttttctgttaggaaatggagctgcctcaaaacaataaactgtaagtaaaattttaatccaaaataattggaatgatcgataggtcaatctatctgtatatattccgttttatcggagagaaattatcttattaaaaacatttccgttttcttcaacctggatgatgtattgatctgctgttttaggatcaagatcaaaagtgatatccaccttgccgtcagcatattttttgttcgaagtataatatgttgtattggaaagatcataaactgaaatgcttacaggtccttttacatcagacatgtgaagcttggccatatgaccggaaatagtatattcaggcttatgcacagcgcttacaggtgttttttccacctccattacattatcagcattgattttaatcttgtatttctctatcttcgcttctgattctgctaccagataatacgttcctggtgtaaaactttgaaaatcataagtcttcatcacatgatctccatctgcaagattttcggaaaatagctcgtcatgtgcagtgttatagacaaaaacagaaacacttttagcatttaaaagctcaaaattcaaggttttgtcttgtacgtttccaaaggaaagggaaaaatctctgtccttactcattacatttgctgaaaacaataaggctcctgcaaaaaatacggctttaaataatgtgctcatgggttaaggcttttaggattaatactgcaaagctatggcagcaatacttctcaggctataattaaattttcatattgatgtactatattaactttgtttaatgatattaatgtattatttgttaattttgcatatgaaattatttgtgtttggcctatgaaacatgtaaatccttcttttgaggccgtaagacctactataggaagcagttttaccagtcttaaatttctgactaatgagaatataaaatctcatgtctggcattaccatcccgaggttgagcttatttttgtatgcaaaggctccgggaagagacagatcggaagcagtatcacttatttttcagaaggagatcttgtattgataggaagcaatcttccgcattgcgggctgaccaatgaaagtacgcataatgagtacgaaatggtaatccagtttaagcctgactttctaggagaaccgatctgggatattccggagatgcaaaggatttcagctttgctggaaaagtcaaaggcaggaatcgtattcggggaagaggtgaagaaaagaatcgggaaagagattacggagatgcatgaagcttcctcactggacaagctgtgcagatttctgaaaatattggatgaactttctgtgactcaggattacaggattttaaatgcaggaaaatattaccttcagacacaggttgaagacaatgaaaggatcaatcttatattcaattacgttaaagatcacttcaaagaagccataaccctcgaagaaatggctgatcttgccaatatgaaagtaccgtctttctgccggtattttaaaaaaattaccaataaaacctttacacagtttgttaacgaatacagaattacccatgctctcaaacttttggcagaacagcctttgagcattacggaagtctgctttgaatcagggtttaataacttcagctattttaacaggacttttaaagaatatatccaaaaaagcccctcacaataccgtaaagaattcaattattttatggagtaattcacagttgggtttaaaaataaattgctgttttggaatgtattgaaatataagtgtatatttaacacttataaacaatatttacaaagtataatttctctgttataaattcagtagttttatacttaggatccccaggatctgtttgatcagataagattgatatgcatgaacagttaatcaacccaaccctagaaaagtttaggaccgaattcaaagaagagcctgaacatattttcctttctcccggcagaattaatattatcggcgagcatgtagactatagcgatggcttcgtattgcctgctgcgatagataaatacatctgttttgctgtccgtaaactccctcagacaaatctttgtaccatcatagccaaggatctcggagaagaatatacatttgatgtcacagcggagataaaaccggtacggcaaatgtgggcaaactatattctgggcgttttcagtcagctgcagaaacccgaaaatcaattttgcggaatggaaatagttttcagtagcaccattccgatgggatccgggctttcctcttcggcagctcttgaatgtgggtttgcctatatccttaatgaactttttgatctgcggctgtcaaaaaaagaaatcgcggtgatcgggcaaaaatccgaacatacttttgcaggagttcagtgcggaattatggatcagtttgcctccgttttcggaaaggaaaataaggtcattatgcttgattgtaattccctggaacatcaatattttgatgctgaactcaagggatacagcttattgctttttgacagctgtgtaaaacatagtcatctgacatccggctataacgaaagacgcaaagatgttgagcatggaaaaaaagttttatgggaaaaattccccgaagtagagaagttccgggattttaccacaactatgcttgacagtgttaaagagaaaatgggaagtgtttcacataaaagatgtctctacttactgaaagaaataaagagggtagaaatggcggcaaaagctatttcagaaggaaatgttgagcatctgggaagacttctcacggaaactcacgccgggctgtccactgaatttgaagtcagctgcgaagaacttgattttttggttgaaaacacattgcagcaggaaggtgtgctgggagcaagaatgatgggaggcggtttcggaggctgcagcatcaacctgattcaggaagataaagttgaggaagtaattcaggctatcagtgaaaaatatcttgaacactttaatattgagatgaaagtttaccaggttaaaatttcagacgggataaaagaatacaccaatgaatacattatttgaccctaaaaaacatccccacagaagatacaatcctcttttggatgaatggatactcgtttccccacaacgggcaaacaggccatggcaggggcagagagaagaaacagtaacagaaaaccgtcctgaatatgacccggactgctatctctgctcaggaaatattcgtgctaacggagaccgtaaccctgaatataaaggaacctatgtctttaacaatgactttggagcattgctgaatgaagaagttgatttttctgagcaacagtcaggattttttactctccttccggaacgaggaatcaacagggtggtttgtttttctgaaaaccacagccttactttgccggaaatgtctttggaacacatcaaaaatgtggtggatgtatggcaggagcagttcaatgagctggccactctggaccatatcaactatgttcagatttttgaaaataaaggaagcattatgggctgcagcaacccgcatccgcatggtcagatatgggcccagtcgtccattccggcaatggttcagaaaacccaggatcagctgaaatcgtattttgaaaaaaataaaaggacattgctggaagactatcttcggcaggaaatcacggctggtgagcgcatcgtcacagaaaatgaacactttgccgcattggttccgttttgggcttcgtggccttacgaaacaatgattgtcagcaaacagaaaagagaaaatattgcggaattttctgaagcggaaaaagaatcttttgctgctgtcctcaaggatctgaccacaatatatgataacctttttaaaacgtcatttccttattctgcgggaattcatcaatctccaacagacggaaaagagcatcctgaatggcattttcatatgcacttttatccgccgttgctcagaagcgcggaagtaaaaaaatttatggtaggatatgaaatgcttgcagagcctcagcgggacattacccccgaacaaagtgccgcaatattaagaaacctttccaccattcattacaagaaaaaataataaatcaatatctttgaaaagaataagcaaattatgattctgctatgtacagaattacgcttttcccaataaaattatggaacagattaaattaattgtgacggacatggatgggacgtttcttaactccagccatgaaatgagccctgagttttcagaagtttataaagaactgaaaaagagaaacattgtatttgtcccggcaagcggaagacagatgccgggcattacccattatttcggagaaatagaaagtgagatcggttttattgctgaaaacggaggatatgttatttataaagaccaggaacttttcgctgatacgctggaatacaaatatatcgttgacatcattaaagcggtccgtgaaatacccggtgccaaagccgtattatcagccaaaaagatggcgtattacgaaaccgaagatcagcagtttgtggattttttctcaaaatattacaccgaaaacatgaaaaaggatgacctgacggaaaaaattgatgataccgcctttaaaatagcagtttatcatcctgaaggttctgaaaaacatctgtatccggctctgaaaaaatttgaagaattcggtctggaagtagtggtttcaggagcgtattggctggatgttatgaataaggacatcaataaaggaaatgctctgaaaatccttcagaaatcgttgggaatctcacctgaaaatacgatggctttcggagactatatgaacgatattgaaatgctgaagaatgccaaatattcttacgctatgcaaaatgcccatcccaatgtaaaacaggtagccaattttgaagcatgcaccaatgacagcttcggggttctgaaaaccattaaagattatctgcatctgaattaatgcatccaaataacaccaattaaactaataatatgaatacatcaaccggaagaaagcccgctaaggtttgctatgagcacatcggcggaaaattaggacagcttctcttggaacagttcgttgagaaaggctggattgccaaggaaaatcctgcagaccgtaactattatattactgataaaggacaggaagaatttacaaaactgggtattgatctgtcacaaataaaggtagaataactttccggtattgcaaatagtatatatttaaaaatcagactcaggtctgattttttttgtttttaatcgtgggaaatttcaatttagatttgtactgcatgctttttggatggtttccattgttaaattttatatgttttttatataaaaggtaaagggtaaatcataaaactacgatatttcgtagtataatttacaaactgtttttaataatatattgaaaaccaattactttattgttttgggttattttttggcattatgctcataagtttaattcaaaaaatactacaacaatgagcacattaacattaaaagacggaacagaaattttttacaaagatcaggggcagggacctgtattaatgtttcaccacggatggcctttatcatctgacgattgggatgcacaggtgatcttctttttacagaaaggctacagggtaattacccacgacagaagaggccacggacgttcaagccagaatatttataatcatactattgaacaatatgcttctgatgctgcagaactggttgaattcttagatctgaaagatgtcgtacacatcgggcattcaacaggtggtggtgaagtgatccggtatgttaacaaatattcaaacgggagagctaggaaagcggttctgatcagtgccattccaccggtgatggttaagagtgaaaacaatcctgacggtgttcctatggaagtttttgacaatatcagggaacagacgatgaacaacagaaaccagttttattacgaccttactattcctttttacggctacaacagagaaggtgctgatgtaaaagacggaattcagagaaactggtggagacagggactgatgggtggaattgttgctcattatgatgggatcaaagccttttcagaaacagatttaaccgaagatttaaaagctgttgatattccggtattggttcttcacggtgaagatgaccagattgtaccgattgaaaattcagcgataaaatcagccaaattactgaagaacggaaaactgataacgtatcctggtttccctcacggtatgccgactacagagcatccaaccatcaacaaagatattttagcttttatcacagaataatcagcattctttaccaatgaatacgatacagccagcttttgatacgttgactgaggccgttcagtggcttaatcaaaacggatatacagaagattttaaccttaaaaatgattgcatcaggctcaataattttcttgatgtttctccggaagactttaaaatacgatatacattccgctttgaaggagataccgatcagggagatgaagaagtagtctacggcatcgcttccgacaagtattctgtaaaaggcatcctgacgagcgcttacggaatctatgcggatactgtaagtacagaactcatcagaaaactatcatccaattaacttaaccccaattatttaataaaataaactttatgaaaccatcatcaaaactcctttcccctgaaaatcatgcactggtactgattgattttgaaggacaaatggcatttgccaccaaaagtatctccatgaatgagctgcgtaataacgttgcggtactgtgtggtgcttctaaaatatttaatgttccgaccatcgttaccacagttgctgaacaaagtttttcaggtcctgttttccctgaaattgaggaagcatttcctatggcaacctcaggatatatcgacagaactactatgaatacatgggaagatgaagccgcttataaagcaattgtgggaacacagaaacagaagctggttttcgcaggattatggacaggcgtttgtattgtgggtcctgcattatctgcgcttgaggaaggctatgatgtgtatgtcattaccgatgcctgcggagatgtaagtgatgaggcgcacgaaagagcagtacagagaatgatccattccggagtaaagcctatgacttccattcagtatatccttgaacttcagagagactgggcacgtcaggaaacatacggtcctgtaactgaccttatgaaaaaatatggtgcttcttacggattagggatccactatgctcaccatatgctgaaccattaaaatctatataccattttcaatgttgaaatctgcaccttcaatactgtttttaaaagcttttttcataacagttcttttatgttctgaaacgttctcatcccagagctttaaacttctgcggtatgacgaaaattatgaatatctgaaagattccaccaaaagcttttatgataacattaaatatctccctctcaatgaaaaaaaagatatctatctctcattgggtggtgaggcaaggtatgaatatgtggatttcaacaatgaagattggggaaggcttaagataggacacaacgatttttttctccaacgttatgaccttcatgcagactggcatttcgggaaaaacttcagaatattttcacagatcagaagtgctttacaaaacggaagaaaaaacggttcaagaggcattgatgaagatcagctgagtattcagaatctctttgtggatgcaggtttggtgaataaggaagatcagaagctgatagtgagactgggaagacaggagctggactacggttccggaagattaatttctgtaagggaagggccgaatgcaaggctgtcttttacaggagctaaaatcatgtattcctataaaaatgtttccgtagatgcttttgcaatgatggcagactctgtcaagactggcgtttttgataataccctttcaaagcagcttaatctttggggactttattccaaaatcattattcctgaagccggaaatctggatctgtattatctcggaatccgtagagacgaatctgtttttgaagccggaacagcaagagaaaagcgccatacagttggtggaaggttgtggaaatatggcggtggatttatctataacctggaagcggcctatcagttcggacgctttggaaacgaaaagatcagtgcctggacgggatctgtagatatcggttatctgtttgaaaatcttacattcagcccaagcatcaatctgagaaacgattatatatcaggagatcattcaaaaaacgacggcaagctcaatacctttaatcctttatatccgaaaggaggctatttcggcttcagtccgcaggtgggtcctgtcaatttaattgatattcacccatatatgacccttgatctgacttccagactcaaaatgcagatggatgttgtcttcaactggcgatattccctgaacgagggagtttaccggccaagcggagcattgaaccgtcccggaagcagttcagataaaaggtatatcggaacggcttatttaaccagctttacctataatttcaacaaacatttctctttggtgagcggacttcagtatttccacaaaggatcttttattgaagatatcattcaggatgcaaaaagcggtgttttctggaatgtccggctgggattcaaattttaatcattactaaatcatttattatgcaaaattcaatttcaaaatacatcaattggtcaaaaacactctttacagtattggtgttggcaactgctggaacccaattcgtttcagcacaggctgctgcagaaaaaacagctattggaacctcaaaaacatggggaactgttgacggaatttctgttgtagggctggtgcagggaccttctgctgccaaagcagatttacagatcgcctgtgttttcgagtatacggaaggagatatttttaatccgccggcgcttcccaaagaactgaacggaatggttcatctggatgaggcactcaaagggattattacagaagtccgtaaaaaaggacagttcaaaggacacgctttggaaaccttattaattaatcctccgaaaggaagccttgcctccggaaaactgctgttgatcggcctggggaacagaaattctttcgatgccgagcttatgaaagaagtaggaagtgttgcgatgagagaagctttgaaactgcaggtacataccgtatcatttgccagcgatatcaaagatgcaggaatcgattctccaaccgctttagtggcagaaaatgtggttttgggcgcttttgacgcctatcgtgcccagttatatttaaatagtcagcacctatccgacaaaatgaaattaaaaaaactgattctgctggccgggccgtcatttttcaccgttgccggaggaggaattcaggatgctatttcgaagttgaacaccaaataattacaaatgaaagcagatcttatcgtatacaacggaaaaatacacactttcaataaagaaactccggaagtttctgccgtggccattaaagacgggaaaattatcgcggttggaaatgacggactggcagaccggttcgcagatgaggccacaaggctgattgaccttaaaaagaaaagagtagtaccgggaatcaatgattctcatatccatctgatccgtggcggattgaattacaacctggaattaagatgggacggagttccgtcactggccgatgcgctcagaatgttaaaagatcaggtagaccgtacgccttcaccccaatgggtacgtgtagtgggaggatggtccgaattccagtttgcagaaagaaggatgccaactctggaggaaattaatgccattgctccggaaacacctgtttttatcctgcatttgtacgacagggctttaatgaacagggcagcattgaaagcggtaggatttactaaagataccccggctccggcaggtggacatattgaaagagatgctaacggtgaacccacagggctgattattgccacacctaatgccatgatcttatattcaacattagcaaaaggcccgaagctttcttacgaacaccagctgaattccacaaggcattttatgacagaactgaaccgtttcggaattaccagcgttattgatgccggcggaggatttcagaattttccggatgattatcaggtagtgaacgaactgaatgagaaaaaacaacttaccgtaaggatcgcctataatctttttacccagaaacctaaacatgaatttgaagatttcagcgattggatcgacacggtaaaattatatcagggcgatgatatgtaccgccataacggggcaggagagatgcttgtattttcggcggccgattttgaagattttctgcagccaagaccggatctgcctgaaaacatggaagcagatcttgaaaaagtagtccgtttactggtagaaaaccgctggccattcaggcttcatgcaacctacaatgaaagcatcacccggtttttaaatgtctttgaaaaagtaaaccgcgacattcccttcaacggtcttccatggatttttgatcatgcggaaaccattgatgaaaaaaatattgaaagggtgaaaatgcttggcggcggaattgccatccagagcagaatggcttaccagggagaatattttgcagaccgttatggttctggcgccgcagaaagtacaccacccgtaaaaaaaatgctggaaatgggagttcctgtaggcggaggttcggatgccacaagagtaagcagctacaatccgtgggtttccatgtactggctgaccgcaggaaaaactgttggcggacttcaattataccacgaaacaaagctggacagagcaaccgcattagaactgtacacaaaaggcagcgcatggttctctcaggaacagcagaaaaaaggtgatatcagagtaggaatgtttgccgatctggcagttcttgatcaggattatttcacggttgatgatgaagagatcaaaaatattgaagcggaaatgaccattgtagacgggaaaatagtctatgccaaaggaacattctcatcctatgcaccaccatctatccctgtgcttccggactggtctcctaccaatctttataacggatattaccctgcaggcggacattttcagaaagaaattgagaaaaatgcaaaacaggatctaaaagctcctttagcttcacaaattcatagctgtgcaggaagctgcgatatccatcatcataaccataaccaggcaagaatgagcaatgtgcctgttaataattaccacacattctggggagctttaggctgttcgtgctttgctttttaactatcaatacatatggaaattttaaaacagatcctttcatcagatttaggttcaccattcaatgatgcttcattcctggttttccgggtactcattgccattcagctgttcagagtgcatggtttaaagaaattcaggctggaaaacggacaaagggaagtcattcccaatcctctgggattgcctgatcaactcaatgccatagtcgcttcatttgctgatctggtggttccgtttctgattattttaggattgggaaccaggcttgcagttttaccgaccattggtgtgacggctatcggatattttgtagttcacagaaaagattcactggaagtacgggatgttccttttatgtacaccctttccctgttactgattcttacattaggggcaggaagatattcacttgattattacttattaaatattttataaaatgaaaacttcaatcggaattaaaaacgaaaatttagcaaaagttgctgaagtactggttaccactttagcagacgaatttgtattgtataccaaaacaagaaaagcacactggaatgtggaaggaccggatttttacaataaacacctgtttttcgaggcacaatacggacagctgaacgacatcatcgatgatctggcagaaagaatcagaacgcttgggcattacgctccggctactttaagggaatatcttgcattaacccatttgtctgagaatcatctggaatcgaacgacagcctgacttacatcagagcacttctttccgaccatgaaagcatcatcattcatcttcgtgaaaatattgaaaactttgctgttgaattccgtgattcaggaacaagcgactacatcacaggattacttgaagctcatgagaaaatggcctggatgctgcgctcacatttaaaatagaagcatggaagtaaaacataatatcggttttgtcaccttattgttaaccatgattgccggatattgcgataccgtgacttttgtatcggcagacgcccttttttcggcgcatgttacgggaaactttattgtatttgcctatcagtttgtgaaaggatcggatattcatgcctgggtaaagctgcttacgtttccggtatttattcttgcggtcatggcaggagggaggattgccgggaaagtcatcaatcattatacgctgttattctgggaaggagcgctgcttttgtcggccggaattattgttgtcgttttcagttactatggaacattttcagaagtcgtgatgtatactgtggctatgattaccgtttttgcaatgggacttcagaatgctttcggaaaactttatgcaaaagaaacccatggcccgactaccatgatgacaggaaatgtaacccaggcttccctggatttcggtacgcttctgtcaagtggctttcaccaccctgaagcatggacaagcctgaagaaacagctgattaccattcttggatttctggttggttgttttttaggggcttatgcaggaaagcaatatgggctggtaacattgattttacccggactggcaatgattatctgctatttttaccaccgtaaaaactagcataggactatggcagattacaggataatagattacctttaaaaaatgaatttcggcctttattttttatctaaaaatccactaaggatagtatttttttcgttggttttgatgttttcatgcaatacaaaagcacagatccaggaaaatcctgcactgttgagaaaacagatttcctcttccaccaatacgattcagaaaatcactttattactgcgtttgagtaactattacattactaaaaaaggagagttgaaagctgacctcgacagtgccgctattctgaaccaacaggcaaaagtactcaatatgaaatccggggatccgttgtctgccggaaaactcatatttctggatgccaaaatagataaagaaagaggccgtaaaacgattgctttttccaatatgaaacaggcgctttcttattttgaaaaaaatcattttaaagagcaggccggagaagcatacaatgaattatcatatatgtatgacaataaacccgaatattttgatactaaaatcaaactgaaagaaaaagcattggaactgtttaagaattcaggatcaaaactgaatcaggcaggcattttaaaagatcttggtgagctttattacatcaaggaaaatgctgataaggctctgggcttgctcagacaatcactgtctgtttatcagtctgtgaaattcagaaaattgcagagtgtgtacaatcttatttcgcaggttgaaattcagaaggcggattatgaggaagcgctccgctatggtcttttagcagaaaaaacagccgaaagtgtgaatgattattctttgcagatgtgctctatttacagcaatatcggaatggtgtattattatctccgtaagaatgacgatgccatgaagtattgggaaaaatcactggccacggcaaagaaaaacaaagataacggctatataagaacggtagccaataatatttctacgatgctgatcaggcagaaaaagtttaagcaggctattaccatgattcaggaatacagagaaaagtatcctattgtagatcagaattttgaaatgtcagagaattatatcctgttcagtacgtacactattctaaagcagtttaacgaagcggaagcctactacaaaaaactggtggcctattatggtgaaaatgcggaaaaaaataaccagcaggcctctttgctgcgaagctttgttttctatcactaccaaacccgggactttaataaaatgtatcgtgaagccagactttttgattcaatagccaaaaataacgggaatgatatgcttcgttcggaaaatcatttaatgtggttcaaagcagattccatacagggaaaataccttgatgccatacagcattatcagctgtacaaaaaactttccgattctgtttttaacggtgaaaaaagcaagcagatcaacagccttaaaattcagtttgaaacagagcagaaggataaaaacattcagctgctaacccagaaagcaaaactgcaggatattaaaattgcgaatgatacctttatcagatatgtcttcatcggaagtattctggcgctgatcctttttgctgctttgctgtataaccgttcaagattaaaaagcaatgccaataaaaaccttgaactgaaacgtaagcagattgatgagcagaatgagcaactgaagaaattactttctgagaaagaatggctcttaaaggaaatccatcacagggttaaaaataacctgcagattgtgatcagcctgctgaatacgcagtcggcttatctggacaatgaagatgccctgatggctatccagaacagccagcacagaatgcatgccatgtctctgatccaccagaagctttatcagtctgacaatctttcaatgattgacatgtcgtggtatatttatgagctgattacctatatcaaagaatgttattcatctgacaggaaaatcaactttacagtagataccgataaagtgtttcttgatgttgcacaggcagttcctatgggtttgatcgtcaatgaagcggtcaataataccgtaaaatatgcttttccggatgaccggaaaggggaagtttttgtttcattcaaaaataccggtgaagatctttgtgaactgatgatttcagataatggagtagggcttcccgaagatttcaatatcgaagaaacagattctttggggatgaatctgatgcgtggacttaccgatcagctggacggaacctttcatctcgaaaacaaagggggcttaaaagttacgattaccttcagaaaaaatacagaaataactccttcaaattaaaggctgattattatgaaagaaaaaatattaattgtagaagatgaatttattgtagccaatgatctgaaactgatgctgatgaaagccggttatcaggttacaggaattgcatcttcagtggttcaggccagaaaactgattgcagataataagccggattgggtgcttcttgatatcatcttaaaaggtgacctcacaggaatcgatctcgcctgggaactgcgtgaaatgagcctgccttttctttatatttcagccaataccaaccagtctaccctggaagcagtgaaagaaacacagccttacggatttatggtaaagcctttccgggagcgtgatatgattgttatgcttgatattgccagataccgttatgatatggaaagaggctgtgaattgtgtactgataccggaaacaatgaagtcattgaaggaattatcgggaaaagcaaggtacttcaggatgttgttgaaaaaataagagtagtagctcctacagatacgtctgttctggtggtcggggaaagcggaacaggaaaggaaaaagtagcccattccgttcatgagctttcagaacgtaaagcccatcctattgttgtggtcaattgtgctgcactgccacatgcgcttatcgaatccgagcttttcggacacgaaaaaggaagctttaccggagccaatacattgaggatcggaaagtttgagcaggccaacggaggaaccgtcttcctggatgaaataggggagctgccattagattcacaggttaaactgctgagggttttacaggagaaagaaatcgaacggctcggaggaaacaacactattaaagtaaacgtaagaattgtggcagcgaccaaccgttctctggaaaaagaagtggcggaaggaagattcaggctggatctgtattaccgattgaatgttttcccaattgaactgcctccgctgagagaaagaaaggaagatatcgtcttgctggcccattttttcctgaataaatatgccgctgcttcaagaagaaatatcacatccatcagtgaaaaagcactggaacagctgttaaattatcactggcccggcaatatccgtgagctggagcatcttattgaaagaagtgttcttctggccaaaaccacagaaatagaaagctttgatctgccaaaaatcgttgaaaaacctacagaaacacaagggccgctgaaatcattggaagatatggaaagagatcatatcatgagtgcgcttcagacttccaaaggaaaagtttccgggccgggtggtgccgcggagcttctgaaaatacaagctcagactttatattccaaaatgaaaaaactgggaattgacaaaggctataaataatcccggggaaagctagccggagaccctattttcttacaattttttaattataattcttcaaataattggaggatacaatcatcatgtctttacaatattaaatcaatcaggtaattatggaaaaagaaacgctcagaatagaaggattcagcgatggtgtttttgcaatagctgttacgcttttggtgctggatcttcactttcctgaagaacattcaatacagaacgggaatgatctgctggtctttctgaagaatcaatggccggcgtttctggcatttatcctttcatttttcagtatttttatcatgtgggtaaaccatcataagatcttcaaacagatctacagccggaattcagcgattatgtttgccaatggactgatcctttttctggtttcagcagtttcttatcctaccgctttgctggcaaggtattttgatggtgaagcttcctcagttgttgtggcactttataccggtatttttgttctgatcaatcttgcttacaatttattatggtttctggctacccgtaacaaaaaacttttacgcccaggtattaccgatgctgctataaaaaagatccataataattatttatatgggcttcccatctatgttattgcattaatcctgtcgttctggataccggcagtttctttgatgatcattttaggactctggattttctgggctttgtcttccgggaaaatagaaatggggcttgacaaacattattcagattccctgaaataatgttccttctctattccaagtttctgcattttggaaataagcgttgtcggaggcaatcccagtagttttgcagcgcctgtttccccgaaaatacggccgttacattttttgattatttttaaaatatattccttttcaaattcctgaagcgttttaacctgaacatcctgatctgtattttgagcgttcataactttcggaaaatccatttccctgatcatatctccttttgccgtcagcatgcttctttcaaccatattttccagttcacggatattacccaaccatggattagcaatcatcattttgaccacgttctgagaaaaaccattaatctttttgcctgtcttaggatagagtttttcaaggaaatagtctgccagcaaaggaatatcctcttttctttcccgcaaggcaggaagatggataggaaaaacattcagcctgtaaaaaagatcacttctgaaccggccttctgccacttctttttcaagattcctgttggtggccgtaatgatccgcacattcaccttaatccttttgtttccgccgattctttcaatttctttttcctgaagaactcttagaagcctggcttgtaattccagaggcagttcgccaatttcatccagaaaaatggtgctgttgtgggcctgttcaaactttcctttccgctgttcggttgctccggtaaaacttcctttttcgtgcccgaaaagttcggattctattaagttggcaggaatagccgcacagtttatcctgatcatcttctttcccgaaaattctgaaagttcatgaaccgcctgtgctataagttcttttcccgtgcccgtttctccatagatgatcacattggattgcgatggagctgcctgtgagattttttcgaaaatgagctgcatggcttcgctttgccccacaattccatgaaagccgtgcccgtttttcttttcttcttcaacttctttcggaaaattccggatatttccctgaaatattttcaattgctcctgaacatccatattatgaagggtaatggaaagctgggtagaaatgccgtttaaaattctttccggaattgtatctcttgaaataaagcttttgtagaaaaggaaaagtacatttttactttcactgacagccggcagtcccagtccgacagccatccgcattcccgaattttttgcttcggtaaaacaggaaggaagcggtgacagttctttcagatcaaaaagcagtggctctgcggaatcaagacagttttttacatacctgtcaagctgttgatctgtggtatggttctgattttcaatccggctactgagtatttcaatagttcctttatcatctctgatgatcatataatcattgaatcccagttcagttttgaaagatgtgttgataacaagctgaagctgtttcttatctaaaatggtagacaactctttggttaaacgggaaatcataagctgttctttctgcatttcctgcaggcgttttatcatttctgcattgggatcagaaggcttactcatagaaaattcttacttgaaagtttaaagataggaaaaattgaaaaagatttgcatgtgagtggttacaatacctgaaataaaaaagatgaaccattaaagttcatcttcaatacatttaaaagagatcgttttttaagatctgataaattccaaaaggtctttgttgatggttggatgctctgtagtcggcatcccgtgagggaatcccggatacgtgatcagttttccgttctttaataatttaattgattttaatgcagcattggcaatgggaacgatctggtcatcttcgccatgcattaccaaaaccggaatgtcaacagcttttaaatcttccgttaaatctgtttctgaaaaagctttgatcccatcataatgtgccacgattcctcccattaatccctgcctccaccagtttctctgtacgccgtcttttacatcagcaccttctctgttgtagccgtagaaagggaaagtaaggtcataataaaactggtttctgttgtttagtgtctgttccctgatgttgtcaaaaacttccataggaacgccgtcaggattgttttcacttttcaccattaccggtggaatggcgctgatcagaaccgctttcttagctcttccattggaatatttattcacataacggattacttcaccacctcctgttgaatgcccgatgtggacaacatctttcagatcaaggaattcaaccagttctgcggcatcagaagcgtattgctcaatagtgtggttgtagatattctggcttgaacgcccgtgacctcttctgtcgtgggtaaccactctgtagcctttctgtaaaaagaagatcacctgtgcatcccaatcgtcagatgataaaggccatccgtggtgaaacattaatacaggcccttgcccctgatctttgtaaaaaatttctgttccgtcttttaatgttaatgtgctcatgttgtttatttttaatgttatgaattgatttttaaatatttttctgattaataggctgtattttctcgtaccaactgaaaaagatcttctgcaccgccgttgaatttatttccgttaatgaaaaaagaaggtgttccgtttacgccgctgatgatgccgctttcaaagtctgtatctactttttctgccagttcctgcttatggatatccgctttgaactgagggatatttaaacccaatttttctgcaagttttaaagggagaccgtcattaagaaattcctggttttcataaatagcatcatgcatttcccagaattttccctgcaaagctgccgcttctgctgccagcgctgccgttcttgcatactgatgcatttctgacagcggaaaatttctgaagacaaatctgatctgatctccgaattccttcattaattctttaagaaccggataggctgctccgcagtaaggacactgataatccccgtattctacaatgactaagctggcatctgagctgccctgagtatggtcagcattgctgactgatggtttaagtgacataattattttgtgttaaggttttctaatgcttctaaaattctgtctgcgccaggattgatggcggtgggagagaggtagctccattcgatgagaccgtctttattgatgacaaacagggctctgttgcattctccttcttcgtcattgtaaacaccatatttcctggctgtttctcctttggcttcaaagtctgcaagcagtggaaagtgcaggtttctggattgtgaaaatgccagatggcaccatttgctgtctacggaaatcccgaaaatctctgcatcatattttttgaaatacttcagcatttcgttgtataatgccatctggtcactgcacaccgggctccagtctgccgggtaaaatgcaaggataacgtttcgtcctctgaattcggataaggtaatcttctgatccggggttgcaaataatgtaaaatcaggggcaaccatatttttttctagcataggattagtttttaaatgttggaattggtactgtaaatgcacagatgagcagtaaggctgccggaaagatcagtgtccagtttcctgaataaaagcacaggaaaggagctgctgaagcaccggagagaaagcccatccataagaataacaaatgaaagatatttactttgtattccttccgctcctctgcgtgatcactcatgacaaaaagagcagctgttcttgccaggctgtttaaagttcctgtcacaaaatcggtgttgatcttttggttacctaccgatgtgacaatggtgttcataagacccattgagaagccgataacagctatagacacttcattggcaatatgctcataataatcagtgatactgtaaaggatcatgatgccggaaactgtgtagaagatcatctttgtgcttctgagcttctttgacaatgatagacacgttcctgtataaatccccgccagaaaaaagctgattacaatgacagaactgatgataatatcatatttttcactgaaaattgctgcacctaactgggtcgtattgccgctcataaaagaaacgtaggttttccattgtatcagccctgtagcatctgtatatcctgcgataaaagcaaggaatactgccagtttctcctgtgttctgacggtcttgtcaggaagcaggatttttgtttccggaagcacaggagttattttccaggtttgatgaatactttcttttccggaaatttttctatttctccttccttcaatccgaaattggtgatgaccacatctttagggtttcctgccaaccactcgctgatatcaatggattcataggtgccgctgttaaatccgatcaatactttacagacggtatctccggtatttttgatataatgcccggctcccatagggacatagcctacatcaccggcattgaactgttctgtgacagaaactccttccgccaggaataccgacatttctgcctgtccggatataaaatactgccactcatccgcattcggatgccagtgcatttctcttaaagctccaggttgcagctccagtacagaacctgccattgtggtgctgatcggaaattccttacttgtaaccaatctttggagccctccgccgggaatgattcttggctgctgggaatgcagaggatagcggtgaaggcttgtcagttcaatgtctgattcctcaggacgggctgtggcattcaccgagagttcgtccggaacaactcctgctgcaaagtaaacttctttctgaggaagttctgctacttcttcaaggcttagtcctaaattctgtgcaacgatttcaggaggcatacttgacacaaaatcggtaacgctgaaggtatggtcttccgaaaaattaccgttgtcgaaaatcaaaataaaatggcattcctctgttccggtagcctggatggaatgtccgtagcctttcgggaaataccatacgtcaccgggttcaaaattgtcagtataactctgtccgtccggatggataatcgttgtacgtaccgttcctgaaatcacatacgcccattctgcggcgttggcatgccagtgaagttctctcatacttccgggctgtaatctcatggaaactccggcaatgcctacagaagcagggaattcctttacagaggcacctcttgttgtaccaccgtcattggtacgcggttcttttttttctaattcgtatctgaaacttaatgatgaaggattcatagtattattttttgtgattaatgctctttgtttttgttattgtaaagctactcctgaattttactttttcttgatgtcattcggtgaaaaggcaaaatgagtcgttgaggatatagagggtttggttgctttaaaaaggctggttatattgccctgtcagtgctttattttcaatgctttttgcaaaatttggtgtttcctcatgattgtgggcgtcagaagcagcctgtctggatgcggcagcatctgcaaggttgatcccgtgttctttcagatattcaaacatttcgggtgtggctgtcgcatgaatttcattggtgtaaagacaggtgttttcatcgatctttgtcactttcagttcccataagacctgaacttttgtgcgcccgttttgggtaattgaatccgagatggaaagcatgcggcagtaatcaggacggtgaacatctgcaacataatgctgtaccatcagtgcatccccaatagtttctacgtttaaagataccggcttaccatcaaaagtgaaagaaatagcggctccgatatgctgggtagagcagcgctggtattcggcgtccggcagattaagcagccagtctgcgatatttactttttcaatgggtgcatggatgatggcacttacgcttgagtgagatagcgcgttttcgggagtttgtaagatttccatagttgttgattttgattgttatgttatgttatgttatgttatgttatgttatgttatgttatgttattgatgatgtaaagctacaaaccggttgttttaatttttaatgctgttcggtcaacaggcgaaaactgtcgttgaataagttgatgatgttcaaatagcaacagggcagggttcctgaaaacaaaaaaatcactgtaggttacagtgattgataaaggataatttttaaatgaggttatttatatagccattttttaatcagcctggtataattgggcatcacagaaaacaccatcagaaaaacaataattccggaattgatgaatccatcagaataatgattggctgtaatatgtaaaaactgtaaaaaaggaatgatcaaagcaggaataagtacagacagcggataaatggcagaccacgttgccagaaactgtttccagcgtaccggaactttattcccttcattttctgtcgtaaaaagaaaatcaagcccggatctgatctgataatggtcgtttttcctgaacagcggattcgctttctcaataagttttttccggttatccgattccatccaatttttaagatggttaatcgtatcaaaacggatgataacagtgtacacaaaagtcagatcaggaataggacgaataatctgaagatcaataaagccttccgaatgcctggtgacaggaataatttcgtccagccatttttcatattgtgattgttttccatccagaatatgatgggtaatgactactgaggcaccccgattttccataactgattttttataggttaatttaatacgctcttttatactgccacggaatttctgtttcaatacctaatgccttggcagaatgaatagcaaaataaggatctctaagatgttcccgggcaatgattaccagatctgcatctcctttgacaataatatcattggcctgttctgcttccgtaatcattcccacagctcctgttaaaatcccggtctgttctttaatggcttttgcaaaaggaacctgatatcccggaaatactttatccttgcttacattggtaaatcctccgccggatgctgtaatgaaatctacaccgttttctttaaggatttctgaaagtttaatgctgtcttccaaagtccaggcttcatccgattctatatagtcaactgcagaaattcttacgaacagaggcatttcagcaggaataactttcctgatttcctgaacggtttctacaagaaaacggattctgttctcaagacttccgccatattcatcctgtcttttattgattactgcggaataaaactgatggaataaataaccatggcctgcgtgaagttcaatggtatcaaaacctgcttcaatggcacgaagagctgctttaacaaatttcgtcttcagttcctgtatatcatcaatggtgagttcttctgcaaaaactccgttgaactcatgagctgaggaggattttaccgtccaggcaccttcttccggagtgaggggtttcattctttcattgggatgtttcaggcttccttttcctcctgcatgccagagttgaattcctattttagcatcctgttcatgtacaaaattcacgatgttttcccaggcgtttttctgctcatcattccagattcctacatcagataatgtagccagaccttcttctgaaacggctgtacattcggtaagaatcaatcctgcgccgccaactgcacgacttccgagatggacaaggtgccagttgccgggaattccgtttttagcgctgtattgctgcattggagataatacaattctgttctttagggtaagattgcgaatgtgtatgggtgaaaataaattcattttttctttttttaaattgtttttgaaaatgcttcagcttcggaaaccgcttctgacagaactttctgtacttctgccagtattttttgcagatcagtattttcttctgatgctgtttctagaatatcgagtttttcctttaaaagaggatgtaatcccataatggcaatactggatttcaaatcgtgagcccacagtttcacctcatgaaaatctttgttttcgtaagccactatcagtttctgtagatgattgggaatattctcaatgaactgttgcgtgaccattttttcgaaacttttgtcgccgccgctcaccgtctgcatataagagagatcaatatactgatagtcagataatggattttcggttttcttttcgtttttattcgtttctttaaacccgaacttcgaaatcagcataaacagctcttcttcattgacaggcttggaaatatattcgttcatcccacggctcaggcatctttctctttcgcctgccagagcatgggcggtcattgcgatgaccggaatatccagtctgagttcttcccggattttctgggtagctgcatatccgtccatgtgcggcatctgtatatccattaaaaccagatcgcatacattgcttttaagataacttacagcttcaagaccgttcgatgaaatatgaaaatcaatattccattgtgaaagcagatgtttcatcaggctttgattgatcacattgtcatcaactaccagaactttcagaggtgtgttggatttatccttaaaatagtgcggatcagcagctggcagaacagtaagctgttcctcagcaactccgtaaggaatgtagaaatgaaaggtagttcctttccccggttcactgcttacttcaatgtttccgttctgcaggagaattaagctttttacaatggataaacctaatcctgttcctccgtaatttcttgtcgttgaatcttctccctgattgaatctttcaaagatttcagtaagcttttctttgtcaattccaattcccgtatctgaaattttaaatccgagaacagcttctttttctgtttgctgtttactgtagatttcaacagaaatatttcccttgtgggtaaattttatggcatttccgatcaggttcactaaaatctgcgtcagtcttgtggcatctcccaccaatgtgtcaggaatggaaggatcaatcgtactggaaatggtaagtcctttttctttggcccgttcggtaaaaaatgtttctacggaattaaccagtccgttaatactgaaaattccaggggtaatgcgcatcattcctgcttctattttggataaatccagaatgtcattgatgatggccatcaggttttctccggaacgctgtatggaagagacaaattctgctgaggtttcatccaaaggacgtttttgcagcaaattggtgaaaccgagaattccgcttaaaggagttctgatttcatggctcatattggcaaggaagttttccttggtttgtgccgccaccaatgcttttttctccgcaatatcaagttcgcttatgagtaacctctggcgtttaaactgtctcagaatgtgatatccaacgacagaaccgcccaaaatcagtaagaccaatattgaaatgtcataaaatcttgctttctgccccatttcctcacttttctggctgagttcaaccatattcagttttctgctttcatatattttagctgtgattctggtgatttcattggaaatattccttgcacgcggattggcaatggaggtattgtcgtccatgtttcctacagacaggtaacggtgcaggagtttatctttggttgttttcttttccatggcaagaacgcttaatctgtggatcagcttttcttcctcagcatttacattgtccttggaaagagaatccagaaaattttcgatctgactgattttttggtcgataccttcaagatgagtggtgtcattcgttgcaatagaagctctgattctgctttccaccccaagaatatcacggtcaatctcccttaaatgattgctggaacgtaattcgctcagcaaagtattgttattctggatcagcgctttggtatttcctgcagaattgagctgaacagctatcagcaggagtgagcctgcaataaatgtcaggataataaaatagctgaatcgcttgttatccattactgaagatatatttttcataataacagtctgatttaaataaaatacagataaaggttgattaaaccctaacctgttcagggattgagatcaaaaaaggaagtcagattttctgatggccggcaaaggctaaaagacattcattctcgtgttgagtgctttcctgtaggcatctgctacaggaatgaatttaccgttgatcataataccgccgtcctgaagggtgtcaattttgcctacagaaacaatataggaacggtgaactcttataaaatgatctttaggaagacgttcttcagccgttttcattttaccgtgaatggcaaacatcttttctttggtgtaaaactttacataatcacccatggcttctgcgtagaaaatatcatccagttttaagcgtcttgtaatattggaatccctcacgaaaagaaactcatcccttgtaatttccacattctcttttctgctttcaagaatcgtctgtgctttgcttactgcctgcagaaatcttaccggcataatgggcttcagaaggtaatctgcaatattaagctcaaatgcttccagtgcatattccttttttgaggtcgtgaaaatgatgatggtctctttaccggaaagggttttcgtgagttcaattcctgtcatttccggcatttctatatcgagaaatatcagatcgacggaattggactgaaggtaatgataagcttctatagcattggaaaactcactgacaatggaaagatccggaacctgtttggcgaggtgtgctaatgttgttcttgcaatatcattatcatccacgattaaggctttcataggtatagttgtttatggtttacacaaagataattataacttttttattttgtgttatctgaaataggaacggatcatccatgccatttcttcatgggtttccatcagacctgtaataaaatcgctggtaccgtaatctttatacttttctgcaaatggagtgatgtttccgcggagaaattcaatgatgctttcatgatcacttaacaagtctctcatgtatcccaaaccatcgtttgttctttcactgtattccgttaaatgagtcagttccagatagattttcattgtcgccggtgcataatgcccgattttacgcattctttctgcgacactgtctatcagttcatccagttgtttgtattgttcttcaaagaaaatgtgattggcatggaagttatctccggttacgttccagtgggcatttcttgttttgatgtaaagcagtgtttcatctgctaataattttgctaattgttctgcaacagcttctgtgtttttttcagtaattccgatttttgttttcataataataagattttagttgagcattattgcctttttctgatgtaaaggtcagccataatcctggaaaacaatctgtattttcggcgaacgggcagaatcaatcggtgaaaagcggacaatttccgctttccataagtttcagaataatataacagataattttataagctaagatgcttctttaaaaaggcaagacttccttctgccaatgtctgagcatcataaggtgatttctgccataatgaaaccttttcctgcattcccggaattgaggaactgaaattttcaagaaccagatttccttcaaaattgatctttttcaatgccgagaaaaattcttcccagttgacagttccttctccaagcatgccccggtgagactctgtaacatgaatatgcttcagcattttttcggatttgataatcgggtcataaaaattatcttcctcgatattcatatgaaaggtatcaaggtgaaggaagagattatttcgccccgttttcttaataagttccaggacattttctgccgtattgcagacataagattcatagcggttaataggctctatggcgatatctatacttttggcctgggcgtaatccgccacattgcaccacacatcagcaatgatttctttttcgttttctgtgagtggttttccggtaaaaacaccgattccgccatgcaggacaccagccagaagatgggtttccagttcatatactttatcgatggcttttttgataagcttttccgaagcttcaggatagaacgcaatatgagcatctttaggaagattcaacgaacatactgcttccagatgattgtctttcaattgtttttttaccgtggacgcatcaaaatccattgatccgggtaacagtatttcgataagatcaaacccggcctgtgacgttttttctatagcatattttcctgattctgcattccataacgccgtgatccaggagagtagggaagctcctaattttatattcatcatatttctttattttaatttaaaaaatccaccattctgtccgtactccgaaataggtcccgaatcttttggctcctgactgctgtaaaaacggtgaataaagactgttcatagcctcatcattataccttgatacttctgcaataaaacggatgtgaggtcttgcccagacacttcgttccgctgtaggaacaatggtgggagccagaacaagtttcatcatcgatgctgcatcctgcgttccgtttttacgggttgcatagtgaaactcggagagaatatggaaccagttgttaaaatagtaagtagctctgatccccgtattaaattctgttttcctgttgaaaatctctcggttataataatccagcgctttatcagtattggctgatcctcctttgcttttggtgaaaaccgcatagggattaagtgaccagcggtttgagatattccagaggaagtgttcaacaaccgtaaaagagtaagctcctttgtatgtttttgtgatctcatcaggagctccgtaggtgcgccaggtctgggtattgccattatcacctccattggcgattccggtcccgtatcgtacagaaagctgattgaatgaacccggaattgtcgttgcaatatctgtatttaatttagctccaaaaacccaaccatgatccgatggatattgctctacagaattttctcctgatttttctacatgatgaaattccgccatcagtttcaacttgtgttttgtatttttaaatggcagcgtctgctccaggacaaaaacttccctttgcctgtagatgaggttttttgaaccgctgatcacattggtgtaagagtagggtgtggagttgctggccgcagtatcaatagctgccgggaaaaacattgaaaatctggtgtttttatgtctcagtccccaaccggttgccgaatggtcatcaaaataaaaataatctgcaatgtgaatgtcatcatatctcagccatcttgaccctgcccagacatcccaatcacttcccataatgtttcttgcttctacaaaggcttccggcaaggcaataatcatcccctgattggattttgaatctacatttcccaggaaagttcctcctgaataaaagctcagtcttgcctgcatatcgatctttgtactttttgtactgtcaccgtttaccactggactaaaatggaaagccggtaaaaagtcaacataatctccctgatccattctgcctcctaaagatccctgattgttcagattcagctgtcttcctgtttttccatcggcattcggagaataaccagctccgattcttcctgttgtcccaaaggaaaattttttgttggttattgtgatctgggcattaattccccttccggcgcatacaagtaaaatgcaccaggctaataaaagctttgttttcatagggattatttaagtgttttgggcttgtagaactttaatgcaaataataaaatgacgacatagcagagaataggaagaaggtaagcatgggcaatatctttttctgcaattctgcccatgatcggagggaaaacagcccctccaaacatcgccataaccaggaatgaggaagcctgctgaacttttgatcctaatcttttaagtccaagactgaaaatagtaggatacattacactcaggaacaggttgagcaaaataaggcttataaatgatacccatccgaaactttgggaaataatcagacacagaacgatattacaggttgtaaagatagccagcagtttgttgggagcaataaatctcatcaggaaggttccgataaatcttccgatcatcatcatcgccatacttaaagaaaaataataagaagcctgtatctccggaaggtgcattttctctacaccgtaattgataaaataagcccatgttccaccctgtgcggcaatattaaaaaactgggcaatgacggcaaatataaaatgtctctgtttgtaaagtggtgcatgaggatctgatacggaaacatcttctcctttttcattttctgaaatgatgatatcttccgcatgaggatctttaaggtccggcactctgataaaactgaaaattatggtaatcgcgagaatgacaatcccaatccatgtataaagattttttacggaatccagggatcctgatcctgtatcaggtgttccgaaaatgaagtaccctcccagcaaaggtccgataatggctcccaaaccattaaatgactgggcaaaattaaccctctggtcacttgttctttcatcccccaaagcggctacaaaaggatgagctaccgtttcaagggttgccattcccattgccagaacaaaaagagccagtctgaaaaagttaaatgaggatgtgtcggcggccggaataaacagaaaggctcccagtgcaaacaatgaaagccccagaatgacccccgatttataaccaaatcttttcataaacagacctgcagggatgcccatcaatgcataagctccaaaaatggaaagctgcaccagccctgatttggactttgaaatatgaagaacattctgaaaatgcttattcaatacatcgcccatggtgagggcaatagcccagaaaaagaatagagaggtaacaaaagaaaggatgatatagtatttcttatctgtaaattttggagtattcatatcataagttttaagaggttttacagctgtttttttctctgaatgccttgaattcttcataagtataatcagggcatgccccagatttggaagtgataaaagcacctaatgacgtggcctgtttcataatttcttccggagatcttccctgaattcttttagacaggaagccggccagaaaagaatctccgctacccactgtgtctgcaatttcaatatgaaccgccggaaaattataggcagtgtctcccacaaaatatctggcgcctttacttcctttggtaaggacaatttcattcagattaaaataagtctggagatgtctgatgctggtatcttcgtcaatatattcttcaccgagatattcaagaatggttctgagttctgccttattcattttaacaagatcagctttatgcaataattttttaatgaattcaaaatcaataaaaggagggcggaagttaacatcaaaaactttgaattttgaatattccaaaagttccagcagagtattccgggatgcctcatttcttgtgatcagacttccaaaaacaaatgcttctgaattttgtatcagttccttatgctccggcagtggctgaatataatcccaggcaacatcctgcacaatgtcatatgcagcctctccatgctcatcaaaatcggcaatgacagttcctgtggccttttcctggtcgatctgtatgaaatctgttgttattccccaatcctggatctgattaagaagtcgatgtcctaattcatcatttcctgtacggcttagcattttggtatcgattcccatttgaaaaagattgtaagcaacgttaaatggtgctccgccggctctggatcctgtaggaaagatgtcccacagaacttctccaaagcaaacgacatcgttaaatttatttgttatcatattaggttaaacgtttaagttgttgtttaaaaaaaatggtttatgtcaaattacttattttaaagacgctttagcaaccagtcttgcggataatgttattctttttccggttggcacataattgttgatttgtccatccagtagcttaattgcttcttcggccatttcttcaatcggctgctggatgtaagtgatctccgtagggaagagatcataagcatcggtttcatcaaatgcgattacagagacctgttccggaacttttatattgtttttaacgaggtaggaaagtcctgctactgcaagtttattactggaaaaatataatgctgtattttcaggtttttttcccaggcttttttcaagttgtacatgtacttcctgtgcaatattttccagtcctaccaggagatattgtatttcagctgtttttctggaagagcttaccgctttttcaaagccatgctgacgatcaagcaggtgtgggagcttagtgtcatagcccacgtagatcattttgtcaaaatccttattaagaagcaggccggctgtgcgctctgcgatctcctgattatcaatggtaattcccggaacagaaacacctttaagatacctgtcaatcgttacaacagggtatttaagctgaataaggttttcaagtgtcttttctgatcctgccacaggagcaacgatcattccgtctacctgctgctgcgaaaatagttgggtaagtttttcaaatttttctgcattttcatcagaactgccgatgatcagggtatagcccagctttaaagctttatcttccagattccttgccatgtgggaatagaaatcgttggagatatctgcaacaataagccccagcagcttggtcttattggttttaaggctttttgcgatcttattaggggtgtagttaatcgtttcagcaatttcaaaaatttttttccgggtctcctcgctgattcgctgtccttcctttcggttgagaacataagatacagtggctacggaaactcctgccagcttagctatatcttttatggaagaccttttcattttaatttttaatgcacaaaaatatttcagaaaatagtaaaaaaacaatagctaggtttttttggtggtttcagaaaaaagtgtaatttagcgcaattttttaaaatcgatttaattgtttgtatatcaattaattatatatttgcaactgtttttaatatgaacaaattgttaactgatttagtcagattgattaaatttggttaaacgtttatccttaaattttttaaattaacttttaaattgataaagcgtgtaaaatttttcgccggatccaccactgttttttgattatagctgtaaatatatttctgagcttgtcttctgaaattggaaatgcagaacagaagaaaaaataaaataagcttcctgctaaaggaagcttatctgatttcaagtaagatgtaattataaacaagactcaaaaataagataaataggaccggataattatgagtgtgatcatattcggtaatgattgttgaaattgcatagtattattttcagtatcttactggtttattaatgttatagagaaaattcagaataagaatcttaacttagatttaaatcttaaacatgaaagaaatgaaaaaaatactatttttcatcatcactataacaagtatagtctttacgaaagggcagactattgaatctgtcagccgaagtaccatcggatacattaaaagtgacgggacaattgaaaacagcagtcatgcgaccacaggttatatcagaaatgacggaaccattgagaacagcagccattcaacgattggatatatcagaaatgatggaactattgaaaacggcaatcgttctacagttggttatgtgagggaagatggaaccgtagaaaacagcagccgtgctactttgggatatattaaaaatgatggaacagttgaaaatgcaagccgaagtacgatagggtatgcccgtgggataaaaaaagaatgggtggctgtagtctatttcttttttaagctctagaagaaaattttattgccggacagctttattgtttctgatattttttttgctttttatatgcttaaagccttttgttggcttgcaaattgatactacaaactgaattgaatttttgatgactaatggctagaacgactgtaactctgattttccttttatgtggttttttctttttacaagcacaggagaagaaagactcactttattataaaatagaaaaattttcagacaaaagaaaggttaccaaattcatccaccggtttatatttcgtagagaaccggattctacatctgtaaaatccaatactgaaaagctttcgcagaagacttatgacaaaaaaatcatcagaaatatcaggatagaaaccattgaccctttcggatataattccaaagacagtaaagaaatgggcagatggtatgattggataaaggatcatcttcattccagtaccaggagatcaacggtcaataattttctactttttgaagaaggagaagagtacaatgcccaaaagctctacgaatctgaacgtttgctgagagcaatgccttttataaacagggttaatatcagtgtttccgatagtacttcgagtaaagattctattgatgttgtggtaagggtacttgattcctggagcctgaagccgagaatcagttattccggaagtaaaattggcctcggtgttacggaagagaatgtgctgggactgggacatacactggacttcctttacagaaacgattccaaagaaaagcagaactatctattagggagctatactacccataatcttttcggtacctatatcaatgcccagattcttggagagcgggacttttcgaaaaatgaaagaattaatttcagcctcacaagagactttttctctcctctgacgaagtgggcgggaggttttacatttgaatattttatgcgaaaagttctacttccaacagatacagctaacacttttcctgaggttcaaattaaagtatacagccaggatttatggggaggttaccagattccggtttcggctgatccgcgtgaaaaagtatccagtaatattgctattataggaaggtttcagaattatcagtacaaagacagcccgggaatagaccagtataaatatttcagctcctacaacagttttctgatgtctgttgggtttattcagagaaacttctctgttcagaagaatattttccagtatgatttgccggaggatattgcttatggtaactctgtcaatattattggaggaggtttatcaagaaataaagaagtgaatccatatgtgggaatttcagcatcttacggccgttttacgaatctgggatatttcacagtgaaagcacagtttggaagattctttaatgaagacagccagaacagggagtctttccgctttgacggaacgtattttactaatcttatggactggaaatttgccaaagcaagacatttcttttctccgactttagcactgggaaatccgcagcataattactcttataaagaccgaataaacctttcatccccggacgaatttccggtttacaattcagattacatcggaactaaaaagcttgttttaagatatcagctccagttgtttataaataagacctggaaaaattttcatttcagtccttatttaacaacagcggtgggctggctgggaatgcctgatgataagctgtttaaaacaaaagccaatgcaaaaatcggaatcggtgttttaattaataatccgtatctggtgttcaacaggattcagatttctttcatgtactatccacgggttccgtttgataataactctgtttttgattttaacagtaaccgtaataacctgttaccattgaacagctttgcaacggagattccgcattttgtgaatttcggaaattagtaaaagttaaaacttccttactcaaaagcaaggaagtttttaaatggcataagaatattttggtcttagactactacgtcaatcttcacattaatattacctctggtcgcttttgaataaggacatgttgcgtgcgctgtttccaccacttttctggcttcatctaccggcagacctggcaaaacgatttgcagatgggcctgcaggaaaaatccgtcatcattggttgccagatctattgaagtgttgacagacagatccggaggaagattaatcccaattttaacggctcccaaatgcatagctccgataaagcatgccgaccaaccggctgccaacaattgttccggattggttccgtttccttttgaacctggagatgtcagttcaatatctaattttccgtcactgctttttgcttgtccgttgcggcctcctgttacgataacattacctgaatacagtactttactgatgttgacaacggttgtgttttctacttcctgaatggtatttaattccatatttttattatttagattagacgatattgttgattgatatttctattaaagtttttttcttaaatctttgaatgctgctctaagctcttctgtaaagacctgtggctgttcccacgctgcaaaatgtccccctttcggagctttatggtaataatataaagtcgggtaagcactttttgaccagctttccggtgcctgatagatttcatgagggaataccgaaatggccacagggattttaatgtctctcgttttctgtgcctcagcactgaaattgtttttattgttttcccaatagaaacgggaagaagacgctcctgtattggtaagccagtaaagggtaatatcatccaggatcgcatcacgacctattacattttcaggatgaagatcactttcgctccattcagcaatcttttcataaaggaatgctgctaaagcaaccggagaatcagaaagtaaatatcctgttgtctgtggacgtgttaccatcattcctccataggctgcatttcttccaaagaatgtactcatcgcgttataagcttttgcttctgaagaggaaagtcctgatggagtaggatctcccgcatttataggttttacaagctcagcaggaatagtggcgggcatagtaagatgaatccctaaaagtcctgaaggagcctgtttggccaatgcatcggatattacagaaccatgatcaccaccttcggaaacatattttttgtatccaagacgcttcatcagcacatcccatgcacgggcaacgcgatcaggattccagccaagttcagtgggtatttctgaaaaaccatatcccggaatagcaggaatgatcacatcaaatgcatcgcttgcctttcctccatattttacgggatcggttagcgggtctattgcattaataaactccagcggagaacctggccagccatgggtaaggattaccggcattgcattagattctttagaacgtacgtggataaactggatatcaagcccgtcaattgtggttacaaactgtggaagtgcattcagtttatcttccacctttctccagtcgtatccgttaccccaataagtgatcagttcttttaactgttcaagctgaattccctgagaagcatctttcacggtttctttatccggaaaacgggcttcagcaatgcgctttttaagatcatccaattgggattgcggaatactgatgtgaaaaggacggatactggtatcagattttgctgatagagtagaagtctgattaacttgtgctttagaaactgcaggtgtacttaagatgaaagtggctgcgaacaggattgttgaaattgttgttttcattgtttttctgtattagattttaaatctgtttttcttttttgatgagacaaaattatgctccggtaagcagctgttaaacgggtaatttgtttaggtggccatatttgattgtgaagcagacattagggaaggcgaagaggatcgttagttataaatgataaatgatgaatggtgaatagaaaaaactgtataaaaattaaactgtttgcttcataaaggacaaaaattagctccgtttttgattaaacggagctatttttcggctgtattttttaaagattatccgtgagcttcaacagatacatcgttccattcttcccagacttttaatcgctgctcataattatgttttacaaatggcagtgccacttttccaagcaacagacgcaatggaggattttcagtttcggcaagttttatcagtgccggagctgtagcttctacacttccgaaagatgtttctgcttctgagaatgcttttttaacatcatcataaacaggattactttgagtgttaattcctgtatgccagatattggaagcatatccgttcggttctaccaaagtcacattgatgccgaatccttttacttctgtagccaatgtttcacttaatccttcaatagcaaatttagaagcattataaagtcccatagttggtaaagtagccaggcctaaaatagaagaaacctgaatgatatgcccgcttttctgatttctcattatgggaagcactgcctgcgtaagccataaagttccaaagaaatttgtttcaaactgtgctctggcttcctgctcgctggtttcttccacagcacctgttaatgcgtaacctgcattgttgatcaggatatcaatgctgccaaaatgctgttgtaccttctgaactaccgctaatgattgctctcttttgtctacgtccaaggataaaggcaatacggaatctccgtattgatctttaagatcctgaagtgtttctacatttctggctgttgccgctactttgtaaccttttgctaaaaaagcttctgcccatgcttttccgaaaccttttgatgctcctgtaattaaaactgtttttgacattgttttgtttatttaattgttatgcttatgcttttctataaagctttatattaatttatatgaccgatcggtcatttttttgataaaaaaaattatactgtattttcctctataatttttttcagattgtttccgataattttcattgtatcattgttaccggacattctggacattaaatgtccaccctcaagcattgcaaacacaactgtggcaaagtctgatgcattccagtctgctctgaattctttgttggcaatccctttttctataatgccggaaagcaatttttctccctgcttaattccacggtttactttttcttttacaataggattggtatcatccgcttcagttccaaagtttaacaaaggacagcctccaacaaccggtggatgattgggatcactgaaaaaatcaatataggccaataattgttccccggaagttttgaatctgcttaaagttttttggagttgatcactcagcatttgcatattatgctctacagctgcacaggccaatacttctttattttcaaaatgaacatacatactgcccttggacaatttggtggcttccataatatcgctcatagaagtagctgcaattccttttgtattaaaaataggagctgctttttctataatgaactgtctggtttcttcaccttttgccatgatgataataaataatgatgcaaatatatgaccgattggtcataaaaacaaattttatcggatttattttgaaaaatataaatattttcattaactcccagtagcagtcctttattttttattataatagatgcttttaaatagaaattttacctattcataatttactgtatattagctttattgtattgttaatcaatttggtatgttttaactgaaaaaatctaataattatgaatctgaaactacttattcccaataaagtttttcttttgataatgctgaatcttatctggattcaattattatatgcacaggaagatctgccagtaagaacgcaattgaaaaagactattcattctgaagtattaaatgaagacaggatattatggattaatcttccgacaggctatactgaaagcgaacaattatatcccgttatttatttgctggatcctgatctgaattttgcatacgtcagcgaactggaaaaatttctttctgaccgctacagaatccctaaatctatcatcgtgggaattgtaaatacagatcgggtaagagattttacacctatccattcaattacatttcacggtaaagttgacaatagcctcatgacaaccggaggtgcaaagaaatttcagagttttctgaaaacagaagttattccttatgtagaaaggaatttccgagtagcaccatatcgcatcttagaaggccattcactaggtgggctatttgctctttattgtaaagtggaagactctgaactctttcaggcttatattattattagtccggcaatctacgatggaaattcaaaaattttagagcaatttcctgaagcattaagtaaaaataatgacagggtcagctatctgcacctctctataggaaatgagcctgatggaagagatgctgtaaacgtacttcatgagcaacttaaaaaatatgcacttaaaacgttaaaatgggattttaaaacttatatgaaagaagatcatttttcagtaggatatcaaagtatgtatgatggactccggtttatttattcaaaatggtttattaacccgagagattcttctgtaatacgatctctttcagatattcataaacattatgattttctatcccgggagtatggatatagaattattcctgatgaagattttatgaatgattcgggataccaaaggctgaataatgaagattttcagcatgcaatcgaaatttttacagagaatgtaaggaataatccaaagtctgccaatgcttatgatagtttgggtgaagcatatatgaaaagtggtaataaaaagctggctattgaaaattatgaaaagtcggttcagttaaactctcataatgataatgcagtgaaaattttgcagacattaaaaaaggaataatgggcataggtttaatgtaaagcagaaactattagagtttctgctttttatttaacgataatcttaatgctttccctgcggtcattttcatacacaatactgatcatgtaaaccccttttccatacgctgataaatctaattttatatcatgggaatgcaggtttttccattcggaaagctttctttgagccatatcataaagattgatattctttatcatttctttactcttaaggtaacagaaatccgtaacaggattaggataaaatgtaagctcagactgtacttcaatatccatagttccaagagaaccgacattaatgattttactgatgatttccgaacatgagtttttattaacagtgagattaaccgtatagcttccgggagaggtatattgatgaatcggattcaatgatgagtcattggtgccatctccgaaattccacagtactgaattgtaattcgctgattgattggtaaagctcacagtcattccattgattcctgctataaaatccgaatgaagatgaaatacattactgttccattgcgccggattattaaaaaagaccagatcagcaatattctgaaaattttcagcagtattttgaggtagtccgttataaaaattggatggaaagacatggtcctggaaaatagcggaatatatagaagcagccacaagatagcttcctttgggccccggatgaatatcattataagatccgtgaagtgccagatcctgggaagaattgtagtaatgcctggcagattcactggcaggtattatttccacctgcatcagattagacatctttgtgatggaatcctttattttctgctggaaattgaaataaacattgtattcattcgcagatggtactccgtaaggaatttcatacagaaatattttggaacaggggctgtacttccggatagagtctcttattttgcgtccgcgttcggctgttaaagaaacagggtaagaatgaccagcagattcagccgttccgggctgcataacaacatatttgtagtttttagatcttactttctgatacagcaaaggatcatccacgtgattgacaaaacctgttcctcccggtgtatgcgtcgttatcgaaacattttttccttttgaaatcgctatattgttgaaaatttcaggcatatcattaaaataggtaacactgtttccaataaacagaacctcatcggcttggcagaataataagactgaaaaacctgtacatatcagaaagagtagtttttttatcatatatcaatttgttgaattgtaattttaaaaaggtacctgtagacaaccacttatactacaggtactaaacacaaacgatgattaaaaaatgttttataaattttaaagttatgtactattctttgccttttttaaatataatcatttttatagtatactgctaaaaatatttaaattgctgttgtatacacatattgtattttataatattcgggcattcaaaagtaattgctaattttgtattacaagcaatgttgtattgtgattttcgcatattgtgtatgtaatacgtacgtattttaggttatttggtggttgggtagtattaatattgcattttattttaatagcattatgatgaaaaaaataatgattgtattctttttcatttcttccttcttcttctatgcacagcaaacggaacaagaaataaagaatattatttttgatatagacttttcgaccgccggcccaaaagagataaaacagattgacagtcttattgcagtttgtaaaaaatattcatacaatgattgtgttgcattaggatatcttaagattgcgaatatctatgataaaatgaatgataccagaaagtctttttattatatcaataaagtagaaaaagaaaacctcatcaattctgataccgactttgaagttatcttttatgttcatttgcaaaaatcttttttataccggaaattgggtgaaagggttgcttcttttaaggaactggatgaaatctatgatgaagcaatgaagacagggaatgcttattttatttatctgatcaacaggcaatatgctgataaatatattgacaccaataagccgctcgcattacagtatagtaaaattgcgtataaattttcaaaaatatacagagaaaataaaggtaaccgttatcggattgataaaaacagattgagtaacagttataaaacttcagcttatctgggaggaatatatactgatcttaataaattggattctgcacggatttatattgaggaagccattcaggatgaaaaaaaagtaaatgatactagtctgaaatatataacttcattatatgccggaagatattttagaacagttaaaaatgttgaacaggcgcagcactatttatggattgccaaaaatattgccaaaaattactttaaaagtgagaactatcaaattgcagtgggagatgagcttaatgctttatataaaagtattggtcagaaagacagtgttggctactattccaactggctggtaagtatagaagaggtaaaccgtgagcaaaatcaaacactgaatgatactgtagacaaacagaatgaattggaaaatatgaataggaaaaaagaaaacaaaaagctttttttcattttatcactaagtattgcaatatgtattctctttattttcctttttctatattattatagaaaacataaaagtaaaaacctggataaaattgatatccctcatcagttgccgatgcaggagagcatttttaaagaagtgacacagcttgccaaagaaaataatcctgagtttttgacccgttttaatgagtactgccctcgtttttcagaagagctgctgaaagtttctcctttaaaaatatcagaaataaggttctgtgcttacatctacctgaatttttccaccaaagaaattgctgaatatacttttacttcagtgaggacggtacaaacaaaaaaatacaatctaaggaaaaagctaaatgtccccagcgatatggatatttatgtttggttttcaaaactgttgaaataaagtaaaacaaagtcccgaaataaaatatactcaattagccaaggttgaaatatggatacattgctgcccattgacctctttaaattcaatggtggtgatcatatcattataaatcagagtactggtgtcattgaattgatagccatcaatatatacaggcctttctttaggaagattattttgctcattgagcatttccagggataaactgtccggatagcccgcattttttttaaatatgatttctaccaaaccattgtcagccagataatcaaatttctttaggtgagaaggtaggctagctttggttttaaaaacatttatcttttcgatgctgcttttgtatagattaaacatactgacagttccgataacattattataaatagcgaactttacagtattgtttttttgagccagaagaactcctgaaaaaaatataaggaatgtatataatagctttttcataattaaagtaatttatatgttttggatcaatttctattttttaccgtaatccatcccgtatattttattggaatctgtttttggttaatctcatcccagctcatgtcaaaccaatagtttgcagtagaaacttttttgccgtcaacagttccatcccatttaaatccgtttgacttattcccttcatgaaccttgcttccatatctgtcatagatactgaatgtgaaattaggtttatttgctaaagcagaataatcaagtatatcatttattccatcaccatttggtgtgatgatattgataaggttgagaactgtaatctctatcttaacaggagtacaattatatgaatcttttacataaaatgtatggctcccacgagggatgttagtaaatatattctcgttttgccagttgatattatccatagaatacttataaggagcttttccggcagttatctttaatataaccgaattattattaatatttacttccgaaatgactgggttttcagaagcatatacctttacagtttgctttataccacattctctggttttcaggtttacccaatatgttccaactcctacatttttgatggattgtgttgttgctccagtgctccattcataagaagtatatcctggtcccgcatccaatgtagtagtatcctccatgcagataatcttatcctttaacgtatctgaataaatagcagaaatgactgtaagagttacttctgcaactctgtaacatccgttagcattacttaccttaacgtaaactattccattaggagcaatataattggctggtgtcagaatttcgtttgttccgttatttgcatcagtaagagacggataatattgcttaattattcccggctgtaaactaactcctgccaatgttaagttaaaattcccaagcaatggattcgaaggtagaaaacatgattttaaagcagcattattaacgattggcttttctgaaatggttaatgttaaagttacccgctcacaatctgtaaaaacgggattatttccacaaaatttataaacaatagtatctgtacccaaataaccagaattgggaacataagtaatgactcctgtcggatcaatagtaacggtaccgtgtaatggcggagttagaatagttactgtgctgggaacatacgtctgagtagaattggtaaactcaggaacaatggtcttatatccttcgcagacagttagtgctttagtagattctgtaaggcaagtatataccttataaaccggagtaattgctggcgtacatgttcctactgcaatttttacggtataatttccggcaaccattggagtataggtgttggaattagctcctggtatcggatttccatttaagcaccattgataggtatcataactatcatcaacttccaatactatgccgggtatacattctccagcttgtttggtaattagcggtatagaagagaatcctgcaaaatatcctccatatcctgatgttctgtagcctccatttatacccgcggttacagccttatcagaaataattgttatatttccggcaattgatgggatgccatatgttacccagctgctatttcctgtcaaaggaaaggggccttctgcagctgtaggtgaaactccgtttaccgtcacattagccccagcttccgttaagatattaagttttacaatagttccgggtgtgacaacacttgttgttccgggtccggttggcatctcgttgattttcccgatttcttcaatttttctcggcaaaaagcagtttaacggtggaatgtagttaaaaccacaggttgcgctactgttattcactgaaaccaattgatataaataaaccttttttgaagtcgaaataaacatgttaaagtgtccggaagttccctgctgaacgtatttgtttcctaatattctgtaaaattctccactgttgatggttgcaataggcgtattagaaccattgatgaatatttgggtattgttttctgtccctatgatgataccaccttctagatcagcattggtagatctggttcttaccatggcaaaagtacttccaagtctttcgataggaacagactgatcaagaatcgcatcggatcccgagcttgtattgtttccaaaatttccattaacatttccattggtaagggtaatcggtttatcggaaacaattttagctcctataaaagcggatagattttgaccacctactccaggacctcctgcaaaaataaaagattgccctttgttaagagtaattgtgtgcgtatgggttgtaggggctgctccgaaaaatgttacatttccgttccacgtagttgttacaacagtattattttctgttgccagtatgcctgcagtgaaattataacctgaaagtgatgaggtgctgggagttccggcaacgtaaaattctttcccgagtccggcttttcctttgcttgttataatttcagcatgtggagtgctacttaccattcttaacgaacagtaaaatggcttggttccttttacatacagccctttattgataacagtaaaggcttcagacgtaaccatagcttctatattgctaataggtacaacaaaggtctgaggagaacctttactaatggtgacagtaccaattggaaggttattactattaactgtaacaacaaaaggagttgttgaatcagtagagagatatagtgcctgtgtataatttgtagaagcataataaggagcaaaccaatgttctgtgtctcgttgggcagaaatatgaatgcttaataagagaaacaataaactaaataaaatattcttcacgcatttctgaattttgattcttaaaattaagaattattttataaaaagcgattatgattattttatattttttttctacatagttacattttgttaacaagattactaataccaataacaatgttaggaggcattgaaccagaataattcttttaatggaaatgttgtttgtcgaaatagttttatatcatcttatacatatcaataatgattttcataaatcattgtatgccagaaatgtaattaacattgttaattctttaaacatgaaagcatcagtaaatatttacctccaaaagattattccatagaatttataatgttagagaaatctcaaatagtatgcatagattactattctttcaatcaggacgcaatactcggatatatgcaccagaaatttattaaaatataaagtgagcttaaaataagggaaatcaagatactttcctgtaatttaaagataataaaaagaaattgcagaattgctttttgtgtcacaagttacagtgtcagagaagcagataattgatagaatcagaaaaaatataatcaaaacaataaataatagtttgatttatagtctgcaggttaatataaaaaacggctatttcatgcaccttttcctgagaattctcctcctgcaaaaaatacaaaaggagaattacccggaacagcttaattaagctgataatttgcgatcactaaactcaggatgaaatgaacataattctgttctacctcttttctgttaatcaatttgtttttgtattcataagaattcagatctttagataatttctgataggtttcaaaatcatcaccttttacctttactcttatattaccatcttttctgttaatcaacacatcatccaaagttcttactttaaacaaaacttcacataatgtaggacgagccttcatggaaccgatatatctttcaactatattaatcttgaacgaatcaaatatgatgttattaaaaacgattttagaattaggctcctgagtgttgagttcaagtttatagttcattactttataaattttggcaaatataagtttaattatgccaaaaaacagactgttttaatagatcattcccatattaatgattgaattttattctgtaaactcaaaatcatatgaaaatgtgaatattagagggcataaatgaaagtattgaaaactttttcttttcttttatttttttccttatagtcatttgcgtaattttattctctgtataacaaaattcatattaataccaatataatggaaagatatagttatggaatggttggccttggagtaatggggcggaatctactttataatatcgctgacaacgggttctcaatcgcgggatttgaccttgatcaggagaaagttaaagaactggaagaaggagctgcttcaggaatgaaagtaagaggtacagacactttggaagatttcgtatcagcgctggaagtcccgagaaaaatcattcttatggttcctgcaggcaaacctgtagatgcagtgctgggaaacattaccccgcttttaactgaaggtgacattgtcattgatgcaggaaattcttattttgaagacaccaacagacgggttgctgatcttgcatccaagaaactgcatttcatgggaatgggagtttcagggggtgaaaaaggagccagaacaggtccaagcataatgcccggaggcgatcctgaagcatttaaacttctgaagccaatgctggaggccatcgcagcaaaagttgataacgaagcatgtacagcctacatgggaaaaggatcagccggaaactacgtaaaaatggtccacaatggtattgaatatgcaatcatgcagcttatcagtgaagcgtatgatcttcttaaaagaggagcaggcttaaataatgatcagctgtatcaggttttcaaagaatggaatagcggagaaatgaactcattccttatcgaaattaccagagatattttcacccagaaagatacattcacagataattaccttgtagatcagattttagataaagctggcgcaaaaggaacaggaaaatggacttctgaacaggctatggaaattggggtttctattcctaccattgatatagcggtaacatcaaggattttatcagcatataaagaagaaagagttcaggcttctgaaatatactctgaaaaagaaattacaaaacctgaggatacagaacagtttattaaagaagtgggagatgctcttttcctttctacgttaatcagctatgcacaaggtttatctttactggtaaaagcatctgaagaatatggttttgaaattccgttaaaagatgttgtgaaaatctggagaggaggatgtatcatccgttctgtgctgctggaaaaattctattctgcatatactcaggatcctaatctttccaacattctgcttgataaagaaatttcagaacttgtaaaatcaaaaatcaaagctttaagaaagactgccggatatgctgtagcaaacggaatttccagcttgggaatccagacagccttaggatattttgatgcctataccacaaaatctcttcctgtgaatctgatccaggctcagcgtgattatttcggagctcatacttatcaacgtattgacagggaaggagttttccatacctcatggcaaagttcaaacaattaaaattcggaaaaaaatgaatcaacacaaagtcttgcagccaacaaatattgttatttttggtgcgacaggcgatctggcaaaaagaaaactttttccggcattttataatctgtatatcgatgggagaatgcccaaaggctttaatattatagcactgggaagagcagaaaataccaatgaactttttagaaattacatcaaggaaaatcttgagagtttctccagaaaaaaagtaacttctgaagactgggcaggttttcaggctcacattacttactttcagcatcagctggatgaagaaagttcttatcagaatctgcagcaaaaactgcaggattttgattccgtttacggaatgagagcaaacagattattttatctctcaatcggacctaattttatctccacaatttccaatcatattaagaccacatcgttagcttccgatccgaaaaaagaccgcattattattgagaagccatttggccacaataaacaatcagcgattgaactgaacagtcttttggcaaaaacttttgaagaagagcagatctatcgtatcgatcattatctgggaaaagaaacggtgcagaatatattggcgttcagatttggaaattcaatttttgagcctttatgggatcataaatatatagaatcagtacagattacggtagccgaagaagtaggagtggaaaccagaggtgctttctacgaacagacaggagcattaagagacatgattcagaaccaccttttgcagattctttgtatgatcgccatggaaccgccggcttcattgcagtctggtgagatcagggatcgtaaggtagatgtgctgaaatcaatccgtagaatatcacccgaccaggttgatcactatgctgtaagagggcagtatggaaaagcaacaataaaaggtgttgaagtaaaaggataccgccaggaggatggtattgcaggagattcaaacacagaaacctttgccgcaataaaattctatctggataatgaaagatggcagaatgtacctttttatgttcgtaccgggaaaaaaatgaaagaaaagcattcctacattacgattcagtttaagccgcttcctcattccacattctcagacagtccgcaccatttatcagcgaacaggctgatcattaatattcagcctatgatggatatcaggttgcagtttatgacgaaaaaaccggggctgacattggatttgaaaccggcagaaatgatttttgataattttgcatgccaggaagatactccggaagcctacgaaacgcttttacaggatgcacttttaggagatcttaccttatttatgcgttccgatcaggtagaagaagcatgggacgttgttaccactatacaggaagcctgggagaataataaagacttatctttcccgaactataaagccggaagctgggggcctgaagatgttaatgctttggttgaaagacaggggcacagttgggtataacaatttaaatttaaacagacaaaaaatgaatattacagtatttgacgatctcgaaaaactgtacacgaaggcagcagatgcatttgttgacctttcaaaaaaatctattcagaaaaagggaagctttgtggtggcgctgagcggaggatcttctccaaaagccattttcaaactactggcaacgcctgaatataaagatcagattgagtggaataaaatctactttttttgggttgatgaacgttgggttcctttacatgatgataagagcaatttccgcatgacagatgaaacccttctcagtcaggttcctgtagataaaaatcatgtatttcctatgtatgctgaaggaatcagtcctgaagactatgcggaaacctacgaacagcagatcaggaatgttcttggtaatgagggaacttttgattttatccttttaggaatgggagatgatgggcatacagcttctcttttccccggagaggccgttttggaagaaaaagaaaagtgggtctctgcctattatcttaagccgcaggaaatgttcaggattactttgacagcacctgtcatcaacaaagcagaaaatattctggtaattgcatttggtgaatccaaaaagcatgcattgaatgaagtgctgaacggtgaatacaatccgtctctatatccgttacagcttattgagaagaaagagggatttcagtttttcacagacgaaaaagcaaaaggttagaatagcttaaactttataaaaatgagactgtcctcggacagtctctcttcatatcaactattttgataccgtaccgtcggtatacaattttctgcagattaaatcaaaaatcagcacttaaattaaaaacagtatcactaaagagctaatgatactgttgcattgtgcttttaccttagttgcatttttcgaaatttttattttccatccacatagtgttctatataaaatggttattagtttgaagcaaatatacaaaataagacactacgtagtgtctaaattgaaaaaaaattgaaaaaaaaatgttaaatttttaaagtggcagataaaaccctttcatacagcgactttacatacatttaaaaatcagaaaagccatatcttatcaaatgaccagttacaatatcttgcagaatattcataactggtaaaaatatctttaataaaagacagcaccattacaatgataataatgctgtctgagtaatgttttacctcagttattgaatattaaaatactttaactgagggaactaatggtacaatctgatctcaatcaacctcacaactttgattatccgtttcaataaaatggttattagtttctacaaatatatacatttagacactaaaaagtgtctaaaatgaaaaaaaattcataaacttgtacgattgaaagtttgtcatggaaagaaagccagtagcaggaagcattcggaacaaagaacgtagtaaaaaaaagttcctggatgcagtagggaaaatactgagaacaaaaggatataccgccttgaaagtaagcagtattgctgcagcagccggagtagataagaaaatgatctattcttattttgggggcttagacgggttgattgatgagtattttcgatcacaggattactggagtgaattagacattgaagaagttgaaaaaataagctttcaatcagaagatggtggaaaatctttcatggaaaaaatgcttcagacaaaatttgattatgtctacaacaataaagaggcacaaaaattacttctatggtgtttatcggaaagccggaaaccattaaaaaaactcaaccatatccaggaagaaaacagagaatatatttttaaaatgctgatgaatccctatgttaaggataaaactgaagatgtccgttctattcttgccattttggtttctggattgtattatcttaatatgtatgctgcgatgaatgggagtattttctgtggaatagacctcagtactattaaaggaagagataaaatcaaaacagcaatctcatttctgctgcactgtacttatgaacatttgcagggttctgataaaaaaacaaaaccattagaaatctaatggtctgtctataaagttgcgtttctaccttagtcgtttcatttcgaaatgttcttaagtaagggaactcaataatacaatgtgacttgttttatttttcaacctgatagtgttttaaatatatagatggtattagtttctacaaatatataaaataagacactactaagtgtgtaaaataataaaaattttattggttttatttaaagcgttgattatcagtgtaataatttttattgttgtaaagtgattcttactttgatgagcaaaacagattcggttttacccaattacagaagtaatttttatgcttacctcggtgttgtcaaataagaaatatctatacaaaaatattttatttatatcaaaacactttcagatttaaagacaaaccgctatgaaagagtaataccgtttttgtcttttttcctcaggtgctgatgacagaaacattttaaactgagggaactaacaatacaatctgaagagttttatttttcaaatctgatagtgatcctgtctgtttggtacgatcagtttttgcaaatatagacaaaccaatgatattagacactgtgtggtgtctaaaataataaaaaaaattcttaaacttgtatattgaatgtttagtcatggaaagaaagtcagcatcaggtagtatcagaaataaagaacgaagtaagaaaaagtttttagatgccgttggaaaaatactgaaaactaaaggacatgcagggttgaagataaatgacatcgctgctactgccggggtagataagaaaatgatctatacctattttggcggaatggatggccttatggacgaatatgtcagaacacaggatttttgggtaaaagtaaccagtgaggaagtggaaaagatgaagccgaatcttgaagatggaggcagagaatttatcgagcatatgctgctttcccagtttgattatgtatacgccaataaggaagctcagaaactcttgttgtggactatttctgagccccggaaatcattaaaaaaactgattgacactcaggaggaaaacggagaatatatcttcaaattattgatggagtcccgtttcaaagataaaatggatacctatcgttctattatggctattatggtttcaggattgtattacctgaatatgttttcgtctctgaacggaagtattttctgtggtatagataccaatactcctgaaggacgggaaaaaatcaaaaaggcaatatctttcatggtagagcaggcccacgataatctttaatctattataaagaacagaaaaagggacaaactattgtccctttttttatgataattatggtgtctatcctttatgataaggacagccagaagctgcgccggcattaactccggtattaaagaactgctcttcaattacttttctctgatcctcaggaatatcttctattttacggagtgtgttcacctggatgtggggccagctcgtggtaccaccgtcatttccgaaatcaaattcgaaaaatacaatctgctcatattgcagctgaagaatctcttttccgttttcaatcactgtttcaatccacatgttcatatccacttcaacggtcgggacaaaacggttgacaaacggtacatttaaaattccgccctgcgccccggttttcatcttggaagacattctgacatggacataattgctgacctcctgacctcttaatgtatctctgagtcttaaatccggccgtacagaatagggatacaaatcatcagccagtattctctgggtgtaaattttgtttgaaccaggatcattatcatcattaagtgtttcatgcacccaggccggtgctggctggtcaagatcaataatattgtcaggtgttacccctgcatttcccattgtacgtgaaatagaaagatgattcgtatcccatgcctctttaccgtaagggaacttaggagaaccattgattaaataaaaggtttgatcagcagtattttgcgggacaatatctccaagcaaagtaatggtgctcccatgaggaatcacaccgcttcgcgaaatagagtagtccgggataaaataaggaccatcaagtcctgctcccggctttatttcctgtgcaggaatgatttcataataaagctgccccggttgtagctggctttgaaggatatactgaggatttgcttcgccgtccggtgttatcctcagcaaaggctcatctctgtattcgccggtatatccatacttggcatcttctgttgaaacggcatggataccacggtctctttcaatagattttttggtagccgcatgattatagacatcgctcagccaaagatacattccgttttcttcatgaataggagtgtattttaatgcttcctgcccctgtacggtagtcgcacttttaatactttgctcatatttaactgctccgcagaatagctcactggcaccaccacggttacgtacaccgccgggaacaatggaaaaggtcagtttctcaatatactcttcactggtaaaagcgaattttccgggaattgttcccgggttggttcccggagacggcataattgtagtatggacaccgcttgccagtgaaggactggtaacatctttattatagttcacattatagcttacccatgtgccatccaatgcggcaaggataccgtaatctacattgttttcaatcgactggagattgtcttctctgaatggtcttaccggatcatcaataagaagcctggaatagccatccataagttcggccagattaactccattttggtctggcattctgcggaacagctgttctcctcccgcttcgggactctctttttttcttttaagcatgatatttagtttttatagttacagatcggtgtattcaaatgttggtcccgcattagtctgagcatccaggggttgtttcatcagattaacagcctgttcttttaaagcatacatgtacataattgatttttcaagctctctctggttaccttccacagcactttgaatagcatccagcagacgtctgtatgttttattaaattcaatagcctgagtatgtaattctttatcttgaatataatcttccagcttaggattgggtttcatcggatatgcctcattccagtctaccggaagatcttttcctgtaggcggtgtggttacaggcatcatcccattttcgtccatgaaaggctcatagtttcctcccagataaaaatgctcatggaaaacttctttgaatctgaaataatgagccagttcaaccccttcttcaaactgcgaaggatccacatcgaaaatagaatcatcagctccttcaccctgacccttaatttcctggaaaacagcaataactccagttaaagcttccacggaatgtaattttccaccacttccataatattgttcaggacggatttgtttttccggctctcctgtgaaaattcctccggtatttaattcttcgaaattcttcggaagtgtcccatgtgctttatagtaagcaataatctggaaaataacgatatagaagaataaaacatcataatactcaccaatggtgtgtacattttccatgatgaaacctttcatgttttcaagtgtccagaggtggttttcctgcagggcagctctttgggaatataattcagaagttttcgtttcataatcatatttcggagcttttaccacaggagtgcttggactttcgatggcaataaatgtagcaatgctgttgcttgagaatgcttccagacctacatagaaatcaacattcatgggtaatttcatgggataagtagggtaattctcctttttgttgacggaaggttgaatatcgatggcattcaatacattacaaaccatgatcaaatgaagcatttcctctacggcaacacttcttatgatttgtgaagccagagcattggttccgtctttaattgaatacaaagcggtaagataaggtggaatggtagaatgctcaataagaattgctgtttgcaaaaggtcctgcaaaatcggtttgtaatcgatttctgtgatctctttttttatttctgaaattcctgaaccgaactgagattccagataggcattaaaatctttaatctgatcattcagtaaaagatgggttactgttttactatgatgctttaatccttctatccagtcttctttactcagtgttgaatcaaataataaagaaggcaatgaaacaggttctataatggctgcgcttcttgccgccaccattttttctgctgttaatgtctcctgtggttgtggtgctttattgataagtctttgtctcatgttgttattttttaagttgaatttcaagatcagcaagaatagattctaccgaacggatggtgaatgctgataatgttaaagtaggatttgatgttcccagcgtggtcatatttcccgcacctacaacgtataaattcggatgatcccaggttttgcagtagctgttggttactgattcttcagctttagaacccattctgtgagttcccacgatgtgccctgcaccattgtaagaatatcttttcttattgtatatcacagagtttttgtctttctcagtatattttgtgaaatccgtaatgtttaatcttttaaacatttgatccgaagcattttttgcctgctccatagctttcatttcatactctgtaagttcataatgaatcacaggtcgtggaattccgaggacatccagatattcatcattaatggttaccctgttattgggattcgggagctgttcaatttcaaaatgaaataatacctgctttgaaagtctgtcggtgagattttttcttaattctgccccaaactgtttttctctgataaagtaagccacatcagaacccggagaaaatgccggccaaccccagccccaattgtcgagcggagagatccatgcggaaaagtcctttctgaacgctccgtcacggaaagaagaaatgtttgtagtggaacccggacctctgtacggatacactggttcagggaaaagtccccacgtaagcattaccatatggtccatcaggtttcttcctacctgatcactgctgttggctgctgtttttacaccatctgaagttgtatatttggagttcagcagaattttcggattttcaaaagcattggccgccagaatgacgatggcatctgaagtatcaatagattcttcaacgaaatcggttttttcttttgagatatatcttctcagatgaacctttgaaactttatgattatcatttggatcaatgcttaatctgtacactacactctgtgcctgaatctgcatgaatggattacggctcaggttatcgttatcatttattttatataaagcctttttcaatgtttttaaggcattgtacttcgcctgaacaggacagatcggaacacacgaagcattcccttcgcagcgttcacccatataaggattccaaacagaaccgagcgctttgtattcttcttttccggaactgtctaaaaccagttgatatccggagtcctttggttctgctttaatgatcttcgtttttccgtattttggattgggaacggaatttctcccttgtggagaaggcaccatcattaaaggaatttctcctgaacttagatttacacttgtccctttaagtccctcaataatcttgtggtccatataactctgtggaatttcttccattggaaatacataattcccataataatcttgcattttctcagtaataggatattcctgtttcgaaacatccccggaaaccccgatttcaaactctgccatctcataataaggccttaattcttcatagcttatcggccagtcgacaggagtttgctcatcagaatccggctttggaatcgtaataccatatttttcggtaagtttgaaatcgttgggaagcattcttggagtggttcccagccagtgaagggtagttccgccgcctactcttattgcatcactggcaaacggcatcggcccgaactgaacgagatacccttttttatccggatacggctggacaatatgttccatatccagaacgttgggagaaggagcctgctttaagttcggataaggagaattgggaactttggcttcctctctgtaaaaagtccggatatactcattataagtggtcattgaggatacggaatccagctcaatacctgcttccaggcctgcttcgtacataagtatggaaatctccttaatattatcagattttcccgcatctgcacgatgaaccatttttcctttggtgacgttaaatacatggtcagacaatagctttgcgattaatgaccctgcgatccctgttcctacaatgatcacatcttttttgttatggattggattcatgagtggatgtttacaggtttaatattccaagatttgtagccaggttgttttgctccgggcggatgggcatgcatcaggttccatacaaggccttccttgtaagaaagatcattgatataagcaccatcccaggttcccaggtaccacatggtaattacttttccggctatgtcgttcattcccgggttaccaataatttcggattggatggcattttttaatgcttcctcaccggaagaattttcaaggatatttttagaaaccgtaaggaattctacgaaagtggctgcttccaggctttttaaaacatatgtgtaataggtttctgcaagccctgttgactgcagttcgtttactgtgaacccggtaagcgcttccgagatagacatgaacacatcgaaataataatcgtcgacgttgagaattttgttaataatattcatttcgtaaaaaatttggattcaatatcttcaactccctttaacaggagatgatcaagctgattgatctacagctgccggatttttcagatatcacctctttttcagaaatgattgaatgtatttcagacgatccatagttatcaattttgttgatccgaaattaatcacatcccggcagataagattcagtatttctacgtaatttgaattaataatcttttaattttttgtaacaattcctttgttgtaagtgtttggaagagattttattttcacatagtttagaattattttaaataatgtggtatcttgttgtttaaaaatatcggataaaaacagtgatgatagcctttgatataaataaaaaatgcctgaattgaatattcaggcaggattaaattaataaggttgaaggtaagaattatcatatcatcgtatcagatactcctagctgtcaagctgttccacagcaattgcgtctatttcaaacaacattccgggtaaagccagctgacttacaggaataagtgtactcgttggaagcaatgtagatttccagactttcatggcttcttctgtccatatctcaagtttttcctggttgtggtctacaataagcagggttattttaacaatattatcaaacgtcattgaatggctctgtaaaacgatttgcaaatttttcaaagcattctgaacctgagttttaaagtcatctgccaatacatgattttcacctacgccgccactctgtccggatataaaacacatcctggaaggagattccacagaaatactgtgagaaaaaccataaggagcaggattaaataactcagcaggattgatcagtttgggttgtttattgttttccataatctttcatttaataaagtaaaaatgagaggaaaaatttgaaaaaacatttacatatgttgaggaaagtatttttttaattctttatatactttcgtgaataataaaattctgatacaaaaaattgctgttcgaaggaacagcaattttttgtttttattctacaataatactttcaatccctttttgcagggctgtttcctgaacgaccggaacagaaagaccttctgcacggacaacagaaatatccgtcattcccataaatccaagcgttttttccaagtaaggaattacgaagtcgtaagcctgtctttccccttcagaatatacgccgccacttgaaaaggcaaggtatacttttttattttttaccaggccttcaggaccgttttcgctgtagctgaatgtttttcctgctctggcaatatgatcaagccatgatttcagtgtggaagtgatgctgaaattgtacaggggcgcttcaataacaataatgtcagcctcctgaagctcatcaattaccgtatccgaaagctttacaatttccgactgttcagaagtccggttttcagccggcgtaaagaatgcattgatatgcgcttcttccaaatgaggaaaaaggggatttgccagatcacgtttttttaaaatatggtcaggatacttggctgtgattttctctacaactgcatttcccagttttttactcactgatgattcacttctcggacttgaagtaatatgaagtactcgtttcattttttattttttttaaaattgatgttccaaaattatctatatttactaataaaaagatagtagttaccgaaaggttagtaataacatttaggttagtaacagaataaaacagaggtaatggaagaagaaaaaatagtgtattcaaggccgcaatgcagtaaccatctctctgctacagaggatgcattatatgttcttggaggcagatggactatacgtgtaatgattgcgatcctgggagggcacacccgtttcaatgaattacagcgtaccatcaagggaatatctgcacgggtattatccagtgaattgaaaaaactggaagttaatcatctggtagaaagaaccgtaattacagatcagaaacctgtgctggtagaatatgttcctacagagtatagtgaatctctgaaagatgtcattgctgctttggcagactggggaacaaaacacaaaaaaaaaatcactacataataaaagtatagcggtgttgcagcaaaatcactttttctgtggtatttgttaagttgcaactttgcttgtactttaagtatttttactcaatttaataatggcaagatgatcatatgcgaagacttattattttcccacggagccagtctggaaaggtatgaagcaggagaaacaatttttcaggaaggaaccgctgcaaaatattattttcagatcagatatggcactgtgaaactgaatactttattggaagacggaaaagaatttgttcacggccttccttttgatgggcattgcatcggcgaaagttatttgtttacagggcatcattatgctgttaacgcagttgcagtgaccagctgtgaaatcatcaggctttctaaaaccagatttcttgaaatattgctggaaaaacctgcattaatgcttgagattaataaatataccgcagacagactgcatttcaggtatatgatctccagttttctggctatttcagatcctatcgtaaagctggtgaaacttttcgaccatcttaaaaaatattttggttttgaagaagcctattcattcctgattccctataccagacaacagattgcaacactcaccggtctccgggtagagacggtgatcagatatgtcaaaaaaatgcaggagctgaagctcgttaaaatcgaaagctctaaaatttattattaatttcaatcagccttttttatttcaggatgagtacaggctgatgggtgttctggtaaattccttcggaaatacttctgcttgccagatagtacaaaaaactgtgcttgccgggcaaagcaataataagatctgcttcatgagtggctgcaaaagtcagaatgccattaatgatattttcatcatgagagtaataaatgttgcttgggatttctgttaaatgctcacggatatagtcttcaagctcttttttcttgttttcatcttctttttcgcgggcattgatatttaaaaaagacagatgcacatcctgcttatgaatgagagatttatgatgaaacaatctttctaaccgtttaattccattgatgtcacaagggataaaaatatttttaacaggagtataatgatagctgttgggaacaattaaagtttttacaggacttgttcttgcgatacttataatattgtcagatacaaaactttcagtggcagatgtctgatcgtcacttcccagaataatcagttccacagacggttcatcttttaaaagttcattgatacttctggtaagagcccaatcacttaaaatttttgaaaccttgatctcaggtgatttttctgttacaatgctgcttaactgatcaagtaataattctgttctttgcaatagattgttgacactttcttcatttacaaatgaatgcccttctgcaatatgcagatagtcaaactcagattctcctgccgtttttaataggataatgttttgatagccgtaggtttttgcccagtctgcggcaactcttactgcattttctgtagttgatgtaaaatcaacaggtacaaggattgttctcatattgtatcgtgttttgatcccggttattccaggtttgctgtcattttttttaccaatagcagtgctttgctgatttctttttcatcaatgccttcaactgcctttttataaagatctaatgcccatggataaacggtttccacaatctgtttacccttcggagttaaaaaaatctgtttatttcttctgtcgttttcatcagctatccgctcaacaagatctctttttacaaggctgttgatgagataggtaatactggatttgtctttgcttactttatttcctatttcctgctggttgattccgttatagcgtgaaagtaatcccagaatctcaatcagttcaaaagacagatcagggtcatattcattaacggtagcctggatcttctgccggagacggctcttcatctcgctcattgccaatccaagctccagagccagttcagaaatatcattcttttttgcaggcatactttttatttatataatgataaacaggttaggagtcatacacaaatggatttttagcataaccttaccctaacaaatatacggaaaattagttttaattaaaactaatagaatgttaaataatgaccggaaaaaattaagctggaatatacttttgcaggaataaattttgctgttgtttattcaataaatttcaaagtgtcatttaaaatcgtaatcatgcctgaaattgcattaaaaagagtttatgaggctgcgtctccggacgacggataccgtgttctgatagatcgtctttggccaagaggcctttctaaagaaaatgctgatcttgatgaatgggataaagacattgcaccatccacagaattaaggctttggtttcatcatgatgtcaggctatgggaagaattctcagaaaaatataggaaagaactccatgaaagtaaccttggaaaagatttcatgaaacgccataagaaacataaaaaaattacattactgtatgcagccaaagatgaagaacactgtcatgcaattattctgaagaagtatcttgaaagcataaaataaacataaaaaaagcagagaatcaactgatctctgctttttcttttttaacagcctgatgcatcatcataataatcccgaaaagaaaacaggcaatgatcagataacgccaggaaagatctttctgttcacttaccgttccgcttaccgaaatgataaagcttgttacggaggtaatcacatataccaatccgcccatgagtccgccggcagttcccgcgtttttaggaaagtaaagcatacttgtcgtaaagaatgaggtaaataaaattccggagcagatatggatgaagaatgcgaaaggaatcataataaaaagactttctgcaaaataacttgtgataatcaaccctgcgatgaggattagctggagaaaaataggctgtaaaatccttgatctgaatccaagagtcagtctgcgtttcccaataaaacctccgatcatccaggaaaaccccaggatcaatgtacaatatccgatcactaccggagtaaaatgaaacgtattttcaataataaaaggtccggtaatattaaacaacattacaatggagtagctcagtcctaagatgaaaattcccagcataaaaatcctgttcttaagcatcattttgtaaaggctgatattctctgaaagatccagtttctttttttgaggaaggctctctccgctgaagaaccattcaaaaaggaagaggaatccggcgtatgcggcaaggaaataaaaattggcatgccagttaaacattttctcaagataacctccgaggaaaggtgccagaatgggaccgcacgaccatacaatggtaaaataactcagatagtgcttcactttctctgcatcatatatatctacaaaaatagcacgggtagctacgacaagcactgaaactgctgccccctgaagtatacgaagcagacagatcaataagatactattcgtcatagtaattaaaatacttgtcagaattaacagaaataaggcgatcagtttgggacggtagcggccgatgctgtccagaattcctcccacaaacaactgggaaatcccgtagctcagaaggtatgatgttaaagtaatctggatatctttttctgataccatcatttcttttgccatagagggaaacgatggtagataaatgtctgtgacaaacccggaaagcgggatagacacgaaagccataatggtaattaatctgattcgttgttcagatgcttctctcaacatattcattcattttttactatgcaaaaataagccaggaaataggaaagtgaattttaaaagacaaagtaaaaattacaaaaatcaaagattaagataaattcttaaattttaatggtgaagtgcgggcgtgctttttaaagaaattattaaagtgggcaggctggtcaaatcctaacgtatagccaatctgggcaatatcccagttcgtatacttcagcagatttttggattcttcaaacattttttccttgataatctgagtggtcgtaagatttgtcacggattttaccgaagagttcaggtggttgacatgaacgttcaggtgttcggcaaagtcagaaggcgtttttaaagccagcggataagcaggagaatccaaaggaaactgtttgttgagcagctcatcaaacagtttatataaacgcacatttgcaggaagctcattcggattgatatcttctacacggttttcaagagccagatgcatcacggacgccagattgcttttgatgctgctgcagcggaaaggataagtggagttgttcattctgtacatctgctcgaaataaagagttgccagctgagtttgctcctctgtcagaaaaacaaccggcttgctccattctttgaacatcgatgtttttttgaacaggttgaattctgtatttccactaaagaattcctggttaaacaaacaaaagtatccttcctgtacatcactctcacattcccatgaatacggaatacccggagatggaaagaacagggcagggcggtcaatatacagctgatgtgaaccataatgaatcgttccttttccaatgataaagctgattttataataatcacggcggttataggggcttttgaagctgcagtatctccgcatggaaatattgaagtgggattttcccgtttcaaagtcttcagaatcaaacattttaatctgatctttgcggatgcgtctgtaataatcttctatggtttccagctgatcactcataaataaaaattataaaaatcaaagataagcaaactgctgttcactcatgattattttaagtgagataataagaatcagaattataggttttctcgatttcgttaaacatcttacgaatctctgtcctgtagttaagaatcagtttttattaatctccagttccaaaatatgcgaaggaagctgaaaaggacccgcctttgaaatatccgcagttacaaatccggactctttaaaaaatgctgcaagcggatcatggtccagcatattgatccatataatatcagtgaagcttactgctgatctgcattttttccagagtgactgccttgtttccggagtgtcaaactctgaaagaagcacaaaactgatttctgttgctctttttccttcaggaattccgggatgaagagaaccgcttttaataatgctgtatcctatgggtttctggtcagcataggtcatgatcagctggttggaaagatcgttaagatcattgatcatctttctcggatctatatcgttgtgaatatattttttaatctgctcctcgcttacgaaattcttatataatgtataaacagaagaatcgataatggttataagatcagaaattccttcttcagaacctactgtaaattttgaaataatatccatggggatttttttttattcaaaattataagattaatctatttaaaaaggatacagtttgctaaaatataatcggtacagaaggatatttttataaatttgttcagtacagttgaaatgtatgatgaaaccctataagtacgaagtttttgcagctgcaatagaggaacagatacgcaatggaattttacaggaaaatgacaggcttccgtctgttcgtgagattaagaaaaaatacaagctgagtacaagttctgtacaaagcggatttgaatatctgatgatcaaaggactgatcaggagcaatccacggtccggatattttgtcaggagaattcaggatgaaaatatcccggaagtgaaaacaaaattcccggcggtcgtgagagacgaagtgtttatgaaaaacataatgctgacttcgaaaaggacttccgaatccagctcttttaatacggcagtgcccggtgatctgctgattccacagaagcttatcctgagaaccatgcaggaagttattcgtgaaaaaggagcatctcttctcagatattatccttcaaatggccttgaagcattaaggatgcatattgcaaaaaaaatgggcacctatgactgtaccttaaatcctgatgaaataattatcactgatggtgctttgcaggctcttaccattgctttaaaatcggctgtaaaagccggtgatgtggtagccgttgacagtccttgtgtgttttctgtactggaagtaattgcccatctggaactgaaagtgatagagattcctgtacattataaaggaggttttgatactgaattcttcagaaaagcttgtaaggaaaataatatccgtgctctggttgttactccgaattttcacaaccctacaggagtgctgatgaatgatgaaacaaaaaaagaaattctaactattgcagaagctcatcagttatatattattgagaatgacatgtattctgatctatattttggcgagcaaagaccacgcagtataaaaagctttgatacgaaagatcaggtcatgatctactcttcattttcaaaaacactttcgccgggaatccgcctgggctggctgtatgccggtgatttgtatgcaatagctgaaagagtgaggtttgctttgggacgttctgtttctccgatatatcaggagttggtgttgaaactgctccagggaaacagctatgaaagacatcttcagtccttccggaaaaaacttaatcagcaggctgctgaggtattggaagctgtaaggaattcttttcctgaaaactcttattttcacagaccacagggaggttacagtatttggggacagcttccggaaagtacagatatgaaaaggttttacaactattgtgagcgataccggattttatttactcccggagatactttttcttttatgaacagatatcattaccatttcaggattatttttgcagaaagaattacttctgaaagtattgttttgctggaaagtgcgggcagtaaagcaaaagaattgcagatttaagaacattaagtttgaaaggtaaatccaaagattttataagtaagacctgtcaaacggagtgatgttgattttattcgtttctttttgatttttaatggtttaattgaatattaaattatactctatatcatgcccggttagatgcttgatttctacaatacttgattttcattttaaaaattaaattgaaattaagaaagactcaaaaaaaataataaaatctgctattttttttcagcacaattaggctggaatcaccataaaacctatatttgcagcctaaatttttaaataaatgaaagaactaattgaaaaaatcaacgcagaatttgaagcgttcacaactgaggcaaaccaacaagcggaaaaaggaaacaaggctgctggtacaagagctcgtaaagcagctttagaactaagcaaactgttcaaagaattcagaaaagtttctgtagaagaagctaagaaataattcacctttaaccggcttttgaagccggtttttttatatctgtactttcctgatcactttcgatcctgtcatacatttatgttgatgctttttaaatccaatgttaatttattttgtttgaatacataccatttatataatttgtattttagaaacatcaatgatggtatattatgaaatatttttatctgctgtttattctcttttttaattttttttcagggcagaaattaaaagttgtggatgcagaaaacgggaagcctattttcaatgcaagaattcttttacaaaatcagattgtgtataccaatgaagacggttttgcacctgttgaacaaggcgctgtgaactttgaaatttctgcttccggtttccaaaagacaatagttcatgaatttcattctgttataaaactaaagcgggtttataaaaaaattgatgaggtaaaactagcaaaaatcgatatcagaaaactctttgaagacgtgagtgataattatagaaagagatattacagtgatccatctctatatgacgtaatctacaaagaaaaaaagagtgataataataagctttattttttagtaattgcggagactaaattgtggagtaaggccaattattacaaccataataaatcctatgataagaacctgcaaatgcagttaaataatgtgaaaagctttaaaaatgtaaagtcagacagtatttttaccgcaggattaaaagaattttctgaagaatatatggggaatttttttttcaattttgaattaacacgggtgctggctcatttaaaaaataaagattcaaaatattcaggatggatgatcttcgaagaaggcaatgaacaattggttacatttagtattaaatcgggattgggaattgaaatggaaggtgaatttaaatttaataaagcagataaagtaattaactattttgagatccattatttacaggatcaatatccgatgatgaaaagaaaaacaggagagggggaagaatatgattatcaactgggaaatgcaatacttgttttcgatttttataagaatgatggaatgtatgttcctgcaatgagcagacttgaagggaataaatatgttgcatattacaaaggggttaaacatgaaaggaagagcagtagggagcttatatacaatacctttaaaaaatcagaagaaaaaggacttgtccctaaagtggattttactaaaaatatttgggataatgttcaggtgaaagaaaataaaaataatacaattttactttccagggaagagcaagcttttatcgataggaaattacctgattttggatccgaatagcagaaatatttctaattatattctttataaatttaatttattatataaaaaactctttaaacaatatagtttaaagagttttttgctttcatttccccaatttctgctatctttaaaccaatcaatatatattatgaggataaatagattttttgcagtgccagcagtagtgctggctgcccagttttcatgggctcagataaaggttgaccccaaagaaaggttagaccctgtcgtaaaaagttttgtagatgaagtaaataataattcccagctggaaaatctggcttatgaactgctggacggtatcgggccacgccttgtaggaactccggaaatgcttgctgcaaatgaatggagtgccaataagcttcgttcgtggggagtggatgccaatcttcagcaattcggaacctggaaaggatggcaaagaggaacaacgcatgttgatatgacctatccgcgggtgaaatctcttgcagcaacacagctggcttggagtccggcaactaaaaaagcggttgaggcagaagtgattactcttccgaaagtatcttccaaagcagaatttgaccaatggcttccttctgtgaagggcaaaatagtcctgatggcacaatatcagaaaatcggacgctctgatgagcagatcaaagaattttctactcctgagttgtatgaaaagcttaaggcagaaagagaacaggctgccaaagactttacagcgtatgtaaaaaatataggatatgataacaacagccttcctgaagcgttagaaaaagcaggtgcagcaggcattgccatctcaaactggaccggtatcatgggggctaacagaatatttggcgcaaaaacatccaagattccaatgatcgatattgatgtggaagactatggaatgctttacaggatggcggaaaaaggagggaagcctaaaattaaaattgatacccagtcaaaaatacttcctgaagccaaaagttttaatacgatcggtatgatcaaaggaaaagaaaagccagatgaatatgtgattctttccgctcaccttgattcatgggatggcgcccagggcgctacagataacggaaccggaacgatcacgatgcttgaggcaatgaggattctgaaaaaatactaccctaacaataagagaacgattgtcattggactttggggaagtgaagagcagggactgaacggttcaagaggttttgttgcagataatcctcagattataaaaggagtacaggctgcttttaatcaggataacggtaccggtcgtgtggtaaatatcagcggtcagggatttgtaaaagcttatgattatatcggaagatggcttgatggtgttcctaaagcagtaaagacccatattaaaacagacttccctggaatgcctggcggcggtggatcggatcatgcttcttttgtggcagcaggagtaccgggattttctttagggtctctgaactggggttacttcggatatacatggcacactacaaaagatacctatgataaaattgtttttgatgaagtaaaaaataatgtgatcttaacggccgcattagcgtatatggcttctgaagatccggaattcaccaacagagagaagagagcaatgcctcaggatgataaaggggaaacggtaaaatggccggaagtaaaagaaccaagaagaagttctaaggattataaataataatttttcttctttgaaaaaatcaaggctgcctaacaggcagccttgattttgatatataatcttatcttgcaatatcagaaatatgaatctttaaatctgaaaatgtaagaatggatggctcataaagagattcagctaactttccaaaaccgtattcacagaaaacaaacggaagtccattagcccttgctgaatcataatcggtttgagtatcacctatgtatacagaatcttcaaaggatagctgatttctttccataagaagtttaatattttcagcctttggcttttgggtccggccatgggattcaaaatcagtaaacagatcattgaattgataatattctaaaaaagattcaatataaccgtcctggcagttacttacaataaaaagagaatgagtactggcaaggcttttcaatgtatcttccacaccgtcatataaaattccgccttgtatacgcaggattttattttcttcggctacgatctcagaaaggagttcccgtatctgaaggtccgaaatttccggaacaatatctttgataatatcgtgagctaataaacccatgtactgatccatgtcttcgggttttatttctctctggatcaactgacgtttacccaataccttattccatattttgatgatcgtcgttctgggatcccataatgtcccatccaggtcgaaaattaagttctttgtgttcaaaataaaaattttgtgtttatactttaatctgcagcagctatttacaaaatcatactcagctgcactctttttcttgcctcatccacttcggttacctttacacgaacatgctggtgaagctttactacttcattgacatcggaaacaaatccgtctttcagctgagaaatatgaaccagtccgctttctttaattccaagatctacaaaacatccgaaggctgtaatattattgataattccaggaagaatcataccggcttttaaatctttaatgcttttaacattaggatcgaattcaaatactttggcggcctttcttggatccagtcccggtttttcaagttcttttaaaatatccttaattcctaaaatcccgatctctcccgtgatatagttttccggttttaccagagctattttttccttattggcaatcagttcattggttttaatccctaaatctttggccattttctcaacaattccataagcttcggggtgtacggcagaattatccagcggatttctggcattcgtaatccttacaaaagctgctgcctgctggaaagctttatctccaagtctcggaacctttttaagctgctttctgtcttcaaacgctccgttttcagtacggtaattaactatattttcagccattttttccccgattccggaaacgtagcttagaagtgatttgctggcagtattgagattaattcctacagaatttacacatttcatcacagtagaatccagctcattttttaattgagtctgatccacatcatgctgatattgccccacacctatagatttggcgtcaattttcaccagttctgccagcggatcagagagtcttcttccgatggaaacggctccgcgaacggtcacatcataggaaggaaactcgtctcttgcgattttacttgcagaatacactgatgctccggcttcagaaaccacgaaaacctgcagaggcttatcaaaagcaatttttttaataaaaaactctgtttcacggcttgcggttccgttaccaattgaaatggcttcaatattataggcatttaccatagaacgaatttttttcatggccattccgctttcgttctgtggagcatgagggtaaattgtttcgttgtgcaacaagtcacctttttcatccagacatactactttgcagccgcttcggtatccgggatctattgcaaggattcttttctctcccaaaggaggagccagaagtagctggcttaagttttcagagaagatttcgatggcttttttgtctgccttttctttggcttcctgcagggcttcatttgaaatggcaggctcaagaagtcttttataactatcttttatggccagcgaaatctggtccgaactttcattatttgatttaataattgctttttcaataaaatctattgcttcatctttatctattcctacattcgttttgacgaagccttccgcttcagctctcagcatggccagaagtctgtgggagggagttctgttaaggctttcttcccattcaaaatattgggagaatttctgtgcttcctcttcatcttttttagcctttacaacttttgaagtaataactgccttacgctgaaataatctgcggagatttttacgcacatacatattttcattaatccattctgccataatatccctggctccctgaagtgcttcttcttcggatgtaacttcgctgctgaggtattttgatgccagaaactgcacatcattattcttttgactcatgataattctggccaaaggttcaagccctttttccttagcggcatcagctttggtttttttacgctttttgaaaggtaaataaagatcttccagctcctggatgtcaaagctttcctctattctctgttgaagttcaggcgttaaagaattctgttcttcaatagattttacaatagattcctttcttttaacaatctcttcaaactgcctgcttatttttgaaatctgttcgatttgtgtttcatcaagatttccggttttatctttccggtaacgggaaataaaaggtatggtacagtcttctgctaatagttgtaaagtattgttgatgctcttttcagaagtattcagctgtttctgtataaattctacggtcgtcattgttctgttttcgtaaggctaaaatagggttttgcgatgaaaaaacgggaatacaggtataaaaaagcccgatggcattgtgtagcaatcgggctgtatcatcagtttttaaattaattaaggcagaacttcgttataataaagcggagtatcattgtttttatcatatcctattatgatcactttgtacttttttgcatcatcattgttataaaactgtacttttgatgattcttcaggttgtgcttcaagaaaggaattccaataaagaacacttcgggtatcctgtgaaactcctttaaatttttcattgccataatcagggctttcaaatggagcttctttgtcatatccggttaaggtaatctgtcttaatttggaagatacaattctatcagaagaggctccccggcggctataaatagcaatggctccattaccaccaccgaaaccgcctgcaaagaatccttttatcacttttaccatagcaatatctgatgtagaaatattgtctacctggctgggatcaacaagcatttcatcaagatagatgcctacttgtcctcctcttagggatgcagtgtagcttccacgctgcatttgaattgttaagccagcaactcttccctgtagccacttcagaatattggttgaagttaccattgtagagtcatttacaaaatcgaaaacctgctcattcatgcttttgaatcgtgggctgctcaactcatcatttaatttcttagtcttattctttacttctccttttaattttatttcttcaatattggtgatgttttcacttatcactttttgagcattaagtgctgtaagtgagcggctgacctcactagatggtttatcatcagaagggcgctgaaccagtttgtaagaacttgtaggaagattctttttgtaaggaacaaaattggaagtaggctgaaaatacacagaatagttattattgagatccttcggctctgaatttagctggtaaaaaaacttcatagaatcctcaaataccagattgttcagtgttagaaatccattgttgtccgatattatctgagacattctggaaccaggctctgaaccgaaaattaagtttacttctgtattgggagcaggtttcccttgaatatttacttttcctttgtaagagagataactttccggctgatatttgatcatcgggtaattgccagtcataatggatttccattcaaaacgtttccacttttctgaaatcagcagggcatccaaagcatctgtattgcgagtttttgtaaaatactgagcaggattggtaataggtgaagtaatgtctccggttaaccacaaagaactcagtaaactttgatcttcttccgaactcctggtattggagtcaaggactaaaaccgtataattggagtaattcgcatccttgggaatatcaaatgaattttttcctcgtggtgtatcttttagcgaaacagactgtaatgaaggttgcttgaactgtaatgactgtggctgaacaaaagcaagtctgtttaaaatcacattctctttatcatcaaaaacggtaagttgcaaaattccattcacaagttggctgttggaaatggagtattgagtttcattattgattttattaatcttagctttataaacaagttggttgttgatagttcccaaaacagtataatattgtgaatcttgagagagagatttggactttatcgtatattttacatggtctttatcacttgtcacctgcaggtttattccggatgcagaaacttcagggagtataacgttttgtttttgtccattcttatcctgaacaatcagttggtacttctttccggttttaggagtgatattaaatattccgatattttgatcaaatcctttaaatgttgtgatttttgtatctggactatcagaatctatgacgtatccttcccattcagaaggagctgttccgttggattgtaatcgtactgctatttttgtattgatcccatctataaaggttccgctttccgggtatgctgtcacagtccatggagttggattgtctatcaatttctgtggagatgaaggattataaatggcaataggttttataagctgaaaatcttcattaaaatttgccatccagctggtataagctctgatatagtaaacatcttccttgaagccggcaagagaaatattaccgctcccttctccgttaattaatggaatcaattttttactgatctgatttttattactgtcataaagctccacaaatagagtagtggaaatggaagatgtagtatagccatcaaaaacgaaagacttaaaccataggttttctcctgccacataactgcttttatccagtaaaagatgtattttttcctggggatattttttttcaaatgttttgagagcctcttcggccttggtttgtgcattaagaccgtagattgtgcttattgctaatagtgttattagtttttttgacatatttcattaaatttgcgtttttcctacaaagcggcaaaaatacatttttattgtgatgtataataacggaaaatgtaaaataataagaatctgtaaaatctggcatatttatttgctaaagctatattttacggtttcccgtattgtgtaattgaataatttatatacttttcagtcaggaaaataaaacttaaattaacacaaataatgaaaaacaaatttattgcgaggttactcacattagtaaccattatggtcttgttctattcctgcaggaatgaactcacaacagaacaagaaacctacaacaacagcagccaattcaggccaacatccaaaacaatccgtttagaccaaagtaaacacaaattagctcttaaaactgaattacaaaaagcacaaaacaatctaacagaaatcaaaacactcaggagtagtttctaatagtatggggactgtagaatcttgttcttatcaaacagtagatatgtatttctcttgctatacaggagaccataaccagactaatgaaagtacttggggcagttgcaattggcaaagtcagggaggttatcctgcccaacacctaaccgtagtagcattagtttgtacagctagcacagctttaggagatgacggaactgcaggaggaggtgaattaggacccactacaggcttaggaagcggaacaaatgatggaactcctacaaccccgactctcacactcccaaaaaatacaccttgtgggaagataaaaactaaatttgcaaatgcaaagtttaaagaaaaagttgaagcgcttgataaacctgaaatacttgcttatgaccatgaaatgggatatgccgctggataccctcctgcaaatacaggtattacagaaacacaatatcttccaatggaaaattctataggaacccataatgtaagactacccgcaggcaatcaattctttggttatatgcatacacacaacaatgaaagtggcgatagcactcccattaaaatcttttcacccgctgatgtgataacttttttaacaagttgcgtaagaaatgcagatgaccacggaaatataggtgatgcttatgcaatggttataacttcacaaggaaactatattcttcaatattctggacttgcagattttaatattggacctaaccaaataaacaattggaatacttggtataaaagagagtttcaaaagttagctgatgaagataaacttacccagccaaacatagaaaaaacttttgcacgatttttaacagaaagtgttaagataaacgggctagaagtttatcaagtagaaaaaataacgggtaatgcttctaaaattaatacagatggtactaaaaccccatgtccttaaaaacaaaaaaaatttaattatgaaaaatatatttttaattattacattattgactttgacaatctcttgtaaagcacaaacttatccattaagaacctatggtatagaaacataccctgcgaactcctacctcaaagatttaaacaatgaacttcctgagtatgaaggaacttggaaaggaacttggaataacaaaacaatctatattattttaaagaaaataaaaagaaatttcacacatttagacaataacccatactatatggatattctaattgggaagtttaaagttacagactcaaatggctccatattatttgacaatacaaatatttctgacgaacaagcaaaaattgaaggaggcaaatttggaaaatctgacggaaaatattctttaacttatacagattctgaaatatgtaatataaacggtttaataaaaatttactttacagattcaactaaaactaagcttaattggaagttttctgatatgacggatattattaccccagattgtccttattacaactctaatccatttcctgagccattacctaaaagcattatattaactaagcaataactataactttaataatttaataatgattggttctaccatagattgggtaaagccaatcattttattctaaagctattgctgttaattgtgaacgtgcagttagattcaaattttccaaactaataaaatatatatgaaatacttattttttatactaacattttttgctatttcatgtaatgctcaaatcatttcattagaacaagcggcacaatgtctaacaaatcctaattgtccacaatataactatgcaaaagatattaataattctctagataaatataccagcacgtggaaaggaacttataatggaaaaacctatgagattcaactcaaaaaaggtatttatgaggagataggtattagaagagacaatttaattggaagaatgaaagtaactgattctaacggaaatattatctataatacctttactgaacctaatgatataaaaacaaattttgacggattgaattttcaacccgatttaaaagcgtatagaatgagctttgtaggtaacagtgaatttgcttgtggcgaggaaggaattgtttatttaagaattaagccagaaacacccaataaaatgagtatacttatgttgcaggatgctgatattacttggggaaattgtccgtctagctaccaacctattataccttacaagacatcaatatctttaataagacaataggctaaaggtttttaaataattaaaaaatgattgatattaccacaatatcaaggcaagatcaatcattttttatcctaaaactatttatagaggtgtgataattattactaatttttattccaacccaaatgacctacattttgaatatctactatatagcagaataatatattgtattgaccaagcaataatttccattttcttactataccatataaaaaatcaaaaaaaattatttcttgatgtatgataaggtgcctcccaataggtttttctatttttgtacccgaaaacaacaaaattcaaacttttttaaaacagttcaatatgaaaaaaattagcgtaattgcattagtaggagtaggattgcttttagcatcatgtaataaagacaaatcggcagaatctgcagctacagctcaggagcagacggtagcagaaagcaaaggtgaaactcttgctgtggatacagtagcttcagtagtaaactggaaagcattccataaaggaggtatggcacctcgttggggaacacttactgtaaaatcaggagatatcagtgttgatgcaggtcaggttgcagcaggaaactttattatcgatatgaattctattaaagtagatccggcttcagtaactgagaaagataaaaagccggcagatcttgaggctcaccttaaaaatcctgatttctttgatgtagcgaaaaaccctacttcagatttcaagattacaagtgttacagatctgaaagaagcgccaaaagatgcagtagcaggagctaataaaacagtaagcggaaaccttacattatcaggaaaaacaatgaatgtaactttccctgccaaagtagatgttactgaaaactcagcagctattcaggctaaattcactgtaaacagagcagattggggaatcaaattcggtacttcagaagcagatcctgcagaatggatgatcagcaaagatatcgagattgcaattgatgtaaaagctaaaaaataagttattcaactttaataaatagcgggctgtcttgataaaaggcagctcttttatttctgtgaattctctcaaaaaaaactaattcaaaatctcagaatgttgaattctcacgcaatattcacttccaagatataagggattgccatgcttttctgaccagaatccatccagaacattcttattcagacagcggtaaacagccactcctttgtagattttattatcttcaccttcataattgaagttaattactaaaatctgatctttataaaatccggtaccattttgtatatgatcaccaataatccattgggcaatgatgcggttgttctcatcaatggttagggttaatataccatgatatgtgggcagggaagattcttcctgattacttccttcaatagaatagcttcccgcaagatcctgtactgtcattaattttatttttaggaagtgcaaatttataaaatcctgttctgaaattaaactctacttttgcagcaaattaattttaaaatgattccttttctttttgtcatcaatctaattacatttggaacttttggctttgataaatggcaggctaaaaaacatcaatggagaatttcagaaaatactcttctagggatttcgcttttgggtggaattttaggtgcggcttccggaatgattcttttcaatcataaagtttccaaaaaatcatttctggtgaaatttatattggtggtgttaattgatctggttttgttttaccgattgatgagacattgatataaagagtcttaagatgatttcgaaaaacagatatttataaaatcaatgttgtgttcattctgcttataaatttgtcaccaaatcattttaaatgacgttttctggacattctttttttatagttctatgagtaagcattttaaacaaaatattaaatatttagagaactaaatagtttttcattaaaaatcactacttttgcacccgtaaaaatcttttatgcaaaacattagaaatattgcgattatcgcacacgttgaccacggaaaaacgactttggttgacaagatcattcacgctaccaacattttcagagaaaatcaggagagtggggagttaattatggataataacgatcttgaaagagaaagagggatcaccattttatccaagaatatttctgttacttataaagacacaaaaattaacgtaattgatactcctggtcacgccgatttcggaggagaagtagaaagagtattaaaaatggctgatggggttattttgttggtggatgcgttcgaaggaccaatgccacaaacaagattcgtacttcagaaagctttggaattaggattaagaccattagtagttatcaataaagtagataaaccaaactgccgtccggatgaagttcacgatcaggtatttgatttattcttcaaccttgaggctactgaagaacagttggatttcccaacattctatggttcttctaagcagggttggttcaacacttcattagaacaaactgaagatattttaccattacttgacggaattttacaatatgttcctgctcctactgtaactgaagggaaccttcagatgcagatcacttcccttgattactcttctttcttaggaagaattgccatcggaaaagtgacaagaggagagattaaggaatctcaatggatcggtcttgctcaagcagacggtaaaattgttaaaggaaaagtaaaagagctttacgtttttgaaggattaggaaagaaaaaagtaacagaagtacaggcaggtgatatctgtgctgtagtaggttttgatgctttccagatcggagattctttcgtagaccttgaaaatcctgagccattggaaagaactgcaattgatgagcctacattgaacatgacgttctctatcaacaattctcctttcttcggtaaagatggtaaatacgttacttcaaaccaccttaaagaaagattaactaaggaattagagaaaaaccttgcattaagagttcagcagactgatgatgcaaatactttccttgtatttggtagaggtattcttcacttatcagttttgatcgaaactatgagaagagaaggttatgaaatgacgattggtcagccacaggttatcctgagagaaattgacggagtaaactgtgagccttacgaatctttagtagtagacgttcctgaagaattcgcttcaagagttatcgatttggctacacaaagaaaaggtgatcttcacattatggaaactaaaggagaaatgcagcatatggagttcgagattccttcaagaggattgatcggattacgttctcagatgctaaccgctactgccggtgaagctattatggcacaccgtttcacagaatacaagcctttcaaaggagctattccgggaagaaacaatggtgtattgatcagcaaaactacaggtccggctacagaatactcaatcaacaaactacaggatagaggtaaattcttcgttgatccgggtgaggaaatctacacaggaatgatcgttggagaacagaacaagcctggagatttggtagtaaatatcgtagaagcaaaacagctgaacaacatgcgtgctgccggaaaagataaggatacaggagttgctccgaaaatcttattctcactggaagaatgtatggaatacatccaggctgatgaagcgattgaggttactccgaatttcatcagaatgagaaagaaaatcctttctgaagaagaaagaaaaagagtagaaagatctgcaaaagcataataaaaattttatacataaaatcaaagcctcgaaaatcgaggctttttttctatacccacttattaaaatgcttattttggcataataatctctgagaaataaaaaataaattttaaagtagttttgtgactatgagaatgaataaattaaaacttatcgttttattaggtgtttttgcttcttacactacctcatgttccgttcagaacaatgttgtaaaaacaccttccacgaaaaatccgacaaaacccgccaacaataccaacccgccaaaagtaaatcctgctgctacaaatccttcaacaggaactgctgcatcagccgaagataatttcagaaccactcttccggaaattaaaagagaattccgtggagcatggattgcgagtgtagccaatatcaactggccttcaagaaatgaccttacagtagagcagcagaaagcagaggcaatcagtatgcttgatatgttgaaagataacaacttcaatgcagctatcttccagatcagaccttcagcagatgccctttatacaagcaatatcgagccatggtcatatttcctgaccggagaaacgggaacagcaccttctcccaactatgatccccttcagttctggatagaagaagcccataaaagaggcttggagctgcatgtatggttaaatccataccgtgcacatcataccaacggtggtgctgtcaataaactgtctatggtcaataaactgtccgatattgttgtcagattaaaaaacggaatgtactggtttgatcctgctaatccgaaaacccagggacacgtatcaaatattgtgaaggatatcgtaaaaagatatgacattgatgccattcattttgacgattatttctatccttatgcaacttataacaaaggcgcagattttcctgataatgcaacctggaatgcttatgtaagcagcggaggtactttatccagagcagattggagaagagacaatgtaaataaatttgtggaacgtatctacaaagaaattcacgcagaaaaaaataatgtaagattcgggatcagtccgtttggaatatggaaaccaggataccctgcaggaattgtaggctcttcacaatatgacgagctgtatgctgatgctaaattgtggttaaataaaggctgggtagattatttctcaccacagctgtattggcctattgattccaaagggcaaagttttgaggccctgttgagctggtggcagtctgaaaacaccatgaaccgtcacttatggccgggactgaatactgttgagatcaaggtttcagaccgcccaacggaaattaaaaaccaaattgctatttcaagaaatatcctgaaaaatgatgccggggaaattcactggagtattgcaggacttaccagaaatccaaatatgcttcctgctctgaaaagcggtccatataacgaaaaagcattggtgccgaaatctccatggataaaagctgccccattgcagactcctacattgtttattgctgataacggaagctttgtgcaggcaagctggagtacaaaaaatgctgctgatgtattcctgtgggtacttttcactcagtacaacggagtgtggcaaacagaaatagtaacactggataccctttcaaaagatattcctaagtctaaagacggtaaaaaactgaatgcagtagccattaaagccgtcgacagattaggaaatgaaagtgattatacagcaagaaaaattaaatagtggtataagacccgctccaataggtcattgcgaacctttaggcgaagcaatctcaacaataaatttaaaacccggttccgtcttagaaccgggttttattttagaataactataaattattaatttaaaatattgaaaaccagttgtgttttaaagtgtattgagcattttaaagtaaaatagaaactttatcggaatcatttttgcatagattattccataatcaccaaaatataacattatgaataccaaaagactttccgacaacatggaaaaggcattaagtgatcagatgaacaaggaaattcacgcgtcacacgtttttttatcctatggaatttgggctgatgataaaggatatcagggaattgccaatttcctttaccgccatgctcaggaagaaagaaatcattcaatcaaattcatggaatatattttaaacagaggaggaaaaccaaaagtagaagctatcccggctcctcccgcagatcctgaaaatcttactgcttgttttgacggggtttttaagcatgaagtagacaatacaaccgctatttacagaattgtagacctttccatggaagaaaaggactgggcaacatggaattttatgcaatggtttgtacaggaacagattgaagaagaaacattagctcagaatttaattgataaattgaaaattgccggcggtgacagagctactgatgaatctttatttactttagataaaactttacaggaagcacccaatgacgttccgctggctcaggaagctaccggagacaatccttaaggtcgttcggtgaaatccagacttttgaaaatctgtcagaacactggcagattttttattatgaaactcgttcaaaaatcactatctttgcgcactcgtaattcaaggttcggagttcaatgtttaaagttgcagaaaccttgggttgccactgaaccttaaactttgaattttacaatatgaaatgtggaatcgtaggcctgccgaatgtaggtaaatcaactctttttaactgtctgagtaacgctaaagctcagtctgcaaactatcctttctgtactattgagccgaacttgggaacggtttctgtaccggatcagagattgtttgaactggaaaaaatcgtaaaacctgagagagttttgccagctgtagttgagattgttgatattgcaggtcttgtgaagggagccagcaaaggagaaggattggggaaccagttcttagccaatatccgtgagtgcgaagcgattattcacgttttaagatgttttgataacggtaatattgttcacgtagaaggttcagtagatccgttaagagataaagagattattgatattgagcttcagctgaaagatcttgaaacagtaggaaaagcagttgagaaagctaaaaaattcatcaagtcagggaagaaagaagatatccttacttacgaaactcttcagaacttacagaaattccttgaggatggtaaaaatgcaagagaattcgctaccgatgactttacaaaatcaattatcggagaagttcagttattgaccaataagccggtactttacgtttgtaatgtggatgaaaattctatcaaaaacggaaatgaatggattggtaagattgaggaaatggctcagaatgaaggagcagaagtagttgtattggctgcacagattgaagctgatatcaacgagcttgaaacttttgaagaaagagaaatcttccttgaagaattaggccttacagaaccgggagttaaccgtttgatcagaaaagcttatgatcttttaaaacttcagacttattttacagctggagtaaaagaagtaagagcatggactatcgggcagggttggactgctccacaggctgcaggagttattcacacagacttcgaaaaaggatttatccgtgcagaagtaattaagtataacgattttatcaactacgggtcagaagtaaaagtaaaagaagccggaaaactttctgtagaaggtaaagaatatattgtacaggatggtgacatcatgcactttagattcaatgtataaataaaagtattaaagttagttataaagaaaagcgcttccatgtatttgggagcgttttttgcttttagattctcgccgttttaatttattttgtaattgaaattcataagatgcactgcataaaaaactgccctctgaaatcagaaagcagttcttgttgttttatcttatattatatacctgtatcgaatctgcattttgcttctatacaagctggagagaaaaccacacagttattgactatatctgtacatcttaactgtgattgaccacctctacattgtggttcatagcatgatgggtgggtttgtgtacatattgttccattttgtatgctacatatcattacacctcctttaatggttttcaactcttttttactgagttttttaccattatttaaatgttgatttctcattcgttgaagtttttatggtttagttttttctttactacaattcaattccgggctggcatcgtatttccgcacaggtaaaagaatattttttgcaggttaggtccggaagcaggcacatttcttttccacctgtaattactcttaattgttttttgttcaatttttttctgtgagttaaattttgatttttcatagtgtttgatttagtgattattaatataattcaatagatatgatgtcttaaggtctgcaaattttctgcgcacaacttggagaaaatatggtacagtttctaatatctccaggtggataggtttcgcaaggaaactctgtacacggaacagcctccatgcaatccagcaagcccccgtgaatcattttcaattgttttttttcaagctttttagctttgcttaattctgtctttttcatagctgttggtttaaaatgatattgagttatagctctggtctacattctttttgtgcacattttggagaaataattgtacatccatagggatcagaagaaggctcgcaaggtgttggacataaaactggttccatacagtttataaggcctcctttgatagttcttaattcttttttgtttaatttttttccaatttgactgatttgattttccattgttttgatttttagtgagttagttttaacgaatgtattaaaaataaatgaaatatatcacgacgcttagaaaaaaatgaattttttttaatatcttattacaatattgatatagattttaaaatgattctaaatcttattcagcataaaaataaaatgttctactttagatatttatttgaaaccggctgtttcataacttcgtatatttgaattttacaaatcatttgtgatggaaaaagtagcacatacttcactggaagacttttacaaggaaatggccgccaaactgggcaaagaccttgaaagtatttttccgaaaggacttcataaagacatcggtcactttaatgttttcgatattgcccaaactatagaacgggcaaaaaccacttcggaaatgccttataacagaagaaaatactataaaatcagttttataaaaggcagaaacagggcagaatatgcagacaaggtaatttctatacaacagaatgccttattatttgcaaccccaaaagttccttatcactgggtacctgaagatccggatcagtcagggagtttctgcgtatttacagaagattttttcattaaggacaaatcttattataaccttgaagatcttcccatttttcaacctggaggaatacctatctttgaaattgatgatgaacttgcagaagagattgaaaacctttttaaaaaaataaagaaagaaattgaatctgattacgtatttaaatatgatctgatccgaaactatgtgctggaattaatccactatgggcagaaattacagcccgcttccaaaatttcagcatccaatgatgcttccatgcgggtggtttctttatttatagaattgctggaaaggcagtttcctatcgaatcatgggagcagagactacaattgaagtcagctaaagattatgctgaccggctggcggttcatgttaattatctgaataaaagattaaaagaaagcacgggaaaaacaaccacggaatttatttctgaccgtattgttcaggaagctaaaatacttttgaagcagacaagatggaatgtttccgaaatatcttatgctttgggatttgaagaagttgcccacttttccaatttctttaaaagaaaaacaacctttactccattggaatttcgctcctgatttgaattttgcaaatttcagattgattcagacaaacacttcaatcctgaaatgtctcaactttgtatcatcaaaataatcaaaatacaatgaacacaaaaacaaatatcgcactggtaaccggaggaagccgtggattggggaaaaattcagcccttaaaattgctcagaaaggattagacgttatcattacatacagaagcaacaaagaagaggcggaagctgtggttagtgaaataaaattgatggggagaaatgccattgcatttcagctggacaccaaagacttaaaaagtttcgatgcttttgtaaaagacgtaacagatcatttgaaagaaaacaccggaagtacccacattgattatcttatcaataatgcaggtacagctttatattcaccaattaccgaagttacggaagagcagctggatgatgtggtagacattcacttcaaaggcgtatttttcctgactcagaaatttttaccatttatcaatgatggaggagggattatcaatatatcttcaggattggcaagatttgcaacgccaggatcttctgtctacggatcaataaaagcaggagtagaaatgttgacaaaatatatggctaaagagttgggaccaagaaaaatcaaagctaatgtggtggccccgggagcaattgaaactgatttcggtgggggaagagtaagagataatgaagaaatcaacgcaatggtagctggtgcaacagccctgggaagagtaggcctgcctgatgatatcggtggagtggtagctttcctgtgcacagaagatgctagatggatcaacgggcaaagaattgaggtttccgggggaatgtttttgtaacatttgaacggcctctcatattaaaaagaatcagccggctcattttgagccggctgattttatttaacctattgtcattagatctttgaaagattctcgagagccttttccagggtctcttttttcttggcgaaacataacctgatcacattttcattcagtttatttttataaaaagatgagaaaggaacactggctaccttatgattaatggtgagttcagaggcaaaatcaaaatcatttttatccgaaatcttatcatattttactgcctgaaaataagttccttcacaatccagcagttcaaacgaagttccttccagtccttttctcagaaaatctcttttttcctggaaaaattggcttagctggctgtaatgttcatcatttttcatgtattcagccaatgccagctggattggagtatttacacaaaatacattgaactgatgaacctttctgaattcatccgtaagacttttaggagcggcacaataacccactttccagcctgtgacatggaaaagcttcccaaaagaggctacaagcaggcttctttctttcagctcaggatatttgcatatgcttaaatgctgctttccgtcaaaaacaatattttcatacacttcgtcgctcagaataagaatggaagttccctttaccagctcaatcagctcctgtatatcattttctttcaggatttttcctgagggattattggggttattaagaataatcattctggttttttcgctgacaagcttttttactgcagtccagtcgatttcataatcgggagctttcatttcaaaacgtttcacaacacctccgaaaagctctaccgtgggttcataacaatcataagccggctcgaaaataatcacttcatcatctttttttacaaaagaagcaattgctgtaaaaatagcctgagttccacctgcggtgacagttatttcagaatccgggtgataaactgcctgatggctgttttcaatttttcttgcaatttcttcctttaagccgatcattccgccgagaggggcatactgattgaagccttttttgataaaatgatctacataattcaacagttcaggatcaggcataaaatcaggaaaaccctgagacaggttgatcgcttcattttcattggcaagctgagtcatctggctgaaaatagtagttcctacattggaaagttttgataaaggaagttgtatcataaaaacagttttgttgatcgaatttaatgaaatatttaaaacagtttgaacttaggacaataaaaatcgggaaatagtaaaggtaaagccaatattcgttaaagccttataagtttcaatgcaaaaattattttaaacatttgtttaaattttccttttgaatcaacataaatatatctacatttgtttgataaacagccattaaaaacgataacaatgaagattaagaaaacagagtttcctgaaaaatccgttttatcaaaaggaaaaaaagagttcgattatatcgatagttttgaaggagaatttacggatggcggccggaatattgatatctcagaaataggaaaagtattttttacaagcggacctaaatggggtaagagaatgtttgctttcaggaataaagcggtgggaatattcgggctaaagaccggctctgaatctgaaacacagcaaaaagaacaggattttaaatgtgaagtaggtgagcgtgcgggcctttttaaggtgtttgataaaaccagcaatgaaattgttctgggagaagatgataagcacctggatttcagagtatctcttttagttgacaggagtaaggtgcatcctgatgaacattcacttaccatttccactaccgtaaagtatcataactggctgggtgtgctttattttctgcctgtacgacctttccataagcttattgtacctgctatgctgaaaaatataattgtacagctggaaaataaaaaataaaatattgatctgcaaatacaaaagtaataatcgtcctgtaattgtaaacatcttaatgaaaattttcagggttaaaatgaattttatttgcttttgtatgtcaactaatttaaagggcttaaaaatcaacgagtattcttctcactggacaataaaagttaggaaaaaatgacttttaaaattcggataattttggacaattttgtatttttgtatgtttgctgaaatcatatatgtcacaagaaataaatccaacctattccgaagataatatcagaaccctcgattggcaggaacacatccgtctgcgccccggtatgtacatcgggaagctcggtgacgggtcttccgctgatgacggtatttatatcctgttaaaagaaatccttgataactctattgatgagttcaggatgagagcaggaaaaagaattgaaataaagctggacgacggaaaagtcacaatccgtgacttcggacgtggtattccactggggaaagttgttgatgcggtttcaaaaatgaataccggaggtaagtacgacagtaaagcttttaaaaaatctgtaggattgaacggggtgggtaccaaagcggtaaatgccctttcagattacttcagagtccgttctttccgtgacggaaaaatgaaagccgccgaattctcccgtggtatgatcaaagaaaactttgacgagaaagagacttcagacagaaacgggactgaaatttcttttatccctgatggagaaatcttcctgcatttcaagtacagaaaagagtatatcgaaagaatgctccgaaactatgcatatctgaatccgggacttaaaattcttttcaacggagaaacctattactctgaaaacggtcttaaagacttattggaagaagagctggaaagtgatatcctttatccgattgtccatttaaaggatgatgatattgaggtggctattacccattctgacaaatctcagacagaaacctatttctcgttcgttaacggacagaacacaacgcagggaggtacacaccttaatgcgttccgtgaagcatatgtaaaaacggttcgtgagtttttcaataaaagttttgatgcttcggatatcagaaaatctattattgcagcaatctcaatcaatgtagaagagccggttttcgagtctcagaccaaaacaaaattaggatctaatgacatgggaccgaacgggcctacagtcagaaccttcattatcgatttccttaaaagcaaactggataattttttacataaaaatccagaaatagcagaagcaattcagagaaaaatcttaatttccgaaagagaaagaaaggaactttcaggaattcagaagctggcaagggaaagagctaaaaaagtatcgcttcacaataaaaagcttcgtgactgcagacagcattataacgatcagaaagccgaaagaaaaggggatacccagatcttcattaccgaaggagattccgcatcaggatctattacaaaatccagggatgtagaaacgcaggcagtattttcactgaaaggtaaacctcttaactgttatgggcttaccaagaaagtggtatatgaaaatgaagaatttaaccttcttcaggcagctctaaatattgaagaaagtctggaagacctaagatataaccaggtaattattgctaccgatgccgatgttgatgggatgcacatccggttgctgatgattactttcttcctgcagttctttccggatctgattaaaaacggacatctttatatccttcagactcctttattcagagtaagaaataaaaaagaaacccgatattgctatacagaacaagaaagagtaaaagcattaaacgaactgggaaagaatcctgagattacacgatttaagggattgggagaaatttctccggatgagtttaagcattttattggtaaagatatccgtttagaacctgtagtagtaggaaaagaccagacgattgatcaacttctggaattttacatgggaaaaaacactccggacagacaaactttcattcttgaaaaccttgttgtagaagatgactcagatattgataaaaaagaaattctggatgaagttgaaaactaaaacttgaaacttaaaaactggttgtaaataccagtacattgactgaaaaaaacacaattttggatgaagtaagaattataaaacttacacagccaaaaaaataaaatgagactaagtaaccgcaataaagcatcgatttataactctctgagtacgttgcttttgatgataaccatgtttggtataatagcatttattgctaatgaataccggtttaatgcaataggtaatgaaagttatttattgattgttatacccattctgctgctgatcatattttacatcagcgggaggcagatttttgaatatgacagcgatggagaagctttgaattttaaaaacaggaatattattccttttttgaataaacctcttcacgatgaatttccaaaatacaaactggtaaaatatgatgtggtcagtattctctttttcaaaagattatacattaccgtttccagcaaaaataatggttctacgatacttaagtaccagatctcttatttgagtagaaaagaagtaaacgatttaaaactttctctgaacaaagtagtgaaagctaataaagataaaaaaacagatgacgacagaagaatattcgcatgagggtgaaagcttaaaaaaagtttccggtttatacaaagactggttccttgattatgcttcctatgtaattttggatagagctatcccttcgatatacgatggtttaaaacccgttcagcgaagaattatgcactctatgcgggaactggaagacggccgttacaataaagtggctaatatcgtgggaaataccatgaaatatcacccgcacggtgatgcttccattacagacgccatggtgcagatcgggcagaaagagctgttgatagacacccaaggaaactggggtaatatttatacaggagactctgctgctgctgcaagatatatagaagcaagactgactccttttgcgctggaggtggtctttaatcctaaaactacggaatggacaaagtcttatgacggaagaaacaatgagcctattgatttacctgtaaaatttcctttactccttgcacagggcgtggaaggtatcggggttgggctttccaccaaaatacttcctcataacttcaatgaacttatcaatgcatctgtagcctatttaaaaggtaaaaaatttgaactctatcccgactttttaacagccggttatctcgacgtttctgagtataatgatggccacagaggtggaaaggtaagagcaagagcaaaaattacccagacggataagcacacattggtgatttccgaacttccatactccaaaacaacaaccgatcttattgactctattttaaaagccaatgagaaaggaaagatcaaaatcaaaaagattgaggacaatacttcagataaagtagaaattctgattcatattcataatgatgtttctccggataaaactattgatgccctgtatgcttttacagactgtcaggtaactatttcaccgaatgcctgcgttatcgtgggagataaaccgatgttcatgaatgtatctgagattctgaaaatgaatacagatcatacggtatccttactgaaaaaagaacttgaaattgaacttcatgaacttcaggaaagctggcatttttcctcgttggaaaggattttcatcgaaaacaggatctaccatgacattgaagaggtgaaaacctgggaagatgtattaaagaccattgatgcaggattaaaacctcatacaaaacatctcttaagagccgttacagaagaggatatcttaaagctgacggagatcagaatcaagagaatttcaagatttgatttagataaatttaaagaaaatattgcatcgctggaaggtaagatagaacaggtaaaatacaatctggaaaacctgatcgcttatgccattgattattatttaaatattcagaaaaaatacggtaaagacaaacagagaagaactgagctcagaatttttgatacgattgatgctacaaaagtagccgtagccaacgaaaagttctatgcgaattttgaagaaggcttcatcggtacatcactaaaaaaagatcagtatttgtttgactgttctgatattgatgacatcatcacattcagaaaagacggaagtatgaaggtggtaaaagtggaagcaaaaacttttatcggaaaagatattcttcacgttgccgtttggaagaaaaacgacaaaaggactgtgtataatatgatctaccgtgaaggcagggaaggaccatattatatgaaacgtttctctgtaacaggggtaaccagaaatacagattatccgttagcttcagataaaaaaggttcggagacattgtatttctcagcaaacccaaatggagaagcagaaacagtaacagtacttttaaaaccgaacccaagaatcagaaaaaataaaatggagattaatttctctgatcttgccatcaaagggcgtgattccaaaggaaatctggttacaaaatatgctgtgaagaaagtagacctgaaggaagaaggagtttctaccctggctccaagaaagatctggtttgatgataccgtaagaagactgaatgcggatgcaagaggaacattactgggaagcttcaaaggagatgacaaaatccttaccatcaatacaaatggtgaagtaaaactggtttcttttgatcttggcaatcgttttgatgatgaatatctggtactggaaaagtggaaacctgaacagccgattacctgcatttattatgacggagaaaaagacatttatttcattaagagattcttactggaaaatacggttaatgtacagacctttatgccatctgaacatcctaaatcctttattgaaaatgtaattgttgccaatgacgccacagcagaaattatttttgccaaagataaaggaaaagagcgcgagccggaagtcgtgaatattgatgaattcattgctgtaaaaggaataaaagcaatcggaaaccagtttaccaagttcaaagtgaaagctatcaatattaccattcctgaacctgtagaagaagagcctgaagcttatgaagatcctgaaccaacaggtgatcttgacgaagatggaggaatgatcggagatctgtttcaggatgacgggaataatgaaaatgaatagtgatctgcctgttcccgtataatataaaaaaatatcatggatataattgttatcattatcattgctgctacatgtatcttcagctacatggggtttaataatacagcattatttgaaaaatataaattcaatgtcgcggctattgccaaccgaaaggaatatatcaggctgatcagctctgcgtttttgcatgctgactttatgcatttatttttcaatatgctttccctgtattttttccagggtgtagttattagtttctttggtgaaacaggatttttaatcctttatttcggatccatgatccttgggaacttattcagtttgcagatctataaaaatcagccgtggtattccgcaatcggagcatcaggagcggtttcaggaattatctttgcttctatagcaatggctccgaatgagattagtgtcaacttcttaccgggatggttattcggagctctgtatttcggatattcagtatatatgatgctgaatccaaagcagtgggataatctggggcacgcagcccatcttggaggagcgttcttcggattggtttactctattgtaatgcatccgcagctggccatgagcaacagccttttcctgggaataatgtcgctcccgctgatttatttaggatatgaaatctttgtaaggaaacgaataggataaaggctatttcaattaaaatatcaaaaccaatgaacacatcagagttaaacagtttcatcgtgatacttatctatggttcattggttttgctttctctgctgaagctggccaatcctttgaaagtaaaccataaggctaatttctggtttggcatatttctttttctgtggtctactttttggctcgatgaagttctttttctcattaccggctcaatagtagaattccattctctcttttgggtcagatgtattcagttttttacacccattgttttttactttagtgtgctgttctataccaacccttcctttacctttaaaattactgatgtaaagtttttattgcttcctgcagcttttctgggatgtcttatgatggtaaaactggggtatgagacaccgtttcagtacataagtattattttaatcctgatacaggcttttttctataccctgctttcctatattaccatcagaaaacaccaaaggagaatccagcagttttcctccaacacggaagggatcaatctgaactggctggagtatattatcctggtaatgcttatcgtaaacatcatctatatcatttataacctgttctacgatccgaaatccctgaatttctttatcaacactgtttttttacttgtgatctactgggtaggatactactctatgaaacaaagagagatttatcctctggaagaaaaacagagagaagaactgatctctattaatgaagattccggttcggaagaagtaaagagaaaactgatttctgatgaggaattgttaaaaattaaaatttcccttcaaactctaatggaagtgcagaagccttatcttgacagtgaactgaatctcatcaggctggcagaaatgctgtccgtttctacccatcatttatcttatgtcatcaatacgggcttcgggaaaaatttctttcagtatgtcaatgaatacagagtagactatgccaaaaaacttctgaaagagccggacagcaaattatccattctgggaatcgcttacgaatccgggttcaattccaaaacctcttttaatactacctttaaaaaagtgaccgggcaaactccttccgagtttaaaaaataagttcagttttataagttttaactttttaatgagtttaaattattgatttttaacccattaaattttggatgttttttattttaaaatacgttcgtccggataaaactgaacatcagaacgttgttcacatgatagctttgtaccataaaatttaaacttatggataccaaagaatcatatgcggtagtaacgggagcaagtcagggacttggaaaatcattcgctgaacatcttgcaaaacaaaagatcaaccttatccttgtaagtcttccacatcagaatcttaaagaactttcccgggaactcgaaaagctgtatgaagtaaaagttcattattatgaaacagatctttccgtgaatgaaaatgtcatgaaacttaccgaatggcttaatcagtcttttgccattcatatcctgatcaataatgccggacttggcggaactaaaaaattcacggaagcctcttctgattatatcaataccattttgcaggtaaatgttgcggctacttctttaattacccatcagcttcttaccaatcttttaaaacaacccgaagcttacatcctgaatgtttcaagtatggcagcattttctccgataggctttaagacagtatatccggcatccaaaagttttatccattccttttcaagagggctgcgcgaggagcttaaaggtactaatgtctttgtaagcgttgtcaatcctggtgcgatgaaaacgaatacggatgtatgcaaaagaatagaaaagcaaggctttataggaagattaacgcttttaaatcatgataaggtagcttcttactgtatccggcagttatttaaaaaagattccgtaattatggtgaacccaatcagttggctggtgataaaaattttaccaatatggatcaggctgccattaatgacccaggcaataaaaagagagatcgaagcatgaaaaaaatttgcgtaaccggagctacagggcttctgggaactaatgttatccttaaattattacaaaatggttattctgttattgctctggtgcgcaagaaaagcagctggctgtgtgaagaaaaagaaaatctgaaacttatagaatctgatcttttatccgatgtttcaacacatcttaccaatatcgactgtgttattcatattgccgcagaaacacgtcagaatcttatcaattatgatgaatacaggaaagtgaattatgaaacggttgtaaatctgtcgaagtatgcagagataatgggggtgaaaaagtttttatttgtaagcacggcaaataccttgggtttcggagagacagcgctctggggaagtgaaaaagcacctcagatatacccttttacctattcctggtatgcccaaagcaaattggctgctgaagattatcttttaaaaaatattaaaaatactgaggtgatcattgtaaatcctacttttatgatcggtgcgtatgacagcaagccaagttcaggaaaaattattttctgggcctggaaaaagaaagtaatattctatccgaaaggaggaaagaactttgtacatgtggaagatgctgccatcggaattgtgaatgccattgaaaaaggacggaatggtgaaaaataccttttagccaacgaaaatttgagctacagagaatttttcaggaaagtaaaccggattactggtcaaaagcctgttatgatagctattccagacaaggtgttgaactttcttggattggttggtgactatttgcgaaaattaaaaataaaaaccaatctcagctcttctaatatgaaggcacttcagatccgtaattattataacaaccggaaatcggtaaaggaacttgggataaagtatcagcctgttgataaagcaattgaagatgctgtccggtattttgttaacaataaaaagtattgatttacttgttaaaaataaaaaccagctgctgagagctggttatatcaaattatcttataattttctgagttacatttctgttggaaatgacacaggctttactgcagttatttgaacttgaaatattaacctgtaccagtgcaggcaatgatctgtattcttctgtattgtaaggagcttcagtaccatttctgccaccacctttaatgtcatactgtatctgagccacaccggtaaacccggcggcaggtttgaaagaaagcgctccggtagtaggaaaataagtccacgttccctgactgttcgtataaacatttccggttatattcggaatcacagctccattactgtccaggaaacggaatgaattaaaatcaagattattatacgaaagtgttggcggattctgaccgtttgctgaagagtaagctgcatcatttagcaaaggataataagttgattttattccgggacagcctgcaaacagatcatccgttacttcagctgcataaggtctcgtcacgcccaggtttttcaataaatgtatatttttggcagctccggtagaagccgcaaaaccaattctgaaagtagcgggaggtgaagtatccagcgttcttactgtggtgttggatattgtggtttctgtatatttaagagaggttggataataataattatcaatcactttttctttcacagttccatgctgtatttccagggtaatattgtaacctccggcaggattgggtaccaacgtaatataggctttacggaatcttgcatcattttcattctgaggaatggtagttccgccgctttcaatactgaactgctgaagattcggatttttaataccgatatactttcccgtctgggtatccagataagcagacctgttgctgctgtaaggagctgcattggtagcaatactgtaaagcagaggataaccattgtatccggcaggctcagctgatgacagatattggtttccgcgttttgcccttaaagacacattacttcttccatctgccagtgttactccaaaaattccatttcttacacgctctccttgtttaaagcttgttttaaaattcccgaattcatccagaccaattcccaggtaggctcctctcaatccttccgtagattcaccaccacgtacaaaactatatcccaatcctccgccgaagtagccgagattgagctgctctttgggaatggaaccatctaccagaaatatcgaaataccatctcctccgttagtatttcctccataaatggcaaattcaaactcgaacttgataccctgatcacttttaaatatcttgtcagccaatatcactcctccggaaatattatttacactccgggtaagcctaagaccatccgtggtaaaggttgcatcattctgaacaccactggtagaaaccttataagcttcctgaggctgtaatccctgtgtgaaattgacaaaataaggataaccggttccctgttcattctgagccttgatattctgggtgaatatcattacgggaagcatcaacaaaaaccttttgcattgtacaattgaggtactttttatcatagctcattatttaacaacaaaaacaatattgatgaaagaacagtctgttgctgctgctttaacgtcgtaagtcattacaccatcatcagaaatagaaatattgctgaatacattaggatcagcatcggttacgtaatagtaaaggtccttgcttgaagggaaaaaaggaattgaagcaggagcgctggtactctttgcttttggagaaccaaactgcgttttatataaagtatataaatctttagtcctgccgttcgctgtgattgaagtgtcaaaagaaacacttggcatgtaaaacatttttacagcattactgctgatacatagccagtcaggcttggctggagttcctatattctggctcagacatttcttgtcggtgtcatagataagaagtgagttggccggattggtaatcgcatctctttttgctgtagtaagtcttggtatcagtattcctttattctgactgtaaatgtccagcatggcactttcgtcaggtgtagggatgttaatacctacttgggcaaatgaaaatgaacttactaaaacgattggtagaaataattttttaatcataatgaattaataattttttatctgtgtatttttatgtgtttatattgtgtttttatgaagaatcagtcaattttaatctcaatggacataattatctttgacaattcatttagaataatcatttgtactgatttaatggcataatggggttctcaggtccaaagccaataaagatttaaaatgcaggtcttcatgagaccataatatggctttatctgaaaatatctactaagtaaattgatgtaagcagacttttatattgaatatacggcggtgtaccagtgaaaatcataatttttgtgttttttgcaaatatacgaataaaatactaaaaaacctgctttaaatagcttgtgagttgatttaacactatttgttagttaaattaatattttttaatttaaatttttattaagataacaagatatgtagattgtttttaatgtataaaatgttgaattaaataaaaataagtgtaaaataggaaatacagagaaacattattaaaacatcaagtttgttatgaagcgttcacattagtaagaacgcttcgcttaagacttaaaatcagaatgatgaattaacttcagaaatttattaaaggtgtattttttcagctgttttctaaacagctgaaaatgttattgagagagcttttctaatgcgtcctctaataatcctacaaaattgacatgttttgttttattactttcaaaaataaaatcctttatacttttactttcgtatttactgaaatcaccaacaatagctaatcctatccgatagttggagaatttctgcaggatttcacccgcaatttttgtttttaaatcgaagaattccggagtgatgtttttctcgtaaagaattactttgtcaaacccctgataataaatgtttcccatgagatcaagcccatcttgtgcagactgtataattatgctgtcagaaataatttctgcaatctttatattgttgatttcgtgtggttgaataatcatatttattgtattgttttttttatgtcgtataaaaagttccctaagggaaatgtatctccctgattggtaagcgcaataatgcagctgttatgcttcaaatctctccagaataaggctttaaagccgttcagaccccctgtatgcattgctgattttcctccgtttttattttctaagaaccatgcaaacccgtagtctgagatctttgcattggacaattggaagggagaatacatcatattggtattttctttattaattaaggcatagtttcgtaaagcacgatcaaatttataaagatcttcaggagtagagtagattccaccatcaccggttgttaaaattgaataatcatcaggctgtttttgtttattatatcctgctgctctgttctgaataactgtaccaggttcatacacataagtgttacccatttttaaagaagtaataatctgctcattgataaatgtgctgtaagattttccggaaaccttttcaatgatctgagacagaatgatgtatccgctgttgctgtacttaaattcgctgtcaggaatgaactcaagatttttaagatcaaacagccagttcattacttgctgattggttaatccctttttagaaaacagattttcataatccctgattcccgaagtatggtgcaaaagctgtctgaccgtaatgtttttagcatattcaggaagctttatgaattgggaagctttgtcatcaaatttcaataaacctttttgctccagcatgataatagctgctgcagtgaatggcttactgagggatgcaatataaaatgaagtgtttttgcctgccttcagttttttttcaaagttgcgaaatcccagagcagtatcacagacaatctgaccgtttttcacaatcagaaccgagccgttgaattctcctttattgtaatatccatttataacatcctgaggattctgtttgcaggataccagctgagtaatgagtaaaacaaagatgaaaaagttccatgtcaaagttttcataggttatgtatatggaagtaaaattacttatttccttccataaataaacctgtcattttcagataaatcctttaataattgaacgttagaaaaataatgatacaggcccagcgtttcgggacctaatttctgattgatttctaaaaataaaagtccatcctctgataaatattttttagcatcttctgcaatttttctgtaaaagatcaaagcatcagcagtaggggagaaaagagccattttgggttcaaattctttcactgaatctgcaatttcaatctcttcttcaatcccgatgtatggcggatttgaaatgataatatcatagtcttcacccagttcataattaagataatcggcgtggatgaaattgatctccagctgatggtactctgcatttctttttgcagtgttcaaggctttttcagaaaaatcaacagaggaaacatgggcttcaggaaaatacttctttaagaccagagggataattccgcttccggttccaatatccagaatctttatatcctgatccttaaactttgaatttttgatctccctgatcgcaatttccagcagttcttccgtttcaggacggggaatcagtacattttcatctacgaaaaatttcattccgtaaaattcggtttcacccaatatctgctggtaaggtttcccggttttaagttctgatacaagatggctaagtttttcttcatcagctgttaaaagttcctgttcggaaaatcttctttgctggaaattatcaaaacctgtaatctggtgaatgaacaaagacgataaaaatgcactttccgactcagtataaaggctggaaagttctgctttgaaatatcttttaaaggctgaaattgtcatttatcttgtaaaaaccagttttgtatctgtggacttttcttcattaattctgtatccttcatagttgaatgcttttacatcctccagagttttggcgttggtttctgcacagaatcttactacaagacctcttgcatgtttggtatacactacaatggtcttgagtttttcatctttcaactcgtaaaaatcaaagtcaattactgtatggtttagcttttttctgtcgattacttttccgtactcattgctggcaagatgaagtaaaagctctccttttttcatttcggaattcagctgttctgtgatcttttctctccagaattcatacaggtttttgtattgctcaaattcaaatggacgtcccatttcaagcctgtacaacattactttatccgaaggtttcagtaaaccgtaaagcccggaaaggattctgtagtttttctgaaggtaatctaccgcatttttatccagtgttttggcatcaagccctctgtaaacttctcctgtaaaagcaaacatggccggagcagattcttttgcggtaggcttggatttccatttttgattcctttcccagttttcatcagccagcttagctgatatttccatcagttcggaaagatattttggtgatttttcttttaaataagattgtataaatgcagcgtcttcaatgaatttcggggtagtggttttcaacaggtccgttgaattttctacgttcatcaattttgccggagatgttataattttcataatgttaaaatacagataagtgtttaatgtcaataaaattcatccctgtcatcgctataaaatcaatcataaaatgacagataatcagaattttaatatttgaataacgtttgtaaaacaaagcaaagacaagtccgataaataaaggtccgataacctgggctatggtaccgtaagtgctatgcagaatcccgaataaaacagaggaaataataattcctgttgccggattgttataaattttttcaattctggactgtatataaccccgcatcaggagttcttctacaatagcagctgtaagtgatgtaaaagtaattaaaaaatagttgtttctgaaaataggtataagattcagaagtttatcacttactttttcttttataatgaacatactgaaggcattcagaatggctccgccgagtatacagagaaaatataagctcagaacagctttgatataaaaacctatggcatattttttctcttctttaagtaaaaaagaacttttctcaacaaaaatactgtatagaaatatgataatcaaaatgatccacaatattattctgctgaaaaaaaaatggtctgccgtaatttttcttatcccagtcattaaagtaatcgccggattagaataaagcatcgcagcagctaaaagaataaaagtaagtaaaatccctgcagcatatttcccggtaagactcatcattttgaattaaataattccttttccctgacggataatctccggttctcctgaagtaaggtcaacaatagtggatgctacattatctccatatcctgaatcaatcacaatgtctaccaggtgatcatatttttctgcaataagctcaggatcggtagaatattcaatgatttcatcatcatccttaatggaagttgaggcaatagggtgtccaagcttttcaacaataagttgcggaatcgggtgatcaggaacgcggatcccgatggttttatgacctttataggctaaaggcaaacttttattagcttccagaatgaaagtaaacggacctggaagatgacttttcaaaaatctgaaaaccgaagtgtcaataggccttgtaaagtcggaaagatggctgagatcattacagataatcgagaattttgacttctcaagcttcatttttttgagctgagccagtttttccatggctttgatatcaaaaatattacagcccaaagcataaaccgtatctgaaggataaatgatcagcccaccattgtttaatgttttaataacctcattcacaagattttcctgcgggttgtccgggtaaattttcaatatttttgccatagaacaaagatacaaataataaaatagtttttataaaagtcctttatttaaaagaaaaattaggaattttaaaaattattcgtacctttgcaatccaatatcgcgggatggagcagtaggtagctcgtcgggctcataacccgaaggtcatcggttcgagtccggttcccgctactaagtcagtgttttcggtaaacactctaaaaatacaccgcggggtggagcagtaggtagctcgtcgggctcataacccgaaggtcgcacgttcgagtcgtgtccccgctactaagtcagtgctttcggtaagcactctaaaaatacaccgcgggatggagcagtaggtagctcgtcgggctcataacccgaaggtcatcggttcgagtccggttcccgctactaagccagtgttttcggtaaacactctaaaaatacgccgcgggatggagcagtaggtagctcgtcgggctcataacccgaaggtcatcggttcgagtccggttcccgctactaagccagcgttgtcggtaaacgctcaaaaaatataccgcgggatggagcagtaggtagctcgtcgggctcataacccgaaggtcatcggttcgagtccggttcccgctactaaacgaaaaatcggtatgacgtattgttataccgattttttatgtttaaaatgatttaatgcaaagtgattttaatcaagaaaagtatttgtattttttaaacggtccgtcataattttagttttgtcattaccattagaatctataactttcaaattgccattatatattgatggattttcgtgaaaactttttcttgcttccaaaaactgtttcttacttttagctttaacctcattataataggttaatggctctataatttcgtctgatcttttaatctctgttgcatatatttcgatagttttatttttattgaacacctccaaaattaaacctgaaagtcctttgaatcggaatggtccatccggaatagcaatctcagtggtaaaccacgcaaaaaaagtatctcctgtatcagttatggttcttgccagctggcatttgaaaccttttatatgtttcatttcattcaaaatttcccaatctaatttaggctcctcaaacgaaaaaatatattttcctaccgggagatatgcatgaataatacctttagcattataaatactttctacggctttaggatatttcggaatgtttccataatttgtattgatagtttgtgtgaaatttcctttataatatgctttagcctctgcgctacaatagatggattctgtattattacatagtaaaacggatgaataaactttcactttttccttatttaggctatcggaaattatcttagtttcatagttaatttccataacagccttattttgtgccgagatcataagaaagcaggaaacaaacaatcccagaaatactattttcaccatgagtaataaagattaatgtttcacaataatatcaatttgatttgaacaatatgaatgaagaaccataatttctataaatttttaattcatccctggagctttctcttaacaattaattccttccattgttgatatgcctccctcatacaatgtccgcacggacggtaattattctgtaaagcatctttttcatctataaagaaaaccctgttttccttcttcatcctttttcctgaacggcaactgagcaatccgtaaatttttaattgtttattacctccaaaacagatttccctactgtggattttgcttctgagatcttcggttgatatctgagaatgttgaatcatagtcataattttaaaaactaattgactgcatcatgaaaaataatacccaaagcatagcggtttccttctttaacttcacttacgccatgtttcatattaactctgtaatggccttttgtgcctttttccggcttaaactgagtcgtgaaaataagaacgtctccttttttaggctttaaaacgatggctttagactgtgctctcggaatttgctgggtaagcacaaactcacctcctgtaaaatcttcgtcaggttcgctaagcattaatacgatctgaatagggaaataaatatctccatataaatcctgatgcagcgtattaaatccaccttttccatatttcagaattaaaacagtagccttttgctgaccgttggcatgacattgatccagaaattcctgatgctgcaaaggaaattgggtatcaatatgcaatgctttaaaccatgtgttggcaattgatgccagataaggatatatagttgttcttatggtctgaattatctctggtaacggataattaaaatacttatattccccgaggccgaaacggtgtctggccataacaactgttttgcggtaaagagcagaatggtcataattggattttaatgtttcgcaatcatcttcagataataacccgggaataatagcatatccgttttgatgcattgtttccgtaagttgctgccagtctgtactttttattttatgaacaatatctttcattggtttgatttgcctgcaaaaatctgacgttgttcagaatgatacaatccaaaacatgcggtatttaaatatcaataaataaaacggatgatatctggcctataggtttaatatatttctggatggtaccatcattcctgtttaaggctacttttgccatgtaataaaaaaaaatgaataacaatgaattacactattaaaaaggcaggtcttgaggatcttgatgaaacggctgaattgttcaatctttaccgagttttttacagacaggaatccgatgttgaaaaaggaaaaacttttctcaaggaacggtttttaaacagtgagtcggatatttttcttgcaatagcagatggaaaagcagtaggatttgtacagctttataagttattccattatacaaaactgcaaaagcaatggttactaagcgatctgtttgttcatcctgattacagaggaaaaggaatttctgtagcattaatagatcgtagtaagcaatggtgtgaagaaacaggagcatgcggattaatgcttgaaacagaaaagaccaataatatcggaaacgcattatacccgcgttgcggatttgagtatgacgatatgcacaattactaccactggtggaaacagggaaagtagtattacttctacaatgttgaacgtttaattctacaggtattgttctgccaatacaggacgtagacctatttttgtaaagctcttacagatcatgggtaggacagttgatctgtagagtgtatgcaaaaaaatctctgcctaattttctactttttccccaagggttttatgattagtaccacaaaactacttttccggtagagattttttgcttttaaaaaaaatagaaccgcaattgcagttctatttttttatttataggtgacttcagatattattgagccagttgggcgtaaggggtaagcttgttgtcatcagacatcgtctgtcccagaaagtctcttttctgatcagccttcattcttcccgcagcttcattggcattgaaataagcttcactcagttttgtagcgatatcagctggcttaaaatcaaatttggtatcaccatctacgcctaaatatccgttctttcttgttaggttagtaatgtaattattatagttgatcatggtacctctaaacatattgttatggtattccatgcattttttagcttttttagaagagttattcaggatgcagtttttcatattatttctatataagaaccattcagattctacaatagcgtattctttacctaaagtaatctttccgttgttcacaatattctgatctccctctttggttgcaatcgtctgaagatgttgaataaccaatggaacggtagcttcgatttttgatttagtatcttttagtatgctaaggtcggcagcaggagaaccctttttttgtgctgtagtaatgttaaaaataagcagtaatagtacaatcaataaattatatcttttcatgagaaatttttaaagcactaaaataaatataatttcccggttaaaacaaattcattttaattttatttaataaaaattaacaagttttaagaatttatcctttaaatgcttctttttatattaattagagaggtatatttttcactccgttaaaaaattaatatattttaactatttttatttgattgatttacagttagttattgtttttatttatttatcactaaaaaaatagttgtttgattcaattttatttctacatttgtataactaatttcttagtgatatagaattaaacggttttatatcacaataattgataaatgaacaggatatgaaaattcagactttaacaaaagcagaagaacaggtaatgcagtatttatggaaaatagaaaaaggatttcttaaagatgttctcgatctttttccggagccaaagccgcataccaatacagtctctactattttaaaagtattgaaggacaaagagtttgtagactatcgtgtacatgggagacagcatgagtattttccgcttgtttcaaaagaacagtattccgggaaaaccatgaaaagccttgtgaaaaattattttaaaggttcttacaaaagtgccgtttcatttttggtagaaaaaaatgaaatgacggtggaagaccttgaaatgctattggatgaactcaaaaagaaagactaatacctatggaagcaatacttttatactttggaaaaattattttatgttcgggtgtaacgtttttgtactaccagttgtctttaaaggacaagacattccatcattataacagattttatctgttggcggcgattgtgatctcgctgttattaccacttataaaggtagatgattttacgatcgaggtaaatagtgatatgtatatgcttcttgacaggatacagaattttaatacagaaaaaactatagacaatggtaacctttattttaaccttactttttcagctctgggactggtttctctctattttctagggaagcttatctatgggatttttaaaatccagcagtttaaaaaacagtttcagaaagaaagctttgacgggatcaacttttaccgtacagatcttaatgaagccccgttttcctactttaaaaatcttttctggaagaatgctattaccctgcattctgatattggaaaacagattttaaagcatgagatggtacatattgagcagaaacactcttttgataagatttttatcgagattataacttctgttttctggttcaatccgttctttcatatcatcaaaaaagaaattaaccttatccacgaatacctggctgataaaaaagccgtaaaacaatcggacaccaaagcatttgcgcagatgcttttagcaagccacttttccggaacacagttgcctgctgccagtccgtttctaagttcaaaccttaaaaaaagacttaagatgttacaaaaaccaaaaaccaagttcggatatgcgcgaagaatctttgcattaccggttttattctcagtagcctttgcttacctggtaaatgcgaaaaacagagaaattgaggaaaccaatatcagcattcagaaagcggtttcacaaattaagaaagacactgtaagacctgaaaaaatacagcaggaagaagttacagatccaataccggaattacctaaattaaaagcgaaatcagcggaacttcaaaaagaacttaatcaaaaaagtaaagaattaagtaagttgaaacctgaaacgtcagcttttgataaaaaaatagaagaaattaatcttcttgcttcagaaatggggaaaataggagatgaaacatcaagactggttgatcaatatttcaaatctccggaatggaaaaataaaatgctggccctggatcatatgaaagtagaattgccggaattgtccaacctcgatattgatgtagattttccggacccacctgtaccaccggatgcgccgggaactccaaaagcaccgaaggctccaagagtattttattttaaaaataataacgctgttcacttcaaagatctgagcggtaaagaaaaggctgaaatccgtaaagcgatgaaagaagccagaagagcaatgaaggaaggtgaaaaagccagaatccagggtgagaaggcacaaattgaaggagacagagcgaggctagagggacaaaaagcctttctggaaggtgaccgtgcaagagcagaaggagctagagccagattagaaggggaaaaagcaagatcagaggcagaaaaagcaagatcagaggcagaaaaggcaagattagagggagaaaaagcaagagctgaaggagatagaatccgcaaagaacatataagaatacgaatagatggggataaaatcagaaaagaggttgaaagagcccgtgcagaagcagaaaaaagatcattcagctttaaagacgggacctttataaaagtgaccaacgcttcacctgatgttatcgtaatgaacgcagattttatcaaaaaagatggtaacggaaacatcgccatgaatggggtgaaaaacttcagaataagcggaaatgatgatgtgaaatacaaatattatattgacgggagggaagtttctaaggaggatgtaaattcattagataccggcaatatatcgaaagtcaatgtcaatactcagaaaaaaggagattttaaacaaggggaagtaagaattgaaacaaagaaataaagttccatcgggttttgtcagtttcagattggcaaagcctttttaattatatactatgaaaagtaaaattctattttttatgtttctgggagtgctcgtcagtgcacaggttaacaggtttttttatgaatataagtttattccggattccaataataaggaagatgtgaagacagaaatgatgatgctcgatatcgataaaaacggatcaagctattacagccgtgataaatttgtcgcagattccaccggaaaggcagaacttgaaaagcagctgaaagcaggtggcggaaacatcagtgtcaacagaagggaaaaaccgggacaggtttcttataaagtaactaaacaatatcctgattttaaaacttatcttttcagaagcatttctacagataagtataaaataaaagaagaccagaaaccggaatggaaaatactacctgagaaacaaaaagtaggggagtatcaggcgcagaaagccactaccagctttggagggagagaatggatagcctggtttacgacagatcttccttttcaggatggaccttatgttttctacggacttcccgggcttattgtcaaaattgaagacaccacaggatcccatattatgacaatgataggtaataaaacctttaatgctccggcttctgaatcggaaatgcaggttcctgatcatgtgagagtactgggaataggaggaaaagagcttgaagtaacaaaagatcagttcaaaaaggtatggaaagcatatgcaaatgatcctgccaaaaatatgagagaaatgctgatgaaaaacggagatggcaatactaaagtcagttttaaggtaagaaccggggacggcaaagaaatctcagatcctaatcaggtacttcgggaaatagaaaaaaatactaaagaagcccttaaaaaagataacaatccgattgagccggatctggtaaactaaaaatcattatattttctactataaacaggatagcatatatgttattctgttttttatttataaggttgtaggtgatgaatatcaattaagattattgttacaaatttcttacctttccatagttaacaccaacttaatatcttatgacagaaaaggaaaaatgtgcagccggacttttatataatgccaactatgatgaagagctgattcaggagcgtattgcctgtaaggatttatgccaggagtataatgccctgaaaaattcggacacggaaaagagatatcaattactcaaaagaattattggcagtataccagaaaatatctgcatagaacccgatttctggtgcgattacggatataatataaaagcaggaaaaaacttctatgccaatcataacctggttattttggattgtgccagagtagagtttggcgataatgtgtttatcggccccaactgcagtttctatactgcaggtcatccgctggatgcacagcaaaggaatgaaggtctggaatatgcacatccgataaaagtaggcgataatgtatggctgggtggaaatgtagttgtacttccgggtatttctattggaaataactcagtaataggagcaggaagtgttgtcacaaaaaatattcctgataatgtggtggccgtaggaaatccgtgtaggattgtaaaatcaattgtaaaagaaaactaaataattcttcaactaataatccatgaaaaaaataattattgcattcagtctgttgttggctcttgcagctaatgcccagaatcagagatttatttatgaatataaatacagtattgactctactgccaaagacaaacccgaaactgaaataatgtttctggacgttgtttccaaaggatccaagttttacagtaaagatgtttttgaatcagattcccttatgactgcatctatggaaaaacagttacaggctggaagtacagaaatcaatttttccggtatcaaatttaaaggcaagattccttatagtgtagaaaaaagctatcctgattattcggtgagcttttttaacaatttatctgcggatgaatatttggtgcaggatgaaagaaaacaggagtggaaaatccttccggaaaaagaaaaaataggaacatttaatgctcagaaagccgtttgtaatttcgcgggaagaaaatggacggcgtggtttacagcagatttgcccatccaggacggaccttataaattttcaggacttccgggattgattgtaaagatggaagatgcttcccgcacccattcatatgaattaaaaggaagtaaaaaacttccggccggatatgagtggaagagtaccaaagagaaagaaaggtttaatgcactggttaccataacggaagccaaataccggaaagcctttaaagaatatcttgcagatccgatgaaaagtgaaaaacaaatggtggctcagggaattgaaattcaggaaatagatgaatccgggaaattgattcctattgataaagcacaaaaagctaaagaaataaaaaagaagaatgatcttaaaaagcagaacaacatcctggaactggatctgctgaaataagattggacataaaaacaaaatcccggaacattgttccgggatttttatatctgaattaagagtcagtgattatgctaatttctgagaatctgcaacaaactgagccaatccgctgtctgttaacgggtgtttcaataagcttaagatcggaggaagtggagatgtaataacatctgctcctattttcgcacagtcgatgatgtgcattgagtgacggatagaagctgcaaggatttcagtttcgtacatatagttatcgaaaattaatctgatttcctggataaggttcagaccatctgtagaaatatcatccagccttccaaggaacggagatacataagtagctcctgcctttgctgccaaaagagcctgcccgggagagaagatcaatgtacagttggttttgattcctttgtcagaaaaatattttaaagctttgattccgtctttgatcatcggaatttttacaacgatattagggtgaatagcagccaattcgtctccttctttgatcatttcttcgtaggttgtagaaagaacttctgcagaaatatctccgtctacaagctcacagattgttttatagtggtttttgatggcttcagctccctgaattccttcttttgccattaatgaagggttggtggtaacaccatctaaaattccaagatctcttgcttccttaatttgctctaaattagctgtgtcaataaaaaatttcattttgataaatagatttattgatacaaatatagggaattaattgggttctgaggtatgaattttgagttacagggtccggatatgagttatagagtaggagcgtttgagcgtttgagaattttgagtttttaagagtaaagataggaaagaaaattttctattaatcttaaatcaaacagttaactttgcttctagcttctagcttctagcttctagcttctagcttctagcttctagcgtccagcttccagcctgatcgttttaaattatgaattatggaaaacaagagtttcaccgctacattggaaatcataggaattaacccttttgtatttgttccggaagaagtactgaacacgatttttgaaaaatcaggcagaaataaaagtcctatcccggtaaaaggaactgtgaacggaaaggaatttaaacaaaacctgatgaaatatctgggagaatggagattgtacgtgaacctcatcatgttgaaaaactctcccaaaagaatcggagaaattattgaagtcgtactggagtatgatgattctgacagaagtatttccattcatcctcaactggaaaaggcgattaaagaaagcagcctggcaacggaaaactttggaaagctgattccttcaagaaagcatgaactgataaggtatatcaataatttaaaaactgaagccagtattcagagaaatattgagaaaattattcgtcacttacatggagaaaccgatttttttggaaagaagattgaataaattaagtattcatcaatgataacaaaaatgccggaaactttccggcattttttattgtactaagaatttaatgttttgctaagtttcagagcatcctcgttggtcgggtcatactgaattgatttagcaatatgctccttagctttatttggatcagttttctgttctgagaaagcaagatagaaataggcatatgccagatttttcttattttgctctacctcttcaggttttactgttgcaatatacttttcataagcaatttttgcgttggcatcatctttagcagactgataggcataagcctggctgtaataagacggagcccagtccggtaataaaacagagatttttttccaggtgtcaatagcattcgtccagtctgatgcatcctggtaagctgctgccaatttagctaaagattctgtatcttttggattggcctcaacctgcttcttaagtccttcaatagttggatttgctgactggcttgttgtggccgtagtttccggttgagttgtttgtgcatttacaagacttacacttcctgctagtattaaacctaagaataggctattaattttactcattttcataatcttatattttaaagtcaaaatctaaaattcaataataattccacaaaaacttaaattttagaggctttaagtttttttagaaaatattaacgggattgatgttttttttaatttaatttttgattcgttcatctttgaggttatctttgtccttcatttttattaatactatataatttcgtcatatgaatatcatattagcctcaacatccacactttttggtggagaatatctggaatacctgaaagaagaattaatccaattgtataaagatattgacgaaatcgtgtttattccttttgcccgcccgggaggtatttcccatgacgattatactgcaaaagcgcgttctttctttgaaaccatcaatataaaagtaaaaggtctccacgaatttgaaaataaagcagaaggcctgaaccaggcaaaaggttattttacaggaggaggaaatacttttttactggttaaaacattacatgaagaaggattgatgtctgttctgaaagaaaatgtatcagcgggaaaagcttatctgggttgcagtgcgggaagtaatatcggaggtcagaatatgaaaactacgaatgatatgccgatcgtatatccgccaagctttgattgcatggggctggttcctttcaatatcaatccgcactatctggatcctaatccggatctgaagcataacggagaaaccagagaaacccgcatcagagaatttcttacccaaaatgacatcaaagtggtaggtctcagagaaggaaactggatcagacgaaccggagatttaataactgttgagggaagtgaactgacaaggatttttgaaaaaggaaaagagccttacgaaattgaagcaggaagcagactttaatgaacgaaaaagaaataaaccttttcatagaacgtaacctgactaatttttcggtgaacagcaccggatgggacggactgatccggaaattactgtatgaatttgcgatggctggctggaatcctgagcataacgtattgggaaaagaaaagtttggcggattgagatgctatacctattctgaagatgaagcgcttaataacaaacttaaaaaaatcaaagacaaatattcagaattgtctgttaaaacctgtgaaatctgtggcagtgaaggtaaaatgagaaccataggttcatggcagaccacattgtgccttactcatttcctggaacagcagccggttattgaaatcgataacaagcagaatatcaggagagaccgtaagaccattctgaatattaaaaatatcattaaagctgaggttgaatatgaccttcagagattatggctttataccaatcgggaggaagtagtttatttttcatggcaggaacccaattactatctgcttttaaaaacgattccgctttcgctttttcccgaagacagacgaggtgaaatttcagcattatttcaaagcttaaaggattgcgaaatatgtggttataaggctgttcatcaaaggaattgcctgcggtgtcataatgagccatggagtgaatccggattttttattcaggagtacaatgaaaaatcagactatattaaatattgccagatggatattttcatagatgaagatgattatgaaaaatattttcaatatgaccggtcatttgaaaaagatcctgatcaccagattcttttcacttcagatgatctcagggagtacgaaaagcttttattttaactatatttgattagaatttagacatgcgaaaaaggttcatgccttggaacattaataccattgcaatgagcttttgaatgctatttgtttagacctaaattaacaatgtaatgaaaaaaacacttgctgtactcacactttctgtacagatcgttgccgcacagaatatcgcccagaaactagacaaagccacaaaggatcttatggattcttcgggagcaatttcttccggcctgtcattttatgtttcggatgaaaacggcaatcttatttatgaatatcaggggaacaaaggtctttctacagcttctacacagaagatttttactgccggtgccgctctggaaactttaggtaaaaactacacctataccaccacctcaagttattccggaaatatatcagcaggaacgctgaacgggaatttatttatcagttccaatggtgatcctacattgggaagctggcggtatgagggctataaaccagaaaattttaaaaagaaactgatagatgccattaaaaattcagggataactaaaatatcgggtgacctcgtcattgatgattcttattttgaccatcagacgattccgggaggctggccgtgggatgatcttggaaattattatggcgccggtgtttggggaatcaactggaaagaaaaccagtttgatattaatattaacggaaccgattttaaaagcttttcttatcctttagaaggagtgaaatggctgaatgacctgaaaacaggaggaagctcagatcaaagcctgatctttaccgctcctcattctgatgttgcgctgattaacgggatgcttccatcagggaaaacagttacggtttccggttctactcctaatccgccgctacagctggcagcagaaataaagcaatggctgaaggaatcgggtattgagctttcgggaaaagcggtaacaaactcgcagcttgaaattgatggaaaacaggctttggaagctccgaaaaataatattattctcactcaccaatcgccgactctggataaaattgtatactggtttctgagaaaaagtatcaatctgtatggtgaaacattaattaaaactttaggaaaagagaaaaaaggaaattcaagcttcaaaagcggggtttcttatctgaaagaattctggaagtcaaagggaatcaacccaaatatgatcaactttgcagatggaagcggactttctccacaaaattatgtagctgcaaaagcagaagtgcaggctctgttatatgccagaaaacaatcctggtttgaagcatattatgaaggatttccggttcaggataatggaatgaagatgaaaagcggaaccatgagagataccaaatcttttgcaggatatcataccgcaaaggatggaaaaaaatatgtattttcgattattatcaataactatcagggaagcggaaatgcagagctgcagaaaatcctgaatgttttaaaataaatacctttgagaaaatctatcctcaccaggctgaataactggatcattttcgttgtgatgactactttggtaattgccatcatagtagcttcaacatcgcttattaattttctcagaaaagaggagatcaaaaggatcagtctgctttccaaagcgataaggatacagcaggaagtgaagactcctgatacggatgttctggatctgctgccggatatcctgaatatcaacaacacaattccgttcatcgtaacagataaatataaaaatccgattcttgatctcggatactacagaaatattcctgaaagtacaatcaaaaaccctgaaaaactacaggatctgatccggaatatggagaaaaattatgacccgattgagatcaaagtgccggatggaaataaccagtttgtgtattatgacaactcccgtttgctgaataacctcaggtattcaccttatatcttaggtctgtttattctgctgtatttcggtttttctttctggtttttcagaaccattaaaaagacggacgaagggtatctttgggcaggtctggcaaaagaaacagcgcatcagatcggaacacctctatcatccatgatcggctggatagaaattatgaagctggataatccggattctgaaggagtacatgagattgaaaaagatattgaaaggttgagaaccatctcagaacggttttcaaaaataggatccgttcctgaactgaacgacagggatttcagtaaaacaattcaggagaattatgattatttaaaaaccagaatttccagaaaaatcaattttaccctgaatcttcctacttataccgttttggtgccccacaataaaatcctgataagctgggtaattgaaaacctggtaaaaaatgctgtggatgcgatgaaaggagaaggtgctattacaatatctgtttttgaaagaaataagaatattttaattgaagtaaaagataacggaagcggaatgacaaaacaacaggcacgaaatgcttttaatcccggctattccaccaaaaaaagaggctggggactgggattgtcgctggccagaagagttattcatgaataccacaacggagatatcaagatttcccagacggaaataggaaagggaagtacctttagaataacgatcagaaaagaggagtgatgctggtttaatgagttgtaaacagaaaatcacttgtaaacagaaacctaacaggttttcaaaacctgttaggtttgaatgttaaagaataagaataaatatcagccttagaaaataaaaagcggggaaatttttccccgcttttctcttattttttaccagtgagccactgggtctgtaatttcagctcttccggagtaggattcgctttaaatactggggtttccatggtcattttatccagtattgcttttcctttcagcgtcattttctctttctttccggcattatctctcaggatagttacggtaacttcctgtccgtctttaatggttcgggtatacccgataaaatcctgtactttttttatgtctaccgttcttccatccagggcaagcacctggtcagtaattttaaatcctatactttttgcaaatggagacagtgcagaatgttcatcaaaagcaaaagcattggtcttgtcatcaaaacctgtctggttcggatctttgataaaccagaaaataggctggctttcctgttttttaatatctacacctaccatgctcagatattgtgcataaggtgttggctggttccctgcaatatatttgttgtaaaattcttttacctgagggtatccggttacggttaccagttcatcaatcagcttatcatctttgaaaggcttgttttcaccaaatctctgtgacagttttctgatcatatcacggtagcccatttctccgttggaaagctttctgagctcaatgtctaaacacattgctaaaagtgctcctttctcatacacatttctgtactgatctttgtaaggctctaccaatacatttttactcattaccgtaaatggcattgtatcatcatagcttttggagttggcgattttctcaccaattctttgcaggaactggtttttgtcgatcaaaccttcctggatctggaataaattggcaaagtattccgttccgccttcatacatccataagtgctgtgacattttaggatccgcgtagtcaaaatagtggatttcttcagaatgggttttcagagggtttaccgtatggaaaaactcgtgagaaaccacatcagtaatggtgttgtcgattgcatctttaggcatggcctcaggaagcacaacgcttgtggattcatggtgctctagtgctccgaaaccttttaccgacggaccatcacctccggaaagataaagcatgatcgcatactttttattcgtattcatatctcccaggaatttcttctgggcaataaccattttttcaagattgtctttgaaatcagcggctttgtattttcctgtcggggaatatacacccaaaacaagatccatccctccggcattgaaagtgatataatccggctttgtatacataagcggagaatctgtcaccttcgcataattggcaagggtataggtatctgtagattcagatttatcctgatctaccaacgctgtggttccgtagaaatcggttggtttctgaacgatcagctgatacggaacatcctgcatattctcaatatatccaatgaatccgtgggtattgatcatatatacttttcctgcctcaatatcggtccctgacggagaaaatacagctttatgtttggaggtatccgtttcttcatcaaaactatcattgacaagataagagattttggaaagtccctgggcatttttcaatgaataggtattgtcatttactttggtatacgtaagttcttttcctttattatcgtaaaatttaattccttcgatgaatcttccgtagtcgtctacagaataagtacccggaactgtttttgggaaatgaaatttaacatctccggatttcattttcgggaattccatggtaacggctactttatcatcttttacattaacaaggtcaatggttgttttaatagactgggcatttgccaaaaaagcagcaaaaataccgaggctaagtactgtttttctcattaggtttacattaatagttaaatagttgctttttttatcaatttgttacggaaaaagtattaaacttttcttaaaattttaaagaaaaacgaaaaaggcaaatctgctggtatgcggatttgccttttttctttatttggtattagaataattgatataatagttgggattaaactcaaccggactattgtttttaagctttacggtctgccattcttccgttggatttatggtttgatctccattaatgatgataggtaatttcagattttttaccacatctgtataacggaactttaaagtatcgccatcctgagtatattccagagttgggatctttactgttctcagatactgatcaaataccgttgaaaaatcaattcctgattttgaggagatataattttcaatctgttgagtggtaaccgtctgatgataaaaatctttattcaggcctcttaaaatctgtctgaatttttcatcattattgatgacctgccgtatcgtatgaagcatattggcacctttcggatacatatctccgctgccttcatttcttacgccatactggccaataattgggatgtcattgtctatcagtttcctgatcccctgaacatagatgtcagcagattttttgtccatatatttttccgtgaacagggtctcggaataattggtgaaactttcatggatccacatatcagcctggtcttttgcggtaatattattagcgaaccattcgtggccgctttcgtgaattataatgaaatcccagtttaatccaactcctgtacctgaaagatctctgccaagatagccgttctgatatttgtttccataggctacattactctgatgttccatgcccaggtgaggagactctacaagtttgtatgaatcttcataaaacgggtagggaccaaaccagtactcaaatgcggagagcataggctttacctgttgaaactgtttttttgccttatccaggttatagtcaagtacccagtaatccaggtccagttttcccttttctccctcaaatacatctttgaaatttacatattttcctatactcgggataatggagtaggcattgataggattttttacttcccaggtataagtagttttgctgcccgttgtttttttagtaatgagcctgccattacccacacccaccagatcattaggagttataattttcatgatgattccgttatcaggttcatcactccagatatctttggtaggaagccatatggaagctcctattccctcatcagcagctgtcatccatgggtttcctttttcatctttagtaaaaacccatccgccatcccagggtgcctttttagcaatggttggatttcccgaatagataacgttgatcgtgtatttttccccttttttgaattttttattcgttgtaatgaaaataaaatctccatcctgtttataattggcaataggaaaacttgcttccaccttatcagctttcataggctgctgaaggtcaatctgaaaaacaggattggtaacatcttttataatctcaaagctgattgtattatttcctttgatgcttttctgttcaaaatccggttctacagaaagatcatattttttgacatcccaaaaattccggaattccgtattggaaccttttaaagtatcctgtttggtaaaaaccttccctttctcaaagaactgtccgaaaaccaatcctgatgcaaataacagggtgtatgacaattttttcatttaaactttattaataatcttttcaaaagtataaaattaaattaatagccttacgcagaaaatcaaattaaatacagattttaagaagacatgaaaaagcccggccattaatggtcgggctgtaaaaaaacaagttagttttattttttgatgaatttcaggttggtagtagcacctttatcttcaattgaaatgatatacgctcctgtacttaattttgaaacagaaattttattatcattaatctggccgttcattactttctggcctgccatattggtaataataaactgagctttggatgaaatctgagttacatttaatacatcacttaccgggttaggatagatctgaatagagctcttatctttcactgtctcacttgtggaaagctgctgctggataagtaccggataatcttcaacttcaccatactgctggttgctgcatccgctgcttggctggctttcatatcccaataccactctcataataacgtttcctccggtataagcatctgcaggtacagagaatgttccggaaaccggtgttgctatgtttggtgcacttgtataaatgacttcagatgaagagaatactccgtctttgttgaagtctatccatgctgttactccgtcattatattgtgcgcctgtccatgctttggtaatgcttatattgttccctgaagatccggacataagagtgatcagcttcgaagggtcggaagtataatccgagtaaggagtattgctgctgctgtttgaaacagggttcattcccgaaggcgttaccgttacattagaaatatattcgtcagctgcgtttgttcctgttattgaacatctggcaaatgaagacgttgtaaaattggttgatgctgaataagaacccagcgtacctgcgcacacattagccacctgtacttcatattgagttgattcagtaagtcctgaaatagtatatgagttcgttgaaactggaacagtggtccaagtggcagttcccacttttctatattgtatagaataggatgcacctaccagagctgcccagtttacagatgccgaagttctagtaattcctgttacagtaattccggtaggggcagatgttgtacaggcacttgcagatgcggaaacagtagcatttccaatcgcatagaatacattatcaatagcacttactcttatttttacactggcacctgttgccagagaagagaatgaaaacggttcagcaccatcattcggagtagatggggtaattaccgtccatgtgctcccattgtctgtggtataatctattttaacattctgtacattatacggagcgctattcgtgtttaccacatcccatgtaatcgctcccggtgtattattataaacagtagctgatgttactttaaacgggccttcgtttcctatatccactttcatcaggctgctctgtgtctgctgttgtgcagcatcgggattattatctcttaccgttaccttgaaattcattgttcttgggatgttggataccgtttcccaatctgcagcactggtaagcgtgccattaagaacatttgaaaacttagggaaatagcgtgtcggattggtggttggcatcagagatctgaagttggccccattatttctggtagcactcaccggtccgaaagcagaagttgccagatcatattgctcccaggtatatgtcatcggatcattttgggtgtctgttgcagaagcggttaacacaaaagctgttcctttagggatcattttactggccattggctggattgaaggtggagtattggctaccggagtaataataccacaatcctgagaattgacatacgctccaacttcctcaatatttttagtatgaaaataagcatcagaatgcatctgaacattataattggtaatgccggcgtatcccattatagtagatccggatccgggctccatatgggcaccatgcaaagcaatagacattgtatgggcggcaccaaactggtggccgatttcatgagctacaaagtctatgtcataattatctccgaaaggctgatccggtgtggaaggtgaagtgattcccgcaccttttgaagtagcatcgttattgcttgcagggtttctgcagacatttcctacatccccggcacttccaccgccgcctctgtggccaaagaaatgtcctatatcatacgcattattacccacacccggtgtattggtaagagtttgctgaagctgaagattccatgctgcgggagcactatatgtaccatttgtattggttattacattcgaataaggatccgtagcaggatctggaaatatgagctgaggaagatcctgaacaatcatatggattccaaagtctttttcgaacacaccatttacacggttcattgttgcattaatacgtgccgctgccaaaggaacgcttccggcaagctgtgtatattcaccgtttacggagatggcgattctataggttctgtacttttgttcactgcttttattaaaacctccgctattcaaaacactttttgtcttaagcagcttattcatctctttttttgctttctcaggctcagaagttctgcattcgaaagggtcttcatgagatttattggatttgaaaaagactccgtaaacatctttttctttgttgatgggttctatgaattcgtattttcctgtatcggcatcaaataccatggactggaagtcattaggtgcagtactgaaccggattcgtttatgcgggttgtccaggccaataccggaataggctcccaattcatagcggtctgccatagacttttctactacaggcgagctgtatactgaaaatctttcaatttttccattggctgctggaataaaaacaattaccgggtttcctcccgtaccggcttcaggagcatttttcagctgatttctcaatgcagaaaggtcaaacttataggcatattctacctttacttctttccttaccggtgccactttccccgaaaccggttcccagcgttgtgcctgtaaaccgctcagacctaaggccaatgcacagacgagaataattttctttttcatattatttttgattgtaattaacgttttaaatatagtgtattttttttaatattttgttgataattcagtgttaattgtctataaattgataatattagttaaattttgcaattgttttaaattgaattaagaataaatataattaaggttaatatttttatataaaaaagcgctgctattcatacgaatagtagcgcctgtattttttttagtaaaatattaattattcttgtactgccggaagatttccattgcttttctgaacctttttataagtgaacgtacacatcataatactgaattcatacaagattagcagcgggaaggcagccatcagcatactcaaaacgtcagcaggggtaataattgcagcaactaccataatcagaacaatagcgtgacgacggtaagttttcatgaacacaggtgtaaggattccgatgcttgtaaggaaatagatcaggattgggaaaaggaatatcactcccatacccaaaactacctgtaaaaacaaagtggtataatcacttaagtcataaagcggaacgataatatccgaaattttaaaaataaccccaaaattaacagcaaacggaaggattagaaaataaccgcataataccccggtcatgaaaagcatccatactgcattgatgatataaatggaattctttttttctctcgggtgtaaagccggactgataaagcgccacagctcccatacaatataaggaaacgcagccaccatcccgccgaaaaccgatacagccatcattacattgaactgctgatacagcctctgcacgcggacagggaaatcttttggaagatgaatgctatcttcgcccaaaatcattcttgaaaaatgattaacaagcctgaaggtagggaaatcatttctggtaggcccaaaaaagatatggtccataatccagttgatgttaaagcccactacaaatgcagcaactatgatagcaataatcgaacggatcaggtgtcctcttaattctcctatatgtccaagaaaggacatgtctttaccttcgctcacggaataaaatttttaaagggcaaatttataaaaaaaatgacagaagtgaatctgatttctcagttctaattgattccttcatccagcagtttatgcagatcaataatcccgaaatattttccgttttctgtaacaaccagctgaccgatattattttctttcagtattttcattgcttctttagccaaagcatctttttcaatggttctcggatgggcagacatgatgtctttagccagcaccttgctgatgtcttcgcctttcatcagcattcttctcagatctccgtccgtgatcaccccaataatctggtcttcattggtgactacggtaattccatggcttgatgcactgatggaaataatgacatctcttatcggagaatcttcagtaacctggggtttttgtgaagataaaaactgctcaactttagaagtcaggttttttcctaaacttcctcccggatggaattttgcaaaatcattagctttgaaatcgttcagttccattaaagcaacagccaaagcatctcctaatgccatttgtatagtggtagaactggtaggtgcaagtttattgggacatgcttcaatatcaacatgagtatccagaattacctctgaaaattccgccagtttgctggtcttgtttccggtcattccgatcaaagcagaagaataatcttttaaataaggaaccagattggcaatttcaggcgaatttcccgaattggagatacataaaaccacatcctgtttctgaattactccaagatctccatgaatagcttcggaagcatgcaaaaactgagaaggggttcctgtagaatttaaagtagctacaattttattcccgacatgagcagatttccctattcctactacaataagtttcccatttgctgaatgaattatctctaccgcacgggcaaactggtcattaattctgttttttaatttttccagttcggaaatctctatttctaaagtgctttttgcaattgatataatgttggttctatccattttacgatgataaggtatacaaaaaagttcttaaaaaacgttatattttaaaaagaatatttaatataaattttattttttataaattcgttcgcttttattttaagcagaatttttataactttgggtgagatgcaaatttagcaatagaaaattagatgagcgcaaaaaaagccaatttatcaggcgaattgaaaaagtattttgggttttctacatttaagggccagcaggaacagattatagacaacctattaggagggaaggatatatttgttttaatgcctacaggtggcggaaaatcattatgttaccagcttccggcacttatttctgaaggtacagcaatagtagtttcgcccttaatagcgttgatgaaaaatcaggtagatgcagtaaacggcctttcatctgatgatggggtagcccatgtactgaattcatcattaaacaaaacacagaccaaacaggtttttgacgatataaaaagcggcaagaccaaacttctgtatgtagctcctgaatcattaattaaagatgattacctggattttttgaaggaagtgaaaatttctttctttgctatcgatgaggcccactgtatttcagaatgggggcatgatttcagaccggaatacaggaatctgaaacagattatagacaaaattgccaatgtaccggtaattgctttgacggctaccgccactcctaaggttcaggatgatatccagaaaactttgggaatgaccaatgcattggtatttaaagaaagcttcaacagacctaatctatactacgaagtacgtccgaaagttaatgtagataaggaaatcgttaagtttatcaatcagcataaaggaaaatcaggaattgtatactgcctgagccgaagaaaagttgaagagtttgcccagcttctgcaggtaaacggaatcaatgcacttccataccacgcaggtcttgaccaaaaggtaagggtggcaaatcaggataaattcctgatggaagaggtggatgtaattgtggcgaccattgctttcggaatgggaattgataaaccggatgttcgttttgtgatccattatgattttccgaaatcactggaaagttattaccaggaaaccggaagagcaggaagagacggaggcgaaggtcactgtctggcattctatgatccgaaggatatcgaaaaactggaaaaattcctggctcagaagcccgtgtctgagagagaaatcggattacagcttctgaatgaagtagtaggctatgctgaaacttcaatgagcagaagacaatatatcctgtattattttggagaaagttttgacccggtaaagggtgaaggtgccaggatgtgtgacaactcatccaacccgccaaaattaaaagatgcaactgccgatttgaaaaaagcgctggagctgattcatgatacaggagaaaaatttaaggcgaaagaccttatttctgttatcgcagggaaggaaactgcggtaacaaaatcttacaagcttgagcaaagttcttattttggcttcggaaaagaagaaaaagacaattactggaaaacgattttgagacaggccactgttcagaattttttacagaaagatattgaaacatatggtgttttaaagattactgacaaaggaagaaatgttctgaatggtaaatctaaagatgtctttttaattgcagaagacagagaatttgatcttacccaggcaaaagcagaaagtgatcaggtacaacagcaggccggaggaggtctggatcagaatcttttcaacctgttgaaagaattgagaaagaaagtggccaaaaagcacggaatcccgccttatacggtgtttatggatccaagtttggaagatatgacggttcagtatccgatcacagtagatgaaattaccaaaatctacggagtaggggaaggaaaggccaaaaaatacggtaaagaattcgcagattatatcaaaacatacgttgaggacaacaatatagaacgtactcaggacatggtattgaagcaggtggccaataaatcaagtcacaaagtattcattatccagagcacggataaaaagattgatcttgaagatattgcaagagccaaaaacctttctatggatgaactcctgaaagaaatggaaaggatcgtgtatcagggaaccaagctgaatatcgattactatattgaagacaattttgatgaagatattgtagatggtttcatggaattcatgaatgaatctgaaagtgacagcatgaaagtattgctggatgaattcggggatgagctttctgatgaagaagtgagaatgttgagaattaagtttatcagtgacgtcgcgaattaaaaaacattataattaaaatataaaataagctcttcatctgaagagcttattttattataagttcgtttaaacttttaattcatagttaatttctgttaacaatcatcccaaacggtcatcttcatccttccaatatttgaaagataactaaactttttagtaactttgataagatgaaaaaaatatctgtcatatttattctgccggacttagaaaccgggggcgcagaaaggattgtaaccaccattgcaaaccatctttcccgagatcggtttgagcctaagattttgttgttacgtaaacagggcggatatttgaatttcctcaaaaaagatgtcgaaattattgatatcaatactgaaagaataagacattcattaagacctattttgggagagatctacagaagaaaaccggatattgttttctcgggttttggcgaagtaaatgcctacctgtctctatttatcaaactatttccgagaacgaaattcattgcaagggaaactaatgttgtgactcagcacgttacccgtaaagaaattaaatttttctacaacttctataataattatcagaaaatcattgcccagagcgatgacatgctcaaagatcttgttgataattttaatattaaaaagaaaaagattgttaagatcaataatcctgtagactttgatttcattgaagagaaaatggctttgtcttcaaaaccagagtgtttcaaatacaattataagaatgtggttgccattggtaatctatcttccagaaaaggatttgataatcttcttaaggttttttcaagacttaaaaatgaaaacatcatgcttcatattttaggtgacggaaaagataaagaccttctgcttcagacaaaagaacttttgggactgaaaaaagtgatcttccatggaaggcaggataatccttaccaatacttaaaatttgctgatttatttgttctttcgtcaagatatgaaggttttcccaacgttcttctggaggcaggtgcctgcggaacttattccctggccaataattgtcccggaggaattaatgagattatccagcataatatcaacggagaaattgcagatattgaaaaccatgaccgatttgcacaggagattgtgaggattcttcagagcaattataatcgggatgctattaaaaactcgatcaaatcaaggttttcaaagaatattatactggacaaatatgaaaaagtattactggatttaatgaagtagctcctattgtctatttgacttatggtgttttatttctttaaatttggggctaaaataaatcgtaatgaataaaatcccgaaaataggatgtgcctgtgaaaaacctgatttcaattatacagaattcagaagttcggaattaggtatagatcatactaacggaagatatggagaagtaacgattcagcagtgcaagctgtgccagagaatatgggttcattattttgtggaatatgagcattattccaaatcaggaagatggtacaaaggaattgtttcgaaaaaagaccggccaaatatcactcctgaaaatgcagtggagtatctggaaagccttgaatggtatgtgtatggaggttcgttttttgaaagtacaggaactatcgggcaaggaacgctgaacgtataatcttctatgctgatttattaacattaaatatcacatccatgaagccatttataattgctgctgtaatgcttaattctgttgtaatgatagctcagcagaagacaatctccagaaaagagctgttaaaaaccggtattgatcagaaagtaaaatctacggagattcaggaaataacaatggctgcagggcagggcgctcccgaacatctgcacccttgtcccgttttagggataatcagttccggcgaagctgtttttcagatagaaggacaggagaaagtagtacttcataagggagatgctttttatgagcctaaaaatgtgaaaattcttcattttgataatgcgtcagctgaacaaccacttgtctttaccgccatttatctgaaggagggaagtgaggaaaatataaagttcataaaataatacttttcatcaaactaaagcatataattatcatttttaaaattgataaaactcactttggtgcttggtaatttatatgtaaatttgtgagaattaagatagataataataaacaaattcatacaataacatgagtcaattcgatgttaccgtaataggttccggtcccggtggttatgttgcagcgatccgtgcagcacaattaggtttcaaaacagcaattattgaaaaatattcaactttaggcggaacttgtcttaacgttggatgtattccgtcaaaagcgcttcttgacagctctgagcatttcgaaaatgcaaaacataattttgcaggtcacggaattatcatcaacgagccgcaagcggatatcgccagaatgatcgaacgtaaaaacgaagtgatcaagcaaaatacagacggaatcagctatctgatgaacaaaaatcagattactgtttttgaaggagtaggaagcttcgaatctgctactcagattaaagtaactaaaaacgatggttcttccgaaacaatcgaatctaaatataccatcattgcaacaggttctaaaccttctacattgcctttcattactttagacaaagaaagagtgattacttctacggaagctttaaaccttaaagaaattcctaagcatttagtagtaatcggtggtggagttatcggtcttgaactaggttcagtatacctgagattaggagcacaggtaacagttgttgaatttatggataaaatcatccctggaatggatggagctttaagtaaggaattgactaaagttcttaaaaaacaaggaatgaagtttatgctttctactgcggtttctgcggtggaaagaaacggagatactgtaaaaatcacagctaaagataaaaaaggagaagaagtagttgtagaaggagattactgtttggtttctgtaggtagaaaaccttacacagacggtcttggacttgaaaaagcaggtgttgagcttgatgagagaggaagagttaaagtaaatgatcacttacagactaacgtagctaatatctatgcgataggtgacgttatcaaaggtgcgatgttggctcacaaagctgaagaagagggagttttcgttgctgaaacattggcaggacaaaaacctcacatcaattataacctgatccctggtgttgtttacacatggccggaagttgcaggagttggtaaaactgaagagcagctgaaagaagaaggtgtagcttataaagtaggatctttcccgatgagagctttaggcagaagccgtgcaagtggtgatatcgacggtctggttaagattattgcagacgaaaaaactgatgaggttttaggaatgcacattgtaggagcaagagcggctgaccttattgctgaaggagtaattgcaatggaattccgtgcaagtgctgaagacatcgcaagaagttctcacgctcacccaacctatgcagaagctattaaagaagctgcattggatgctactgcaaaaagaccaatccatatgtaataattgattaaagatttaatcatttaaatataaaaaggagaaatcaattcggtttctccttttttttgtataaaaatcgaattagtttttaaaatttcatctattaattataataacggtttttacattattttcatcttatcataaaacttagaatacttaggtgcaatattgagctgtattccaaaagtcactcctttaaaatatttttctttatgaattggaaaggcatagccggtatttaaaaagatggtattgaataatgaaataccaattcttggctccaatgaatactgatttcctgatatcccaaaaagtaatccgttatcgataaaattaatattagcttccggaatgaatttatcggtctggttaatgcgggtatagagaagagaaggaccaactactattgatttgtaacggctttctccaaatctgtattctaaccctgcctgcaggacgtttcttccggtgtaacggtatgaaatattcaatgcagttttctctaaaatctgggcttttacaaaaaacattgaaaaaaacagaaacagtataccatattttttcatgattatttttgttcaaatgtaagcgtttttatggtatttatgaaagatgtaaatgaggcttcaagaattataatcgtattgactaggttcgcatcttcaaatttccgtaactttgtcagctaattttatcatcaatgcaactcggaaaaactcagactttaacaatttcagaaaaaattaattcaggatggatcctcgtagacgaatccggtgagaaagcttttcttcctaaaattttcattcaggatgaaaaagatacaggtgatgaagttgaagtatttgtgtatcaggatgacgataaattaaaggcaactactgaaattccattggctgaagtaggagaatttgcggtaatgagctgtgtacaaagtcttccaagcggagcttttatggattggggaatcattaaagacttatttattccttacaagcagcagaaaacaaagatcgtagaaggaaaaagatatctggtatatatctatgtagatgaagatatggagctgattaccggaactacaaaattcaaaagaaatcctcagtatgatgaacttccgttcaaaaagggggataaggtagatctgatcatgatgaacgaaagtgaactgggctggaatgtgatcatcaataagcaatacattggccttatctatgcttcagatgtttttaaaaagctgtatccgctgtcagaagaaaaaggatatatcaaaacaatacgtgaggacggaaaaattgatgtttctttacagccggaaggttttgaaaatattgacgagttcaagcagaaaattctgaacaagctggaagaaaattacggacttctgtatgtttccgacaaatcttctcctgaagagatcaaagatgagcttcagatgagtaagaaaaactttaagaaggcgatcggaggactttacaaagataagattattgatattttagacgataaaatcaaattattataaaactaaaaacgggcagaaatttctgcccgttttttttattacctgctgtaaaaaaactaaattattttattgtacaccttggatttagattaataacatgacggatgtcatgacttttttgtttaatttttttgtttaacagttttgtcaaaaataaattttactataaatttgcacaaatttgtttaacaaaaatgtcaaatcaagcaaaaaaagaccaaacacaggaattgatcaaggagacagcgaaaaatttgttctttgtgaaaggaaaatttgatgctactacgcaggagatcgcagatgaagcaggagtgaacaggacccttattaattactatttccgttccagggataagcttattcagatcatctttgatgaagcacaaagagtggaacaggaaaagtcgaagatcattcagaattctgatctgccctttaaagaaaagatcagcaaattcattgaaagcagcctttctacaagccttcagtatccgtatcttgaaacgtatatcgtatcccagattaataaaggaacctgccatcacagggaaattgaggaagatatcctgaacgaaatgtatcgtgatattgaaaaggaaatggagttgggaaatattgaaaaaatggcaccggtgcagtttattctgaatatggtttcgctgctggtatttccaagtgccatacgaccgttatttatggagaatcttttaattaatgatgaagaatatgataggattatttctgaacgaaaagaaataattatcaatatgttatttaaaaattaataaaaactaaagtatttctgatgatgattcgtcaaatagaaataaataatgaacgaattaaataaaaaaataaacgaagtataaaattatgaatagaaaacgtataactgctacaaagctaaaaattgggatagcttcagcatttatgattttcggtttttcattggtgtctgcccagcagcaggtttccctgcaggaagcaatcaaacaggccctccagaataaggcagaagcaaagaaagctgctttacaggttaaaaaagccgaatacaagattgatgaggccagagccggggctctccctcagatcagtgcaacaataaacaatacgtacaatcctattttgcaaaaatctgttcttcccggtgaggttttaggtaaacctggtgagctgattcctgttgcctttggaacgaaatggcaatctgtaaacgtagtaactcttaatcagaacgtttttgatcagagagtttttattggtcttaaagcagcaaaatctacaagagagttctatcttttaaattcggatttaaccaacgagcagattattgagaatgttgccacagcatattatcaggtgttcgtacaggaagagaatcttaaaacggtggaagagagttatgccaatacggaaagggtaagaaacgttatcaaaagtttggtagataatggtcttgctaagccaattgacctggatcgtaccaatgttcagcttaccaatatcggttcaaacaagcagcaattaattaatgctgttgaagtgtcaaaaaactcattgaagttctatatgggaattcctattgatacacctattgaacttgaagacaaaacaattgtaccgaatccgcagctattggacagcaatgtaaacctggagacgcgttctgaattaaaagttttaaataaacaaagagagcttctggaatatagcaaaaaggcaactattgcaaatctttatcctacggtaggactttcagctaactatggctggcagggactggggaataaatttccttatgctacgggatcaagccagggaacgaactggggagactatgcttccattggtttagcgattaaaattccgatttttatgggaggggctaccaaagctcagattcaacaggcggaaatcgatattcaggatctggatcaggatatacagaaccaaaaactgaacttgagtttagattataaaaatgcagtttccaatatggagaatgcaataatcaatattcaaagcatgaaagataatgtggacctggcagaaaaagtacagaaaaatactcagtccaactatcagtatggtttagcaacacttacagaagtattggatactgaaaatgctctgacgcaggctaaacagaattatgcaaatgcattactggactataagcaggctgaaatcaaagtcattaaagcaaaaggagagttaaacacattacaaaacccataataaacaatgaaaaaaactttaatatatatcatcgtagcagctgtactggtaggtttggccgcttataagattgcaggtaacaaagaaaagcagactcaggaagtaaaagaagttgccaagcaggtagataaaatcaacgttaatattgtaaccgttacaagagaaaatattgatacagactattcagccaacggaactttcattcctaagcaggaaatgaaccagtcttcggagatctcaggacgtatcgtaaacgttttggtaaaagaaggttcaagagtaggtgcaggccaggttctggcaaccatcaaaagagatgctatcgaagtggatgttacccaggctcagaataacttgcagaatgctattattgataaccagcgctatgaaaacgcatacaaaacaggcggagttacaaaacaacagcttgataactcgagattacagcttaaaaatgctcaggctgcagtaaaagctcagggcgtaaaagtaaacgatacaagcatccgtgcaggaatcagcggtacgatcaacaagaaaatggttgagccaggaaccgttgtttcaccggggacagcaatgtttgaaattgttaatatcaacagcttaaaactttctgttttagtagatgaaagccagatcggaaaaattcagttaggtcaggaagttcctattaaagtaaacgttttacctgaagattccttcgtaggaagaattacatttatcgctcctaagagtgatgcttctctgaatttccctgttgaaatcgaagttcagaataaaggaaaccttaaagccggtatgtatgcaactgctaaattcagtaccaacaacggcgcggaaacccagaatatgcttaccgttcctgcagaagcatttgtaaacggagtaagctcaggacaattattcattgttcagaatggcgttgcaaaattgatcaaagtaaccatcggaaaagtttacggagataaagttcagattttaagcggattgaatggaggagagcaggtagtaaccagcggacagatcaatctggacaacggatctaaagtaaacattataaagtagaacgtttatgaagttagcagaaatatcgattaaaagaccctcgctggtaattgtattatttacaattctgacgttgggaggtatcctgagttatacgctcatgggatacgaattgattccgaagtttgaaaccaatatggtaaccatttccacggtgtatccgggagcttcgcctgcagaggtggaaacatccgtgacccggaagattgaagatgccgtaggttccctggaaaacgttaaaaaagtagaatcttcttcatacgaaagtttatccgtaatcatggttcagctgaacgatggtgccgatgtagactacgccttgaatgatgcccagagaaaggtaaatgcgatccttgcagaccttccggaagatgtaaaagcaccgtctctgaataaattctccttagatgacttaccgattattacgatgagtatttcatctgataaactgaacagtaaggatctttatgacttactggataaaaagattgagcctattttctcccgtgtaaacggtgtagctcaggttgaccttgtgggtggacaggagagagaaatccaggtaaaccttgatgagaaaaaattacaggggtacggactttcaatcggagacgtacaacaggctatcctttcatccaaccttgatttccctacaggaagtctgaaaacaagaactacaaaatctacgatcagactttcaggaaaatataaatctattgaagagatgaacaaccttgtggtttccaataaaaacggagctcaggtacgtttatccgatattgcaacagttttcgactctcagaaggatgtagagaaagtagcgagattcaatcagtttcctaccattttgatgcaggttaaaaaacaatctgatgccaatgccgtagcggtatctgaaagtgttcagaaaacaattaaaacagtagaagaagcttataaagttcagggtgtaaaagtaaaaatcgtaaatgatactacagaatttacccttgaatcagccaaccacgttatttttgacttattcttagcgattatcctcgtggcaattgtaatgctattattccttcacagtatcagaaacgcgtttatcgtaatggtttcgatcccggcttcactggtagcagcgttcatcgggatgaacttaatgggatataccctgaacctgatgagcttactggggctgtcgctcgtggtaggtatcctggtggatgatgcgatcgtagtactggaaaacatttaccgtcacatggagatgggtaaaagtaagatcagagcggcgtatgacggagcatcagagatcggatttaccgttgctgcgattacattggtaattgtagtggtattcttaccgattgcaatgagttcaggtcttgtggccaacatccttgcccagttctgcgtcacggtagtaattgcaaccttattatcattgctggcttcatttaccatcattccttggttatcatcaaggttcggtaaactggaacatttaacagggaaaaactggtttgagaaattcatcctttggtttgaaggattaatcgacaagtttacacactggattacaggaattcttgaatggtgtctgaaaacgacattaagaagaatctcaacagtagtgatcacgttccttgtcttaatcagttcatttatgctggtagcattcggattcatcggaggtgaattcttcccgccgattgaccgtggtcagttccttgtacagatggaattatccaaagatgcaactgttgaaaaaaccaaccagttaacattagaagttgagaaattcttaagaaatgataaagatgttgtagaccttattacaacagtaggacaacagtctacaggttttggtggtgctcaggcaactacttaccagtctgaggttcaggtgaacttaacagataagtccgaacgttctgaaagtaccaatatcaaagctgcaaaaataaaaagacagctggaagagaaatttactggtgttgaatttaaaacggctccgatcggtatcatgggtgcagaaaatgctccgattgaaatggtagtaacaggaccggataacgctactgcagtaaaagaagcaaccagaatccttgaactattgaaaaaagtaccgggagctgtggatgccgaattatcaacagatacaggtagccctgaagttcaggtaagtatcgacagagataaaatggcttctttgggcttgaatctttcaagtgtaggacagacgatgcagactgcattcaacggaaatacagacggcaaattcagagcaggggagtatgaatatgatatcaatatccgtttcggagatgtcaacagacagtccattgatgatgttaaaaaccttatgtttaccaatcctcagggacagcaggttcgtctgagccagtttgccgatgtgaaaatgggttcaggaccaagcttacttgagcgtagagataaatctccttctgtaaaagtaagagcaaaagcggtaggtagaccggtaggggatgtagctaatgaatgggcagataagttcatgaagagcgataaaaaacctgtaggagtagattatatctggagtggagatatggaaaaccagcaggaaggtttcggtacgttaggaattgctttattggcagctatcgtattggtatacctggtaatggtttcactgtatgacagtttcgtgtatcctttcgtggtattgttctcaattccgttagcgatgatcggagtaatggtaattctagccttaactgccaactcactgaacatctttaccatgttagggatgatcatgttgattggacttgtagcgaagaatgcgatccttatcgttgactttacgaatgcgagaaaagcagcaggagccaatactcacgatgctttggtacaggctaaccacgcacgtcttcgtccgatcctgatgaccactattgcgatgatcttcggtatgttaccgatcgcattggcaacaggggccggagctgaaatgaacaaaggtcttgcatgggtagtaatcggtggtttgacatcgtcactattccttacattgatcattgtaccggtagtatattcattatttgactctcttttaagaagaatgggacaacataagaaagtagactacgaagctgaaatgaaagcagattatgtacacagagaactgaatgaagacggatttactccgaagcatttagataaataaattaaaccttttaattaattgaaagcgcctcagaacttctgaggcgcttttttgtttataattgagagaaagtgaatctgcgtataaactcattatgaattctaaatacattagatggcatatttaaaatatattctttatcagataaaattttaagtaattcagcttttaaaatgtctaattcattatgctctaagataatttgaaaataatgttttattttttcaaaactattgtgctccttatttatgaaagcttcgaaagaagatgctaattttttatacttgccgagaggtagcgcaattagaaataatactgccgtgatttcttgattttgagaaagatttgaagattgaaactcttcatgagctttaataattctataagtatttacaaaccttttaatgcatcttggattacttcctacaatttctgacatattctgcattaactcaacttcagtatctgttaatactaagttttctggttcaaactcactattttctaagacttctgaattattgttttcagtttgtccttttgtttcataatcacgataaattatttggtcggatatatttttattactgtcgtctttgattgaaacactgatgttttcaggtgctagaatttgatttagttctgttggctttttagttgtattttcttgtgcaagatttagaatcatatctttgacattagtgtcttctgcttcttttaaatgaaaaggaatttgaaatattttttctaaataatttgatacatcaatagcatctctagaatgatttccatcaaaatggatcgcatgttttttatataatgaattcttgatccatcgcgcatctacacctacaacaacaacaaaaagaggaaatgccattaaaagattaactgcttctagaacttgtactacgttttcctctgggcatctgtctaaatcatcaatgtaaagtataattctttccaaaggttttttaaacttacctttaaattcttcattggatttatttgtctcaaattctttatagtgtccaataaacaagtcatttaatatttcaaaatcttttctaataatagaaattaaaccaagatgtttttgatagtcagtgcttttggagcgtttgtcaataaatgaataaagagtttctgttgtgagagaatggtttattctgaattctaaatcaatttttactatttcagctttttgtatttgttcgcttattaaaagaatctcagctttgtttttttcaattttaagttttaatactttttctttttgttcaaatcccatttttgcttcattaatcttagcttcataggtttcttttattttccaaaaagaagagacgattggttgaagtttattatatactatttcgcctcttttccatattgcaccaatggtgattagtaatgtaagtgtggtttgtgatataagaaaattggttatattaattttgtcaataaatattttgagtatgagaggaactatagcgattaatataagaattacaaacaggtaaattatattaggataaattttatcctttcggaaaaattcttttaaaaaagtatattttgattttgcaatttcatatgtttttttcgggtctttccaataactttctggaattatttcttttaattcactaatactttcattaaaagaattattattggctaaagacttatgcaattcttcttcaatattgaattctctatttattttgttaataacgtcccaaatagagttcaattggattcgttttatattagattttatttctttctctagatttcttctttgcgattttaatttgaaaatttgatcagataacagattcttttcgattttaagtttactaatttcaccttttgcaattgataattgggaagctaatttttcttctattagccttttttctaaactactatgagtattgttggaaatataagtatttaattcctcaaaaattcgtgtaacaatacttgcccataagtttgaatcaatatatgaccatgcattaaaatgaatttgtacaactccttcacaataaaaattattccttcttgatagattattaattttttgttttagcttttgcataaaaaagctttttccggatccccatttcccaaaaagagcaattgccaaaggtggtttgaagctttttgctgaaataactttagcaaatgcatttatatctttttcaatttttaaatagtccgtaccattgtcagagtcactaattaatccagcgattttctccttaactcgagtttctgtatttgataataaaaaatcatttaaatatgaaggatttagttgggctaaaatcagtttaatttcttctttcgaaatattttgaatagttcttctaagatatcctaaatgctctatatcaatagaaatatctttaattctccaatcaacaaatactttagttccgtcttgtggattctcagtaacagttcctatcccttttattttaagatagctaattccattataaggaaaagttgattttaaaagtataatgtcactttttttaatatttaaaacgatatctgaatagctgtcatcttggtgacctttttcccagatattttcatcataaaatctcttgatctgatcattaccatcccaaatagttcctgctacaaaaaaattgatattatttttttcaataaaatttaagtgtttaaaaagaggggcatttaaattaaattgtatgttatcaaaaagttcaatgccatcatcagtttcaggtattgataacaaaaatgtagtttcaattgaagttcctctgtgaaaagaattaattgcattaactgttgttacatatacttcttcaagagatattttattgttttcgtttctagtaatagggaagaacacttttttttctataaaccagtatctaaactcttgtaatgtttcggtgagaattttctcaatactttttaatgttacatcattagtttttccaggagatatgaatattattggtgttttattttcaccttctagggttgcatatccaaatttctgtaaactttctttttgaatattgctgagatcacttcctttatacccatatttatcaagagtgtttaaagtaaaaatggataagggaccgagatgatcaatagggagtattgcaatgtctccttcatttgggtttatattaatccgagtcagataattaaattctatagatggtaagattgatggcattatagtttttagctaaaataaagttattttaacaggctacattacggaaagccataattatttacaatacaaaaaaagcttccagtaaaactgaaagctcttctatattgtagtagaaaaaattaatctgccataacctctccggactttctgtaaacgaagtttccgtagatatgtcttcttgcaaaacggcttggggaatcagcattgatcattttgatataagtattctttggaacacctatatattcgtagatattgccgttaagatgttgtaccgttaaaatcgatttttcaagatagaaatcctggatattggactttgtaatcgtttctgtatattcttctttatatttttcctgagtttccggattgatactcaccaaaaaatggtaggcttcaataacagacttgctcttttcttccgcttcctgctttcctgcttcatcattaatgaatttatcaggatgggtgtctttcatcacatttctgtaaatggtctttaattcttttaaagtaacatttttatctacgccaagaagtgttctgtgctcaccaatttttttcatatctctaatccttattttcggggtgcaaaattacggatttaaatctgataaaccataacttatttattattatttatttgattttcaacttgaaacaattttaaaacaaaaaacagcaccaatgaaagtgctgtcatatattgtataatgtaaatcttaacttttaattcttatggttcatcacaggttcttttcagttttgtaaagattttgtcaaaatctttataggaagtctcttcattatcacgtttttgtctgaaactgctgttggcacagttatgaaaacctaaaccaatcatatcaatcaaagcgtagtcttctctctgaggatcattcattttagcgtcaaatcttgccattacgcctttagggtcagcattatttttacttttaagctccgtatacattctccatgcagcatacatcttttctctgtccggagaagcaatggcgtcaatctgctctctgcaggtatcgtaatatttactgtttttaagagttgaaggatcagaataagcaatgatttcttccttattcaactggtattcattttcaaaagactggattgtttcttcctgaagttttttccatcgtggaagatcaatcacttttatactgtacagctcctttttcttttcctgatattgtttttcaagctcttctaaataagcttctctgttctgacggatttcttcaagctgggaaagcttaaatacgggacgggtatcaaaaacaacgccgttgaactggtacaaaagcttgttcactccgtctatttcttcctttttatatttagccggatcaaagtagcctttattgtcacaattgaaagtctgatagctgtatggtgtcagattatttgtttttgcaggagatttttgcccccatatagtaatggataaggccattgtaagcccgatcatcatttttttcatgtacatacgttgttgaaagaatccgaattttctgaatttcattgcaaaattaaggctttaaattcaaaatctaaagaattaaatagattttctcaattgattttgcattttttatacagattttgtagcatggctttcattcacgtttttcagacagtatatcatttactcctcaatcccgtcatagcagcgggtacagagaatttaatgtgctataaagcaggggttcttgttgacaattgctttttaggatttaaaataatagatttacatgaattaataagcatccatgatatattatgtttttcttctctgtattctcgctgtttttgcaggcatttcttctctgattatgcgttttttcggtaaatggactaagaagagtaaatacgaaactttatttaatacttttatattcattgcttcattctttctgatttcattttttagcatttatatttttctgtcaaatcttaatttttcccgataacagaagagtttcttttaagaattatataagcaataaaaagattgatcagaagagctgcccagacattcaagccataaaagagctcgtaatcatgacgggtttcattgtatagaagatttttaatgattctgaaggtaattgcagtggtggtcactgcgtagcttaaagtcatatacatcttatgcctgctgacatttcctttttttactgaaatcaaagcagcaatggtaaaatacatccaaagcacatcttgtatcagaaatccactaatcccgataaaacctccgtttgaaaacaatcccaaaacgaaacaggcaggaacattaatgatcagaatattataaacatatatgctgccaatgatcctatgaaggcttctgctttccgttaaaatccggccggaaaactgtgtaagaccagccagaaggcaaaatgttatggaaaagatatggacgtagaaaaaagccatccaatatggattgttgacaacctgttgtttaaaagcgagaaacccggtatttttatcaaaagaagtgtattgggaaatcactttcagcatcaggatactgaaaaggaagattaaaaacaaagctgcggctttaaggatttttattcccaaagatttcatagataaacttttccgggtaacgacaggtctaactttccaaaatttaaaacatcgtttatcaatcatcatttttacataattcctttcagccgtaagtgctgaagaagcataatcgttttagcatctttgatctctccgctatcaatcatttccaggcttttttcaaaagaaagttcaagcacctgtatattttcaccttcttcttccaatcctccgccatcatttattttcatttcattcgaatattctgcaatgaaaaaataaagaatttcagttacggatccgggagacatataggcttcaaataccttttctactttcgaaatcttatatccggtttcttcttccgtttcccgttttatacaatcttcaggattatcattatccagaagtcctgcacaggcctcaataagcattcctgttggatttccgttgatataagtaggcaggcggaattgtttcgtaaggattaccgtgtttgaaagtttgttgtaaagaaggataaccgctccgtttccacggtcataagcttctctgctttgagtttctgtagttccgtcctttttgcggacagaaaaagttactttatttaatgtgtaccagttgtctgataaaatttcggttttaaggatggtaatatcaggattttgcatatgggatatcttctatgttataataaatggttagtcctctttctttagctattcttacgtcctcatcagcgcctttggatgctccttctatacggagtactgcatcacatttttcgagcagggcatgagccacgggatactgtatctcctgccatgcttcatcacctatttgggtagatcccgcaaggtgtatcaatggtaacgcaacccactctcctatgataggaatatgcccttttctgtagatagggagtgcaacagattcaagacggttaagattctgctgaatcagttgcggatcatcattcgttccgctgcggtaaggtcctgcaataagtataaacataatcttttttgggtaaaataacagaactttcaggataaaaaaaataatatagcttaagagaaactgtttttttgtttgttggattttataaggcttaaaaattcaggagtaatgcctaaataagaagcaatttgcttttgcctgatgcgttttaccgcttcaggatatttgtgaagaaagttaaaataacgctcttctgctggtaaagacaggttttcaatcgttcggagttgctccctgatataagcattttgcatcatgatccggaaaaaacgttcaaattttgggaccttgagataaagttcatccagatgatctttctgaagctgtaaaatactgctttcttccaatgcttcaatattcagcatggcaggtttctgattgataaagcaatacatatcggtaatccaccagtccaccacagcaaacatgatggtagactcctttcccgaagcatccatatgaaaagctctcagaattcctgactgaacaaaattgatctctttacaaacttgttggtgctccagaattaattctttcttagccagctttctttcttttaaaagagacagaaaataagatttttcgtaatgggtaagcgaaatatgcctggaaatgttttttataattaaaagttcttccattatcctcctattgcttttttaacagatcgcgtaaagccttttccagatcaggaaacttaaaatgaaacccggcattcagaattttctctgaagaagctcgggagccttccagtatgactgaagccagttcgccaaatatcagttttaaaacaaatcctggaacattaggcatccataatggcttaccaagtactttcgcaatcttttttgtaagttctttattggtggcgtgctgtggagaaacggcattgtaagcgccctcaatcgcagaatttttcaaagcaaattcgtaaatagagcaaatgtcctcaatatgaatccagggcatgtattgttttccatttcctaaaggagaaccaatataatattgaatcggaggaaccattttcttcagagctccgtccttttcagaaagcactacagctgtccgtattttgacaactctttctgccagttcctgttctttaaaatcatctgcagctctttcccataaaacaactacttcacttaaaaaatcattgccgggcggatcggtttccacatcaattttttctgaagtctttgtaccgtagaaattaattcctgaagctgaaataaaagattttaatttaatcttgttttttcttaaagtggcccgaagtagttccgcagaatcgacacggctggagatcagttctctttttctttcaggcgtccagcgcttttctgaaatattggctcctgcaagatgaatgatgtgggaaacgttgtcaaaggcagtttcatccaccgttccttttttaaggtcccattcatattcattttcttgcttcctgtgcctggtcagaaacctgatttcatagtcttgacctattttttttgccagttctttggcaatcataccaccggctccggtaatcagaacaacttctttcataataatattgttaaggtgtagtttttatgcctgattttttacaatcagtacaaagtcatcttccagcagtttataaccgtaatcataaataaacttgtattcagaaccgtttttatagactttcagattggtaaaataatcaaaatcaaaacccaagccatccagccgggatttgggtacttttgttttaccgtctgtgttaatctccataaggatgcggtaatttttgcggagtttgttattcacattccgcatcagattattagaatccttattctgcttattgttataggcgttccggcaggcatcattacagaactttttatcagaccttccgatgattttttcgccgcattccagacaattcatgatctttattttaggtgatgtgtgtgtcttttttttagcagtttcttaaacctgctgtgggtagggtagcttctgttgggcgtaatgttattaaagaacaaagccacaagcagaagaataatgcatcctgaaagaacaggggagactacataccaataccctaattcagggattttgcccgtagagcttacagcaatgagagcggtagcacctccaggtggatgcaatgtctttgtatactgcatcagcacgatagagaaagccactgccagaggtgccgaaagccagatgatatgaggaacaaactgataaacagtaactcctacgagtgccgataaaacatggccgccaataaggtttctgggctgtgccaacggactttgtatggctccgtaaataagaacacttgaagctccgaaagaaccgatgaggaaaatattttcagtttcggccagtgaatgagactggataaatgcaataattccgatcccaaaaaacgcacctaaaaatgaccagaaatgctctttataatcaacaagcgtttccttatagattacgtactttgaaactctgaatgttctttttatactcttcttcatttagtcttctttataatttgaattaaataattgtctattggaaaattattggtaacaaagcaaaaaaggattttcaatttaaacctcgcattttgttagtgtaatttctctatataaaggattttgcatttatatattttccttcaactaatctttgtctcttattgaaattattgttgtaatcttcttcattgattgtaattagatttgttgagttatccattatatccatatatctaatttctatatcttcaagttccacagactttaatatatttcgtacaatgttttcaaattctttatcaattctgtatccaaagtatattttcacaattttcgcacgaccatcaaaatcctcatatcctggatgtccccattttctccattctttttcataactccaatgaggtgatttaacagttaagctattataaaaatctcttttcatctctactaaatctttatatggagaattgtcatcgcacattagtgatttaatgtttaatgaatctactttatctgaatacttaacttttattaaatcattttcaactaataaatcctcagaaaattcaaatgcgagacaaaaacctgtatgtgatgaagcataatgtgaccacattaaaatattattgtaatcttctgaaaatgatgaaaaacaaagtccagtcagaatatttctgcgtaggaagttaagacattcaattaattgctcgttattataatttaaccaatctgattttgtgttaatttcattttctttaatatattttctgtattgatttaaatcttcttgagagtattcttgactaattaatgtcaatgattctaaaggatcattcattttaagggctgaattcatccaaacagatttacaagagagagcttttagagaattaatgttctcggggaaatatttatataaaatcataagttaatttttggtgagaattatgtttaatgaaaaagtattgagcaagtacgagaaaagctgattattcaatttaggtagacattacaaatattttttcataaatttaaactaataaaaatgtatggaattgaaaaatagtggtgacaatatagaacgatgatctttcacaaagatacgcaattatccatttgtaaatgactagctgtgagatattcacctattttattgaaacaaactcatctttagaatgaaataactcttaacttctgaaatacagtaaattatttaaaaaacggaactgatttgagaatattctgatggctatggtagttcattttatgaaaaaaggcctaatttatttattaaaatattcttctgaatattcaagcctgtattttgtttaattttctatattttgaaaaattcaatgtttatcaatgttttaaaatatttttttattcataatatattattgtttgtaactatcttgttttcatgcaaataaattgaatttttatttcacgatattgtggttttttgtaattttgagataacattcaaaaagcaaaccatgaaaaaatccaatttattgatgagtattgtatgctcttccttcgtgtctgcacaggttgggattaatacaacctctccacaaggagttttagatgtaacctcatccaattcggcagttgtgttaaccagaaatgccaaccctccggcaaatgtaaccacacccacagcgggaatggtcatctacgattctacaattaagaccttaaggtactacaacgggatccagtggagtacggtaatttcttcgcagaccttaacaacagctaatgaaggcgttgtaaaactgaatagcggggcaggtgtgaagccttcattcgcattcagatcttccggcggagttccattaatgacttatgaaaacattgtttatcagaccccgatgaatattgtgacagactttgctgctcctcctacaactacctggccggaaaatattctcaatccggtacccggggacatatataatcctaccacgggacggtttctggaaaaccctattgcagggcaggttcatatgtggagggttattgtaagctatgccaataagaataatggttctgttgcatttgtgacagtaaacctatcaaatcctattcctccttccacattctccatagatcagacagctgttgcacccaatggggtaacatccggaaatctggtcttttatctggtgagtgttgcagatcctttatctattggcagcggatatcttattaaaataaaatctgatacatcattagatgccactattgatagtataacaagaatttctcaagccaaagattaatctcattatttaaagcttattaaacgactgatcattgaatgagaaacgtataaaattccaattctaagttagatgattaagtgaaaggtactcattagttgcttgagtgccttttttattctgatattctgatatcgtaaatggtagtcaggcctgaagttacaggagattggttgttgtcctgcagataatttcctgccttgaaataaacggattcttttttccagctgtcaccaaaatgaaaagaaacagtctgctggtttaccgttactaagacatcagcattgttttgttgaatactgtaatcaaatgtttgatctaaagaaacatttttcagaagcgtaattctttcttctttgtcattaacttcttttttgaagccagcctgaatttcaccattattccaccagatttttaaagcttcggtgcctttggaatgcccatgaatctgaccaataataatttttccggttccaggttgctgcaaaacagccatttttacacgtaaactatgttgattttcaaaattccattcttttatctggcgtaattctgttcttggaaaatgtgaaccttgggtcgttttgccattagaagaacaaaagaaacgtatgctgctatcctgaggagaaaaataaaagttatcggaggagaattgttcaatatcagatcctttaataattgtaatggaattatttttaggaataggcagttgcagatcaaatctactcagatcaaattgatgaggaactttcgtataagtatttttttgtgctgaagagagcacgggaaacaataaaaatacggtgtatgcagcgagaattttaaaatgatttctcatacaaaggaaattatgccggaataacctaaacgaatttagaacttttgttgaataatattcccgataaataattaagaaaatattaaaaattactttaccagatgtctgaaaaaagaaagtcagaataagtaataacccattctgacttcaatatatttttagcaataattttattttttcagtctttcaatttcctctttcaaaagcccaatatattcctgcatcgttttaataatttctatgcttaattcattgctgatgttagtagtattattattaccaatatttgctagagagctatcattaaatataggattctcgacaacaaattttacttcctcttcttcgtaaatttcttcaaccggaacctctagaaatttagcaagtttgttccattctgtctgtgtaatagatacagtaccactttcttttctgctgtaattggagacatcagtggggattacctcagccatttgctgctgggtaaagcctttcatctttcttactgtacggagtttttctttttgcatatcagacatttttacaaatttgcaaaaaaaaattaaattaaatagaaaaaaatcctcgttcatacttctgtttttctgtgtttttgaatggagaacaatatttttggatatgtttttgtttcattaaatttttaattaaaaagcagaaattattgccttttaatcagatgaatcctgctttatactgaattctttttgtttttgtatccgtttacaaacgactacaaacggatttaaatagtttataaccgactgtgatatcagaacatcgcaatctttgcaacagagatttgagaaaaacagtgaacgtctcttatctgaatttattaatctttaaaatctaaaagttatgtcactaagaaacaaagtaacattaattggttacacaggaaaagaagttgaaatggtaaacttcgacaacggaaatgtaaaagcaagtgtatccttagctaccagtgatcattacacgaatgccaaaggagaaaaagtagaagaaacgcaatggcacaaccttattgcctttggaaaaacagcagaaatttttgaaaaatatgttcccaaaggaaaagaaattgccgtagaaggaaagcttacctacaggtcatatgatgacaaggatggggtgaagcggtatatcacagaaattcgtgtagatgagatcctattattaggaggtaaataattctaaaaacacaaatgatgaaagtaaaagtttttaaaatcaggattcctgaagaatttctctacaaagatcagaaaatgctggatgattttctggaagccaacgaaattatgaaagtagaaacagcttttgtaagtgaagagcgctactggtctgtaatattgtactttgaagacttaaagcctgcaaaaaatacagtaaaagaaccgaagaccgtaaagtactctgccgaaagcgaaactttgaatatggatgaagaaaagatactggatgctttgaagctctggagatcagaaaaagcaaaagaacagaatcttcccacttatttcattgcaagcaataaagagctggtctctgtagcgaagtataaacctgctaaaaaagaagaattactggagatcaaagggttcggaaaacataaaattgaaaattatggtgaagaaattctcgaaattcttgaaagcatatgattttttgaaataattgataacacaacaagaaaagctgaaggaagattttcttcagcttttttatgctgtgtaaagtccctgcaattccttacttttgcatttatcaaaatgacatacaagaaatgaagccaagtttagcaaaagggacgagagattttacggcacaggaagtttccagaagaaaatatatcatcaatattttacagaataattttgaattattcgggtttcagccattggaaacaccaagttttgaaaatctttctacacttacaggaaaatacggagaagaaggtgaccgcttgatttttaaaattttaaattcaagtatcaatgaagcaaaagaagagaaaaaaactcagatgcttcatgatttccaaaaagcattggaaaaaccattcagtgcagaaagccttaccgataaagctcttcgctatgaccttaccgtaccttttgcaagatttgtagcaatgaaccatgggaaactgacctttccgttcaaacgttcgcaaattcagccggtttggagagcagacagacctcagaaaggaagattcagagaattctatcagtgtgatgcagatgtggtgggaagtgaaagcttattacaggaagtagagctggttcagttatatttaaaatcatttgctgatctgaaagttcccgttacgattcatatgaataacaggaaaatcctttccggtttggcagaatatgccggaatcacagataaactgattgacttcacggtggcattggataaactggataaaattggcaaagacggagtggtgaaagaattactggaaagagaaatttctcaggaatctatcgataaactagacttcttattcagccagtctgatgatgcactggaaaatcttcttcagctgaaagaaaaatttgcaggaaatgaaatcggactgaaaggagtagaagaactggagtttgttcttacccagtctttgaaccttggtgttgatattcaaaaccttgtattcaatattacattggccagaggtttagattactacacaggagccatctttgaagtgaaggcagatgaggttgctatgggatccatcgggggaggtggaagatatgataacctgactgaagtttttggagtgaagaatattccgggaataggaatttcattcggattagacagaatctatcttgtaatggaagaattgaaccttttccctgaagaggcgtcagccaaaatagaatatctgtttgctaactttggaggtgacggagtaacggaagctttaaaactaatgatgcagctaagagcaaaaggtatttcggcagaattgtatcctgaaaacgcgaaaatcaacaaacagtttacttacgcagaaaagaaaggcataaagaatcttgttttccttggtgaagaagaaattaaaaataatacagttacttttaaagatctggaagccggagtacagaaaacggtttcattagaagaatttttaggagaataattttttaattatataaaaacagaacaactgcaaaattacttttgtagttgttttttttgatggatgctgagaatttaaatacttttgaataaaaaagaaatgactaataattgtgcattttgtaaggcagaattaacatctatggatacgcttctgggagccaatatgctttctgatggcaatgttttatgcaataagtgtctgaatatagcaacaaatatcaatgaagaattactttataacctcaataagttcagcattgaagatatcagtaaaattctgaataatgaaaaacccggatctttagaggttgctgtaaacgcaaatcagaatctttctgcgcttacgaatatagattcaggccagatctcaagagatgtttataaaagaagacatcgcaaaataaagcaggaactggaaaaactgcgtgccaacctttctattttcaccaaaggagaaatcaaagaacttccttacctgattcctgaagatgaaccaattattgcaattacagatgctcaatttgtcaatacgttagctgcaggaatacttgtagctacctccaaaaggctgatttctgtttcaaaatcaatgttcggggcagcggagatcaatgattatcccaatgaaaccatcaaagcggtaagttttgtaacagatcccagatcacccatcattaagctgcatcttgatgaaaaggttgcagagtttgaatgttttatggataaggaagatgcagaaaagttctatgatacgataaaagctttctataacgctccacagaaactgtcttctatacaaactgatactgtaaacaaaagagccgtctcatcagaagagattttaaatcagcttgaaaaattaggaaaacttcgggaaaacggaattttgactgatgcagaatttacagagcaaaaaaagaaattgctggaacaattataaaaaacttttaatacgatgagggataaagtaacaatcgtagaaaactggcttaagggttggtgtttatcaagagaagtatcttttcctgttcaatataaatcaggtttcagagtgattgtaggagatgaaaagcaaaaagaacgttttgtatttcctaaacttaatgacgatttttttcagctcgcccactcagttcatgagccctggattcatctgaaagtatctactgctcctgaagaatttatagaaaaaattcctgaaagatgggtactgcagccacagggttatatgatgacctgctttcacccgatgcatttcagggaaatcagtcttgcaaaaggatatcacctggagttttctgagtacaatacaacttttgtggtcagaattgtgacagaaaatggggaacaggcttccattggacgtgtttctcttatagataacctggctgtttatgacaggattgttactgaaaaagatcatcagagacaaggtcttgctacttttttattgaaagagcttgagaagattgctttgtcaaaaggattttcaaataaccttttagtggcaacagaagaaggaaaactattatatcaaaccttaggctggaaggtgtattgcctgcatacttccattgtaataccatctcagagctaggtttctcaaaaagcagtaatttagatctttgaactataactataaaaatcaagaccttgttaaacaatggaaaactacttagaaataaataaaaaatcatggaatgccaaagtggagccgcatctgaagtcggatttctactttgtagatgaatttttgaaaggaaggacctctttgaattcaattgaactggagcttcttggggatataaaaggaaaaaatattctgcacctgcagtgccatttcggccaggattctatttccttatcaagaatgggagcaaaagttacaggaattgatctttctgataaagcgattgatacagccagagatctggcacagaaatgcggtacggatactgaatttatctgttcagatgtttatgatctgccgaatattctggatcataaatttgatatcgtttataccagctatggtacaataggatggcttcctgatcttgaaaagtgggcagaagttatcaatcattttctgaagccgggaggaaagttcattatggcagagtttcaccctgttgtctggatgtttgatgatgactttactaaagtagcatacaattatttcaatgaaaaaccaattgtggaaacctatgaaggaacttatgcagatcagtctgcggctatcatacaggaatatgttatgtggaatcattctttagcagaagttcttgataatttaattaagaaggatctgaaactggatacttttcaggaattcgactggtcaccatacccgtgtttcaggcatgtggaagaatttgaaaaaggaaaatggagaattccgcactttggaaacaaaataccactggtatttgctttggttgcagagaaaaaataagatttaattaaccattaagatcagataagcttttaaagaatggtttaatctttaaataaaaagtcatcgcaattaccattacgatgactttttcctatatatgaatgttaaaaaaactgctctttgttggttagcttaaagaatcttcagcttttgtttttacttcgtccactttactctgaacctgggaagccacatcattggctttgcttttaaggtcatttccccatttattcagattatcttttgctgtattgattttatcttttacagcttgttgatcttcagggcttgaattcttatatttccaataagctaatgcacctaatcctagtaaagctaataaaccttttgtcttgtttcccatgatttctatttttttaagtattaatattaaaattgttgttatgaataatgtaaaatacgtgccaaaaaaataaatggacctataaaaaaatgttaaatttaagaaaagacttcaaaattttcaccgtcaaaactggcgaaaaccatagtgggataggagtcctgatgataaatatttccatctttatcaatagcgatggcacctgcgaaaccatcaatggttttaagctcttcaaatgttttggtaaaagcctgctgaagattcatcccatcggtaaccctcgttacaatttttgcagcagtagcattgcttacaatatcttcacccacaccggtacagcttactgcacagaaagcattggcataatttccggccacagtggcagaatctgaaatccttccgggaatctcaaaaccttttccacctgtggatgttgcaacggctagtttcccttcatgatctattgctacgcagcctacagttcctttgcctccattggcaagcttggcttcatattcttttcttctctgaggagtctccgtagaaaaattctcaaacccattttccgtagcatagattttagcaccatttcctcctaaaactctgtcgtcttcattgataagatctttggcaacaaatatagggttctgtacattttcaatattgatcacgccgcttagtttctgagtatctccgttcattattgcagcactcatgcggatcacaccatcactctggatctgagatccgattccggcattgtataaaggatcatcttcaagcagcgaaacagcataggcaacagtatcaaaagccgaatgtgttgtaagataatcaaaagctttctttgcaattgattgtaaagactcctgttttgctgtctttacttcgtggctttggtcactttcagagaaaaaaccgccgtggataatgattttcatagaataagagttgatgaatatttttacgaaggtaatttattaataaaagataaaagataaaagataaaaagatattatcgtaaatcaactattatgcatccggatatcaacatcaatagaggtgggctttagcccgccttaccataaacatattaaatccattggctttagccccaacataaaatataaatgttaaataaaaaacggaaccgaggtcccgtttgtatagctgtattagttgttctatttatcctgtggaatagggttaaactgcgaattctcaatcgtcagtgttttggtagtaagatcataatggtcattcatagacatgacatgtaccgtcagattatcaatagaaatcggttccccaaggttaatattggtaaggttggtgtctttaataaaccttccgtctaccagaatcacaagacctgagcctacggctgtcatcacatcattatgaatgaaaagtcctgtatcttctcccaatccgattcccagcgttctcggattgttcactaccgcctgaaaaagacgcccgattctgcctcgctgtacaaagtgggtatcaataatgacattatcaattaatcctaatccctgtgtggttttgatttctcctttcagaagtgcttcagaactgcttccctgataaatcatattttcagaagctgcggcagcacctgcagaagttccggaataaataaagtcctgttcctgatatttcagtaaaactgtatcgtggaatcttgttcctccaagaatagaagtcagtctcagctggtctccgccagtgaacatcatgacgtctgcagcattggctcttgcaaccatagcatcagaattagcttcttcgcggttatgaatatcaaggacatttacatttttagccccaagaaattcaaatgcttttttgtattcggaacctacgatctgagggatttgagaggcagttgttacaatttcaatgacagaattctcctttagttttgattcgttgatgatctttcgcaggatcccacgctcaaaaaaattaagattcttttctatattctgatcataatcggtttcagcaaaactgcctttgtttacagcgcctccgataactattaattttccaacaggtttcatcattgtgcaaaattaaaaaataattcacattctctggccaatttcatgccatctttagttgatttttaatgttttagaaatgttaattaaaattaatttttttttagcgaatctttaaatgtggtatagtttcgtttagggttttacattatctttgattatgaaaggagttattgttaactgttaaaatgccaatagactatgaaaatcgaaaagattcaggcactaagaggtcctaacatctggagcatcagaagaaagaagctgatacagatgaggttggacttagaagaaatggagaattatcctaccaataaaatcgaaggatttcgggaaaggattgaaaaattaatcccatcattaattacacatcgctgctcggaaggagtggaaggcggttttttccatagagtggaaacaggtacctggatgggacatgtcattgagcatatcgccctggaaatacagacgctggcagggatggatgtagggtttggaagaacccgcgaaacaaaaactccgggagtgtataatgtggtattcaattatattgaagaaaacgcagggatttatgctgcagaagaatctgtaaagattgctgaagcattgatagaaggaaaagattatgatttgaatgcatgtattcacaggttaaaagaaatcagggagcgtgtccgtctgggtccttctaccggaagtattgtagaagaagccgcttccagaaaaatcccatggatcagattgggaaccaattctctggtacagctgggttacggagtcaatcagcagaggtttcaggctacgattaccggaaacacaagttctattgctgttgatatcgcctgtaacaaagaattaaccaaaagaatgcttcacgatgctgctattcccgttccgattggtgatctggtagtggatgaagagggtttagatgctgtgatcaggaaaattgggtatccgattgttttaaaacctttggatggcaaccatggaaaaggctcttccattaatgtcaacgactgggaggctgccaaaacaggcctggagcatgcgcagaaatattcaagaaaagtaattgttgaaaaatatattaccggttatgatttccgtatcctggtaattaataataaaatggtggctgcagcaagaagagttccggcccatgttgttggagacggagaattaaaccttcagcagcttatcgaaaaagaaaataaagatccgagaagaggatatgggcatgaaaatgtccttaccgaaattgagatcgataaagataccttagaattgcttgataagcttcagtatactttggaaacaatccctcagaagggagagattgtatatcttaaatctactgccaatctttctacgggaggaacgtctattgatgtaacagatatggtgcatccggaaaatatcacaatggcagaaagaatctccaaaattatcgggttggatgtctgcggtatagacgttatggcagaaaaccttacacagcctttaaaggaaagtggcggagcaattattgaagtaaacgctgctccagggttcagaatgcacctggctccaagtgaaggcttgccaaggaacgtggctgcaccggtggtagatatgctgtatcctcagggaaaaccttttaccattccaattattgcagtaacgggaaccaatggaaagacaacaacaacaaggcttatttcgcatattgtaaaaagtaacggatatagagtgggatttacaacgtcagatggaatctatattcaaaataccatgctgtctaaaggagatacgacaggaccactttctgcagaatttattctgaaagatcctacggtggaatttgcagtgctggaaacggcaaggggcggtatcttacgttcggggcttggcttttcacaatgtgatatcggggtgttgaccaatattgaggaagatcatctggggatgaatgacattcacagtttaaaagatcttaccagggtaaaacgtgttgtattggacagcgttaaaaagagcggatggagcgtattgaatgctgataatgaatattccatgaagattgtgaatgaccttgattccaatgtggcgattttcagtatggatgaaaacaatcctcatatcgtaaaatttgccaaagaaggaaagatcacctgcgtgtatgaagagggttttgtaaccattaagaaaggagactggaaaatcagaataggaaaagcaaaggatttcccgatcacgatggaaggtaaggccagatttatgattgaaaacgtattggcggccagcctggcgagttatctgtatggattcggaattgaagatatttccaattctttgagaacctttattccgagtgcccagctcactccgggaagactgaatgtttttaaattcaaaaactttaaagtactgatcgactttgcgcacaatccttccggctatgaagcaattgaagattatctgaaaaatgttgaatctaccaagaagatcggaattatctcaggcgttggagacagaagagacaatgatatcagagaatgcggaaagatagcaggcagaatgtttgatcacatcattatccgaaacgaaaaacaccttcgcggaagaaccgaagatgaaattaacggattgatcattgaaggaatgcaggctgcaggaaaagatgtaagctacgagatcattcccaaagaaatagaagcattgaaacatgccataggaatggcagaagaaggaacatttatcacggctttaagtgatgttatttccaatgctattgatctggttcaggaataccaggcgcgggagctgctggaagatgataaaaatatatagaaaaacctccggaatttccggaggttttgttttttataaagtttcttaggttcctttataatgtttgaaattttaattacataaaatatagtaatcacaacaattaaaatagggtgtttttccttcactgttttgggacttacaggtttaattttgttcatcaataaataaaatgaaatcaatgagaccaatcaattacatcgttatacattgtacagcaacacagccggatgttacaatagagagcattaaacggtattggaaggaaaacctgaaatggaaaaatccagggtatcactatatgataaaagctgatggagaaatagttaacaccttaccaattgatcaggtatccaatggcgtagcagggtggaattcccaaattatcaatatatcatacattggaggcattgataaaagcaaccatccaaaagatacaagaacgcaagagcaaaaaaaatctattgtcaagctgctaagagaattgaaatcaaaatttcctaaagctagaattcagggacacagagattttcccaatgttcataaagcatgtcctagctttgatgctaagaaagaatatgctggcttatcataagttgaagtgttgtaaggctgttagaaagcatttatggaaaacttataattaaaaagcaggccttacggtttcccgtagagtatacctccggtcaatttgtatatttacgatgtttgtgaaaacacaacatacatgttaattttttatatcctccttttgggggattttatgattaaagagattttgaggaataaaaataacctccgatatttcggaggtttgtttctataagttttcccaggttgttttgatgctctgcattttcttaagataaaaatacagcgggatgagttctaatctgagggtgaagctgatcgttggaatagtaaaagggataatagccatcatgatcagacaaatggcaatgcctatgattgcatcaattatggctgcctgtggtgcccatttttgttcaaaccaaagtccgtaggctacaacacctttgaacaggaataaagaacagatcaaaagtcctgtcattgaatagggatgatcagccttcattccatataaagataaagaagtgttagtgatcagaaagcccgacatcagtaatacagcagctactgcacctccgattaaaaagatccataggaaaactttaatccaggtgggtaataggtttcttcttcgtgttaagatgttgttgtcaaattctgcgaaacgcgttgatgtttcttccatgtattattagtttttataagttatttatccaaaaaaggcattcgaacttccgatccagatggcatcttttttattgaaatctacattcaccatggcggctttagtcattcttccaagattttccaataggataggacgttcatcattttcccgccaaatatacaacaaacggatctctgctttcgaaaaatctccgttaatatcttcaaaaatcggttcatagtacacttttctctgcagaatgtagttttccttatcctgaatagagtctgtaatttcgcgggtagggtttaaattaactccgcttcctgcgaatgaaaacaatggttttagtacaaaattttcaagattttcatgctccgggaattcatgcagaaagtaactctttggaacaaattgatgttttaataaaggcagcagaaattttgagattttaaagaaccagttcgggtgagtgatccacttgacatccacttcctcccggaaatcaaattctgttttcagatccggaatattatccagttcgtcaaatataacacggttgtagattcttttgatctctgtatgcttgccatcattttcataatacagctttcgtccttccttctttatctttgtcagacatacggttttaattcctattaatttctctgtaagtgcaaaatcaatggccgttttttgtttttccggaaaaatttcaagcagaattacattttcaggatgttcatgtcctacaatgagttcatttaagtagtttttaaaggtttcatgaggcattgggtttctgatctctgaaagaaaagggtagacctcacagtacgtttcttcatagactttttgaaaagcatacaaagaagggaaagcctgaagttctatcaactgaggttctattgctccgttttcacttttgcacactccaaaatcgatggtgaaaaaatggggctgattggtatcattgggaaccctgcagtgatcaggaatagctttttgaagcagttctgccggcattgctttaatctggctgatgatactttcactggcgtctatgagcttactctcaaattctttagtcagaaaaataggactttctgaaactctgaaagcaggagctataccgcctttttctgccaatatgcctttgagctggctgtatttttcatccgaaaactctttattgaactgttttctgtattttggaatcatattttttttctttgtgatgttaaaaaaatcgagcattgttgcccgattgttatttatagctggaagagggaagctgggagagggaagttttcaattctgaagttttaattattagttataaataaaagaatatcaataatcaataatctttgaaaataacttccagccttttatgccaaagtttcagctttcttcaaaatgttttttcttgcaaactgaaggaatcttggaaggatctgatgtctggtcagaataattttgtcttcatcatctattctgtccatagtttcaaggtatttttccataccgaagttttcgatcatggcttctctgtttttttcgtctttcagattttcgatcagagattcagggttggcttccggatgaaactgtgtcccgaatatctcttcagaaaaacgaacggccattaccgctctttcaaggttaatatgaggacggaatttttcaatcgccataatagtcattccaagctcttcaaaacggttatgatccggctcaataaactgataggctcttgaatccaccgcataaaaaggatcctgaagatttttgaataaaaattcgtctttgccctcttcggttttatgaacaggcattaccccgaaagaataggactttcttttgcagatatttcccaggttccagtgaatgcttgccagctggaatgaatggcagatcaggaaaagatactttttatcgtcatggtatttattatgctcaaaaacagcatccagaaaatcagcatatttgtcttcccatgcaagaccttcccgatgtggatttccgggtccgcctgaagaaataaaaatatcaaaatctccgatttcgggcatttcatctttatatcttacatcaaacgttttgatcaccacattttcttcagagttctgctgaaaagtttcggaaatctctttaatgtttctaaaaccttgattcacatgattgttgttcatgtccagcagagcaattcgaatatctttcattacatcatattttttgtaaagttaccaaaaatattatgaagccggctcaccatgagttataccgtactctgtttcagagatcatataatcaacgactttcgtgagatcatctgtttccttaaagatctgaagctgtctgtctgcaccggttccgttttcaaggattttccaggcgtattcaacttccttgcggcatcctaaatcgtctactacatcatcaataaattctaaaagctctttcaataaatgaggataaggaacagattcttctttcccaaaatcgataagatgagcttcaataccgcttttcgaggcacgccatttattttcgttcagcagcagccttctgtagcttctgaagctcaggttttgctggtgaagtttatatattttagctacaagactctgcataatggctgccagacatacggtttcatctatcctcagaggcatgtcacagattctgaactcaatagtaggataaaacggatgtacccgtaaatcccaccagattttcttggcattgtctatagttcctgttttcaccagaagatctacataactgtcaaattctgcaagagagttaaaatagctcggaatacccgttctggggaattttacgaaaatttcctgacgataagatttaaaacctgtgtatcttccgatccagaaaggtgaattggtagaaagagcatacacatgaggaagaaaataacgcatcacattctggattcttaccccttcttcacggttgggaattccgatatgaacatgcagtccgaaaataaggttttcacgcgcaacatctcccatatcatctacgattttaatatatctttctccctgagtaatattattttccgaccaatgagagaacgggtgggtgcctcctccggaaactcgtagtccctgttcatgggcgatattgataagatgacgtcttaaattcgttaattcagctctggcttcctgaatattctgacagattcccgtttccatttcaatcatggattcgtgcatttcgtgctttaaattttcacttaaaaccgctttgccgccttcaatgatttttgaaacatgagaaaccagatctctgctttccacatcaatgatctgatattcttcttcaattccaatagtaaactgatgatgcatttattttgtgttttttaattctttttaatgttatttaatggaatctttcacaaaggttccccaggcaatattgggttttcccggaacatattctttagctttttctatagccagttttgctgaatgctcaatgatccatgcaaagttttcttcgcctacagaatttctgtctgcgtcaggggcgggattacagaaatcaatagcataagggataccgtctcttaccgcaaattctacggtgttgaaatcatatcccagggcttcattcatagtaatggtataatcatgaatggttttcaggagtttttcaagctcctttccttctgttttatgggtggtggcatatcttaaatgcggtgcatttcttggttcataaggcatgatatgaacatactttctgcccaggcagtaaaccctgtaataatcatcaaagataatttcttcctgaaccatcatgaccagttgttccgtttcccctaatttattccagagatcatcaggattttccactctgtacacgtttttccaaccccctccgtcatgaggcttcatataagcagggaaacctacataattgaagatgtattcccagtcatgtggaaatttcaggtttctgaatgaagtttctgaagtattatccggtctttcatgggatggaagcaaaactgttttaggaagtggaattccgagtttggacatcagggcattgttgaaaaacttctcgtcagcgctccaccagaacggattgttaatcacataggtaccgttaagcgcagcgttttttaaatacgctctgtaaaagggaacgtcctgtgaaattctgtcgataatcactgcatagccataatctgcaccttgttccagtttatctataataacaggttcagctatgatatttccacctcccagttcattcactttgtctataaatgcccagggaaaagtgtcttccataccgaaaagaattcctactttttttgtcataatttttgtttttaagatgggtgtttattttttctatttgtcttttattgctttatgttaagagaaaaaagctcctatgaaagtagggaagaccattctccacaaaggccagtcgtggccgatccattttctttcatcataccagaagtctatgcctttcatcctaagaatttcagccatttcaacgtttttatctttgcagatatcctgatctgaggtgcttagtacaatatgcatatgtttgtatttccaggcctcgtcatttcggacaaactcccttgggcagttgaaatataccagatcatcagaatagccgtccataaagtttctgatactgaatgctccggaaagacaaaagagatgagaaaccacatccggaaatctggaagcaaaattagcagcatgatatcccccgaagctcgctccggcaactgccacacgatgtgttttgtgaagtttttggatataaggcacaaattcctggatcagaaactgtacataccgttcataattccttattctttgctgtggagatatcttatcatcataaaagctccagctgtcaatagtctgcacattgtaaagctttacctttgcctgttctataaaccagttgatacttccgttaagatgaaaatcatgattctgggtatactgtccctgggaagtagggaacataatgatagggtagccgtaatgcccggttacttctaccttgagactaattcccagtatatttgaataatattctgtatgttctatgtgaggcattttccttgttgggttttatcttttctaaattacgttttaccgtggaactgctgatagggtgtatattatgaattcaataacattttgaatatcaatgttacgcatcatttcaggagtttagtttgttgcttttgggaggaagaacattcagcatatctgcatgaattatttctgctgcagaatcaagtctgtcctgcacaacagaagcatctccggatttataaacaatcccgacatgataatctatgggaaggaacttgacaacttcttcacattcaaaattactgtagtccggttctttatctttaatcagggcgacaatcagacctgaataatatcctgtgggtggtgaaacatggtaatcattacctctcagaagagcatcttcaattttagcccattctctccatatattgatgttacttgatgcttctaccagatccggaatatgagcaccgccaactctggaagaggtttccaggaaataccattttccgtcttctcttccacggataaattctgtgtgggtggctccgttgacaagtccgaagttggaaaggaccctggcatttatttcttccaatgctttaaattcttcagaataccttcctaaagttttagatctgaaaacgccgccttcatgagaaacctgcattggaggggccagatattttgatgcagaggtgaatacgatttttttattaaaagtaaggctgtccacatggtaaacatctccgggtttaaaactttccagtaagaaaagatgacgttcttctccgagagtttccaaggcttcaagcagttgttctttagaggtaattttcttaatgcctgatgctgatgcttcagagcgcggctttaatacccatggagctggaacacggtctgtaaattcgtccacttcatgatcgttgaatacagcagtaaattcgggaacgctgatcccggaatcttttgctttttgtcgcattgccagcttatctctgaaatatcggtgcgtagtctgtcccattcccggaatacggaatgtttctctgattaatgcagctttttcaacgtcataatcatccagagccactacagcatctactttgcgggtcttcatcagatgggaaaagccctgaataagatgttccagattccatacggatggtttaagctcaggcatgtaaaatacctcatcaatagcgtgccatggccagtttttctctttgaggttttcagaggttaccaggataactttattgccgagcttcttcatctcgtccataaaatcataacctttgtaatagcacgaaatacatacgatagttttcttctccatataatgtttttaaagatttagtgaattttcaaaaataaaagcatttgtttattattttattaatactaaaaaatgtaatatcgtgcggttttgaaaattcactaatcaattatacagagtttttttgtaaaaaactaatttttagtgataattttcaattaaattcgcgagcaattgaaccccaaaaccagtggctgctttttctttggcataacccacatttccaaaggctactccggcaatgtccagatgagcccatttagggtggttttcaatgaattgttctaagaatttagcggcaataatacagtctccaacaggcttcagggatatgtttttcatatccgccacatcagactttatatcgtctttccagacctcccataaaggcagattccataccctctgattggtttgatcaccggtttttatcagatggtttttcagttcctcattattggagaacatggcggcacaggtatctccgaacattctgacagaacttcccgttaaagtagccagatcaataaggaaatctgttttgtagtttttagccagataagatagtccgtctgcaagaattaatctgccttccgcatcagtgtcaagaacttcaatggtttttccgttataagctgtaatcacatcacttggaagaagagccttttcagagaccgcattgtctgtaataggcagaacagcaataatgttcacaggaagtttcatttcagcagcatagatcaatgctcccaataccgctgtagcacctcccatatcagatttcatataatgaagattggcagagctctttattgatatacctccggtgtcaaataatatgcattttcctaccagcccaaaagttttcgcatttttaacggtagttttatattccagaatcgtaaatgcagcatcataagcacttccctggttgacggaaagataggcgcctaatccgagctcttcgcatttttttctgttgaatgctgtatatttcagatcatattttttagcgagatttttcaggtatgcacttaatatatccggttttttcagattggccggtttgttgagccagtcctggcaggcagtctgtccattaatcaatgcttctgttttctggctgatatggtctagttttttctgacttaaattttcaaaatgcaattcaaattttgcattccagaaagtgtgttttttatcaaaagggtagttgtaagttccggccagaagcccttttgcaaattcctcaaattgtttctcattgatgaaatcagccagtgccaacgtcggaactgcctgaagcttttctttataggtttgtgaaaattttgctgcaacctgctggatttcgaaattttgtaaggcagattttcccagtccgataaaataagtgattccttcttcatgtgcattgacaaaaacttcatacttctttcctgtgaaaaaagtggaaatatttttattgaaatttttacttgttttcgtccactcttcctctgtaaataattgaaaaatctgagtgtagtttttgttttttttattgattaatttcataaatagatgttatatttctaaagtcatacaaccgttgtcttcaatattttcaatcggcgtaaatttcctacagcttttgtatgtttagtttttaatgcttcgttgttgcggctttacttccacagggttttctgtattgtcatagaacagccattctatagctcttggaaactcctgcgaccagtaaaattcattgtgggtgccttcagggttaatatttgttttaaattcgaaatcaaaaagctttttttcttcccatcttttcagatattcttcaaaaatatgaattctcctgaccattttagaaccctcctgaccaccgccgtaaagataaatttttgttttaaaaggaactctgaaattcatcatcgggaaattattattcggttctacccaaagggaaggagagaatatcaaaagctttgaatacacttcaggataaagaaatccactatatatactgatcaatgctcccaatgaactgcccccgattccggtgttgtcgcggtcttttttagttctgtaattttcgtccacataaggttttaaagtatccgcaataaagcggatgtatttctttccttcagaaccgttggccacatgatcattatcaaaaatatattctttaattctttcctcgctgccatgttctattgctatgatgataagatcaccacgtccgtattctgcaaggatagacagttttttatcgatttcccagttgccatatccgcttccttcattgaacagattctgtgcatcctgaaggtataaaacaggataacgcttatctgtagtatgatagtcataaggaagaagtgcccagattttgcggtaacggtcaagctgtggaatataaaaattttccgaaataacttccgcagtaggaaaatactcttccttgaatggtccccagtttaatctccatttttttacaatatcagaagtgttgccggaacttttttttgctttccggttaggtgtgatgttgccgtactgatccagttccacgttctcccagccaccttttgtgaatttgtattcaatatcatcgggaagattctgattttcaatttctatgaaatagctggcagggtcaagttgcttaagctgaaaattataatctttagggttccagctgttgaaatttccggtgataaaaaccggtctgtcatctttttcttctgtataaagttcaaacctcatcgtatgtgtttaataaatgttgatgttaaatttataaaaagattgttttggaatcataaaaaatgtgaggtaaaaaatgatatatttgatagatagacgaaagccgaaattcagttgataaatatttgatgaattattaaccgcttttgccggtatttttcgtagtttcagggaaaatataaatacaaactgatcttgatgaattctgttaagacctacacgcttttcaccgatcatgatgtgtatctttttaaagaaggtagacattataagctgtatggtaaattcggtgcacattctgcagaaaaggatggcgtaaaaggagtgtatttttccgtatgggcacctaatgcaaagaaagtttccgtgatcggaaatttcaacaactggaatcataaagatcatatcctttttccaagatgggacggatccgggatctgggaaggctttattgaaggattaacctggggtaccttgtataaatacgctattgaaacacagggtggcgaaattctggaaaaaagtgatccttatgcattaagctgggagcagaatattcaggcggcttctctggtttctactacatggtatgaatggaatgatcaggaatggatggaccagcgctggaaaaaaaacagactggaagctccgttatctgtatatgagctgcacctgggttcatgggtaagagacggggagtatcctgaccgctttctgaattaccgggatattgccagaaagctggttccctatataaaagagatgggatttacccatgtagaatttatgcctgtgatggaatatccttacgagcccagctggggatatcagattaccggtttttatgctgctacctcacgttttggctcaccgcaggatctgatgtttctgattgatgagcttcacaacaatgaaattggggttatcctggattgggttccgtctcatttcccgggagatgccaatggtcttcaccgttttgatggcacttacctttatgagcatgaagatccgagaaaaggctttcatcccgattggaaatcgcatattttcaactatggaagaaatgaggttaaatcttttctgatttcaaacgccatgttctggctggatcgttatcatgccgacggattacgcgtagatgcggtaacttcaatgctccatctggattattcaagaaatgaaggagagtgggaacctaatatatatggaacgaatgtgaaccttgaagccaaagcttttctgcaggaattcaacactgctgtttacaaagagtttggagataatatcataactattgctgaagaaagttcggattttcctatgcttaccaagcctgttcatgatggtggcgtgggttttggtatgaaatggatgatgggctggatgcatgatacactggattattttaaagaagactttgaaaacaggaaattccatcaccataagctgacatttgcttccatgtatatgtataatgaaaattatatgatgcctttatcgcatgacgaagtggtacatggcaaagcaagtcttatctataaaatgaaaggtgacgaatggcagaaatttgccaatctgcgtaccttatatgtatatatgtatacgcatcccggagccaagttactttttatgggagatgaatttgggcagaccagtgaatggaattttaccagaagcctcgactggcatttgctgaaataccctgttcacaaaggaatgcaggagcttgttaaagatatgaatcacctttacagatcagaaactgccttttatgaaaatcagtttgatagaaatggttttgagtgggtggaagcggatgatctcgaaaattcaatttacatttatctgagaaaaggtaaaaaaagggacgatattgtgatggtgattttgaacctggctccgaaagttttggattataaaatcgggattcctgcaggtacccactgggaagttgttttgaattcagatgatgaaaaatacagtggaagcggagtagaacctgaaatcctgggagagaagtatgaagaatggagaaattatccaaaaacaatgaccgtgaagctgccgccattggccggaatagtgttacgtcagaagaaagataaaaaatataaattacacagaattaaacataagagataaagaatggttatttatcatttaagtacagaatgttaccctgtcgcaaaagttggtggtctggcagatgtggtcggagcacttccaaaatatcagaataaaatagaaggagtagaggcgaaggttgtaatgccctggtacaacaaatcctttgtatatgatcatgaatttgacctggtttttgatgggtttattcatcagggggccaatatgttgcaggttcaggtactgaaagaaaagacaaatgttctgggatttgagctatatatggtaagaattcccggattattagacagggacaatccctatggctaccaggatgaaagtttccagtttctggcctttcaacatggcgttctgcattggctgtctgcgatgaaaatccgccctgatgtactgcattgccatgattatcatacaggtctggtgccttttatggtagaaaattgttatgaatttgaattcctaaaaggagtaaaaacaataggaactattcataatggcgaatatcagggcatgatgaactggactatggcacaatatatgccttctttcgatgcgtatcaatggggactgatggattggaacggattgatgaatcctctggccagtatgatcaaatgtgcccatgcttttaccaccgtttctgaaggatatcttgaagaactttttataagcttccgcggactcgaaagcctggttcgtcaggaattcggaaaagcatacggaatcatcaatggtattgacacggaagtctggaatccagagacagatcctatgctggattttaattttagtattacaaatgcggtagatcaaaagaaaaaaaataaagaaaacctctgtaaagaatatggattaaaacccgaacttcctttatttgcctttatcggaaggtttgctacagagaagggtgctgatttgctgccggatgttgtatggagaagtatcaagcaaagttatggtgctttaaatattatgattctcggatcagggaatacctatattgagaataaactgaaagaatacgactatacatataccaattttgcattggatctcggatataaagaacatctttctcataagatctatgcctcggcagattttcttctgatgccttccagggtagaaccatgcggattgaatcagatgtactctatgagatacgggactgttcccgtggtaagatatacaggaggactcaaagatacggtggaagatatttcaaccggcggagcagggctgaactttacttatccgggggtagatgatgttgtacatgcgatgaacagagcaatggcgatttataatcaaaaaggcgttatggaagatcttatccatgccaatatgaattttgattttgcatgggagaaatctgcagaaaaatatatagctttatataatagctgatggtgtgaagattttcggatttcttttcctgataatgcttatgttgttttcctgtaaagaagacagaggaagttatcatggaggctattactggatctatggctacggacttccggcaatggaaaagtatgaagcaatggctggcatttccgaaaaatggaaaataaagcattactctgtcggtggttgtctggtggaatctgaagagatgaaaagaatagatgctcttaataaaaggacctacgctgcaatagaaagaaaatatggaaaaggctggagagaaaggtatcgtaaagatgttgatgactttgtaataaagagtgctgatgtaatggacgtgcttattacaaatcctctcttcagaaatgaacttaaaaaatataatattgaaatctataacctggataaagaggttttagtactgaatgataaagatgattttcgggtgactgtttataaaaacaaactccaatatgaaaacaaagaatgctttaaagtagcagtaaacactaagaacaaaacagtaagcttaataaaataaaacgccagatatttatgaatcgaaatgtaatctctattgttttaggaggaggtagaggaacaagattattcccgttaacgtataccagatcaaaaccggctgttccaattgcaggaaaatacagactagtagatattcctatctcaaactgtctgaactcaggactgaacaaaattctggtgttgacgcagtttaattctgcttccctcaattcacatatcaagaattcttatcactttgatattttcagcaaaggctttgttgatattcttgcagctgagcagaatgtagaaaatgatagctggtaccagggaacagcagatgctgtacgtcagtcaatgaagcaccttgaaaaatatgattatgactatattcttattctttcaggtgatcagttgtatcagatggatttcagggaaatgctcgacttccatattgaaaatggaggagatcttaccattgctactattcccgtgaacgcaaaagatgccacgggttttggaatcttaaagtcagatgatgaaggaaatattacctctttctatgaaaagccgggttatgatatgctggaaggcatgaaatctgaagtttcagatgaaaataaacatgcaggaaaggaattccttgcttctatgggaatttatatcttcaccaagaatatccttaaaaagatgtttgaagagggagcaggtgatgatttcggaaaagatatcattccaagttccatcggaaaatataaaacattaagctatcaatatgaaggctactggacagatatcggaaccatagaatctttctacgaagcgaatcttgatctttgtcttgatctgccacagtttaaccttttctcttcatcaccaatctataccagagcaagaatgcttccaccgtcaaaaatcaacggttcatacgtaagtaaggctgtttttggagatggatgtatcattatggcagataaaattgaaaattctgtgatcggaaacagaaccagaattgataaaggaagtaccatcgtgaactcctatgttatgggagctgatttctatcagaatacgacagaaattgtgatcaatgacagaggaggacgtccgaatatgggaatcggaaaatattgctatatagaaaaagcaatccttgataaaaactgttacattggtgacaatgtcaaaatcatcggcggaaaacatatcccggacggagattatggaacctattctgttcaggatgggattgtggttgtaaagaaaggtgctgtgattgcgccgggaacacatataggataagaattctgaataatgaaagtgtagtaataacttctcttggtaaatcagaaatcttctaaaagcatataaaaaaagaaacctgctttaggtttctttttttcgtttatcatgatcttatttagaaaataaggttagtgaatattccagttccgggtctttatgctcttttaaagattgtaggaaaaattgggtattcactgtatgatcaggaattactcccttacagttagcagcattctccttgtcatcattgttgaagaatatttccgttcttggaatagaaattgtggactttgtatgaggaagccggtacgtaagaaaccatgctgcagttgtaaagttgctgcaggaaccagtttcctttcctataattgcgcctcttttttcactttgaaacagagaagcaaaataggtggcagcagaaaaagtacggttattgatcaataatacagtctctccgtcaaaaaatgctccgtctctgggatagctttttatgtatgtattatccagtcttgagtttccaaaataataatctcctttttctgctttgtcaaaccgttgtctcatgaaattattttgatcggcaatatccgtatctgaataatagcggttggtctggggatctaccagataatctttataaatgatgtcaacaaccttagttccgtatttgtattcattattaaatgttttatctttagcaatgaaagaatacagcagaggaacattactgatggctcctccagggttattacggatatccagaataagctttttaattttcagatctttaatttcctggaaatatttttttaacctttcataaaaaaagctttcatcataagaaaacgatttcacggataaatagtaagtataggaatctattgtataaccataaattccggcgttttctgagatcagatcaacaggtaatacagaatgtctgctttcgtaatagaatctgggatatttaatgcccttcactttgagggttttctgttcgccgcttggtgttttgtattgtaaagaaaaatcattcgtacggttttttaaaacaaagggaatataaaatgacacatctatatcttccactttgatatttccgtctgcggctttaggaacagcctgtaaaagttctttggaatgtatatcattaatctccataatctcactgcccacttcaatagcatatggattggaaccattcacaaatagccggccattgtgtacataagtctgcagaggaaaaaaattaagagaacttaaaatattttcaaaataattggaatctgcactaaaggaactgtgcccgtcaccaataactctcgcaggattgttcataaggaggctgatgtaacctgggtttattttaacaatattccgaagggaatctatttttttggcgataacttccttgctgtggaatctgtaaggatttggatgctgtttctgaatgatgtcaacggcaatatcaaagtctttcaggtatccatcctgtgggatttcagaaattgagtattgggaaaatacaactgatgataacaaaaccaatggaaatgtacataacttcttcataaaataaaattaagtccttcctggaatcaatatgcataccatacataccacagattatttgatattaatcattaaatcaatattttttgatgcattattttttttcaaaacgatctgtatattgttcactctttttatttgtattatttttgtgcgatgcgtatttttaaaatcttagcggtaattattatccttttgggaggagcttatgctgcttccatgtattactttgtggacgaaagtaaaaacttcacgattgaaaaagagatcgattatcccgtggataaggtttttgcccagtttaataaccttcagaattttacaagatggaataatttttttaccagctcaccttctatagacattgattattatacgccatacgagggacagggaagtgccatcagttatgtagaccctaaaaatgatactgatggggaaatgttcatcagatatgagaaccttaataaaaccctgaaatatcagctttttgaggatgaaaatgaaaacccgacgctggttgatgttaaatttaagcccgtttctgcagaaaaaacaaaaataatctggtacgtacacactccgaaactgccggtttggaagagagtggaaaacttctggacggaggaccgttttgctgaaaatatcaacaaaagtatggtgaatcttaaaaactctttaggaaataaagtggaaaaagacaaccaaatggcagcaataaagtacgacagcttaatggtagaaaatgaagaaaacaaattgttgctgggaatcaatgtgagtacttcaaacaagaaagatgcgctttacaaaaatatcgtgatgaactataataaagtttataatttcgtgacgatggatcttggaaaaagggatgatgaattcggatatcctgtcctgattactgacgcggataatttcaaagacaaagaggtttcttatttcctcggaattccactttccaagaaaatcggagtatctgataataacttcaattttaggaccgtaaatccgtctcaaaattatgtaatttactacaaaggaaactacgaggggcgaattaaggcaattcagcagctgattcagaaagccaaaaaagacgagatgcgcttcggagatatttgccagacctttattgaacgtccgatggatggacaggaagtgaacgttaagctctcattatcagtatataagtaatttttttttaatttattttttcttaagtttttttaacggtttcagactgttctaagtcggttttttttattaaatttgaagattaattctacaaataaattttaataaatagataaactgtaataatggacagattttcattcctaaacgcagctcattctcagttaattgaggatttataccaacagtacttaaaattcccggactctctagaaccatcatggaaagctttctttcaaggctttgattttgctttggagaactacggagatgacgataacactcaatttattcaggcttcggccagcgctgccccggcagtacaacaacagatttctcaggcagtatctaacggagaagttcctgagcacatcaagaaagaatttaaagtagtaaaccttattgaggcttacagaacgagaggacacctttttacaaagactaacccggttagagagagaagacactatacccctactttagacatcgagaattttggtctttctaaagaagatttaaatacaaaattcaactgtgctgtagaaacaggaatgaaagagccgtcaactctggcagatttgatcaagcaccttgaaaacatctactgtgattcaatcggagtagaatacatgcacatcaataacgttgaagaaaaagatttcatcaaaagatggcttcaggtcaatgaaaatcatccaaacctttctgcaaacgaaaaaacagaaatcttattaaaattaaatcaggcggtagcttttgaaaactaccttcacacaaaatttgtaggacaaaaaagattctcgttagaaggaggtgaaacattaatccctgctttagatcagctgatctcaagatcttctcaattaggagtggatgaagtagtattagggatggctcacagaggtagattgaatgttcttaccaacattttcggaaaatcttacaaacagatcttctcagagtttgaagggaaagaattcgaagaagatgtattctccggtgacgttaaatatcacttgggatcatctaaaaagatcaaaacagcttccggagaagaagtatgtatcaaccttactccgaacccgtctcaccttgaaacagtagctgctttggtagaaggaatctgccgtgcaaaagtagacgacaagtacaaagactattctaaagtattgccaatcatcattcacggtgacggtgctattgcaggacaaggcattgcttacgaagttgctcagatgatgactcttgaagggtacagaacaggaggtactgttcatatcgttgttaataaccaggtttcatttacaaccaactacatggacgcaagatcttcaacatactgtacagacattgcgaaagttacagaatctcctgtaatgcacgtaaatgctgatgatgctgaggcggttgttcatgcgatccattttgctgctgatttcagagcgaaattcggtaaagatgtttatatcgaccttttaggatacagaaaatatggtcacaacgaaggtgatgagccaagattcactcagcctaacttatataaaacaatctcaaaacacccgaatccaagagaaatttataaagataaattattgaaagacagcgttacttccaacgatgtaatcgctaaaatggaaacggaattcaaggctcttttagataaagattttgatgcttctaaagagattgagaagaatgtaatggatgttttcatggctgaagattgggtaaactatccgattggtaaaagaggagcagttcagttgccggtagatacaaaatatgaccttgcgaagctgaaagaactggcaattaaaatgtcaacacttcctgcagacaaaaagttcatcaataaaattacaagacttttcgaaaaccgtatcaaagctattgaaggaaattcattagactgggcgttaggagagtggttagcttatgcaacacttcttgtagaaggtcacaatgtaagaatctcaggagaagatgtggaaagaggtaccttctctcacagacacgctgtcgtaaaaacagaagatacggaagaagaatatatcccgttaagacacgtttctgaaaacagatttgatgtattcaactctcacctttcagaatatggtgttttaggtttcgattatggatatgcaatggcttctccgaatacactaaccatatgggaagctcagttcggggatttcgtgaacggtgcacagattattgtagaccagtatctggcagctgcagaagaaaaatggaaaatccaggacggattggtaatgttattgcctcacggttcagaaggacagggagcagagcactcgtcagcaagattagagagattccttaccctttgtgctaatgaaaacatggtagtagccaatattacttcacctgccaactacttccacttattgagaagacagttgaaatggtcattcagaaaaccattggtggtaatgagccctaaatctctgttgagacatcctaaagtagtttctccgcttgaagattttgcaaacggtgcattccagccggtattagacgatcctactgcagatcctaaaaaagtggaaaaattagttctttgttcaggtaaactgtacttcgaattattagcgaagaaagaagaactgaactgtgaaaatattgcattggtaagattcgagcagttatatccgcttcagacagatgctattgaagccatcttcaacaaatatgaaaacagaaaacaattggtgtgggctcaggaagaacctgaaaacatgggggcatggtcttatatcctgagaaacttcagagatacaggaatccaggtagttgctccggtaccaagcggtgcaccagctccgggtagccacaaaatgtttgagaaaaaccaaaatgcagtaatcaacagagtcttcgacagagacgatgctcctgcaaaaagaccagtaacagcttaatttaaaataataatcaattaaaaaataaaaaatactcgatatgtcagttttagaaatgaaagttccttcaccgggcgaatcaattacagaagttgaaattgcaacttggcttgtaaaagatggtgattatgtagaaaaagatcaacctatcgccgaagtggattcagataaagcaactcttgaattgcctgcagaacaaagtggtgtaatcactttaaaagcagaagaaggtgatgtagtacaagtaggtcaggtagtttgtttaattgatatggatgctaaaaagccggaaggtgctgcacctgctgctgaggctccaaaacaggaagaggctccgaaagctgctgaacctgctaaacaggaagctccgaaacctgctgctccggtagctgcaccacaaacttatgcaacaggagctccatctccggctgctaagaaaatccttgacgaaaaaggaatggatgctgcacaggtatcaggaacaggaagagacggaagaattactaaaactgatgctgaattagcagcagtacctgcattaggaggtagccctcttactgcaacaggttcaagatctactacaacgactaaactttcagttttaagaagaaaaatcgctcagagattagtttctgtgaagaatgaaacagcgatgttgactactttcaatgaagttgacatgtctgaaatcttcagattaagaaaacaatataaagaagaatttgctcaaaagcacggcgttgggcttggtttcatgtctttcttcacaaaggctgttacaagagcattacaaatgtatccggatgtaaatgcatctattgatggtgacttcaaagtaaactatgatttctgtgatatttcaattgcagtttcaggtcctaaaggattgatggttcctgtattaagaaatgcagaaaacatgtctttcagcgctgtagaagcaaacatcaaggatcttgctacaaaagtaagagacggtaaaattactgttgatgaaatgacgggtggtactttcacaattacaaacggtggtactttcggatctatgatgtctacaccaatcatcaaccctccgcaatctgcaattcttggaatgcacaatatcatccagagaccggttgctgttgacgggcaggtagtaatcagaccaatgatgtatgtagcaatgtcttatgaccacagaattatcgacggaaaagagtctgtaggattccttgtagcggtaaaagaagcgatcgacaatcctgttggaatcttaatgggaggtgacgaaagaaaaggccttggattatagttttaacagaattataacataaatatacaatctcgcctaaaaaaggcgagatttttgtatctattaagaaaatgctacaatgatgttttcaaaaatgacttccaatatcaaagtttcagtaatacctgaatatgatagtaaaaacagttatccatccgaaaaccgttacgtttttaaatacaatatcacgatagaaaatgacggaagctttcctatcaaagtgttgaaaagaaaatggttgatttttgacgtaggatttggatatacagagattataggagatggcgtaatcggccttactcctgaaataggaaccagcgaaaatttcgcttatttctccaatgtaatgcttcgttccggagtagggaatatgagcggaaaatacctggtaaaaaacatggagacacaggagacttttgaaattgatattccaaaatttaatctgttgtctgaagtattaagtaattaatgattatcaattgcaggctaagaacccgggttcagtagtctgtaatattaaagttttttgatttttgctttcatataatcatgtacttcatcattactggtgaggaagagtttttcaaatgccagcaaagaaattttggcacatacttcagcatcagctcctgcccggtggtgggtaaaatcaatcttatgatattcagctaagggtttcagtccgtattttggaagataattccatgattttttggcaagctggatactgcacaaatagttcaatttaggggtaaacattccgtaatgctccagacatcctcttaaaacagacgcatcgaaaccggcattatgagcaatcataaggcttccgtacatcatatcctgagcctcataccatatttcatcaaacgttggagcgtcttttacatcttccggctgaattccatgcaccgcaatattgaatttgctgaaataaggaaagcttggcggtttaatcagccacgtttttgtttcaacaattttagaatcctgtaccacacaaattcccatctcacaagctgaacttttctcatgagtggcagtttcaaaatctattgcacagaaatccattattttaaaattataaggtgttgggttatttttgttgctggttactgatttttgtttggaatttaatgttcaaggttttgagtttaaagtgtaaggttaattgaagttataaatttttactcaaataaaatccttagttcataataaataagaaagtcttagttttttctaatccctggaacctatgaacatcaccttcctcccaaaaagtgtttaaaaataagccattttgattgatagaaattcttcttctgatggctttgacgaagtttccacgttcccggaatctgactgtaaaacgcaaaatgagctctcaatacagcccagagatgagaaaaaccatatttgattccaaaatatactccagcaataccatctaaacataacctgaaaaaaattacccagatcacctgtgaaacgggaagatttttaagcaacatagaaaggttgttcctcatgttcaaataggttttctgtgcgctctgtttgttgagcgttccacctcctacatggtaaacttcggactttcctgtgtaataaatcttttttcctgaattgatcagcctccagcaaaggtcaatttcttcctgatgagcaaaaaatctggcatcaaaaccgttttgctcccaaaagtcttttgagcgtatgaaaaaacaacatcctgaagcccagaaaatctctgcttcatcattatattgccctttatcttcttcaagatcatcgaaaaccctgcctctgcaatacggatatccaaggttatcaattaatccgcctgcagcacctgcaaactcgaaataacttctattgtgataggataagattttgggctgtacagctgaaatagaagggttactttccaataattccaatacaggttctgtccagttctctgtcacctccacatcagaattaagaagacaataatattcgtttttgatggctttcaacccttcattataaccgcctgcaaaaccatagttcttatcgtttttaacaatctgtactgtgggaaaatgcttttctaaaaactcaattgaatcatccgtagaaagattgtctatcacataaatatcggcattctgagaaaattgaactactccaggaagaaattgttcaagccaattcctgccgttccagtttaagatggcaactgccagttttttctgcatgtcaatctattttttttcagaatcaaaatttttgatagagtcctgatatttccattttctgtgtgaccaaagataattgtccggatgtttgtgcaaagtgttttccagcaatttatggaactttctaactacttcattctctgtaaacttttccccatccgggtaaattctgtgataattaacctgataataaccacgctttacctttttcatttcacaatagatgaaaacaaggtccattcttgtggcaagcttgtcatatcctatgaaagcaggagtacgctgattcaaaaactctaatccatacgtaatatgagcgtgatggggtgtttggtcagccacaaacatatatgctgagtcaccgttgtttttagatctgaaaatattcagaatcacttcattggcttccagtgcttcatttccgaatttattcctgactttcttcatttgattttcccagaagtcactatttacttttctgtatacaggatggcagtgcgcctgggggataattttcgccagtgcattgatccattcccaattgaaaacatggcctgccagtaaaatgatatttttaccttcctctttggcttcgtgaaataaatgctggttgatatgctgcattctcactctggattctgtttccgaaatgctgaatgatttgatggtttctaccagataatcagaaaaattgaggtagaattttttccggatctccttgatttcttcttcagacttatcagggaaagactttttcaggttttgtgtaataacctcttttctgtatccaactatatgatagttcaggaaaaagatgacgtccgaaaaaatatataatattttaagcggaagcttggaaatcagatataatattttgatcagaaaattcataaaacacgcaaatttagtgataataaaattatggttctatttttgctgagggatatatgttattttttttacttttatattatgaaaaaattgataatattcgcttctttgggattaagtgcttttgctttttcacaagaagtaaagaattcgcctgataacagaaaacaaaaaacagctcttatagtgcctgcagaacaagcaaaattagaggctcagaaaaaggctgctgaagaaaaggctaagcttcctaaaccttatgacccaaaagcagatgctcaggctgatattaataaactggttgcccaagctaagaaagaaggaaagaatgtgatgatccaggctggtggaaactggtgtatctggtgtcttcgttttaataattttgtgcagacaactcctgaactgaaggaattagtagataagaattatgtttactaccatctgaacttttctccagacaataagaatgaaaaggtttttgcccaatatggaaatccgggtgaaaaatttggttatccggtttttatcgttttggataaggatgggaaaatgattaaggttcagcaaagtgatgttttggaagaaggaaaagggtacagtaaagaaaaagtaaaagaattctttactacctggaccccaaagaaaggataaaaatataaaactgcttcagaaatgaggcagtttttatttttatgtattgatttatagatatgttataatacaaatagttaaatctgtacaaatataaccttcagcattacattaatttctttatccagcttaattttttttccgaataaggcggatatttgatatttggttcaccccatgtggctttttcaagaatggctttttgatgtgagaacgtttcaaaaccatactttccatggtaatttcctataccggaacttcctacgcctccgaatggcaggttatcattgctcagatgcatcactgtatcattgatgcaacctcctccgaatgaaagtttccgtgtaaagatttctttttcttcagaattattggtgaaaagataagctgccaatggtttttcaagctctgaaacagtgttgagaactgcattatagctttgaaaactgatgacaggcagaagaggaccgaaaatttcttcctgcatgatttcgtcattccaatctatatgattcagaatagtaggttcaatgtacaaactttcttcatcaaaatttcctccggaatagattttttctttatcaataaggcgtataagacgctggaaatttctttggttaataattcttgtatattgttcagaatccggttcatattgaaattctttaatatatttcctgagcatttccagaaactgttcctgaatggtttcttctatcagcagataatccggagctacacaggtttgcccggcattaagaaattttccccatacaattcttttggctgcaatttccagattggcatctttggtgacaatggccggggattttccgcccaactcaagcgttacaggagtaagatgttctgccgccgctttataaatgatctttccgaccttcgtgcttccggtaaaaaatattttgtcaaattttaattttaaaagagctgtcgtttcttcaatacctccttcgtacacataaagatactcagaaggaaagttttcattgatgagtgaagccattgctttcattgtattttcagcaatttcactgggtttaaggatacagcagtttccggctgccattgcaacaataacgggagaaagagataattgataaggataattccacgctccgattaccagcacacagccaaggggttccttataaattttactgtttccgagttgattgacaaggttggtccttactttctgggggtttgaaagcgcttttaaattactgatataatagtcaatatcattcagaataaaggataattcggtagtgaaggtgtcgaattttgattttccaaaatctttgttaattgcttcatacagcatattctcattagaaataataagatttttaagcttttcaaggtacatcttccggaaggcaatacctttggtttgctgtgttgcaaaaaaatctctttgcttcagtagaatactttcaattttcattggtgatttttttattaaacgtttgtatttcctggattgtattgatcggaaattatgataataattgtctattaatttaattaaaaacaatataatatcaaataattattaataaaataataaatattgaaaaaatcattgtttggtgataaaaaatattgtagatttatttgtataaaatttgcggatgagaaatttattctatctattttccttattcttctgttatttcagttacgcacaatgtacaaactgcggaattcaaaaccctactgatccaaatttccattttcccgacaatacaacggtttgtttcagttccgatatgacatttaataatccaacctttggaaccaattccaagatttgtattgcttccggcgttaccttgcaatttcagaatagtataagtggcgtagctaatgctcctgcggtttttgaagtgtatggaaaacttaattttatccagacgataaccagtgttgctgatcttgatgtacatgtttatagcactgggagtattacagtgggaggaggaaatggtaaccttaccattggaggacaggataataaaataattaatgaaggacttattgaaatgggagtgcttcaattaggtgataataccaacaatatcattgataatttcggaaatctcaatattaatgggaacctgaatatgagtaattctgcgaccactttatttagaaacgaaggcggcggcttgatatcaatcactggtaattatggaaataatgagcagagcgtgtatgtcaattgtggtactattatatctcagaacggatttaacattaatggcggtaaaatcatcaataccggcatttttactgtaggaggcgatattaatttatcaggaagcagcagcgaaattcataatttcggtctttttacttccaccggaaatatgaataatgcaccggctgatgcagttatttataatgaggggcaattgaccttaaatcaattccagggaggaaacgcagctatccagggaccttcctcatcatcaaaaaaaggatatatagtcctgcaaaatcctatacaggtaggaaacgttgttgtaggtcctaatcttgactttaggagaaccaccggcgtatctgatcccagtactatcttcatgaacagtaacccaagttttctggcgaatgttacttacgattgcgcttccacaaacagttgtagtgctcctttgatcatcaatccgggattttgtcctgccattaacggagccttacctccaatggcggttgatgatacatataccattgttgccggaggatcttctgcaggaattgtactggataatgactttgaaacctacggcggagcacaggcaacactttctaatgttttgctatcacaaatatccacttcaaactcaaatatttcattaaatacagctgacgggcatgttttagcagctccgggaacagctccgggaacgtactcgctggtttatcagatctgccagacagcttctccatcaaattgtgatacggcaatagttacggttacaatccaaggaactgtaccttgttataaaccggctgtaacagggggtacttcgctttcttcaaatttcggcattacttcactgagcagggcagatagtggagagagtaactggccgggagtgagaaaaggagcatgggtcgtattggaatcaaaaaataaaggttttgtccttaacagacttaccgatactcaggttgcagcaatccctcaggcagaccttaaagaaggaatgatgatttataataccacacagaactgcctgcaggttaatattgacggaacagcaacaggctggaagtgctttaatacccaaacctgcccggattaaaagaaaactgaactgtatgaaaaaaattaccttaataatagttatagcagctttcggatattgtaatgcccaggttgcttttgggaaaacgactttagaatcagcttcatcatctattgaattcgggaatgaaaaccgcggacttgttcttccctgggtaaccaatacatccggtattcagaatgttgtgaatggtactctgattttcgatacttcggatatgaaggtgaaagtttatcagaataatctctggaaagatctttcagtagatggaacaggtactgctgatacaagtctgcaggatggtttaacagacaagccggatgcagaagtttccgtaggggcaccatcatcagtctcaggaattctggtgctggaggataataataaagcgatgattttacctaaagtagcctctccccatcttactattgtttctcctgcagccggaatgattgtgtatgatacacaaaaaaaacagctggctgtttttaatggtacagtatggtctttttggggtgagtgatcctacatgatattccttattgctatttttaccggatggtaaagcaataaaccaattgcagtaacaagagccagccagaacagtcctgtaaaaatttccatattggaaaggaggatggattgagctgtgattttagctttaaaagccccagctgttatggaaagagaatcattcaccggaagcctggaaaccgcatttccgaaaatctgattccactgactgtaaaaaacaggattggtatctgtaagattagcgctgagtgcgtcagaatgttttaacgttaaaaataacatcaggttctgcatcagtgcatatccgatagcagttgtccagaagcgggttgttgtccccagggctgtagcattggatacatattcttccttagttcctgaaatcaaaaagaaaacaagcggcgtaaataataacccctgggctgttccctgcaggaataagggtggacagatcgtagaaagagtagtatcaggataaaaagtataggtaaaccatgcacagtcaatggcaagtaacagaaatcctgtaaagaaaacaatccttgaagatacaccgcgaaccagacacagtcccgataatacaatacccaacagcgtaccggcaacattccagtattggatgttcacaatataatcccatggccatttccatacggtagccatgatgctgtaaacattattcagtcccgagcggatcaggtaaaaaataaaaaaaaggatcattccggcaatgacatttctggaactgaaaacttcaaaatgaaaaagtggtcttttggaatttctctgtttaagcgtaaataatcctcctgaaagaagaaatataaaaaggcacatcataatggtatcggattcgaaccacatgagtcttttaccgtagataattgcataaccgccagcctgcagagaaacccaaagcaaaaaccagctggtaatatccaactgatacaaaggctttttaggaaagaatctgtttttgttgaatagtgcaataccaataatcagtacaaatacatgaaagtaaaccatcatcaggatcatatgccggaaatcataattctcaatacttgatttcagcagggaagtagtgatggttcctcccgtcagcataatcgtatacataaagagataagccaaaactttggcatgtttcgtttttaactccgcaatgatcaaaggaaggaaaatagccccctcaagcaatccgaaaattccttccagaaatctgatgaccaaaataacatgatagtcgtgggttactgacagaatataaagaataatcacagaaatagaagccatcagcagcacataatatttcacgctgaaataagccataaacctctgtaaaactaaaagggtaaccacaaatgtcccatacatcaaaatcattaaatactggatgtcatctgaatctacatccataaaagaagatgtgaaggcgctgttcgaatgtaaaagcgacaacaacatcaggtggggaaacaatgccaagatgagaagcggcagtttcagccattgtggtacccatttatgataaactgaattgtgttgcataattttttaaaacaaaaggcaaaaaagcgaaatgtagaatcgcaaaattgcggttgaatataatcagaccataagtgattttacttttagtataatacctgtttaatctgtttaaaaaaacgcgaaaagacaaaagggcaaggtgtaaagtaaaaggtaaaatggcaaatatgcttaagaaaaaattcgcagattcgctatttgcagttttgccttttcgcaaaaaaaataatttaattgtaaagtctgaaataggttgatgtaaagatattttgtactctaatattctaaaaccctcccacattcagactcatatcttcttagcgctcaccagaacattcattccggaaagcagcttttcattgtctttattgttatcaaggataatttttacaggaaatctctgttcaatttttacaaagtttccggttgcattatccggttttaccaaagaaaattgtgatccggaggcaggagacacagacagtattcttcctttaaattcaacatcagggtaagcatctgctgtaataatcacttccttgctctggtcaatctgtccgagctgtgtttctttataattggctatgatccatttctctttgcttacgatctgaaccaaagcctgaccttctttaatcaattgaccttcctgaatagttttcttacccacccatccgtcataaggagccgtaattaccgtataggaaagataaagtttagcattattaaggtttgcagaactctgctgaatctggcttttaacaggagctacctttgtctgctgttcgtttgctccggctctcactgcatttttctgctgttccaatgccagaagattagcctttgactgttcataggaagcttttacattttcaaattcctgttcggttgctgcgtcttctgccagaaggtttttatatcttttaaaatcctgttctgttctccagatatcaatttttgcagacgcaattttagcatcaatgatcttggtgtcgctttctttggtattgacaccgctttcaatagtgctgatggttgctgcattggcatgaaggttggcttctgccatctgtacctggttcaggaactccctgttgtctatgatgattaaagtgtcgcctttatggacaaactggttttcattaaactttattgttttaataaaccctgataccttgctggaaacgggagtaatatattgctcgatctgtgcgtcatttgtagtaacattttttcttgaaaaaagataaaagctgaccatcccagtaattccgctgataatcaggatccaggccagtaaagtaatggacttgttaattcttttttctttttgtgtcagttgtttctgtgccatagtttttataggtttccaatcgtatattggagttggtaatatttaagttgtctgtttatttttacggagataaggttagattcggcttccagataagcattgtccgcatctatcagttctgtgataagactaagcttattggcgtattttgttctaacaatacggtagttttctttggcctgttgaatggcttcctcagcaattttaaccttctggtctgtttcttcaaactttttatacgcttcatatacattgtgtctgattttctcttcattttcctcgatctgaagcttggcaagatcaatattttcctttgcttcctgcattttatacttattcttatacaggctttcaataggataggtaagatttactccaaccattcccagacgataagcatagggctcaggagggaagaacatcatattcgggtattttaaaaagtattctccgccagcggtgatttttggtaaataattcgctttggtaattttctgatccagctccttcagtgagaggtttttgtgggtaatttcaacagattcgtttttgtttaatgcggtttctgtcagttcatcaacatagggaatcgaagcattctctgaaatcaaatcttctgtatcaacgtgcatttcctggctttccggaagggaaagaatcgttttaagtttgtgttctgcaatctgaatgtcattatccaattcagtccggctcattgtatggtttgatagctgcagtgacgttcttaaaacttcgtttaccgttacaacaccattggctttcaaagcttttacctgcttgatgttgacagaatcttctttcattttatcattaataagactttgctgctcttttaaatgatgaatctgcagaaaagcagtaatgatctccattttaagttgtctttcatcaagatgagctttcagtgctgaaatttcagtatcaatgcccgctttcttttccgtgttcttgattttgccgcccatatatacaggaatagaagcagataatgtaaagtcgtacataccattgatgacatcatacttggttgctttgttaaacacgccattctgatgctggaacaggttggttacctgattatagctggtatgaaactcaatgtccggaagtttttccattttgagatctttctctttggtaacagacatgttctgtttcagatgactgatctggatggttttattgtttttcaaaccaatttctatagcttgttgtaagccaagatgctggtaatctatcatctgtgattgtaaaaaactgctcaataataagcacaacgctatgcacagataccggcatgcgttaaatatgatattcataaattaattaaaggatttttgctaaaaatgattttgatgcagcaaagttacgacgtcatgcatagtacccgatttgtgaaaacagaaaaagatttgctcatttacgccaaattgaaaattcttccatacctttatactatgaatgacagccattttaaagcagtagaagaggacgatgccgagttttacgtctatcacgtcctcacaggtaacgtaaccacagagattcattatcacagttctgcacaattggtttatgcagaaggcggtattgtgcatgtttttactgatcagaagcactggtaccttcctgccagatgcttcatgtggattcctgcaggaactccccactatattttctctaccagtcccaaagtggatttatttaatttttattttaaaaaagaagaaaatgaaagtggcttttttgatgaaattaacatttattccgttaataacttacttcgggagatgattttttatactaaagactgggatgggaaaatcacaaaaaatgatcattctaaatattattttctcaaagctcttaaaggtgttctacaggaaaaaaaacacaagcatctggcatttcccatacagcatccttttcccaaagatgaaacactgctgaagattgcaagatatattcatgctaaccttgaaaagccccttacgatagaatccacggcaaaagaattcggaatgagtacaagaaccctttcaaggaaattcaaggaaattctgggcatgaattacgtccgctttctacgtgcattacgaattacacgttctctggaactgatgctggaaggaaaatataatatgtatgaaatcgctatgatggtagggtacaacagtctgtcgtcattcagtaatattttcaaaaagatcattggtgtacctcctacggaataccagcataaactgagaggggataagtagagtggagtgtttgagagtttgagtttcgtgattcgggttacggggcagcgggttctacaacactggataatacttctctacataacaacttgctttttagctaaataagaaggataaaagcttatataactagtaataacagttaagatttcctacattccctttctgtgaaggggggtggattctgcaacgcaaaaagacggggtagttcaataaaaaaaccacttcaatcaattgaagtggtcttgtattgtgagaaattctcagtcgcttattaagcttcttcagttttagcttcttcttttttaggagctgcctcaaccggagcatcagatacgatatcaaactcgtagttgtactcaacatttctgtgaagtctgataagagctgtgaatttaccagttctcttgatcgtgttaccaggaattttgatgtattttttctctacagaaacaccagctttttctaaagcagcagatagatcagcattgttgatagatccgaataatttatcaccagcacctacttttgcaggaatagtgatagaagttttcttcaattgctcaactacagcgttagcagcagcgattaatttagcttcttcttcttttctagcttctaatgtagcttctaaagcagctttgtttttaggggtcgctaaaagtgcaaatccttgagggattaggaagtttctagcataaccaggctttacgtttactgtatcaaactcaagtcctaagttttctacgtctttttttaggataatttccattgttgttgtccttttttagattttagtggtctaaaatcaagttagaattaatgatgtattcagcaacaaaagaagaggttgccctcttcttttatttattttttgtcttatttcaataagtcagctacgtatggtagtaatgcaaggtgtcttgctcttttgatagcagcagaaacttttctttggtattttaaagaagttccggtgtatcttcttggtaaaattttaccttgctcgtttacgaattgtaataagaaatcagcatctttgtagtcaacgtgcttaattccgtattttttgaatctacaatatttcttttcagattttgtattgatatcaagtggagtaaggaattttacttctgattctcctcctgctgaggcttgtttagccatttcatctattgccatgtcttgtcttttttaaaaaatagggttaataattaagctttagctgcttttactttagctcttcttgttacagcgtactcaacagcgtgtttgtcaagttttgtagtaaggtaacggattactctttcgtcacgtttgaatgccaattctaagtcagctactacagaaccttctcctttaaattcgattaaagtatagaacccattctttttcaattgaatagggtaagccaatttttttaatccccagttttctttagcaacgatttcgcagttcttttctttgattagatcttcgaattttttcactgcttcctccacctgtgcatcagatagaacgggagttaaaatgaaaacagtttcgtaattgttcataatgttaaaaaatttgttaattatttcgaggtgcaaaggtagaaaatatatttcttatatgcaagaggatggagtaaatagttgagcattcccgggaagatttattttcttttggatcagtttctggtttcaacttcatctttagctctgacttccaccagaaaattcactttcaaaacatcatacaatgaatgtctgcttactaatatggaagcaatagaagatatcattccggcaagcatcagatggaatatcagcgaatgtctgtcggtcatttccagaacgataatcgctgaagtaaaaggggctctggtaattcctgtaagaaaagcaaccattccggccaggaccacaacattcgtttcattaggtgtcaaatgaatcgctcctgaaatgacggaacctatactggctcctgcagtaagggccggagcaaaaattccaccagcacctccggaagtaaaggacagggcaggccctagcattctcagaacaggaacataccagtcttcgtgcttgtctttggtaaaaagaacccgctccatgatctcttttcccgaacccagaatttctctgttgatgaaataagcaatcgaagcaataattaatgcacaaattaccaggaatatcacattggctttatctgttttcagttttttctttttccagctgttgattttaagcatgatgactgagagctgactggcaagaatgccggccgtagctgcaacaagaatgatcggaaacatgaccattaaagaaacatcattggttttcggatatcccagatataaataagaccctgccagtgtctgtgccgtaagacctgcaataattactgctgtaaacaacgctgttttaaagtaattgatatgggtttttgataattcttccaccgcaaaaacgattcctcccagcggggtgttaaatgccgccgcaagtcccgctgctgctcctgtcataatcatgttcttcttggaaatctttggccaccattcaggaaggtattcattgacttttctgaaaacggagcctgcaatctgaattgttggtccttcacgtcctacggcgccacctccgattaccagaataactgaagacaggattttgaaaaaaataatcttaaggctaagaagacttctgattttgcgatgttctttgggattggcaagttctacagctgccataacctgcggaataccgcttcctttggcgttcggagcaaattctttaacgagccaccatgaaagaacaaatccgatgggagcaataatgaaaatcatccaggcatgccagtcaaaaatgaaattcatcagatgttcgccccatgcaaatacctgtgcatacatcaccgcaaaaaagcctgtaatcacagacccaatccaaaagggaatcgcctgaagcaggttgtgcttcagctgttcgttccggatgttgtcgaaggaatttttgagggatttccgtatcaggatgaaaattttcagcatttgcaggttttgagggatgaatttacggtaaaattttggaaattatatttcgtttaaaaattttgaaatcatttcagcatttttaaccgtaagaatatcaggtataccaaagcttaaaatgctgtttctgacttcaagcttaaagctttcatcagggaagctttttattgcttcttttcttttttgggttaaaaaactcatggttttaaatgaatcacttcccacgacataaaaatctttaaaatcaggatctttaaaattcacggagaaactgctgaaaattcctgcaatcttatccattagcttctttttattaatggaaatatatccaaagtcttcttttaagttttttagtccccaaagctggatggtgtcatatttacgatctaaacgtccgcctttgaaatttattcccactttactgatgataaaaagatagaaagggttattgttcacatcctctaccaggtaacagatgcgtggaataaataacggatacatatcaaaagaactgaactgttcgtaaggagactcactaatatcaataactgaaatatcataagagagagaaagcagatcatagatttcagtaatgagcttttcatcctgttcggtgaaatcaaaaaaccttgtgacatcatatttcctgtaatccggatccattttcttatatattatttgtttaaaaataatgctaatcaatttaatttccaagaacttattataaattggatttaaataattattgtttttataaatttaagcatatttaattagttatttaataatgattttggttattgtttgttcttttgaaatcgagtgaacttaaccatataaaaaacaaaaaaacctccgattaaatcgaaggtttagtatttaaaatcaacaaaattacttattgctgattactcattacttatatttctgtgttcagatcccagttttcaaggtagtcatgaacgtgcttcagcatcattcctcccaaagaaccatctactactctgtggtcataagagtgagacatgaacatcaggtttctgattgcgattacatcaccgtcagcggtttcaagaactgcaggcttcttaacaatagctccgatggctaaaatagctacctgaggctgaggaataattggggttcccataaggtttccaaagcttcctacgttagagattgtatacgttgcaccctgagtgtcttctggtcttaattttttgtttcttgctctgtaagcaaggtcattgattgcttttgcaagacctgaaagagagagctgatccgcatttttgattactggaacaataaggtttccgtccggaagggcagtcgccataccgatgttgatatttttctttttgatgatgttatcaccatttacagaaacattgatcattgggaaatcctgaattgccttcactacagcttttacaaaaataggcatgaaagtaagcttttcaccttcacgtttttcgaatgcagctttgtttttatttctccattttacaacgttggtaacgtcagtttcaataaaagaggttacgtgtggagcaatttgttttgctttcaccatgttttcagcgatgatctttctcattctgtccataggaatgatctcatcacctgcatttaccggaaccgtagctgccggagcagatactgctactgccggttgtggagtagaagctgcctgtacaggagcggcctgctgagctggctggcttcctctgttggcaacgtaagctaatatatcttcttttgttattcttccttccaaaccgcttcctttgatggatttcagttcagtttccgaaatattttcctgttgtgcgatagattttacgagtggagaaagataaagatctcctgagaattctacgtttgaagcagctgctgtctgcaaaggctgttcaatcgtttttaaagtttcagcatccggagcagccgacggagtttcagttttcgcttcttctgaagctgtaccttctccttcaatttctaaaatagcaatggcttcacctacttttgcaacttcatctttttgctttaaaattttcacgattttccccgaaactggtgtcggaacgtctgaatctactttatctgttgcaatttctactacggagtcatcctcctttacgttatcaccttcattgaataaccaagtgataattgtcgcttccataacaccttctcccatggaaggaagcaataatttgtattctgccatttttgatttttagattttgacaaatatataaaaaaaatcggtttttttaagaaatatataatcttagctaaattcgatgtaaatattttctcccacattcagtccaaacaggcttttggcgccgtttttcctgcttcctttatagatggtaagctccaatagctggctatcattgaaaatagcagcagactgtccgtggaattccgtttctctgtcccagtccgaaaccacttctgtatggctggaaaatatccttgacaggcttaaattcctgaattttatagtaaaactgttgtaacctttgctgatattttcaaaaaaatctttattaatatttgatattatatttccgaaattatcaatataggtgacttcaccaataatcattccttccgattcattgtaaactgctcgcgggaacattaattgctttgcagaatgtatttttcgtcctatcacttcaggaagcccgccattggcaagatgtaccgctgcgggaacaaaaatatccgtagaagtgaaattgatgacatcgtcaaagcggttgttcagcgtaagttcatagatggcctcaggcttaatatcaaaaaaaataaggcttaaaaggccgttatccgctgccagaaagtaagatccgtcggccttatagagtatattttttcttgatttatggtgaaaactgtctaccgaaaggatatgaatgcttcctttaggaaaatatttgtacgcatttcttacaatataagaagtctgtataaggttgaatgcctggatttcgtgagtgatatcaataatattaacctcagggtttagagacagaattttgccttttacagcggcaactctgtagtccaaatttccgaaatccgaagtaagggtaataattgacatgagtaattttagaatagtctagtattgcaaagttatttaaataaaaagaaagcccgaaagattgttgaaaagaatttgatataaatttgaaaaaaagctttaattttaaaatctaaaaataaaaatactacatgtttgaattaacatatgatttggaagatatcgatgcaaaaatcttctatggagttaataaccaatatttcaacttaataaaatcaagctttccaaccattaaaattacaggaagagatcattttatctttgccatggggaatcaggaggctttagacatactgaaacaaaaactggatgatattgtcagttttatctccaaaaacaactcaataggactgaaagacgttgaaaatatattgaatattaaagacgaaaacgagaaacagctggtatttgaccaggatattatcgtaaaaggagtcaacggtaaagttatcaaggctaaaacgaccaatcttaaaaagctggtgaaggaaacggagaaaaaggacatggtctttgccattggtcctgcaggaaccggaaaaacatataccagtgtggcattggcagcaagagctttaagagataaagaagtaaaaagaattatcctgacaagaccggctgtagaagcaggggagagtcttggatttctgccgggcgaccttaaagaaaagctggatccgtatttacagccattatatgatgcactccgtgatatgattccacatgaaaaactggaagggtttatggagaaaaaagtaattgaagtagctccgttagctttcatgagaggacgtacactggatgatgcttttgtgattcttgatgaagcgcagaacactactcatgcgcagatgaaaatgttcctgaccagaatggggatgaatgccaagtttattattaccggtgacccaagtcagattgaccttccgaaaaatcaacagtcgggtctgaaagaggcaatgaggattttaaacggggtgaaggagattggatttgtacatcttacagaagaggatgtggtaagacatccggtagtaagaaagattatccttgcttataacgatgaagagaaaagattgaggaatgactaattctgtatcagtaaaagttttgttaactttttattaaccttaaaattaagacaaaatttggtgttttaaaaaaaaataattagtttcgcagtccttaaatgtaaaactaattaaacatgaaaaaacttttacttgctgcagcagtcgctgtaatggggatttctgcaaatgcacaggaattcagatttggtccaaaagccggatactcttattctacaattaaattaaaaggagataatcagtctgaaacttcagatcctttacatacattttatatcggtggtatcgctgaatataaattgagtgataagtttgccctacagggagaacttttatactcgccgcttggaggaaaagtaaacgtagctgaagcggatccggaagatccaactacttttttaaatgtaaaggcaaagcagacttaccatactttattggttcctatctctgctaagtatttcattacagaaggattgtctgtttctgcaggagcaagcttcggatttattctttctgcaaagcaaaaacttactgctgatttcggattcggaattccagggttcgagattgatgctaatgacgaaagagatattaaagaccagatgaacactttgaatatcgctcctttcctgggtgcagagtacgctcttgaaaatggattgttctttgatgcgagatacaatcttggtgtttctaaccttgctaaacatgctgaagggaatgaaaagctaactaacagcttcgtacaggtaggtgtaggttttaaattcggaggaaactaatgctggaattttaatatcaatcatgatataaatataaagcagggcaaattttgtcctgctttttttcgttgtagaccgttttatcttaatgatgaaaataattagtatttttgcaaagtaaaatttaaacttaaaaaaaatgaaaaaactattattactaggtgcttttgcgcttttaggaggtgttgctcaggcacaagaagggttcaaattgggtggacatattggtgttcctgtatctgatgcaagtgatgtatcttcatttacattaggagtggatgctgcttatatgtggaatattgcgaaaggttttgaccttggggtaacaacaggatattctcatttcttcggaaaagatcactttgatgatttcggatttgttcctgtggctgtttccgggaagtataaatttaaaggtgctcctatttttgtaggattagaccttggatatggtatttctacaaaagatggggtagatggtggtttctatgcacaacctaaattcggatatcagatgtccaaaggagagctgtatatcggatatcagtctatcagtaacagacgtgattatggttggtacaagcatgattggaacgtaggcgctgtcaacttaggatttaacttctttatcaaataaagacagcttaaaaataactgaactccggccgaaggccggagttttttactatataattagctttacggatgttttgatggaagtttttaaataaaatggatgttactggaatacaaaaaacaaaaaacagaaccatataataaacgtttgtttaaattttaagagttaataacttaaaaattaacaatttaggttaattgtttttgtagttttcccagaatccatggtgtttcagaggaaaagtgaaaatttaaaaaagtaaatatatttaactcttgttgataaaaagtgatttttttattcataatattgtgaaaaactcaacagtatctcttaagtatgatttatttttataaaaccctaaaaattagtactgatattaatcacattaacaaattttaatattcgtggtagccactgtaaatttgccctcagaaagtattaaaattttttacaatgaaaaaaatattattagcgggtgctgttgcactttttggtttatcaaacgctcagattgctaaaggaactacatatttatcaggatctgttggttattctcaagaagaaactaacaacggtaacgataaaaaagaaaacttcaacgtattacctacagttggatatttcgtaaacactaacttggcaatcggattaggagttggttaccaaactgaaaaaaacaccctgactagcactgtgggtaacactgtaagtgaaagcgtaactaagcaacctgcttttgttgtggctccattcgtaagaaaatactggactttatctgacaagttatatttcttcggtcaattagcagttccaatgcagtttggtaaaactgagaatgaaactaactctgtaactacagtaggaaacacagttgttacaagctctacttctactgaagctaaatacactaaaatcggtgttactgtgaagccaggtttagattatttcttaaacaagaactggtctatcgaagctactatcggtgagttcggttacagcaactacaagccaaaagatggtgatgctacaaacaactacaacttcggattgaatttatcttctgtaactttcggagttaaatatgtatttgcaaaataataaacaaagcatatagcaagaaagccctgagaaactcttagggctttttttctgtaaaactaatataatagtcatgaaaaaaatcttattgatgggcgctgtagcgcttttcggtttatcaaatgcacagattgcaaaaggaacttcttatctttccggacaggtaggatattatcacaatgaaagtaacaaattcgaaacccaaataaaggatgatgtgatcagaattcttccaacagctggatattttgttagtaacaacttagcagtaggacttggtataggctataaaagtgccgttacaaaatattatgtaagtggcgctgtcattgccaatccatatgaaattaaatatacggataatgcatttgtagtcgctccgttcgtaagaaaatactggactttatctgataaattatttttattcggacaattacaggtcccattggagtttggccaggaaaagttggattttaacagtaaaggtaatggtggagatcctatactttccgctccgtttacagaaaaaaataactacaccaacatcggagtgaatattaaaccagggctggattatttcctgactaagaactggtcaattgaagctacaataggggaattcggatacaatacttacaaaaaagacatggaaggagctaaaagaactaatgattacaaatttggaatcaatttagcttcagtgacttttggagtgaaatatgtatttgcaaaataataaacaattatatactttagccctggggttaatatcccgggcttttttaagtttgaaaactatttaattaataatcatgaaaaaaatcttattagcgtctgcaattgctttatttgcaggtctgaatgcgcaaactacattcggtgtcaaagccggttatgctttatcaaccttaaattctgatgctaacagtgtcgattttggaggaataggagcaagccttgagtctaaatccggtttctatatcggaggtttggttgaacataaactgaacaataaatttgcattacaaggagaagtggaatatgctaatctgggaggtaaagcagtggtaaaagcttccggtgttacagtaactgaaaaactgaacttcaacagaattgttattcctgtatctgcaaggtattatgcaactcctgaactgggactttatgcaggtccgtatgtaagtttcagaaccaatacaaaagctaaaattgaagtgagtggagctcagtctaatccgagcgctatcaacgaaggtgaaaaataccttgaaaactattttgataatggtctgaagtctacagaattcggtttattcttaggtgctgattataatgtgtataaaggattatttgtagatgcgcgctacagcttcggtcttacgaatatgatcaaaaatcctgtggatggagaaaaattaaagatgaatttcttccagttaggaataggatacaagtttaaatagacggatatctatataaaaaaacaaaactctcaggatttctgagagtttttttatgaataatttggactttcttattttccgaacattccacccattccaggcatattcggcattttgctcatcatctgcatcatttgttttccctgaggtccctgcatcatcttcatcattttacccatctgatcgaattgcttcatcaattgattcacgtcttcgatttttcttccggcacctttagcaattctgttttttctctgcgtattgataatagaaggttttcttctttcttcaggagtcatagagtaaataattgcctcaatgtgcttgaatgcatcatcactgatttctacatctttgattgcttttccaactccaggaatcattcccatcagatccttcatattacccatcttcttgatctggttgatctgcttaaggaaatcatcaaatccgaattcgtttttagcaatttttttgtgaagctttttagcttcttcttcatcaaactgctcctgagctctttctaccaaggaaacaacgtctcccattcccagtattctgtctgccatcctttccgggtagaaaagatctaaagcttccattttttcccctgtggagataaatttgattggtttttcaacaacagaacggattgttaaagcagcaccccctcttgtatcaccatctaattttgttagaacaactccgtcaaagttcaaagcatcgttaaatgcttttgctgtattcactgcatcctgacctgtcatagagtccactacgaaaagagtctcctgtggtttgatgaaataatgtacggatttgatctcgttcatcatctgctcatcaattgccaaacggcctgcggtatccacaatcacaacatcatgaccgtttgattttgcaaaattgatcgcattttcagcaatcgtagacgggttggtagaaccttcttcagtataaacaggaactttaatctgtcctcccagtactttcagctggtcaattgctgcaggacggtatacgtcacatgctaccagtaaaggttttttatttctttttgtctgtaaataattagcaagctttcctgagaaagtagtcttaccggatccctgaagacctgcaataaggattacagttggttttcctgaaagattgattccttcctgagaacctcccatcaggtctaccagttcatcatgaacaattttcgtcatcagctgtcccggtgtaagggaagtaagaacgttttgtcccaatgctttatcctgaactcttttggtaaggtcttttgcaactttatagttaacgtcagcatccaccaatgctctacggatctcctttacggtttccgccacgttgatttcagtaatttttcctctaccggaaatattatgcaatgccttgtctaatttatcctgtaaactattaaacatatttattgtaaattataggtttgcaaaaataaggaatttttagcatatccttatcattattttataaaccacggaatacagtactttttagatattattatcttgtatagtttattttctaatctttttttgtataatttaatattccagaaaaaataaaatatcttattctttggattaataaaaaatcaagtctgcccaagaagtcatccatatcttttgagcctgactggcgtgaaaatagaataagcttttcgtaaggctgtgatagtaaataagattttaaatcattaataccagtttcaatttgaatattttgacggaaagttttaaggataatgctttctaatcccagataatattcaatcagttcatttttttcattcaacataataatgtactcacaactctctgcgtctttctgtaagttttcttttaagaattttctatccgaggcgtaagtccaattccatttactttgatttatatatacatttttcgaaatttctactgattgtttcaaaaaccaactatcatcatgatccaaaaactctagtgaattttttttatttacaaagttttcaaagtactttgtaatattggattctttatctagtgttttgatatcatatctctttttctccaacagatagatgtcctctaattgttcagcaattttagttcccttaaaattttttaaaatattttcaataaattctataaaattattaatttctggaataatcttaacttctgaagaaaaatatttatttaatattctaggaagagactctttaagaaagtccagagttctcttaaaaaaatggcctaaaattatagttcttacttcgatgatatcaatgaaatataagtcattagctggtatattatgatcataaaaaggctctagaatattttttgtatcgatattattattcaatagctttaataggaaatagactttacttagttctccaaaaaataatccaccagagatatcattatattgaatgtctttaataattttttttgtaaactcttttagtggttcaataaaggattgatttgtattaatttgttttaagtaaaatagcccaaggctactgctgccattaaatagtgatgtgttttcaaagctgttgatttctaattgtgataaatcatagcaatagttttggttccaaggtattaaattgcctagtaatccttggttccactctgtttgaaaggaggagaaagaaagtaactccttattttcaatatattgagtaagatattttgaaaacatttctttatttaaaatatctttttcaaagtttttaaaattactttgtttaaaatcccagtttgaattgatatattgatcaatatttttaatgatatagtctatccctatatcttgagaaattgtataaataatcagaagagaatactttataccagcagcaccgaaagcaaatccaactgagttttttatatttatttcttcatgttccttccaagaaatcccattttcagcaacttcacaattatttagaatcttaagataaattaaagatatatatttggacaattcttgatctttagttagaagatacaaattcaccaaggtaagaagtgtacctgctctgccattaaaaatatagtcactggtataagaggagtttataaattccctaagatccgatatttggacaagttcaagacaaatatttatatattgatgattatttgtaatttcaaacaattgaatgagagtataaattacacctgatcttcctgcaaataatgaataatcttgagatggattttgaagacagtaatttattaaattgtcagccattttttctatcttttctaaacttattatcctaagatgataaaattctatcataagaataattactccgctataacccgaacatatgttttcaggagcattaaatgttaaagaatttttgtttttaaagtgttgttctttaaagtcttcaacagttagaagagatagcttattgcatatttgatttaggaattcaaataatttttttttctcccattcgtctattatattaataatatccgcagtatctgtattcatgcttatagttgcttggtccttagtaaatttattatttcgtagtaatattctggaaaatcagttaaaagtctatgttctaaaatttcattaattgtaggtagccccttataaaatccaacagtgtggataaaactaacagtattgggaacttgtgtgaagtttgcaataccatcaaaagatggattaatatctgaaataaaaggagaaattattttattagatttttcagctaaagcattgaataagaattgttcataaacagtattaaacatgccaatatcaattttttcaagatgcggaatatttttatcaataaattcaaatgctgattgagtatattcttgaaaaaatgcaatatcattccctccaaataacccagcattcactgaaattattttattgtttttctcgatggaatcatgcagagcctgaggaacgtagtcaaaagcctctttcaattcattaaaaaccttgtcatagaagaaaaaacccttttcaaagttttgaacaatcaaacttgctttttcaagtgataaagggaaaggtttataaatataaatatcactatcaatgtgaataaatggttctgtttgtattctataagcatgtaatttaccaactgcccaaagatcgggatgataatgattgagctcatcaagaacaaccgaaacatttgtgtatggaagtttaagtttgttgataaggatatcataacctttttcgtctgtaaccagctctactttttcgtaaaattttcttagttgcaggcaacttagggcccaactcatataattgtgttttttacttagccaccctcctttatttctgtcagttgaattaattttattattcttaaaagttggttttgtccaaaagctttgaattatcttcatgaaactgaaaaaaaatttgtttcaaaaatataaaattaattttaaataaaaagtgctgtaattcaaaagagatttatatttttggggtgagaaattaattctctacgatgttgagataaaagggaatgaaacttaacataatatcatatcgtagagaattaatctgaatttgtaatgtacagttcggtatgagaaaaaaactaaatgaccacctgaattcaatcgaaaatgatacaatggagtttttgaacgaaatagcagaaaattattcttctgctatttctttagcttcaggaagacccgatagtagattttttgatcttaaaaaaattgatttctatatcaatacttatctcaactttatttctgaaactcaaaaaaagccttatgagactgtactctccaatttggggcaatacagtgaggctagtggaattattaacgaaataatcgctaaatatttattggtagaatatggcttggaaacaaccccggaaaatattcttatcaatgtaggaactcaggaaagtctgttgatttctgttcttacactatgtaacaaagaaaatgatattattattgttgaagatccgtgttatgttgggataaaaaactatgctcttattgcaggatatgaggtttctggagtgaagcttcatacagatggtatgtgtctggattctttggaaaaaaagattctaagttatcaggaaaaaggaagacatgtcaaaatagtatatatagtttctgattttcagaatccatctgggattagaatgtctattgtaaaaaggaaagaaataatagagctagcggaaaaatatgattttttcatccttgaagataatgcctatggtgacttttgctttgcagatgagatgtttcctactttaaaaaagttagataaatacaatagagttatttatttacatacattttcaaaacttatttatccttctgtccgaataggagtaatggttgctgattataaatttgaagatgggagaagcttgagcaaccagttaaaaaaggtaaagggatatacaacggttaatacatcctctataaatcaggcgattattgctggaattttaatagacaatagtttttcattaaaggaatataatagagaaaaattagaaaatctcaaagaaaagaaaaagttaatactcgatgctttacaaaagtactttagaggtaatagtgaagtgtggtgcgaaaatattaaatggaatgatccggaaggcggttttttcatggttattgatttaccgtttaaagtaacacaggaggatgttattacatgtgctgaagtatttggcgtaatctttacacccatgtcttttttccaattagatgaaattaatgagaaaaatataaggattgcatatagcaatataaaagaagatagaataatcactgcagttgaaagactttacaatttttttaaaaacaaaaatgagaatgaaaaaaaagaatgttaaatcggaacttcacaatatcaaaattgagtttgtagaattttatgtaggaacggcaaaagctgtagtgtattggcatgttaaagctttaggatttaaagtaattgcctattgtggccccgaaacagggaacactgaaaaggtttcatatttgattgttaaaaatgatatcaaattaataattacatcagctataaaccctctttctcatcacatattatcttatgtaaatttacatggtgatgctattaagagaattggaattaaagtaagtgatgtagcggcttattttaataaatccatatcaaaaggaggtattccaattgaaggtccccaagcattaagcgatgatagtggtgtagtagagtatgccattttgaaattgtttgatgataacgaaatattcttgattgataatagtggctatgttggggattttatgcctggatttataaatattgagactgattgggaagatatcaatgaagaaaattctgaaatttcggaaattgatcatatagcatgtgctttaagaataaatgagatgtttctatgggaagattatctgaataatattctggcttcaaaaacaattgaagaatatgatgaaagaaaaacattagacagtgataagaaaataggaatgtatttaaaggcgttacagacgcaaaataaaaaaatcaataaagtattggtagaacctgaattaaataagaagaatcaagttcaattatatattaccgaaaattacgggtcaggaatacaacatttagcatttaaaacaaataacattgttaaaactgtcgaagtattaaagaaaaatggtgtaaaattcaataattaccctgactcctactatgtatccttacagcagaaatatccagatatggatattcaagatctcaaaaagtatgggattttatgtgatgtagatgaaaattccctactattacagactttcacttctcccatcggagatagacctacttttttttatgaatttattcagagggttaatgactatgatggttttggcttaaataacatacaagcattatttgaggcactggaaggtgaaattatgaaataatttatgaataacaaaaaagctaagcttgacaaattgacgtcaattgtagggacagaacgcttattaccatacattggaaagaaatatgaagaacaatcttttagtccattggctgttatttttcctaaaactacatttgaagtttcagagattatgaaattttgctatactactaatcttaaagtaactgttagaggaggaggaagtaatgtaaatggtggagcaatgtcatgtggaggtgatattattttatcattggaaaaactgaacagcatattagagattaataaaattgaaagaatcgtaactgtagaagctggagttgtaacagaagtattacaaaaagaggtgaagaagtatggattatgctttcctcaaaatatcagtagtgcaggaatgagttttatcggaggaaatattgctatacgaagtggaagtcccaaatcatttaaatatggtacaactgcaaactatatactgaatctcgaagtagtactccctgacggacaggttatttggacaggaaagaatgttaaaaaggactcttcaggatataatcttactcaattatttacaggaagtgaaggaacattagggatcattacaaaagcggttattaagcttatcccattgaaaaaagaatggcttttctttatatcatttccttcaataagtgatatgtatgatttcattaacgaagttcttaccttgggactcaatccttcaagtatagagtttttggatacaaagggttttgagctggtctgcaattatttgaaagatacgagaatgattgttaatactggtttctgtatctggatggagtttgaaactgaagtctggcaatctgaacttcctgaattggaagtcatgaatcaactgattggcaaatattctaatgataatgctttgtttgcggaatcatcaagagagaaagaagagttgtggaagtataggaataaaataggagaagcatgtttagattattctgaatttgttgattatgatttttctattccattttctgtttcccaagaggtatatgaaaagattacagcaatcctcgaagaatttaattttgaaagtataatcgttggacatattggtgatggaaattttcatatcaatgttttttgtgacaaaggtttgtcttcagaacaatgggagtcaaaaatatatcaatgttttatgatgatcacctcagttatagtaaattttggaggaagtgttccaggggagcatggagtaggttatctgaataaaaaatattttaatctttcagtaggtgaaaaacaaatagaactgatgaatggaattaaaagaatttttgatccgaaaagtattttaaattttgacaaaatattttaataaaaattgaacactcatactaaaattatagctttaccttttgctggaggagggaaacattcattttatcgatttgcagaaaaagtctctcacttttatactgttgaatatccaggtaggggaagtaggtttaatgattcgtctattgacaatatcgaacttttacttgaagatttactacacaccattttacctcatataaatacctcatataagtactttttgtatgggcatagcatgggagcactgttagcatatttactatcacataaaattgaagaaataggattacaattaccttccaaattgattgtttcaggtaaaaattctccttgttgtccaagaaagcgtgaaaaaatctcagatcttccttcggacgaattttggagggaactgaagtcatatggtgggatttccgaagaaattatcgctaatgaagatattcgaacgcattatgaacctatcataaaatcagattttaagattgtcgaaaattttgaatataagccaatgaaacctttatcaataccaattgatatcttctatggtgatgatgaagagatagaggactttgaaatcataaagtgggaggagaaaacaatgaaaacagttaatattaaaaaaatgaagggtaaccatttttttatatataggcatgaacaatatttagttcaatattttaacaatttacaaaaaccatttaaaactcatatatgataaagatctctagaaaaagaattcttatgctttttcttttttcgatccctaatactttgtttagctttttgatgcttcatatcataaatagtgttgtaacagacggagtttctattattaaagaatataaaggaattgctttttttctattggcgatattatcatatatttttactttattattccaaaaaaaacttatatatctttccaaaacgttcgtttatgataatgaattaaagatattccaggcattacaaaaaacttctttgggtaaaattgaaaaattaggcacggaaagaatttatagcatagttgaagatattagagtatatatttttttgccagatactatggttactgcattaaactcctttttaacacttttggtttatataggatatcttatttatatatcaagtttctcgactattattattgttattttattggtttccatgatcacttgtcatataatcgtaggaaaaaagttgtctaagaaagtagaagaaatcaaaaaatacaatgataaatatttcaagtttgtagaagactctatcaaaggatttaaacaatttaaaataagtaaaaccaaaacacaaaacttatataaaaaatttctaagtcccaatagagaagctgcaaaaagaaaagatatcatactgtcaaacagctttttgggagtaaatcttcttagccaatatggattatatttcattttagggaccattttatttattttgcctgcacttaatgtccttgagaaagataagattaattcttttctagttgtattcctatttatcttaggaccaattatgaccttagtttcaacacaagagtttttcactcgaatttttacagcagaaaagaggatcaaggatttttttaatgattttacagcagaaaaagaggtaaatataactccaaaaatcaaaaaatttgaaaagttagaagttagagatctctattttgagtatgataacaatgaaaataatttcacactaaaatcaattaatttctcagttaataaaggagaaattatttttattgttggaggaaatgggtcaggtaaaactacatttatgaatgttctttcagggctttacaaaccgactaatggacaagttctgttaaatgatcaaataattgataataatgatagtaattataaagatattttttctatcgttttttctgacagtcacttgttttctgaaaactataataatttttcgctttctaggaataataaatttgctagtttgttagagctaatgaagctaaaaaatattgttaaatataatgatgaagatttttctataccgccactgtcttcgggacaaaccaaaagaatgcttttgataatgagtttgttggaagaaacacctgtgattcttcttgatgaatgggctgcagaacaggacccgttttttagaaattatttctatagaatattattaccgatgctaagagaagaaggaaaaactataattgctataactcatgatgatgaatattttgatgttgctgacagagttgtaaaatttgaatacggaaaaatattataaataaaactaattaaatcatgaaacttactttatctcaaaaagatatatacaatgaacaattattatttcctgatttacctatttacaacatcggaggtaaaatagaaataaaaggttttatttgtaccaacactttgtataaagcatgtaatcagtttataagagatcatgattcttatagaatgattgttaaagaagaatcggaagaaccacagatagtgtttttagaaaaatatgattttcagatagaatatagagactttagtgaacaggaagatgctaagggaagtgcagaagcatatctgaagaaagaattttcaattccttttagttttagtaatcaaaaactattaaacagatttattttggttaaaatgtctgaggagtttcattgtttgtttacttactatcatcatattattacagatggttgggggtcttcgttaatgattcaacgtattattcaaaattacaatgagatggttacctatggaaaaacaatctctatttatgattttaaataccaagactatgtattggaagatattgaatatcaaaagtcaaaaatatttgaggaagataaaaactattggataaataagtttatagataatattccaaatcaaatttttagaaaaaaaattaattcaactggtctttttaagagcgagagagaggaattaattattgacaggtcattttataatgaattgttaaaattttgtgaaaataaaaacactactttttttcattttatactggcttcattattctcctatgtaggaattagccgctctttaaatgcaatagcgataggtattccaacacttaacagaagtagtcgtaaatataagaagacagctggactttttgctggaatatcaccattaaaaattaatttaaattatagtgagacgtttacggatctattaaaaacaatttctagagaacttagagatgattatcgtcatcaaagatttcctctgggaaagttgatgaatgaacttaatttatcagatcccaatgaattgtttaatattgttctttcatatgaaaagcatgattatgcacatcattttatagatacaataaccgaagtaattcctttcaatcacggattcgaaagagtagctatggctatgtatataagagaatggtatgataatgatgatgtaagaattcactttgactataatcagaattatttggataaagaagaggtttctaattttgttgaaaactttttttattttattaagaaaattcttattgaatatgaaaaacctttaaatgaattatcttatctgatcccatctgatgtggacaaacttttatatggttttaaccagacggatgctgcttatccccaggataaaacagtgattgatctttttgaatcacaggtgttattgactcctggtaatacagcgttaatttttgaagggatatccctgagttatcgagagcttgatgagcgttccaaccaatttgcccattatcttcgcagtccgtctgtttatgtcctttaggagtagtaggagagatctgtatttctggggtgggagttgcacggggatatttaaacaatgaattattaacaaaggagaagtttgtttctaatccttatcttccgggcgagcgtatgtataaaacaggagatttgggccgttggctttctaatgggagtattgaatatataggaaggaaggacagtcaggtaaagatccggggttaccgtattgaattgggagagatcgagctagctcttcaggggtatcctgatgtaagtggtagtgtagtattggcagttgagaatactgacggccataaagagctggctgcttatattacgggaagtactgatttaagcattgtctcacttcgtgactatttacgtggagttttacctgattatatggttcctggtcattatatccagctggaaagttttcctttgacatctaatggtaagctggatcgtaatagtttaccagatgcgtttggatcctctttaggatcggggagagaatatgtagcagcgcgtaatgaaacagaagagaaattaatttctatctgggaaaatgttttagggaaatcgggaataggaattaaagataatttctttgaattaggagggcatagtttgaaagcgattcaaatgataaattcagttcgaaaagaatttaattataaattaattgtatctgtgctatacgaaaatcaaactattgaacatttaagtgaagctattataaaagcagataatacaaatatattagttaaaatgaatacagaaggtagtaaaaaacctttcttttttgttcccaccattataggcgatgttttctcattccatacattatccgaattattagggaaaaaccagcctttttatggtttccaatctccgaacctttatctttcaaagaaaaaaacttcatactctatatctgaaatagctgaaaagataatttcagaaatgcaaaggatagatcccaaaggaccttatacattaggaggctattcttatggtgggcttattgtttacgagatatgttctcaattacaaaataagggaatgaaattaaatgaagtttttttcattgactgtaaaccaccacaaaagaataaaacaataacacactttgaaatcaaagattctatagtttctttttgtaacatggtcaattttatgaatgattcaagaggtagaacagatttaaaaatagatattaatgatttcgaaaagaatacattagataatcaattattatgtctccatgaaaaatttatagatctaggatttttatttagcgtagaaatgttggaatcttatatgtatgaatatatgaggagtgttcagaatatgattgaatataccccttcccatattaaaattgatgcagatattaaattgataaagtcttataattatggaaatcatgcagataattatggttgggaggaattttcttataaaaataaattaacaggtattgaagttgattgtgaccacttagaacttcttaatgagaaaaacattttaaaatatatacatatcttaaaaaaataattcaaatgaatattatagtaacaggagcaagtagaggaatcggatatgatactgtattagaattcagtaaaaataataaaaataaaattattgccatatcaagagatatggcaagattggaagaattaaaacaaagatgtaatgaaaattatggtaatgagattcatgttatttcacatgatattacagatgatcaaaacaaattaaaaaatgaattaaaggattatgagaatattgatatcttaataaataatgcaggtctacttattaataagccttttttagatttatctattgaagattggcaggaaacattcaatgtaaatttatttggagcagttaaaattatacaatctgtttttgataaaatagtaaaaagcaaatatgctcatatagtaaatataggaagtatgggaggaatcagtatagctcaaaagtttgaaggattatcagcttattctagtagtaaatctgcactggcaaaccttactgaatgtctagctgaagagtttaaagattataaagtatctataaattgtctatgcttaggggctgtagacacagaaatgctaagacttgcttttccggaatgtaaagattcttttcaaagtgtagatatagcaaaatttatttgtgacttttcatttaattacgccagattattcaatggtaaaattattcccgtttcttcagcaaccccctaaaatgtaaattgtaaaatatgaaagttaaagtttccagacgtgcaacattcaatgctgcacaccgattacataataatttatggagtgatgctaaaaataaagaaatcttcggaaagtgtaataacccctattatcatggacataattatacattgtttacatcggttacaggtaaggtctgtaaagaaactggattcgtgatcgacttaggttatttgaataatctggtcaatgaattaattatagattatttagatcataaaaatctaaatttagaaattattgaatttagagatttaaatcctacacttgaaaatatgctgattgttatttataataaattaagaaataagattgatgaaaaatacagactggaggtaaagttgtttgaaacagaaaataattttgcagagatttctgatttagaataaagatttaataaaagtgaatagagaggaaatatagttttatacttatttatgttgtagttaaatgtttagtgttatttttgcgtcatgaattttctagatagtttcattgtaattttattaatagccatccttaatattatagtatatataatatttaaaaagtatttatatagaaaacctgatgcaggaatgaaattcttaactattaatatatccaaggatattatttggcttgtcacttctcttcttattttagaaaaaagtaaagctaattttctcttcattgtgatctgctttattattgcatcattctttatttatttatccataataaaactcattaataagtcttgatttttttgatgataaaaatcaatttttaatattggtaaagtttaataaaatcgatatatttgcacacgattaaaaaagagatatgaacagaaaaatttcttcattatttttcgcatttttatttgtgtttataagcagtttagcttctgctcaacatgaatctgatggagagaaatcagcggaaaaagtagagaacaaagaggcgaaagatggcttcaatgcgaccacaatgatcatggaacacattggtgattctaatgaatggcatttatggactacaaaagatgatagtggtgaagaacatcacgtttctatccctttgccaattatcattaaggataatgaaggatggcatactttcctttctagcagtatagcgcacggacacgaacatgatgggtatactttagaagatgggcaggtggtttctactaaaggtgttgaaaaagctactttgttttcaatcattagtggaaaacaaaaatcaaatgaagtgttttttgatctttcaatcacaaaaaatacggcttcaatgttcttgtcagtgatttttatggcagtagtgtttatcggtatggcaagaaattataagaaatctcaacttccaaggggtattggaaaattaatggagcccgtaatagtgtttatcagagacgaagtagctattccaaacattgggtctgttaagtataaaagatatatgccttatttattaactgcatttttctttatttggattaacaacttgtttggattgattcctttcttcccttttggagctaacctcacaggtaacattgcaattacagcagtattagctatcattacattattaatcacattattcagtgcgaataaagattactggaaacacatctttatgccgccggttccaatcttattgtatccaattatggttccaattgagattatcgggatcttcacaaagcctttcgctttaatgatgcgacttttcgctaacgttacagcgggacacattatgatcttggcgatcgtttcattgatctttattttcaaaactccattattaggatttgcatctgtaccattagcattatttgtttcagtattggaattattggtagctgcattacaagcctatatcttcactgtattatccgcactatttatcggaattgcagttgcagagcatgaacatgagcatggtcacgaagaacacgctcattaattaaaagagaataattttaaaaataatttttaactaatataatttatttattatggatttatcaacaggagcaggattaatttacgtaggtatcggtttagcagtactaggtgtaggtctaggtatcggtaaaatcggtggtcacgcaatggacgctatcgctagacagccagaacaagctggtaagattcaaggagcaatgcttattgctgctggtcttattgaaggtgctggtcttatcgcgatcatctttggtgctttcatcaagtaatctatcctcaaaaaacattcttagcagcaaagcggttggctgctgctaagaattttaaaaacaatccataaaataacatttaaaaaaagaatttacagatatgggaattatagaacctggaattggacttttattttggatgacgcttacttttgttatcctattgtttcttcttgctaaattcgcttggaaaccaattgtaaatgctgttaatgagagagaaacttctatcgttgatgctttaaaccaagctaaattggctaaaaaagagatggaagagctgaaagctgataacgaaagaatcattcgtgaagctaaaatcgaaagagatgctatccttaaagaagctagagaaattaaagacagaatcgtaggagaagctaaggatgttgctaaagctgaaggagacaaaatgatcgaagctgctaaacagactatcaacgctgagaaaaatgctgctatggcagacatcaaaactcaaatcggtactttatctgtaaacattgctgaatctatcttgaagcaaaagttagacaacagcgaagctcaaaacgaattagttcaaaattatttaaacaaatcaaaccttaactaataatgcttacatctaaagtagctaaaagatacgcacaaggtttacttgacttcaccaacgaggcagggcaaacggctactgtattttcagaaatgaaagatgtagtaaaggtaatggctgaatctaaagatttaaacaagtttttccttactccttacatcgattctaaaaagaaaatagaagtagcaaacgaaatattcaaaggtttatctgtttcttctcaaaatctgatcagattggtgattaaacacggacgtgaaaaccaattgaaaaatatcgctcaggaattcatcaataaagttgaagaccttagtggtgtacagagagtaacgcttactacagcaactccgctttcaaaagaaaaccttgaccagattttaagatctacaaatcttgtaaatgctgattcaaactttgatctgaaagtaaatgttaagcctgaaattcttggaggatatattctgagagtaggtgaccagcaggtagatgcgtctgtgaagacaaaactgaaccaagttaaaaaagatttccaattaaattaagaaaaacaaccatacaatggcagaaataaatccggcagaagtatctgcgatcttaaaacagcaattggccaacttcgatactcaatccaacgttgaggaagtaggtacagttttaaccatcggtgatggtattgctcgtgtatacgggttagaaaacgtacaatacggagagttggtgaaattttctagtgatgtagaaggtattgtacttaaccttgaagaagacaacgtgggtgttgctctacttggtgaaagtaaattagtaaaagaaggtgatacagtaagaagaacaaacagaatctcttctatcaaagtaggagaaggaatgttaggaagagtagtagatactcttggtaacccaatcgatggtaaaggtcctattactggggatttatacgaaatgccattggaaagaaaagctcctggagttatcttcagacagccggtaactgagcctttacagtcaggtatcgttgcgatcgactctatgatccctgtaggaagaggacagagagagcttatcatcggtgacagacaaacaggtaaaactactgttgcgatcgatacgatcatcaaccaaaaagaattctttgatgctggtaaaccagtatattgtatatatgttgctatcggtcagaaagcttctactgtagcacaaatcgttaaaaccctttctgataaaggagctttagcatatactgtaatcgttgcggctaatgcatcagatccggttcctatgcaggtatattctgcgatggcaggtgctgctatcggggaattcttcagagatacaggtagaccagcgcttatcgtttatgatgatttatctaaacaagctgttgcttaccgtgagctttctctactattaagaagaccaccgggccgtgaagcttatcctggagacgttttctatcttcactcaagactattggaaagagctgcaaaagtaattgctgatgataatatcgctaagcaaatgaacgacttgccagaatctcttagaccaatcgtaaaaggtggtggttcattaacagcccttccgattatcgaaactcaggctggtgacgtttctgcatatatccctacaaacgtaatctctattacagacggacagatcttcctggagtctgatctattcaactcaggggttcgtcctgcaattaacgtaggtatctctgtatcaagggtaggaggtaatgctcagatcaaatcaatgaaaaaagtatctggtacattgaaacttgaccaggctcaatataaagaattggaagcgtttgctaagttcggttctgaccttgatgcttctacgctggcagtaatctctaaaggagaaagaaacgtggagcttcttaagcagccggtaaactctccacttcctgtagacagccaggttgcaatgatctatgctggtactgagaacttattgagaaacgttccattgaacaagattaaagaattccaacacgagtatatcgagttccttagatctaagcaccctgatacaatggctgctatcaaatctggaaaaatcgataacgatattacaggtgttcttaagcaggcagctaacgatttagcttctaaatacaactaaaaaattcaatgtttaaggtttaaaatatagcgttttaagccttaaactttagaccttaaactttgaacccaaattaatggcaaacttaaaagaaatacgaggcagaattacgtcaatttcatctacgatgcagattacacgtgctatgaagatggtttccgcagcgaaacttaaaaaagcacaggacgcaatcgtaatgctaagaccttattctgaaaaattacaggagcttatccagaatgtaaattctagctctgatcctgaccaggtttctgtatatgctcagaaaagagaggttaaaagagtacttttcatcgctgttacttcaaacagaggtcttgcgggagcttttaactcttctatcgtaaaggagcttaacattcagttccagaacaacgctcagtatgagattgaagttcttccggtaggtaaaaaagtatatgatgctgtaagaaaaaaccgttcggtttatgctaatggaagttctgtttatgataatctgaactttgatacagttgctcatattactgaaggagtaatgacaagcttcaaagaaggaaagtttgatgaagtttatgttatctataacaaattcgttaatgcagctactcaggaagtaactacagaaaaacttcttccgatctcaatgcctgaaaatacagagccacaggttgaaactgattatatctttgaacctaacagagctgaaatccttgataatttgattccgaaatctatcaaaactcaggttttcaaagcgatcttagattcagtagcatctgagcacggagcgagaatgacagcaatgcacaaagcaacagataatgctcaggctttaaagaatgatcttgtgatcttctacaacaaagcaagacaggcagcaattaccaacgaaatcctggaaattgtttccggagcagaagctttgaaaaattcgtaaagaattattttaacatacaattaaagcaccgatattatcggtgcttttttattttcacaaggctgaaagtgccatttaatacccaaaaaactctttattgatatcataatgagaatatacctcaattattttttttattgagaaaaaccagcatcagatcacttcagatttttctttcaaaaattccttcatcgaaataatctatcccggattcaggttatttttattttacatatctttgtacttaataaaatttatacaacttctaaatggactcggacatagtcaggcttttgctggccttatttcttgttttactaaatggctttttcgtagccgcagaattttcaattgttaaagttcgttattcgcaaattcagttaaaagctgcagaaggaaattctatggctaaacaggcagaacatatcatcaagcatcttgatgaatacctttctgctacacaattaggaattacattggcatctcttgccctgggttgggtaggagaaagtgccctgcatcatattgttgaaaatatttttcattcccttaatatggaaatgagccaggcttccattacttcggtatcactggtgatcagtttcgtattaattaccatcatgcacattgtgtttggtgagcttattccaaaatcaattgcgatcagaaaatctgaagctactaccatggcaacagctgttccactgagaattttctacctgatctttaaaccgtttatctggttgatgaactctatgtcgaatggtttcctgagattaatcaaaatccatccggcttctgaacaggagatccactctacagaagagctccagcttctggtaaaacaaagtgccgatagcggagagattgaagaggaaaactatgagatcatcaaaaatgcatttgattttacagaccattctgccaagcagatcatggtgccgagacagaatattacttccatagactttgaagaagatatcaatgagattatcaacaagattatggacagcggatattcccgtattcctgtatatattgactccattgacaatgtaatcgggattttctataccaaagaaattataagggaatatgtgaaaagaaaaggagatcttgatcatgaagaccttaaagatcttatgagagatgcattctttgtggtagaaagcaaaaaagtttcagatttgttgaaaacctttcagcttaaaaaacagcatattgccattgttattgatgaattcggaggaacagaggggattattacgctggaggatattcttgaagagctggtaggggaaattcaggacgaagaagatgatgaggaaaaaatcgttgataaaatagctgagaatacctattgggtacaggcaactcagcctttggacgaaatcaatgagttcttacctaaaaaactgccgctttctgaagaaagtgaatataattcattagcaggatttattctttatgaactggaagagattcctgaagaaaatcaggagtttgacctggccaactatcattttaaaattctgaagatgaataataaaagtgttgagctggtagagttggtgtatgaagagcccagcactatagataacttagcagacaaaatcggagaagtttaaaacaaaaccgtaacaatgaatttttataacagtataaaagattacgaaaacccaaaacgtcagtatgaagaagaagtccttgttctggatgatacggatgacgtttataaactggtactgcacaatgatgatattcatacctttgattatgtaattgactgcctgatcgaaatatgcaaacatacccttgagcaggctgaacaatgtacgattcttgttcactacaagggtaaatgtaccgtaaaaacaggttcaatggatgttttgaaacctatgcatgaaaaattaatttcgcgcgaattaacaagcgaaatcgtataagataaagtccggtaaattttattaccggacttttttatgaaatctaaagagtaaatttgagtaataacaataaatcataaagactggctggtttcctgaaaatattttaatctttaaaagctttaatcttttaatttctcaacacacttacattgtcatattttatctaaaatagtatatttgtaccaactataaagaaacaaaaaaacaatgcttgtaataggaattgccggtggtacaggatccggcaaaactactgttgttgacaagatacttcagcagcttgatattgagggaatgaatatcctctctcaggataattattatcacgacaaccagggtcttacattgacggaaagagaggctttaaattatgaccatccaaaatcaatagactttgacttactgataaaacatgtaaaagctttaaaaaacaatgagccgattgaacagccgatttacagctttgttacgcattccagaacaggagatcatgtcactgtagaacctaaaaacgtattggtagtagaaggaattcttgttcttaccaacaaagaattactgaaagaatttgatctgaaggtatttgttcatgctgattctgatgaaagattaatcaggagaatcaggagggatacccaggaaaggggaagagatctgagtgaggtattacaccgttatcagaccactttaaagccaatgcaccaggaattcattgagccttctaaaaatgaggccgatctcattatcccgaatatgaagcagaattccgtagcgatagattttttaactactgttattaaaaactcgttgaaaaaacattaaaaaaatggaagaaaacaaccttatcaaagacattcagccgaaatctgaaacattcaaacttattcagaaatatgttttgaacaagtataccattacgatctgtctgtttttggtatggatgatttttttcgataaaacctcatttcttgtgattaacgaactgaatggtgagattcataaatatgaagagcagctggactattataaaaaagagtacgagaaaaatgatgctttttataaaaaactgatgaacaacaaatcagagaaagaaaaatacgcaagagaaaattattttatgaaaaaaccgaatgaagaaatcttcattctggtggtagacagtacaaaagtcgctaagaaataataaagttgaatagagaaattcactattgacaattcacaaataaaaaactaatgtcaaatacagatatactttcaaactgggaaaatttagtcaaaaaacagcttaaaacagaggatatttatcctgttttagagaaacagaatctggaaggaatagaggtgaagcctttttatacaaaagtgcagaagcctttggtaaacctgccacgagttgaagaaagtacccatctggtagcaagataccatgaaagtctggaagaggaagtatttgcatttatattggatcagaatgtagaaaatctggatcagaaaactctttttgtgaataataaagatcttgcagggcatatcagtcctaaagaagaagatcagtatttttcgctgatcgatgtttttaatgaaaaagaaggaaatattgatgatcagctggcaaaagaattactggcaaaaggttttaaaagaagcatctgtgtagacatttcactccaccagaatgcaggagcggcaatttatcagcagcttggtattgctcttgccaaaacaaaagagctggtagaagcatacagtgctgaaattttaaataaactgatcttcagaatagcagtaggaggaaactatttctttgaaatggcaaagctgagagcttttaaaatagtctttaaccagctttccaaagaatacggactggatgaagttccttacatcttcgcagagacttcactgcgaaataaagccgtttcagacaatgaaaacaatctgatccgatctacactggaacttgcttccgcaatgatcggtggagcagacgctgttttctctaacaattatctggtggacagaagtacagataattcagaagaaatttccttcaagcaacagattgttctggcctacgaaagtattatcaatgtatttgaagatgcttctaacggaagttattatgttgaagatatcacccgtcagtttgcagaaaaagcctgggctttatttgttgaaatggaagaagcaggaggatatcttgaattattaaaacagggagttgttcagaaaaagatttatgatcatgctgtggaagagcagcaatggatagaagagggcaaaataaagctgataggagtgaatctataccctaaattagacattaaaaagtctgtcgcagatctttacaacgaaaaagaaataaaggcggtacgctgggctgaaatgtttgaataatgaaagaaaaactgatcgatttatttgaatacacctatcatttcaatgctgaagtgattaaaggtattgctgagaacagagaacttgtagatgataaaacaatcagtctgattaatcatactcttaatgcacagcagatctggaatgccagaatactaggagaaactacttttgaagtatggcagatcaatccatttgagtctctgcaggagattaatcataagaattttcttaaaagtattgatcttatcagtagtcttgatttagataaaaggatagaataccagaactcaagagggacaaaatttgaaaacagtatttttgaaatgctttttcatgcagtcaaccattccacctatcacagaggacaaatcaattctttgcttaagcaaaacgggataactccagtagcggctgattatattttttataaaagataatttgattaataatcattttcgaataagattttgtattctgatacgtaaaatgagacattaagcatctatggaaatcttttatgcggttaagaaggaatgaatacattcaaatatttaaaattacgtaaataaaacacaagcatctgtgaaaatccgtgtcatctgtgattaaattaataaacaaggaaattcaaaactacatcaatgcaaatctgaatacagatttacacacattactgctgaaaaaatctccatttcctgaagtatcgatgcatgaaattgttcagcagatcaaaggaaaacaggttgccgaaagaaaattcccttttctgttgaaagaaggtgtcatttttccaccgcagcttaaccttgagcagtcatcatcagaaaaaactgccctgtacaaatcggcaactttaaaaggaaataagtttattgatctgacaagcggttttggtattgatgcctattatctgtctcaaaactttgacgatattactttaatagagcagaatacagaacttctggacattgttgaacataactggaagattttaggccgccaggcaaaatttatcaacagcagacttgaggatttcctaaacgaaaatcaggaacattttgatgttatttatcttgatccggctagaagagaccagaataaaaacaaagttttccttttggaagatctttccccggatattcttgaaattcatgaaaaattgcaagctgtttccagtctggtagtcattaaactttccccgctcatagatcttaaataccttgtttcagtgctgccgggtattgtaaggattgatattattgccctgaaaaacgatgtgaaagaagtagttgtttttctatccaaagcaaatatgggaaaagttttctgcaattgtgtaaaccttgatagcaatgaagctgcctttacttacacatttggggacgaagaaactgcacaagctgaatactctgagcctgaaaaatacatttatatcccaaataatgccgttttgaaggcaggtgtttttaatttgatttcgcagaaattcggattgaaaaagcttcacccgaatagccatctctacacttccggtgaaaagatagataattttccggggagaatttttgaaatggtaatgattgattctaaaagtattaagaaaaaaggtcagtttaatattatttcaaaaaattaccctttaaaacccgaagaaatcaaaaagaaatatggtttaaaagacggaggagaccagtatcttatttttacacaatccaaaaaaggaaaaattatattaaaatcagtataaaaatgttgccgaaaaaagcaggatttcttacttttgggcaatcaaaaatttaagcatgagatcgcttgctgtttggaagattatacagactgaaaatagtgcggtttcatattacctttaaaaaataattttacatatgaaaaaattagtgatatgtttggcgattgcaacggtggcggtaagctgtaaaaaagttccgcaaggaggaaacagaggtgctttgaaacttgaagaaggagtagaaagatattctgatgatcctcagggtggagctcacgggcatgaagctgctgcagcagagcacaaagaagagactcctgcacaaccggaagctgctgctccgaaaacagacagtactgcggctgcaaaacctgctgaagctgaaaaagctccaaaagctgaacactaattacaagtacaaaatatataattgccctgtttctgcagggcattttttattaaaaagagtgctacagggctcattagcatgacgttgggaaaatcctgcctttttgtttgcccctgccggtcattttttttaattttaacaaaataaatttttacaatgcaagagacattaaattacattaacgaaaacaaacagcgtttcgtggatgaattatttgagttattgagaattccttctatttctgcagatcccgcgtataaagatgacgttttgaaatgtgcagacgtagtggcagcacaccttaaaaatgcaggagctgatcatgttgaagtttgccagaccaaaggatatccaattgttttcggagagaaaattttagataaaaatttaccaacagtactggtatacgggcattatgatgttcagccggcagatccgttggaattatggaccaaaccgccttttgaaccttatattgagaaaacggaattacatcctgaaggagcaatctttgccagaggtgccgcagacgacaaagggcagttcttcatgcatctgaaggcttttgaagccatgatgaaaaccaatgctcttccttgcaacgttaaatttattctggaaggagaagaagaagtaggatctgtaagcttaggcgactgggtaaatgaaaataaagagaaattagcctgcgattgtatcctgatttccgatacacatatttacagcaacgaacaaccgactgttacaacagggttaagaggattaagctacgtagaagtagaagtggaaggtccaaacagagacctgcattcagggctttatggaggagcggttccaaatccaatccacgttctttcaagaatgatcgctgatctgattgatgaaaacggtcatatcaccattgacggattctacgacaatgtagaaacggtttcagatgcagagagagctgaaatgaacaaactgaaagataatccggaagaattcaaaaaatcaatcggattaagcaatattgaaggggaaaaaggctatacaactttagaaagaacatctatccgtcctacgttagactgcaacggaatctggggtggttatacaggagaaggtgcaaaaacagtaattccttcaaaagcttttgctaaaatttcaatgcgtttggttccttaccagactccgcaggagatcacggaaaaattcactaaatattttgaaaaaatcgctccggatacagtaaaagttaaagtaactcctcaccacggaggaatgccatatgttttaccaacgaataccaaagagtttgctgcagcaaagcaggcaatggaatctgcattcggaaaagaggtgcttccatacagaggaggaggaagtattccgattacagcgatgttcgaacaggttttaggcgctaaatctgtattaatgggattcggattggattctgacgcaattcactctccaaacgagcattacggactattcaacttctataaaggaattgaaagtatcccgttattttttgagaattattcaaaataattgaacaaaaataatatatgataaggtatttctgagaagagataccttattttttgttttattttctatcataaaatacatttagaagcatatttttaaagggctgaaaaattaaattccctgataataaaagcgttattttttatttgcaataagttatttcaccattcatggaaagtttatatttttaatacaaaacttgaactactatgaaaaaatactactcaattgcactgttgatatcatcagtttgcatttttgcacagcagtccatatcctttgagtctactgaaggattcaacgctggagatatcaacggacaggcaggatggatcagtactcccaccggaggagttccccaaaatgtaacccatcagaccatcagcatggataaggcaagtgatggaaacagttccctgaaaattgtcaaagaaaatacctacggaatccagagtgctcccattatcggagggttttacaacttgccgacacctcttgcctacaacaatttttctatatcattcgatattaatatgtcacaacttaatggctctgattttggttttcagggagtaaatgatatggatgatcagtttgtaatgagattggattttgaaaaaaacggattggtaaagctcctgaatatggtatccggtatacagaacctgattactgtttcttcaacctggctgcctaatagctggtatcatttaaaagtaatagggaccgccacagatgtcagatattaccttaatgatctgttgatttataccggcccggcagcaagctctctacctataaaccagcttcgttttgtacacaataatgcattgggttctgcctatattgataacattaaaatcaataatcaggcaactctatctacaaaagatccggttaaaaatgaggtgagattatcggtttatccaaacccggctactgagtttataaagatcacaacttctcaaaaaataaggcatattgaagtatatgacctgtcaggaaaaaaaatagatgtaccggtgaatggagagcaggtatatgtgaaaaatctgccttccggaacttatttactgaatgtggaaacagatggaagaaattttacagagaagttcatcaaagaataaatcctgataaatcttagtatcagcaaaacgccccaattggagcgtttttgttattttagagaattaaaaattaaccatatgtcagaaaataaaacagcttatataacaggaggaaccaaaggaataggtttcggaattgcgaaaatattacttgaaaacggaatctctgtcgcattttcaggaagaaaaagggaagatgtgatgaaggcggaagaagagctcagacagtattcacaaaatgtattgggaattgtttctgatgtaagaaacctggaaagtgaacaggaagcggtaaaatatacgattgaaaaattcggaaggctggattatgtggttgcgaatgcaggattggggatttttaagcccgtagatgagcttaccgccgaggaatggaacgatatgatagaaaccaatctcacgggtgtattttataccttaaaagcctctgtggaagaacttaaaaagacagaaggttattatattaccatctccagtctcgcaggtgccaatttttttgaaaacggaacaggatacaacgcatcgaaattcggggtagtagggtttacgcaggctgcaatgattgatttaagaaaatacaatattaaatctacagtgattatgccggggtctgtagcaactcacttcaatggaaacgttccttcagaaaaggacagttggaagattcagcctgaagatatggggaatctcgtattggatattctgaagatgaatccaagagttttgccaagtaaaatagagtttagggcaacaaaaccagcgaagtaactacatctaatgtattgaataataatttaataagtattatgcatgcataatatattttttatttatattagcaaaaattaattcagacaaaatctctgcataaaccatcatgattttatgcttcaaagagaaaaataaaaatagtacacgtgaaaccctaaggttacatatgaccaataaaaaaattaagaacaacatatgaaaatattagtttgcattagtagtgttccggatactacttccaaaattaactttacagcagataaatctgctttcgacaaaaacggaattcagtgggtaatcaatcctctagacgaatttgcgttgacaaaagcggttaaacttcaggaatcccagggagcaacagtaacagtaatcaacgtaggagatactgctacagaacctgttatcagaaaagctttggcaattggtgctaacgatgcagtaagagtaaatcttgatccgaaagacagctattctacagcaaaagaaattgcagctgtggcgcaaaacggaggatatgatcttatcctttgcggaaaagaatctatcgattataacggaggttctgttccgggaatggtagctcagttattgaaccagcctttcgtaaacgcttctgtaggattagacgtaaacggaagtgaagctacagcagtaagagaaattgaaggaggaaaagaaactatttcagtaaaattaccggcagttattgcaggtcagaaaggattggtagatgagaaagatcttatcatcccgaatatgagaggaattatgtctgcaagaacaaaaccattgcaggtagtagaaccttcttcttcagaagtaaaagttcagggtgtatcttatgacagtgttccgccaagagcagctgtgaaaatggtttctcctgacaatctggatgaattggtaagattacttcacgaagaagctaaagtaatctaatctttaaatttttcaatctttaaattttaaatgtaaaacaatggcagtattcgtatacgcagaaaatataaacggagtttacaaaaaagcggctttcgaagcagtttcttacgctaaagctatcgctgataaggcaggagataccgttacggcaatctctgtaaacccaactgactcttcagatttattatacaaatatggagcgtcaaacgtaatcaatatcaaagacgaaggtcttaagaacttctcagcaaaagcatttgcacaggcggtaagcgaagtggcagacggaaatatcatcgttttccctcacactactgatgcttcttctgttgctcctatgcttgctgtgatgaaaaactattctttaatcactaacgcattggaagctcctgaaaacctttctcctttccaggtaaaaagaagagcattctcaggaaaaggtttcatgcatgctaaagctgaaggaaacggagtaatcgttacggtttctcaaaatgctttcggtgttaaagaaaatgcagtatcaggttcagaagaagtgaaaaacctatctgtagcgaatgaagataccaaagtgatctctcacgagcagagctcaggtaaattagaccttaaagaagctgaaatcgttgtttctgccggtagaggaatgaaaggtcctgaaaactggggaatgatcgaagatctggcaaacgttttaggagctgctacagcatgttctaagcctgtttctgatatcggatggagacctcacacagagcacgtagggcaaacaggtaaagcgatttcaccaaacctttacatcgctgtagggatttccggagctatccagcaccttgcaggggttaactcttcaaaaacaatcgtagtaatcaacagtgatcctgaagcaccattcttcaagtctgctgattatggagttgtaggagatgctttccagattattcctgcattaacagagaaaattaaagcaattaaaggataagaaagtgaatagtgaatagtcgcttgcttttcaatttttaattaaataattcactcgcaaagcaaaattcactattgacgtttgaccatcatcaacaatacaataaaagctcggctttccgggcttttatttttgcgtaaaaaagtgaaaacacaacaaaaaattaatctatatttgtagctatggattataaacagctaattattcgcggaatatcgtacagccagactcaatcaggcgcgtacgcattgttactggagcatgaagaaacacacataaaattacctgttgttataggaaacttcgaagcccagtctatctctctaggattggaaaaagatattcatccgccgcgtcctcttacccatgatttattcacaaaatttatagtctctgccaattatgagttggtttctgtcattatctatcagattgtagacggagtattcttctccaatatcaactttaaaaataaagtgacggatgaagaactgatccttgatgccagaacttctgatgctgttgcgatggctgtaagattcgatgcgccgatatttacaacccaacaggttttaaatgaagccggaattttactggaacttgaagacgtatcaaaagaagaccagtctttctcagaaactgtacagacagaagataacttaaaatctctttctatggaggagcttcagaaactattggatgaagccgtgaaagaagaagactatgatactgcccttgagattcaggaagaaatcaagaggaggaaaaagaaaattgattaaagagatactttttatataaactatgaatttaaaattacgactgactgtcctgaattttcttcagtttgcagtttggggagcttacttaacttctatgggaaattatttaggttctataggattaggctccaaaataggacttttctatgcaatgcagggaattgtttctatttttatgcctgcaattatgggaattattgcagatcgttggatccaggcgcaaagacttcttgggatctgtcatttacttgctgcgggatttttaattgctgcaggatattatgggatgtcagcaggaaacaatgttgagtttcccaaattatttactttgtatagtttgagtgtgatgttctatatgccttcaattgcattgtcaaactctgtagcctatacaattcttgttaataataatttcgatacaattaaagctttcccaccaattcgtacttttggaacgattgggtttatctgtgcaatgttatttgtagattttacgagttatcagaataattattcacagttttttgtttctggtattttaggaattattttattcctgtattcatttacgttgcctgcatgtcctgttaataaaagcaatgaaaaaagaagcttatatgatgctttaggattaaaagcttttagtttgtttaaagataaaaaaatggcaacattctttatcttttcaatgttattgggagtttcccttcagattactaatggttatgcaaatccgtttataacaagttttaaagatattccttcttttaaagaaacatggggagctaatcatgctaatgcattgatttccttgtcccaggtttctgaaacagcatgtattttgttaattccattcttcttaaaaagattcggaattaaaaaagtaatgctaatggccatgttcgcatgggttttaagattcggattatttggatttggaaatcctggtggtggtgtatggatgtttattctgtccatgatcgtctatggtattgcattcgatttcttcaatgtatcaggttccctctttgtggataaagaaacagataagagtatacgatcaagtgcacaaggagtttttatgatgatgacaaacggtttcggtgcaacaattggaatgcttctagcacaggagattgtaaaccattatgtattttctcaaaccgatcctttgctgcaactaaaaggatgggaaatgtcctggtatatttttgcaggatatgctttagtcgttgcagtattgtttgcttttattttcaaacacaagcacaatccgaaagatgtttcatccgtaaaacattaattgaaactcacattttattaagatattaaattgcattttgaaaaaaatgcaatttttttatttaaagatggttatgcgaattaaatctgcttttttcataaggactttacttctgcttttactaataatgcttactgaacaaaaaatatggtcttcagataggaatagaaatagcaagtgttgattttaaatttaataataaattcattttttctttacataataattaaaaatatcaaatattttttatgtctaacaagtgttcgggtgccaaacttctatttttaaaacacactatttaaaagtgtgtttttttttgtattttggcactttagtaaatatgaaaaatattcagttattaggtttaattttagtcatcgtaggcagctttttacctttggtacatgtgcctgtcatcggaaactggaactattggaagcttgatcattatctggctattatctgctggattttttctgcttgtgcggtttttggaattgtaaataacagtgccggagttgttagattttttggtattctgcttattcttttattcggatttacattagttgctgtgaaaatgcagtcgcttcaatactttagctttttaccattcaaatcatggcaggaaacttttgcgggaattgttaggttaaaatggggatgggctgtagaattttcaggtgctttgatgatgatttttgcaggaagaaataaaaaagtaaacaatagaacacaaatataaaaatgaatttcttaaaaatattttcagcaggaattttgctgacagcagctattcagatagaggcccaggcaacaggacagaaaaagccggataatccgcctaagtgtgctaatattaaggaagggaagttcgtaagacccaattatccggaagggatatggcatatgaccattaaggataatattcagactgaatatttgaataatggaaaagattatatcaaatcgacactggtttttgtggatgattgcaattacaaggcaatcgtgatggaaaaatcagataaaaatgatcccgcacagataggagatgttttcaataataaaattgtagccactcaggacaaccttctgaaagtgaatactaaaattgaaggaactcaatttgatgtggtgtacgtaaaagtaaaataaattcaaactataaaaagggattaagttcccttagctaaaataaaaattatatacatgaaagaagtattcattgtttccgcagtaagaacacctatggggagttttatgggaagcttatcaacagttccggctacaaaactgggagcaactgccgtaaaaggagcattagataaaatcggtttagatcctaataatgttcaggaaatctatatggggaatgttcttcaggcaggggaaggccaggcgccggctcgtcaggttgctttaggagcaggtctttcaatcaatacaccatctactacagtaaataaagtttgtgcttcaggaatgaaggctgtaacaatggctgctcaggccatcaaagctggtgatgcagatgtaattgttgcaggaggtatggagaatatgtctttggttcctcactattataatgcaagagtggccacaaaattaggcgatatcaaaatgcttgacggaatggtacttgacggtcttacagatgtatataacaaagtacatatgggtgtatgtgcagaaaaatgtgctgcagactataacattacaagagaagatcaggataacttcgctatagaatcttacaaaagatctgcaaaagcatggagcgaaggaaaattcaatgaagaaattgtaccggtttctattcctcagagaaaaggagaaccagtaatctttgctgaagatgaagaatacaaagcagtaaacttcgacagaatttcaacacttcctaccgtattcaaaaaagaagaaggtacagtaaccgcagcaaatgcatctactttgaatgacggagcttctgcattaatccttgtttccaaagaaaaaatggaagaatttggactgaagcctcttgcaaaaatcatttcttatgctgatgcagctcaggagcctgaaaactttacaactgctccggcaaaagctctacctatcgctcttaaaaaagcaggattggagatttcagatatcgatttctttgaattcaacgaagcgttctctgtagtaggattggcaaacaataaaatcttaggattggatgctgccaaagtaaacgtaaacggaggtgctgtagcattaggacatccactgggaagttcaggctcaagaatcattgtaactttaattaacgtattgaagcaaaataatgcaaaatacggtgctgcagcaatctgcaacggtggtggaggtgcttctgctatcgtgattgaaaatatctaatattctgtttcagaatatattgccattaaggaatcgataatttttttaaaaacttatccatttcttaatggtttttttatttttgtgctactaatatttatttgaaatgtctgaaactgagaatcgacagcctaaaaacataaagaataatccgaagattatgaaggcctgggctgtatatgactgggcaaactccgtgtattccctggttattacctctaccatttttcccatttattattctatccttaccactgcttatgagaagaaagaatatgtagcagaaacaaaatcctggattgatgttccggtaaggcatacgattaaaatttttggagaaggttaccagccggatgctgtatacgggtattcacttaccatatcgttttttgttgtggttttgttgtcaccgtttttatcttctttggcagataccatcggaaacaaaaaatcttttttgcagttcttctgctacctgggagcaacttcatgtatgggattggctatgtttacaggaatgcataatgtctttctggggcttctgttcagtattacggccagtgtcgggttctggggaagtctggtgttttataactcgttccttcctgatattgccacaccggacaggcaggatgcactttctgcaagaggatatgtttacggatatatcggctctgtagtattagtggtgatctgtttggtactgattcaggtttttgccaaaggagctgcgcagcaactactgtttacaagaatcagcttcctgcttacaggagcatggtggttcgggttctctcaatatactttcaaacaccttcctcagtttggggatgtaaaagataagcttcctaaagatcttgtattattgaactataaaaatatctttaaaaagcacgaagagcagggaggctttttcgaagtactgaaagataatcttagcttttataaagacattgcaaaagaaagtttccatgaactgttcaaagtaggcggagagcttttcaaagacagaaatctgaaattcttcctgtcaagtttcttcttttacagcgtaggaatgcagactattttcctgatggcaaccttatttgggaaaagtgaaatcaacctggctcaggataaactgatcggaacgcttttggtcatccagattgaagcgattatcggagctgttattttctcaagattatctaagagaatcggtaataaaaatgttatttcaattgctatcatactttggattatagcatgtatatgggcctatttccttaacaaagaaaatcctacggtagagtaccagttctatggcgtagctgcagtggtaggccttgtaatgggtggacttcaggcgatgtcaagatctacatactcaaagctgcttcctgaagactccatggaaaatacaaccttcttcagcttctatgacgtgttggagaaaattgccatcattattggaacatttatctttgcaacactgattgagcattttaataatatgcgtattgcagctttatcaatgactgtattttttggcgcaggattaattttaatacgattcctaaaggttaaaatgagaaaagacagagaaacattataaaattgaaagacgttattttaacgtcttttttattgtattttatttttaaaattatgtttatttattatatttatttcgtaattttattaaaagaactgacgaaagtaaaatagaaaacaattcggcctgagttttgcttatattcagcggaataattttaactttgcaaaaagatttattgtcaaaatgaccaaccctttattttatgcaaaaataatcctgtttggagaatatggaatgattgaagattcccaggggcttgtagtaccttacagcttctataaagggactctgaaatattctgatttaagttctgaatttgagcttaattccaacaggcatctgcagaaatattctgattttcttacaaaacttgatctttccgacgattttaaactggatattgagagtttcaaaaaagatatttcaaacggacttttctttgattccaatattccgcaaggatatggagtgggaagttccggagcgctggtagctgctatttttgaaaaatattcaatcagtaaacttaatcctgagaacatttccaaagataatcttaaaaaattaaaagctgtttttggtgaaatggaaagctatttccatggaaaaagttcaggaatggatccactgatctgttatatgaatctgccgattcttatcgaaaataaagaaaatttagacagggtaaatattcccgagggagaagaaggaaaaggagctatattcctgattgattccggtatgacaggagaaacagggcctatgattcagattttctttgaaaaaatgaaaacagaaggtttccgtaaaaccctgaaagaagagttcatccgttacaacaacgcatgcatcgaatctttccttaaaaaagacatgaacccattcttcagaaatcttaaaaagctttctcactgggcttatgaacatttccgtcctatgattcctgaaagtatctttaacatatggaaaaaaggactggattctaacgcttattatctgaaactctgcggaagcggtggaggaggctatatcttaggatttaccaaagactatgcaaaagcagaaaaaatgcttgaaggcttccagaaagaagtgatctacagattttaaacagcctggaatgaattctgaaaaagaacctttccaatctaaagactatctctcaaaatctctattttacagattttcacaatttgtgggctttttgctcggagcacgtttttttgtagctgccctgctgacatttgccctctatgtttccacttttttcctgttcaatcaggatgaatctttcagaaatttcgtatttgatttcaaagtgcacggtattattttttgtaccgtccttaccattttagctggtggtatcatcaaccagttctatgatctggagaaagaccatttagtaaaacccttcagaaccaggcttcagagttttatcaaacaaaaatattttctgtatgcctacctggcgttgagcgctgtttctttggggattgcctggatgatttcccataatgtttttgttttttttgtaatctaccagttttttatgtggttttacagccataaactgagcagaatattgatactgaataaccttacttttgtcagtctcacgctgtatccgttctttggaatgatggtatattacgaaaccttttccaaaaaggtattcctgatggctgtttttcttttccttattctgttatgtattgatattgtaaaagatacccttacccgaagtgtagataaagcattcggatatactaccatccctaattattttaaaaccagaaatacaaaaatcattctgacctcattattgataattaccatggtggtttctatgaagattattacaaaaaccggtattacaggattcatggcctattattttgccggtggtctttttgtcatgatcgtatgtatttatctccttataaatgcttcccggagaagtaacttctttacattgaatatattacggttctgggtttttataggaatcatagcaatgcttttaaacggaatagagcataaattataaaaaaattcttttaaataaactgaggttattattacctttgcataactaaatttaataaataggaatgcccatttttaatgatactaaaattgcatttgcagacaagtctgatgcacaattgagaaaggcttactggatgtttaaaatgattgaacagcccgctcttacaagccttggaacatctgttctgaatttcacagtacataacaattttcctttcgttacaggaattgtaaaaaacaccttatttgagcagttctgcggtggtgaaacccgtgaagaaagtatgaaagttgtgaagcagcttttcaaaagaggagttggaagtattttcgattactctattgaaggaaaagaagatgaggaaacttttgatgcagtttgcaaagaaattaaggacattgtaagattctcagtaggaaatccggcgattccttttattgtatttaagcctaccgctttcggaagaattgatctttatgaagctgttggaaaaggggcagagcttacaacaagccagaaagaagaatgggaaagagtggtgagaagatttgatgaaatatgtagtctttgccatgagaatgataaaaaagtaatggtagatgctgaagaaacctggatgcaggacgcagcagaccacctttgtgaagagatgatggagaaatacaaccagcagaagcctatcgtttggaataccatccagatgtacagaaccggaaggctggaatatatggaagctcaccttcagagagcgagagagaaaaattacttcatcggttataaaatcgttcgtggtgcttatatggaaaaagaaagagccagagcagcagaaaaaggatatgcagatccaatacagccaaccaaagacgcttcagataaaaattataatgcaggaatcgactttgtaatggagcatctggataaggtttcagcgtttttcgggacccataatgagatctcttcggaactgattatggacaaaatgaaggcaaaatctctggaaagcggtaatccgcatgtctatttcggacagctttacgggatgagtgataatatcaccttctatttgtcagataaaggctataatgtggctaaatatcttccgtacggacctgtaaaggatgttgtgccttatctgacgagaagagcccaggaaaatacctctgtggccggacaaaccggaagagagcttggactgatcaaaaaagaactggaaagaagaaagaaacaagcgtagtattgttctcaataaatcaatcagacccgcatttttgcgggtcttttttattggttatatcttaattgctgaaccaaaaatggaattttatttgaatttaaaaataactaatctatttactatttaaatcgattatatataaaataattttatttttattgctgatttgattttaaatatttatatttgataaagacataaaaactagcacatggaaatgtttttcactgactgtgataagtcttatggacattttgcccatatgatagccacagtaattatccacctaaaaaaccggcattataaaattataaataggaacagatgattattagataaattcgattaaatgataccctgtcaaaaatttttaaaaataaaataaagcaatagctttagttttcttcttcaaatattttttaacctgatcatttctctgatcaggtttttttttaaggctcaaaactttcgaattttccattttcataaaacaaaacaatacgttttattttactttgctgattaccaaatagttgtcctaaaatctgatcaccagaattttctaatcgctgagaatccgatattttttccggagctttatcattggccgttataaccgattctccagcacttacttttggagtttcagcttccgtttcttcgcttccgaattcatcatcatcattcatcatcgtaaaaagatcgggtagtggagttgtttttattttctcctcttcggtatgttcttctttaatttctgtttctggcaattgcgatttcagcatttctccttcgcccgtaaccagccaatcccatagaagttccgggaaacgggattttatttttatgataaattcaagagacggtttgtttcttcctgatgtgatatgtgaaatggacgaacgctgtacatcaatctcatcagcaaactcggaaggagtaagattggaatactctataatttttgaaattctttcatttaaactcataaaaataagcctttaattattttacaaatgtaatatttataatttacaaatgcaaaatacaaatgtaaataaatgtgtaatttaattatatacatttgtaaatagaattcaaaacgctttaaaacaaggattcatagataaattacaattgtatttaattttaaaatcatttctgatgaggcttattgattaaaccttacatttattgaaaaacaagtttaatattgtaaattcacttcattttgctctgtatttttactgttaaagctcctaaaatctactgtttacattgttaatatcctgtatttccatttctttagtccaattagcttaattccttgttatatgccattaaaagccatattgaaaccatatacaaaagtaaaatataccgattttatactaaataaacatcaaattgggagaaataatcttaaccttaaaccacttaattttctaaacattaaaatgcctgcgaaaagcctataaaaaataaaaatatttcacggaaactcttatttttattgtgtttacatttgtatatgaaaatagatgtctaagttttccacaattaagatgtttaaaaaaataatgctcaactggccttaaaaagcattatatttacttcaagtatagttataaatgcaatttaaataagttttataacttactgaatataaatattttaaatatatgtaattaaattattcgcaatccacatttttatccacagacaatttgtccatcagtactgtttaacaatgttacaaaagttaacttgattacttaactcaaaattaatgtggattaaatcttgtaaatttattttaaaccacaatgtcaaatgtaaattcaatcattttactgatttttacaaatgttaatttaaattttagcccaaaaatggctaaatttgattcctgtaaattatttcgcaaaatgaattttgaacagatctactctcagaaccccgatttctcaaatcgctatatttctcctgaaaaattattttcttatctacaggcaaatctcagcgattacattcagcagataggaacatcctatttagataagccgatttatcagttaagcatcgggaccggaaacattcaggtgctggcctggtcacaaatgcacggcaatgaatccaatgctacgcacgctatgcttgatcttttggaaagccttaataaagctccggaaatgaaagaggatttattcagtaaaataaaacttgattttatattcatgctgaatcctgacggatctgaaagatggaccagactgaatgcagcggatattgatctgaacagagattttcataacgaagcaagtaaagagatcaaattcctgaaaaaagcagctgcttccaaaaaatatgattatgctttaaaccttcatgaacagagaaccatttttaccactgatggtattcatcctgctacactttcctttttagctccgtccgaaaatgtagagcgtaccgtgactgaaaatagaaaaaaatgtatggcagttatcggaagcgtatacaaccatttgaaagaaatgattcctaatcagatcggaagatattctgatgaattctatccgacttctacaggagacaatttcattaaagcgggaatgccgactattttatttgaaggtggacactttgtggatgattataccagaaaaggaaccagaaaatattatacaattgccctttattatgccctgaaggcaatcagtgaactcaactctgatattacaggctgggaaacatacctcgaaattcctgagaacagggaaacccactatgatattatttacaggaatgtaaaattaaatactgaccatgaatgtattctggatattgcagttcaatacagggaaatcaaagaggaaggaaaagatgatatttcttttatcccttttgtaatggaagccggggatgtaaaacaaaagaaaggttggttggaaatagactgtaccggcaagaaatttatttctgcaactaaatatccaaaactggattctgtagtggattttaaaattgaagactaaaagaattttaaataacctcataaaaaatctccggcagcctgaagggctgccagagattttatttttataactaaattccaaacttgagatattaaaatttatattcaataggaatgggcattagcccatttacattaaataaagattcatccggctttagccaaaacttaatttcagaatataaagtttagttaaccactttaattccatttgctacaaatctgatttcttctttaggctgggtaatcgcatcaatttcagactgaggttttttagcatcttccgcataatgtttctgctcatttacagaagttacttttctctcagcattcccttccaatactacatttttcccttttaaagcggtaggaacgaagaacgcataatctttcattttcacaaaaaacttagaattgtcttccgtctgtatggtaagccagcagccttttttgtcgcagacatcggttaccttgcctttaacagcaacattctccacttttttattgtcttttttgagctttttgttcaatttatctactgtgatcgctttggattctgcggatgaacttacctgagctccataaatatcacctaccaaagcttttccttccggaggaccggattgggcaaatgttaatgaagaagctgttaatgctacacaaaataatattgttttgaatttcatgttaaaaatttttccaaaaatactaattaaaattgaatcataacgaaataaaaaatggtaaaaagcagttgtttttaaggaattttcaacaaatttgaaaatcaacggcagatttgattatatttgaatcctatacttgactatgcagaaaaaactgaaactatgggatgccatcatgctggtgatgggatcgatgattggaagcgggatctttattgtaagtgctgatatgatgcgaaatctgggaacaggattttgggtgattatcgtatgggtgattacaggaattatgacggtagcagcagcaataagctacggtgaactgtctgccctgtttcccaaggccggaggacaatacacttatctgaaagagattttcggaaaaaaaatgggcttcctttacggatggggtctgtttacggtaatacaaaccggaactattgcagcagtggcaatggcttttggaaaatttaccgcttatttagttccgtcattgaatgatgccgcaccaatatttcaaagtggtgaatttaaaattacatggatccagattctggcgattggagtgattttattgcttacctatattaacacccggggagtagaaagtggtaaaatccttcagaatatctttacgggttccaaaattatagcattattaggcttaattgccgccggttttattctggtagacatttctcatttgtcagaaaacttcagttggggaacagattcttttaataatcttaaaaaagatctgagtggtaatttcctgaaggaaggttgggaaccaatcggaggaatgactcttcttgggggaattgctgctgccatggtaggttctgttttcagttctgttgcctgggaaagtgtgacctttgtttccggtgaaattgaaaatcctaaaaaaaatgtagtaaaatcgatgatttacggtacttctgctgtgatgattctttatattgctgtaaactatgtctatctgaatgcgcttgacagggatagcattgcatttgcagctaatgacagggtagcggtagcagcctctcagaatatatttggaagtgcgggaaccattattattgccttattggtaatgatctccacatttggatgcaataacggactcattctggcaggagccagagttttccagacgatggcaaaagacggtatgttctttaaatcggcagtacaaaacaacaaaaatgaagttcctgaaaatgcactttggatgcagggagtttgggcttccattttatgcctgagcgggcagtacggaaatttattggatatgatctctttcgtaatcgtccttttctatatgattacggtttttggagttatttatttaagaatgaaacagccggatctggaaagaccttataagacatggctttatccggtaacgcctgttatttaccttttgataggaacctgtttttgtatcttattgctaatttacaaacagcaatatacatggcctggttttatactggtattgctcgggcttccagtgtattattttatcaaccgtaaaaaggcagatcagtaaaatatagtacagaagataagagatatagaatattcagggctttcaattcaggttgaaggcccttttttttcaataatattttaaagtattgtagcctttatttgccgaaaatgcgtattttggtatttcgtttttaaacaggaccatgaagtaaaaacaataagttatggatacaccaaattacagaatgcctttcgtaccgtctactttaatgaccgaaggcggaagtatcgatacctgcgatatgggggaaagtattgcccacaatattatgctgctgatcaccactaaaaaaggggagaacagatatgatgaaaactatggaaacgatgtctggaaccttgaatttgataatggagttacaagcgccatctgggaaagcgtttttatcaaaagcttaagaaggcagattcaggaatatgaaccaagaatcgtgaacccgcagattgatgcccatatacagtttgtagagcacagctacgatactaaagaacacaccgaaattaaaaagaaagtaagaattgccatcaatgcaaaaatggaagaaacaggagaacgtttcagtttctcgacggaactgtttctaagtccaatgtctattgattaatatttttaacagcgaaagaaaattatgaatttagatcagaatatttattccaaagaatctgtaaaagcaagaatgctgcagaatgcaactaaagtatggggattgagaagcccgcagtctttagatccgtttgtaaaactgctgatagatgcattcagtacagaagttttcaaagcgaataatgaaatacagacagtaaatgcccgcatattggaaaagctggcaaaactgcttacaccttctatttacacacatcctatcccggctcattccgtggcttttacacaaccttatgagtcttctgaaattttactggaacatacggaattcttcttccgtaaacagatgacatccactgtaaaatcagagtcagacaaacagctgaacattccttttactcctgtaggaaatgtgagaatcaataaagttcacacgtctatcatgtttgtaggaaatacctgttacagcattgatgaccgattcaataaaattcctatttcaagatttcagggcagacctgaagattacagaaaaatcacaataggagtagatgtcagtaaatatgtgagtgagaactttccgaaatatctgagcattttctgctccaatccggcttttgagcatcttgattttgtatacaaattactaccttatatcacagtttcaagcaacggtaatccattatttgtaagagaaggattaagctatctcacggaaagtcattcggatggctacgaacagatgttcaaagagcagtccatcagaaataaggtgattgaagatattaaaagcatttaccgtcataaatttattgaagtaacaggaatctcccaaagcctgttttcagaaccaggagagcttccgcagaaccttgatttcctgacaggaaaagaagaaatcactaaatttctggataataaacgttatctgtggcttacttttgagtttccaccacaattttcagcagaaatccttgacaatttttcctttgttctgaatgctttcccgatatacaacagaggctggaaaaagacagaatacagccttgatatcatggggaataatattcctttggtaaccgatgaaggggagcacttcctgtatgtagatgaagtacaggacggtgacggaaggaaatatactgaaatccctttcacgccggctgatgatctcaaaaaagggttatacactgtaagaaagggaggtatggaacgcttcaccagcagaaatgccgttgatatgattgccaatgttctggaactaacaagggatgaaattgccgcattttcccttttgaacagagacaatgtaaaaggagttctcagcgaaatgtccgataaaatgaaatccatggtgcagaaagtcaacaatgccaaaaggaatatcagacaggaattgaactacgtgatcatggaacctgtagaaaaaacagaccatacttatgcctctttttgggtaacacactgcactctggccaatcatatgcgcccgggaactgaactttccaaccagttgaagtcacaaaccgttgtgctgcttaccgaaactttagggggagctgaagaacagaaaggtactgacagtatccaggcctataaatacgcgctgacaaccagagataaaattatttctttggaagatgttaaaaattactgccgtatgattctgaaagatgaggtaaaagaagtaagggtaagaagggggacaatgatcagcaacaaaccaaaagaaggtttcgtaagaaccgttgaggtagagattgttcctcagaattattccttttatggaagagcctattgggaaaatatggccaatatcatcagaaaccaaatcatagccaaggccatcgacggaattgaatatatcgtaaggattactaatgaagatgttgacttccaggatatgtaatctttaaagaaaattaaatcagtttaaaatataaatgccgtatgaattactgcatttttgaatgatatcaatagaaacgggctttagcccgttttttaatagataatattctccaatgacttttgtcaaaacatataaatcgttctgtagaaattcaacaatttcttatttactccattaacaaaaactaagaattttttatgaaacttttatcccttttatattcaaaaaaagtctataaaatttcgtatttttgcacgttgtgattttctggcaaagtcaccccaaattatgagtaaatcaacagaatatatagaagtttacggggcacgtgaacataaccttaaaaatattaacgtaaaaattccgcgcaacgaattggtcgtgattaccggcctttccggaagtggaaaatcatcattggcttttgataccatttttgcagaaggccagcgtcgttatattgaaacattctctgcttatgcacgccagtttctgggcggattggagcgtcctgatgtagacaaaattgaaggactttctcccgttatagccattgagcagaagaccaccaataaaaatccgcgttctaccgtaggaacggttaccgagttgtatgactttctgcgcctactgtatgcaagagtttcggatgcttactctctgtctacaggacagaaattggtgagttataccgaagagcagattctggaaaccatcaaagaaaattataaaaaggagaagatcatgcttttggcaccagtggtgcgttccagaaaagggcattatcatgaactctttgttcagatggctaaaaaaggatacggacaggcaagaattgacggtgagctgcaggatattgaatatgatttaaaacttgaccgttataaaacccacgatattgatattgtcattgaccgttggatcatcggggaaaatgcctcagaaagcagaatggaaaaatcgttgcgtaccgcaatggaaatgggagaaggaattatcggtatccagaagctgggaagtacagatattgagtacttttccaaaaacctgatggatgcagaaaccggacactctctggcactgcctgaaccgaatactttttcattcaactcaccgaaaggaagctgcccaaactgcaaagggttaggcaccatcaaaaagatcaatacagattatttcgtagataatccaaaactatccattaatcagggaggattattaccattggaagatatcaaatctaacaaatggatactgtcacagattaaaaacatccttgagattttcggattgggattaacaacacctttaaaagatattccggaagaagcactggattatatctacaacggatgtcataaagagtttaataaagatctgaaatacgccggaattaccaaaaaaataaaaataggtttcgatggtctgattgctttcatggaggagattattgatgatagagactcatatgaagctgttttattggaaagacattttacgacagaagaaacctgcccggaatgtcatggcacccgccttcagccttcaagtttaagttttaaaattgatggaaaaaatattgctgaagtcaatgctttaagcttagcggatttaaaagactggctggccgatgttaaagataaattctcagaaaaaaataaaatcattgctcatgagatcttaaaagaaatcgaaaccaggcttcagtttttgctggatgtagggttggattatttaagtctgagcagaagttcaaaaactctttcaggaggagaatcgcaaagaatccgtctggcaacacagatcggatctcagctggtgaatgttttatatatccttgatgaaccaagcatcggacttcaccagagagataatgaaaggctgatcaactccctgaaaaacctcagagatatcggaaattctgtattggttgtagagcatgacaaagacatgattctggaagctgatgaggtgctggatattggtcctaaagccggaaaattcggtggagagattctttggcaggggaaacccaaggatttggttaaagcagataccatcacggctcaatatatcaatggtaaaagaaagattgaaattcctgcagtaagaagagcaggaagcggtaaaaatattgtattaaaaggagctacaggaaacaatcttaaaaatgtaaccctggatattcctcttggaaaactggttgtagtaaccggaatttcaggaagcggaaaatcttctctgattaatggaactttgtatccaatccttaacaaacatttctacagagcggttcaggagccgttaccttacaaaaaaattgaaggattagagaatattgataaaattgtagacgtagatcagacaccaattggaagaactccacgttcaaacccggcaacttatacaggaatgtttacagacatccgcaacctttttgccgaactgccggaaagtaaaatccggggatataaaccgggaagattctctttcaacgtgaaaggcggaagatgcgaaacctgtcagggtggaggattgaaggtaattgaaatgaatttccttccggacgtttatgttcattgcgaaacatgtaacggtaaacgcttcaacagggaaactctggaagtccgttacaaaggaaaatcaatttctgatgtgctggatatgacgattgatgaagcggtagatttcttccagccgattcctaagattttttcaaaagtgaaaacattgcaggatgtaggattaggatatattacccttggacagcagtcgacaaccctttcagggggtgaagcacagcgtatcaagctggcaaccgaactggcaaaaagacaaaccggaaacaccctttatatccttgatgaaccaacaacaggattgcatttcgaagacgtaaaaatccttatggatgctattaatcaattggtagaacttggaaactcattcatcatcattgaacataatatggatgtgatcaaattagccgaccatattattgatgttggacccgaaggaggaaagcatggtggacagatcgttgcacagggaactcctgaagaaattgtgaaatctaagaaaagcttgacaggaaagtttttgaagagagaactggagtaaagatttataaaattattcagtattttgccattccgaaggaatctaaataatttatttcagaatattgagcaacttttaaattaaaaattaggataataatcggctaaactataaggtttagccttttttatgattaaaaatctacctccaatattaaattttcatttattttttaaaaattatttatctgataatcagttaattatattttaatgttaactcagtgttaactgaatgtaaaattaatatgaattatttttaataactttggttaagagatacaaaaataggttagtataatatttaaaaccagttagttatgaaaaatagaattcaaatatgcattgcttcacttttggtttgcggatttgctgctgttttaaacactgctaaagctcagactacagatcatagtaccattcaggaaattcaactgaatagaagtgaaacgtttaatgacatcagaaataaactggaagccaactttgaccttaccaatcctgattataaacagggaaccgtaaactcagtggtgaaatttgatattgctaaaaacgggaaaatcgttaatgttcattctacaggcgactgtaaaaccgtaagcagggaaattgaaacggtactcagcgatcttgattatagagtagaccgaaaaaaactgactgataatatggttgcttatacctatgtaatgccagtgacagtcgaaattcacagcagataatatttattacatattattcataaatgtgtgaataatgaaaccttacaggattaaattgtaataaagaataaacagatatgttttagttttgggctaccataaaattagaactatatgaaaaatttaaagaaactgacaaaatcagatttgaagtcagtgaacggaggagagccggtaaaatattgtacattttgcgaatgggcaaataaagtaatttgcagcgatgttccaatcgttcaatgtccgtaaaaaataaagccgctttataagcggcttttctattatcttgtacttttaacaaattcttttaatcttgccttaagatccccggaattccctattgtatcgaaagtaatattatctatcttccatcttttccctgtattcgtaagatgtatggtatctgtccatgctactttcggtgaagcaaggttgtattcaaatgcaaccggtacttctgctgttatattctttatcctgacggatttaattttataatctgtaaacccttcatataaactggagaaaagagcgccttcaaagattaaaggcttttcatcaggatgatcactgttttttaccttttctatatctgcttttgaagtattaatagcctcttccagaacttttttcagatcttcggaaaacaaatcttccggaatgggttgattgtaaattgcttcattagattttccgtaagtagtataaagctcatttatttttgcattgatggctgcatcagaagataaagaggagtgtgcttcattctttttacacgatgcaaataatagaaagattcccgaaagaagaattaattttttcatggaagtattttgtaaggtcaatttacagtccagatgtcaaaatttataccaacccgtcaataaattattttttgcaaatcacaaaaatcaatacatttgagtagataaaaaaattgtggatcctattcttaacgttgctgtccgttccctctgcgtttaccttttcatggtaattgctatccgtttatttggtaaaaatcagctttcccagctcaatgcaggtgatgtagtacttttactgctgatttcaaatgccgttcagaatgcgatggtagggactgatacttctttgcagggtggcattgttgcggcattggttttgttcgttgctaattttattctaaaaaggataatgttttccagccgttcctttcagaccttgatggaagatgaacctgtggtccttatcagggatggagttacagaccaggctgctctgaaccgcgttaaaataacagaaagcgaacttgaagaggcaataagggagcatggcattgaaaatatagatgatgtaaagctgtctgtactggaagtagacggcaatatcagtgttgtttctcaggacgaaaaaagcaaacagacccactattcaagaattaaaagaaaaattaaaagaaaatatcactaaaacgatgaattacgaattaagagaaatgcttcccactgatgaagccagggtcctggaaattttccgccagggaatagatggtggaatttccacttttgagacagaagttccaactgctgaagcctggagcatgggatattttaacgactgccgctgggtgttggaaaatgaaaataatgaagttgtgggatggtgcgccttaaaaccggtcagcaagagagagtgttacaagggtgttgcagaagttagcatttattttgataacgaataccagggaaaaggattgggttccgtgttgcttaaaaagttgattttagacagtgaagatcacgggttctggacattacaaaccaatatcttctccgaaaatgaaacttctattaaatttcatcagaaaaacggtttcagaatggtaggtatccgaaaaaaaatcggaaagctcaatggagagtggaaagatgttattctgatggaaaaaagaagtgaaatcatttagaattataaattataattgatgaatgatgattgatgattgatgattgatgattgatgattgatgattgatgattgatgattgatgattttgtcgataagcaaaactaatctccataacaaattcattatggacttgcgaagcaaaattgaccattgatcaaaaggctgtatattccaaccttcaactctgaattttaaatttttggcattaccattgttatattaactcaaatttgaaaaagtggaataatgaaaagtatcattaaaattacaggagctgttattatattatcgatgatgacatcgtgtgtcgcttatgataatggatatggatatcagaccaagagacttccgccgggccaggctaaaaaaatctacggtggaagcgcaaaagattatgctccgggacaagtgaaaaaaagatatggtcactaatcagcaataaaattaacagttgatttttatctgcatcatgttgatttaaatactttttggcattatcattgatatatttcgctatcgaaattgaaaaagtgaaaataatgaaaagtatgtttaaaatcgcaggagcagctgtggtagcattgttgttgtcctcttgtgtggtacatgagcatcatggaagaagaatgccgccaggtcatgcaaaaaggtattatggcggaagtgcgaggtactacgcaccaggccaggtaaagaaagtgtatatttatgacgatcgcggacatggacatcacaaaggtcacggtcatggacatcacagataaaaagaaagcactgaattttttcagtgcttttttatgattattataatcttgtttttttcggattaagaaaagtgttaaaaaccatcacttcctgcccgaactttttctcaatcctttcggaaatattcaaaagttcacttttaataaaatcttcacgaagatcgttattatcaaaaattagcaggagattataattttttccttcctcaataaagtcgctgtgcacttcagaaagaatatatttgcttacatccatcaggttttcagtcattaaaaccaatgtttcatcaatataattttcccattcttctagcctgtcttttgtgcagtggaaagttatacttaatacgctcatatttttatgaatttttaagattttttggataaattctacagcaaaaatcggcatttttttcgtaaattagcccgttaataaaaattggaaataaataattttcggacttacagctaagggtctgaatatcattacaataaaatttgtttatgcaaaaagaaggagaaagactgattcctatcaacattgttgatgaaatgaagtcgtcttatatcgattattcgatgtcggttatcgtttccagagcgctaccggatgtaagagacggcttgaaacccgttcacagaagagtactttacggtatgtatggactaggggtgttttctaatagaaaatatttaaaatctgcgagaattgttggggatgttttgggtaaataccacccgcatggagattcctctgtatacgatgctatggtaagaatggctcaggactggagcttacgttatcctcaggtagacgggcagggtaacttcggttctatggatggtgaccctcctgcagcaatgcgttatactgaggcaagactgaaaaaaatctctgatgaggttctttcagacctggacaaagaaacggttgattttcagaataactttgacgacagcttacaggagccgacagtgatgccgacaaaaattccgaaccttttagtaaacggtacttcaggtattgcagtagggatggcaaccaacatggcgccgcacaacttatcagaatctgttgatgcaatctgcgcttatatcgataataaagaaattacgatcgatgaattaatgcagcacatcattgctccggattttcctacaggaggtatcatttatggttacgatggagtaagggatgctttccatacaggaagaggtagagtggttttaagagctaaagttaactttgacgaaatcggaaacagaaacgctattatcgttactgaaatcccttatcaggtgaacaaagctgaaatgattgccagaacagcagagcttgttaaggatgaaaaaattcctggtattcacgaaatcagagacgaatcggacagaaaaggacttcgtattgtttacgaactgaaaaacgatgcaattccgaatgttgtccttaacttattatataaatatacggcacttcaaacttctttcagtgtaaataatattgcattggtacacggaagaccggagcagctgaaccttaaagatatcattcatcactttgtagagcacagacatgaggtgatcgtaagaagaactcagtttgagcttaaaaaagcaaaagaaagagcacatatccttgaaggattcatgaaagtgatcggaactcaggatgctttagacagagcgatttctattatccgtcacagtgcgaatcctcaggctgcaaaagaaggattgattgaagcttttgaactttctgatattcaggcacaggcaatccttgatcttagattagcccgtcttacaggaatggagcttgataagatccgtgatgaatatgatgcgatcatgaaagaaatcgcgaatttggaagacatcttagcgaacgagccaagaagattccagatcatcaaagaagaattgcttgagatcaaagaaaaatacggagacgaaagaagaactgaaatagattactcaggaggagaaatgtctatcgaagatattatcccgaacgaatctgtagttcttactatttctcacgcaggatacatcaagagaacttcgctttcagaatataaaatccaaagtagaggaggtgtgggtaataaagcagcaacaacaagggattctgacttccttgaatatatcgtttctgcaaccaaccaccagtatatgctgttctttactgaaaaaggaagatgttactggttaagagtatttgaaattcctgaaggctccaaaacggcaaaaggaagagcagtacaaaaccttatcaatattgaaccagatgataagatcaaagcatacatcagaaccaacaaccttaaggattctgaatacgtaaatcaaatgagcgttgtgatggtaaccaaaaatggaaccatcaagaaaacatcattagaagcttattcaagaccaagagtaaacggggtaaatgctattgagatcagagataatgaccagctattgggagcttacctgacaaacggaaattctcagatcatgatcgctaccaaaaatggtaaatgtatccgtttccctgaagaaaaagtaagagaagtaggtagaggatctatcggggtaagaggaatcttgcttgaagatggtgatgaagctattggtatgattgttgtgaacgatgtagagaacgaaacagtacttgtggtatctgaaaaaggatacggtaagagaactgcggtagaagactacagaattaccaacagaggaggaaaaggagttattaccctgaacattactgaaaaaacaggtaatctgattgctattcaaaacgtaacagacgaagatggattgatgattatcaacaaatccggtgttgccatcagaatgggaatggatgagatgagagtaatgggtagaaatactcagggagtaaaactgatcaaccttaagaaaaatgacgaaattgcagccattgcaaaagtagaaatggataaagatgtagaggaagattctgaagaacttgaagaaacagaagaaggagttgtaggatcgctatttgataaccaggaagacaatacagtacctcaggctgaaaatgaaaactcagcagaggaaaatgagaattctgattctgaagaataaattgtacaattaatataaaatagttattatgaagaaactaattttaggaatggctatcgtagcgtctgcttttgcttttgggcagaaaaaagatgccaacgctctgaacgctcagcttcaggaaactaataaggccgctatggatgcatacaatgcaaaaaattatgcagccgcagcacctaagtttattgaagtttatgacttattgaaagctaacggacaggacaataaaatatatatgtattatgcgggattgagccacgcgttagccaataacagtgaacagtctatcaaaatatatacagatcttgttaattccggatttacaggagtagaaactacttacactgcaaaagaaaagaaaacaggacaggttgtaaaccttgataaagcgacgtgggagctgatgaagaaaaattcagactatactgatttcaaaacagaacagacaaaaagtatcgaacctgatttatatgaaacccttgcttcattacttcttaatgcaaaaaaaccggaagctcttgctgttatcgaaaaaggattggcaaaattccctaataatgctaaacttaaagaagctcagactacagcataccttcagtcaggaaatacagacaaattcgtttcaggattgaaagagcagttagctaaaaaccctaacgatgctacgaactggtataaccttggagtaatgcaggctaaaaacccggctactgttaatgacgctttagaagctttcaaaaaagcagttgagcttaaacctgacttctctgacgcatatcagaacttggtttatactacgatcggtgacgatgctaaagtagtaggtgaaatcaatgcattgagaaaagacaagccggatgaagcttctaaactgatcgacgcaagaagagaaagatttgcaaaagctttaccgtacgctgaaggatggtataaagctaatccaaaaagtcttgatgcggtttctgcattaaaagaaatttatgtagtaactaaaaacatggataaagttaaagaaatgaaagctaaagaagctgaacttacagctgctggagcaaaataatcattttgataacaacagatataaaaaccggaacagaaatgttccggttttttattttaaacagaaagtgctgactgaggttcttatccggattttatatttcatgtaggagcttttagatctgttataattttgaattaaaatctataaacctaacaggtttcaaaaacctgttaggtttaatttgttaccagcccttctatacagtttctgctgaaaattcttcataccggattcacacattcaaaatttctgttttttgtagtgatgaacctcaaatttcaccttcagaaattctctgtaattccgtatctttgagaaaaatttttataagatgatcgagtggaaaaccgccaaggaatacgaagatattacctataaaaaatgtaacggagtagcaagaattgctttcaacagacctgaggtgcgtaatgctttcagacctaaaacaacttcggaattatacgatgctttttatgatgcctatgaagatccttcaataggagttgtattgctttcaggagaaggaccaagtcctaaagacggaggatgggcattttgcagcggaggagatcagaaagccagaggacaccagggatatgtaggagaagacggaagacaccgtttgaatatccttgaagttcagcgtctgatccgttttatgccaaaggttgttattgcagtggttccgggatgggcagttggtggaggacactcgcttcatgttgtatgtgatctgactttggcaagtgaagaacatgctattttcaaacaaacagatgctgatgttacaagttttgatggtgggtatggctctgcttatcttgctaaaatggtaggtcagaaaaaagcccgtgaaattttctttttaggaagaaactattccgctcaggaagctttcgaaatgggaatggtaaacaaagtagttcctcatgcagaattagaagatacagcttacgaatgggctcaggaaatattggcaaaatctccgacttctatcagaatgctgaaatttgccatgaaccttacagatgacggtatggtagggcagcaggtgtttgccggagaagctacccgtctggcctatatgacagaagaagctaaagaaggaagaaacgcatttcttgaaaagagaaagcctaacttcggagaagatcaatggatatcataacattagtgatgagtaataagtaatgagcaaaatttttcattacttattacccattgctcattacttataaatttatgacgcattggataaaagccgcaaggctaaggactttaccgctttctttaagcgggattattatgggagctttcattgcaaaatggagactttacggagaaggcggaacctgggactggaagatttttgcccttgcccttttggtaacgcttttataccagattttatcaaattatgccaatgattatggtgacggagtaaaaggaaccgatgctaagagaatcaatgaagctgaagcaagagcagtagcctcagggaaaattacggcaaagcagatgaaaaatgcagtaattcttttcgcagcattatcatttattgcaaccattgctttgctgtatgtagctttcattccggattatatgaatgaattctatatcttcataggattgggagtagcaagtattctggcagccattgggtatacagtaggtaaaaaaccttacggatatatgggattgggagatatctttgtgtttatcttctttggattggtttctgtgtgcggaagttattttctctttacaaaaactttcagctgggacatgctattgcctggaacagctgttggaatgatgagtatggcggttcttaacctgaataatatgagagatattgaaagcgacagattatcaggaaaaaacagcttcgctttgaaaataggattcaaaaatgccatgatttatgaaatggtactgttacagcttccattgttgcttattcttacatttttaggaataaatggattcatgaaggaacagaactactatgttttcattgtaatgatcctgttattcccattatcaaaactgagaaaaaagattttgtcggtaaaagagccgaaagaattagatcaatatttaaagcaggtagggatcatgacttttgtaatggcaatccttacagcagccggacttaatttatttcactaaatcccaaaatagtatattatgagttctaatgcatatgttgaagcccaaatgctcatccgaaagccggttgaagatgtttttgaagcatttatcaatccggaagtgaccactaatttctggtttacaaaatctaccggaagattagaagaaggcaaaacggtaatctgggaatgggaaatgtacggcgtaaaaaacgctgtcaacgttcatcagattattcctaaccagctgatcagaacagaatggggagaaccttcgacaaatgtagattatgaattcagaactatggaaaaaggtactcttgttatcattaaaagttatggattcagccagacgggtgaagacctgctgaaagtgattaatgacaatacaggaggttttacaacagtattagacggttgtaaagcttatctggagcatagaataaaacttaatctgattgaggataagttcccatcgaaataataaaattaaacaaacacggatggcacgaatgctttcacaaaacgtcaataatctcattgttctatttgtgaaattatttgagtcatttgtgtttaataatatttaataataattgaaactaaatttaaaatgaaaatacaattcttagggcaaaattgtttcctgttcacatataaggacaaaacaattctgagcgaccctttctacaactacaaaaaagcagaatcaggttttgatattgctgctcaaaaaatcgactacattctgctgactcatgcacacggcgatcatattgctgatgtagcagaagtgttgcagcattatccggaagctaccatcattggagttcctgaagtatgcggttacttccaacaggcaaaaaataaagatgatgtgaacttaggaggatcggcaaaaatcgacgatcttaaaatttccatggttcctgctcaccatacaagttcttttccggatggaagctatggaggcgttcctgtagggtatatcttcagattgcctgaaggtaagaatatctatttggctggtgatacaggagtaatggcggatatggagctgttcccgagattatacggaaacatcgatctttctatccttcccatcggaagccactacacaatgtgcccgagaaaagcttcttttgcagcagcagagctgttaaaaacaccaaaagtaatcggatgtcactttgatactttccctgctattgaaatcaatcatgaaagtgcattaaagcattttgcagataaaaatgtagaactggttttaccaaaattaggagagacgttcgaattttaatcaataacggaaccggaggtaatctgaaaattagaaaatgaaaatgatgcgtaaggtattaaaaacaaaaaaagataattatcaaattacctctcttcttactttaaaccaaaaaaaaatggcaagctacctaaatcacaccgctacgaccgattacctttgctgcgttcccaccctggaggattctcaggagctggttgtttaggacttgccgttgcaaaggtaggaatattttataaacttcaaaactttattagagaaaattagttgaaaaaatgcagtggtaaagctaattgcctgacatttagagggaaaatttttcaacttttttctaaaaatttaaatatgacgaaaagtccatcaacactaggaattatactttttatcgctacaatgattgttttctttgtagtatatacttttttctcaggaatcaattattttgatatctctttgaaagccaacgcttttcttttacctgttttatatgcaggagcggctttctggtctgtaaaatcttactggaacaagcatagagtagtaaaattcaaagaagctttcaaaagagcattcgtaccgatgttcgttggaggaattctttccatcttcagcatttatgcttttttaaactttgtagatcctgctgccaaaagccttctgaactatcaatatgttcaaagacaaaaatcagaactggatacagaatatacctctgcaagaaaaattctgaagcaccagaaggatattgatgagctggatcagaaatacaaggaaagattacaaagcttcaatcctgaagcagttaaaggaaaagatatgcttactgcgagtcatttttcaggatattttgcagcaattcttatattttacgtagttttgtcggtgtttttcggagcgtttttcagaacaagaacaatacatcagcccgaagaaacaaatcaagcctaatttttattaaaattaaatgaatttatctatagttattccgttactgaacgaagaagattctctggaagagcttttttcaagaattgataaagtatgcacaaccagcaatttatcctatgagatctggtttgtagacgatggaagtacggatttgtcgtggagtattattgagaatatgaaagtacagtatcctcagatccacgcaattaaattttccagaaattatggaaaatcccaggcgcttcatgctgcctttgaaagaacaaacggtgaggtagtgattaccatggatgccgatttacaggatttccctgaagaaattccggaactgtataatatggtgatcaatgataattatgatatcgtttccggttggaaaaagaagcgttttgacaatgtaatgacaaaaaatattccttcaaaactattcaatgctgcagcaagaaaagtatcaggagtttatcttcacgatttcaattgcggtctgaaagcctataaaagacaggttgtaaaatctgttgatgtatatggggacatgcaccgttatattccggtattggctgccaatgcgggtttcagaagaattactgaaaaagaagtgaagcatcaggcaagaccttacggaacttcgaaattcggaacagaaagatttatcagaggatttctggatttgataaccctttggtttgtaagtcgtttcgggggaaggccaatgcatttcttcggagcagtaggaactttaatgtttattgtcggtttcctttcagccctttggctagggatttctaaactgattgacgttgccagaggaatttatggacatttaatcaccaataatccatggttctatattgccttaacaatgatgatcatgggaacacttctctttatcgcaggattcttaggagaaatgattatcagaaccaaccgtgagcataagaattataatattgatgaagtgatataatggaagaaaaactgccgagaatttattctaaaaaagccattttaggattttctatttttctttcctctcttttcggaggagttttattataccaaaatttaatagaggttaataaaaagaaagaagcatacacggtgttggccatttctgttatattaacgattatcacaggaattattgtcaatatcccagaagaacctaaaagttcacttgcttatatttgcggctttggagggggaagtttgctctcctactattttatgccgaaatattttccggatgaagagaaatatccgaaaaaagcgatatggaaacccttgattgttggggttgcgattgttgcaatacttttgactttaatcatttatggtacttctgttgaaaatagctaaccatagaaaagttataatagatcatcaattcttatagatttaagaatataatataatgaagagcactctgtcaacagggtgctttttttgtaattttataaaaaaatttaacttaaatgtttcaacccaaatcaattctttttcattttcttttactcctgacaatttcatgttcatccaacaagctctctggttcctgggaatttattgacatttacgacggagagatcaatcgggtagatacattgaaaaacaaaacaaacaaatcaaggtacggaactggaatcctcaccttttatcaggatgaaacattcacttcaatgggaaacgatggaacttatcagatagaaaacaacttgttgaaaatgaaatataatgatgatgaaaagacaattccaatgaaaatttcctacataagcaaagaacatctgctcttattttcaatggctggaagtccgaaaacctggttttataaaaaagtaaagaagaatagcaaataagtctcttcctgagaagcagaaaattgaaaattatcaggtattttattgtcaaaagacaaagatttttagaaattttaatcctatttttgttcgaagtaattattgaaggtcctttgtaaggcatgaaaaacctttcggagattttcagtaaaatcgttgcgattgtaatatgaatatttaaaaataaatatgaaaaaagttgtatacacattaatgctggcggcactggtttcctgcggaaaagtttctccaaaaggaaatattgagaagaaagatgtggatgtaccggaattcgtcaatcttgatctggaaggaaagttccgtgtattttatgccagagggcctaaaaattttgtagaaatagaaacctatccgaatgtggccagtaatctggatgtggatgtgaaagacaaaacactttttataaaagaaaaaagagggacaaagggagtcgatttttataatgtaacgatctattcaaaatataaccttgaaaaagtagcggtttcagactctgtggaaatgaatatttcaagcgagattaagaccgacaatttcaggcttgctatgaagaataatgccagctttatgggatctgtaaacaccagaagggcagaagtggaaatgcagaacagaagccgtgctaattttttaggattaacaaaagaagcggttataaaaatctcagatacagcgagtttaattgctccttactggaagattaccaatctgaatatcgattctaaaaacggaaattatgcagaagtaaatgtaaaagattctttaaaaggacatattcagaacacggcaaaatttgtctattataacgatccgatcagggcgtttaaaattgataaaacaacgaaagtcgagaacaaaaaactggattaaaaacagtattattaaaaccaggaactttacaactataaagaacaacatataaatatgaatacactagaaaaagcgaaactttggttaagtgataccttcgataaagaaacgagagacgctgtacaattactgattgacagcaattcccctgatctggaagattctttctacagagaactggaattcggaacaggaggaatgcgcgggataatgggagtaggaaccaaccgcttgaataaatatacgttaggtcaggctacacagggattggcgaactatatgctgcagcagtttaagggagaggaaattaaagtggccatcgcttatgatgttcgtaataactcaaaagaattcgggaagctggtggcagatgttttaacagccaacggaattaaagtattgcttttcaaagaccacagaccgacaccggaattgtcttttaccgttcgtgataaaaaatgtaacggaggaattgtattgacagcctctcataatccgccggaatataacggttacaaagtatactggaacgacggagcacagattgttccacctaatgatgaagccattatcaaggaagtatattctgtaaaatttgaagaaattaaatttgacggaaatgatgatctgatcgaatggatcggagaggagcaggacgatgtatatatcgatgcatgcattgaaaactctacctatcagaatgttggaaaagaaaatttaaatattgttttcacatctatccacggaacaacctacacaaccgttcctaaagctcttgcaaaagcaggatttaaaaaagtggatcttgttaaagaacagatgatcccaagcggaaatttcccgacagtagattctccaaacccggaagaacctgcagcgcttgaaatggccctggatctggcaagaatcaccaatgctgacattgtgatcggaacagacccggatggggacagattaggaattgcagtaagaaatcttgatggcgaaatgcagcttttgaacggtaaccaaaccaatacaatccttacttattatatcctgaatgaatggagaaagcaggaaagaattacaggaaaagaatttataggttctacgattgtaacctcggatattttctttgacatagcacaaaaattcggagttgaatgtaaagtagggcttaccggattcaaatggatcgggaaaatgatccgtgaagcagaaggaaagcagaaatttgtgtgtggcggggaagaaagtttcggatttatgaccggagattttgttcgtgacaaagattcttgcggaagtattcttttagcatgtgaaattgcagcatggtgtaaagccaatggaagaacaatgtaccagtacatgatcgagatttacgaagatcttggaatgtattacgaaggattgatcaatattgtaagaaaaggaaaagaaggtgctgaagagattcagaatatgatgaaaaacttccgtgaaaatcctccaaaagaattggcaggatcatcggtagaactagttaaggatttcaaggaacagacaagtcttaccatttctaccaacgagaaaaaagtaatgaatgatattcctgcatccaatgtattgatctattatacacaggatggaacaaaagtatgcgtaagaccttcaggaacggaaccaaaaatcaagttctatgtttctgtaaaggattctatcacttcagaatcagactttagagataaattaaaatcattggaagctaaaatcggagctgttaaaacagatttgaaactggattaatttcccgaaacagcagatgattaaaaaaataatagcagtttgcttactctctgcagccgtagtttcctgtaaaaaggaagctgcagctgcaggaataaagcagaagaacgattcaattgcccggactgagcctaaagaagatcagtataaaccgatagatacggcctgttcacctgccggtaaaacggaggattatatcaaatctcttcaatggtaccggacaaaaatcgaaaaagaaatgacaggaagcaatccggaacagaatgacagagtatatgaagattatttaaaaataagagataagtatacagaatgtctgatgaatttgcatgctgatattttggataaatatgtgaattattatgatcctgataaagatcggtacaactttccggaccatattaaaaagattgcttcagaactgaaaaaagcaggtcttgaattcagggaagtaggagaagggatgactgaaatatggaccgttccgggatattactcttctttgtttaagaataaggtaacgccggattatgaagcctatattttgcagaatgacaaagaaagtgaatccaattatgccgcggatgcaggactgatgatttcctgggaacagctgggagacaggctgatattctgggagaattttatgaataaatatccggaaagtaagcttataaaggatgtaaaaacaggttatcaaatgtatttgtctgactatcttttgggaatggaaaatacgcctacctttgaaagagatctggacaaagaaaccggaaaactgtacgatgaaaacagagcagagttcaacaggattatcaaaaaatatccgaattccaatacagcaaaaaaagcaaaagaggcaatagccctttttgatgcgcaaacaccggtagatcaaatatatgagaagatcaacagagaacgataatataaattttaaataaaaaaaagtgaaagtttcaaaattagcagcgaacctgatcggttctgaaattgtaaaaattggtaacgaagtaaatgacttaaaagcaaagggagcggaaattgccaatcttactattggtgatctgaattctaatatctatcctattccggcattgctgaaggaagagattcagaaagcttatcagaataatctgacgaactatcctcctgcaaacggacttttatctttaagaaaagaagtttccaaagaccttaaacaaagatggaacctggattattctcctgaggatattttaattactgcaggatctagacctttgatctatgctgtatacaaaaccatcgtagatgaaggagataaagtagtatatcctacaccgtcatggaacaacaatcactatgcttaccttacttcggccaatgctgtagaagtaaaaacaagacctgaaaccaatttccttccgactgctgatgacctgagacctcacctggaaggagctgttttattagcactttgttcaccattgaaccctaccggaacaatgtttacaaaagaacagctttcagaaatctgcgaactggtaatcgctgaaaacaacaaaagaggagccgatgaaaaaccgttgtacctaatgtatgaccagatctattcttgccttacttttggagcagcgcatgtagatcctgtttctcttttccctgaaatgaaagactacaccatctacattgacggtatttcaaaatgccttgcagcaaccggagttcgtgtaggatggggatttggtccttctcatattcttgataaaatgaaagcgcttcttacgcacgttggagcatgggcaccaaaacctgagcaggaagcaaccgccaaattttatgaaaatccggagaacgtaaatactttcgttaatgattttaaagctaagcttgaagaaagtttaaaagttcttcataacggagttcaggatttgaaagcaaaaggtctttctgtagacagtatcgagcctatgggagcactttatcttaccattaagcttgattatatcggaaaaacaaaacctgatggaactgttatcggaaactcttcagaccttgtattctacttaattaatgaagcaggtgttgctttagtgccattctctgccttcggggaagaaaaatcagaaccttggttccgtgcttctgtaggaggattggcggtagatgagatcaaagtaatgcttccgaaactggaaaatgctttgaacaatttaaagtaaccttcagataaataaatgcatcgactctgtccggcatgacatcgttaaaacaagaatcagtattagcattgtcattccagatagagtcgattcgttttcttagagatatttaaactgatagtataaaaattaaataaatattaaaagttaaataagtgctttgtacaacactcaactaggagctatctttgggattttacacacctaaatataaaagttgaaaattacaacgatgaaaaaactgagatttctactcttgccagtttcaatactggtatgctcgcaagaggttgatacattgaagataaaagaacttccaaaggaatctgagttgccaaaagtacaaacctatacgttaaaggacggatctgtcagaacctatccaaaaccgaaactactggattttgtaaccaaattaccccggaattttatcaataccaataaagatttcgtagccaaagatcatggttattatcttggaggagcagtggctgcaacacttattctcttaccttttgatcaaaagcttattgacaattccagagagctgggagaaagatggggaatggataaagataacaactatcacaaaattggaggtgtctttaaaattcctaaagatatcgggtctaccttatatctgataggaaacggttctacattggtgctgatgggtattggtttcggaacctacggtcttatcaaaaatgattacagagcacaggctacagccagcggtttgatggaaagtttaattctttccggagtttttacccaaacccttaaaagaattactgggagagaaagcccatttattgctgaaataaacgggaataaaggaggagcatggaatccgttcccaagcttttcggcattcagcaaaaacacttcgaattatgatgcaatgccttccggacatttaacaacctttatggctggtattacggtgattgcagacaattatcctgatgtaaagtggattaagccggtaggatataccttagcaggagcattatgttttcaaatgatgcagagtaaagtacactgggcttcagattatcctttagccttattaatgggatattttatcgggaaaacaatctcaaaaagcagatatacttcatcagaaggaacgataggaaaaacaaaatataatctcaactttgtggcatcccgccaatgggaatacaatttggtaggggtaaaactctctttttaagctgctgaaatctttgttttgtatagtaaataagatacttttcactacatttgatctcaatataaaggaaacattacagcatgatatatgctgaaatggcaacctgttgaattaaagagaattacttaatacttttactgaatgaaaataatcgctgttattcctgcccgctacgaagcaagccgttttccaggaaaactgatgcagattttaggagaaaaaaccgttattaccacaacgtatcagaatgtagtggaaaccggactgtttgatgaagtatttgtcgctacagactctgaaattatttttgacgaaattcaaaaaaacggtggaaaggccgtaatgacaggccagcatgagaccggaagcgaccgtattgccgaagctgtacaacatatagactgtgatattgtgatcaatgttcagggagacgagcctttcctaaaattagagcctttacaacagctgatagaagttttcagacatgatgatcaacaggaaatctccttagcttctttaaaaatacagctgcatgaaaaagaagaaatagaaaacccgaataacgtaaaagtgattacagataataatggttttgctttgtatttcagccgttccgtaattccttttcacagggaagtttcttatgatgtaagctattttaaacatattggagtttatgctttcagaaaggaagccttgctgcagttttcaaaactggctatgaaacctttggaaatatccgaaaaaatagaatgtatccgctatcttgaatacggaatgaaaatcaaaatgattgaaaccaatttcataggagtgggcatagataccccggaagatctggaaaaagccagaaaactgatttaaaatattgaaggcaaaaaagctaattatcaaatgctcttttgcctttttgtaattttacagaaatccccctatatttgaatttataaataaaattaatgaagaagttattattagtatttggactgatattttcgcatgtcgcatttgcacagaccgcaaaggaaattattgacaaaaacattgaattatccggagggttagccaattggaaattattgaattcggtattgcttcagggaaaagtaattttaggaatcaaagatgaatatccgataaaaatctatcagcagcgtccgaatcttactaaaacattgattactaccggtggaaaagaaaccgcaattgaaggctatgatggaactaaaggctatgcaatgaattatgcagccaataagcttcaggaatatccagaatatgttccggaaagttttgacaatgacttcattgattgggaaaacaaaggctttgaggcaaaatatcttggaaaagaaaaagtaggagagatctactgccataaagttgaactgaccaagaatgtcaataagaacatgtactattttgatacaaagacctatatgctgatcaaagaagtgaaaaaagatgaaacactggtgtattctgattttaaaaaagtgggaaatcttatcatgccattcagaatagaatcatcaagtgccaagaaagacggagattacgtaatgctgctcaacagaattgatatcaacaaagtgtttcctgcaaatatttttaagttttaatcaactgcggttcgctgcacaaaattataaaaaatgaaaaaaatttttttactgctgctttcattcatcgcatttctgcaaagctgcaccaaccaaaaaagtgaagtttctaaagctaaaaccaacgaacttatgggaaaaacaatatacgacttcaaagtagaaagtcttgatggtaaggaaatcaattttgctgatttcaaaggaaagaaaatcctgattgtcaataccgcttcagagtgtggatttaccccgcagtatgcagatcttgaaaaagtatacgaacagtataaagataagctggtagtagtaggtttccctgccaataatttcggaggacaggagcctggaacaaatactgaaatcggggctttctgccagaaaaactatggtgtaacatttcctatggctgcaaaagtgtctgtaaaaggtgatgatacagctcctatctttaagtatttaacagaaaaagaattaaacggagtaaaaaatacaagcatcctttggaactttaccaaattcctggtagatgaaaacggaaaactgattgattcatttgtaagcactacaaagcctaccgatgaggccattacaaaatatctgaaataagaattattatatggattttttggatcggtttgaagcctgtattatgagcggagcaattggagatgcatggggaagcagctatgaaaatgaagtagaaaccgatgattcacatatttattatttaggaaaaaagaataaaaagcgaagagtctggagtattacggatgatacacaaatgactttggcaacctgcgaggttctgtctgatagttttactcccgaaaatcttatcaatagatttatagaatattacagaagccgcaaattaacaggaattggcgcttctacacttaaggcaattttagatactgaagcgggttttcattggagtcaggctggacgaattggagagtttgccgcaggaaacggaggagcgatgagaattgctccttttgcttttttctcagatattacaagagagaatgtttacgaagcatgtaaattaacacatagaaatgatgaagcgttttctggagctttagctgtttttctttctataaaagcaatcctcaattctgattggaacggaaaaaataatctttttgatattattattccagaaattcctgatacaaatgtaagagacaggttaatcgaaatcaattcaattggaaataactcttcaatttcagaaatatcaaaattaggtaataatggctatgttgttaattcagttccttttgcaatttattgctcaaccaaaattattgatttaggtctggaagaaatgttgaaacaaattatcagtactggaggagatacagataccaacgcttcaattgccgggcaaattgccggaacattaatcggaactgaaaatattccttatgaattaattttaaagcttagaaaattacccgattacaaatggatcaagcgtgttattgatgcgacaaaacagagaatcagttaaaatattattgattgcttttttccgcaaaacagaaaatattcccgagtttgatactggaatagccattactttttattttcgaagaattaatcatagcctttgccaggatatccgtcggcagaggtttttgactttctaataaacccaatttattggcaaatttgataatacggcttcccaaaacttctccggttctttcagaatcttttcgctcaagcattcctggtttgaaaatagtaatcttattaaaatgtaactgttttacagcttcttcaagttcccctttcattttggaatagaaaattttagactgcgggttagctccgtaagctgataccagaatataatcttccacattgttctctttcgccgcttttgcaaattcatattgataatcaaaatctacttttttctgggcttccttgcttccggcatcctttaaagtcgttcccagacacgaaaaggcaacgtctccttttaccatatctttccattcttcaggcttttcaaaattcacaacatgaaccttaagcttatcattatgaatatcaacaggttttctgacgaaaatatctacttcatcaaattctttatcattgagtaactgattcaccagatcttttcctgtggcgcctgtagcacctattaccagagctttcataataattgtgattttgtaagattatttctttcttaaatttactaaatttgaattaaagagtaaagaattaatttaatcattactcattgcttatcactcattactcaattaatatggatgccaacgaaattttagattactgtcttgccaaaaaaggagttacggaaagttttccgtttgataacgaaacacttgtaatgaaggtagataccaaaatgtttttattaatgggccttgaaaaacaaccgctggcgatcaatgtaaaaacagatcctgaatggagtgcagagcttcgtgagcagtatccacagattacaggggcctaccacatgaacaaaacccactggaattctgtaacagtggacggattgaaaagagacctgatctttaaacttattgaccaatcctatgatctggtttttaaatccctgactaagaaagctcagaatgaagtcaattctttgtagaaaataagaaaagacagggtatggtatttgttatctttcaacagtgaaatatatattaaatagtaataaaaataaataacaaatgagaaattaccttttattattcgtaacggccggaacgttgatgctgacaagctgtaccaagccggtaaataaaaatactgatacaaaaacagaatctgctctatcagctactgaaaaagctcccggaactcttaaaatagaattttcagggacagatcaatttaccataaaaagtgccctgcttaaagtaagcttatatggagtagacgaaaaactggctgatgcgcctgccacattaattacagaacaggagtatgaacagaagtcggtacctttcaccatcaatctgcctataccggaagatgccgaaagcaagattaatccaaagcctgcaggcccaaaatactatgtggcgataagctgggattctgacggcaatgggaaagccggtgaaaaaggtgatattgttattgactatgacaagcagtttccgaatgtaaaactggataatgaaactcagaaaatctacttaaaacaattgaaataaatcaaaaggctattcggtgagaatagccttaactttttaaaaattgaattcttctgttaatttcttatcgtcatccagcctttcaatcaacttgtcaagaccttcaaatttgatttcatcatgaagaaaatccctgaaacttaccgtaatcttttcgttataaatatcctcatcaaaatcaaggatataaacctccacagtcagtttttctccgtttaccgtcgggttggttccaatgctcagcattcctttatattggttgccctttacaaatacctctacaatataagctccttttttaggtaaaagcttgatagattctgtatcaatattagccgttggatatccgattgttcttccgattttcttgccatgcaccacagttccggaaacagagtaggaatatcccagcatttcattggcttcctgaatattgcctgctaaaagtgcattacgcacttttgtggaactgatgttgttttcatgaatattgatagcctccatttgttcaacttcaaaaccaagttcttttgacaatttttgaaggagctcaaaatttccgcttttgttttttccgaaagaatgatcgtagcctataataagatactttacattaagcttatcaactaaaatctgacgtacaaattcttctccggtcagatttctgaattcttcatcaaattctttcagaaacagattatcaatgccatatttctccacaagctgtttcttttcctccagggtattcagaagctttaaatcttcattcggattaaaaacaaaccttgggtgcggccagaaagtgaggatagcagtttccagattattttctgtacctatttgagtcagttcatcgataatacttttgtgtccgagatgtaccccgtcaaacattcctaaagataatgctaaaggcttctgtgaggaataatctgtaaaattcttgaaaactttcaaaacggaaaaattttgattgcaaatatagatataatgtaacaatctatcaatataacaatgtatcaatatttccggaagggaaaatatgagtgtgggagaggtaaattgctgtattagtaaatttgtaaaagcatgataaaaatcttttttttaccaattgcgggtttatgaagaatcactatatttgcaccaagaaaaaatttagcaatggcaaaccaaattaaaggtaaaatttctcaaattattggtccggtaatcgacgttgtcttcacagatgtggaagctgttccagcaatctatgacgcgttagaaattacaaaagaaaacggtgaaaaagtagttttagaggtagaacaacatattggcgaagatacagtaagatgtattgcaatggacgctactgacggtcttaagagaggacaagatgtaatcggattcggaaatcctattatgatgccaatcggagaggctgtaaacggaagactattcaacgttgttggtgatgctatcgacggacttcaagatatttctaaggatggtggtcttccaattcacagaccagctccaaaatttgatcaattatcaacttcagcagaagttttatttacaggtattaaagtaatcgacctagttgagccttacgcaaaaggaggtaaaattggattgttcggtggtgccggtgtaggtaaaacagtattgatccaggagttgattaacaatattgcaaaaggacacggaggtctttcagtatttgccggagtaggtgaaagaacgagagaaggaaatgaccttttaagagagatgttggaatcaggtatcatcaagtatggtgatgatttcatgcactctatggaaaacggaggttgggatctttctaaagtagatttagaagcgatgaaagattcaaaagcagcattcgttttcggacagatgaacgagccgccaggtgcaagagcaagagtagcactttctggtcttactttagctgagtactacagagacggtggagaaagcggacaaggtagagacgtacttttcttcgtagacaacatcttccgttttacacaggctggttctgaggtatctgcacttcttggtcgtatgccatcagcggtaggttaccaacctacacttgcttctgaaatgggtgcgatgcaggaaagaattacttcaactaaaaatggttcaattacttcagtacaggcggtatacgtacctgcggatgacttaactgacccggctcctgcaactacgtttgctcaccttgatgcaactacagtactagacagaaagattgcttcattaggtatctatcctgcggtagatccattggcttctacttcaagaatccttgctccggaagttattggtcacgatcactacaactgtgctcaaagagtaaaagaaatccttcaaagatataaagcacttcaggatatcatcgcgatccttggtatggaagaactttctgaagaagataaagcggttgtataccgtgcaagaaaagttcagagattcttatctcagcctttccacgtagcagagcagtttacaggtatcccgggatcattggtagacatcaaagataccatcaaaggattcaacatgattatggatggtgaattagatcacttaccggaagcagctttcaacctgaaaggaactattgaagaagctatcgaagctggacaaaaaatgttggctgaaaacgcataaattattaacaatttgagatttgaaatttgagattcgatgagtaatttcaaatttcaaacatcaaatttcaaatttgtttctatgaatataaaaattttaacaccagaatacgtagtttttgaaggtgaagtagactcagtattactgcctggaaagaatggtgaattccacatcatgaaaaaccacgcaggaattgtttcttctttggtaggaggtgatgtaaagctttttgccaattctattgatgaggcttttgctaaaaacttcacgaaagaatctggaaaagactctgtttttgcttatgctatcaaaagcggtgttgtagaatttaatcataataaaggcattatcctttgtgaataattaaatgaaaagctaaatatattttcaagaaagtgtaactttgtgttacactttttttattgatgtaaaagtctgattttatgaagaaaagtataatcatattctttacagttctgagtgttttcctccatgctcagaatatcaaaaccaagaggggaattattaatatagacggcattccggtggctaagctatccaacaaatccagcgaatatacttttatggatctgaaggagaccccgatatacacgataaagtttattgataaaagtatcgttgattccgtgcgtgacagctatatcagtatcaacagggtatacaacagggataaaactatagaagtagactattcatcaccttctgctttttcgggagaagaaaaatctgcagtttttacttcagtgaaagatcttaagatcattgataacaaaggcatcaatgtcaaaaatcttgatgagcttttttccaatgttccgaaaaggaaactggacgctaaaacaaaagatgcttatgcgatcagaaagaaaatagacaagatgaatattgaggtcaataaagtaggagagattctcagcaatggtgttcctgtagggtattttaccaatttacctgtaagctttggatctgaagatacaattatggataaaacgcctatagatattgaaatctatgatgccaaaagcaagcttatcggaaggtatatcacgaccacaaaacagcttaaaacagccggaggcaaatcttttactatttacagggaaatgtcggggagagcttctattctgaaattccctacctataaagccttagcagaacgcatggcgatcatggatcctaattttattaaagttcaggagaaagtctctgtaggtaacgtatcaaaggagactccaaattaaagctctgattaaaaaagaaaaatattttcgtatcaataggaacgggctttagcccgttttttattatggattaaattcatccgttttcagtcaaaacttaaaccaccccgtcaaaaattctttgaattttcgccacccctccggaggaggggaatattttgccgttttatttgtagtagttagaaatttggatttgatttcttagttatggaaaatagaagattctctctcaaaattaagatctgtgcaaatccgcgaaatctgtgggaaattaaattcaagcaggtgttattcgttcagaaaaaaatgacaaaaattctgcaatcacaaaaatccctgagaaaaaacggaaatttttataaacttaaaatcactccgttttccttcaattgctgcatcggttttgagaaccagaacagttcaaaatcttcaaaattttcctcaaaattatttttaagttgctgaactgtaggttttttagaattttcaattgcattttcttccagcacattcatcagccatccagctttttcctgttccagttcaatctttacaatattggtttttaagtggaatgtaagcagcgtatatgtaccggaatatttctttttattttttacgcgattctcagcgattacgtttttagttaaaaagacaacttttgaattcgttttcaattgaaactgcccatcttccaaaagacagtcgtgaatgtaatcctgatgaatagttgttctcggaattttaaaatcaaaccattcctggagcggcaattcaaaattgactccatgcatatagttgaacagagatttctttaatccaaaactaaacttgttatgatcgattccggttttatctttaaaatccacatcattattggcaaacaggatttcctgctttacgggaaccaccccaaaatcttccgggctcattccaacaggcgaatgtgctgtcatagcaaactgatgccagaaaccactttgaagaattcccatctcaaacatctgtctgaccatttccaatgaatcaacagtttcctgaacggtttgagtagggtagccatacatcagataagcatggaccataattccggcttcagtaaaatttctggttacattggcaacctgttccaccgaaactcctttatcaattaatttcagcaatcggtcactggccacttcaagccctccggaaacggctacacatcctgaaagtttcagaagatagcacaaatcacgggtgaaacttttttcaaagcggatattcgtccaccaggtaacgaccaggtttcttcggagaatttccagagctacttctctcattaaagcaggtggtgccgcttcatctacaaaatggaatcctgtttcgccggttgttctgatcaattcttcaatccgatctaccagaattttagcagaaataggttcgtagatcttgatataatctaaagaaatatcgcagaaggtacattttccccagtagcatccatgtgccattgtcagtttgttccatcttccgtcactccataaactgtgcatgggattggcgatttcaataacggaaatatattgatccagttttagatctgtataatcgggagttcctatttcagattgtttaaaatcatgtcttttagaattgtttttatagacaactacattattttcgagaacgaaagtccttttaaattcagcttcttccgcagggatttctaaattctgatgaagcagttccaacggaagttcgccatcatctaaagtaataaaatcgaaaaactcaaaaactctctggtctttaacttctcttaattctgtattgggaaaacctcctcccatcgcaattttaatgtgagggtagtgcgttttgatccattgggcacatttgaaaccggaatacagattccccggaaaaggtattgaaaaacaaaccagtttaggctgtacggcttcgattttttcctgaagaattttcaaagtaaactcatcaataaaggtgggctcaccagataacttagaatataattcatcaaaagaattggcactttttccaagacgttctgcatatctgctgaaaccaaaatcaggatcaatattttctacaatataatcggaaatatcttctaagtagagagttgccaaatgtttggctttatcctgaagtcccatatttccaaaagcaaattccatatcatccagctggttgaaacgggaagcttccggaagaaagttcatgctgcagatctgtcttgccaatgttggtgtttttccctgtaaaaaagggataacctgatctatcgtttttaaatactcttctcttaaagcataaattctctgggaattttcagaggtattctgaagatcaatttctttattgaaaaccttctggattccgtctttagaaaataattccaaaataacatcgatccccagatctacctgatagctggaaatatttttggtatttagaaaccctttaatataagccgtggcaggataaggagtattaagttgggtaaaaggcggagtaataagaagcaggtctttcaacagaaaatttttgcaaagttattccaaagtttttttagaaaaaaatttttccccctgattataaacagtgaggaaaagtctttagagttccggcttattgcaatttctgtctcaaaacaaatcagccggtttaataaataagtgatccggagcactattttcaataaagcttaaaaaagcatcttcatcgaaatatccgtcctgatcaagaatcgcaggattcaacaataccatttcactgggtttttccagactgatattctcaatgaattttccagttttcccggttatttcattatgaaaactgattaaatatctggagtaaatatttccttcagctacagtgtaatgcccgttttctgcaataagtgcggtcataatactgcctccggtataggtttcattatcattaccagacgctccgaacaatactctggcagtaatggttcctgaacagtataaagaaccgttgatgattatattttctgcctctatattaccggttacaataagaactatatagtcttcaacatatagttttccggataaatgaagatcaccttctatgagaacaattttatatccttcgccttctttggtaatcagttcgagagatgtattgttttcactttctgtgaggacaatttcggggacatcactttcatgattggtttgcagagaggcttcttttattttttctgcaatttcatcatccagcatttcaagaaattcagcaaggctttcttcatctaaagtgctttcattgaaaaaattattttcaagagcttcacgggtgatgttgtataagttttctgatttctctttaattctattatataactgatctttagtaagtttctgcaactctttcataggcttttataatcaatgcatttatctgttatagaaggggaacacctatcaatagacctatgcaatatagtcagataaattttgttataccagagggtgtaatgaattgttgaattttttcaatcagataatagatacaaatagttactttttatttaaatgatatggtccttattgataacattccagtttaggcatgattcagatttttacgatccgttattacatttaaagtaacccctaagaggatcagtgtaatgccgatcattaagttattggtgaatttttcatgaaatatcaggacactgatcaatactgcaactacaggttccagcgcccccagaatagcgacaggagtagatccgatatatttaatggcatacaccagacaaagactggatattaccgttgtgagaaatgcaaaaatgaggaagttaatgaaaatctctgcagaaggaataacgaaggatgcatcagccattgcagctttgctcataaagaacatggatgtaaaaaacatagaatagaaggtgagtttaaaccctgaaaccttaatgtttgatttgttgacaatcaccatatacagagcataaaaaagtgaactgagcatcacaattcccaatcctgtaaaattgatttccagcccgtttccttttaagcatagaacaataaccccggcaaaagcaagaagtaaagaaactattgataatcttgccagtttctctttgtagaaaaaaaacataagcaatgcaacaataacagggtaaataaataaaacggtagaagcaattcctggcgtaaggaaatcatatcccaaaaacaaaaattccgaagaaagagcatagcaaactccaagaaccgccagtattaaggcttctcttttattgattttaaaactttctttggaatacacgagatatcctcccaccattaaagctgaaaagaaaaatctgtaaaacagcgtaatatccattgaaaagtgggcctgcttaacgggcaggataaaaatcggaatcaggccatatgaaacagccgacagaattcccagtgcgtaacctctaagtttcatgtgcttttatagttgagtcgtcctaaaataggttgacataaattaaacaatatttaatccggagagatattttatttcttcggattttttatgcactttatctggagtttgcatattaaggcttagatgtggataattagtattataaagacaaactatctacttgagaaactattcttaatttaaaggctatactgtagtctttttgtgtgcgcttttctctttttaatacttgatctttcataaataagtcgattagttgtcaacttatttcaggacgagacaagttattaaaaaaagccactgaatcaatcagtggcttttttttattttgatgaattaaatcggtttaaaacttaatccttgttcctgcagtaatttttgttcctgctctttgtagtagccacctactaatttatcatgaattgcttcaaatgctgccagagtttcattaatctcagcatctgtatgagaagcggtaggaataagtcttaaaagaatcattcccttcggaatgaccggatataccaccacagaggtgaagataccgtaattctctcttaaatccttaaccaatagagtagcctctaccggagttccctgcatcattaccggagttacacaagtattggtgtctccaatattgaatcctctttctttaagtccgttctgtagcttgtaaacattctcccaaagtttagctttgatctcaggtcttgatctcaatagttccagtcttttcagacctccgatcaccattggcatggtaagggattttgcgaagatttgtgatctcaggttgaatttcagatatctgatgatttctttatcacccgcaaggaatgctccgaaaccagccattgatttggcaaaagtagagaaatacacatcaatctgatcgttgcaatcctgctcttcacccacaccggcacctgttttaccaagtgttccgaaaccatgagcatcatctaccaataatctgaactggtattttgacttaaggtcgcagatctctttgatttttccctgctggcctctcatcccgaaaaccccttctgtaatcacaagaatacctcctcctgtttcttcagctaccttagttgctctctgaagatttttctcaagacttgccatatcgttgtgcttataagtaaatcttttacctgaatgaagtcttactccatccacgatgcaggcatgagaatccatatcataaacaattacatcatttctgcttaccagggcatcaatagtagaaaccattccctggtaaccgaagttcaataaatatgctgattctttttttacgaagtctgccaattctctttccagctgaaggtgctggtctgtttctccggacattgctcttgctcccatcgggtagaacattccatattcagccgccgcttttgcatccgcttcaattacttcaggatgattacacagccctaaatagtcattggcactccagaaaattacttctctaccctgaaactgcattctagggcctataggtccctctaatcttgggaaaataaaatagccttcaccataatctgcaaattgtccaagtggtcctggattttcttttattctttcaaaaatatccaacattgtatcgtaatttttaagtaataaagccttttttgtctgaatacgcaaaaggctttatttatttgtatcgtgattttattcgttcttatttgataaactccgttttgaaaacttcgtcatagttatgaacacagttgttgacaaatccctgctcagccatccatttatcactgtatactttagtgatgtatcttgagccatggtcaggataaattaaaacaaccaggtcgttttctgtaagttcatgagactgggcatactgcattagtccctgtgttacagctccggtagtgtagccacccatgatcgcttcttttaaagcaatttcgcgggttctgtaggcagacatttcatcatttacccttacaaactcatctaccttgtcaaaaagcagggcagaagggatcaggtttttacccattccctcaatctgataaggatgtacatcttctttgtgaatttctcctgtctcgtgatagctcttcagaatagaaccatctgcatctactccgatgatcttgatatccggatttttttccttcagaaacttcgccgaacctgataatgttccaccagttcctgtacaggcaaaaaggtgagtgatcttaccttgtgtctgttcccagatctcaggacctgttgtctgataatgtgcatcaatattaagctcgttaaaatattgattgatgtaaatagaattaggagtttccttagcgattcttttagctacttcataatatgatctgggatcatcagccggtacattggccggacatatatacaccgtcgctcccaatgctttcaggtaagcaattttttcgggttttgttttatcacttactgcaagaatacatttatatcccttaatgatacataccatcgcaatagaaaacccggtattaccggaagtagtttctacaactacagaatcttcttttaaaaggccttttttctctgcgttctctataatatgaagtgcgattcggtctttggtggaatgtccaggattatatgattctaacttggcataaacggttgctggaatatcttttgtaacagtatttagctttaccataggagtatgtcctatcaggccaaggatattatcgtaaacattactcattatttgttattttcaataaaaatctgactgcaaaaatacaaaaaaataaataattactaaacttttgtttgatttctagggcatagtttgtaaaaaattattttcgtattttcagttttgacacgagtataatcgcaaatactacgccaaaatttttaaattttgttaaaacccgcataaaataagataaaagccttattttcgcataattgatttaatactatgaaaaattggacttttaggcaatggaacaccgtctcaggatgggtgattttcgtcattgcgtttttcacgtacttgtccaccatagaacccaatttcagtttctgggattgtggcgagtacatttcttctgcagtaaaactcgaagtaacgcacgctcccggagctgctttatttcagatagtgggtgccgtggcagccatttttgcattagggaaaggcgaaaattactccatcgtgatcaacgcgatgtctgcattgttcagtgcgctgactattttatttttgttctggacgattacccactttgtgagaagacttttgaacaaagattttgaagaaattacgaaacatcaggaaatctctatcttatttgccggagcagtaggagcactttgctttacattctcagatacattctggttctcagcagtagagggagaggtttattctatggcttctatgtttattgcgcttttggtctggttgatcaccaaatgggagaatgagtataaagcgggagacagtgaaagatggatcattcttattttcttcgttttaggactttctgtgggagtgcatatgatgtgtatgctggcgatccctgcagtatgtctggtatattatgcaagaaattataagtttacctggaaaaactttatctgggcaaaccttatcacattgggaattttgattattgttttcaaaattattttccctctgattatgacgatgttcggaagacttgagattttcttcgtgaatggtcttggacttcctttccactccggaacaattgctgcttttgttttgatggtagtgatttgctatttcttaatcaagtatgcaagaaaagcaaaaagaaacatctatcagacggctgcactatctgtggtgtttatgatgatcggattctcctgctggatggttattccaatcagagcaaacgccaatccgccgatgaaccttaatgatccggatacagcaattggtatgctggattattataacagagagcagtatggtgactggccaacaatctacgggcagaattatactgcattcctggatgctaacggaattgagaaaaatgaggacggaagcttcaagacacaaaaaaccggagaaatctacgaaaaagatgaaaaaaccggaacatacagaaaaaccggagaccgtttcaactatatattcagcaagtctcaggtaagcttaatgccgagaatgtttaacgaagataaggatgtaatggcgaactatatttcgatgtatggtgctcctgattttacattcaactatgctaacgaagatgtggcagacaatccgcaggctaagcagatctttgatgagctgagagcaaaatatgaagataaatcgattaccgcttcagattatctgaaggtaaaaccttataacctcatcaatgttcagaagccttcgttccttcagaatatggattatttcatcactttccagaatggatattactttgtaagatatctgatgtggaactttgtaggaagacagaatgaccttgaaggaaacatggaaagcacaaaaggaaactggatttccggaattccttttgtcgataatgctgtggtaggaaaccaggataaaatgcctgcgaagtttaagaatgaaagcacagtgaaattcttcttccttccattaattttaggtttaatcggattctttttccaattaaacagagacttcggaagattctatgcgttgttgtctttattcattttaacaagtgtaggaattatcttctatacaggagtaaagccttttgagccgagagaaagagattatgcaatggtaggttcattctacgcatttgctatctggatcggtgtgggagccggagcaattttgtggttcctgcagtctaaagtaaaatcaaacggagccaacattgctctgggagtggttttattaggggtaccttttatgatgggcttccagaactacaacgttcacgacagaagcaaccgatacacagcgtatgattatgcgtattccgttttaaaatcattaccgaaaaacgatatccttttcgtgtatggtgataacgatacttacccggtttgggcaattcaggaaacagaaagattcagagatgatgtaaaggtggttaactttaccctggcttcaactccttggaaccttgaccagatcaaaagaagaacttacaatgcgatgggaatccctagccagctaacacatgaagattacagagatggggtaaacgaccagatctatatgatgaagaaagaagattgggaaggtgtattctctatgctgaaagaacagggagctcctgaaagtgaattccagtctttcagaaaataccttactcaggattctttaacattgaaacaggcgattgagttcatcaaattcaaatctcctgaaaaagatgagttattgaaaatgtattttggggaagagaagtttgaaaaatacaatatccttccggtaaacaaattcatccttcctgtcaataaagaaaatgctttaaaagctgggattatcaacaaagaagaccttccgaatgttgctaatcagatcatgattacttacaaaggaaacacattgtataagaataacctgattttaatggatcttttagcgaacttcgactggaagcgtcctatcaacttctcatcaggaggtatttatgacagtgagaatattttctatctgaatgattatcttcagtttgacggattcagttacagattaattcctatccaaacacctccgacagctgatggcgatatgggaagagtagatgccaattctctttataatgtggtgaaaaacttcagatgggggaacttcaaaaacttaaatgctcactttgatgaaacggcaacttctaatatcatcagctacagaatgtcggcgagcagagcggcagcggcccttgcattaagcggacagaaagctaaagcattggaaattctggatcttgcagcaaaagaaattccggcagagaaatataatgatccacgttcattaagttcaattgtttcaggatacatcattgcagggcaggagcagaaaggtcttcagattgctgaagtacttaaaaaaggaatctttgaagaatacgattattatttaagcctttccaaagcagaccaaagctacctgagaagacaaatgagaacaaaacctatggaatattctcttgtcgtttctgcagtaacagatgcttacacgaagatcggacagaaagaaaaagcatatgcttatctggtaaaatccattgagccgattgataagaagttcaatgtgtttatcaaagatcttcaggaaatgggcagagataaggcaatgaaagagtctgaaaatgtacagcagatcacgccattctatcagtacttatttgatgtcatggaaccttatgattctacttattcaaaagaaaaagaaagtcagatcacgaacgcgattatcaaagcgacaaaataaaaatactttaaaacggaacttcggttccgtttttttattattgggaatcctgaatattaagattatatttgtgaaactaaaaatacataatggctgaaacaaataatagcaggttcccaatctatgccgtaattgctacagttgcttttaaactcctttttttactgacacattatatccaggaagatgcatttattacctggagagttgctcagaatttgttggattatggtgtgatcgggttcaatggagacaccaaaatctctgcatctacaacacatttgtatgtttttgtatcttattttttcaaccttgtttttggaaaggagaactttattgagcctcttttgatttttaattcaatattgtttacgataggaactttattgctgtcccatttagtgcttaaaaacccctggcataaagcgatcttcatattcctgatcggtattttacctccggctattaaaatttcaattctaggaatggagtatggaattttgttctttcttgaaatgtcattattatattatggcttccacaaaggaaagaaatgggtattgacgtttcttccggtcttaattatgtttaccagaatcgatacggtaatattcctgggaattgtatttctggtagatgtattctggaacagaaaaatcagatggaattacatttttggcggaattctgggtgttttatcaacagtcgcttttaattggttttactttggtgaactggtgaacaataccattacggcaaaaaagctactttacagtgaagactttacgatccagcagcatattggttacttttttaagagtttcggaaacttctggggaatgctgaaagttcccggagattttaaccctgtcaccatagttgtattgatctttgagctgctttgctttatttatctgatcagacagagagaaaagagaaattactttttgtggatgatttttatcttcggatgggtaaaacaaattatttttatttctcaaaaaagcttatttgactggtattactgggttccgcagatcttacttttcgttcccgttcttatttttgtactggagcagaaggagagaagaaatctttggctgtccttattggttatattctatattttcccgatgcttgtttttcaaaccgttcattctattgctacaggaaatggagaatggaattacagaagaacgataggtatttttttaaatcaatatgaaaaagacaaaaaccaatggattctgcttgagccggcaggatatgttccttatttttcaggattaaaaacgatagatgaggttggattggtagataaacagattcaggaagaaattaaaaaggataaagtaaattactggatcaatacagtaaaaacaagaaaaccgaaatatcttctctcttacaaaaacctgtatgagggcaataatgactattcaagatattatcaaacccattataaactattgaaggaattccgggtgaaagatcacctgaaaagcgataataagattttagaaaaaatttaccatctgaaaccttccggaacagactataatttgtacattagagttgattaaaagattaaaatatttaaaaattgaaagcattcagaaaaaaagttttataataactctttcactctaatactctcaaaccctccaaccctccaacccaatataatccctaaaaaaatgaattactgtgcttttctccgcggcgtcaacgtaaaaggaactaacatgaaaatggcagatgtctgccaggtctttaaagatgccggcatgaatgaggtgagctcaatactggcgtccggaaatattgtgttttcttccgataaaaatagtgatgaattgaagacaattctggaaaaagcaatgtcagagcatttttcttatgaagcatttttgtttgtgagatctcaggaagaagcagaagtgttgtggaacagtattccttatgaaaagaatgatacatttcacatttatggctttataggaattccgggtgtggaaaaggttctgatggaggagtttcagaaagcggctcaggatgaaaatgaaaaagctgcgattgttaatggtatattttactggcaggttcctaaaggaaatactttggattctacctttggaaaagtattaggtaaaaagagccttaaagatcagtttaccagcaggaatgtaaatacgtttgagaaggtcttgaagaagatggggtaaaatattccatagttgggtttaatattttctgattatttttaagttttggctgaaaccaatggctgtttgttttatttgtaaacgggctaaagcccgttcctattgattttttaatctgcaaacagtggaattgttcacaaaaattacacagattctacctttggaaagtactgggcaaaaaaagttttaaagatcagtttatcagcaggaaggtgaacaggcatgagaaaattttaaaaaattctaaataattatcgcaatgcttcggcaggctcagcatgacaccgctaaaaaataacgttaatataatgtggcttcgacgtaggtttttgtacattgatggtttatactttgtattataattttcacattaataaaacagctagtattagagttgtcatgctgagcttgtcgaagcatctatcacttatcacttatccagtgccgattaacagttaggattagggttgtcatgctgagcctgtcgaagcatctatcaataaataataagaaatccaaaagccaaaaactattgcagccatagcctgttaaagcaatcaaataatttccatttgtgaaactttctcagtatttttactgaacttttaatgacaacaaaaatgattcagtatttagataatatttcgcacaaagattcaaaaaactttttccttattgccggtccttgtattatagaaggagaagatatggcactaagaatcgctgaaaaagtaatcagtattacggataaatataatattccatacattttcaaaggaagtttcaaaaaagcaaacagaagccgtgtagattctttcacaaccattggagaagagaaatctcttgaaatccttaaaaaagtaggagagactttcaatattcctactacaacagatattcatgagaatgagcatgcggcattggcagcacaatatgtggatgttctgcagattcctgcattccttgttcgccagactgatttattgatcgctgcagcaaaaacaggaaaatgtgttaccctgaaaaaaggacagttcctttctccggaagcgatgaagtttgccgttcagaaagtaacagattcccataaccagaaagtggctattattgaaagaggaaattctttcggatatacagatcttatcgtggattacagaggaattcctacgatgagagagtacgctcctgtgatacttgacgttacacattccttgcaacagcctaatcaaagctcaggggttacaggaggaagaccagaccttattgaaacggttgctaaagcaggaattgcagtaggagcagacggaattttcatcgaaacacatcctacaccggaaaccgcattatctgatggtgccaatatgttaagattagatttattagaagatttgttacaaaaattaacaagaattagagaatcgattttgtaattgttaaaaaaacattaattttagaaattctaaaacatttcttttgaaaaaactagttttaccgctaagccttatggtcccgtttctgattttctctcaacaaagaaaaaaagatacagcgaccactaaagtaaccgatatagaggaagttgtcttccagaaaaaagcaacaggaagaaccaatgaccttaccaacgtaagaatttcagcgaaagaagccaaatcagtagcttctattaatggtggaattgaaggattgcttaaaacactaccttccgtaaactccaatacagagctgtcttcccaatatatggttcgtggcggaaactatgatgaaaaccttatctacattaatgatattgagatttacagacctttcctgatcagaaactcgcaacaggaagggatgagtatcatcaatcccgatatggtttctacagttaatttctctgcaggaggatttgaagctaaatatggagataaaatgtcttctgctttaaatatctattatcgtgagcctgaaaaatttgaagtttcaggagaagcaagtttaataggtggaagattgacaacaggtttggcttcaaaaaataaaaagtttacagccttattttccggaagatacagaaataccaatcttgttcttaacactctgaaggaagatacggattttaacccgacctattgggatttccagtcttatctgaattatcatgtcagtgataaattctctatgtcattcattgggtattattccaaaaatgattatgagatgattcccagagcaaaaagtgttactttcggaagtcttcagcagcctattacggtggatatagggtatgcgggtaaagaaaatgaccagtataaaaatatgatgggtacattctctatgaactataagccagccgacaaatggaaacttacattggatgcttttgcctatcagaacagagaaagagaatactatacaatcaattcaggatatgaattgcagacttttgatcctgtgacgcagcagccggtaacatcgtttgacgtcggcggacagatagaacatgcaagaaatgacctgtttgtaagaacctatggaacccagttcagggccaaattttcacccaatgtaaataccgactttgaggttggatttaaatatgaaaaagaaaacctgaaagatcttaccaatgaatggaaggttgtagattctgcagggtacagcctgccaagacctgaaattattgatccgagaacaggaatgacaggtgatcttaaacttgcgtattatattgccgggcaaaacaatattgagcctacaagactttctgcatatgcacaatactcacagaaattctattggggagccagtaaagtatttgtgaatgccggagtacgtgtggccaactggagtttcaataaagaaacgatattctctccaagagcccagtttgcgattaagcctgattgggacagtgatatgttgttcaaaatttcagggggaatctattatcaggctcctttctataaagagattaaggatttagacggtaattttaactctaacataaaatcgcagcgttctatccaggttattcttgccaatgattatgagttccagatgtatgacagaccatttaaactgactacagaactttattacaagaaactggataatctgatcccgtattatatggataacgtaagaattcgttattccggacagaacaattccaaaggttatgcttatggtattgatacaagattattcggggaatttgttcctggtgtagattcctggttgtctgcaagttatgctagagtgtatgaaaatattgatggaagaggagatattccaagacctacagaccaaaggttgaggtttgccatgttctatcaggattatatgccaagttttccgtctatgcgtgtcaatcttactttagtctatgctatgggattacctacaggagcgcctgtcatgttcaacagcaacggacagccggattttggttcagcgtataattatcagcagactcttccttcttataaaagggtagatttaggattgacaaaggtatttattgatccgaaagaaaaaaataagagatccggtttctggggtaatttcgaagaactgacattaggagttcaggttttcaacgcattcaatattaacaatactgttgcaaaccaatggattacagattacaataccaattatatgtatcctgttccggtacgtcttacagggcgtttcttcaatgtgaagctagaatttaaactgtaaaatccactcaatcagaatcatctgaagataaaaataaaagatcctctgaaaaataattcagaggattttatttgcctgaaattttataactatggtttctctgataacccttatttttcaaaatgtacaatataataacaacaattgattgattttaaatcagttaattataaatttaaattatattgatggaataagtaaatttgaaggttagtagaaatgttatgagcaatattatatttaaaataaacgaaaagatagaaattaaaacaattaaagatttatttttcatgtccaattatttgccaattattgacatggatgatgactttcgtttacaaaaaatgtttgataatgcaaaccttgttgtatctgcctggtcagaaaataaattagtaggtattgcccggtcactatgcgactttagctattgttgttacttatctgatatttgtgtaaacaaagaattcaggcatttaaatattgggaaaagattaattgaaataacaaaagaacaggcaggaaaagaatgtaaaataattctccattcttcagaagatgcattaaatttctaccataaaattggaatgaaaagaatttcagaagcatttataatccaaagagaatattaaaatgagaaagcagcaattggggtggcaatggaatagttgaaaagttaatttctgaaaattttttgtttcccgaattttataacaacattaccaaattttataacaatcatattacagatatttttaactttgtcctaccaatgaaaaagattcttgccatattgttttctattttctacttcgggttttcttccggagcggcatttagcattcactattgcatgaaagaatttgtttccgtaagccagaaaacagatggtatctgtgcaaaatgcggtgttaaagataaaaaaggatgttgcaaaacagagatcaaagtagtaaaagtagatgattcccagagatcagatctgcttaaaattgactttttaggccagatttcagaagttccggttaaacatcagtttgctgtaattgataagtctttttcggcaaccaaatttactcagatccagatcaatgcgccgcccgaataccggccggtacctatctacatcaatcattgtaattttagaatttagaatccgtcagtcgtttccggtatcatcaattgtataccgttacgggcgacatgtcctgacgcatttactgatgcgttatccattcttattaaaagttaattctaaaatttaaaacaatgaaaaaatatatcatcacagcagccttatctttattctcaattatttcagtagcagcccaatctaaaaaggatgctcaggtctctaagctgtatcagaactatatcgctatcaaatcagctttggcttcagatgacgcagataaaacatcaaaagcagcaaacgaatttattaaaacagcttcagccatagactataaagttgtatctgaaggaaatcttaatattctcagaaaagatgcctctgctatttctgaagcaagaaccgttgcagcacaaagagaaacttttttcaacctttcagacaatatgattgctttgaccaaagagtttaagctttctgaaaagccggtatatgtacaatactgcccaatggcagatggaagctggctaagcgatgaaaaacagatcgcgaatccatattatgggaaatctatgcttacttgcgggagtgtaaagtcagaaattaattaattcttgtattattcttaaaaacaataagttgtatagcttgagttataattaaatttaagctatgcagcttctaaaagttcgaaatgttatgaaaaaattaataatgtttctggtgcttttattctctgtttttactttcgcacaaactacaaaaacgtattatacctgcccgatgcacccggaagtggtgtcatcaaaacccggagactgcccgaaatgcggaatgactcttgtgaaaaaaacagcagttataaaatccaaagtagcagcaaaaccggaaacgaaagcgatccctgcaacagagattaaaacaaaatctccagaaacaaaaataaataaggtaaaggaagcaactaagtttgagaaaacaaaagtaataaagccttctgttcaacctgagaaaaaagtcttaactcaagctcaaactgtttacacctgtcccatgcaccctgaggtggtttcagacaaacctggaaaatgccctaaatgtgggatggatctggtagaaaaagaagatcattcccgtcacacagacactgaaacgaaagaagaaaagtctgttctaaagcgtaattcagaaaacgggagaattactttcggaggaaaaacagttcgttatgatctgtatgtaaaagatacgattgtcaattttacaggaaaaaacagaagggctattgcaatcaacgggaaacttcaggctcctactttgtattttacagaaggtgacactgctgaaatctatctgcacaatatgcttaaggaaaataccggattgcactggcacggagtgattcttcccaatgaacatgatggtgttccatatcttaccacaaagcctgtaaaacctggagaaacccatttatataaattcagaatctctcaaaatggaacctattggtatcattctcacgaagctcttcaggaacagataggaatgaacggtattctggtctttaaaaaaagagaaggcgaaccgaaaacggagtacaatgctgaaattccggtattactgggcgattggagcaatgatgatccgatgcagatcgcaagaaggcttcatatggcgaatacagactggtatgctgtaaagaaaaatgcagtacagagttactgggaagccattaagtccgggaatttaggaacaaaagtcctgaatgaatggaaaagaatggaagcaatggatgtaagtgatgtttattacgataaatttttgattaacggtactccaagttcagattattccaatttaaaaactggtgacaaagtaaggcttagagttgcgaatgggggttcttctacctatttctggctgaattatggaggcggaaagataaaagtagtgggaaatgacgggaatgatgtggtacctgtagaggttgaccgtctgattgtaggagtttccgaaacctatgatattgaagtgaccatccctgaaaataaaagctttgaattccgggcgacctcagaagacagaataggacacgcttcactttggctgggttccggtgaaaaggttgaagctcccaatcttccaaggcttatgctttttgaaggaatgaaaatgatgaacggaatgatggagatgagcgggaatatgaagcctatgaatatgacgatgggaaatcagatgatggatatgaatgaagtcatgtatccggaattatctgaaaatcaaagaaaaactacaatgaagcacattaatgagatgatgggcgtgaaaacgaaggaagacaagaaggaagatcattcccaacactcaggcatggatatgaaggaagaaaaagccatcaaaagattgtcttacaatattttaaaatctcctgaaaaaaccattcttcccacagacagtatccgtgaaatgaaatttacgctggaagggaatatgaaccattatctgtggactttggataacaaaaccgtaacagagacagataaaattctgatcaaaaaaggagaggttctcagaatcaagatgtataataattctatgatgcgtcacccgatgcaccttcacggtcatgatttcagattgatcaattcaaaaggagaatactctccactgaagaatgtagtggatatcatgccgatggaaaccgtaacgatagaatttgcagccaatcaggatggagactggtttttccactgccatattttataccatatgatggcgggaatgggaagaatcttcagctatgaaaattcaaaacccaatccacaacttccgaatagaaaattagcctggaaaaactttatacaggacaataaaatgacgagttctatggcaatgctggatgtggcaagcaataagattcatgcagaaaccatgaccatgtttgggccaagatgggctaaccttaatgagtttcataccaactggaattttgatcattttgaaggaagtgcaaaagtaggacgcttcttaggaaaatttcaatgggcattaccttatgcaggaatcaggattcagaagaatcatgagatcatggagagaaagatggcagaagatctgggaatggattttcatggcaaaaagacatggttcggacagcagaaagcctccagaaacaagtttgcatttatagtaggtatgcagtatgtgctgccaatgttgattactgctgacgcaagtgtggaccaaaacggaaaagtattactggaattgagccgtgaagatataccgctttccagaaggctgaggggaaatttcagtgtcaattcagatggtgagttttcaaccggagtgaggtatattcttcaaaaatggttatctgtttccggaaattatgataatgaactgggctggggcgcaggtgttactttaacctattaatttttttaaccctattatttaagaaacaatgaaaaatataataaccatactgtttgtgggggctacattatactcttgtaataaatccgatactacaatatctgaaaagaaagcagagccggaaattaaaacgactggcaaaactgaacctgctgaaatctcagatcagaaagtacaggaaagtccggaagaaagtaaaaaagaaacaaacaagctttcagcttttccgatccagcaaattatcaaaggctaccttcctctaaaaaatgcactggctcaggatgattctaaaaaagcatccgatgcggctaaaagtctgttttctgtattaaagaaaatagacatcagtaaaaccgatgctaaaaggaattctgagttgcgtgatattttagaaagtgctgcagaaaatgtagagcatatcattgaaaaatctgatgatatagcacatcagagagagcatctgctttccctgagcaatgatatcaccgatttaataaaagaacagggaacaggcggtctgaaattataccaggatttctgtcctatgtataataacggaaaaggagggacctggatcagtgaatcggaagagattatcaatccatatgaaggccagaaaatgattaactgtggctctgtaaaaaaagtattttaaaacatacaaagagatgaaccggaacattaaatatatatttttagggtttgttctcatttttttgcttattcaattcattcagcctgcccgtaatactgattatgggcaggtaccttcaacagatatttcaaacgtttataaagttcctgagaatgtacagtatgttttgaggaattcctgttatgactgtcacagtaattctactcattatcccttctattcctatatacaacctttaggatattatattgaaaagcatataagaaagggaaaagaagaattgaattttaatgaatggagtaattacagccgtcgtaaacagactcataaattagaatctgttgcgaatcaggtacagcagaaaaaaatgccgcttacctcttatacttatcttcatccggaagttgccctttctgaaaatcagataaaagagatgattcgctggatagagttggtgcagactgaaaataataaagcaaataagaattaaaaaataaaaagccatccgtttacagggtggctttgttgatagaaacataagtgtacagcttgtactgactatatagtttaacttttttcttttggtctttaatttaaaatgataaaatataactctccgacacctttttgaaaccatatttactaaaaaagttgtgagcgccatgattgttgactccactttctaataagataaaactgatgttccagcttttagattcatgaatggctttctcaagcagcttgctcccaagggattgtcctctcacagactgatccaggagcatatcttccagaatggcatattttttaaaaggactgttgatgacgttaaaaaccatcatgccgacaatttccccgttttcattttctgcaatcagaatattcagtttggaacttccatcagaattaaaatcggtgatcagctgctctgtcagaatcagctcaagatcaggattccaatggtgtgaatctatcgctctgccggacatcatttcgccatgagaaatatatgcatctgttttatgggtaataaaaaagtcgacaagttctttcacgcggcttttatcggtaagccattgggtagtatatttcataagctgcagtgtatttattttaattttttcaattcttccagcaatttattctgcttgttgataaattgattgagactgtctgttttcagagggtgagccttttggtatttttcaatttcaggaagcgtctttctgatcttgaaggcagcgtataagctgtaaatactttgcttgttacgattaattttatgcttaagatcttttattatttgaactttttgataataatcattttgactttcctcgatgagcttaatcatttcctttcttaaaaccgaatcattaatagattttgcttcattttttgcaatcaaataataatcttctgaattagaaatgatgctgctgtatataccttgcattttatgagcatcttcttgcattaaagatattttttcatctattttcttaatttctttatcatttttgattttttcatcatagatgccattaaatatatcctgagctttgcttagtcgttttacaggaatactggattctgtgttctcagctgctttttctacaatatcattttgtgattttttttcactgcaggaaattaaagaaagaaccacagcagaagcgaaaaatatttttttcatagtttgtttttataggtgcataatcaacattatatcccttctaaaattaatcatttagattttatcatcagtgattaaaggatatgaatttaattagttgaacaagctttgacaaatgttacatccaaaaaaaaaacggagcctgaaaacagactccgcctataaaatttttacgctaaaattatttacccaggtaagatttaaggatcttgcttctggtattgtgttttagtctcttaattgctttttctttgatctgacgaactctctctcttgtaagatcgaaagtctcaccaatttcctctaaagtcattgggtgttttccgttcagtccgaaatacaatcttactaaatcagcctctctaggcgtcaaagtattcaatgctctttcaatctcgatttgcagagattcaagcatcagatctttatcaggacttggagattctcctgaacgtaatacatcataaagattagaatcttcaccttctaccaaaggcgcatccatagacaggtgtcttccggagtttttcatagattctttaatatcttcctcgctcatatcaagaacttcagccaattcttccggagaaggtggtctttcattttcctgctcgaggtgagcgtatgctttattgattttgttgatagatccaatcttgttcaatggcaatcttacaattcttgactgctcagccaatgcctgtaaaattgattgacggatccaccatactgcataagagataaatttgaaacctctagtttcatcgtacctttttgccgctttcattaatcctaagttaccttcattgatcaaatcgggtaaagaaagaccctggttttggtattgcttagatacagatactacgaaacgaaggttggctttgattaatttctccagtgcggctctgtcgccggcacgtattctttgtgccaattctacttcctcgtccgcagtaatcagttccactttaccaatttcctgcaaatacttgtctaatgaagcagtttccctgttggtaacctgcttagtgatttttaattgtctcatttattttcctcaaaaaagagttactataatatatacgtatgaaaaggtaaaaaggttacacaggattcagtttttttgtacaatgtacaatgtaaaaacgtattaataatttttagtgataatttaaattattgataattaatcttttagatatatttatttttgattttaaaatatacaaactttataatttccctaaaccctaaaccctaaaccctaaaccctaaaccctaaactttaaacaaaaaaaaacgaaaccgaagtcccgtttttatatctaaaagtactatttcaggttatattaggttatccgcaaacccaaaactagcaactcgtaatctgcaattagaaaagttcgttcagcactttcgccagtctcaatccaccgtacaataattgtctttccattgtttcattaaacttgtactggtagtcgtaagataatttagaatcgttaggagtctgtgcatagatcttattggcgattttgtgagaatcgtacaaccagtcttccagagttccggcctgaatctttgctacttcttccttggatttaatatctaaaagcttagaatattcagtgtagctgtatttttgagaatctacaagttttccatcccaaacagagtgtaaattcgttttttccccgaaataggtaacattgattttgtttcctcccaaatcttcagctcttcctacgtgtagcggctgtgcaagatctcccataatgtgaataaggaagatcaaagcaatttttctgtctttttcagaggtatttttatctttgatctggcttgataacgtgtttacctgagtataaaggcttggtcctgcctgtgcttttaagttttgttcaaaagccttaaaatcagtcatcggatcaatgtttacataatgccatgatgaagcctgtttccatgcacctgtcgtatcagatttgataaaatccggccagttcgcccagtaagccagacgttctttccccataatctttttaatctcccttcttgctttacgggaaaggtggttttgtgcaatgtctgcaatcactctgtgtcccgttaatccccacgcataagaataaagtgaagaggccatgaatgctaaaatcagaattttagaataaatacttttcattttaaataacaattttcagtctgcaaagatacggcccgctttcggaatgagcatgcattatcctgaattaattccataaagatgatgttaataaaatttaatgtaaataaaagtcgcaattatggtaggtttgaaggcttaaaacccagaaagaatatagagtaacaggatgggggtagatattatatgataaagttttttagagattgagaataattcattccaactttaaaatgtagataataaacgttaatcatctgatactgaaagaataattttaaattcagaaaaacaaataaaccctttaattcccgtatttttacggaatttaacggaaattattccttttaatgtcaataaattagtatttttaaaataaaattattgtcaaaatattttttcaaacttaagagatatattatctttacaagtcataatcagaggaaacactatgtatgagaataatattgtagatatgcattacaataagctgcagacagactttaaggctgaagctgtggcagttaatcttttgaaataccatcgtgcggtaagcaatatattcatagagcgtgtcggcgtaaacgaccgtgcttacctgaaggatatcaaaagtatttcaagcagttatttaggatttgatgaagaagtatttaccatagagacttacagggagggtatttatgactatcttccggaagggttgttccatccgccgtctctgggtgcttccagaaaaaatgtagattctgtggtaagggaaatccgcagacaaaaaagagtggaagatgatgcgcgcaaatttttccgtccttttgaactggaggttttctttacggagatcagtgctctgctaaaagaatctgagtttgatattacgagcaatacagattctttattagatacaataagtgaactttggcctctgataaagatgctggataagcagagtgcctatatttttatgcatattttacctttcttccatcagatcagaggggacaaaagatggttcgaaagatgtatgacagcttttctgcaggtaccggtaaaagtaactttttctcccaatatcattgatgaaatagagaagaatgatgattccatgctattaggaaattcacgattgggagttacctatattcccagcgggccgcatatggacggacagcggaactgggtagtgaacattggtcctattccttacagagatatgaagaggtatatcccgggaagtccgttcagaaatgtacttcaggctctttatgattattttcttccggtaactgtagatgtggaagagaattttgtcacagaaaaggaagaatattccttcagtcttgaagacgatgaaagaaatgccagccgccttggatactctacattcctctaaattattttactatatttacaactaccaacaaagtataaattcgaaaagaaacaaatggaaatttcttcagtaaaaggtatttttttaaggtatattttaatgcctttaatcgcaattattatgatggttatactcggtgtaatcaggagaaataaacctgcgataaaaattaaagtaattattgtatacgtattgctgtgcagcttatgtctggctgttcctggttttttcggatttgccggaaatctttttaatccgtactggtatcttattgcacaggtgatctaccttattttagggattattcacgtgaaccttttacataagtatttcaaaaaacatattgattcccttgcgatgagcattctgtttgaatccatactgtctctgacatgtattgctttgggaggatacctttttaccctgctctttaagtggatgagtaacggattgggaaatggggtaatggcagcaactagtatgctgatttttgtggttcctatggtattttactactgttatatccagtttatcagcattccttttgatatttataaaacatggagatattctccggagcagaaactgcctgattttgaaggagcagattttgacagattaatggtattgaatgttgaactgagcaaaaaattagaagataccaaccgtttcagaattaaagccaaaacacttccgacaggagtgactttcggagactggttctacagggtggtagatgattacaatcataaaaatccgggttcaatcatacatctttcagacgaaggaaatgagccgtattactggatcttttacaccaaaaaatcgtttttcagctttagaaaatacatagatttcgaccacgatattacaacaaacaacatttctgaaaatgaagtggtgatttgtaagcgggttattcagcatgaagaggaaggaattgcaagaaaatcataaacacaaaaaattaaaaagtattaaacatgatacagcctattaaacattttgcgatcaattgggtggacgggatgaaagtttcccagagacaccttaatgatcaggataatttcttaattgataccatcagagattccaattcccttggaattactacatataattacggacttctgcctatttccaatgaatttacagaccgtaccatttttgatgttcacaacacggcgaccaatgatgtacagcttgtaatcaaacgttgcagcgctgtgacaatggcagggtaccgtattgagcttacagacagaagaatcagtgtgaagtctttggcaaaatcaatgaatgaagagcaggcagatggggaatattatattctgatctctgtaaatccttttgataaagtacctttcggagatattgatcctgaagaaattccgccacgtcatccaagtgcacagcctaatcatcatattgagctacttcctgtaacctctttgaacagcagttattcaggaggaaattaccttatcatcggaaaggtggatctcaaaggaaatattgcccaggtagattccaactttattcctccatgtacttctgtacagagtcatccggctttggtagactactacagcagttatgcaaagtctatcggaaaccttcagcagtatgcctttaaaatcattcagaaagcgtcccataagaatcagaataccgctttggcacaaaacgtcaagtttctgtgtacaacaatgatcaatacttttggtgatatgtatttccagttcagaaatattacgccgtggcagccgcctgtatttttgattgagtcttttgcaagactggcgcttcatttatacaactcaacccagcttcttgttcctgcagaactggaagaaatgctgaactacagtttagagtggagcgaaattgcccctcatactttactgaatcagctttctattgttgcagaaaccaattacgatcaccacaattgtggagaaccattactttacattcaacagatgctgagaagccttgaaaccattttctctaagctgagcgagcttgattacatcggtcagagaaaagaaaatatcattgttaatgaacaggaagtttctaccaataccaatcctaagagaggttggagtgttttagattaaatcatttattaaaaatagagtcccgggtgaaaatccgggattttttatgtccaagatagaaaaaattaaaagtaaatttgttgtaaggattgatagaaatgaatttagagattatcagacaggagacgcccggatgttcggataaaatatttttaaacagcgcaggggcatcattaatgcctaagaccgttacagatgctaccgttaagtttttatatgaagagcaggagttgggaggttacgcagctgccactcggaacacagataagatcggcaggttttatgaagaggctgcaaagcttatcaatacaaaaccttccaatattgcatttgtaagcagttctaccgatggctatgccaaagctttgtccagtattgattttaaagaaggagattgtatcattacgaccaatgatgattatatatccaatcagattgcttttatttctctgcagaaaagatatcatattgaaatcgtaagagctaccaatctttctgaccatgagcttgatctggaggattttgaaaacttaatcagaaagcatcatcctaaattaatcgcagtcactcatattcctaccaattccggattgattcagaatatagaaggagtagggaagttgtgtaagcaatatgatattctttatcttgtagatgcctgtcagtcggtaggacagctcgtggtagatgttgaaaaaatccattgtgattttctgacggccaccggaaggaaatttatgcgtggaccaagaggaacaggttttttatatgtttcggataaagctttggatagaaatatgtatcctttatttttagatagtatcggagccagatggtcttcctttgatgattttcagcttaatgataccgccagaagatttgaactttttgaaaggccctattcagcattgctgggatttgcagaagctttgcgttatgcgaatacgattggtatggataagattgaaagttacaatcatacattgtcagggactttaagagctcatcttcagagtagtggtttcaccgttctggataaagggaacagattaagcagtattattgccttctgccagccagacggagaggttgaaaaaattcacaaaatcctgagtgataacaatgtgttttttaaggaaaaccggagaggagatgcattaattgattttacttctaagaatgtggaacattcaatccgtttgtctcctcattattttaatacaatggaagaaattgaaactgtatcacagcttttaaaaagtatcagtcattagcatgctgtttaaatatttcgggccccggcattcgccggggcccgaagtatttattttttatttaaaagatcaagtgtgtgctctacatggccgccgcctttccattcatcatgtccgggaatgatcagggttgcctgagcgtatttggattttaacttttccattgtttttggccattgtgcaacgttggcttcgccggtgtatccaagatcggttgctgctttactttttacaagacaacctccgtccagtatcttatatttgggaaaccaaaccactacattatccgccgtatgaccttcaccaagaaagtctactacaaattcttctccaccaatacggtaaggtttaccggtttttataatttctgtagaagttgcttttccttctttctttaaaatttcattggtttttgctgtagcgtaggttttgattcctttgttattataaaagcttaaatctccggctctgtcttcatgagaatgggtggcaaataccacaataaccggcagatgatgacgtttttgaatggtatccatcaggctttggtattgtgttttctgccatggaacatcaaacaggacaactccttttttagtcaccagataaacggcattggtagaatattctttccctccgaatactccgaaagttttgtaaatataaaagttaggtttaatttgcggctcaattacaaaatctcttacctgtgtgtcctgggcgtttgccaatgggcttagcaacatcgaaataataaaaaacggaatgctttttttcataatttttgagtaataattaatgtttgtatttgtcagaaaagacaaagtctgcagattgttttgcaaacctaattaaaaataaatctttcgactttaaagagatggagtttaaccgttttttaacagtttaaggaataaatgtatttttccaggtaagtgcagattggtataaatagtaaacctaacaggttttaaaaacctgttaggtttatttttcagttttaatgatttatttcttaacgagtatcttctcagtagcttttttacttaaaacctcggtcttaccatcaatttctattgtcattgacatatcaaaactttcaattttaataatctttactttggtattcaggagaagttttctgtcattcaggtaggtcaggaaagcatcatcggaaagggtaacagatgcaaaagttacattttctcccggttcacagctgcttaatttctgcagatcctgggctatgatgttcccatctttatcaggaataggttctccatgaggatcgaatttaggatgatccagaatttcatccattttgtcaaaaaagatttgagaatgtacatgctcaagctgttccgcaatctcatgaacattttcccagccgaaattcattttttttaccaggaacatttcagtaagcctgtgcttacgaactacaagggcagcttcccgtcttcctttttctgtaacgattaagggtttgtaggtctcataaatcacccattttttctcggcaaatttcttcatcatgttattgacactcggcatttttacatttaaaaatttactgagctcattaatcgtaacctttccttcattgtcaactaaatgaaacaaagctttcaggtaattctcttctgttagggttgttctcaaaatgttagatgattttcactacaaatctaacaaaataaaatgaaaagtttacgcttgttattttaactttttttaattttactctatgaaattttcattcaaaaacgactattctgagggatgtcatcccactattttacaagctcttttacagcataatcttgaccagcaggccggatatggcgaagatgaatattccttaaaggccaaagatttaattaaggagaaaatcaataatcagcattcggatatttattttgtttccggaggtacgcaggctaacttaattgttatttcttcaattttaaaaccttatcagtgtgtgatttcagcttcttccgggcatatattaaacaatgaaaccggagctattgaagctacggggcacaaagtgctgagcattgaaactgaagatggcaagctgagaccgtcggatattattcctgtgctggaaaatcataagaatgtgccgcatcaggtgatgcctaaactggtttatatttccaattctacagagttgggaacaatttaccttgcgaaagaactggaagaactttctgttttctgtaaacaatataatttattcctctttatggatggagcgagattgggtcacggcctgacttctgaaataagtgatcttacgctggaaaaagtggcggcccttactgatgttttttatcttggaggaactaagaacggagctttgattggcgaagcgattgttattaataatcctgttcttcaggaagattttgcttttaatatcaaacagaaaggagcgttactggcaaaggggagacttttgggaatccagtttctggaactgatgaaaaataatctgtattttgatattgctcagcacgctaatcagcaggctatgaaaattaagaaagcattacagaaaaagggaactgcttttcttgcggatacttataccaatcagatttttcccatcttacctcataaccttattgaggttttgtctaaggattttgagttctatgtctggaaaaaaatagatgaaaatttttctgcggttcgtcttattacttcatggagcacaggagatgatgctgtgaaccggtttattgaaatgatagaaacagaattagcataaaaagaacagccttgaataaggctgttttttatttataattgatttttattttaaagctttgctcactactttacaatctgcagtgttcagcttctgtccgtctttatagctgattttcttttcgtcagcatatttggtctgtccatcttcttctttatgatcgccaataccttctgttaaagtattatctttctggatgaagtaaatatctctcttgcttttcttaccttcagaatcaaattcataggtcagcttcaatgtatctcctgatttaaaaccggtaacatctccttttgaactgtctttttcactgtttttataagataatttcccggtgatcgttcctaaattatcatcaatagaagcaaaaacactgtcttttcctgtaaccccaatataacagaatgattttggaccaagcgtatctattacaggctcttctgcagcaatcgtatctgctactgctttgggagccggtgcctcagtttttttattacagttgattaaaaaagctgatacagcgcccaataagattaattttttcatatccttaaatgttaaaatcaaatttctattctgctaaaataacaatagtattcgtatattaaaaataggatatgaagagataatgattttatgatgaaaattaatatttcagaaaagagttttaagaaaaaaaaattaatgctctcaaacataataaatatttttaggcacggaaaatgatctacttttttaaattgatttaatgaaaaagataactaaagtattgggtttggggctgtttattctaaacttatattttgtgactgcacaggctcctcagaattatatttacacttcttcgggagatctgcatgcaattgaaaagatgatcacccgtaaagatattggcggagtccagattgtttataactggaaagcactggaaacttcaaaagatgtgtatgatttttctgttattgagaaagatctcaattatctgacgggtctcaataaaaaattatttatccagcttcaggaccgtttttttgaaccacaggcaagatatgttcctgattatatattgaaggataaagaatataacgggggattggtacctcaatatgacaatcccggggagaataaacctgtaggaagtggttgggtaacccagcaatggaatccagctgtccgggatcggtttcagaaactgattggagaactggcgaagaagtttgacggaaagatccagggaattaattttccggaaacttccattgatatagaaatgaaaaaagataagacaggtttcagctgtgaccgttattttcaggctgaactggaaaatcttaaatttgcgagaagtgctttccgtgaatcctatgttttgcagtacgttaatttctttccctgtgaatgggaaaatgaccatcaatatatgtccagactgttcgattttgcctacaaaaataatataggattgggcggacctgatattgttccggataaaaaagcacagatgaagaattcttatccttttttcaaccaatacaaaggaaagctttctttggtggctatggccgttcaggagccaacgttaacgtataccaatccgaaaactaaaaaaccttttaccaaagaagaatttacagcatacgctgaaaactttctgggcgtaaaaattatcttctggagtgtggaatctctctggttgagagattcctgattgttctgataaaaagctgggtcaattctctgctcatacttttactattcctctgaatcctctggcagcataataagaatctgcaccgttgtgatacataaatacagtattgtatcgtctgtcgcagaaaacagcccctccaagttcacggatttgtggtggtgttttgatccagcttgaagttttttgatcaaattttcctaattcctgaagatgacggtattgttcctctgtcaaaagttcaattcccatttctttagctttgtcgatggcgttgctttccggtttattggcttttctggcattccaggctggataatcatagcacaggcttcggcgtttcgggctttccggggagcagtctacaaaagaatattcatctgtttttttattgtagtctactacgtcgggttcaccttcagtaacttccatttcgtataaagactgtatcttttctgggctggcttccagtttttgttggattctttcccatttcaggtctttatgacggttcatgtttttttcaaaacgggtttttagtgtttttaaaagctcgttgatttgttccggggttagtttatttttcatgccaaatttttgttttatagtgtagtgttgttggaaatcgcaaagacgcaagttttgttaatgagggattgtttaaggcgcaaagattttatctgcgataaaatttctttcttttttactcttaaatgattttaataaaaactgtttaacctatcaaagaatgttcagtatatattgaattattctgactttaagcttaaagcgaagctcgtcttcatattctaaatagcttaatacaatcttaatgtttcaaaaataaaagtttaaacaattttaatatcaaaataattaatcaatgatagtaattttcctttctgcaggtctgaagtaccaggaaataataaccaatatgaataataatactgcggggaaagttctgccagctgtgtcacccacaataagatgggaaatgacagctccggacattacaaagaaaaatcctgcataagcccattcttttaaaagcaaacgtttaggaattaagatcgcaataacgcccagaattttccatactccgatgatggtcatcaggtaagaaggatagccgagattggtaaagttggccagttcatctttgtttttcattagctggacaatggctgttgaaaccattcccagagccatccagagggtgaatatccaatagatgatttttgttcttttttgtgaggggtgtggtgtgttcatgatctgttttttatagttagtcgtttaatcctattccatccatgatttgtggaatgcatttttcaatgcgggcttcgcgggttttggactgtttggcagaggagaagtgaagcaggtaggctctttgtcttcctggtgttaatgctttaaaagcttcctgtaatgcaggattttgatccagcttctcctgaaactcttcagccatttcaaactcttttgttttcttcatttccactttagcgcctgattcttctatttcaacagcttcaaacatatattggcgaagaatgtcttccagatcattaatttgttccacatcagtaaaacggatctgccttgcagcctgcacattttcggtctgctgaatcaggatatggtccggatctttcatcaaggcccctttaaagaagagcagcgcacaatattccttaaaaccatgaatcaggaaaatatttttcccttcataagtataacagggacagccccattttaaatcttcaaccaattcggtgcttagagcgattgttcttagcttttcaaattcttctttccactgtgtggctttatcgaagaaaaaattcacttttggattcattgtgtggtatgtttgagggtttgagggtttgagagtattagagtggaagagttttgggtttcgggatgcgagattcggggtgtttaggtttgaggatttgagagtgggagagtataagggtttaaggtttaaagtttaatgttcaaggttctgttgtttattaaataatgattgacgattcacttgcgaagcaaaattcactatgacattgatgcccacaatttaaaccttgttgcccattgtctatcatctcttcgtctattctcttttcgtctctctaaacaattcctgcaaacggttatgcgccatattaataccttgggcgaatggcattttcagatgctggtctctgaagtctacagatttataaatggtctgaatggttattttactggtggcatccgttaatttttcaaattctaaaaactcgatctgaacgggaaaaggagtgttctccatctgaaaagttcttataattttctcattctgaacaatatcatgaatggttccgtttgcactgaaaaccacatcgccctgaggatttaaagtttcgaaacggtaacttccatgcggtttgttttcgaatttggttactttcgttctcatccattgcccgaaaagttctgcttctgtataggctttgaaaagcagttctacaggaaggtcaaattctctgatgatgaagatttcctgtttgccgtcttctgcgtgaatttttgttttgagttccatattttgagtttgagggtttgagagtgttagagtgggagagtattagaggaaagagttcaaggttttatgtttaaagttcaaggttgtcattctttcactggtgattgacgattcacttgcgaagcaaaattgactattgacattcgagtttaaggtttgaagtttaaagttcaaggttgtcatcctattcactgataattgacgattcacttgcgaagcaaaattgactattgacatccaccagttaaattttgatgctcttgtctattatctatccgtctatcatcttttatgtcttattattcacattctgatacgctttcatcacactttccagcttattgaatttctcatcccacattttgcggaaaggttctataaaatcggctatttctttcattttattgggattaaggtgatagataatttctctgccgttttgttcagatctcagcagttcgcattctgtaaggatctggagatgctttgaaacggtaggccttgccgtatcaaaattggaagcgatagctcccgccgtcatcgactgtgccgccaccaacatcaatatagaccgtctcgtaggatctgctatcgcctgaaatacatctcttcttaaattcattgtgtagttatttgactacaaatatatgtgtagttatttagctacgcaagttatttttgagaaaatatacaataaagtgaggtattctaataaaaatttattcgttccttagtcttagtttttcgagtatttcattaatatgattaggatatttatcttcaaaatattcaaagataagtggatttcctgcaaaaaaatgactacaaaacttaatccaagtgtttatgctcactataccgttcatcttgaaaagtttctgtgataaagtttttatatgaccttggttcttattgttgtaattgaaatctgaatcacgtcgtgcataatattggttttcattataaaaatggatagccccatcaaagtgcctgaaatatcccttttgcatatcatattctgcatgaatatatcttacaggaaaatattcaacattattttttattattttaatttcctcagttttaaattcttccgcctgaaaacttttaatattatcttttgtagtccatttaatatctaaggaatatgcatttctaaagaaagatgaaatatatgtatattcaatatccattggtggacgcaatttcactattccatcaggaattaaatcaattttattattgaattgagcaccataccatgtatcaagctctaagcaaggagaaccattaacatcaatccttactctatccatatcaatagatatataatgatctacattagtgtcattagattcccaaaagtattcaataaatcttggtgcatagttatttatttcatgaaactctctcctaaaatatgagttagccattaaaacaaaattttcatgaaacaagtaaccattgaaaaatgttttttttacgaatgttttattaagttcatcaaaatttattaatccgtctttgtctataactagatcttcaaccaaaagattaacaatattagggaaagatacaataatgccagaggtttgataaaaattaaagttatcatcagttaacttaatccctttatctttcatgattttcttgaaatattgaatttgaggtttatacttctcaagttcttctttttctatttctcgaagagcttttagatattcttctttaaaattatccatctcttttattatttatctattttgaaatattcttcagcttgtacaatcatctttaaggaaagccaccaaagataaataccgtaatagtttatttctaatggagaaattaatccatgagatattttgttcctaaaatttacactattaccatctattaaaaagctgtttaattctaataataaatttttttcacaaataccatcaagcattttcccattttcttttgtacttaatatgcctcctagagtattgtcattctgaatatcttctgaaagtaatatcgtgtttctattgttagattctatgatagattttaaactattttcaatttgaggaataaggagatgtgatgcaagtataaaattattctgaaatccactgtaaatcccttcaatgaataaatattctctatcttttgaaatgaatgagctcttacatttgttaatcatttctgctacccaatctttggatacctgtccatccaaatccattataaatttaatctcttggattaatgaaattgtaatatttctataatattctctttcttggtttagattaaactcttctgtatttgaaataccactaacagttcctttatttgtaatgtggacacttgtcggaaaatatcgttgataaaaattattgttttcttgctttttaataaaagtaggactaaaaattggacaccataatagaaaattgaaaccactataaaagtcgtcaatattttgttcttttattagctgaggaatatttaattttgatttgccagtagtgccaattattgatataatttctgcttctattttttgttccttttttatctttttttcaagtctagttttaaaacttttatctacaacaattccttttatttgttttagagcatcaagataagttgataatatgtttgggttatatgtattttcgtctttttgagacttataataatctgcctcttcttctaaacataatgctgtctctattttgagttcattatgattaaagtgccctaacttatttaacccctgaatataattaagagcattgccatactgatttgcttttaaactttcttttaatttaattataaaataatttttaagcttttctgaagaaacttcttgaattagaagattgatggaagcacttaaaagttttaattgataatatgatgattctaatctaaaaattatttctagtattttctcttctaatcgtataagatcttgtttaaaaatagattttacttttcgtattaattctagggaacgaattagataatctaattcatcagtcctttcatatattcttatataggagtctacagcattttttatacagtttaatttgtccttgtccccgagaataaattttatatcattaatcctagctgatatctcaatattgtcaatatgtatttcaggtaaaatgaacttagggtcttttaaaagattttcaatgctgtcctctgtaaggttgcagttaatgagctgatataagctatttatttgtttatctgtagaattgcttttccaaaggttaaataattcaaatcttagttcttttgaatacttgttgttcaggatttcttttgataattctttcatttcaaatatgatagctgtaaaatataaactaaggtatgtatgaatattgggtttatagttctatcatttgttcgtttatttcactaacaaatttagttgttgcagtaatcagctcttgaatttctttctttcctatattatgttcagttgatacctttgtctccttatcaatcttcgtttttccatttcgatgaactatatcatgtcttatttcaattgctttataaatagttgctttatcacttgggaatttgattgtaaaggtatccttaaacatttgattaactgtagaaagattatgatatattattcctaaaatttcatcagtaacaatctcttcaattttattatatttcacaaaaatttcagacagttcgaatttttgtgaattgtctttgcctttaaattttggataagtttccacaaatttttttaaatataaagtattttgaaaaatagtatttataaaaatatcagctaaataagtttctagagaggtaataacatttgcatataatagatatgctaccaaattgtctccggaagaatcttcattcaacttattagtaacctccagtattttattgatattatctttaaaagctatgaaaatactattacgatctaactcaatatttaaattaggaaatgatgattgaatttgttgaagatttccagattttcttcttagttcgactaattctggtctgtttaaggcaaaagtagaaatagtgattttccctttctctgtttttccttctaataatccagaattaatatctaaagtaagatgttcttggggttcttctattgaaggatttataagcaatggcatattgttttcatcaagaggaaacttatcccttttaactatattacaaacctggcaacataatattaaattattccatttgaaagcttcttggggatatttattttttgggtaaaaattatcaatttgtggtaaactggttatatttaaatctccttcacaatatccgcatttattattgaattctttaattaaatctggacgaattctttcaaagtatttataataattatctttactaaaattaaaatctttaaaatagtcaggttcttttcgagcaataaatttcatatattagttttattcatggtttagttattatctattcattgttctctcattatatcttcgtaaaagctttctattccatccacataatcagtatatttagcaaaaacatcagctgtgtatagaaatagtgtcatgcttttctcaagtaattcagcaacatcaattaaatttattcggtcattatttttaaatgatggattttgttttttatcaattggatatctaaaagcatcagaatttttgtctaaaatatgaagagtattatttaatttttcaacctcgtcacataattgtttgaaagattttttatcttcatcttcaatatcaatattatgtttgctttttaaattttcaatagttttttcaacatgcattttaaaagcattgaatagtttttcaaggtcatgtgttcctgcattggtataatcatctttttctgaatactttgaaaaatatcctatgtttgcttttagtcctagctctaagcaatgtctagcaatgaatagcattggatatgcaatatgatcaacatgagatttggtatttacaacattatttagtaaaatatcaaaacttcggttataactcccaaggtaactagtaaagcttagatattgatctataaatgcattgaattgatgttcagttctattatttctttctatgtcatattataatacttacttctgttgtatcaacttttccaatttctcaatcatttcctgctgttgctgaagcatacgctcataaagctccaccattttatcaagaggattgaaagtaaaattaggataatagttataaccatttgattggtcattgaaagtattcgaaataatattcacggcttgttcctcatcaaaattctcaatcgcttctgcgggaactttcaaaatctttgcaacttgtgccagaatatcagattctacggtttctttttgttccagaagggagattttcttttggttccagtcgtcgcccagctcaaaagccagagcttcctgtttgatgcccagcatttcgcggaaacgctttatatttctaccctgatgtatttttttattttgcatatctgtgtaagtcataataacaaatataaagctttagaacaaaaaaataatgctctgttttaaaataaatactattctaaaatatccttctttctgaataaaatatcctttatccggatggtttatccttcttattatcccttcatttgttgaaaaataacaaagatgaaaagaaaaagaagaatgaacagcagcaaatataatgaactgcacaaccgtaaccttacggttttcctcaaatcgttttcacgagcgtatggcagaattgtatattttcctgaaataagaattacagggaagtgggtacagcaatgtggttttcaggcaggagataagatactggtaaccgtaagcagaaaccagattattttagaaagggagatgaattatgaagaagagtgtttttccaaccattaaggaggcttaactttttaagaaagttaagcttgtcacaaatcgaagatttaacatagtcaatgacaatggtgtaaattgtatatagttgtacttttactattcttaatggtttaaaattcattttgctttttggcgcaaaggttttgaaaaggcgaatgctttattttagggagcaaagagtgggcaagtggacttgcctgatgaagcggagtgaacaatttcggccaccaaaagcggccgaaacacacaagattaagttcttcttttatatttaattggaagtttttgttttctgtttacaaaaatgtctgtccaaaaaaatatgaagcacggtcataaaaatggaaatacttttctgctttttcattagggtaggaattttctcttttttttaacacactaaagagtgtgttgtttgatgattgcaaatgtataaaataattgtataaacaaaaaggtaaattgataaaattattctcataaagtttaataatctaatgttggtaatgcattacatgattttgcaaggatataagcggaaaaggcgtactcaggaaattgccttatctttggggaaccgatgtttctcagaattaatcaatatatcatagatgaaatttttactggactttttatttcgtgttttacagctttttacggaaccttatttcttgctgtttcttgtgatcgtgctcattgctctgttgaaaagaaacagtaaacataaaaaactgagaattggaatgggcatatttgccgttttgctgatcatctttgtaggaaatggttttctcggcaaactgatttcaggctatctgcagaaaagttacctcaatacttccgaaatcaggaattccggttctcaacatcccgtaattgttgtattaggtggcggagtggtagacatagaccatacagaaaagctgcatacaatgtcttattccagaatggtaactgcttaccagctttatcatgcatacaaaacaaataatcaatcctgtaaaatattagtttcgggaaaaggaaagggacgcatgagtgaagcggaattatttcgtgagaattttaaaaaaatgggagtggcagatgctgatattattaaggaagataaaagcatgaatacgtatgaaaatgcaaaatattccagcaggattttgaagcagatggctccttccagtatagacctggtgacttctggttttcatatgaaaagatctgttgctttgtttcagacctttggattacatcctgttcccaatgcatcagattttattactactgaaattacactgatttctaacagctacaatgctgcgttcacttttgtcatgcttaaagaagtccttggaatatggcaggtgaaggtgtataacagtttgggattgaatggataaaaaccaaaaactataaaaaccggacacttaagttattttaagtgtccggttttggtttaacaaagcttgattattattttgttttcttaatagaaattaccgtctgcaaaaccacagaagcaataataaacagcaatcctatataaaacgaaagatttacttctttgctttctccaaaaaataaaaatgccataataatagcatacacaggctccagattgtacgttaaattaaccgtaaaagcaggaattttttttaaaacctctgcaaacatcacatataagccaactgtgcaaaaaagtgataaaacgcccaaataagctgtattttttaagtcaggaactatgctatctgacttgaaatagaggagatatacgggcaaaagcgctccccagcatacagtaccggcaatcatctgataatagttgattaccctggtatcaaaatgattcaccaaccgtttgttataaatagtatacaaagcaccgaatgctgacgaaaagacacctaatataatcccaagctgataggaagtatcaaaatgaaatattaaactgattcctataatcgtcaacgtactgagaagtaattctgaaagcttgaatttttccttttcaatgacaggtgtaaaaactgctgtgaaaaaactggtcaggcagtaacataccacgccaatggatatattggcatattttatactcgcataaaaaagaagccagtgaaatgtaagcagtaaaccggtttttgaaatctgaattttcccacggaaagaaatatgaccggggattttcagcagctttataataaagaacaaaataatagaggagaataggagtctgtaccagaccagcaaaccttcgttaagtgtgatcaatttcccgaatacgcctgtaaacccggccagtattacggccagatgtaataataaatatgattttttcattagagaatgaactgtaaaattggaattaatatttttttagaatgtgaagcactacaaaccctatcgttaataaattaacgacatgagtacgcttcaaattaaattgaaaatattaaggtgccggaggaggcagacagttcgagcggttcatattttgatctgttgaaggccaaatataggaaaaattattttgaatctctacataaaaaatacgttgaacttgtgtccgtcaggatccgcaaatacaaagccataataattgtctccaaaactttcaggttctgaaacaatggttccacctgcgttttttacttcattggcccagttgtttacctgttctttagtttctgcagaagggtgaatatgatttcattggcgctttgcggatctccaaagttcatggtttttaaatttctttcgatgatatcttttaagaaaaagtggatgacaaattcattttccccgaaaaaaaagctgaccagttcattagagctgtgcggattattaggcttgaatcccagttctgtataaaatttctgtgtgcgttctaggttggttacggccagattggcccagatcattttaggtttcataggattgagatttaggttaggataaaggtattgtgtttaattttcataaaaactgtcatgtggcaagattttgtatttttaagggtaaaatgaaaaattatggaaaatattgctgtggagaaaggaaatggttatcctttaaatttctcattataacaatttaacataatatataatgaaaaaataatgaataaaaatatcatacataaaatcaatgcattaggaggaaatacagacgctgttaatgtttctgaaaattttgctgaaaactggaagaatataaggttcaacaatcatctttattacaaagactggcagttgtacgggattgatgagtttcatgaaacctataaagaactttatggccgggataagcagaaatggatatcctgatcatttttttgtatgtactacatatcctgatcagtcgaatccaacagtttacagcacagaccatgaagtatatttcgaggaaattgaaaacagaggaaaactggaggatttcctggacggattcatgacgaaagaagagttctcagaaaccgttataacatatctggaagaaaaaagtaaagaataagggattctcagacgattaatactctatttcagcagtattataaaaatcctataatttatattatgttaaattgtatattatttgagttcaaagattcaaagcacgtcccaagattttcattattttgaattctttattcaagtaacaatcaactctattcctggtttccctgcttcattataatctcatcataatatttttaaaatggcggattaagacttaatgtaaatattcttaatccgccattttgcaaattgatttaattcttcttatttagtttttctatttctggtaattcacttttatatttttcaacatcccaaactaaatcccaattttttatataatcagagattgggcctaggccaacttctgttcttcttttatctacattatcaggatctagtaaaggtaaaacatagtaagtattattactttgattgattcctatctggcttccgtatatttgttttctgccttcccggatttctattctatcaattaacaacgctaaagaaccggcacttgcatttccttttgttacagcatctttcatcattggcagatattttttctgcgtttcaagatctgaatgttgaatgacaagaaataaagcactgttggcttgtgcgcctactttgtctttaccaacccagcctttctcatctaatattttttttacttttattaagttaagtgagtctttctgcattgttattttccaaagatcattcatttctttagattgcggaccaaattttttctgggtttcatccatttgcattctgtatttttggtcttcctcgagaattgccaataattcagcctgcaggggtttgtcataattggcttctattgccgctatctttttttctaacttttcaattgttttcccccactctttttttgaatgtagattatccaaatctgtatcagattttaagtgctttagattggtccagcctttatctattgacaggttcagccatttaaaggcttttttcgtatttcctgctaaagcagatgagcaagcgccgttatataagtggcttggattttcgctttcaattttaaaagctttatcatatacatcagcagacattttataatcttttgctctgtataattgatcggcttcatttattaattttgaatattcctgagcattaacgcctgtgaataaaaacaataataataaagcataaatagtgtttctcatgttttctgtatttaattcttaaatttagatggttatgtttttgtttccaaatttacacattaggtaggtttaattgatatgacttagctccattatttgaaattatttaaatttatatatagattacctgttaaacggatattcattaacccaatgaaaccctcttttatttaacggataatcttcctttttctttcttatcgtttttattttcacagaatcactacccttatttccggtaaaaataatactatctttttgaagactgtaatgcaggtaagcatatatgttctgttcatctgctttacgaagcataagtgttttttttccggtatctaaaacactctgaaacgctttagtactgtcattattaagaattatgtttgtccttcccgggtaactgattattatttttttccagcccagtgaatcattgcaaggtatttcctggttattgataatatattgatcaacaatgtatgctccctccattgggacagccggcggtgtatagaacagggctgatgaagaactcgatataaaaaaagccactacaagccatttgaacgcagtaagagtaattctcttccattttttgtcggatgttcttttttgaaaacgtaattgcgatggctgatgcaatacaaaaaaacgatataaagcaatagtatcaccacttataataaagagacaaaataaaacaatatgactggaaaatatttttaccggtacatcataaaagaaattcaacagtgctacattgatcatcaccgtcatggaaaaaagtgctccaaaagttttggttctcctgaaaagaagcaaaagcccgccaataacttccagcaatccggaaacaaatgtataaccagtggaagctcccatcatagtccataccacacccattggcgacatatctccaactctttcttccagtctgccaatggtgttggcgggaaactgcccgtcgtgaagtttggcaaaaccgtatgaaagcatgatcatagcaacataatagcgtgcgactaccaccgtaaaccaatgcaagtctttaaatgtccgctgttttttatctgcaagaattataacgagtgcagttactacagccaagacaatatttacagccactacccaataatcaagcgtggtatctccactacccgttatctcaatatattctacctgcttttgctgaaaaacatttttacacaaccacaaaacgctactcttatagactcccccaaaaggtgaaaactgtgaggtaaaaataaaaaggtacacataagaaatagcacacaaatgcaggaaacgtactacagcattgcggtttctttggttggaaaaattgatagattttgtatccatattaactatttattacttaatcttaatgataattgttttgtgatgttatttgtactaaggtctggattcactaatgatttttaactgattcctatcatttattatctacatcaaaaagtttctttctaaattcaaaaattaacttgtaattttcttcaattggaacttccttttttgatactgtattgatgtttttaccttgttccgtccataagtaaggataaaagctgaatacctggtcgcctttaagttttgctacatctttttcccagtttagccatctgtatccattataaaattcatcaagatttttattaaagcaaaaattcagaaattcagtgtaagtaaggtcgagtggctcaagttccaaattatcaggagccaaataataaacttttcctaaatcgctgccaagtccgccaccattaagaataaaaatgcctcctattgcatcatcggcaattaaaagatatggtattggctttccataattctcaaatgtttttcctctattccattccggcaatgacctgtttaacttatcacttcctgaaccaagaattcttatccagccattatcaaccaaaagtccccctgtcatgtatacaattgaacccattggagatttggttgtaacttgggttttatataaagcatcctttgctttgttgctatctacaggcaatatttccactttattttttgcggtgtctatccattcttttacaagaatccaaccttgatctttatcgtttattaattcatcaatagagcgcattttttgtccataagttgttaatgagaataaggatataataattgtcaaacattttatcatgctgtttagttttctaagatgataattaattgtatacatttttctgtcattattttacctcaattttatgataaacaatccaacgtttgagattgtccaccattctttttaaatgatcctcattcaggaaaatattggtccaagcaagcagtgaagaggttgctgaagtgaaaactaaaagaaagagtaagtacttttttatcatggatatcagttaagactcaaatttacggattgtgttcttataaaatttgtaacgatggcaatgttttttgattttttccataaaaagctccaaaatccttagattttggagctgaatttaaaccgacagcctttcagctgattaattattgcttggtaattttattgaaaaaagtatcacctttaaagatatagtctcctgaaggatattcagtcagatcgatggtatttttcccttttctaaacaatatatttttaatcaggttaccgttattatcatataaataaacattttcatctgctgaggattccacattgatcactcctgtcgttggattaggataagcggaagttttcgtttttggagaagcttctcttgttgacagaaaacaaccggaaatataggaatctccaataatattaaaacctttgttgatcagctgggctctggccagcatcgcttgcggtgtagaataaaccagtcctgttgcatctatagttccggacgttattgtggagttcgcccaggtaggattattattcagagcgatgagaaaattgctgtaattcgtacatgataagcctgcatttttaaatccaaaatagattgaattccagctgaagttctgaagcttgatattccacgcagaaatatcctggtcaaaatgcgaagcacctgcaaacatattaaatccggcgaaataatcagccttgcttacatcccagtttccgatgggttgattgaatgacactgcattttcaaacatatgctcaaaatctgttactttacctgtattccagttatcaagtggctgattaaatgctgccgcattatagaatgtatagcggaaattggtagcattttctgtattccatgaatttaatggctggttgaaagctgtggcatctgcaaacatggatgaaaaatcagttccggatgttgtgttccacgctgaaatatcctgattaaaagaagaggcagaagaaaacatgctgctaaaattggttacttttgatgtatcccagtttccgatgttctgattaaaccgcgttgctccgctgaacataccgctcatgtctgtaatacggaatggattccagtaagaaaatgaagtatggcctgtcaaagatgaacagttaaggaacatttgcgataaactggtgatctgtgttaaatcaggagtatctgcagccgttacgttaagattaggacagttggcgaatgctctgtcgaattgctgaagccatgtcgtatttccccactggctgagttctatgagttcctgatttccacccggaggaatgatgtcggtattggccctgaacccgtaaaatgatccgttaccgctgaatacttttaattcgtaagtggcctgcagaggatctggatggaatgatggcccaaaatatatgagtaaaggctcactgctgctagagtttacattatcaaacatcccgttatgctcaggatatcctacttcgtgccagtaaatggtgtaatcggttcctgtgccaccgaatcttattgaatgatcaatgatgccgtttgcattgggtttccagatggtagtgaattcattctgcgcataggaaatgcaaaataaaaggagaaaaatgattattagttgttttttacacataattttaaaagttgttttaaggttaaaattgggttgggtaagacaattaatttcccgggattctttatcttatctctgatacaaaagtactggtgcacagcgacaaaactcgtcgtgttataatttaatgacttgtttttttacgtttttttgaggtaaaaaacctctgaagaataacccggaaatggtaatgacaaaatttgtattgtaatgttgattttgataagaaaagatgccatagaaacattggcaaatgcagactaatgaaggaaaaatgaacgctttattcagcagcatttttacagattacagcaaaatagacttggttacaactcttcatagctgccatgttgataataagttgctgaaatatttggaataaagaaataaataggaataaatattcttaaaagaaatgattatggactaagggcataaaaaaaccgctctgaaaagagcggtaaatttttaatgtcaaattgtttgctgattagcaagtagaaccgcactcaagtaatttgatgtggattacaccgttaacaacacattgtgtctggcataaagcgtttgttacaacagtgcttacaccgcctactactccacctactgtagatcctacgccagttacaacaccaccaacgatagtacctacaccgcctactactccaccaactacacctcctagtccacctagaagtccgccgattggatctagtaatccgttacctgaaatagcttttaattcgtttctgtccaatttttttaagtttttcataactatatttttatatgattattacatcacgaatatatgaataatatttacacaattgcaaattattttaaataaattaattatttgttcttattgtttaatatttcattaatatataggtgttttaataaaaatatgattttcactgatatgtgattgattttctaaatgttaaaaaacataactcaatttatgaaatttggagttattatttatgtattaaaatatatttattgttgtttattttttaatttatatagaatcattaaaattcttcttaaataaggcttgaatggatagaaaatgagtctttaaaatgctgcaattcatccatttcggagaggaatagcgaaataatcaataaaatttgcttcctgcaggcagtaaaacccatatgaattactgataacggaatcaaattttgtatttttgctgacatacttttatcaatgtcagttttttcaaataatatacgctttttaagagccagaagaaagctctcccaacagaatgtagccgatgaactcatgatttcaagagtacggtattcaaaatatgaaaacggtatatctgaacctcctattgagctgctcgtaaaaatctcaaaatattttcatgtgagcattgatcttatactttctgtagatctggagaaacatccggtggatgaaatgctgaaacttccggataacaggattgttcttccggtagcagtggatactcaaggaaatgataccatagaaattattcctcagaaagcttccatgggatatctggaaggatacagcgatatagaatacattgaaagtcttcagcgtattgcgcttccttttcttaacaacggaaaatacagggcctttcctgcagatggtgattctatgccgccgttcaggagcggttcttatatagtaggaaaatatgtagaaggcattaatgaactgaaagaaggcaaaacctatgtttttgttacactgaatgacggtattacgtacaagcgttttaaagaaaggaaagaaaatgcaatctgtgtaagtgctgacaattcattttatgaaccttatgatattccttttgaggaagtggtggaaatctggcagtatgcgtcaggaattttccctgaagattttgaaccgggtgattatgaaaactataatttcaaagagatgttccgggaactgagaaaagatatcaaagatcttgataaaaagatctcgggccgacgtcgtaaacagtcataaaatcaatatctataataaaaatgctcctgatgttaaatcaggagcatttttatatatgtttatgctataggtcctcagaaagttcaatccatacgggagcatggtcgctgcttttctcccagccccgcacgtggcggtctactccaccactttgtaaccgggaatgaaggtaagggcttaataagatatgatccagtcttatccctgcatttctgtcataagctttgtataagtaatcccagaacgtatagattttctcgcccggatagaggcttcgtatagaatccagccagccttttttctgaagatccttatatacttttcttacctctgcccggtataatgcatcattttcccagcgctcaggtttatggacgtcaataggttccggaatgatattaaaatcgcctataagaatggcaggaagttccattttaatgagctgatcggttcgttttttaaaacgtttgagccatgataatttataatcaaacttaggccctggataaggatttccgttgggaaggtaaaggcagcatatcaccatctgatctataatagcttctatataacggctttgaatatcgtctggatcacctggtaaggatctttgtacttctgtgatttctttgtttttcgttaatatggccaccccgttccagctcttctgtccattccagatggcctgatatccggcgttattgatttcctgcaaagggaaacgttcctgaggtgcttttaattcctgaagacagacaatatccggtgaagcttctttcaaccacttcaataaaacaggcagacggccgttgactccatttacattataggttgctattttcatgatgaaggtttttggaaaatcaattcttttttaattacgacaataattattccatcataaatatctcttggttggtattttgtgaaataataatctgaaaaaattaagttttgatgaataatctctgggctgtgaggtaaaagttcaatatatttgtgatacaagatatagctcattaatacttaaatccctcaatgaaaagatatacgacctttttattagcattactttttcctgttacgatgtatggacagcagaatctcactgctgacgaattgtttgctaaagcccgtaccacggcttttgaacagaaggattatacaacttctatagcgcttgctaaagaagcattggaaaaagcgccgaattatacagatatttcagtttttcttgggagattatatacatggaataaagatcttcccgcggcgagagctgtatttgaagaccttggaaaaagaggtgttcaggatgaagattattttctggcctacgcctcattggaatactggaatgatcagaatacaaaggctatcgaaattattgataaaggtctttcctaccatccaaaatccgaagcacttttgctgctgaaggcgaaagtgtattttgggatggatcattatgaggaagctgatcaggctgtaaagactcttttatccattaatcctaaaaatacggaagcaagagctcttgctgtgagaataaatgatctttcttctaaaaatgcggttggaattgtttacaactattcccattttgataagcagtttgatgacgactggcatattgtgggagtaagctataagagagtaactcctattggttctgtgattcttcgcgggaactatgcgaataaatttgcgcagggaggaacgcagattgagctggaagcgtatccaagactttcgaaaatgttttatctgtatgttggcggaggatattctgacgatgtcggtctttttccgaaataccgtacaggagtttctttaaatgccaatcttccccacagcttcgaggcagaattaggttaccgtcaattgtatttcagcaacagcatctggatgtatactgcggctgtaggaaaatattataaaaacttctggttcaacctgcgtacttatattacgccggacagcaaaaatatttcacactcttatacggctacggtacgatattatacaaaaagtgcccaggactattttgcttttcagataggaacaggaatcagccctgaagaaaatcgtaataacctcctggaaaacgaaacttttaagctgaaaacgtttaaaataggtgcagaatataatttctcttaccgcaccaatctgttttcagtaggtaccatgtattataatcaggaattccgtccgggtgagaaaggaaatcagtttgatattactttaggttacaccagaaagttctaaaactttgatttcgtttttttcttaaaattaaccattaccgaatcaggcatcagttttttagtggaataaaactttgcattcatacttttatactgattgaatctgccattgatcttattcatggctgccgcgtcatcggaaggatcttcttccaggttcttaagcgtgaaaagctgtccgtcatggatataatacttttcagatacgaaatcaataagctggtttttactctgcatcattggaattcctgccttgctgatttcagcatctgcagaaaagcctcttcctacccatgttacggtagaaggtgttttgatctgataattatttctgtaataggccagaatagaaggtgcaatatcaaaatggcttactgttttataaaaacgttttgattcctttaataagggtgaatagatcaataatggtacatgaaatctgtcaattttagattgtaaagtaatttcaggcatactgtgatcccctgtaatgacaaaaattgtattgttataatccgggcgtttgctgtaatttttaaagaaacctttaatcgcatcatcggcgttcaatactgaaatgagctgatctttatgagctgttgcccactttttctgttccgaagttaaaatcgcggaattaagcctttgattatacaacttttcataataatctttattgttaattaaaaaaggattatgagttgaaagcgtaaggatcatattgaaatacggctgattctgtggtttttgctgctcctgcattttactaaaaacggcctggtcttcatatccccagctctctccgttgctggcaggaagtttacggtacggactgctgaataatgcttcatctacaatgtggtctacgccactgtattccagaaactcacgataccggtcaaatgatgtatgacctccataatagaaccccgtttcaaatccgttcgctttaagaacattataaagattgaaattctccggtgttttctctatttcaagaaacccgtttttcccgaaaggaagtgaacctgttaaagacggtaacgctccgaatgttcttcctgctgaacttaaactgttctcccagtacaagcttttattagaaagagaatcaaggtaaggagtaaaattaccgatgtatcctttgggtgatgtatacgcgtgtccgaagccttccatgataaggaaaacaagattgggaaccttctcggatctgttaaaatatgatcccaggaaatcgggtgtattttcttttctccagaatggaaaatttttatcaagcatttccgcattggcggtatagtcttcattttcgcttagcaattcggtcagctcaggatgattactgatgaaattatcttcgttggatttaaagaaataagcccatttactttttgctgcattttgattaaactcactttcagagctcagaattgtggatcctacgatatcggaaggaataaaaaaggcagctaatcccaataccatgattatcaatcccggatacattgtttttaaagcggttttacccgcaatccataaaggaataaatgagccggctattaaaattcccagtagtgcaaagtttttaaaattgagcattccgctggcctgtaagatttgctttatttcttctttactgtaatataaaacatctgcccccaatacgtttcgggtttcagaaaaatacaggaataagatatattgggtaacagctacaatgagcagggttactacccccagaatccttgcccagccttctttgataaaattgatgatcagataaacaaatccgatacagaagattagtctaagagcaaataagatattttctgtgaaaagatggccaatgatagccggagtttcaaattttggaaagatatacttataccacaatgattctgcaactacgccaaccaaaaataaggcaaagaaaatcaatgccagcattccccactttttaagtcccacctgaagaatagcatatattctttctttcagaggtaaattttgtgtactttgattaaagccttgtctggtcatttcaccccacccatgcgattttttgaaataatctataaacccgtttacccctgctttcaccacaataggatggaaataaaaaggttcggaaaaggcggtgaaaatcaatctgaggaaatctttccttttggtataaacctgatggcttacaagatctaccaatatggcatagatagaatacaggaagcccatcgagatcacaagagcaaacagaattacaaaaaacggccagttgataattcccagcaataaaaaaatgataaagatgatgtatcctgaaaactcgataagcggccccaaaaattcaaagaaaaaccaatacggcagactgatcattcctaattttctgtatttcggattgaacatcagtttcctgtgtttccacagggtttccatcgttccgcgcatccatctgtttcgttgttttctgagaatatctttggactcgggaacctccgtccagcataaaggatccggaatggtaagcacttcataaggttcgttcctttcttccatgtatttcctcattcttaccaccagctccatatcctctcccactgtacttttatcataacctccgcatgccagcacaatttttctgtcaaaaacgccaaaagcgccggagatcagaatcagaccggatgcacgggaccacgccatacgaccgagtacgaaagcccggatgtattccagagcctgtgttcttcccagcagggtcttcggcatgttgacacttactacttttccgttttcaatgacacaattgttggccagacgaatcactccaccgcaggcgatgaactttttatcggtctgctccagcatcggttttgccagttttaaaatcgaatcctgctccagaatacaatctacatcaatgcagaccagatattcccctgaagagatattgactcccacgtttaaagcatctgcttttccgccgttttccttatcaacaacaataagctttttaaaggccggatttttacttttataaactcctcttactgcattggtttcgattttcccctggatgaaataagccacagattccagttcataagcttcgatcagtttttgtatggaatcatccttacttccgtcgtttacaataataatttccagattatgatagtaaagggacagcagggagcgtacattttccacaatggtcatgccttcgttataggccggtgcaataacactgaataccggcgcattgggattggccgcaatgatactgtaatctgtaaatgtattttcttttttataacgcagtacagcgcccagtgcatatattcctatccacccatagataagggttactgctgttccgtaaattaaaaacagccagataacaacttcatagatgatgtgtgagaattctaacatactttttcctgtaatgcgtatttaatgatttgaattaattcttctgttgtttccctgttcaatacttctgtcagatactcctgctgtcgaagtgcacataaggcttctgcggcatacactttcacgcctgaatcagtgccgttcattaactggtctttcagaaaatccttactgcgctggtcttttgactttttcatgactttaaggatctctttctgaacttcagccggctgatgcggatagacttccataagatgggtaatcgtagaagagttttccagtgataataaagtttgtaccgcctgtatccgtacttcagaagaagaatggtccagcagattaataacagaagaataaagggatagtatctgaaatttccttaagagtttaagggtgaaaataactacggaatcattagagctttccatccagcttttaatatgatctccagagttgtcaggaatctgatttattgaaagaagcaaacgaagctgctgccattctgatatggtggaggtaatgctgctcaggaaatgaagtccttcaaatcctttaaagtgaaccattgcatattgtgcttcctgatacacctgagcagaaggatgacttaaaaatgtagatatttttggtaatgcttctgctacattcatggcggtaagttcctgtattccccctgcaattaagtgcacttttttttgactgagtttcttaaatgcttcttcctgaagcccatattcacggaataagtctttcagtttgttttgtgctgctccggaaaatttcttctcggattctgccagcttctgtagaaataaatttctgaataaggaactgcctgatgctgatgagaaattatcatccggagacatttcatcttcaccatatacaatcacttctgaaattctcttattgattacttctgaccatctggaagcctgcacggattctctgtactgataaaaactgtagatcagcactacaataatcagcaagagaaccagggaaagcatccccagaaaaacaagaaaaagaaaatgtatagaagtggtgagaaacatggttatggtttatcttgaagaaaatctttttattcttaatatcaattcattggggctgaatggttttacaataaaatccgctgctccgaggtcaaaagcattcagtaccacctcttcctggcccatgctggaaagcatgatcaccgggatctgtttgcccatggttttaatggcggaaagtatttcaattccggaggcaaacggcatcatgatatctgtgatggccaggtctacatcttttgttttgagtgtttcaatagcgtcttttccgttacgggtaagaatcacttcgtgcccctcttttaataatttgtgctcaatcgtttttagaatcagttcgtcgtcttcggcgatgagaatcagcataattttatttatttttattgtattaaatttttaatagcttgtaatcctgttgtaatatcccggataatttctttttccatggcgataaaatccatgtcggtttctgattttttttcccagtccgctgcatgttctgtgagtcgtatcaatcctgccgttcctgccgttcctttaagcttatgaaggatcattttcagggctgcggtgtctttttctgcagcgctttttctgatgttttcttcggcctgagtaagttcctgtaccacaaggttcaaaaatatttgtttggaatcgtcatcatcatcacccatatgttcattcaaaagctttatatcaaagaatttttctttatctgatgattcttctgcgggaatgtgattttcattaaaaatatatttttccagtattcccagcagatctgcctgtcttaaaggtttaggaaggaagtcattcattcctgaatccaggcacttttctttttctcccagtacatttcctgcagttacaccaataataggaacaccggcataatccggaagtaaccggatttgtttcgttgcttcaataccgtccattaccggcatctgaacatccattaaaataatatcgaatgttttttctttgcactgctccaaggcctgaagaccatcagtagcttctgtgagctgtgcatcagggattaatgaacgtaccattttattgttcagcaccatattgacagggttgtcatctacaagtaaaaccttggcagactgcatgagctttggtgcattagtttctgcttgtgtgttactgtttatctctttctcagtattttttacagcaagcttcagcgtcttgtaaagttcttcagatttgatcggtttcaataagaagaatgaattgttttcctggcggaaagaattgataacatcatgctcttcagaagaggtatgaaggataatgagaggtgatgattcattttgtttatcaaacagctccctgattttttctatggtttccagtcccgaaatgaccggcatgtgataatccatcagaatcacatcaaaacgttctcccgcaagcagtatctgaagggcttccattccattggcggcaagctttgaatctacatttttataagcgagcatatgctgaatgataatcctgttggcctcattgtcatctacaatcaatactttttttattttcagatcttcctcttcatggcgctcagacatttcgtaagggacctggatatcaaaatagaaagtagacccttgatgaagctcactcaccaatgacaggctgcttcccatatagttcaggatattgttggaaatggtcagtccgaggccggttcctccatactttttgctgatagagctgttttcctgagtaaaagcattgaaaatatgcttttgtttttctttaggaataccaattccggtgtcccttacggaaaatctaagggtaatatttttactctcaatacttagtttttccactttaagttctatttctccctcttgggtaaacttcacggcatttccaagaagattgatcagaatttgcttaagtctcgattcatccagccagatggtttcgggaagtcccggttctatatttaagagtaattctatattctttttctgggactggtaaaggatcacgttgattacctgactgacaatatcataaacattggctttttcaatggaaagctccatcttcccggattctattttggaaaaatcaaggatatcattgatgatactcaacaggttttcaccagattcattaatataattaagatactgtgtctgtatttcattcaatggtgtttttaagagaagatccgaaaaaccgataacaccatttaacggagttctgatttcatgactcatattggccagaaattctgacttcgcctggctggcaatatcggccattttctttgcattcttaagttccttattgattttcacagaggttgtaatattctgtgcagcaacaataattccccctataacattactggaaaggtaccatggggtaacctctacattataatgctgaatagattccttgccgggaatttctatcgccatatcttcattcttgtaggcttttcctgccagtgcatcccggtatatttttattctttcatccggtacatccggggaaatcttaaacatgttctctccaatgagcctgatgtcgttcatctggaattcatctttccagcttctgcttactgacagataattaagatccttatcaaacatggctaccgtagccggaacataggcaacaaatgactgaagcatagcctcttttctggccagttcgaggtaaacttttttgaaattatcaatatcctgtataattccgtagactctcgtacatacttcgccttcaaattccggtattccttttacccttacccagatcatgacgccgtcatttcgtaccagctgtaattcttcatcgtaaggtataccttctttcactgctctctcgaataaggattccagtttttcccggctgttttcactatagaagcctaatgcattctctaaatccggctggaaagttttatctattttatgtatttctctggtagactgtgaccagattacagtattgtttttgaggttgacttcccagcccccgacctgggcaaccgcactggtctgttccagcattttttttgtattgaccagatctttttccagtgttactctttcggtaacattcagtgcggtactgactacgtaaggttttccttctttattgatttccacaaggttgtggtacatccatattacttcatcacctccttttgttttcagaatcatggttccgaaatcttcacggtttttgttgatacgctccagatattgctcaagaagatgccagtttttttcagggacaagatcttttaaattcaggtcttctacctcttcagcagaatattgaagggtttctcttcctttttcattgacggcgataatatttccttccatatcatgcatactcatcagtcctattgcattttcgaagaagcttctgaaacggcgttcggagctttccagttttagtttttcttcaatacgctgggtaatattgattccgaagcaaaaaatatccgaatggctttggttcagttttaaataccattcaacaataatggtttggttatcattgatattggtagaagtggtaaacgttatctcttcatccgtatcaggaagatctttagaaagtaattgaagctgggaattatggctgcctaccagatcaaggaaattctgattgataacctggcttttatttacttgaaatgcattttcaaaagccgggttaatatctttcagtaaaaaatttttgtccagcacacagatcaggttattagaaatactgaaggtctgctggaaatattctgcctggatatttttccgttttcccatcagaagtttcgtgaccgcttcccctattttttttagggtagagatctggtcttccgtaatagttttaggcttataatcaattacgcaaagcgttcccaatgcaaatccttcgtcatctaacaggggcactcctgcataaaaccggattccgcctgccagtatgagtggattatcagaagatctttcatccagtaaagtgtcattgatgactacaatgtccccactcgcgatagaatactggcatacagtatctttcctgtctacaaagtccagggcaagtcccacacaactctggatcgtctgggtttcgctttccatcatggcaataagtgctgccgggcagccagtcaccagacatgctgtttctgcaaaaacgtctaactggggatctttttccaggtttaaaagatcaaaaaactccagttttctcattcgatcttcttcattcgcaggaattgggtacttcttcatatgttatttcaacggttagagatttttcttttttgattattaaaaaatgataatcaagtccttaaagtttatattttcaacatttttaagtgctttaaattattattttaataagtaaagcaaaatacgaaataattttgtattccgttgcagtaaatttgttaataaaggaatatgcatggttattttaaaatattttaaagatataaagaagtaataaacaatataaaataaaaagtaccacatgtgatcatatggtacttagtgtttgaatcaggatgaaaagtaatgttttaacagtgtttttttaaggcctgacgattgatttttaaagtccatttccggatgagcccggaaatggacacaccacttatcatcatccaaatcacaactatactatgaacagggaggcaatagcctgcgcatcgctgccacttaaaatctcatcataagctgcagaaccggctgcagctccaaataaggttcctgtattgaaacccgcctgattggtattatcttctcctgcataaacaggattggttgcagaaggcatacttccaccatcggcaagctctatccatcctttgtttgctcgcattcttcttacctgcgaagcatgtctggcttctacagaatgaatctgtaaggctgcctgaagcacaactttattggacattacgtttcctgcctgtcctttgtatgcccttactcccgtatcttcaaaggcctgggcaagaataagaaactgattataatctgtaaaaggagtaaaatttccaccagcggtaaaatcaaaagtcggtttgtttcccggagttgttcctaaagaagtcagtgtgcttttcagaaaaccaacatgagcagattcatgctttgagatctgcataaaaactgttctgtctgcattcggaataagtcccggtgtggacaatcctatgctgtaatattcattttcaaggtattccagtaccaatgccagctgcaatgcatctgtgagggtactttttaaagccatacctgtgaatgctgtttttgaggtttctgctttagccggtgttgccatcagtgcacccaatccaagcggaactgctgctactgctgctttttttccggatagagacatattggtaatcgcctcaagtcttgacgcttccgttgtgaagaatttatcatgggaaagcttatccagtaatctaagaatattcataatgtgagtttttaaggtgaatgattagttgatacctctttctttccaggtaaaaggtgttttgatgaatgctccggcagccattacgatatctttgggctcttttgcgaggtcaagtccattggcatctatcacgtcatctcctgaaaaatctgcagagccgggattgatgatatttctgatggcggaagcatgtctggcttctactgaaactattttaccggcaataacaaggtaggctgggttggaaatatatttccccgcaccattgtaagcggctacccctgtatcttccaatgcttttgcagtggccagaactgagctcctgttattaaaattcacattcgggtactggaattcgagcttaggcagcacatgatctgtagctccgctgatggcagctttaaagaaatccctgtgtatcacttcatgatggtacaggtctgtaaaaagttctttttcaatacttgaaattcccgtatagaaattgttgactactttcgtataaaagtcagcttcaagctgttcaagggcgtaggcgtaatttaatactcctacatctcctgttccaaggtcatacttggattcttcaataatctggaagtcgtcattgtcgtcacagccaatgatggtaagccctgcgatggccagtcctactccacttaatttcagaaagtttcttctgctggtatcaagggtagctccctgattagaaacgttaatggttcttttcatactattaattttttagtgttgtatttaagagaaaaaaacagcatatcagtatgctgttgaaatctcacaatttgttatggcattaaaactgtatcgatgacatgaatcacaccattagactggttgacgtctgcaatggttactttcgcgctgtttcctttggcatcttttatataaaggtcttttcctttagtccagaaagtaagttcctctccctgtacagttttcatcatactttttccgtttcctgcttttacggctgcccagatttctttagcactgtatcttccgggaagaacatggtacgttaagatgctggtaagtgttgccttattttcaggttttacaagattttctacggttcctttcggaagttttgcgaaagctgcatcagtaggtgccaatactgtaaaaggtccagctccttctaatgtttccaccagtccggcggctttcactgctgcgaccagtgttttgtggtctttggaattgacagcgttctcaataatatttttggacggatacataggtgctcctcctaccattactgttttttctttcatcgtttgtgcagttacctttccactgaaagcaaatgataaagctaccattgctaagactgtgatttttgattgtgtgttcatcgtgttgatttttttatgaattatatttatttgtgcttttaatgtcatttacgaggttggttttattttagattgaaaaaaaatgaaatttattttatattactgattttcagttatttatttttttaatcgggacaaactccagacagatagagttcatacagaatcgttttccggttggttttgggccatcatcaaaaacatgtccaagatgagactcacatcttccacacagcacttctgtacgttccatatgatgagagctgtcttttctgtattttacactgtttttacgaagaggctgataaaatgagggccagccgcaggtagttgcaaatttggaagttgaaaggaagagaggattcccacatacggcacagtaataggttcctttttcatcgaattcataatattttccggtaaaagcagtttctgtggctccttctctggctacctcatagagttcggggtttaaaatctttttccattcactattgcttactttcagtgtattttctgcagtgtgtgagtaataaggatttctggttttgaaaagactgttttgggctgtgcaaaatccgaaggacaccgttacagaaagtagaagtattgtttttgaagataaggttttcatatttcaatatttttaatgattgtcttaaaatcatgtacgaaataaaagttgactcagatttttttgggaatatgttttattttattacatttgggtagaaaaataaaagctattaaaacaacctattctgaagaggaacttatcgttttattgaaagaaaaaaacgaaactggttttcattatctgtatgaccactattccggtgcgttgtacggggttgttcttcggattgttcagtctaaagaatatactgaagaagttattcaggatgtttttgttaaaatatggaactccattcatcagtacgatatttctaaaggaagattttatacctggatgattaatattgcaaggaatacggctattgactatctcaagtcaaaaggattccagaatgaacttaaaaaccaatcacttccggatttcgtatataatactgcagaactttcaacaacgaataactcttccgattatatcggatttaataatgtgctggaaggtctggaagtagacaagcaggaacttatagatcttgcgtattatcagggatatacccaacatgaaatatccgaaaaactgaagataccgctgggaacggtaaaaacgaaaatgcggaacgcactgatgaaattaaaggatttgctaaaagattaccaataaattgaacactaaagaatacatatcatccggaattatagaatcttatattcttggccatgcttctcccgaggaagcagggattttggagtgtgtgatgaagaataatgctgaagtaaaggcagcttttgaagaagcgcagaaaactttggaagatcttgctacggcacaggctgtaacccctccagatgatcttaagtctaagatctggaataaaattcaaaaggagcagactcttcaagagattactcctgttctttcaactgatatttctgaagtaaaagatcatacagagaacagaatccaggaatccagccagcgaaataacggatggaaaacgtatgcagtagcagcctctgttctgtttctggtaagtgttgccggtaacttttactggatgaatacccaatctgccagtcaaaaagagatggctctgctggcagcagataaaaagcatcaggatgaggccatgcagaaaatgaatcagaagcttgagatgttttccaatcctgatatgaagatggttatgctgaaaggagtagaaaagcatgcagatgccaaagcaatggttttctgggacaaaaaaacaaaagaagtttatctgaatgctgaaaagcttccaaaagctcctgagggtatgcagtatcagctttgggctattgaaaacgggaagccggtaagtgcaggaatgtacaccgaagataaagacagcagaatagctttagctaatattccagatgcccaggcctttgccattactcttgaaaaagaaggtgggagtaaagtgcctaccatggaaaatatgtttgtaatgggggaaatatagccctttttataataaaaaaacaaggcggacacaatcaaacccgccttgccatctcccaaataattaaatatgaaaaaatatgaatgttttgtttatacaggacatacgcaataattaaggttaattttaaatatcttttggaaagggatcttcaaagctttgctttttgtcaaacaattccttttctctttcattgataaggcaatgctgaagatcagacaacatttgatctttgtccagattctgcccaatgaagaccagttcattaatcctgtcaccccagtttttgtcccatcttttttcaataaaactttgattttccgcaaatgaagaatactgcactctacgacttagtggcatgctgcaccaccatacccctgctttttccaaacggaaagatcccccggcctgagaaaagttcagggcatcatcaggtcttgacgccagccagaacaaacctttcgctcttattgttccttcgggataatgatgattcaggtattcccataaccttaccggatgaaaaggctttctgtctctgaaaacgattgaacttattccatattcttccgtttcaggcgtgtggtgctccgattgcagttctttttgccagccggcagatgactgcgctttgtcgaaatcaaaaagccgtgtatttaaaatctgttgaggatcaatttttccaaattctgagtgtaagataaccgcatcggggtttaatttttttatagcagcttttaaaaagccaagcttatcagcatctataagatctgttttatttaaaataatcacattggcaaattcgatctgatcggtcaaaaggttaacaattgtccggtaatcgccttccatatctgtaagatcgcgatccatcagcaactcattagaaccgaaatcttttatgaaattaaaacaatctaccaccgttaccatggtatctacataactgaaacgggaaaggtcgattccgctttcttcatcaatgtaggtaaaggtttgggcaacaggaaccggttcactgattcctgtactttcaataagaagataatcaaaccggttttcgctggcaaggcgttccacttctatcatcagatcttcacgaagtgtgcagcagatgcatccgttgctcatttctaccagcttttcttctgttcttgaaagggtgttttgattttcaacaaggcgggcatcaatattcacttcactcatatcgttcactattacagctacttttaaacctcttttgttatgcagaatatggttcagtaatgtagtttttcctgcccctagaaaaccactgagtaccgttacaggaagtttctttgtcatttttaatgtttatgatttttaaagttgatgatatggcctgtaattaagcctgcagctcccacatagattaagggaagatgaacttcatacagaagatctgtcagtatagaaatgaaaataaggcttaatgatatccggaacagaaactttagccaccggctttccattttttttgttattctgaataccacaacggctccaatgaaaaggaaggccagatcaatataaggattatgggatattcccaatggaacaattaatagcagtggaaagacaatacaatgaatcaggcatagaacagcagcggagattcctacagcatcaagaatttttgatttcataatagtatagaattaattttcttattgtaactttgttgcaaaagtagaaataaaaaattaaatattgcaactttgttgcattaaaatatgaaacaggtcagaaatacgcatgccaagactgaaattttaaaccttatcaatggttcggatgtagcccttacgcattctgatattcagaagaaattaggtgatctgtgtaatagggtaaccatttacagagtgctggaaaggcttgaaaacgaaggagctatacacaagatcgttaatattgacggggtggtaaattttgcgaaatgcagcgggaaatgtacccatgaacagcattttcacaatcatgttcatttcaactgcaaagaatgtcattctgtgacatgtattgaaaatgcgattccggagatcagtctgccggaacattttattgcacaggagtacaattttattatcagcgggatatgtccgaagtgtgctgatgcttaaaagcgaaaggtaaaaaaacaaatttgcttgtatgtttttttacctttttgcgatttgttataaggaagagatatagacttctattttggttccgtcataattgaaggttccgtcagaattctttttgcctaatacccatttcatgtctacaggtacagaccatgcagatcctaatgaaaatccattaacggatctgatttcatttccttttcctgtagtaactgctgaatgaaaccagcttttatcaatcagtctgtagaaaccgattgcttttcctgccgggatcggtgaatatccgtcccacttctctcctgccggatagttgaaaacagttaaccatttttgtccggctgattctgccagttgagcaggacttatagatgcaccacgcatatataatgcatacgctacagcatcatggcatactccactgttgtatttcgaaatattttctgctcctgaaagaagagcaagcgcaacaggcgctctttcggatctggatagctgagccttcctggctccttccggtgtgataaatgacatataataatattttgtttggtagggtaaagatacagctttaaaatttaatcacttatgttggataatattttaagttttggctgaagccgttgatagggtcattaatcaataagcgggttaaaacccgcctctattgatacataaacctggtattatatctgagaatggtatgaatattcaataggaacgggctttagcctgttctaacaattgcatgcagatagttcggcttcagccgaaacttaatatcgtataggtttggctgaaacctttggaatggcagataataaaataatcgggctttagcccgattctattgataagtattaattaaggattcatttagcaaaaatacatgcattcatagctgaaaagctttccgtctttaaaggtaaaaataaaaagtcctgcatccccgttctggatatgatactcgtgcggagaggagacccagcgtgaagaaagcagatccccgaaatgcgttacaaaattcttttcatcataattggaatccatacgttcatttcctaaaaccaaagcttccccattggtaaaagacattttgtagacacttccggaaatttttcctttatattcttcaaaagcaacaatgatgtccggtgttttataaaagtattgaggctcccagccgcattccggcatatcagaaatatcatttactttctgcatttccagctttttcatctgggaatctgttattttgccgtcaaaaagcgttgtttctttccataagaaatgcatattcagggcttttactttcttttcataatcctttgttccaggttttttttcaaactgctcagccagaagaagctcaaagtcgatatctattttcggattttctatgccggtattggattctttccagtattgtaaggcctgtttaagatttttatcttccatccaggcaatttcacgtaaccttccaacctgcgtcaattctttttctttgttcttgcctttcaccgcaaggtagtctttcagcactttttcgtaggtaagttcagaaccaaggtacttcatctggatatattccggattttcatggaaatgatcaccaatataaacccagccatcctgatataaaggaacataatcaatacaaaccagctcatttaaagcagctctccgtaccggcgtactttctgttgtagggcctttccgtacccgaagttctgatacctgtatataaaaatgcggacattgctgtccctgcgacccgcggtagaaatactgggcaggttcacctgaagattttttaccctgcatggttttttgtaaaggctggcggtctataaacccgatatccccgttgcttacctgaactttatattgtgtccgggtagaatccagaagataaacaggggcttctgtagaaaaaattcctaaaagatctttgttatttcctttttcacggaagagatgtccccattctgatgtataaaccggcttttcacctggtttctgggccatggtattgtaaaagcagcattgaatgatgccggctcctaataatatctttttcaacatattgtcattggtgcaaacctttttagaaaagagtttgttattattatactgttatttccttcaaaattactgaaaaatcaagggttttcctattattattgttattcagaatcggtataaattccatgctattcaccatcttccattgggtaaagtaaataaaaatactatttttatcggccaaaaaaagtaaagactaattatgccgactgatgcttctcataagctgattccgatgaccactttcgtgctggagtattattctcacgaaggatatgccgatcttcagattttgaatctgatgaataattatgccaatttcttaaagaagcgtttgactcttggaatgtttgttcctgtagaccgtaaagggaatattctgaaagaacctaaaaactacaaggaatggaaatccctggatcataatgacgggaaaagaacggatgttattggatttgaagaatatgctgaatatcagaaggcggaacagaactgcatgtttgaaggctttaaggtagattataacgggtattcaaaagtgaggatcatcgctgcatatgatccttccattgaattatcttttaataaaaatgatctgattcctacgggatataatgatgtggaatcacttactgtttttgatgatatttttttaacctccagtgcattaaaagcgatcggaataagaagataaaaacataaatatttaaaacaaaaacgtttatcagtctgataaacgtttttgttttttgatatactatcgtacacattctcccgaatgacaatgatagcctgaaggacacaacccgttaatgcaagggcctgcagcatcagggtaacatctttcatctgcccggcaatgggaatgaggcgggcacagagacagcaggtttccaaggcaaacgcctaccggaagagggagattaagttcaataccaatttctccgatcatgttcttcaatgtttttctgtttaattttttcatggattttgttttaaggtgttattgatttattatattttcaagttctgtgataaaatctttctgtgctgtattgatgcgcttttgtgcttcttctgaagggaaccattgccattgatctacttccgaaacttccattattttaccggatctgggaggccattccaatggaaaggtattactgtaaagatcggcagtatcaagatcgctttctaaggcccaggcatatacggtttttcctcctttctgcttaataggcgacagttcgataaactttccatctatggttttaccggtttcttcttcaaattctgtcaaggcgcgttgcaatggattttcatcagcaagaatttcccctttggggatagaccatgctccaaggtctttatttttccagaaaggaccgccgggatgtaccagaaaataatacagactgtttttttcttttttaaaaagtagaataccagcactcgttttcatggatgtaagggtttgattattaaagatatgaaaaaatatataaccgtatgatcaatatgatatacttttctttttaaactcagagggggacatttgtttgtacgttttgaatattttattgaagtggctggcatcattgaaacccagcttgtcagcaatttcactgatattataacgactttgaagcaaaagcttttcagcagtttttattttatgctgcataacgtgctgctgtactgagaaaccagtttcctttttgatataaatgctgatgtaatggggcgaaagcataaattcttcagccagattcccgattttcattttatcagcatccagagcgttgacattgatatagtacagtatcttttcaattctgctcagattttgggttatccattctttggcagtactgttatttattgtattccggatcaggatcgtaataacggatgaaaaaagatcagcagtaatctccttattataggtatttttatggctgaattcataaagaagaatccgggctagctgtaacagatgggctctatctgttttattcttgattacggactcgtagacaaaagaatggtcttccatcagaatctgtactacttttttaagctcattagttttgttggacaaaaggttttgccagatatactgctcagtaaattttatataaatgaaacgagttttacttgtaatggtaaattcatgggcatcacttggcctcaaaaggaaaacatctccttttttgtaggaaaaagttacgttgttaaggtgatgaaatcctttgccatgttctatgataatcagttcataaaagttatggttatgatactcaacatcccatatttccttttcaatactgaaaacattaaaagaattaaagttaacgattcgtttcataatagaatggatttttacaaatttaccattaatttttacaatacagactgagtgattattgatgaattttgccttatcaatacattcaaaatgaaacatataaaacaatccgtattgttgcttgcttcaacaatcgttttaatgtccttttctgatgctcatgataaggataaaagagagaaaaaagagatgtctcaggcacaggctccggccaaaaaatactggccgaacggcgctcagctggttatttccgtttctatgcagtttgaaacaggcggacagcctgaaggtgctgaaagtcctttcagcgggactcccctgcccaaaggacaacctgatcttcccgcagaaagctggtaccggtatggcggaaacgaaggaatttacaggatgctggatctatggaaaaaatatgatatcaaagtaacctctcatgtggtgggaactgctgctgaaaagtatcctgatgtggcaaaagctattgcaaaaggaggtcatgaaattgccgctcatggcattgcctgggataatcaatggaataaaagttatgctgatgagctgaattttgtaaaacagggtgtagatgtggtggaaaagattaccggtcagaaagcggtaggttataactgtaactggctgagaagaggcccgaatacgcttaaagtattacaggaactgggttttttatatcatatagatgaccttagccatgatgagccttttattacaaaagtaaaagggaaaaattttgtagtcattccctatacgttacggaacaatgatatcgttactatagaaggaaagcattggagtccggatcagtttctggcacagctgaagtttgaatttgatcgcctttatgaagaaggagcttctaagagaaggatgatgagcatcagttttcatgacaggattggtgggacaccggcaatggtgcatgccatggaggaattcatcaggtataccagagaaaagcagggtgtcgtctttatgagaaaagatgatattgcaaaaatggtaatgaatgatcccgatactccggtcgataacagtgaagaaaagtttaataagtaataagttataagtaaggaagctggaagcgggaggaagggagttattgaaatctgtaaagtagttttgtggtctgtataacttccatcttccatcttcgtgcttccatcctaaaaaaatacctttatgaataacacaaaaacagcctattttttccttcgtgtgtcgatgggaatcaattttttgggacatggattggtccgactggtaaaattacaggattttgcatcaggaatgatgaaaggttttgaatcaagctggcttccacaaccattagtacacatgtttggtgtcacgctcccttttctcgaatttacaattggtctgctgctaataattggatttaaaacccgtattgctgccatggccggagcctccctgattatcttactcctttttggaagcagtaccgttgaaaactgggaagcaatgggaattcagatgatctatgcaggtctgttctatattctgatcagcagaattgaagataattacctggctttggatcgaaaataaaaacagtatggctgaaaaagtaaagaattacacctgattattataaagttgtttaaactttaccaaaccacaaaaggcacaaaaggcacaaaaggcttcattttaaaacactttagtttatttaagcaagttcaaatgatcccacaaaaaagtacaccaaagtttggttctgaaaaaattggagtatttaaaactttttgtgccttttgacttcgtcgaatcttcgatttgtggttagaataatgattcaatgctgtattttactttctcagcctgattatttttttatattgttcagagattatgttacaactttcatagattcagttactctgtttttataattatgcccgaattttgtatcagaaataaaataaactgaaagtattcaatttattttctgtaaaatagctaaccctcaaaatgaaaaatgatgcaaactatattgggagccaacggacagattggtgaagaacttgcaagagaactgaagagaaattatacttcagacatccgtattgtaagcagaaatgccaaaaaagtgaatgaaaccgatactgtattttcagcagatttatcagacagacaacaggccatagaagctgtgaaaggaagtgaaattgcatattttacccttgggcttcctatggataccggtttatgggaaaaacaatttttgatcattttaaaaaatgttattgaagcctgtaaaatcaacggaacaaaactggtcttttttgataacacgtatatgtatcctcaaaataatgagattctgacggaacaaacccgttttgatcctgtaggaagaaaaggaatcgtaagaaaacagatggcagatatgcttttaaaagaaatgaaggctggtacaatagacgctgttatctgcagggctcctgagttttatggtcccgggaaaactcaaagtattacgaatactcttattttcaacgctattaaagatgataaaaaactaaaggttcctttgaaggatgataaaatcagaagtctgatctggactcctgatgcgagccgtgcaactgctctgatcggaaacactccggatgcctatggccagacatggcatttgccggtagatgatcataaactgaattataaagaatttattgctttggcttctcaggcctatggaaaagaattcaggtattccgtaatcccgaaactgctttttgcaataggatctttattcagcaaaaatgcaaaagagctattggagctgcttccgagatatcaatatgataatctttttgatgattcaaaattcaggaaaaggttcccggaatttcggataacttcttacagagagggaattgaacaaattaaaaaagaacagcaaaaagcaaaagaaaatcattaaaataagtaacttagaaacaccatcaccacaaccgaaagggaatatccccttctttcgaggggtggtaaaaaaataaacaaaatgaaagctcccgaaaaagtaacttccatcacagcattgcataagtatctgaacctgaaaaggccttcacatcctttgatcagtgtatttgattttaatgaggtgaatattgatcctgaaacgatcctgagttcagtaactacagatttttacgtagtttccattaaaaaagattgtgcgggaagatgcaaatacggacagcattattatgactttgaggatggaatcatgtattttattgctccccatcaggtactgcagtttgaagatatactgcttgctgaggtaagaggaaatgtactggttattcatccggattttctgcagggatatccgctggcttccacaatcaaagattatggctacttttcatatacagccaatgaagcgctgtacctttcggaaaaagaagaaaaatccgtaacggatatcatggataatatcagcagggagatagaagccaacatggatagtttcacccaggatttgctggtttccaacatcgatttgctgttaaaatactgtgacagattctataaccgtcagtttttaacccggaaaaaagtgaaccatgatctcctgacccagcttgaaattttactggacgattatttcaaaaatggaaaactgctgaccgacgggattcctacggtacaatttgtggcggctcagatgaatatcagccccaactatctgagtgatatgttaagggttcatacaggacagaccacacagcagcatattcagaacagggtgattgaaaaggcaaaagaactgttgtctactaccccaatgaccgtttctgagattgcgtatcacttaggatttgagcatcctcaatccttccatcgtttatttaaaaatcagactactgtttcaccgttggaattcagaaaatcttttaattgatcgtatcatgaaaaaaatattattaatagtaacgaacgtagatcagtatgccagcggtaatcttaaaacaggtttatggctgagtgagcttacccatatatatcatgcagtaaaggaaaaaggttggcaggtgaccatagcgtcccctaaaggcggaaatactcctgtagacccggaaagtctgaaacctatggtccttgatggaatttcaaaaaaatattatgaaaaccccgaattcatgaatgaactggcccatacaaagagccttgatgaggtaaagaatgaatctttcgactgcatttatctggccggcggacatgcaacgatgtatgatttccctgataatacaactttacaggcaatactccgggaccaatatgaaaattgtaaaatggttgcagcgatctgccatggagtcggaggattattaaatgtaaggctttcggatggtgaatacatgattaaagataagaatatcacagggttcgactggtttgaagaaactctggcaagaaggaaaaacgaagttccatttaatctagaagccgcccttaaagtacgggatgtacattataaaaaagcttttattccgatgacttccaatgttgtggttgacgggaatctgattacaggacaaaatcctttcagctccaaggaaatggccaaagtagtagtccgtgagcttgaaaaataaaactagcgatgatatgattgtatttacaattcttaagaataatacagaagtaaaaacgcaaagtttaaagatgtaagccttttaataaagtgagcaaagggttgctactatgtctctgatgaagctttggctatgcatccgctcgaaaggaagcaataaattgattccttatgataaaaaggattttgttatcgtcaccagactcattatgatcactactattcccactaccacaaacattttctttgtcggaagttttgccgtaagcatcgctgaaaaaggagcggtaaaaacgcctcccaataaatgccccaaaacaatattccagtgatggattccaatagtgaaaataaaagttatcgcacttgttacagtcaagagaaacttagctacggtagagcttcccacgacataacgtggaatccttccctctttgatcagcgttccggttaccaaaggtccccatcctcctcctgcaaaagaatctataaagcctccagccaatcctaatattctgagattagttcttcttttggtttttgcctgtcctaactttttatctttaaatgcattttttaaaatattaatcccaagatataaagtatagcaggcaataataggctttacaatatgagcataatgttcgccatagtgagacaaggttaaagcaccgatgacagagcctacaatagccaatggaaacagtacccaaaccattttcttattgacatttcccagtttataatggctgaaacttccggcagcagtagtaaaagattccgcagaatgaatgcttgcactcacaacaggtggcggtacattcagcagtaaaaggatggtagtacaaattactccatagcccattcccatagatccggcaacaatttctgccatgaaaccggcaaacagcatccagtaaaaaatatggccgtctttgttcagaaaatactggatatcatctgaaagatcaaattgataaacgacaagtccaaataatccgaaaagaagtaaaacacctatgatggccagatagatattggcttttctctgggctgttttggtaatactgatcagtttttcaatttctttgtccggttttgaagaaacttttccatccgtcaggtattctgtcgtgattttgttgagctctttcactttatagttgaaatctccggtcagttgattacggatatgctgcatattgtccagcacatgatccatttcatcagggataacctctgtaaaggtttctcttaatcttttagcgatagtcggcgatttcccgttggtggaaatagcaattttaagacttccttttttaacgatggaacctaaataaaaatcacacagatcgggcttatcggcaatattcaccagaacacttttttcctgggctttttctctgatttctcctgccagttcaatatcatttactgcaataatggccagatcagtatcgttaaaatcatgatcactatatgccctttcatgcagggtaatattggaaaactgattttgtaagattctgacctcagggataatttctttcgccaccagtttgatggaagtatccggagagtttcccagtactgactccagtttttcaagagcaacctttccaccgccaatgatcagcagtgaaaggttttcaagttttaaaaatacgggatataaagaattgctcatcctgattacagttttaagtcataagtaaaagcgagataatacagtcctccgatttcgggacctgctgcatactggaagtaacggcggttcagcaaattggtagctccaatcttaatattggcatgaatttcaggcagcttccatgtagcctgtgcatcaatggtataataagccggaatttccccggatgccaaaggactttcccacataaaactgctctgccatcttgcaacaagggtaaatcctatatttttaacaatttctctgtttcctatacttacattcaccatccatttcggagtgttgaaagcggtaataaacaggtctgagttattattggaagccagatcattataagaaacatttgtgttcacattataatttcctgtgatattgtaacggattccaagagatgtcccatagcttttgtaggtactgttgctgttggtatacaccctgtaacggtcctgtttgcttcggtcaagcatcgcaagaacagctgcattgcttcctacctggctgtttttaggaacggccacttctacctgcccaaggaaaccttcataaatattgtaataaaaatcccaatccagcaccagtttattattgaaaaaagtagacttatatcctacttcaaatgaattgatcttttcaggctgtaacttctgcagattggctactgttaaaagctgtttgttatcctgagctgcctgactttgggttttccctgcatccatgtctgcatttaccgctgaggtgaatttatcgatggaagccaatgtataggaattttccagatagcctaatccgtcatttacttttgaaaggcctcctactcttcttacatttccgttgttgacgaatgaaagggcttcaaataacgaagggaaacgatatccgttttgaaaagacgctctgaaattatgttctttaacaggagaataaaccacacttactcttggattaagtttggcttcaaattccgggtttctatcaatccgcaaggcggcattgatttttaatttatcatcaaagaaaagcttggtgatctgtgcaaaagctccatatttctgatagataacatctttcccgaaggtaccatcagctaaaggaatatttctttcattcaccggacggttgaaatcaacaaaattatttccatccggagtaatgctgtataaacggtaatccacaccgacaagaaggttgaatatcttcacaaatctgttgaaatcataagtaagctcaccctgataaaagcgggatttctgttcaagcttggctcctcctgttgccggagctcctgcaattcctgcattcgctgaatcccagttattgatgccgatgatggtgttctttaactgttcaaaagctgcagttcccggtacagccctgtttttatcggcttcccggcgggcaaggataaaagcatcattaagattggttccggcgttcagactgttctgaagtgcagtctgaaatatatttttccagttggtattggaaagattggtcagatcaagattatctgctaaaggtttcaggttataagaatctcctgtattttctatggatacatacgctctgaatgttaattcttttcctgtcagctccactttatggttctgaactgtggcattctgcagacggattttattccctctctgaaaagttccgtccagcaagccgtaacgatacacataggatgctctccactgatctccaaatcgataatataaacctgcgtcaaacttgatatttttcacatcagggcttaccagatctttttccagatagcctgttctggaaacattgaatgtggttggttttccgttgtaatccacttttacggcaacacggttgtttctttcatctccatacttattccaaagatcttcagcaggattattggcaagggcaaaattaggattggcggtgactaatgatcctgaattctgatctgtcaggttgtttgagatccagtcggttccactgaaataagaggcattgactttaacagcaaaatttttattgatcacttttgcaaagcggatggcactttctcccagggaacttattttatggttgacattatccacatgatttactccgccacggaaataaacgcttattccttcagaagtaaacggatctttggtctgtaaacttgccagcccgttaatggcattcattccatacaatgctgaagcagctccgggagttacttccattgactgaatatccagttccgttggcccaatggcatttcccaatggtacacctaatgttgcagattgtacatcaacaccatcaaccaactgcatgaaacggaaattgttcggcgaattgaaacctcttgaattcggaattttcaacgtaagactggaagttaacagctgtaatccttttacgttttccagggtttcataaaacgaagcagccggactttccctgatggttttaatatcaattttttcaatcgcgatcggtgatcttaatatcttttccggaactctggaggctgaaatcaccacatcatcaatgattgtgttctgaggattaagtcctaccgttattttgttggaaggtgaaagtatttcaaccgtctggctggtaaaaccatctttctgaatcactacccgaaaaggaatggtaacccttgttctgagcttaaaattacctgcctgatccgttaatgcggtatcctgcgtgttttcgatctgtacttttacggagtcaagacctttgcttgttcctgtgtttttgatgcttccactaagctctataagttgctgctgagcttctgccaggttaaaaaatagaaatgtaaatgcaataatgcctgcttttggtagaaaatttccctgctttttgtttttcatttttcttcattttttaggttgagaatgaagctgcctgaatttttacattgattatttttaccacaaaaggcacaaaagttttcattttaaaatactttagttcaattatgtaagcttaaaatgacactgtagaaaagttcacattagatgaaaatcaaagatttttacaaaacttaggtgtacttattatgcacaaagtttggctcttaaaaagcttaagtgtttaaaacttttgtgacttttgcggttttgaatcgaaaaacttcaaatagctttgtttgtattgttatttgagaatcaacaacacatacacattcgtccgcctaaatgaagaggttgattatttttgttttttttcagatcataatgaaaattagccatataattaatttaaggtgtgtaagtaacggtatgaaaaatcaccaaatgtttcctctgccagtcttttctgtacataaatcccgaaaagttcatccagggtggtcagaatttcttcctcgccaatgttttctttaaattttgtattcaatcgcattcctaagcggtctcctccaatgtgaagattatatttcccataagcagttcccacaaatccgatttctgcattaggggatcttccacagccgttgggacaacctgtcatacggatcgtgatatcttcttccaacaaaccatatttttcaaggataggctctatttttgtgaccagtgaaggcagataacgctgtgcttcagccagtgccagtgaacaggtatttaaagctacacacgccacagagtttttacgtaaagcacttgctccgtcggtatgttctgaaattccgtgctcttttaaaatgtcttcgatttcaggcttatctttttcatcaatatcagcaaggataaggttctggttgcaggtaaaacggaaattcgcttttcctgtccgcgcaatttttaataatcctgattttaaaggatattctgctgtattaaggattcttccgtgttctacaaagaccgtataaaaccattttccttcatgattttgaatccagccgtagcggtcttttctttgtgtaaatgtaaattcacgggccggttcaaagctgaatcctgttctcttttccacttcagctctgtactgatcgatacctaatttatcaatcgtgtattttaatcttgatagtttccggtcacttctgtttccaaagtctctttgtaccgtaatgatttcgtagacggcttttaatactttttcttccgtatctaaaaatccaaggatagaggcgagacgggcataagtagcttcatatccgtgagtggcacctaatcctcctccggcagcaatattataacctacgattttatcattttctataatggcgattaaagcgatatcattgatgaatacatccacatcattattgggcggaacagcaattcctattttcagttttcttggaagatatctgtcctgatacaaaggatcttcctctgctttacggtctacaagaagttcatcatcaatccagatatcatagtaagctttggttttcggaagacacatttcactgattttacctgccagttcgtaggcttcctgctgtaaaggggattccgaaggattggctgtacaggttacgtttctgttgacatctccacaagcggcaattgaatccagatgctgaagattgaaactctgaatggtaggtcttaaatgagattttaaaataccatgcagctgaatggtttgtcttgtggttactttaatggttcctgttgagtgatcttcggctgtttcatttaatcctacccattgttctggagttaaaaaaccgccgggaagtcttaatctgatcatataagaatacagccattccagttttttggaggcacgctcttcccttctgtccctgtcgtcctgctggtacattccatggaatttgatcagcgtctgatcatcttctctgatcgctcctgtgaagttatctgcaagactttcctttaaagttcccctgagtccgttactgccggttttaatcctttctaccggtgaaaggttttctttatcgttgttcataactgtttcctttaattttttgagtacttcttttaatacacatctttagcatatctgccgcttaattccatttcttccaggtaggttaaagcatcttctttgctacgctttccttcattctgtattatggtgagaagcgtttgttctacatcacgggccatgggttctttagcaccgcatacatacacagatgctccgccttcaagccagtaaaatacttcctgagctttttgttccaacctgtgctgaacatatactttttcagctgtatctcttgaaaaggcaagatccagatgcgtcagactgcctgttttaagaaaatcctgaagttctgcctggtaaagaaaatcggatacaaagtttctgtctccgaaaaacagccagtttcttccttctgcacctgtggcatcacgttcccaaaggaatgacctgaagggcgcaatacctgttcccggaccaatcatgatgatatctttatccgcttcaggcagtttgaaatgtcctgcttcctgaatataaaactctatttcccctccttctttgaattcactcagaaagccactgcataatccattgtgcttctgatgatcaataaagaattctgatttagctaccgtaatatggatttcggtatcgccatgagcttccggagaagaagaaatggaatacaggcggggcgcctgagcggttaatatctgtaagatttcttcaaactcatcggcattttttacgggataaattctaagaagatcaagaagacttaatctgacttccggaatggaatgtcctgttattttcgcatattgagcaacaactgatttcagtaaataactgatgttgagttttttatgcaacagttcttcaacagaagctgtaaccttcggtgtttctacctgtttttgaggatcaatcccggtcagcgcaataatttcactgactatttctttagcattgaaagggattattcccaacgcagcacctggttgataactaagcgcttcttctgtttcaatttcaatatgatacgtttctttttcagaggtaatgtcattcagattgatgatggctgaaacttttccctggtattttttccttccggtagaaacctttggagctgaaatattttttgtaccctgccccgcatttttattgactgtttcaaatacattctctatccagtgggaagcttcctgttcataatcaatatcacattttttcaatggaatcatgcgctgagcacccagtatttcaaagcgtgagtctacatcttccccggttttacagaacagcggataactgctgtctcccaatgccagtatcccatatttaagtccgctgagatcaatttcattctcatgaatataatcatagaattttttggcaagagccgggggttcgccttctccctgagtgctgatgactacaaaaaagaactcttctttagccagatctttagacttgtattgggaaaggtctgcgagttttacctgaagtccttttttctttacgatacccgccaatgctgtagcgagttttttactgtttccggtttctgtaccgtaagccagtgttattttctttacaacattctctgcgatatcatttgtttgctgtggtggcagaacagcggtcagtgaagatcctccggcaatacccgcaagatatccgctagcccagatggcttcatctctggaaagatctgtggagatttgttttaatacgtttaatttagtttcagacagcatattcaaagaaattttgagtggtagggatcagacttccgttttccactgatttaaaataaagaccttcctgctcggcattttccaaccatgaaaattcttcgtggagatttacaattttgcctactaccaccaatgaaggggaagcaaagtttttgtctccgaatttttcattaaaatcatcaaatgatgacgtgtacaccttctgaaaaggcgttgtagcctgttcaatgactgcaatttttttatcacctgaaatctgaagagctttcagtttttccaccagaggagtaagattttctttagacatatagaaaacaagcgtgtcattggttaaggcaagctctttccagtattcttcacttacgatttccgatttataataggtcagaaaacgaacagatgtagaataacctcttgctgttaaaggcatccctgcaaacgctgctgctcctaaagcggctgtaattcccggaatgatttcgtaaggaatatgattttcttttaaagcctgtaactcatccagaatattggagaatatggaaacatctcctcctttcagccttacaatcgttttattctggcgggcatattccactatcaaagtattgatatgagattggggtgtggaagcatttttgctgcattcttttcctacataaatgatttctgtgttttcattaacgtaggtttccagaatttcaggacttacaagacggtcgcataaaacaacgtctgcttctgcgattgcttttacagcttttacagtgatcagttcagggttgccgggccctgcacctataaggtaaacctttggtgattttatatttgttttcattgaagtaggtgttaattaaggatttagaagagtccttctacagagagatacctttctcctgtatcataattgatggtaaggattttagcgttaggtggtatttccggtaaatgtttggcgatagcggctaaagcggctcctgtggaaactcctacaaaaagaccttcttttttagcggcgttaagggcatattcataagcctcgtcctttcctactgtgatgacaccatctaaaagtgttatatccagaatggaaggaacaaagccagcccctaatccctgcaatggatgtggtgccgggctacctccgcttaaaacgggagataattcgggttctacggcgaaaacttttacgtttggatatttttctttaaccactttggcaattccggtgatgtgcccaccggttcctactccggtaatgatataatcaagaccgtccgggaaatcttttaaaatttcctgtgctgtggtttctacatgtacttttacattggcaggattgtcaaactgtcttgggatccatgagttgggcgtttcttccgcaagctcattggctttttcaatggcgcctttcattcctttttctcttggggtaagcacgaattctgctccgtatgcttccataatcttgcggcgttctatactcatgctttcgggcatgacaagaatgagtttgtatccttttacggcagcagccaaagcgagtcctattcccgtgtttccgcttgtgggctctataatgatgctgtctttatttaataatcctttggcttctgcatcttcaatcatcgccagtccgattctgtctttaatgcttccgccgggattgtttttttcaagtttgatccagacttcatgatctgaaccgaagagtttgttgattttcacgacgggtgtattcccaatcgtttctaatgcattcttaaatttcatatcaatgtactttttatttttgtttttttaaatcacaaaggttaatgattccggtaatgaagaattatcctttatttttatttcacttttgtggtagaccagagagttggcaggaacatcctgtgttacccatacatttccgccaatgatgctttctctgcctatggtagtttcgcctcccagaatagttgctcctgaatagataatgacatcatcttcaatattgggatgtcttttctgatgggctttttctttggaaacattcaaggctccgagggttactccctgatagattttgacattattcccgataaccgttgtttctccgatcacaattcctgttccgtgatcaatgaaaaaagatcttccgatggtggctcccgggtgaatatctattcctgttttgctgtgggcgtattctgaaatgacgcgtggcaatattttcaccttctgagtccagagctggtgcgaaatacggtagacatacgtggcaaaaaagccgggatatgccaggtatacttcttccagtgagtcagcggcaggatcaaattccagaatggattttgcatccaacaccagctgatcataaagtcccggtaaagcttcaaaaaactgactgacctgtttttctgtaagatctttatctcctgttacagtattaatctgatcagaaagtgtttgctgcaatgcttcaaaatttcttttcagttgatcttcagtattgtcattctgaggaaggaagagtgtttcatacaaatccttgacccattttttggtctttattttatcaaagaatccatgaatactattgtgtttggtttgatgaattctttctgtgagttgatcggaaattgccattttttctattgaattatgcaggctgctaccgttgaattggacgtttcatccaccagaatggcagagcccgttgttttattattggtaaaactgtcatagaccaaaggctgtgccgttcggagggtaactttcacaatttcattgagttttatttcaccatcggcctcttctctgataagagtattaacattgatcttgtaatctatctctttcactactgcttttacaagtctgctgttctgctgaagaagatatttatttcctggctgcagaggtttttgatcaagccagcataaaaggatttcaagatctttttcaacggccggaacatgttcttctgtaacaaaaatatctcctctgctgatatccagatcatgagcaaggtggataacggctggctggccttcaaaggcttcttctttttcaacgccattgatctcaatcttcgtaatttctgtggtcagatctgccggaagaatatggattttgtctcctttggtgaactttccgcttaatatttgtccggcatagcctctgtaatcgtgcagttcttccgtttgaggacgaatcacatactgcacctgaaaacggcttccgttatttttttcttcattgattgttacttcttcaagatattccagtaaagaagttccttcataccactctgttctggaagattttgaaacaatattatcaccttttaatgcagagatcgggaaataccttacgtcattcagtcccagattttctgcaatttttgcatattctgatttaatgttttcaaaaacttcttccgaataatctaccatatccattttgttgatggctacagcaacttttttcaactgtaataaagaagcaatgatggaatgtcttctggtctgttcaatcacaccttttcttgcgtcgataagaataaccatcaggtcagagtttgatgctccggtgatcatattgcgtgtatattgtacgtgaccaggtgcatcagcgatgatgaattttctttttgccgttgaaaaataacggtaagcaacatcaatcgttattccctgttctctttctgcacgcaggccatctgttaaaagagcaaggtctaccccatcttcatttttgtttttggaatgtttttcaaggacttccaactggtcctgcaaaatacttttgctatcgtaaagcagtctgccgataagggtacttttaccgtcatccacgcttcctgctgttataaatcttaatatatccatccgaattttaattataagtaatgagtaatgggcaatgagtaatattttgctgttttaagaagtaaaggtgtttatcctattacttattactcatcgctgattgcttatctaaaaatagcctcctttttttctgtcctccatggcggcttctgttaccctgtcatcaattctggtttcgccacgctctgaaattctggtggctacgatttcttcgataacggcatctatggtaacggcgtcagattctacggcagcggtgcatgtcatatctcctacggttcggtaacggattttccttgtagtgatgatatcttctggttccagtacaacatgggaagaattggccaaccattgtccattaaagtcgattacttctctttcatgcgagaaatagatggatggaagggcaatcttttctcttcggatatagttccagatgtccagttctgtccagttgctgatagggaaaactcttacattttctcctttgtggatttttccattgaagatattccaaagctcaggtcgctgaagtttaggatcccactgcccgaattcatcacgaacggagaatatcctttcttttgctcttgccttttcctcatctcttctggctcctccgatgcaggcatcgaattcaaattcttcaatggtatcaagaagagtataggtttgcagccagtttctgcttgggaatttacctttggcttcagtcagttttttactttttatggtgtcttccacttttctgaccaccagattcacatccaactgctgtaccagctgatcacggaaatccagaacttccggaaagttgtgcccggtatcaacatgaacaaaggtaaacgggattttcccatgaaagaacgcttttctcgccagatgcgccagtacaatactgtcttttcctccactgaataacaacgccggacgttcaaactggcctgcgacttctcttaatatataaatagattcagcttctaactgatctaaatagtttaactgatgtattgacatttttttcttttttattgatgaatatgcagaccgcattcttttttattggcatcttcccaccaccaccggcctgccctgaaatcttctccttctttgattgctctggtacacggttcacatcctatacttacaaatcctttcttgtgaagatgattgtaaggtaaatgatgatcttttacataggctgtcacctgttctgtagtccagtgaaggataggatggaatttgatgatcttgttatccggatcccattccagctggggcatattctgtctgttgggagaatgctccgctcttagtcctgtaatccataccttatatccttccaaggctttttttaagggatgaacctttcggatggtacagcatgctttcctgttttctacggattgatagaatgaatcaggcccgttttctgtgacaaattctctgagttcctccgtgtccggataataggctttgatgttctttttaaaaaacgccttcgtagaggtccaggtttcataggtttgttcaaaaagtcttcccgtatccagagtgaatatttcaatatttaaatcttttatcagatgagtaatgacctgatcttcgtaactgaaactggtggaaaagatcaccttatccgggaatttttcagccagtaattgcagtccattagtttgaaaagaagcttcatcagcctcttttatcagattttcgaattcatttttcagactgttttccattttgaattgagatttaagtcttgcaaatatatataaaattctataactcctatcaaaatagtagtatttaaataaaaatttttttaatctttattaataaacttagtcaaagtggcttccatcatgcttgttctggtcttttcacgaacgatcattaattcttttctcaggtagcagacagcttcatccacacaatcatcgcaagcttcataaaagtttaaagaaacacatggggtaagcgcaataggaccatcaaaaatacggtaaatgtctgctaatgagacctcatcaggtgatttcagaagataatatcctcctactttaccctgcttgctgttgacaagcttggctcttttaagctcgagaagaatttgttccagaaatttcctggggatgttttcgtcctgtgcaataacggaggttggcagaaagccctggttataattccttgctaatctgaccattgctttaagcgcatatttgcaacgttttgacatcataattgctgcaagttatgataaattattgtataaatgaaatgtttttatggctgaaaactttgtattttaaccacaaatcgaagactcgacgaagccaaaagccacaaaagataaagccatttaagttgcttttatggttaaagataaatagttgagaagttcacttagtttgaaaaccttgatttttattgatatacaaacctctgtgtaaatcagtgaaatcttcaggaaaagctaaccaccccgtcaaaaattctttgaattttcgccactcctccacaggaggggaattgtgagttctacggttctgagggatcagatctgtttactatttctgtaacataaagtaagccagttccctatccaccctttttagattctcaattcttttaaagttgttgttcagaagaactttctgagatccgatattatcaagatcggttacagcaacaatatctttctgatgattcagtgaggaacagtaatcaacaagcgctttacaaacttcagttccgaggccttttccccaataattttctcctaaagtatagcctatttccagctgatccggattgtcaagaaagattctggccagacacattcctacaaaatcattgttttgagtgttgaatattccccatctgctgaatggtccttctttataatcggctaaggatttttcaaacatttccttatattcttcaggagttttgtagggcagatagcgggttacattttcattttcaaaaagagtagaaaataatgaaaattcttcaggggcaaattcacggataatgatcctctcgtttttaaattgcattgtatcgtaattacagaataaaaatacgtaaataaatgaagaactgttcataaacaggataaaaaagattgggcttacaatgaagcccaatcaaatagcatatgaatgctgatctattttttaatgaatttctgggaagatttccctaaagaagtttcaatatcaattaaataagttccgctcaggaagtgtttaacatcaaccttatccccaataacattagcattcatttttcttccaaacatatcataaacagaaattgacttaatttcccattttgttttaatattcaatacatcagaaaccggatttggatagatggatgtttctgagtttgttgtatcaacgtctgaagtggataataataatgcacaaggcgttgtaatactgccatttggttgtgtattatatgcaaactcagtgacagaataatttgaaccattggctccaacgctcactttgaaatagccgttaatatcgtagccttcgaattggtttctaaaaccaacataggctgttttaccagaccaggtagtataggtaggagtatacacatccagttgtccgggagtccaagttggataccctatattatttgcattcgttatggtggtacaggctggaattaaactaatattccgtgttcctgtttggcacactagtcctttccaataagtttccaattttaattgattggctccatagtaccaggcgccatagcctgcatcatcactaagctccggattaatgataaaatatttccaagttgctcctgagttggtggttactgttgttggtgttgggttggcataactttccagaggagtccctgtaactattttataaggatctttataagaaaaagttaatgctaatgctgtcgttgaccctagtgaagctgtgcctcctgttatagccggattcaggaatgtaatagatgaattcaggacctggcttttaggatgactggttgcagcaccattgatggtaagtgtagctgttgttgggcttgtaactactatagctgctgttagtcctgctggtaatgaagacgtgaaatgtgttcctgctgtaagagttgttccattgggtacggcaaatgttgctgaatttaatgtaattgttgattggggagcagaagctactgttccatctaatgacacggctccgttattgtttaagttctctgtaaaggtactgttgctaagagttaatcttggaggagtattggcaactccggttgcggctaagttggcaggctgccataaattcattcgcgaaggatggtttaatgctgctagcattctgttaacttgtccaatggtaaacattttataacaaccagaagaaccattgtaccccatatagttttcaacgtttactttctgtccgagacaattgtttccagcgttacatcccaatccggaagaagtattttctacaggggtgtcagcaactccgtcaccatcattattagggtttgcagttgaacacggaacattgaatgtgtgttgaagatttaaccaatgaccgaattcgtgagtaaatgtatcagaaaactcgtttgaagccactgttcctgaagcattaaatatataacgcccattatacaccactctggctgtatttactgaactcatgtatgaatccggataccaggcaactcctgattgatataaatctttattagcatatagatcattttggatatacacattcatatactttgtattatcccatgcatctgcgccaatctctgcatcatatccgcctccgttgccatatccacctttgaaaggatgaaaaatcacgccgcttgttgcttttccggttggatcaattttagctaatcggaattcaatgcttaatgcccctctgatagattgaaaatcaggatctacagtatttgaatcagtgttgattccattgaaatttaagttgatttgctgcagtaagtcaactactttttggtaatttacttttacattactttgagattctccataaatatgaaaaaccacagggataatgtaggttggattgttgatccgattattcaatgaatttttgtttggtcccattttttttatgaaatctttggtgtatttctcaaagttttcatattcagccttagattcgggatgcagttcaaaatgttttttcatcatttcatctgctttacactcgcgaggtctgttttcctgggcaaaacctattactggaaatagggaaacaagtactagtaatttaaattttttcataattttttggatttggttgttaataaattatttaaataatcaaattgtttttggtcataaatttgtgtgttatgtgatattttaactaaatctttcagggttgaatatctttatctcaaccgttggcttttggtcattggcaagttctgaaactgtttttccaaagatgggtcctaaacttaaacccatcataccgccgccgcctgcaataatcaggttcttcaattgggaagattgtcctaaataaggaagtccatccggagcgcagggtctgtagccaaaccatatttcagattctttgggtttctccatctgaaagtcaggtaaatattgaggaatggaccggacgataccttctacccttttcatattaatggtatcctgatgggaagccagttccatcgttccaccaaaacggatctgtccgttcattggagtcactgctactctggcttccagtaataaagcagcatgatttagagtattgaccggattttcaggagtatgcatgaatgaatatccttttccgggcattaaccggattttaatacctgccttttgagcaagctcaggtaagaatgagcctcctgtcatgacaaactggtctgcagtaaatttctgaccgttggcaataacagctttaatatggctgccggaagtttcaaagcctgttacctgatgatgggtatgaaaaatggcaccattacttttaagataagaaatcatttgcttcatcagtttcatggggttcatatggccgtcacatttataattgactcctccgattacatccagcctgacattgggctccaactcctgaattccgtttttatcaagaatatcaacgggtaaacccatactgattgtcttgtgggcaagctctgtctcttcttctgcaaatttctctgttttatagagcattaaaatgccgttctgattcagctcaaaatcaaattcatcttttttcgcaatctcattataaagtctgctgctggccagattaagatccctgatggctgccgcagaatagtcaacatgtttctggttagagtgtttcagaaacttcaatccccatgatatcagattagaattgagtgaaggtcttacgtaaaacgggcttttactgtcgaacatccagcgtattccctgagcaacaactcccggtgctgccagcggagtaaaatgactgggcacaatcatgcctgcattgccgtaagaacagttgttggtaagatcattctgttcaagaatctccacctgccatcccttctgcaaaagataatacgctgagcttaatcccgctattcctgcaccgatgatgagtgcttttcctttattctgtgtcatatgcctgttacattacctgaaaacccagccaataaggatcttcatcatcaataattatatgattatatccggtaattcttgcccagccttctactgacgggataatggctgcttttccatcaatagttgtggtttcttcaattctcccgataaactgggatcctatataactttcatgaatgaattcttccccttccttcagttttccctttgcataccattgggccattcttgcagaagttcctgtaccacatggtgaacggtccagagcattttcacccactaaaacagcatttcttccgctggctttaggatctgtaggtttacccgtccattgaatatggcttaatcctgtaatatgttcaatttcaggatggatgaactggtacttttcattaagtaattttctgataatctttccataatgaataagctggctggccgtaaaatcagaaatatctctgaagttttcctgaggatctataattgcatagaagtttccgccataagcaacatcggcttttattaatcccaggtccggacaatcaacttcaaggtcttccgcatataggaaagactttacattggtcagttttacagattttacttttttcccttcctgtacataatcgatgagaataagccctgcaggtgtttcaaaacgtaattttcccggaattttgggaacaacaagaccttcttcaatggcaatggtaaccgttccgatggttccgtgcccgcacatgggaagacatccgctggtttcaatatataaaactccgatatcgttattttcatctacaggaggatacagaatacttccgctcatcatgtcatggccgcggggctcaaacattaatccctttctgatccagtcgtatttttccataaagtgcagccggcgttccatcatggagtttccttttaaaataggggcacctcctgcaacaagacgtacaggacatccacaggtgtgtgaatctatacaaaagaatgttctgttcatgtggtttgtagttttagtgattctgaattcattattccatctaccattctgctgatctgcagtggattttcattcttcaactcatccggtaggaattcatccggccagttctggaaagaaatcgggcggacaaatcgttttacagcatccgggcctacggaagtaaagcgtgaatcggttgtagaaggaaatggccctccatgctgcatgccatacaccacttctactcctgtaggcattccgttgaataataatcttccgcatttatcttttaaaacagtaatcaatgtaccgttatcacgcacatcttcatgggtcgccgcaatggtaatggttaactgtccttttagctgccgggcaatttccataagttctttctctgtatcacattccacaacaataccaaatggcccaaagacttcttcactcaatatcggattattaatgaagtttttggcacgggtttttatgactgcagcacttccttcagtactttcagtatgtactgatgcaattaattcaacatcaggttgttctattgcaatgctcttgtttttttcgaaactttcaaaaattccttcgtgaagcattttagcgggagtaatttcctgaatttcctcttttaaggcattgataaaacggtcaagcgggtttcctttcaatgcaataaatactcccggattggtacaaaattgtcctactccaagcgttaaagaaccgatatattcctttgccaatgcttcagctttggtttcaagcaggttttgaaaggcaaatacaggattgatacttcccatttctgcaaacaccggaatcgggtcttttctacggttggcaatatcaaacaaagcttttccgccagtgaaagatccggtaaaggcaacagcccggatatccggatgctgagtaagataagtgccaatctcataagatgttccggtaatatgactgaaaatcccttcaggccatccaaatgctttaataaccgtagttatcgcatccgccattatctgtgaagtctgaggatgtgctggatgtgcttttataatgacgggacagcctgctccaatagcacttgcagtatctcctcccgcagtagaaaatgcatacggaaaattgctggctccgaaaacaactacaggtcctatgcctacattatattttctgagatctcctttttgtttttcaggccgggcaagatcaattctggcttccgtatagataccggcagcaacagcttttgcataacttctccattgtcccactgttctggatttttcaccggcaagtctggctaatggcaatgaagtttcggcatgagtaactgtcaaaagttcttctcccaaagcttcaatctgatcagcaacagcattcataaattcagccctttcactgatggtggtattcttcagaaactggaaagcttcagccgccatctgaatttttctgtctatatcctgtgttgatgtttcttcaatcatatctgtgtttctggaattaataataccggacgatttgctctgccttcttcaataattttttgaattctttcagcttcttctccgtgaagttcaagacgtggcgctctcacatacggattgcttattccttctgctgttgcagccagtttgatatactggataagtttagggtgaatgtcaagctcaagcaatggcataaaccatctgtagagggctacagctttgtcatattcgcctgttttaacataattgtacatcgccatggtttcgttaggaaaagcatctacaagacctgccacaagaccatcagccccaagcatcagggtttccagacagatcgtatctacgcctccgagaattttgatcctttttccaaaacggttgatcattctggttacattcgcaagatctcttgtagattctttaacagcctgaatagtgggatattcaataagctcctcaaacatttcaagggtaacataaattccgtaatctataggattattataaataaggatcggaagatctgtagcggaagccactgctttgaaatattcgatcacttcacggttatcggctttgtaacgcattggcggaagcagcatcagaccgtctgcaccgagttcttttgctttcctggcaaagttgactgcatttttggtggtattttcagataggttaagaatgacaggaattcttccctgcgttattttttttgcatatttcagcagctcaaatttttcttctgtttccaaagcactggcttcccctaatgttcctgcaaggataatcccgtgaacgcctgctttaatctgagcttctgtattaatagcaaacatttcaaaatcaatctttccttcttttgtaaaaggagttaatacagcaggataaatacctacccagtttagttttgtactcatatcaaataatatttattcaaaactaagtgaattttaaaacggtaaatgttaatattttaatatgtattaaccgtattttaacaggttgttttttattgctctacagtagcctctttatagtgtttaaggtattctttaggggaatatttcatgatagacttgaaaaccctgttaaaattagtaaggctgttgaatccgctattaaaagctacagaagaaatgctgtacatgttactggatgtcagtaatctgcaggcccgctgtacgcggagttcattaagatattcaatataggtgattccggttcgttttttaaaagatctgcagaatgcttgaggcgtcatacaagcttctttggcaatagcatcaagggtaagtttagtttgggtaaaattcttcttaataaaggtctgggcatctataattctttgatcatagtctgaaatatgattcggcagattcttttctgaagacaaaggaatatgcaggtgcctgttttgcataagatggtttagaatcctgataaaatctatgatctgctctactccttctgttttttgtaatgccgcaatgttttctccgatacttgttttcaatttaggagcgatctggaaaccgacttctgaatgggtaatgaaatttttaagttctccaaactccggaaggtcgaaaaatgcagcaatctttttataaggatcaaaaaaaatagagatggaatgaaccttctgtttttcatttttttcaaaattgcctctgaaaacatgggattgattggcacccaggtaaaaaatatcaccggcttcaaaattaaacagattctgctctatggccaatgttccccgtcctttaatgatccacatgatctgtgtttctgtatgtctgtgaaaataaggatagaaattaggcataatatcttcctggattcggatactcttgttggtgtcggcgggaacagagaattgaagacttttcatggttaggctgctttactgatataaaatatgcattaggttaaaatattgctgaagttaagcaaaatatgaacattaagtattattttaaaatccaaactttacatgttctttattttaaacaagaaacacttattaatggtacaaaattgtaaatttaaacctttaaaataaaaactattcataatatgttttcagcacaaacttatcaagatagaagagccgtactacagcataatgtagcgaacggaattttattatttctgggaaatatagagaatcctgtgaattttgagcacaatccttattatttccgccaggacagcacctatttatattatttcgggattcaggaaccccgtatagcagccattattgatattgatgaaaataaaaccatcatctttggcgatgagcttagtatagatgaaattgtatggatgggaaggcaggaaacccttaaggaaaaaagtctgaaatccggtgttcaggaaacgttaccttacacagaactagcccgatatatttcaaaggtacatagctccggaagaaaagtgcattatcttcctccgtatcagccttccaataaaattttgctgtcggatcttcttgggataaaaatttcagacctgcagccttctgtagaaatgattaaggcaattgtaaagcaaagatcaatcaaagaacctcaggaaatagaacagatagaacaggctgtgaatgtttccaatgaaatgcatctgctggccatgcgccttgcgaaaccgggaatgaaagaatatgaaattgccaatgccatccaatatcttgctgcgaataaagagtgccagatgtcctatcctccgattgtgacaatcaacggaggtattctgcataatcattaccgtcttaatactttaaaagagggagatcttttcctcaatgattccggagcagaaacggcaatgggatatgcaggtgatcttaccagaacatttcctgtaagcaaagcttttactacaaagcagaaggaaatgtacgaagtagttctgaatgctttcaataatgcccagcagcttctgaaaccaggtgttcgtttcaaagatattcatctgaaagcagctcagcatctggtagaaggccttattgatcttggactgatgaaaggaaacgttgaagacgctgtaaaaaaccatgcccataccctgtttttccagtgtggtctgggtcatatgatgggattggatgtgcatgatatggaagatcttggtgagcagtacatcgggtatactgaagaagaaccgaaagataccaaaacattcggtcttaagtctttacgtttaggaaaagcccttgaatcaggatttgtagttacggttgagccaggtatttatatgattccggaactgattgacatgtggcaggcagaaaataaaaatgcagactttattaattatgataaagtaaatgaataccgtaatttcggaggtgttcgtgtagaagatgatttcctggttacagacaatggctacagactccttggaaacgggctgattaaaaccgtagaagaaattgaaaattacagagctgaacatttagcttaattcaaatattatttatgaaggaaataaagaaactaacagccattgcattgtattttttgtgtttatcaccattggcagcacagaagacacaatggactccggatggcaatgcttattattcatttactaaaaaaggggttgaaattgtggatgtgctgcatcccggaaaagaccagacacttttaagcagcaatgaactgattcctgcaggaagttctgaagcattgaaggtacaaagctttcaggtttctccggatggaaaaagcttattgctttttgccaatacaaagaaagtatggagagataatacccgcggtgactactggatttttgacaaaaataccaaaaagcttacccagcttggaaaaggcttgccggcttcttcattaatgtttgcaaaatattctccggatggtaaaaaggtagcctatgtatctaagcataatatttatatcgaagatctttcaaacaatcagcagacaaagatcacttcggatggtacggatggaatgatcaacggtaccttcgattgggtatatgaagaggaatttggaacccaggatggtttcagatggtccccggacggtaacaaaattgcttactggaaactggacgcaagagggacaaaaaacttcctgatgattaataataccgatagtctgtactcatttaccatccctgtagaatacccgaaagctggtgaaaatccttccggatgtagtatctggttttatgatcttgcttcaggatctaccaggaaagctgatatttcaggagatgaggtacaacattatattccgagaatggaatgggttctggattctaaatctgttattctgcagcagttgaacagaaaacagaatcaaagtaaaattatcgtggcagatgcaggttccggaagcagtaagacgatctatacggaaacagatgcagcatggattgatataaaatcccgctggaatgataatgatccgagcggatgggactggattgataatggaaaagaattcttatggctgtctgaaaaggacggatggagacatatttacaaaatagatatgaacggtaaagaaacattaattacaaaagatgcatttgatgttataaagccggaattttttgatattcagaataagcagatctattttttggcgtcacccaacaatgccacacagaaatatctgtataaagtaagcatgaagggaggaaaagcacaaaaagtaactcctgaaacctatacgggttctaatgaatacacgatttctcctaacggaaagatcgcaatgtttaccaatgataacatcaataccatttcaataggttccgtagtatctcttcctgaacataaggaattggtagctgccaaaagatccgcaaaagcagatccatcgatagctaaagcagaatttttccaggttaccacacaggacggagttacattggacggatgggtagtaaaacctaaaaacttcgattccaataaaaaataccctattgtttttaccgtatatggagaacctgcaatgcagacggtaacagatagtttctacacaggctggaatggattatacacagggaatatggctgaagacggctatttatatgtttctcttgaaaaccgtggaactcctgcaccgaaagggcgtgaatggagaaaatcaatttaccgaaaaataggacagctgaatatccgtgatcaggcaatgggagctaaagcattatttgcaaaatggccttatattgatacgtcaagagttgccgtatggggctggagcggcggaggctcttctaccctgaaccttttaggacaatatcctgatatataccagacgggaattgcgattgctccggttgccaatcagttattctatgataatatctaccaggagcgctatatggggcttcctcaggagaacagagaagactttgttaatggttccccgctcgcttatgctaaaaatttaaaaggaaaccttttactggttcacggtacaggggatgataatgtacattaccagaatacagaagtgtatatcaacgagttggtaaagtataataaacagtttcagctgatgtcttatcctaaccgtacccactctattgatgagggtgaaggaacatcactgcatcttgccaccctgtttacaaaatttctgaaagaacactgccctccgggagcaaaataactctaaaagtctcacagtgatgtgggactttttattttaggtacgtttccaacaaaaattccccggagaaatctggggaattaaagtgtcaaaacctatattttttatagtggtgtgaatgatgttgagttgagagaaacaatgggtatgccaaattaatcactattttatgaaatgtgagttttgtggtatcttttgtttacaccgaaggtttttgttttatggattatcactaaatttgagtgaataatttctaaaatcattcatgaaactaccacgctcctattattccaatccggatgttctttttttggctaaggaccttttaggaaaagtactttttactgaaatcgacggggaaactacagcgggaatcattgtagaaaccgaagcctatttcggagttaaagataaagcttcccatgcctatggaggcaggcgtacagaccgtaccgaaaccctatacagccatggcggagtttcttatgtttatttatgttacggtattcatcacctttttaatgtagtgacttctgttgaagatgagcctcatgctgttctcgtaagagctgttgagcctttgatcggtaaagaaattatggaactcaggagaaatatgccggctactaaaccttctatttccgcggggccgggatctgcagccaaaactttaggaattgaccgttcatttaacaggaaaaaattaacggaaaatgaaatctggattgaagatcacggcattgcgtatcgaccggatgaaatcatcgcaggaccacgtataggtgttgcttatgcagaggaagacgcccttttaccatggcgtttctttgtaaaaggaaataagtatgtgagcaaaccgaataaggcataatatcaggattcatttacagtatgataaaactccttataataattgaccaaactgtcaagagtaaacccgcggttcaggccactggtgttgggtaaaacccatacttttgctccacagaagtcttcaggctgctctccccaaaggatttctttctttttagaaaaggccttgtaggctgctttgccaagaaaagctacatatttaggctgatattttattattttcgatgtgaaacttttaagtgcttcttcaaattcttcctttgaaagttcatcagcacgggaagttgctctttccacagcggttgtcaatccatatccgaaatccagaatagagatatcatttacggcttgtatctcataaggagtaaagcctgactgatgaaggactttccagaaacggttactccttccggaaaaatgaaagccgtcattagatgattttaatcccggattgattccacaaaaaataatatcgagatgattggcaataatatctgtcagcataattaaaagtacaatggtataaaaataaagagcagtatgattcctgctctttatggtttataaaagtttagttctgtaataaatttttctttaaaaattcttccagatctttgccgtgaagattcttagctaaaatggttccctgaccatcaatgatgatgttaaaagggagttcatccacttcataaagctttgctacagggcttttccagaattttaaatcactgatctgtatccagttgataccgaacctgtcaattgctttctgccagctttctttattcctatctaaagagatcccgagaatttcaaactgattgttctttaccttatcggaatacgtagcatacaatgctttcagctcaggctgttcttcaacgcatggagcacaccatgttgcccagaaatcgatcagaaccattttccctttcaatgtagaaagagaaaatgctgttccatctgctttggtcatcgtaatttcaggtgctctttttcctatttctattgctttctgggcatcaacagaaacagaaagaaacagcaaaaataatattgtaaaacaggtcttcatattactcatttgtaggatagtttttatccagccaatctgttttgatatttttaggaaggtttaaaagcttcgcatttttgaagcccagttccatcagtaatgtaaaagtaggacggatattagggcactttacgaatggacagcatccgcaatagattacgatttctctgtttttcggaacatcttttagataatttctcagtttttccagattttcaggctcatgagtggggccaatgtctacagaacctttgataatcgcttcaggacctactgaaatgattacgagatctttagtcttatgcttttcaattctggaagccagtaacgccggatccatcagctggctgtctttccacggatcctgtttttgctgtgcctgaccgaaaacggaacagacaaggcaaaccataatgaacaaatacttcatacttctatttttcacaaatataagatgaaaagttcagagttcaggccggctttatacgttgcattctttaatttttcttattttcaatctgattccgaataattttatacatttatattcagtatcattcaaacattttaacccatggaagaaacattcaggcctgatgccattatcataggcgcaggactggcaggacttactgctgcgatggaaattaccaatgccggaaaaaaagtactgctcctggaccaggaaaccgagcagaatatcggaggacaggctttctggtcattcggagggctttttctgatcaattcaccccagcaaagaagaatgggaatcaaagactcttatgagctggctttacaggactggaaaggaactgccggtttcgaccgtcctgaagattattggccgcgtcaatgggcggaagcttacctgaaatttgctgccggtgaaaagtatcaatacatttctaagctcgggatcaagctgatgtttatggtaggctgggcagagcgtggtgatggttcagcaacaggtcatgggaattcggtgccccgttttcatgtgagctggggaaccggtacaggtgttgtaaagccttttgtagagaaagcttataaagctaaggacaaaggtttgctgcagatgaaattcagacacagggtgacggaatttataacagaaaacggaaaaataaaaggactgaaaggagatatcctggaagatgatcataaaaaaagaggtgctgctaccaatagaaatgtaatttcatcatttgaatatactgctccgaatgttattattgcttcaggaggaattggagccaatcatgagctggtaaggaaaaactggcccgaacggcttggaaaagcccctgaaaatatggtttgcggggttcctgcatatgtagatggtaaaatgattggtattgcagaaaatacaggggctcatatcattaatcctgacaggatgtggcattatacagaaggtttgcaaaactgggatcctatctggccgaatcatggaatcaggatattaccagggccttcatctttatggtttgatgcaaaaggcaaacgcctgcctgctccttttcttccgggatttgatacattgggaacattaaaatacatacaggaaaccggcttttcctattcgtggtttattctgacccagaaaattatcaaaaaagaatttgcgctttcgggttcagaacagaatcctgatattaccaataaagattatcctctttttctgaaaaggatctttggtaaaaaagcaccgggtccagtggaagcatttaaagaacatggaaaagattttattgtatcggacaatctggaagaccttgttaaaaggatgaatgaactggctggaaataaccttctgaaatacgataaaataaaatcccagatcgaagccagggacagagagctggataataaattctcaaaagatacccagattaattatatcaggaatacccggaattacttaggagataagttgggtcgtgtagcagcgccccataaaattttagaccctgagaacggacctttaatcgctgtacgcctgaatattttaacccgtaaaactttaggcggaatcaaaacgaatctgaacggacaagtcttaagagatgatgacagtattattgaaggactgtttgctgctggtgaagctgccggctttggtggtggcggaatgcacggctaccgggcactggaaggaacttttttaggaggatgtattttctccggaatgaaagccggaaagtatatcgcaggacttaaataaaataatgagcagatatgagcagttatttcgatcataaagtcatctggatcaccggagcatcatcaggcattggagaagctttggtaaaaaacctggcaaaaaacagcagtgccagaatcattctgtcttccagaaaagaagatcagctgcattccgtggctgaaaaagcaggattaagcattgaccggtatgcagtgattcctttagacctcaaaaattataaggatatgcctgatattgcaaaaaaagctgcagaacaattgggaaagattgatattcttattaataacgcaggactgtcacagcgttctctggcgatggaaacggatattgaggtagataagcaactcattgatattgattatatcggaacagtagcccttacgaaagcagttattccttatatgatcaggaataaaggaggacagattgctgtagtctccagccttatgggaatatttggagctcctatgcgaagcggatatgccggggcaaaacatgcgttacatggcttttttgatgctttgcgggcagaattattcaatcagaatatcaggattactatgatctgtccgggttttatacagactgacatttctattcatgcagtaaccggagacggctcattacaaggaaccatggatgatgctacgaaaaacggaatgccggtagatatttttgcaggaaaaatgctgcatgccatccaaaagcagaaaaaacaaaaagtaataggaggaaaagaagtgatggctgtctatctgaaaagattttttccaggcttattggcaaaaataatccgtaaagcaaaagtggtataaaaaagctctgttcaataaagagcagagctttttcagaatgaaagtttgtatcaaaaggttttcaccagtcctattcctactgttttattttgataaaaaggcataaccatggtagatgataaagtctttttacttttatttcctctcaatacattgtcaatttttggaaacagccagtaagccagttctgtagaaaggattccaaatccggctcctgccacaacatctcccagccagtgcttatcattcagcattctgtatacagccgtgaaaacagcgaacggatatcctgaaagactcagccagaaattagtgtctttatactccctgaacataaactgtgctgaagaaaatgctgtagcagaatgtcctgaaggaaacgataaggtgttggaaccgtcaggcctttcttcttttaccaggtattttaagggcatggtaaaagccgcggcaatcagttgtgaagaagcataaataatagtacggtctctcagattgtgttttccttttatacccatggcattaagtccgtaaaccattactgccggagcgtattgggtataattatccagttttatctgtgcaggctgatgctcgttaatttcaacccgtgttgattgattaagatttttcaggtttttcatgcttaaacctgctactccataagcaatgaatgcggcaggaataatcaggcttttataattcaaagtgctttttggggcatctttggtcatcatactgtcctctacaggtttctgaacagatatcgtatcattggtattctgggcgttgatcctgccaatggctgaactcaaaaccattatataaatcagtgttttttgaaagtactttttcatcctaaatcgcattataattatccaattctgtattaaaatttataactgtatcctaaacggattacctgggtttcgtaataatcattgcttgtgtaggcaaatccatttccctgaacagactttctgattaccattgtgttgagcaggtctgaagcgttcataaacagttcgcccttccctttctgaatcgtttttttcactcctgcatccatggtaaatcttgactttgtttttccctgtggaatgatgtccggtgccagatatacaagggtaaactgcatgtccagtccttttgaaaaatgaaaaacgttattcattttgatatttcctgaaatggcagtctgccggtcggctgaaaaagcattaggctgaggatacaggttttgtacagtaaatgcgttgatctggttacggtatagatttccattaacattgaaagaatatacatctgatactttttggttccatatcgtttccagccccgtattatagcttcttcctgcattctggaatatcgcatagataagtgtgctgcccgggacaacacttgaaattctggtgatagttccgttggcaaaacgatgatacagtgcagaatacaaatatccgttagcccaattgtgtttgtagcccaattcaactgaatttgtaaactgaggacgtaatgccggatttcctaccttaatgatctccgcatcatcatattttggaaaaatcctgatatccacttcgttgggacggtctacccttctgttgtagaaaacagagaacttattatgatcatcaagtttgtatgccaatctgaaattcgggaatggctgggtataattatagccgtcacttttataggttggatggttaggatttacatcatactgaattttcacatattccagtctgagtcccaattctgcttcccatttttcattttcaaagacataatttccatacacggctggaataaactctttataatctgcctttccacccgcagaaacatccaacacagagttggcgcccggaataaaattcatattggtaggaatacttctgttccgaagcttaattcctgtttctattcgtccgtatttcaaaggttttacataatctacattgaaatcgtagacctgttcatccgataatagtttaaaagcatcagttccggtagaagatggcagataattatcatagaaatatttttcatcctctctatggaacgtatagttgaatcccacgtttaaaacatgtccggcttctttgaatttatgctgataggaagccgttcccatcactgttgttttcagttcatcctccagaaactgccataaacgcaaacgctgagacagatctccgttgaaaaacggttgatctccccggtcaataattttttcgcttccgtacattcctgaaatggttaatgtattttgaggatcaatattccagtcgattccggctttggtggtaaagaaattagtatttctgtttcttttcagctgggaattgataatggttccgtcatcatacgtacgggttacaaattcattcttgttaagggtctctgtatataaattgtcggcctgtaaaaatagattgaccttgttttttctgtaattcacagacagtgaagggttaattttaggcgtgagtgtatattgcggtcttatggtgggaagattctcctttcttacccataatgatcctaatcctgtagtgaaccctgcctttccgttccagccgttctgcttattctttttcatgataatattgatgattccggcattcccgttagcgtcatacttcgaggaaggattgttgatgatctcaattttatcaatggcagaagcagggatattatccaatccggtttggcttccaaaacctgtaagagctgtttgtttgccatcgattaatacagtaaccttatcatttcctctcaattgtactttaccgtcctgtacagtaattccgggaagattctgcatgctttgcagtacagaaccaccattttggctgatgttatctgcgacggaataggtctttttatcaaggcggctgtctatttcattctttttagaggctgtaatggtaaccgtctcgattttggtttcattttcctggtcctcagcgagctcaatatctggaatttccagaaattcagacaggctgccaataaaaacgggttgtatatgttttttataaccggtaagtgaagtttccagaatataatgatcaggttttagaccggtaagagaaaatcttccgtcttcattagtaatcgttccagctgcaaaggcactgtctttttctttttttaaaataatatgggcgtaaggtaatgctgttttgtttttaccggtaattcttcctgatgctgtcacagacattgtctgtgcagaaacaagggatgaaatgagcatacatgatgggagaaaaaacagggctgttctattcattttactattttattttcttttaaaatctattgtttaagtggttaactatgatttgttttcaattgatggtaattcacgggtatgctttctttgggaaataataatcatcagaaccatcagtgtgagggatatcagagatgcattaagtgttcccaggtccagtcctcctttaaccaggggtttggttaaaaggtcgccaaaggttgctccaaaaggtctggtaaaaacaaaagcaatccagaacaggagaacatgattgatttttgtgaaataatgcagcaggactacagctaaaataataagtccggtaatcagagctccggtcatatatccaagtcccagattatcgctcagaaaatccccgaaagctgttcccaggctattggaaaacagtattgctgtccagtaatacaattctttatttctctcagaaatcggatatacttcaagatttccgtattttttataccataaaaacagggaaagtaaaagcccggagagtaaaatgaggcttccggtaagatatcctgttttcagcgttctgtctataaaatctgagatttctgtccctaaagtcgttgttccgatgatcaccatccagtaaatcgccgggatatatttttttacgctgagctgcacagacaaaatgatgatgaaaaataccagggtgatcacaattcccgcaacatatcctaaattcagggtcatggaaataaaatctcccagtgtttctcctaacgtggtggctacaattttcattaaccagaaaaggagcgtaaccgctgcaactttattaaatgttctcattctcatgtacttttgtaatggataaaggatactgcagaattaaaagcatggaatgtttctgaatcatttctaaatacagttaatacctcagtatattttatacaaaggtgcagtccgatttagaagaaattttgaattgctgggttcggaaatctttttaactaaaatttaacggtgaaaatatggaggccgttttcaaatctgtagctgatcatccattggtgcagcctgcctatttcctgtatgatagacagtcctaagccacttccgttgttgtccgctgaaaatttagaaaatcttttgaacaatgcttctgtattcagtttttccgttcctgaattggaaacttcaaaataagattgatttaattctatagacacagaacctcccggtgaagtatggcggatagcattgatgatgagattgttgatcaatatttctgtcagaatactgttcccgtttacttgtacatcatttgaaatactttcagtggctgaaatatttttttgttcaaaatgctcttcgagaatttcaatactttgatgaagcagctgatcaaagaaaattgtttctgaatggtcaaactggttattgtcaattttcgcgagaagcaaaaggtttttattgatacgggaacttcttgtaagcgctttgttgatgtcttctgcaattctgtattgcttttcagtaagatcctgatcctgaagtaaaatgtccagtttgtttttaataatagcaagtggggtctgcagctcatgagatgcattttcagtgaattctttctgggccttataagtagagatatttcgctcaatgagtttgtagagagattgattaagttcttcaaattctgaagtatcagaaaccggaaattctatggtactctgactgttaagattaaaagtcttcaattgatctaatgtatccctgaatggtttccagatcgatgaggacagctttctgttcagatataaaagtccgacaacaataaccacaaaaaagaatatggtgatcatcgcaatcacagctatggtttcatgggattcttcaatattggtctgtatggtaaaaagataaggtttgttatgcagataaactacttttttaaggcatctgtaacgttcctttttttgttctgaaataaaaggcagctgcttttcgtaggtataaacagtgtctcttctgatctgaccgggagaaatcttttcaatattggtttcaggctggatttgattccataattcaagacttttttccaatgcttcatcagaaagctttaaacggttaaactcaaaagctgttttctctataataatctggttatgctcatccagctcatttttccagatcgtatccactacaaaataatacacaggaatactgatcatcagtacaatcaatacgtagataagaaagggtttggtggtttttgttaatagaggcttcacaatagttatgaattataaatttatagtgtttaaggtttaaagttcaggatttaaagtttaagtaatatacaaaagataatcatttttcaccttcaaccttcaactatcaattatcaattctcccacttataccctgttccatataccgttttgagataatgtccgcatcccgcatcatacagttttttcttaaggttttttacatgagcataaacaaaatcatgattgtcaagcatatctgccagatctccggaaaggtgttctgcaagtgtacttttggagatcactttatttttatttccgataaaataaatcaagagatcgaattcttttttcgttaatgaaatcgtttcattatttacggtcactgttttagccaacagatctatctgaagctcattttgtttcactacgttggagctgctgaactgtttccggcggatcacagaatatacccttgccatcagttcagaaagatgaaaaggtttggtaagatagtcatcggctcccagcttcaggccttcaattttatcatccaaagcgtttttggcagaaataataataacaccgtcctgtttctgctgtttctttaattcttccagaattttcagaccattgccgtcgggaagcatgatatccagcaaaatacagtcatagtcaaaagcctctgttttattcatggcttcatcaaatgtagcggcatgttcacagagataactttctccggacagatattcggaaatacttttcgcgagctcagcttcgtcttcaacaatcagaattttcatgcgataaagctatcattaaattttgaagaaattttgaatataatgcatctgttatataaatttctgattacgatctctcctaagagatgtatatgatattgtaaaataggattttatcagagacaaaatccttatttctacaatattttttacaactaaaaattctttttcttattgcgtttcctaacgctatctgattttctatccggttatttttctcccggaacctgggctttttcatagatcagcttttcactttttaattctttccaaaattcagcaggaatagcagtgttgagggcttccctattatcttttacctgttcaggcttgctggctcccgggataatggaagcaaattcatcagctgccaatacaaaatggagtgctgcatcaacaagacttatactgtacttttcagcaatggaagtcatccgttcccttttttcactcattcctttcgggatgacatctttataattgtaacgctcccttcctaccacatatcctgaattgtatcctgctcctgaaaccagttttacaccagcttttctgacagcaggaagaagacggtccaccgcatcttcatgttcgaggattgagtattgtgttgcagaaagacagatatccggatctgcagattcaatacagtctaagataggttctattttattgacacccattccccaggcttttataacaccctgatctctaagttcggaaagaatcttaaaagcaccttttctggcctgttccagaaaatagggataacggtcaccgacctggtcttcggataaatcatgaatataaacgatatcaatatggttcagcccggttcttttcaggctttcttcaatagacctctgtacagcatcagcagtataatcatggcggaaatcataattcaatggatttttccacatggtaggcggaacctcagcttctggtacttcacggaaaagccttcccactttggttgaaaaaacaaaatcatttctttcctgatctttcaggaaatctccaaatcttcgttcgctttttgttaatccgtaccatggcgaagtatcataatatctgatgcctgtattccatgccgtctgcagaatttcatgagcctgctcatctgtgatattttcgaaagccgttccgatcgctactccaccaattcccagtcggtgtttttctgttaaaatgtctgttttcatattgaaatattttatggtgttggttataaacaggctgcaaacatcgtgcagatatcatggaaacgttaaaagtaaagatcgtgttcaaccttttgaaatccttaatgagtaaagctataaggcttcttttgatattttaaatattatgttaaatgtttttttcatcgcttctttggtcttgttattgaataaactgtaatacaccatttcaataaattatttcatatgaaaaagcatattctaatcgtaggaggaggatttgcgggtattaaccttatcaaatctctcaaaaatgataaacggttcaaaataacgctggtcgataagaataactatcatttttttccacccctgatctatcaggtggccacttcttttatagaggcctccaatatcagctaccctttcagaaagctgttttcaaacaatagaaatgtgaaattccatatgggcagcctgattagggtaaatcctgaaaacaaaacaatagatacggataccggtactctgggttatgattatctggtattggcactgggaacagaatccaactttttcggaatggaaaatgtaaagaaatgtgccttgccaatgaaaaatatcgaagaagcactttacctgagaaatcatatcctgcttacccttgaagaagcagcccgtaataaagatatcaagcaagccgaaaagcttcagaacatcgttattgcaggtggcggccctacaggggttgaactggcaggaatgcttgcagagatgggaaggtatattgctcagaaagaatatccggaaattaagttaggcctttccaatctttatcttatagacgcactgcctacccttctttccccgatgagtaagctggctcagaagacagcttatgaaaaactgaaagaattaggtgttaaaattgtattgaatgtttctgtaaaggattataccgataacaaagtcatcttaagcgacggaaacattattgagacagaaacgctgatctggacttcgggagtgatcggaaaagaagtttctggattaccggaaaacagtatcggaaaaggaaggagaattctggtggatgcctataataaagtagagggaaccaatactatttatgcattaggagacatagcactgatgctttcagaagaaaaatatcctaagggacatcctcagctggctcaggttgccattcagcaaggtaaaaatcttgccgccaatttcaaacggatagaagatggaaaagtgctggagccgttccattacaatgataaaggaagtatggctatcatttcaaaatacaatgctgtagtggatcttccaaagcattcctttaatggctttattgcctggctcacctggctttttattcacattattcctcttgtagggttcaaaaacaaaattcagctggcagtggactggttccgtttatttatcaccaacaatccgtccatcaggcttattctttttccgaaaagaaatacaacaggcaacggataattacataacaaataccaacacttaaatcttatagtatgaaaaatcaaagaagacctcctttttttggagaaacagtggttattacaggagcatcaagcggagttggtaaagccacagcagaagcttttgcagaacagggtgcagatcttgttctggcagcaagaggtgaagacgcactcaaagatacagcagagttatgcagaaagctaggggctactgtgattgcagtacctacagatacttccgtagctgaagatgttcagaatcttgtcaaacaagcccttgaattcagtggcaaaattgattattgggtaaataatgcgggagttcttgcatttggtaaatttgaagagattccggcagatgttacagaccagattgttaaaacaaatctcctaggatatatgcacgcagctcatgcggtacttcctgtatttaaaaagcagaaaaagggagtactgcttaataatatttctattggcggatggatgccggcaccgtatggaacggcctatacagcctcaaaattcggggttcgcggtatggtggaaacattacagggggaggtttctgattttccggatattcatatctgtgcattgtatcccggttttcagaaatcttcaggaatagaacacgctgccaattattcaggaataaaactgagtacccctccaccctcttttgatccccggaaactggcttctgcaattgtaaagaccgctaaaaatccaaaagaagtcatctatccggactggtctgccattgtatttaaaaatttatacgaaatagttcccggaatcatccgttatgtttcttcagcaggaatgcgtatggtaatgaaaaatgctaataaggataataaaacgggaggaaatgttttgaagccctccgaaggtaatatgggaataaacggaaaaacaatgttttcctttcctaaaaaaactttgctgtgggcaggtgccggactcataggagcaatggctgcaggcttgcttttatcaggaaaatccaacaaaatagaatcatcataaacaggtaaaatctgataggataaaggttgaaaaacctgcttttggctgttttttgtaagatatttcataaatttacggagctgtatctgtttcatagcagcataaaaatgtttccaaggtgaaaattcacaacaaaaaaaagtacctgagcttccttaaatttaaaagagatttccagaaatacggattggaaaaagcacgcagttatgagcttattctgcattggctgaacaacagactgagcaggaaccagtttcttgtgctttccgggattcttgtaggctgtacggccggcctcgcaggggtgatactgaaaactctggtacacaatattcattattttattaccaataaagtacattttgaatatcagattttattctatatcgtttttccttttttagggattgtcctaactaccatgattgttctgacacttttcaaagggcaggaccgtaaaggaatcggagctattttgtatgagattgcacagaattccagcattgtggcttccgttaaaatgtattcccaggtgatacagagtgctgttaccgtgggattgggtggatctgcaggactggagagtcccattgccgtgaccggagctgctattggttcaaactatgcgcaaacctacagactgagttataaagaacgtactttactgctggcagccggtgctactgccgggattgcttcagcattcaatgcgcctattgcagggatcatgtttgcttttgaaattcttctaaccggagtagtttttacagactttattcctttggtagttgcagcagtgtgcggaagtcttttgtcaagaattttacttcaggaagatgtgcttttcagattttataccagagatgccttcaattataaaaatgttccttactatcttattttagggattgttacaggtttatatgcccgttattttgtggttatttctcaaaaagtggaacatttcataaagggacttcagctttcaagaatgcgtaaggcgatgtttggaggggctgttctttcgctgttatgcgttttgtttccaccattattcggggaaggatatgaaaccgtgaaagcctttaccaacgggaatacctactctattattgaaaacagttttttcagatattttgaaatcggtgactggacgattatcatatttttagttctggtcttgcttttaaaagcttttgcaacgtcttttaccatattcagtggtggaaacggagggaattttgctccgtcgctttttgccggcggaactttagggtatttgttcgcactggtatgccagcatctggggtttacagatgttcctgtgactaatcttgttctggttggaatggccggagcaatgagcggtgtactgtatgccccgcttactgcaatatttttgatcgcagaatccagtttcggatatgatttgtttatcccgctgatgattgtttccgtgatatcttaccttattgccaaatggttctccccgatttctcctgaactgaaatctttggcagatcagggaaaaatattcaccaataaacatgataaaaacctgctctttgctttaagaacggaggattttattgatcaatactctcagaccatcaatcagaatgcttctgttacggaactgtttgaaatggtaaagaacggagataaaaatattttcgctgttgtagatgacagcagaaagctgaaaggagtgcttaccctagacgatataagaccttatctctttaataaagaaatagaaacttcccaatcgatcactcagattatgaaagcaccaccggcagttcttcaccgtgaaaataagccactggatattctccagacttttgatgataccggtgtctggaatcttccggtagtgagtgaaaataatgattttataggatttatttcaaaatcttcaatactgatgagctacagacagcttctgaaagaatactctgattaaatattgacgtacaatatgacacctgaagaactcaattcccctcctctggcggggtggcgaaaattcaaagaatttttgacagggtggtcagcatggtcgaataacaaaaatccgttcaatagctgaacggatttctttttaatctataatgaaagtcgaaaaaattagttgcttgcgttattgagcagatcaatatcttcctgatccaaaacaagctttggggcattgaatactgtttccagctgtgatgcactcgtagcacttacaataggtgctgtgatcaatggattcgataacagccatgccagggaaacggttccttgtgtggtattatgcttggcacttacctggtccaaagcctttaaaacctcaagtcctttatcatttaaatattttcttaccccttcacctctcgcactttttgcaagatctgcttccgtacggtatttgcctgttaaaaagccagctgccagagaccaatatggaaacacacttaaatcaaactgctccgccaaaggggcatagttttgctcaaaaccttctctttccaccaggttataatgaggctgcaatgcaacatatttaggaagattatttttttctgccgcgtcaaatgatgctttcagacgttccggagacagattggaagctgcaatataccgtacttttcctgctttaataatctcatcatatgcggacagcgtttcttctaccggagtggtatcgtcatcaaaatgggtataatagagatcaatatgatccgtctgaagtctctgcagcgactcatcaacggattttaagatatgttttctgctgatatcaaagccatgttcttttgtttgtgaacctacttttgttgccaaaacaatatcattacggttgttacggcttttcatccattttccgataatttcttcagactgtccgcctttcccgttcacccaccatgaataagtatctgctgtatctataaagttgaatcctgcttctgtaaaacggtccagtatatcaaatgactgtttctcatccagcgtccatccaaaaacatttcctccgaaattgattggtgcaatcgttaaatcggtatttttgatttttcttttttccataaaaataattttactaagtgacctctaaggtaggaaatattaagcctgaaggatatttaaaatagccattttccctatagttattatgaatgaaaatgctgatgtttactaagtttttttgcctattatctgttggagaacgcaaagacgcaaaaccttactcgtaatgatgctataaggcgca
